United States Patent 10,463,751 (MODIFIED POLYNUCLEOTIDES FOR THE PRODUCTION OF CYTOPLASMIC AND CYTOSKELETAL PROTEINS) - sequence listing, part 9

SEQ ID NO: 15227 - DNA, 2406 bp, Artificial Sequence
  Description of Artificial Sequence: Synthetic coding sequence
atgggtgacacagtcgtggaacctgcaccactcaagcccacaagcgagcctacgtccggacctccagggaataatggaggctcccttttgagcgtgattacagagggtgtgggagagctgtctgtgatcgacccagaggtcgcccagaaggcatgtcaggaggtgctggagaaggtgaaactgctgcatggtggcgttgcggtaagcagcaggggaacaccactggagttagttaacggagatggggtggattctgaaattagatgtttagatgaccctccggctcagattcgcgaggaggaggatgaaatgggggcggctgtcgccagtggaacggctaaaggggcccgccggcggaggcagaacaattccgcaaaacaatcctggctgcttaggctctttgaaagtaaactgtttgacatttccatggcaatctcatacctttacaattcgaaagagcccggcgtgcaagcatacataggtaacaggctgttctgtttcaggaatgaggatgtggatttttacctcccacagctgctaaacatgtatatccatatggatgaggacgttggtgatgcaataaagccatacattgtccaccggtgccgccagtccattaacttctctctgcaatgcgccttgttactgggcgcgtactcctccgacatgcacatatccacccagcgccattctcgcgggaccaagcttcgaaagcttattcttagtgatgagctgaagccagcccatcggaagagagagcttcccagtctgtctcccgcgccagacactggcctgagcccttccaagaggacccatcagcgatccaaaagtgatgctacagcttcaatctccttgagctctaatctaaagcgcaccgccagcaacccgaaagtcgaaaacgaggatgaacccgtcagactggctccggaaagagagttcatcaaaagcttgatggccatcggtaaacgattggcgaccctcccgacaaaggaacagaaaacccaacggctgatctctgagttgtctctgctgaatcataaactgccagctcgagtctggcttcccactgcagggttcgaccatcatgtggtgagggtgccgcacactcaggcagtggtgctgaatagtaaagataaggccccttatctcatctacgtggaagtactggaatgcgaaaactttgataccacctccgtccctgctagaatccccgagaacaggatacggagtacacggtccgtggagaaccttcctgaatgcggaatcacccacgagcagcgcgccgggagtttcagtactgtcccaaactacgacaatgacgatgaagcctggagcgtggatgatattggcgaacttcaggtggaattaccagaagtccatacaaattcttgcgataacataagtcagtttagtgtcgactccattacatcacaagaatccaaagagcccgtgttcatagcagccggagatatcagaaggagactgagcgaacagctcgctcatacgcccactgcctttaaacgtgatccggaggatcccagcgccgtagctctgaaggagccttggcaggaaaaagtacgaagaatcagggaaggttcaccctatggacatcttcccaattggagactactctcggtgatcgtaaaatgcggggacgacttacgacaggagcttttggcctttcaagtactaaagcagttgcagtcgatatgggaacaggagcgcgtgcctctctggattaagccttacaaaattctggtgatttctgcagactccggcatgatcgagcctgtggtaaatgccgtgtcaattcatcaggttaagaaacagtctcaattgtccctattggattatttccttcaggaacacggatcttacacaaccgaagctttcctgagcgcccagcgcaactttgttcagagttgcgctggctattgcctggtatgttaccttctccaagtcaaggatcggcataatggcaatatactcttagacgcagagggacatatcatccatatcgattttggctttattcttagcagctcacccaggaacttgggctttgagaccagtgcttttaagctgacaacagaattcgtggatgtaatgggcggattagacggcgatatgtttaactactacaaaatgttaatgctgcagggcttgatcgctgctcgcaagcacatggacaaagtagtgcagattgtcgaaataatgcagcaaggatcccagctcccatgtttccacggcagttccaccattcggaaccttaaggagcgctttcatatgtctatgacggaagagcagctccagctcctcgtggaacagatggttgatgggagcatgagaagcattaccaccaaactgtatgacggattccagtatctgacgaacggcattatgtag

SEQ ID NO: 15228 - DNA, 2487 bp, Artificial Sequence
  Description of Artificial Sequence: Synthetic coding sequence
atgagatttttggaagcccggagcctggccgtcgctatgggggatacagtcgtcgagcccgcccctctcaagcccacttctgagcctacaagcggtcccccagggaacaatggcggatcacttctgtccgtgatcacagagggagtaggcgagctgagcgttattgaccctgaagtggcacagaaggcctgccaggaggtgctcgagaaagtgaaactgctgcacgggggggtggcagtatcgtcccggggtacgcctctggagctggtaaacggcgacggcgtcgacagcgagatacggtgtctggacgatccacctgcacaaattcgcgaggaagaggatgaaatgggggcggcagtcgctagcggcactgcaaagggcgctagacgacgccgccagaacaacagcgctaaacagtcgtggctgctacggctgttcgagtccaaattattcgacatttcaatggcgatcagttacttgtataatagcaaggagcccggggtgcaggcctacattggaaacaggcttttttgtttccggaacgaggacgtggacttttacctgccacagctgctgaacatgtatatacatatggacgaggatgttggggacgccatcaagccttacatcgttcaccggtgccgccagtctatcaacttcagtctacaatgtgccctccttctcggggcttactcttctgatatgcacatcagtacgcaacgccattcacgaggaacaaaactccgaaaactgatcctgagtgatgaactgaaaccagctcatcgtaaacgggaactgccttcacttagcccagctccggacaccggcctttcaccatccaaacggacccatcagcgttccaagagcgatgccacggcttctattagcttaagtagcaatcttaagcggaccgcaagcaaccctaaggtggagaatgaggacgaggagctctccagtagcactgagtccattgataatagcttctcgagcccggtgcgcctggctcccgaacgggagtttataaagagcctgatggccatcggaaagcggctggcaacactgccaactaaagagcagaagacacagcgacttatcagcgaactttctctgctgaatcataaactcccagccagagtgtggctgcctaccgccggctttgaccatcacgtggtgagggttcctcacacacaggcagtggttctgaattccaaggataaggcgccctatctgatctacgtagaggtgctcgagtgcgagaactttgacaccacctccgttcccgctcggatcccggaaaatcgaataagatccacacgaagtgtggagaaccttcccgaatgcggaattactcacgagcaacgcgctggaagcttttccacggtgcccaactacgacaacgatgacgaagcttggtctgtggatgatattggtgagctgcaggtcgagctcccagaggtgcacaccaactcatgtgacaacatcagccagttttcagtggatagtatcaccagccaagagtctaaggagccagtgttcatcgctgcgggggatatcagacgacgcttgtcagagcagctggcccacacgccaacagcatttaaaagagatcctgaagacccgtccgctgtcgcgctgaaggagccttggcaggagaaagttcggaggataagggagggttcgccctacggccacctgcccaactggcgactgctcagcgtgatcgtcaagtgcggagacgacctgcgacaagagctccttgccttccaggtgctgaaacagctgcagagcatctgggaacaagaacgcgttcccctgtggatcaaaccatataaaatactcgtgatctccgccgattctgggatgatagaacccgtcgttaatgctgtgtctatccaccaggtaaaaaagcagtctcagttgagcttgttggattacttcctgcaggagcatggaagctacactacggaagcatttctctccgcgcaacgtaacttcgtccagagttgcgctggatattgcctcgtctgctatctgctgcaggtgaaggaccggcacaatgggaatattctgcttgatgcagaaggacacatcatccacatagacttcgggttcatattgtcgtccagtccacgcaacctgggatttgagacctctgctttcaagctgactacagagttcgttgatgtaatgggcgggctagacggtgacatgtttaactattataaaatgcttatgctgcagggcctgattgccgctcgaaagcatatggataaggtagtgcagattgtggagattatgcagcagggaagtcaactgccctgttttcatggcagcagcaccatcaggaatctgaaagaacgattccacatgtccatgaccgaggaacaacttcagctgctcgttgaacagatggtggacggctcgatgcggtctattacaaccaaattgtatgacggattccagtacctgacaaacggaatcatgtag

SEQ ID NO: 15229 - DNA, 1143 bp, Artificial Sequence
  Description of Artificial Sequence: Synthetic coding sequence
atggtcctggagtccaccatggtctgtgtcgataactccgagtacatgagaaatggtgatttcctcccaacacggctgcaggcccaacaggatgctgtcaatattgtgtgccatagcaaaacacggagcaatccagagaacaatgtgggattaataacactggctaatgattgtgaggtcctaacaactctgactcctgataccgggcggatcctgtcaaagctccatacagttcagccgaagggcaagatcaccttttgcaccgggattcgcgtggcacatcttgcactcaaacatagacaaggaaaaaaccataaaatgcggataattgcttttgtggggagcccagtcgaggacaacgagaaagatctggtcaaactggccaaacgcttaaaaaaggagaaggtgaatgtggacatcattaacttcggggaagaagaggtgaatactgagaaactgaccgcgttcgtcaataccctgaacggcaaggatggcacgggatcgcatctggtgactgtgccccccggcccttcgcttgctgatgctttgataagttcacccatactcgccggcgaagggggggccatgcttggattgggcgcgtccgactttgaatttggcgtagacccctccgctgatccggagctagcgttagccctgagagtttctatggaggagcaaaggcagcggcaagaggaagaagccaggcgcgcggccgcagcgtcagcagctgaagcaggtatcgcaaccactgggacagagggtgagcgcgattctgatgatgccctgttgaagatgaccatctctcagcaagaattcgggcgtacgggactccctgaccttagctccatgaccgaggaagagcagatagcctatgccatgcagatgtcactgcagggggccgagttcggccaggctgagtcagctgatatcgacgcctcttccgccatggacacttctgagcctgccaaagaggaagatgattacgatgtcatgcaggaccccgaattccttcagtccgtcctggagaacctgcctggtgtggatccaaacaacgaggccatcagaaatgccatgggttctctcgcctctcaggcgacgaaagatggcaaaaaagataaaaaagaggaagacaaaaagtag

SEQ ID NO: 15230 - DNA, 1134 bp, Artificial Sequence
  Description of Artificial Sequence: Synthetic coding sequence
atggtgcttgaatcgacaatggtttgcgtcgacaactccgaatacatgaggaatggggactttttacctacccggctgcaagctcagcaggacgccgtgaatattgtgtgccactccaagacccgctccaaccctgaaaataacgtgggactcatcactctggctaatgattgcgaggtcctcaccacactgacccccgatacaggaagaattctgagcaaactgcacactgtgcagcctaaaggaaagatcactttttgcacgggcattagagtggcccatttggcactgaagcaccgacagggcaagaaccataaaatgcgtattattgcttttgtggggagtccagtggaagataatgaaaaagatctagtcaaactagctaaaagactcaagaaggagaaggttaatgtggacatcataaactttggcgaggaggaagttaacacggaaaagctcaccgcattcgtcaatactctcaacgggaaggacgggacagggagccaccttgtgacagtacctcccggcccaagtcttgctgatgcgctcattagctctcccatcctggcgggcgaaggaggcgcaatgttgggtctcggcgcctccgattttgagtttggggttgacccttctgctgacccagagctggcactagccttacgggtttccatggaagaacagcggcaacggcaggaagaagaggccaggcgcgccgccgccgcatcagccgcagaggctgggatcgccaccacaggaacagaggattcagacgatgctcttttgaagatgaccatctctcagcaggaatttggaaggacaggactgccagatctgtcttccatgactgaggaggagcaaattgcctacgcaatgcagatgagcctgcaaggtgcggagttcgggcaagcagaatccgcagatatcgatgcctcatccgcgatggatacatcagagcccgctaaagaagaagatgactatgacgtgatgcaggaccccgagtttttgcagagcgtgttggagaacctcccaggagtggaccccaacaacgaagcgattagaaacgcaatgggatcgctcgcaagtcaggccacaaaagacgggaagaaggataaaaaggaggaggataagaagtag

SEQ ID NO: 15231 - DNA, 933 bp, Artificial Sequence
  Description of Artificial Sequence: Synthetic coding sequence
atgcggccagcccggcactgggagacacgattcggtgcccgcgatttcgggggtttccaggactgctttttccgggacagattaatggataccgccaggatcgccgtcgtcggggccggcgtggtgggtctctctactgccgtgtgtatctccaagctggtgcctaggtgttcagtgactattatcagtgacaaatttacaccggataccacaagtgatgtggctgccggcatgctcatcccacacacctaccccgatacccctatccacactcagaaacaatggttcagagagacattcaaccacctgttcgcaatagccaacagtgccgaggccggcgatgccggggttcatcttgtgtctgggatcaaaggctccggaggctggactctaaccagaagaatcgaagatctgtgggagctgcacccgtccttcgacatcgtagtcaattgctcagggctgggcagtcgacagctggccggggactccaaaatcttccctgtcagggggcaggtgctgcaggtgcaggccccctgggtagagcattttatccgagatgggtctggactcacctacatctacccgggaaccagtcacgtgactctgggcggtaccaggcaaaagggggattggaacctgtcacctgacgctgaaaattcccgggaaattctctctcgttgctgtgcactggagccctctctccatggagcatgcaacattcgagagaaggttggattgcggccttacagaccaggtgtgaggcttcagacggaactgctggcacgggacgggcagcgattacccgtagttcatcattacggccatggcagtgggggaatatctgtgcactggggtaccgctctcgaggctgcaagactggtatccgaatgtgttcatgctctgcgcactcctatccctaagtcaaacctgtag

SEQ ID NO: 15232 - DNA, 1110 bp, Artificial Sequence
  Description of Artificial Sequence: Synthetic coding sequence
atgcggcccgcacgccactgggaaacccgctttggcgcacgcgacttcgggggctttcaggactgctttttccgagataggctgatggacacagccaggatcgccgtggtcggggcaggtgtcgtgggcttgtctaccgccgtatgcatttctaaactcgtccctaggtgttctgttaccatcatttccgataagttcacaccagacacaacgagtgacgtggcagcagggatgctgatccctcacacatatcctgacacccctatccacacgcagaaacagtggttccgcgaaaccttcaaccatttattcgcaatcgcaaactcagcagaggctggtgatgctggtgtgcacctggtatccggatggcaaatcttccagtccacacctactgaggaagtgcccttctgggccgacgttgttctgggatttaggaaaatgaccgaggctgaactcaagaagttcccccaatatgtgtttggtcaggccttcaccacattaaaatgtgagtgtcccgcttacctgccatggttggaaaagcggattaaaggctcaggaggttggacactcacacgccggatcgaagacctttgggagctccatcctagctttgatattgtggtcaattgctcaggcttgggcagtcgccagctagcgggagactcaaagattttccctgtaagaggccaagttctgcaggtgcaggccccatgggtggaacatttcattcgggatggaagcgggctgacctatatctatcctggaacatcacatgtcaccttgggaggcaccagacagaaaggggattggaatttgtctcccgatgctgaaaattccagagaaattctctcaaggtgctgcgctttagaaccttctttgcacggcgcatgcaacattcgcgagaaggttgggctcagaccctataggccaggtgtgaggctccagactgagctgctcgcccgggatggccagcgcctcccagtggtgcaccattatggacatggcagcggcgggatttctgtgcactggggcaccgcactggaagctgcgcgtctagtttcagaatgtgtgcacgcactaagaacacctatacccaagagtaacctgtag

SEQ ID NO: 15233 - DNA, 1026 bp, Artificial Sequence
  Description of Artificial Sequence: Synthetic coding sequence
atggacaccgctagaatagctgtcgtaggagccggggtcgtgggtctttctaccgcagtgtgtataagcaagttggtaccgagatgctccgttacaattatcagtgataagttcaccccagacaccacttctgacgtggcagcagggatgctcatcccacacacttacccagacacccctatccacacccagaaacagtggtttcgggagacattcaatcatctatttgccattgcgaactctgctgaggctggagatgctggagtacatttggtgagcggatggcaaatctttcagagcacccccactgaggaagtgcccttctgggccgatgtagtactgggcttccgaaaaatgacagaggcagagctgaaaaaattccctcagtacgtgttcggacaagcctttacgacattaaagtgtgaatgccctgcgtacctgccctggttagaaaagaggattaaagggtcaggtggatggaccctcacccgacggatcgaggacttgtgggagttacatcctagctttgacatcgttgtaaattgtagtggactcggctcgcggcaactggccggtgactctaaaattttccccgtgcgaggccaggtgctgcaggtccaggccccttgggtggagcactttatcagagacgggtccgggttgacctacatttacccgggaacatcacatgtgactctcggggggactcgacagaaaggagactggaacctgtcccctgacgccgagaatagccgagagattttatccagatgctgcgccctggagcctagcctgcacggagcatgtaatatacgggagaaggtggggctacgcccttatcggccaggcgtgagactacagactgagctgcttgccagggatgggcagaggctgcccgtagtccatcactacggccacggtagcggtggcataagcgtccactggggcacggcactcgaggctgcgcgactcgtgtccgagtgcgtccacgcgttgcgaaccccaattcctaagtctaacctttag

SEQ ID NO: 15234 - DNA, 1074 bp, Artificial Sequence
  Description of Artificial Sequence: Synthetic coding sequence
atgggtacaatacaagaggccggtaagaagaccgatgtcggcgtgagagaaatagctgaggccccagagctgggcgcggccctgcgccacggagaactcgaacttaaagaagaatggcaagacgaggagtttccccggctgttgcccgaagaagccggcacctccgaagatcctgaagatcctaaaggggatagccaggctgccgcaggcacacctagtacactggcgttatgcggccagcggcctatgaggaagcgtctctctgccccggagctgcgtttgtcactcaccaagggaccaggaaatgatggggcgtcgcccacccaatcggctcccagtagccccgatgggagctctgatttggagatcgacgaactggagacaccgtctgacagcgagcagctggactcaggtcatgagtttgaatgggaagatgaattacccagagcagagggtctcggtacgagtgaaacagcagaaagacttggtcggggttgcatgtgggacgtgactggggaggatgggcatcattggcgggtctttagaatgggtcctcgggaacagcgggtggatatgacagtgatcgagccctataagaaggtgttgagtcatgggggataccatggggacggcctgaacgctgttatcctttttgcctcctgttacctgccccgttcgtccattccaaactatacatacgtaatggagcatctgtttcggtacatggtgggcacactggaactccttgtggctgaaaattacctcttggtgcacctctcgggcggtacgtcacgggcccaggtaccgcccttgagctggatccgtcaatgttaccgaactctggaccgccgcctcagaaagaacctgcgggctctcgtggtagtccacgcgacgtggtatgtcaaggcattccttgctctcctccggcccttcatcagcagcaagtttactcgaaagattaggttcctggactccctcggcgagttagctcagctgatttcactcgatcaagtgcacatccctgaagctgtgcggcagctggaccgggatctgcatgggagcggcggcacctag

SEQ ID NO: 15235 - DNA, 1269 bp, Artificial Sequence
  Description of Artificial Sequence: Synthetic coding sequence
atgctgaagttcctcgcgaaaggcgaagttccgaagggatcttgtgaggatgagcctatggattccacaatggacgatgcagtcgctggggacttcgccctaatcaataaactggatatccaatgcgatctcaagactctctctgatgatattaaagaaagtcttgagagtgaaggcaaaaatagcaagaaagaagagccgcaagagctgctgcagtcacaggatttcgttggcgaaaaactgggctctggtgagcctagccacagtgttaaagtgcacaccgtgcccaagcccggcaagggggcggatctaagcaagcctccatgtcgtaaagcaaaggagattcgaaaggaaaggaaacggctgaaattaatgcagcaaaacccggcgggcgagcttgaaggctttcaggcacaggggcacccaccatccctgtttcctcccaaggctaagagtaaccagcctaagtctttagaggacttaatctttgaatcactcccagaaaacgcaagtcacaaattagaagtgcgactcgtccctgtcagttttgaggatcccgaattcaagtcttccttttcccaatcattttccttgtacgttaagtaccaggttgcaattcatcaggacccgcccgacgaatgtggaaaaaccgagtttacaaggttcttgtgttcttcgcccctagaggccgaaaccccccccaacgggcccgattgtggatacgggtcttttcaccaacagtattggttggatggcaagattatcgctgttggcgtgattgatattcttcctaactgcgtctcctccgtctacctctactacgacccggactattcgttcttgagtttgggggtttactcagcgctacgagagatagccttcacacgccagctccacgaaaagacatctcagctctcttattattacatggggttttatatacatagttgcccgaagatgaagtacaaaggccagtacagaccgtccgatttactgtgccccgaaacatatgtatgggtcccaattgagcagtgcctcccgtctctcgagaatagcaagtattgtcggttcaatcaggacccagaagccgtagatgaggatcggtctaccgagcccgaccgcctgcaggtgttccacaagcgagctatcatgccttatggggtctataaaaagcagcagaaagacccttcagaggaagccgcagtgcttcaatatgcctcgctggtgggccagaagtgtagtgaaaggatgctgctgtttcggaattag

SEQ ID NO: 15236 - DNA, 1557 bp, Artificial Sequence
  Description of Artificial Sequence: Synthetic coding sequence
atggccttctgggcgggcggttccccatcagtcgtggattacttcccctcggaggacttttaccgttgtggttactgcaaaaatgaatcaggatcgaggtcaaacggcatgtgggctcactctatgaccgtgcaggattaccaggatcttatcgaccgcggctggcggaggtctgggaaatacgtttataagccagtaatgaaccagacctgctgcccccaatacacaataaggtgtcggcctttgcagtttcagcccagtaagagtcacaaaaaagtgttaaaaaaaatgctgaagttccttgccaaaggggaagttcccaaaggatcgtgtgaagatgagccaatggactcaacaatggatgacgctgtggccggtgattttgccctgatcaataaacttgatattcagtgcgacctaaagaccttgagtgacgatattaaggaaagtctggagagtgaggggaagaacagtaagaaagaggaaccacaagaactgctacagtcccaagattttgtgggcgaaaaacttggatcaggcgagccctcccactccgtgaaagtccacaccgtgcctaagcctggaaaaggggctgacctctcgaagcctccttgcaggaaagcgaaggaaatacgcaaagagaggaagcggctcaagctgatgcagcagaatcctgcaggagaactggaaggtttccaggctcagggacatccgccctccctttttcctcctaaagcgaaatcaaaccagcccaaatccctcgaggatcttatattcgagagcttgcccgagaacgcctcacacaagctagaggtgaggctagttccagtatcttttgaagatccagaatttaagtcctccttttctcaaagtttctcattgtatgtgaaatatcaggtggcaatccaccaggacccacctgacgaatgcgggaagaccgagttcacgcggttcctctgtagctctcctttggaagccgaaacgcctcccaacggaccagactgtggatacggatcttttcaccagcagtactggctcgatggaaaaataatcgccgtcggcgttatcgatatcttacctaattgcgtgtctagcgtgtatctctactacgatcccgattactcattcctttctctgggggtctacagcgccctccgagaaatcgcattcacacgccaactgcacgaaaaaacctcccagctatcctattattatatgggcttttacatacattcttgtccaaagatgaagtataagggccaataccggcccagcgatttgttgtgtcctgaaacttacgtgtgggtacctatcgagcagtgcctcccctccctcgagaattccaagtactgcagattcaatcaggaccccgaagcagtcgatgaagatcgaagtacagaacctgatcggctgcaggtgtttcacaagcgagccatcatgccctacggagtgtacaaaaaacagcagaaggatcctagcgaggaagccgcagttctacaatacgcgagcctggtgggtcaaaagtgttccgaacgcatgctacttttccgcaactag

SEQ ID NO: 15237 - DNA, 3003 bp, Artificial Sequence
  Description of Artificial Sequence: Synthetic coding sequence
atggccgagcgaaagccaaacggggggagcggaggggctagcacatcttcctcaggcaccaatttgctgttctcaagctcagctacagaattttcgttcaatgtacctttcattcccgtaacgcaggctagcgcctcccccgccagcctccttcttccaggggaagactctaccgatgtgggtgaggaagattcatttcttggtcagacatccatccacacttctgccccccagacattctcctacttcagtcaggtgagcagtagctctgaccccttcggtaacattggtcagtcgcccttaaccacggcagctactagcgtcggccagtctggatttcccaagccactgaccgcactcccatttacaaccgggagccaagacgtttccaacgctttctcccctagtatatcaaaggcgcaacccggggcacctccttctagccttatggggatcaatagttatctgccttcccagccgtcgagtctgcccccatcctattttggtaaccagcctcagggcatcccacagcctgggtacaacccctataggcacacccccggcagcagtcgggctaatccttacattgcccctccccagttgcagcaatgccaaacgcccggcccccctgcacacccacccccatcaggcccccccgtacaaatgtaccaaatgccccctggatcacttccccctgtccctagctcagtgcaaagcccagctcagcagcaggtgcctgctcgtcccggcgcaccatcggtccaggtcccgtccccgtttctcctgcagaaccaatacgagcctgtgcagccccactggttttattgcaaggaagtcgagtataagcaactctggatgcctttctccgtattcgactcactcaatctggaagagatttacaacagcgtccaacctgatcctgaatccgtggtcctggggaccgacggaggtcgatatgatgtgtatttgtacgaccggattaggaaggcagcctactgggaggaggagccggcagaagtgcgccgctgtacatggttttacaaaggcgacaccgacagccggtttatcccctatacagaggagttctccgagaaactggaagcagagtataaaaaagcagtcactacaaaccaatggcaccggaggctagaattcccatccggcgagacgatcgttatgcacaacccgaaagtgattgttcagtttcaaccttctagcgtgccagatgagtggggaacaactcaagatggacaaacaaggcctcgtgttgttaaaagagggattgatgacaacttggacgaaatcccagacggggaaatgccgcaggtggaccacctcgtctttgttgtgcacggaatcgggcctgtttgcgatctacggttcagatctattattgagtgtgtggatgatttcagagtcgtctccctcaaattgttaagaacacacttcaagaaatcgctggacgatgggaaggttagccgagtggaattcctgcctgtgcactggcattcctctttaggaggagatgctactggcgtcgaccgaaatatcaaaaagattacactaccgagcattgggcgcttccgccactttacaaatgagacgctgctggacattttattttataactcccctacttactgtcagacgattgttgaaaaggtaggtatggagattaatcacctgcatgccctgtttatgtcgcggaaccccgattttaagggtggggttagtgtcgcaggtcactccctgggttcactgatcttatttgacattctctctaatcagaaggacctgaacctcagcaagtgccctgggccactcgccgtggcgaatggcgtggtaaagcagctccacttccaggagaaacagatgccagaagaacccaagcttacactcgacgagagttacgatctggtcgtggagaataaagaggtgctgactctgcaggaaaccctggaagccttgtctttaagcgagtatttctctacattcgagaaagaaaagattgatatggagtctctgttgatgtgcaccgtggacgatctgaaggagatggggatccctcttggcccccgaaagaaaatcgcaaattttgtggagcataaggcagccaagctgaaaaaagccgcgtctgagaaaaaggccgtcgcagctactagcacgaaagggcaggagcagtccgcgcagaagaccaaggacatggcttcactacctagcgagtcaaacgaacccaagagaaagcttccagtcggggcttgcgtgagtagcgtgtgtgtgaattacgagtcgtttgaggtgggcgccggacaagtctccgtggcctataatagcctcgacttcgagcctgagatattttttgcactcggtagcccaatcgccatgtttctgacaataaggggtgtcgataggatcgacgaaaactacagcctccctacttgtaaagggttttttaacatctaccaccctctcgatcctgtagcttaccggctagagcctatgatcgtgcccgacctcgatcttaaagcagtgctgatcccccaccacaagggccgcaagcggctgcacttggagctcaaggaatcacttagcaggatgggcagcgatctcaagcagggcttcatctcttctctcaaatccgcttggcaaaccctaaatgaattcgcgagggcacacacgtccagcacccaattacaagaagaactagagaaagttgctaatcaaatcaaagaggaagaggagaagcaggtcgtcgaagcagagaaggtcgtggagtcacccgatttcagcaaggacgaagattacctagggaaggtcgggatgctcaatggcggcaggcggatagactatgtactacaggagaagccaatcgagtccttcaacgagtacttgtttgcacttcagagtcacttgtgttattgggaaagtgaggacaccgctctgttgctgttgaaggagatctaccggacgatgaacatctcacctgaacagccgcagcactag

SEQ ID NO: 15238 - DNA, 495 bp, Artificial Sequence
  Description of Artificial Sequence: Synthetic coding sequence
atggtgaattccgtggtgttctttgatatcacagtagacggaaagcccctgggcagaatctccattaagctgttcgccgataaaatcctgaagaccgcagaaaactttagggctctttcaactggcgagaaggggttcaggtacaaaggcagctgttttcacaggattatcccaggctttatgtgccagggcggagactttacacgccacaacggcacaggggacaagagcatttacggcgagaagttcgacgacgaaaatctcattaggaaacacacaggatccggcatcctgtcaatggccaacgctggccccaacaccaacggaagtcaattcttcatctgcgcagctaaaacagagtggctggatggcaagcacgtagctttcggaaaagtgaaagaaagagtaaacatcgtggaagctatggagcatttcggctaccggaattcgaagactagtaaaaaaatcacgattgccgactgtggtcaattttag

SEQ ID NO: 15239 - DNA, 426 bp, Artificial Sequence
  Description of Artificial Sequence: Synthetic coding sequence
atgaagattctcgacgtgggatgtgggggtggcttgcttactgagcccggaggtagcttgttcatcactacgattaataaaacacagctctcctacgcactggggatcgtgttttctgagcagattgcaagcatcgtgccaaagggcacccacacctgggaaaaatttgtctctccagagacgcttgagtcgattcttgagtctaacggactgagcgtccagactgtggtgggaatgttgtataatcccttctctggctattggcattggtctgagaacacctcactgaattatgcagcctacgctgtaaagtcccgggtacaggagcaccccgcctcagccgaattcgtgctgaagggcgaaacagaagagttgcaagccaatgcttgtactaacccagcagttcacgagaaattaaagaagtag

SEQ ID NO: 15240 - DNA, 426 bp, Artificial Sequence
  Description of Artificial Sequence: Synthetic coding sequence
atgaaaatactggatgttgggtgcggaggtggcttacttacagagcccggcggatcactgttcatcactactattaacaagacacagctgagctacgcactaggaatcgtgttttccgaacagatcgcaagtatcgtgcccaaaggtactcacacttgggagaagtttgtgtcaccagagaccctcgagtcgatccttgagtccaatggattgtccgttcaaaccgtggtcggtatgctgtacaaccctttttccggctactggcattggtctgaaaatacaagcttgaactatgcggcttatgccgtcaagagcagggtccaggaacaccctgcatcagctgaatttgtgttaaaaggcgagactgaggagttgcaagccaacgcttgcaccaatccagcggtgcatgagaaattgaagaaatag

SEQ ID NO: 15241 - DNA, 2157 bp, Artificial Sequence
  Description of Artificial Sequence: Synthetic coding sequence
atgctgatgaccctggaaatgaccgagctgacagatccacatcacacaatgggagattacaaagtggcacacccacaggatccccatcacccctcagagaaacctgtcatccattgtcacaaatgtggcgaaccatgtaagggggaggtactcagggtacagaccaaacactttcatatcaagtgcttcacttgtaaggtttgcggctgtgacctcgcccagggcggcttctttataaaaaacggcgagtacctctgcactctcgactatcagcgaatgtacggaaccaggtgtcacggctgtggagagtttgtcgagggcgaggttgtcacagccctcggtaagacgtatcacccgaattgcttcgcttgcacaatttgtaaacggcccttcccacccggagaccgggtcacttttaatgggagagactgtctctgccagctgtgcgcccagccaatgtcttccagcccaaaggagactactttttccagcaattgcgccggatgtgggcgagatatcaaaaacggtcaggcacttctggcgctggacaaacagtggcacttgggttgcttcaaatgcaagtcttgtggtaaggtactcaccggcgagtacatctcaaaggacggggccccatattgcgagaaggattaccagggactgttcggcgtcaaatgcgaggcatgtcaccagttcattactggcaaagtcctcgaggctggagacaaacactaccacccttcatgcgccaggtgttcccggtgtaatcagatgttcaccgagggtgaggagatgtacctccaaggttcaacggtctggcatcctgattgtaaacaatctaccaagaccgaggaaaagctgaggcccaccagaacatcttccgagagcatctactcccggccagggtcctccatccccgggtctcccggccatacgatctacgctaaagtcgacaacgagatactggattacaaagacctggccgcaatacccaaagtaaaagctatatacgacatcgagcgacctgatctgatcacttacgagccattttataccagcgggtatgatgataagcaggagcgccaaagccttggggaaagccctcgaaccctgagtcccacgccaagtgcagaaggttatcaagacgtgcgggataggatgatacatagaagtacatcacaaggatcgatcaattctcctgtgtactccaggcacagttataccccaaccacatcgcgctctccccaacactttcatcgccccgggaatgagccttcttcgggtcgaaactccccccttccttatcgaccagattcccgcccactcacccccacttatgctcaggcgcccaagcactttcacgtccccgatcaggggatcaatatttaccggaaacctccaatatataagcagcatgccgccctggccgctcaatccaaatcctcagaggatatcatcaagttctcaaaatttccagcagctcaggcacccgacccgtcagagactcctaagatcgaaacagaccattggcccggcccgccctcctttgccgttgttgggccggatatgaagcgaagaagctctggacgagaagaagatgatgaggagttattgagaaggcgacagctgcaggaagaacaattgatgaagttgaactcgggcttgggtcagctgattttaaaggaggagatggagaaagagagcagggaaagaagctccttgttagcctctagatatgactctccaatcaatagcgcgagtcacatcccgagcagcaagaccgccagcctcccaggctacggccgcaatgggctccaccggccagtatctacagatttcgctcagtataacagctacggggacgtatctggcggcgtccgggattaccagacgttgcccgatggccatatgcctgcaatgcgaatggaccggggcgtcagtatgccaaacatgttagagcctaagatctttccatatgaaatgttgatggtgaccaatagaggaaggaataaaattcttcgcgaggtggaccggaccaggctggaaaggcacctggcaccagaggttttccgcgagatctttgggatgtctatccaggagttcgatagacttcctctttggcggagaaacgacatgaaaaaaaaggcaaaactgttctag

SEQ ID NO: 15242 - DNA, 1593 bp, Artificial Sequence
  Description of Artificial Sequence: Synthetic coding sequence
atgttcacagagggcgaagagatgtacttacaaggatctaccgtttggcaccccgactgcaagcagagcaccaaaacggaggaaaaactgaggttaccgaacatccgcagaagctctagtgattttttctactcaaaatcattgatccgaagaacaggaaggtcaccatcactgcagccgacaaggacatcgtcagagtcaatctatagcaggccgggcagctcaattcctgggtctcctggccacacaatatatgccaaagttgacaacgaaatcctggattacaaggatctggcagccatccctaaggtcaaagctatttacgacatcgagagacccgacctgataacctatgagcccttctacactagcgggtatgacgacaagcaggaaaggcaatccctaggagagagcccacggactctctcacccacaccgtccgctgagggttaccaggacgtcagagacagaatgattcacaggagtacgagtcagggctcaatcaatagtccagtctattcaaggcactcttacactccaacaacttccaggtctccccagcattttcacaggccagaactgctctctcctggagtacaacgcctgtcatatctgaggacctcatcgctaagtcccactcacagtgattcccgtcctaaccctccattccggcaccatttcattccgcacattaagggtaatgagccatcgtccgggagaaacagtcctctgccataccgccctgatagccgacctcttacccccacctacgcacaggccccgaaacattttcacgtcccggaccaggggattaacatttatcgtaagccccccatctataaacagcacgccgcactcgcggcacaaagtaagtcctctgaggacatcattaaattctctaagttcccagccgcccaggcccccgatccatcagagactccaaagattgagaccgatcactggcctgggcctccaagtttcgcagtagtgggccctgatatgaaaagaagaagtagcgggcgggaagaagatgatgaggaactcttgaggcgcagacaactgcaggaggaacagcttatgaaactgaatagcgggctaggccaactgatccttaaagaggaaatggagaaggaatcccgtgaacgctcctcactcttggcatcaagatacgactctccaattaattcggccagtcacatcccatcaagcaaaactgcatcattacccgggtacggccgaaacggcctacaccgcccagtgagtactgacttcgcccagtacaattcctatggagatgtgagtggcggggtccgcgactatcagacactgcccgatgggcatatgcctgccatgcgcatggacaggggagtctcaatgcctaatatgttggaacctaagatattcccttacgaaatgcttatggtgaccaatcggggacgtaacaaaatcctgcgggaagtggatagaacaagattagaacggcacctggcccccgaggttttcagggagatcttcggcatgagtatccaggagtttgatcgactgcctctgtggcggcgcaacgatatgaagaaaaaagctaagctgttctag

SEQ ID NO: 15243 - DNA, 2109 bp, Artificial Sequence
  Description of Artificial Sequence: Synthetic coding sequence
atggtcaaagaaaaagtcgctcatccacaagacccccatcatccctcagaaaaacctgtgattcactgtcacaagtgcggggaaccgtgtaagggagaggtcttgagggtccaaacaaaacatttccacatcaagtgtttcacatgtaaggtctgcggttgtgacctggcccagggtggcttctttataaaaaatggagagtatctgtgcacactggactatcagagaatgtacgggactaggtgtcatggatgcggagaattcgttgagggcgaggttgtgactgcactcggcaaaacgtatcacccaaattgtttcgcctgcaccatttgtaaacggccattcccccctggtgatagagtgacatttaatggcagagactgtctgtgccaactttgcgcccagcccatgtcctccagccccaaggagacaaccttcagtagtaactgcgccggctgtggccgagacataaaaaacggccaagcccttctggccctggataagcagtggcacctaggatgtttcaaatgcaagtcatgcggtaaagtgctgacgggggagtacatttcgaaggatggggccccttattgcgagaaagattaccaagggttgtttggtgtgaagtgcgaggcatgtcaccagttcattacaggcaaagtacttgaggccggcgacaaacattaccacccctcctgtgcacgctgtagtcgctgcaaccagatgttcactgagggggaggagatgtacttgcaagggtccaccgtatggcacccagactgcaagcaatcaacgaagaccgaggagaagctgcggcctacccggactagcagcgaatcaatttactcgagaccaggttccagtattcccggcagccctgggcacactatatacgccaaggtcgataacgagattctggactacaaggacttggccgctattcctaaggtgaaggctatatatgacatcgaaaggcccgacctcattacttatgagcccttctatacaagtggctatgacgacaagcaggaacgacagagtctcggagagagtccccgaacactctcccctacaccaagcgccgagggatatcaggatgtcagggaccgaatgatacacaggtccacgtcccagggaagcattaacagtcctgtttatagtcgccattcctataccccaacaacgtccaggtcacctcaacacttccaccgcccgggcaacgaacctagttcgggacggaatagtcctctgccttatcgccctgatagtaggccacttacaccaacctatgcccaagcccccaaacacttccacgtgcccgaccagggtattaacatataccgtaaacctcctatctataaacagcatgccgctcttgcagctcaaagcaaatcaagcgaggatatcatcaaattttctaagttccccgcagcacaggcgcctgatccgtctgaaacacctaaaatagagaccgaccactggcccggccctccctctttcgcagtcgtggggcctgacatgaaacgccgttcgtcgggacgggaggaggacgatgaggaattgttgcggcgccggcagttacaagaggaacagttaatgaagctgaattctgggttaggacagcttatactgaaggaggagatggagaaggaatctcgtgagcggagctcactcttggcatcacgatatgattcccccattaattccgcaagtcacatacccagtagcaaaaccgcaagtctgcccggatatggccggaacgggctccatagacccgtgagtactgattttgctcaatacaattcatacggcgacgtcagcggaggtgtgcgagactaccagacgctgccagacggccacatgccagccatgaggatggatcggggggtaagtatgcccaatatgttggagccgaagattttcccctatgagatgctgatggtcactaatcgcgggcggaacaagattctgagggaggtggatagaaccagactggagcgtcacctcgctcccgaggttttcagagagatctttggtatgagcatccaagaatttgaccggctccccctttggagaaggaacgacatgaagaagaaggcaaagctgttctag

SEQ ID NO: 15244 - DNA, 1206 bp, Artificial Sequence
  Description of Artificial Sequence: Synthetic coding sequence
atgtttaccgaaggggaagaaatgtacctacagggctccactgtgtggcatccagattgtaagcagtcaaccaagaccgaagaaaaattaagggccaaagtcgacaacgaaattttggactataaagacctcgccgcgatcccaaaagtgaaagccatttatgatattgagcgtccagatttgatcacctatgagcccttctacacatccgggtacgatgacaagcaggaacggcagtctctgggagaatcgccgcggacactgtcccccacgccgagtgctgaaggataccaagacgttcgcgacaggatgattcacaggagcacctctcaggggagcattaattcccctgtgtattcgcgacattcctacacccccaccacgagtcgatcaccgcagcattttcaccggccagaccagggcattaatatttaccgaaaaccccccatctacaagcaacacgcagctctagcagcccaatctaaaagcagcgaggatattataaaattttccaaattcccagcggcacaagcccccgacccgtccgagaccccaaaaattgaaaccgatcactggcccggaccgcccagcttcgcagtggtcgggcctgatatgaaacggagatcttccgggcgagaggaggatgacgaggaactgctaagaaggaggcaattgcaggaggagcagctgatgaaactaaacagtggattgggccaactgattctgaaggaagaaatggagaaagaaagcagagagcgctcaagtctattagcctcccgttacgactcaccaatcaacagtgcaagtcacattcctagtagcaagaccgcctctctgcccggctatggccgcaacggactgcatagacccgtgtccactgattttgcgcagtacaactcttacggcgacgtttcgggcggcgtgcgcgattatcagactctcccggacggacacatgcctgcaatgcgaatggatcggggcgtgtcaatgcccaatatgcttgagccgaagatcttcccctacgaaatgctgatggtgacaaaccgaggccgcaataaaatccttcgcgaagttgacaggacacgcctggaaaggcacctggcacccgaggtttttcgtgagattttcggaatgtcaatccaggaattcgacagactgcccttatggaggcgcaacgatatgaagaaaaaagccaaattgttctag

SEQ ID NO: 15245 - DNA, 1968 bp, Artificial Sequence
  Description of Artificial Sequence: Synthetic coding sequence
atggtgaaagagaaagttgctcaccctcaggaccctcaccatccatctgaaaaacccgtcatccattgtcacaagtgtggggagccatgcaagggagaagtgctcagggtccagacaaagcattttcacatcaagtgtttcacctgcaaagtgtgcgggtgtgatcttgcgcaggggggcttcttcatcaaaaatggagaatacttatgtaccctggactaccaacgcatgtacggaaccaggtgtcacggatgcggggaatttgtcgaaggggaagttgtgactgctcttgggaagacctaccaccccaattgttttgcctgtactatttgtaaacgcccctttccacctggggacagagtcacctttaatggcagagattgcctgtgccaactttgtgctcagcccatgtctagtagtccaaaggagactacattttcaagcaattgcgccggatgcgggcgcgatatcaaaaacggccaggcactccttgccttggacaaacagtggcacctgggttgtttcaagtgtaagtcttgtgggaaagtgctgaccggagagtacattagtaaggatggagctccatattgtgagaaagactaccaaggcctattcggagtgaaatgtgaggcatgccatcagttcatcaccggaaaagtgttggaggctggcgacaagcattaccatcctagctgtgctcggtgttcacgctgtaatcagatgttcacagaaggagaagagatgtacctgcaggggtcaaccgtgtggcaccctgactgtaaacaatctacaaagacagaggagaagctacgacctacaaggacatcaagtgaaagcatatactcaagacccggatcctcaatccctggcagtcctggacataccatttacgccaaggtggataatgaaattctcgattataaagatcttgccgctattcctaaagtgaaggctatttatgatattgagcggcctgaccttattacgtatgagcccttttatacctctggttatgacgacaagcaggaaagacagtccctgggcgagagcccacgcaccctgtcccctacaccttctgcagagggataccaggacgtccgggatcgcatgattcatagatccacctcccagggatccattaactcccctgtatactccagacactcttacacgcccacgacatcacgctcaccacagcactttcatcggccaggcaacgagccaagcagcggacgcaactcccccctcccgtatcggcccgactctagacctttgactccaacatacgcacaggcccctaaacactttcacgttccagatcaggggatcaatatctatcgaaaaccacctatatacaagcagcatggacccgatatgaagcgccggtcctcaggacgggaggaggatgacgaagagctgctgcgccgcaggcagctgcaggaagaacagcttatgaaacttaattccggtctcggccagcttatcctgaaagaggagatggaaaaagaaagtcgggagcgcagtagccttctcgcctcccggtatgactctccgatcaactccgctagtcacatcccaagttctaagactgcatctttgcctggctacggccgtaacgggctacacaggcctgtatcaacggatttcgctcaatacaatagctatggggatgtctctggcggcgtgagggattttcagaccttgcctgatggtcacatgcccgctatgcgcatggatcgtggagtttccatgccaaacatgctggagcccaaaatctttccgtatgagatgctaatggtcaccaatcgtgggcgtaacaaaattttgcgagaagtagatcggaccaggctggaacggcatctcgctccggaggtctttagggagatttttggaatgagtatccaggagttcgatcgactgcctctctggcggagaaacgacatgaaaaagaaagcgaagttattctag

SEQ ID NO: 15246 - DNA, 2541 bp, Artificial Sequence
  Description of Artificial Sequence: Synthetic coding sequence
atgcccgcctttctcggactcaagtgtctcggaaaactgtgtagtagtgagaagtcaaaagtcactagttctgaacgcaccagtgccaggggcagcaatagaaaacgcctgattgtcgaggatcgtagagtcagtggaacctcttttacagcacaccggcgcgccacgatcacccacttattgtatctgtgccctaaggattattgccctcgtgggcgagtgtgtaacagcgttgacccttttgtggctcaccctcaggacccacatcatccatctgaaaagccagtaattcactgccataaatgcggcgaaccttgcaaaggcgaagtcctgcgcgtgcagacaaaacacttccacatcaagtgcttcacatgcaaagtgtgcggctgcgacctcgcccaggggggtttttttatcaaaaatggtgagtatctgtgcacgctggattatcagcggatgtatgggactcgttgccatggctgcggcgagttcgtggagggtgaggtggtgacggctctcggaaagacctatcatcccaactgcttcgcgtgcaccatttgcaagcgcccttttccacctggcgatagagtgacattcaacgggcgcgattgcctatgccagctttgcgcccagccaatgagttcttcaccaaaagaaacgaccttctcatctaattgcgccggctgcgggagggatatcaaaaacgggcaggccctgcttgccctcgataaacaatggcatcttggctgctttaagtgtaagtcatgcggcaaggtactcactggagagtacatttctaaggacggtgcaccctattgcgaaaaggactaccaggggctgttcggtgttaaatgcgaggcctgccaccagtttataacagggaaggtactggaggccggagacaagcactatcatccttcctgtgccaggtgttcaagatgtaaccagatgtttacggagggcgaagagatgtacctgcagggtagcactgtgtggcatcccgactgtaagcaatcaacaaagactgaggagaagctccggttgccaaatattcgtcggtcctcatccgactttttttattctaaatctcttattcgccggaccggtaggtctccgagcctgcagccgacccggacctctagcgagagtatatacagccgaccaggctcaagtatccccggatctccaggtcatactatttacgcaaaagtggacaatgagattctggactataaagacctggccgcaattcctaaggtgaaggccatctatgatatcgaaagacccgacctgataacctacgagcccttttataccagcgggtatgacgataagcaagagcgtcaaagcctgggagagtctccgcggaccctaagtcccacaccttccgcggaaggttatcaggacgtacgagacaggatgattcaccgctccacctcccaaggctccatcaactctcccgtatactcgagacattcgtacacacctactacctcccgtagccctcaacacttccaccgccctgagctgctcagcccaggggtgcagcggctcagctatctgcggacttctagcctttcgcctacccattcagactctaggcctaaccccccattcaggcaccatttcatcccacatataaaaggtaatgagccctcatcagggaggaacagccctttgccgtatcggccagattcccggcccctaacacccacatacgcccaggcgcccaagcacttccacgtgccagatcagggcatcaacatctatcgcaaaccccccatctacaaacagcatgcagcgttggccgcgcagtctaagtccagtgaggatatcattaagttctccaagttccctgccgctcaagctcctgatccttcagagacacccaagatcgagaccgaccattggcccggccctccgagcttcgcagtcgtgggtccagacatgaagcggagatcatccggtagggaagaagacgacgaggaactgctgaggcgccgccagttgcaagaggagcagctcatgaagctaaattcaggcctcggtcaattgatcctgaaggaggaaatggagaaagaatcacgggagcgctcaagcttacttgcatcacgttacgactctccaatcaactctgccagtcatatcccaagcagcaaaaccgctagtctgccaggatatggacggaatggtttacatcggcctgtgagcacagattttgcacagtacaattcctacggcgacgtgagcggcggggtacgggagtaccaaactctgcctgacgggcatatgcctgcaatgcgtatggaccgcggtgtgtcaatgccaaacatgctcgagccaaaaatattcccatacgaaatgctgatggtcaccaaccgcggccgtaataaaattctacgcgaggtagacaggaccagactcgagagacacctggctccggaggtgtttcgcgaaatctttggcatgtcaattcaggagttcgaccgcctccccttatggcgaaggaatgacatgaagaagaaagcgaaactgttctag

SEQ ID NO: 15247 - DNA, 2109 bp, Artificial Sequence
  Description of Artificial Sequence: Synthetic coding sequence
atggtcccagatcccgtggcccatccacaagacccgcatcatccttctgagaagcccgttattcactgccacaagtgtggcgagccttgcaagggcgaagtactgagggtacagactaaacactttcatatcaagtgtttcacttgtaaagtttgtggctgcgatttggcccagggaggattctttatcaaaaacggagagtatctctgcacattagattatcagcgcatgtacggaaccaggtgccacggctgcggtgaattcgttgaaggggaggtcgtgactgctttgggcaaaacgtatcatcctaactgtttcgcatgcaccatctgcaaacggccttttcccccaggggacagagtcacattcaacgggagagactgtctttgtcagttatgtgcacagcccatgtctagcagtccaaaagagacaaccttcagctcaaactgtgccggatgcggccgcgatataaaaaatggccaggcactgctggcactggacaaacaatggcacttaggatgtttcaagtgtaagtcttgtggtaaagttcttacaggggaatatatctccaaggatggcgctccatactgtgagaaggattaccaaggtttgttcggagtgaagtgcgaggcttgccaccaattcatcacaggtaaggtgctagaggccggggacaaacactaccatccttcgtgcgcaaggtgctctagatgcaaccaaatgtttaccgaaggcgaggagatgtaccttcagggctccaccgtttggcatccagactgtaagcaaagcaccaaaactgaggagaagctgcgacctacccgtacttcatccgagagcatttacagcagacctggcagctcaatccccggtagtccaggacacaccatctatgctaaggtggacaacgagatactggactacaaggatttggccgccatcccaaaggtgaaagctatttatgatattgagcgccctgacctgatcacatacgaaccattttatacgagtggatacgatgataaacaggaaagacagagtctgggggagtcccccaggactctgagtcccacacctagtgctgagggctatcaggacgtgcgtgaccgaatgatccaccgctccacgtctcagggtagcattaattccccagtgtatagccgccacagttatacacccactacaagccgttctccacaacattttcaccgcccaggaaacgagcctagttccgggagaaattcccccctgccttataggcctgattcccgccctctgacaccaacatatgcgcaggctcctaaacatttccatgttccggaccaaggcataaacatctatcgtaagccacccatctataaacagcacgctgccctcgccgcccagtcgaagtcttccgaggatatcataaagttctccaaatttcccgctgctcaggcacctgatccatcagaaacccccaaaatagagactgaccactggcctggaccaccttcttttgcagtcgtgggacccgatatgaaacgccggtctagtggtagggaggaagacgatgaggagcttttgcggcggaggcaactacaggaagagcaactcatgaaattaaactccggcctcggacagttaattctgaaagaggagatggaaaaagagagtcgcgaaaggtcctcccttttggctagccgatatgattccccgataaattcagcttcacacataccaagttcaaaaactgcgagtctgccaggttacggacgaaacggactgcaccgcccggttagcactgactttgcacaatataattcttacggcgacgtgtctggtggtgtcagggagtaccagacacttcctgacggccacatgcccgctatgaggatggatcggggtgtgtccatgccaaatatgctcgaacccaaaatttttccttatgaaatgttaatggtgacaaacagagggcgcaacaagatcctgagggaggtcgatagaacccggctggaaagacatctcgcacctgaagtgttcagggaaattttcggcatgtcgatacaggaattcgatcgattaccactatggagacgtaacgacatgaagaaaaaggctaaactcttctag

SEQ ID NO: 15248 - DNA, 1368 bp, Artificial Sequence
  Description of Artificial Sequence: Synthetic coding sequence
atgtttacagaaggcgaagaaatgtacctccagggaagtacggtgtggcaccctgattgcaagcaatccacaaagaccgaggagaagctccgattacctaatatccggaggtcttcatctgacttcttttactctaaatccctgatccggagaactggtcgctccccctccctccaacccacaaggactagcagcgagtcaatctacagcaggcctggcagctcaatccctggttcccccggacacaccatttatgctaaggtggataatgaaatcctggattataaagaccttgcggctatacctaaggtgaaagccatttacgatattgaaagaccagaccttataacctacgagcctttttacacaagtggctatgatgataaacaggagagacaatctctgggggagagcccccgcaccttaagccctaccccgtcagcagaaggatatcaagacgtccgggaccgaatgattcaccgctccacaagtcagggctctatcaattccccagtctatagccgtcattcatacacccccacaacatctaggtctccacagcacttccatagaccagaccagggaattaacatctaccgcaagcccccaatctacaagcagcatgctgccctggccgcccagagcaagtcaagcgaggacataattaagttcagcaaatttcccgcagcacaggcccccgacccgtccgaaacacctaagatcgaaacagatcattggccagggccgccatccttcgcagtggtcggccctgacatgaaacgcaggtcatctggacgtgaagaggatgatgaagagctgcttaggaggcgccaactgcaggaagaacaattaatgaagctgaactccggcctggggcagttgatcctgaaggaagagatggagaaggagtcccgtgaacgcagttcattactggcctcacgctacgattccccgataaattcagcaagtcacatacctagctctaagaccgcatctcttcccgggtacggtcgcaatggcctccaccgcccagtttccaccgacttcgcccagtacaacagctacggcgacgtgtcaggaggtgtacgggactttcaaaccctccccgatggacacatgccggctatgcgcatggacagaggggttagtatgcccaacatgcttgaaccaaaaatcttcccttacgaaatgctcatggtcacgaaccggggccgtaacaagatcttgcgcgaggtggatcggaccagactggagaggcacctggccccggaggtcttccgggagattttcggaatgtccatccaggaattcgatcgtctgcccctgtggcgtcgaaatgatatgaaaaaaaaagcaaagctgttttag

SEQ ID NO: 15249 - DNA, 2241 bp, Artificial Sequence
  Description of Artificial Sequence: Synthetic coding sequence
atgcttatgaccctcgagatgaccgaactcaccgatcctcatcacaccatgggagattataaagtggcacacccccaagatccgcatcacccttcagagaaacccgtgattcattgccataaatgcggcgagccctgcaagggggaggtcctcagagtgcagactaagcacttccacatcaaatgcttcacttgtaaagtgtgtgggtgtgatctggcacaaggagggttttttatcaaaaacggagagtatctgtgtacattggactaccagcgaatgtatggcactcgctgccatggatgcggggagtttgtagagggtgaagtcgtgaccgccctcggcaagacttaccatccgaattgtttcgcatgcacaatttgtaaacggccctttcctcctggcgaccgcgtgacctttaatggaagggactgtctctgccagctttgcgcgcagcccatgtcaagcagccccaaagagactaccttttccagcaattgcgcagggtgtggccgcgatatcaaaaatggacaggcactgctggctcttgacaagcaatggcacctgggttgtttcaaatgcaagtcatgtggaaaagtgttgactggggagtacatctcaaaagacggagccccgtattgcgagaaagactaccaggggctcttcggagttaagtgtgaagcatgccaccagtttatcaccggtaaagtactcgaggcgggggacaaacattatcatcctagttgtgctcgttgttcccggtgtaatcagatgttcactgagggcgaagaaatgtatttgcaaggttctaccgtctggcatcctgactgtaaacagtccactaaaacggaagagaagttgcgcctgcccaacattcggcgctcctccagcgactttttctattccaaatcactcatccgacggacagggcgatcccccagtctgcagccgacgcggactagtagtgagagcatctacagccgccctggatcctcaatccctggatcccctgggcataccatctatgcaaaggtcgacaatgagattctggactataaggacctggccgcaatcccaaaggtgaaggctatatatgatatcgagcgtccagatttaattacctatgagccattttacacaagtggctatgatgacaagcaagaaagacagtccctgggagagtctccccgaaccctgtctccaaccccctctgccgagggttaccaagacgtgcgtgatagaatgattcacaggagcacttctcagggttctatcaatagccccgtctatagcaggcattcctataccccgactacttcccggagcccacagcactttcacaggccaggcaatgagccctcaagcggccgaaactcccctctaccctacagacccgatagccgcccccttactccgacatacgcccaggcacccaagcactttcacgtccctgatcaggggatcaatatttataggaagccgcctatctacaaacaacacgctgccttagctgctcagtcgaagtcctccgaggacattattaaattctccaagtttcctgccgctcaagcgccggatccctcagagacacctaagatcgaaaccgatcattggccaggcccaccatctttcgcggtggttggtccagatatgaagcggcgcagctcgggccgcgaggaagatgatgaagagctcttgaggcgtcgccagttgcaggaggaacagctcatgaagctgaattcaggcctgggccagctgatcctcaaggaggaaatggagaaagaaagcagggagaggtcttctttactagcttccagatacgattcacctatcaactctgcctctcacatcccttcttccaagacggcatcccttccaggatatggaagaaatggacttcaccgcccggtgtccacggattttgcccagtacaactcctatggggacgtttccggaggcgtcagggacttccagaccttacccgacggtcacatgcccgccatgcgaatggatcggggcgtttcgatgcctaacatgctggagcccaagattttcccctatgaaatgcttatggtaacaaatcggggccgaaacaaaattctccgcgaggttgatcggacacgcttggaaaggcacctggcacccgaggtattcagagagatttttggtatgtctatccaggagtttgaccgcctcccactgtggcgacgcaacgacatgaagaagaaggctaaattgttctag

SEQ ID NO: 15250 - DNA, 915 bp, Artificial Sequence
  Description of Artificial Sequence: Synthetic coding sequence
atggctgaagcctctgcggcgggagccgactctggcgctgctgtagccgcacaccggttcttctgtcatttctgcaaaggcgaggtttcgcccaaattgccagagtacatttgcccccggtgcgagtctggcttcatcgaggaagtgaccgacgacagttcctttttaggaggcggaggatctcgtattgataacaccactacaacgcacttcgctgagctgtgggggcaccttgaccacacaatgtttttccaggatttcaggccatttctttcaagttctcctctcgaccaggacaaccgggctaatgagcgtggccaccaaacacatacggacttttggggtgctaggcccccgcgcctccctttgggccgccgttataggagcaggggaagctcacggccagataggtcccccgcaattgaggggatactccagcacatttttgctgggtttttcgccaattctgccatccccggctcaccacatcccttcagctggagtggaatgctgcattccaaccccggtgattacgcttggggacagactgggctggacgccattgttacacaactgcttggccagttggagaacacaggacctccccctgcggacaaggagaagattacgtcactgcctacagtgactgtgacccaggagcaagttgacatggggcttgagtgccctgtatgtaaagaggattacacagtggaagaggaagtccggcagcttccctgtaatcactttttccactcgtcctgcatcgttccttggctggaattacacgacacgtgtcccgtctgcaggaagtccctgaatggagaggactccaccagacagtcccagagcactgaggcgagcgcctctaatagattcagcaacgactcccagctacacgataggtggactttctag

SEQ ID NO: 15251 - DNA, 636 bp, Artificial Sequence
  Description of Artificial Sequence: Synthetic coding sequence
atgagttgtactatcgaaaagatcctcactgatgcgaagacgctgttggagcggctgcgcgagcacgatgccgccgccgagagcttggtcgaccagtccgctgccttacaccggcgcgtggcggccatgcgcgaggcaggaacagcacttcccgaccaagttagacagagatatcaagaagacgcatccgacatgaaagacatgtcgaagtataagccacacattttgttgtcccaagagaatacacagatccgtgacctgcagcaagagaatcgtgaattatggatctctttagaggagcaccaggatgccctggaattgatcatgtcaaagtacagaaaacagatgctgcagctcatggtcgcaaaaaaagccgtagatgccgagccggtgttgaaggcccaccagtctcactccgctgagatcgaaagtcagatcgatagaatatgcgaaatgggcgaggtcatgcgtaaggccgtccaggtcgatgacgaccagttctgcaagattcaggaaaagctcgctcagctggagctggaaaataaagagctgcgagagctcttgtccatctcatccgagtccttgcaggcgagaaaagaaaattccatggacaccgcctctcaagctatcaagtag

SEQ ID NO: 15252 - DNA, 2451 bp, Artificial Sequence
  Description of Artificial Sequence: Synthetic coding sequence
atggtgttgatgtttcagatccggtatattagtcagacacaaggattgccagccgagtatcttttatccgcagggactaagacaacacgcttttttaaccgggatcctaatctaggctatccactgtggcggctgaagacccctgaggagcacgaactggaaaccggaatcaagtcaaaggaagccagaaaatacattttcaattgtctggatgatatggctcaagtgaacatgtccaccgatctcgaaggtactgacatgctggcggagaaagcagacagaagagagtacattgacctgctaaaaaagatgctgacgatcgatgccgacaagagaataacccctctgaagacgcttaaccatcagttcgtaaccatgacacatttgttggatttcccgcactccaatcacgtaaaatcttgtttccagaatatggagatatgcaaaaggcgagttcatatgtacgataccgtgagtcagatcaaatcacctttcacaactcatgtggcacccaatacctccactaacttgactatgagcttcagtaaccagctcaacacagtgcacaaccaggcgtcagtcctggcctccagttctacagctgctgccgccacattgtccttggctaacagtgacgtctcccttctgaattaccagagcgcgctatatccttccagtgctgcccccgtacccggtgtcgcccagcaaggggtgtctttacaaccgggcaccacccaaatatgcacacagaccgacccctttcagcagacgttcatagtctgcccccctgcctttcagactggccttcaagccacaaccaagcatagcggcttcccggttagaatggacaacgccgttccaattgtccctcaagcccccgcagcgcagccactgcagatccagtccggcgtactgacccagggctcatgtactccgttaatggtggctacactccacccccaagtcgctacaattacccctcagtacgctgtcccattcactctgagctgcgctgcgggtaggcctgctctggtggaacagacggccgctgtgctccaagcatggcctggcgggacccagcaaatcttgcttccatccacctggcagcagctacccggcgtggccctacacaatagtgtgcagcctaccgccatgattcctgaagctatgggtagcggtcagcaactggccgattggcggaatgctcattcccacgggaaccaatactctactatcatgcagcagccaagtttattaacaaatcacgtgaccctggccaccgcccagcccctgaatgtgggggtggcccacgtggttcggcaacagcagagcagcagcctgccttcgaagaagaacaaacagtctgctccagtgtcttcaaagtcttctctcgatgttcttccctcgcaggtgtatagcctcgtgggctcctcaccactgaggacgacgagctcatacaactcacttgtgcccgtgcaggaccagcatcagcccattatcattcctgataccccttcaccaccagtaagcgttattacaattcggtctgatacagacgaagaagaagacaataagtacaagccatccagctctggtctgaaaccccggtcaaatgtaatatcctatgtgacagtcaatgacagtcccgactccgattcatctcttagctccccctattccacagacacactgtccgcactcagggggaatagcggctcagtccttgagggccctggccgggttgttgctgatgggaccggaacaagaacaatcatcgtaccgcccttaaaaacgcagctgggcgactgtacggtggcgacacaagcctctggtctgttatcaaacaagaccaaaccggtggcctcagtgtctggccagtcaagtggatgttgcatcacccctactggctaccgcgcccagaggggaggaacatcagcagcacagccccttaatttgtcccaaaaccagcaatctagtgctgcccctaccagccaggaaaggtcttcaaatcccgccccccgccgccaacaggcattcgttgctcccctttcccaagccccctataccttccagcatggtagccctcttcactcgaccggacatcctcacctggcccctgcccccgcccatttgcccagtcaggcgcacttgtatacttacgctgccccaacctcagccgcagcacttggttccacgtcttctatagctcaccttttctcaccccagggatcctcacggcacgctgccgcttacacaacgcatccatcgaccctagtgcaccaggtcccggtctctgtaggcccctcacttttgacctcggccagtgtagctccggctcagtatcagcatcagttcgcaacccagtcctacattggaagctcaagggggagcactatctacaccgggtacccgttatcacctacaaaaatcagccagtattcttacctgtag

SEQ ID NO: 15253 - DNA, 3498 bp, Artificial Sequence
  Description of Artificial Sequence: Synthetic coding sequence
atggcatcccaactccaggtcttctccccccctagtgtgagctcgagcgctttctgctccgctaagaagttaaaaattgagccttcgggctgggacgttagtggccaatctagcaacgataagtattacacccattccaaaactctgcccgccacacagggtcaagcaaactcatcgcaccaagttgccaactttaatattcctgcctatgatcaagggctgctgctgccagctccagccgttgaacacattgtggtgaccgctgccgatagctctgggtcggctgcaaccagcacattccaatcctcccagactctgacacatagatcgaatgtctccctgttagagccttatcagaagtgcggattgaaacgtaaatcggaggaggtggatagtaacggctctgtgcagatcatcgaagagcacccacccctgatgttacagaatcgcaccgtggttggcgccgccgcgactacgaccaccgtgaccaccaaatcttcctctagctccggtgaaggcgattaccagctagttcaacatgagatcctgtgtagcatgacaaactcgtacgaagtgctggaattcctcggaagaggcactttcggacaggtcgccaaatgctggaaaaggagcactaaggagattgtggctatcaagatcctcaagaaccatcctagttatgctcggcagggacagattgaggttagcatcttgtctcggctgtccagtgagaatgctgatgaatacaatttcgtgcgcagctacgaatgtttccaacataaaaaccacacgtgcctggtgttcgagatgctggagcaaaatctgtatgatttccttaaacagaacaagttcagcccacttcctctgaaatacatccggcccattttacagcaggtggccactgccctgatgaaactgaaatccttaggactcattcatgcggatctcaaaccagagaatatcatgttggtagacccagtccgccaaccgtatcgggtcaaggtgattgattttggaagtgcatctcacgtttctaaagccgtgtgctctacatacctccagtcccgatattaccgagctccggagataatactcgggctccctttctgtgaggctatagacatgtggtccctcgggtgtgtgattgccgagctctttctgggctggcctttgtaccctggggcttcagagtacgatcagattagatatatctctcagacgcaggggctccctgcagaatatttactctccgcaggtactaagactacgcggttctttaacagggatcccaacctgggatatcctctgtggcgcttaaaaacacctgaagagcacgagctggagaccggaattaagtccaaagaggccagaaaatacattttcaactgtctggatgatatggcacaggtgaacatgagtactgacctcgagggaactgatatgttggcagagaaagcggacaggcgcgagtatattgatctgctgaagaagatgctaacgatcgacgctgacaaacgcattactcctctcaagaccttgaatcatcagtttgtcacaatgacccacctgctggactttccccacagtaatcatgtaaagtcctgtttccagaatatggaaatttgtaaaagaagagtccacatgtatgacactgtgtcacaaattaaaagtccattcacgacccacgtagccccaaatacctcgactaatctcacaatgagtttctcaaaccagctgaataccgtgcataatcaagcgagcgtgctcgcctcatcttcaaccgctgctgccgcaaccttaagtttagcgaattccgacgtatcgttgctcaattatcagagtgcgttgtatccatctagtgccgctcctgtccccggcgttgcccagcaaggagtctccttgcagcctggaactacacaaatatgtacacaaactgatccgtttcaacagacctttattgtctgcccgcctgcttttcagaccggactgcaagccactactaagcatagtgggtttcctgtacggatggacaatgcagtgccaatcgtgcctcaggcccccgccgcgcaaccactgcagattcagtccggagtattgacccagcaagcctggcccggaggaacccaacagattttactcccgtctacctggcaacagctgcctggagtcgctctacataacagtgtgcagccaacagctatgattccagaagcaatgggcagtgggcaacagctggccgattggagaaacgctcacagtcatggaaaccagtactccaccatcatgcagcagccgagtctgcttaccaaccatgtaaccttggccactgcccagccccttaatgtgggcgtagcacatgtggtcaggcagcagcagagttctagtctgccctcaaaaaaaaacaagcagagcgcacccgtctctagcaagagtagcctagacgtgctgccttctcaggtctactctttagtaggctctagtccacttagaaccacttcaagctataattccttggtccctgtacaggatcagcaccaacccatcattattccggacactccgtctccccccgtatctgttataacaatccggagcgataccgatgaggaggaggataacaagtataaacctagttccagtggcctaaaacctcgctcaaacgtgatctcatatgtgacagtaaacgacagccctgacagtgattcatctctgagttcaccttacagcaccgatacactgtctgcacttaggggcaattccggctcggtcctggagggaccaggacgcgtagttgcggacggcacaggcaccaggaccataatcgtcccacccctgaagacccagctgggagattgcacggtggccactcaggccagcgggcttttgagcaacaaaacaaaaccagtggctagcgtgtcagggcagtcttcgggctgttgtattacccccaccggctacagagcgcagagaggcggaacttctgcagctcagccgcttaaccttagccagaatcagcagtcttctgcggctcccacgagtcaggaaagatccagcaatcccgccccaagacgacagcaagcattcgtcgctcctttgtcacaggcaccatataccttccaacacggttcaccactgcactccaccggccatccacatctggcccccgcacctgcccatctgccctcccaagcccatctgtatacatacgcagcccccacgagcgccgccgcacttggaagcacttccagtattgcccatctgttttcgccccaaggttcctctagacacgcagcagcctacaccacacatccatccaccttggtacatcaggtgcctgtcagtgttggcccatctctcctcaccagtgcctctgtggcacctgcccaataccaacatcaatttgctacgcagagctacataggatcaagcagggggagcacaatatacaccggttaccctttgtcacccaccaaaattagtcagtactcctacctctag

SEQ ID NO: 15254 - DNA, 3498 bp, Artificial Sequence
  Description of Artificial Sequence: Synthetic coding sequence
atggcatcacaactccaagtcttctccccgccttccgtgagcagtagtgcattctgttccgcaaagaagttgaagatagaaccctccggctgggacgtgtcagggcagtcaagtaacgataaatactatacacactccaagactctgcctgcaacccaaggacaggcgaatagcagccaccaggtggccaatttcaatattcctgcgtatgaccagggcctgttgctgccagctccagccgttgagcacattgtggtgactgccgccgatagttctgggagcgcggccacttccacttttcagtcttctcagaccttaacccatcggagtaatgtaagcctgctagaaccttaccagaagtgcggtcttaaaagaaagtcagaggaagtggactccaacggttctgtgcagattatagaggagcatccacccctgatgctgcagaaccggaccgtcgtgggcgcggcagctaccacaaccacggtaactactaaaagctctagctccagtggagaaggcgattatcagctcgttcagcatgaaattttatgcagcatgacaaatagctatgaggtactggagtttctcgggaggggcacctttggacaggtggcaaaatgttggaaacggtctacaaaggaaattgttgcaatcaagattctgaagaaccaccctagctatgccagacaaggtcagattgaggtatcaattctgagtagactgtcatcagaaaatgccgatgagtataacttcgttcgaagttacgagtgtttccagcataaaaatcacacatgtctggttttcgaaatgctggaacagaatctttatgattttttaaaacagaacaaattctctcccctgcccctgaaatatattagacctatcctccaacaggtggccaccgccctgatgaaattgaagagcctgggactcatccatgcagacttgaaacccgaaaatatcatgctggtggatcccgttcgccagccctaccgagtcaaggtcatcgactttggcagcgcatcacatgtgagcaaagctgtctgcagcacctatctgcagtccagatattacagggcgcctgaaattatcctgggcctacccttctgtgaagccattgacatgtggtcactagggtgtgtgatcgccgagctgttcctgggttggccactgtatccaggggcctcagaatatgaccaaattaggtatatctctcagactcaaggattacctgctgagtatctgctgtcagcagggaccaaaaccacacgtttctttaaccgggaccccaatttaggataccccctgtggagactcaaaaccccagaagaacacgagctggagacaggtatcaagtccaaggaagcacgcaaatacatattcaattgccttgatgacatggcccaggtgaacatgtccacagatctggaagggacagacatgcttgccgaaaaagctgaccgaagagagtatatcgacctactcaagaagatgcttaccattgacgcggataagaggatcacccccctaaagaccctaaatcaccagtttgtgacaatgacacacctactcgattttcctcatagtaatcatgtaaagtcctgctttcaaaacatggagatttgtaaacggagggtgcacatgtatgatacagtctcacaaatcaaatcaccttttacaacccatgtagcccctaatacgtcaacgaatctgaccatgtccttttctaaccaattgaatactgtccacaaccaggctagcgtgcttgcatccagcagcactgccgccgccgcaacccttagcctagcgaatagtgacgtcagcctcttaaactaccagagtgccctgtatccctcctccgctgccccagtgcccggggtcgcccagcagggcgtgagcttacagcctggtactacccagatctgtacccagacggacccgtttcagcaaaccttcattgtgtgccctcctgcattccagacaggcctccaggctaccactaagcatagcgggttccccgttagaatggacaatgcagtgcccattgtgccccaggcacctgctgcccagcccctgcagatccagtccggagtgttgacccagcaggcctggcccgggggtacacagcagattttgctcccatctacctggcaacagctgccaggggttgcattgcataatagcgtccagcctactgccatgatccctgaggctatgggaagcggacaacagctggctgactggcgcaatgcccattcccatggaaaccaatattccactattatgcagcagccatcactattgacgaatcatgtgactctggcaaccgcacagccgttaaatgtcggagtggcccacgtcgtacgtcaacaacagtcgtcttcgctgccgtcaaagaagaacaagcaatcagcacccgtgagttctaaaagcagtctggatgtgctcccttcacaagtgtactctctggtgggtagctcccccctgagaactactagcagttacaacagtttggtgcccgtgcaggatcagcatcaaccaattatcatcccggacaccccctctccacctgtgtctgttatcacgatccgatccgacactgacgaggaagaggataataaatataagccatcctcctcagggttaaaacccagaagcaatgtaatctcttatgtcactgtgaatgacagccccgatagtgattctagcctgtcaagtccttactctaccgacaccctgtcagccctacgtggaaactcgggttcagttctcgaaggacctggccgtgtagtggctgatggaaccgggacccgcacgatcatcgtccctcctctaaagactcaactcggcgactgcacagtggccacccaggcctccgggctgcttagcaacaagaccaaaccagtcgcatccgtttccggtcagtcaagtggatgttgtatcacaccaacaggctacagggctcagaggggtggtaccagcgctgcccagccgctgaacctcagtcagaatcagcagagctccgcagcccctacgagccaggagagaagcagtaatccagccccacggagacaacaagcctttgtagcaccattgagccaagctccatatactttccagcacggctcaccgctgcacagcacaggtcacccacacctagcccccgcaccggcccaccttccgagccaggctcatctgtacacttacgcagccccaacatctgctgccgcattagggtccacctcttctatcgcccatctgttctctccgcagggttccagccgccacgccgctgcctatactacccatcccagcaccttggttcaccaggtcccggtgagtgtgggtccttcattgttaacgtcggcaagcgttgccccggcgcagtaccaacaccaatttgcgactcagagctatattggatctagcagggggagtacaatctataccggataccctctcagcccaaccaaaatttctcagtatagttacctgtag

SEQ ID NO: 15255 - DNA, 3633 bp, Artificial Sequence
  Description of Artificial Sequence: Synthetic coding sequence
atggctagtcagcttcaagtcttctccccaccatcagtctccagtagtgccttctgctcagccaagaagctgaaaatcgaaccttctggatgggatgtaagcggacagtcatccaacgataagtactacactcacagcaaaactctacccgcaactcaggggcaggccaactcatcccaccaggtcgctaatttcaacattcctgcgtatgatcagggcctactcttgccggcccctgctgtcgaacacatcgtcgtgacagctgctgattcatcaggctccgccgctacctctacgttccaatcaagccagacgctgacccaccgctctaatgtgagtctgttggagccttatcagaaatgcggcttgaagcgtaagtctgaggaagtggactcgaatggatccgtccaaattattgaagaacacccccctctgatgcttcagaaccgcactgtggtaggagccgccgcaactacaacgaccgtcaccacaaagtccagctccagctctggcgaaggtgattaccagctggtgcagcacgagatcctctgttccatgactaatagctatgaagtgctggagttccttggcagaggtacgtttggacaagttgcgaagtgttggaaaagatcaacaaaggagattgtagcaataaaaatcctgaagaatcacccgtcctacgccaggcaaggccaaatcgaagtctcaatcttgtcacgtctttccagcgaaaatgccgacgagtacaacttcgtgaggagttatgaatgtttccagcataagaaccatacatgcctcgtttttgaaatgctggagcaaaatttatacgactttctgaaacagaacaaatttagtccgctgcccctgaagtacatcagacccatccttcagcaagttgcaaccgccctcatgaaattgaagagcttaggcttgattcacgcggatctgaagcctgaaaacattatgctggtggatcctgtgcggcagccctacagagtaaaggtgattgactttggaagcgcatcccacgtgagtaaagccgtctgctctacctacctccagtctcgctattatagggcccctgaaatcatccttggcctgcctttctgcgaggcgatcgatatgtggtctctgggttgcgtcattgctgagctcttcctcggttggcctctgtacccgggcgccagcgaatatgatcagatccgctacattagccaaacgcagggcctgccggccgaataccttttatcagctggaacgaagaccaccagattttttaatagagatcccaatctcgggtatccactctggcgcctcaagacaccagaagagcacgaactggaaacaggaatcaaatcaaaggaggcccgcaagtacatctttaattgcctcgacgatatggctcaggttaatatgtcaactgatctggagggtacagatatgctggccgaaaaagcagaccggcgggagtatattgacctgttgaagaaaatgttgacaatcgatgctgataagcgcatcacgcctctgaagaccttgaatcaccagtttgttacaatgacacatctgctggattttccccactccaatcacgttaaatcgtgctttcagaacatggagatctgtaagaggcgggtccacatgtacgatacagtcagtcagataaagagcccttttactactcacgttgccccaaatacctcaacaaatctaacaatgagcttctccaaccaactgaatacggtgcataaccaggcctccgtgttagcctctagctctaccgccgctgcagccactctttcccttgccaactcagacgtctcactgctgaactaccaatcagctctatatccatcttcagccgcaccagtgcctggggtggcccagcagggcgtcagcttacaaccaggtacaacgcagatctgtactcagacagaccctttccagcagacattcatcgtgtgtccacctgcatttcagaccgggctacaggctaccacaaagcattccgggttccccgtgcgcatggacaatgccgtccccatcgtgcctcaggctccagcagcacagcctctgcagatacagtcaggagtactgacgcagggcagttgtacgccgttaatggtagctacccttcatccccaggtggcaaccataacacctcaatacgcggttccctttaccctgagctgcgcggcaggtcgcccagccctggtcgagcagaccgccgccgtcttgcaagcatggccaggaggaacgcagcagatcttactcccatccacctggcagcagctccccggtgtggcactgcataattccgtgcaacccacggcgatgataccagaggccatgggttctggacagcaactcgcagattggaggaacgcccattcccatggaaaccagtatagcaccatcatgcagcaaccctcccttctgaccaaccacgtgacattggccacagctcagccccttaacgtaggcgtggcgcatgtggtgaggcagcagcaaagcagtagtctcccctcaaaaaaaaataaacaatccgctccagtatcctctaagagttcactcgatgtgctaccatcccaggtctattcactcgttggcagtagtcccttgcgtactaccagcagttacaacagccttgttcccgtccaggaccaacatcagcctatcataatccccgacactccttctccaccagtgtctgtgattacaatccgcagtgacactgatgaagaggaggacaacaagtacaagccctcctcttccggtcttaagcctcgatccaacgtgatctcctacgtgacagtgaacgactcgccagattccgattcgagtctttccagcccctactctaccgataccctgagtgctctgagaggcaattctgggtcagtactggagggcccgggaagggtggttgctgatgggactggaacccgcaccattatcgtccccccccttaagacccagttgggagactgtacggtggcaacccaagcgtcaggcctcctttctaataagaccaaacccgtggcatccgtcagcggtcagtcatccggttgttgtatcacaccaactggctatcgagcccagcgcggcggcacctcagcggctcagccgctcaatctgtcccagaaccagcaatcgtccgccgccccaacatctcaagagcgctcaagcaatcctgcccccaggaggcagcaggcgtttgtagctccgctgtctcaggccccctatacattccagcatggaagccccctgcattctactggccacccacatctggcaccagctcccgcacatttaccatcccaggcacatctatacacttatgccgcaccaacatcagccgctgctcttggctctacaagcagtatcgctcacctgttctcacctcagggctcttccaggcatgccgccgcgtatacaacacacccgtctaccctagttcaccaagtgcctgtttctgtgggtccttccctgctcacttcggccagtgtggcccctgcgcagtatcaacaccaatttgcaacgcagtcttacatcggcagcagccggggttccacgatctacacagggtacccgttaagccccactaagatcagccagtactcttatctatag

SEQ ID NO: 15256 - DNA, 3228 bp, Artificial Sequence
  Description of Artificial Sequence: Synthetic coding sequence
atggccagtcagcttcaggtgttctcaccacctagtgtgtccagcagcgctttctgcagtgctaagaagctgaagatagaaccgagcgggtgggacgtaagcgggcagagctccaacgacaaatattacacgcactctaaaactctgcccgcaactcaggggcaagcaaacagcagccaccaggtggctaacttcaacattcccgcttacgatcaggggctccttcttccggcccccgcagtcgaacacatcgttgtaacagcagccgattcttcaggatctgctgcgacctcaaccttccaatcatcacagacgctgactcaccggtctaacgtgtctctgctcgagccttatcaaaaatgcgggctgaagcgcaaatcagaagaagtggattccaacggatccgttcagatcattgaagaacatcccccgctgatgctgcaaaacaggacagtggtgggagcggccgcaacaaccaccaccgtgacgactaaatcatcatcatcttctggcgaaggtgattatcagcttgtgcagcacgaaatcttgtgcagtatgactaacagttacgaggtgctcgaattcttggggcgcggtacatttggacaggtagcgaagtgctggaagcggtccaccaaggagatcgtcgccattaagatccttaagaaccacccatcttacgcacgtcaggggcagatcgaggttagtattctgagcagattatcatcagagaacgcagatgaatacaattttgttcggtcatacgaatgcttccaacataaaaatcacacttgcctggtcttcgagatgctagaacagaatctgtacgacttcctcaaacagaataagttttctccactgccactcaaatacatcagacccatacttcagcaggtagctactgccttgatgaaattaaagagtttgggcctgattcatgcagacctgaagcccgagaacatcatgctggtcgatcctgtgagacagccctatcgagtcaaagtcatcgactttggctcagccagccatgtcagcaaagccgtgtgtagcacatacctgcagagcagatactaccgcgctcccgaaatcatcctcggcttaccgttttgcgaagcaattgacatgtggtcactcggatgtgtgatagccgaactgtttctaggctggccactgtaccctggcgctagcgagtacgatcagattcgctatattagtcagactcaaggtctgccggcggaatatctgctctcagctggcacgaaaacaacgcggttctttaatcgcgaccctaaccttgggtaccccctgtggaggttaaagacgccagaagagcacgaactggaaacaggaatcaagagtaaggaggccaggaaatacatttttaattgcctcgacgacatggcccaggtgaatatgtccacagatttggaggggaccgatatgttggctgagaaagcggatcggagagaatatatcgatttactgaaaaagatgttgaccatagatgctgacaaacggattacccctttaaagacgcttaaccaccaattcgtgacgatgacccacttgctggacttccctcactccaatcacgtcaagtcgtgttttcagaacatggaaatttgtaagaggcgggttcatatgtacgatacagtaagtcaaattaaatcccccttcactactcacgtggctccaaataccagcactaacctgacaatgagcttcagcaaccagcttaacacagtgcataatcaagcctccgtgctagcatcttcatctactgctgctgcagctacactttctctagctaatagcgacgtctcacttctgaactaccagagcgccctttatcccagttctgctgcccccgttcccggcgtcgcacaacagggggtgagccttcaaccgggaactacccaaatttgcacccagacagaccccttccagcagactttcatcgtgtgtccgcctgccttccaaaccggattacaagcgactacaaagcattctggatttcccgtaagaatggataatgccgtgcccatagtcccgcaggcgccagccgcacagccactccaaatacaatccggtgtgcttacccaggggtcgtgtactcctcttatggttgctactctacatccacaggtagctaccatcaccccacagtacgccgttccatttacactgtcatgtgctgctggccgccccgccctcgtggagcagaccgcggcggttcttcaggcctggcccggcggtacacagcaaatccttcttcctagcacatggcagcagctccccggtgtcgccctgcacaatagtgtgcagccgaccgcaatgattccggaggcaatgggaagtggacagcaacttgccgattggcgaaatgctcattctcatgggaatcagtattcgacaataatgcaacaaccatccttactaaccaatcatgtcacactggctacagctcagccactgaacgtcggggtcgcgcacgtggtaagacaacagcagagctcctcccttccgtcaaaaaaaaacaaacagtccgctccagtgtcaagtaaatcgagcctggatgtcctgccatcccaagtgtattctctggtgggctccagtcccctgcgtaccacctccagttacaatagcctggtgccggttcaggaccagcatcagcctataatcatccctgatacaccttctccccccgtctctgtaattacgatccgctcagacaccgacgaggaggaagataataaatataagccatctagctcagggttaaaacctcggtccaatgttatcagttatgtcaccgtgaatgactcgcctgactctgattcaagtctgtcgtccccatactcgaccgacactcttagcgctctcagggggaactccggcagcgtcttagaggggccaggacgcgtggtggccgacggaaccgggacccgcactattatagtgccaccgctcaagacacaattaggcgactgtacagtggcaactcaggcttccggcctcttgtctaataagacgaaaccagtcgcttctgtgagtggacaatcttcaggttgctgcataacccctaccgggtatcgggcacaaaggggtgggacatcggccgctcagcctctgaacctgtcccaggtgtccgctatgggctattgccttttatttgggccatgtacagtggtgaccttctggcgcactctgttgttggcggggtgctag

SEQ ID NO: 15257 - DNA, 543 bp, Artificial Sequence
  Description of Artificial Sequence: Synthetic coding sequence
atgcaagcagagggtcaagggaccggcggctccaccggcgacgccgatgggcctggcggccctggcatacctgatggtcctggagggaatgctggaggccccggggaagccggcgccactggtggacgcggccctcggggtgccggcgccgccagggccagtggccctcgtggtggcgcccctcggggccctcatggaggagccgcctcagctcaggatggtcggtgtccttgcggggcaagacggccagatagccgattactgcagctgcacataacaatgccattctccagccctatggaggccgagctggtgcgccgcatcctgagccgcgatgccgcgcccctccccaggccaggcgccgtgcttaaagactttactgttagcggaaatctgctgttcatccggttaacagctgcggatcaccggcagttgcagctatcaatttcatcttgcttgcagcagctcagcctgctgatgtggataacgcaatgcttcttgccagttttcctggcccaggcaccttcaggccagaggcggtag

SEQ ID NO: 15258 - DNA, 717 bp, Artificial Sequence
  Description of Artificial Sequence: Synthetic coding sequence
atgagcgaagacctggctaagcaactcgcctcatacaaagctcagctgcagcaggtggaggccgctctttctgggaatggcgaaaacgaggaccttctaaagttgaaaaaagacctgcaggaagtgatcgaactgaccaaagaccttctatcaacgcagccttccgagactctggcctctagtgattcattcgcgagcactcagccaactcactcctggaaagtgggggataaatgtatggcagtgtggagcgaagacggacagtgttatgaagcagagatagaagaaatcgatgaggaaaatggaaccgcggccatcacattcgcgggctatggaaacgctgaagtgacccctctactcaatctgaaacccgtggaggaagggcgcaaagccaaagaggacagtggaaataaaccaatgtctaaaaaggagatgatagcccagcagcgggagtataaaaagaaaaaggctttgaaaaaagcacagaggatcaaggagcttgagcaggaacgagaagatcagaaagtgaagtggcagcagtttaataaccgcgcttactcaaaaaacaagaaaggacaggtcaagaggtctatattcgccagtcctgaaagcgtgaccggaaaagtgggagtaggaacctgcggtattgctgacaagccaatgacacagtatcaggataccagcaagtataatgttagacatttgatgccgcagtag

SEQ ID NO: 15259 - DNA, 717 bp, Artificial Sequence
  Description of Artificial Sequence: Synthetic coding sequence
atgagcgaggatctggcaaaacagttagcctcatacaaagcccagctccagcaagtagaggccgcattgagcggcaatggggagaacgaggatctgctcaagctcaagaaagaccttcaggaggtgatcgagctaactaaagatctgctctcaacccaaccaagcgagacgctggcctcatctgatagctttgcaagcactcagcctacccactcctggaaggttggcgataaatgcatggcagtctggagcgaagacggccaatgttatgaggccgaaatcgaagaaatcgatgaggaaaatggcacggccgcgattacattcgccggctacggaaacgcggaagttacacccctattgaacctcaagcccgttgaagagggtcgaaaggcaaaggaagattcagggaataaacctatgtccaagaaggagatgattgcccagcagcgggaatacaagaagaagaaggctctcaaaaaggcccagcggatcaaagagctggagcaggagagggaagaccagaaagtgaaatggcagcagtttaataacagggcctattctaaaaacaaaaaaggacaggtcaagcgatccatcttcgcctctcccgagtccgtcaccggcaaagtcggagtcggcacatgtgggattgcagacaagcctatgacacaatatcaggacacttccaagtacaacgttcgacacttgatgccgcagtag

SEQ ID NO: 15260 - DNA, 2229 bp, Artificial Sequence
  Description of Artificial Sequence: Synthetic coding sequence
gatttgtcctccggggggggaatcgaaccacagtgttcatccgaagtatactttcgagcccgtgaacgggggtgcgaaaacgtcgcttggtccttgggcttgcggtcccactgcttccttgaggctgagctgcatcccttgccttggtttctgcccactaacgtatgcagccccctccctggcgccgcacacaaactcgtgtgctatttcaccaattgggcgcattcccgccccgggcccgcgtcgatattgccacacgatcttgatccttttctgtgcacccatcttattttcgccttcgcttctatgaacaataaccagattgtggcaaaagacctccaggatgaaaagatattgtatcccgagttcaacaaactgaaggaaaggatgtggcagcaactgcctactggcgtaaaaaatcctgcccaccagccgagcctgagccaccataggaacagggagctaaagactctactgagcattggagggtggaatttcgggacgtccagattcaccactatgctctctacattcgcaaaccgggaaaaattcattgcaagcgttatcagcctgcttcggacccatgatttcgacggcttagatctatttttcctctaccctggcctcaggggcagcccaatgcacgataggtggaccttcttgttcctaattgaggagctgctgtttgcttttaggaaggaagctctgctaacaatgcgccccagactgttgctgagcgccgccgttagcggcgtgccacacattgtgcaaacttcatacgacgttcgttttttaggcagattgctggatttcataaacgtgctctcttatgatctgcacgggagttgggagcggttcacaggacacaatagccctttgttctcactgcctgaagaccccaagagcagtgcatacgccatgaattattggagaaaattgggcgcacctagtgagaagttaataatgggcatccccacctacgggagaacctttcggctgcttaaggcaagcaagaatgggctccaggcacgagctatcggcccagcgagtccaggcaaatacacaaaacaggagggctttctggcctacttcgagatatgctcgttcgtctggggcgcgaagaagcactggatcgactatcagtacgtcccgtacgccaataaaggtaaggaatgggtgggatatgacaacgccatcagctttagctataaggcgtggttcatcagaagggaacacttcggcggagccatggtgtggactctggatatggacgatgtccggggcactttttgtggaaccggtccttttccactagtctatgtactcaatgatattctggttcgggctgagttcagctccactagcctcccacagttctggctttccagcgccgtgaacagttcctccacagatccggaacggctcgctgtaacgacggcttggaccacggactctaaaattctgcctcccggcggtgaagctggagtcaccgagatacacggtaagtgcgagaatatgaccatcactccccggggcaccaccgtgacaccaacaaaggaaactgtgagcctggggaagcacactgtggcgctgggcgagaagacagaaattactggcgccatgactatgacatccgttggacaccagtcaatgacacctggggagaaggcactcactcccgttggacatcagagcgtgacgaccggccagaagactctcacatccgtggggtatcagtccgtgacccctggagagaagactctgacccctgtcggccatcagtccgtgacccctgtatctcatcaaagtgtgtctcccgggggaactactatgactccagtacatttccagacagaaaccctgcggcagaatactgtggcacctcgcagaaaagccgtggctcgggagaaagtgaccgtgccctctagaaatatttccgtgacccctgagggccagacaatgcccttgcggggagaaaatcttacctccgaggtggggactcatccaagaatgggaaacctggggctacagatggaggccgagaacagaatgatgctcagcagttcaccagtgatccagctccccgaacaaactccattggcttttgacaaccgtttcgtcccaatctatggcaatcatagcagtgtcaattccgtaactccccagacaagccccctttccctgaaaaaggaaatccccgagaactccgcggtggacgaagaagcctag

SEQ ID NO: 15261 - DNA, 2037 bp, Artificial Sequence
  Description of Artificial Sequence: Synthetic coding sequence
atgtggaaattacttctgtgggtgggccttgtacttgtgctcaaacaccacgacggggcggctcataagctggtttgttattttacgaactgggcgcattctagaccaggtcctgctagcatccttccccacgacctggatcctttcttgtgtacccacctcatttttgcgttcgctagcatgaataacaaccaaatcgtggctaaggatttgcaagacgagaaaattctctaccccgagttcaacaaattaaaggagaggaaccgagagctaaagacactgctctctattgggggttggaattttgggacctctaggttcactaccatgttgagcactttcgccaatagagagaaattcattgcctcagtcataagcctactccgaactcatgactttgacggtttggacctgttttttctctaccctggcctgcgcggctcccccatgcacgacaggtggacattcctgttcctcattgaggagttgctcttcgcttttcgcaaggaagcactgctgactatgaggcctagattgctgttatcagctgctgtgagcggtgtccctcacatcgtccagaccagctacgacgtgaggttccttggcagactgttggactttatcaatgtactgagctatgacttgcatgggtcatgggaacggtttacaggccacaactcaccattgttctcattacccgaagatcccaagtcctctgcctacgctatgaattactggcggaaactgggagctccctcagaaaagctgataatgggcatccccacatatggcaggacctttaggctgttgaaggcttcgaaaaacggcctgcaagcccgcgcaattggccctgcctcgcccgggaagtacactaagcaagagggcttcttagcctatttcgaaatctgtagctttgtttggggcgccaaaaaacattggatcgattatcagtacgtgccgtatgccaacaagggaaaagagtgggtcggctacgacaacgctatttctttctcctacaaggcttggtttattaggagggaacactttgggggcgccatggtttggaccttggacatggacgacgttcgtggcaccttttgtgggacgggtcccttcccactggtgtacgtgcttaacgatattctggtccgtgccgagttttcaagcactagccttccccagttttggctgtcctctgcggtcaattcttcctctacagatcccgaaaggctcgcggtcactacagcttggacgaccgactctaaaatcctgcctccaggaggagaggcaggcgttacagagatacatgggaagtgtgagaatatgaccatcacaccgcggggtacgaccgtgactcccacaaaggaaactgttagtctcggcaaacacaccgtggctcttggggaaaaaactgagatcacaggagccatgacaatgaccagcgtgggacatcagagcatgacgcccggggaaaaagctctgactcctgtaggccaccagtctgtgactaccggccagaaaactctcacctcagtgggttaccagtctgtgacgcctggtgagaaaacactcacacccgtgggccaccaaagcgtcactcctgtgagtcaccagagcgtgtcaccaggcggtactactatgaccccggtgcactttcagactgagaccctgagacagaataccgtggctccaagacgaaaagccgtcgccagagagaaagtcacagtgccttccaggaatatctccgttacccccgaaggccagactatgccactgaggggcgagaacctaacttccgaggttggcacccatccacgcatgggcaatctggggctgcagatggaggcagagaatcgcatgatgctcagcagttctcccgtgattcagctccctgagcagactccattagcattcgataatcgctttgtccccatttacggtaatcatagcagcgtgaattctgtcacccctcagaccagcccactgtcactgaagaaggaaattccagagaatagcgctgtggacgaggaggcttag

SEQ ID NO: 15262 - DNA, 1005 bp, Artificial Sequence
  Description of Artificial Sequence: Synthetic coding sequence
atgggcggagcagttagtgcaggagaggataacgatgaactaatagacaacttgaaagaagctcagtatatccgcactgagttggttgaacaggcattcagggctatcgatcgggccgattactacctggaagagttcaaggaaaatgcctacaaagacctggcctggaagcatggcaacattcaccttagcgctccttgcatatactctgaggtgatggaagcactggatctgcagccaggactctccttcctgaacctgggatctggcacagggtacctatcctcaatggtgggattgattttaggccccttcggagtgaaccatggcgtcgaactccattccgacgtgattgagtacgccaaacagaagttagacttcttcattaggacgtccgactcattcgataagtttgacttttgcgaaccaagctttgtgacaggaaattgtctggagattagcccagactgttctcaatacgacagggtgtactgcggggccggcgtccagaaggagcacgaggaatacatgaaaaatctgctcaaggtgggagggatccttgtgatgccactggaagaaaagccttgtcacagcgagagtggcaaatctaggttagtgcagctaccacctgttgctgtgaggagcttgcaggatctcgccaggattgccatacgtggaacaattaagaaaatcatacaccaagagactgtgagcaagaacggcaacgggctgaagaacacaccacgtttcaaaaggcgtcgtgtgcggcgccgtcgaatggaaaccatcgttttccttgacaaggaagtcttcgccagccgaatctctaacccctcagatgataacagttgtgaagacctagaggaggagcggagagaagaagaagagaaaacacccccggagaccaagcctgatcctccagtgaactttctgagacagaaggtgctgagcctgcctctccccgaccctctgaaatattatctcctgtactacagagaaaagtag

SEQ ID NO: 15263 - DNA, 1785 bp, Artificial Sequence
  Description of Artificial Sequence: Synthetic coding sequence
atgtctaggccatcttctagggcaatctatctgcacaggaaggagtactcacaaaacctgaccagtgaacccactctgctccaacaccgagttgaacacctgatgacctgcaaacaagggtcccagagggtgcaggggccagaagatgcgctccaaaaactatttgagatggacgcccagggacgtgtttggtcccaagacctcatcctgcaggtgagggacggatggctccagttactggatatcgaaacaaaggaggagcttgactcatacagattagactccatacaggctatgaacgttgccctcaacacctgttcttataacagcattctgtccatcacagtgcaggagcccggcctccctggaactagcaccctcctcttccagtgccaagaagtgggtgcagaacgactgaaaacctccttacagaaagccctggaagaggagctggagcagagcagacctcgccttgggggcctgcaacctgggcaggacaggtggaggggtcccgcgatggagagacccctacctatggaacaggcaagatacctggaacccgggatcccccctgaacaacctcatcagaggacacttgaacattccttacccccaagccctagacccctccctaggcacacctcagctcgggagccctccgcctttacactgccaccaccccggcgatcctctagtcccgaagatcctgagcgcgacgaagaagttttgaaccacgtgctgagagacatcgagctgtttatgggaaagctcgaaaaggctcaggccaagacaagccgcaagaagaaattcggcaaaaagaataaggatcagggcgggttgacacaggcccagtatatcgactgcttccagaaaataaaacattcgttcaatctattaggtcggctcgctacttggcttaaggaaacaagcgcgcctgaattggtgcatatcttatttaagtcgctgaattttattctggcacgatgccccgaggcaggattggctgcccaggtgatatcaccactgcttacccccaaggctattaacctcttgcaaagttgtctatctcctcctgagtcaaacctatggatgggcctgggaccagcttggactactagccgcgctgattggactggagatgaaccgctgccctaccagcccaccttttcagatgactggcagctgcccgaaccctcttcccaggcaccgctgggataccaggacccggtgagtcttcgtcgagggtcccacagacttggatccactagccatttcccgcaggaaaaaactcacaatcatgatccccagccaggggaccccaactctaggccctcaagcccaaaacccgctcagccagccctgaaaatgcaagtcctgtatgaatttgaagcccgcaaccctcgagagctcaccgtggtgcagggggaaaagctcgaggtgcttgaccatagtaaaaggtggtggctggtcaagaatgaagctgggcgctctgggtacattccctcaaacattctagaacctctgcagcccggtacaccaggcacccaagggcagtctccatccagggtccccatgctgcggttgtctagccgaccagaagaggtgacagattggctgcaggcagagaatttctcaactgctactgtccgcacacttggatctctcaccggaagtcagctcctgcgaattagaccaggagagctccagatgctctgcccccaggaggcacccagaatactctcgagactggaggccgtgcgcagaatgctggggatcagtccatag

SEQ ID NO: 15264 - DNA, 1500 bp, Artificial Sequence
  Description of Artificial Sequence: Synthetic coding sequence
atgtccttcggcagcgagcactacctctgctcttcctcctcctaccggaaagtatttggagatggatctcgattgtctgcgcgcctctcgggcgcaggaggggcaggcgggtttaggtcccaaagcctttcgcgctccaatgtagcttcttcagctgcctgttcttctgccagctctctgggcctagggttagcatacaggaggccaccagcttcagacggcctggacctgagtcaggcagctgcaagaactaacgagtacaagattatacgtacaaatgagaaagaacaactgcaaggcctgaacgacagattcgcagtgtttatcgaaaaggtccaccagctggagacccagaacagggctctggaggcagaactggccgcgctgaggcagcgccacgccgaaccgagcagagtaggggagctcttccagcgggaattacgcgacctccgcgcccagctcgaggaggcttcatcagcccgctcccaagcccttctggagagagatggccttgcggaggaggtgcagagactccgcgctcgctgcgaggaagagtcccggggtcgggaaggagcggagagggcactcaaagcccagcagagagacgtggatggagccacacttgccaggttagaccttgagaagaaggtggaaagtctgctggacgagctcgccttcgttaggcaggtgcacgacgaggaggtagcagagctgcttgccacgctgcaagctagttcccaggccgcggccgaggtcgatgttacagtggctaagcccgaccttacgtccgccctcagagagattcgagcgcagtacgagagcctagctgcaaaaaatttacagtcagcagaagagtggtacaagtccaaattcgccaatttgaatgagcaggccgccaggtctaccgaggccattcgcgcaagccgtgaagagattcatgaataccgaagacagcttcaagcccgcacaatcgagatcgaggggctccgcggcgccaacgagtccctcgagaggcagattctggagctggaagaacggcatagtgctgaagtagccggctaccaggactctatcggacaactggagaatgacctccgaaacacaaagagcgagatggctcgacacctgagggaatatcaggacttgttgaacgtgaagatggcgctggacatcgagatcgctgcttataggaagctcctggaaggcgaggagactcggttcagcacttccggactcagcatatcgggactgaaccccctgcccaacccttcctatctattaccaccacgaattttatccgccaccacgtcaaaagtcagttcgactggactgagtcttaagaaggaagaggaggaggaagaggccagtaaggtagcgtcgaaaaaaacatcgcagatcggcgaaagtttcgaggaaattctggaggagactgtgatttctaccaaaaagaccgaaaaaagtaacattgaggagactaccatctcctcgcagaaaatttag

SEQ ID NO: 15265 - DNA, 1131 bp, Artificial Sequence
  Description of Artificial Sequence: Synthetic coding sequence
atggagagttacgatgttatagcaaaccaacccgtggtcatagataatggcagcggggtcattaaagcaggcttcgctggagatcagatcccgaagtactgcttccctaactacgtcggtaggccaaagcacgtccgggttatggccggggccctggagggggatattttcattggcccaaaagcagaggaacaccgtggattgctttctattagatatcctatggagcacggtattgtgaaagattggaacgatatggagaggatttggcaatacgtttactctaaggatcaacttcagaccttcagtgaggagcaccctgtactcttaaccgaggcaccgctgaacccgagaaaaaatcgcgaacgcgccgctgaggtgttctttgagaccttcaacgtcccagccttattcataagcatgcaggccgttctctcgctttacgccaccggcaggaccacaggtgttgttctcgactcaggagatggggtgacacacgctgtgccaatctacgaaggtttcgcgatgcctcattctattatgagaatcgatatcgcgggccgagacgtaagcagattcctgcgcctatatttgcgcaaagagggctacgactttcatagcagcagcgagttcgaaatcgtaaaggctatcaaggagcgtgcctgctatctttctattaatcctcagaaggatgagacccttgaaacggagaaggcccaatattatcttcccgacgggtccaccatcgaaatcggtcccagccggtttcgcgcccccgaacttctgtttaggccagaccttattggtgaagaatccgagggcattcacgaagtgttggtgttcgctatccaaaaatcagacatggatctaaggcgcacactgttttccaatatcgtactgtcgggcggcagtactttgttcaaaggcttcggtgataggctgctctccgaagtcaagaagctggcaccaaaggacgttaagatacgcatctctgcgccccaggaaaggctatactccacctggatcggcgggagcattcttgcatccctggacacatttaaaaagatgtgggtatctaagaaggagtatgaggaagacggagccagaagcattcaccgcaagacattttag

SEQ ID NO: 15266 - DNA, 783 bp, Artificial Sequence
  Description of Artificial Sequence: Synthetic coding sequence
atgtcacttcagaagacgcctcccacacgggttttcgtggaattagttccctgggctgacaggtcgcgggagaataatctggcttccggaagggagacattgcccggactgagacaccccctgtccagcacccaagctcagacagctacgagggaggttcaggtatccggcacatcagaggtcagtgcaggtccagatagggcacaggtggtcgtgagggtgtcaagcaccaaagaggccgctgccgaagctaagaaatctgtgtgtagacgcctagattacatcactcaaagcttacagcagcagggcgttcaggccgaaaatatcaccgtgaccaaggattttcgccgagtggaaaacgcctatcatatggaagccgaggtgtgtatcacttttactgagtttggcaaaatgcagaacatctgcaacttccttgtggaaaaactagacagctctgtcgtcatttctcctccacagttctaccacacccccggcagtgtcgaaaacctcaggaggcaagcttgtttagtcgcggttgagaacgcttggagaaaggcccaggaggtatgtaatctcgttggacagactctgggaaagcccctgctgatcaaggaggaagaaactaaagaatgggaaggccaaattgacgatcaccagagttcccgtctctcgtcctcactcaccgttcagcagaaaattaaatccgcgacaatccatgcggcatcgaaagtgttcattaccttcgaggtaaagggcaaggaaaaacgcaaaaagcatctatag

SEQ ID NO: 15267 - DNA, 891 bp, Artificial Sequence
  Description of Artificial Sequence: Synthetic coding sequence
atggaaccttccggcggcgaacaggagcctggcgcagtgagattcttagatctgccttgggaagacgtgctactgccccatgtgctgaatcgcgtcccccttcgacagttgctcagacttcagcgagtgtcacgggcatttcgatctttggtgcagctgcacctcgctggattgcggagattcgacgccgcccaggttggcccgcaaattccacgcgctgcattggctcgccttctgcgcgacgcagaaggcctccaagagcttgcactagcaccctgccacgagtggctgtccgacgaagacttggtgcctgtactggcccgcaacccacagctgaggtctgtggctcttggtggatgcggtcagctgtcaagacgtgctctcggtgctctcgccgaggggtgtcctcgcctccagcgtctgtctctggcacactgcgactgggtggacggactggccttgcgcgggctggctgaccgctgtcctgccctcgaggagctcgacctgactgcatgtaggcagctcaaggacgaggccatagtgtacctggcccagcgccgaggagctggtctacgttccctgtccctggctgtaaacgccaatgtaggggacgccgccgtccaggagctggctaggaattgccccgaactgcaccacctggatctgactggatgcctgagagtcggttccgacggcgtcagaacgctcgcagagtattgccctgtactcaggtctctgagggtaagacactgtcaccatgtggccgagtcgtcgctcagtcgcctgcggaaaaggggcgttgatatcgatgtggaacctccactgcaccaggcattggtgctgttacaagatatggcaggcttcgctccgtttgtaaatctgcaggtttag

SEQ ID NO: 15268 - DNA, 2100 bp, Artificial Sequence
  Description of Artificial Sequence: Synthetic coding sequence
atggccgacgccggtataagacgggtcgtgccgagtgatctgtatccgctagtccttgggtttctccgcgataaccagctcagcgaagtggctaacaagtttgccaaggccacaggcgccacgcagcaggacgctaacgctagctccctcctagacatttacagcttctggctcaagtcggctaaagtacctgagcgtaagctgcaagctaacggccccgttgctaagaaggctaaaaaaaaagctagctcaagcgactcagaagactcatcagaggaagaagaggaggtgcaagggccccccgccaaaaaggctgcggtgccagccaaacgggttggcttaccaccagggaaggccgctgccaaggccagcgagtcctcctcaagtgaagagagttccgatgatgatgacgaggaggaccagaaaaagcagccagtgcaaaagggagttaagcctcaagcaaaggctgccaaagcccctcctaagaaagctaagtcaagcgatagtgattcagattcttctagtgaggacgaacctcctaagaatcagaagccaaaaattacaccagttactgtgaaggcacagacgaaggctccccctaaaccggctagagcagctccaaagatcgccaacgggaaggctgcaagtagtagctcctcctccagtagttcgagcagtagtgatgattccgaggaggaaaaagcagccgccacacccaaaaagactgtgcctaaaaagcaggtcgtggctaaggcaccagttaaagccgccaccactcctacgcggaagtccagtagctccgaagacagctcaagcgatgaagaagaggagcagaagaagcccatgaagaacaagccaggcccctatagttcagtccccccacccagcgcgccaccccctaagaagagcttgggaacgcagcctcccaaaaaagcggtcgagaaacaacagccagtggagagctctgaagactcatccgacgagagcgatagtagttctgaggaggagaaaaagcccccaactaaggccgtggtgtccaaggctacaaccaagcctcccccagctaagaaggccgcagaatcttctagcgacagtagcgactctgacagcagcgaagatgatgaggcacccagcaagcctgcaggcactacaaaaaacagcagtaacaagcccgcagttactaccaaaagcccagccgtaaagcctgctgctgcccccaagcaaccggtgggtggtggccagaagcttctaaccaggaaagccgatagcagtagctccgaggaggagagcagcagtagcgaagaggaaaagactaagaagatggtcgctaccaccaaaccgaaggccacagccaaggctgcactttccctgccagccaagcaggctccccaaggcagccgtgactcgtcttctgactcggatagtagctcctctgaggaagaagaggagaagacctcaaaatccgcagtgaagaaaaagccacaaaaggttgccggaggcgccgctccatctaagccagcgagtgcaaaaaagggaaaggccgagagttccaattctagttccagtgacgattctagcgaggaggaggaagaaaagctgaagggcaaggggtctcccagaccccaagcaccaaaagcaaatggtacctctgccctgaccgcacagaacggtaaggcagcgaaaaatagcgaagaggaagaggaggaaaagaagaaggcggctgtggttgtgtcaaagagcggaagcctgaagaagaggaaacagaatgaggctgctaaggaggcagagacaccgcaggccaaaaagataaaattacagaccccaaacactttccctaaaagaaaaaagggtgaaaaacgggcgagctcacccttcagaagggtgcgtgaggaggaaatcgaagttgattccagggtggccgacaactcattcgacgccaaacgcggcgctgcgggagattggggggaaagagccaaccaggtcctaaaatttaccaaaggtaagtctttccgtcatgagaaaaccaagaaaaagcgcggatcctaccggggggggagcatatctgtgcaagttaactctataaaatttgacagcgaatag

SEQ ID NO: 15269 - DNA, 1275 bp, Artificial Sequence
  Description of Artificial Sequence: Synthetic coding sequence
atggaggagaataatctccagtgtagcagcgtggtggacggaaattttgaagaggttccgcgtgagactgccattcagtttaaaccacccttatataggcagagatatcagtttgtcaagaaccttgtcgatcaacatgagcctaaaaaagtagccgacctggggtgtggtgatacaagtctgctccgtctccttaaagtgaatccttgtatcgaactgttagtaggcgtcgatatcaatgaggataagttacggtggagaggcgactctctggcccctttcctcggcgactttctgaagccccgcgatctgaacttgaccatcacactctaccatggctctgtggtggagcgggattccaggctcctggggtttgaccttattacatgcattgagctcatagagcacctggactcgggagacctagcgcgcttcccagaagtagtattcgggtatttgtccccttcgatgattgtgatttccacgcctaacagtgagtttaacccactatttcctagcgtgactctgcgggactctgaccacaaatttgagtggacccggatggagttccagacatgggcactgtatgtggcaaaccgctacgactacagtgtggagttcactggcgtgggcgagccccccgcaggggccgagaacgtggggtactgtactcagatcggaatcttccgaaaaaacggggggaaagctaccgagtcatgtctgtccgagcagcatgaccagcatgtctacaaggcccggcagggacttaccatgctacccagactggtcctaaacttccatcctcaagcaatcctgttgccccatctgccgaagatgctcaggttgcaagtctttaccacctcatatcctagtttgcagcaggagaggttcttcaagctagtgctcgtaaatgaagtctctcagcaggtagagtcactacgcgtgagccatctcccacgccgcaaggagcaggccggcgagcgtggcgataagccgaaagatattggggggtccaaagccccagtgccttgtttcgggcccgtgtttacagaggtggagaaggcgaagattgagaactcaccgaccccgttttgcgtgggagacaagttctttgttcccctgcaacgcctgctcgcatatcctaagctcaaccgcctctgcgccaacgaggagatgatgcggagcgtgattgccgattccatacccctcagcagcgatgggtccgccgtggttgcggatctgagaaattatttcgatgagcaattcgaattttag

SEQ ID NO: 15270 - DNA, 1182 bp, Artificial Sequence
  Description of Artificial Sequence: Synthetic coding sequence
atggaagagaataatctgcagtgcagctccgtcgtcgatggcaattttgaggaagttccgcgagagacggcgatccaatttaagccacccctttaccgacagagataccagttcgtcaagaatcttgttgatcagcatgagcctaagaaggtggcagatctgggctgcggcgatacatccctacttagacttctgaaggtgaacccatgtatcgaactgttagtaggagtggatatcaacgaggataagctgcgatggagaggagactcgctcgcacccttcctgggggattttcttaagccacgggatctgaaccttactattactctttaccacggttcagtggttgaacgggattcgaggctgcttggcttcgacctgataacctgcattgaactgatagaacacctggactctggcgacctggctcgcttccctgaggtcgtctttgggtacctgagtccttccatgatcgtaatctcaactccgaattcggaatttaaccctctcttcccaagtgtgaccctgagagatagcgaccacaagttcgagtggacaagaatggagtttcaaacatgggctctttacgtggccaatcggtatgactacagcgtggaatttactggcgttggtgagcctcctgcgggggcagaaaacgtaggatactgtacacaaattggcatttttaggaagaacggtgggaaagccactgaatcatgcttaagcgagcagcatgaccagcacgtgtacaaggcggtgttcaccacctcttatccaagtctgcagcaagagaggtttttcaagttggtgttagtgaatgaggtgagccaacaagtggaatccctacgggtgtcccacctgcctagacgcaaggagcaggccggtgaacggggcgataagccaaaagacattggtgggagcaaggcccccgtgccctgtttcgggcccgtgttcaccgaagttgagaaagccaagatcgagaattcccctacacccttttgcgtcggcgacaagttctttgttccgcttcaacggctactcgcgtatcctaagctcaatagattgtgtgctaatgaagagatgatgcggtctgtcattgccgactccatccccctgtcaagcgatggttctgccgttgtggccgatctgagaaattattttgacgagcaatttgaattttag

SEQ ID NO: 15271 - DNA, 1701 bp, Artificial Sequence
  Description of Artificial Sequence: Synthetic coding sequence
atgtcagcctccactgggggcggaggtgattcagggggctctggcggcagctcctcctcctcgcaggcctcctgcgggcccgagagcagtggaagtgagctggctctcgcgactcccgtgcctcaaatgctgcaagggctgcttgggtcagacgacgaagagcaagaagaccctaaggactactgtaaaggcggataccatccagtgaagattggtgacgtattcaacggtcggtaccatgttgtcaggaaactgggctggggacatttctctacagtttggctttgttgggatatccagcgtaagagattcgtggcgctcaaggtagttaaatccgctgggcactacaccgagaccgccgtggacgagattaaactgctcaaatgtgtgcgggactccgacccctcagaccctaagcgggaaaccatagtacagttgatcgatgactttcgcatcagtggagtgaacggcgttcacgtctgcatggtgctggaggtcctggggcaccagctcctcaagtggatcatcaaatctaattatcagggactcccagtgccctgcgtaaaaagcattgtgcgtcaggtcctgcatggattagactatctccacaccaagtgtaaaatcattcacaccgacattaaacctgagaacatcttactatgtgttggagatgcatatatacgccgcctggccgcagaggcaacagagtggcagcaggccggcgcaccgccaccgtctcggtcgatcgtctccacagccccacaggaagttttaacaggcaagctgtcaaaaaataagcgaaagaaaatgcgacgtaagagaaagcagcagaagcgtctgcttgaggaacggttaagggacctgcagcggctggaggctatggaagccgctacccaggctgaggattccggtctgcgtcttgacggaggaagcggttccacctcatcctctggctgtcaccctggaggagcaagggccgggccatctcctgcctccagctcccctgctcccggaggtgggcgaagcctgtctgcaggcagccagacctccggcttcagcggctcactgttctctcccgccagctgcagtatcctcagtgggagtagcaaccaacgggaaactgggggcttactcagccccagtacgccatttggcgcttctaatcttttagtaaatcctttggaaccacagaatgctgacaagattaaaattaagattgctgatcttggtaatgcgtgctgggtgcacaagcactttaccgaggacattcagacaagacaatatcgggcggtggaggttcttataggagcggaatacggtccacccgcggacatctggtctacagcctgcatggcattcgagctggccaccggcgattatctgttcgaaccgcactctggagaggattatagcagagatgaggatcacatcgcccacattgtggagctcctgggagacattcccccagcgtttgccttaagtgggagatattcccgggagttcttcaataggaggggcgaactgcgacacattcataatttaaaacactgggggctctacgaggtcctgatggaaaagtacgaatggcctcttgaacaggccacacagtttagcgcattcctgctccccatgatggaatacataccggagaagcgcgctagtgccgctgattgccttcagcatccatggttgaacccctag

SEQ ID NO: 15272 - DNA, 150 bp, Artificial Sequence
  Description of Artificial Sequence: Synthetic coding sequence
atggctggtcccagggtggaggtggatgggtctattatggagggaggtggccagatcctcagggtttccactgctctgagttgcctgttgggacttccactgcgggtgcagaaaatcagggcaggtcgctcgacacctggactgaggtag

SEQ ID NO: 15273 - DNA, 1101 bp, Artificial Sequence
  Description of Artificial Sequence: Synthetic coding sequence
atggccggccctcgggtagaggtggatgggtcaattatggaaggtggcggacagatattgcgagtgtcgaccgccctgtcctgccttctgggcttgccactgcgggttcagaagatcagggcggggcggtccacacctgggcttaggccgcagcacctatccggactggagatgattcgagacctgtgtgacggccagctggagggtgccgagatcgggtccacagagattactttcaccccagaaaagatcaagggcggcatccatacagcagatacaaaaacagcagggagcgtctgtctgctgatgcaggtcagcatgccatgcgtcttatttgctgcttctcccagcgagctgcatctgaagggggggaccaatgcagagatggcaccacagatcgattataccgtgatggtgttcaagccaatcgtagaaaagttcgggtttattttcaactgcgacataaagaccagggggtattaccctaaaggaggcggagaggtgatagtaagaatgagccccgtcaaacagctgaacccaatcaacctgaccgagagaggatgcgtaaccaagatctatggacgggccttcgtggctggagtccttccttttaaggtagctaaggatatggctgctgccgctgtgcggtgcatacgaaaagagattcgggacctctatgtcaacatacagccagtgcaagagccaaaggaccaggcctttggaaacgggaacggaatcattattattgccgaaacctcgactggctgcctctttgctggttcttcactgggaaagaggggggtgaacgctgacaaggtcgggattgaagccgctgagatgttgctcgcaaaccttcgccatggcgggactgtggacgagtatctccaggaccagcttatcgtcttcatggcactggcaaatggcgtgtcacgaattaaaacaggccccgtgaccctgcatacacagaccgctatacactttgccgagcagattgccaaagcaaaatttattgtcaagaaaagcgaggacgaggaggacgctgctaaagatacttacatcatcgagtgccagggcattgggatgaccaatcccaatctgtag

SEQ ID NO: 15274 - DNA, 1155 bp, Artificial Sequence
  Description of Artificial Sequence: Synthetic coding sequence
atggagggcttaggtcgaagttgtttatggctacggcgcgaactgagcccgccacgcccccgactgctgctgctcgactgcagatcgcgggagttgtatgagagtgcgagaataggcggcgccctctccgtggcactacctgcactcctgctgcggagactcagacgaggcagtttgagcgttcgggcgctgttgcccggaccccccctccaaccccccccccctgctccggttctcctctacgaccagggcgggggacgtagaaggaggggagaagcagaggcagaagcagaggaatgggaggctgaatcagttttgggaactttacttcagaaacttcgcgaagagggttatttagcctactacctccaaggcggcttttctaggtttcaagctgagtgcccccacctttgcgaaacctccctggccggccgcgccggttcttcgatggcccccgtgcctggcccggtgcccgttgtagggttggggagcctatgcctagggagtgactgctcagatgccgagtccgaggcagaccgtgatagtatgtcctgcggtctggattccgagggggccacacctcccccagttgggttgagggcgagctttccggtacaaattttacctaatctatatctggggtcagctcgtgacagcgcgaatctcgagagcctcgcaaaactgggaataaggtatatcctgaacgttacacctaatctgccaaacttctttgagaagaatggtgatttccattataagcagattcccatttccgaccattggagtcagaacctttccagattttttccggaggccattgagtttatagacgaggccctgagtcagaactgtggggttcttgtgcactgcctggccggggtcagcagatccgtgacggtgaccgtggcatacctaatgcagaagctgcacctgagcctgaacgacgcgtatgacttggtcaaacgaaaaaaatctaacatcagcccaaacttcaacttcatgggccaactgcttgacttcgaacgatctctgaggctggaagagaggcatagtcaggagcaaggcagcggagggcaggcctctgccgcttccaaccctccctcctttttcacaacgccgacatccgatggcgcatttgaattggcccccacctag

SEQ ID NO: 15275 - DNA, 804 bp, Artificial Sequence
  Description of Artificial Sequence: Synthetic coding sequence
atggccgaaccggttcaggaggagctttcagtcctcgccgcaatattttgccgaccacacgagtgggaggttctcagcaggagtgaaacagatgggactgtgttcagaattcacactaaagcagagggatttatggacgttgacatccctctggagctggttttccatctccccgttaactatcccagctgcttgcccggcatcagtatcaattccgagcagttgacacgcgcacaatgcgtgactgtgaaggagaatctgctggagcaagctgagagcctgctgtccgagcctatggtacatgagttggtactgtggattcagcagaatctgcgtcacatcctgtctcagccagagactggtagcggcagcgagaagtgcacgttctctacctcaacaacaatggatgatgggttatggattaccttattgcacctcgatcatatgagggcgaagaccaagtatgtcaagattgtggaaaagtgggccagtgatctccgactcactggcagactaatgttcatgggcaagattatcctcattctgcttcaaggggatcgaaacaatcttaaagaatacctgatcctgcaaaaaaccagcaaggtcgacgtagactccagtggcaagaagtgcaaggaaaagatgatctccgtcctgtttgaaaccaaagtacaaactgaacataagcgcttcctggcctttgaagtgaaggagtacagcgcactggacgagctgcagaaggagtttgagacagcggggcttaagaagctgttttccgaatttgtactggccctagtaaagtag

SEQ ID NO: 15276 - DNA, 2010 bp, Artificial Sequence
  Description of Artificial Sequence: Synthetic coding sequence
atggctatcgtccagacattgccagttccgctagaacctgccccagaagctgcaaccgctcctcaggctccggtgatgggttccgtgtcttcactgatatccggcagaccatgcccaggcgggccagccccccctcgtcaccacggacctccaggcccaacgttctttagacagcaggatggcttgttacggggcggctatgaagctcaggaacccctgtgccccgctgtacccccccgtaaggccgtaccggttacaagcttcacctatatcaacgaagacttccggaccgagtcccccccctctcccagcagcgatgtcgaagatgcaagggaacagagagcccacaacgctcacctgcgaggtcctcccccaaagctgattccggtgagtgggaagctcgaaaagaatatggaaaagatcctgatacggccaaccgccttcaagccggtgctgccaaaacctagaggggccccgagtctgccaagctttatggggcctcgcgctacaggcctctccggcagccaaggcagccttacgcagctctttggaggcccagcaagctcctcttccagcagctcgtcatcctcagcagcagataaacctctagctttttcaggttgggcctccggatgccccagtgggactctgtctgactccggccgaaattccctgtcctccctgccaacctactcaacaggaggtgccgaaccaactacatcgagcccaggcggccacctgccgagtcatgggtcaggccgaggcgctctgccgggacctgctaggggcgttcccactggccctagccacagcgattccggaaggagcagcagctcaaagagcaccggaagcctcggtggaagggtggctggcggactcctggggtcgggcacacgggcctcccccgacagctccagttgtggggagagatccccccccccgccccccccacccccgtcagacgaagcactgttacactgtgtcctcgagggcaaactccgtgaccgcgaggccgagctgcagcaactgcgggatagtttggatgagaacgaggccactatgtgccaggcatatgaggaacggcaaaggcactggcagcgggaacgggaggcacttagggaggactgcgctgcccaagctcagagggctcagcgtgcccaacaactcctacagctgcaggtattccagctccaacaggagaagagacaattacaggacgactttgcccaattgctgcaggaaagagagcagctcgagagacgctgcgctacattggagagagagcagagagaactgggtcctcggctcgaggaaaccaaatgggaggtgtgtcagaagtctggagaaatatccttactgaaacagcagttgaaagagtcccaagccgagctggtacaaaaagggtctgagctcgtggcactgagagtagccttgcgtgaagccagagctactctcagggtaagcgagggacgcgctcgcggcttgcaagaagccgccagagccagagagctcgagctggaggcttgcagtcaggaactccagagacacagacaggaagccgaacagttacgggagaaagctggccagcttgacgcagaagcagctggactgcgggaaccacccgtgccacctgctactgccgatccttttctgttagcggaatctgacgaggcaaaagttcaacgggccgccgccggggtggggggctcattgcgggcccaggtcgagcgattacgcgtggagctgcagcgtgagcggcggcgcggagaagagcagcgggattcctttgagggcgaacggctggcatggcaggccgagaaggaacaggtaataagatatcagaaacagttacagcataattatatccagatgtaccgtagaaaccgacaactggaacaagaattgcagcaactatctctcgaactagaggccagagagttggctgatctggggctcgctgaacaggccccatgcatatgcctggaggaaatcacagccactgaaatatag

SEQ ID NO: 15277 - DNA, 2010 bp, Artificial Sequence
  Description of Artificial Sequence: Synthetic coding sequence
atggcaatagtgcagactctgcctgtaccacttgaacccgcgcctgaggcggctaccgctcctcaagcccccgttatgggatctgtctcatcccttatcagcggacggccgtgccctggtggtccagctccgccaaggcaccacggaccccccggaccaactttttttcgccagcaggatgggttattacgcgggggttacgaggcccaggagcccctgtgtcccgccgtgccgcccaggaaggccgtccccgtgacctcttttacctatattaacgaagactttaggaccgaatccccacccagcccctccagcgatgtagaagatgctagggagcagagagctcacaacgcccacttgagaggtcccccccctaaacttatcccagttagcggaaagctagagaagaacatggaaaagatcctaatccgtcctacggcgtttaagccagtactcccaaagccaagaggggctcccagtttaccctcctttatgggtcccagagcgactgggctgagtggcagtcagggctccctgacccagctcttcgggggccccgcctcaagctcttcttccagctcaagctcatcagccgcagataagcccctagcattcagcggctgggcgagtgggtgtcccagcggcaccttgagtgatagcggccggaacagcctatcaagtctgccgacgtattccaccggaggagccgagccgaccacttcaagccctggtggtcaccttcccagtcatggtagcggcagaggtgccttgcctggcccagctcgcggagtgccaactggtccatcccacagcgactccggtcggtcctcttcgagcaagtcaactggcagtctcggcgggcgcgtcgccggcggtctgctgggttccggcacacgcgcgtcacctgactcaagctcatgcggtgaacgctctcctccaccccctcctccacctccctctgacgaagctttgttgcactgcgtactggagggaaagctgagagacagggaagcagaattacaacaactgcgcgactctctcgatgagaatgaggcaacaatgtgtcaggcctacgaggagaggcaaaggcactggcaacgagagcgagaggccctgagggaagactgcgcagcccaggcacagagggctcagcgcgctcagcagctcctccagttgcaggtattccagcttcagcaagaaaagaggcagcttcaagacgattttgcacagttgctgcaggaaagggagcagctggaaaggcggtgtgccactctcgagagggagcagcgggagttggggccccggttagaggagaccaagtgggaggtgtgccaaaaatccggcgagatttccctgcttaagcaacagttaaaagagagtcaggccgagttggtccagaagggctccgagctcgtagcgctgagggttgccttgagagaagctagagcaaccctgagggtatctgagggccgtgcccgagggctgcaagaggcggcaagggccagggaactggagctggaagcttgttctcaggaattacagcgacacaggcaagaggccgaacaactgcgggaaaaggcaggtcagttggatgccgaagccgccggactgcgggaacctccagtgccccccgccactgccgatccatttctgctcgctgagagcgacgaggccaaagtgcagcgggctgcggcaggagtaggagggtccctgagagctcaggttgaacggttgagggtggaactgcaacgggagcggagacgcggtgaagaacaacgcgacagcttcgagggggagcgactcgcctggcaggcagagaaagagcaggtcattcgttatcagaagcagctccagcacaactacatacaaatgtatcggagaaatcgacaactggagcaggagctgcagcagcttagtctcgaattggaggcccgcgagctagccgatctaggtctggctgagcaggcaccgtgtatctgtctcgaggaaattactgcaactgagatatag

SEQ ID NO: 15278 - DNA, 1059 bp, Artificial Sequence
  Description of Artificial Sequence: Synthetic coding sequence
atgaagttaaaggagctggagcggccagcagtgcaagcctggagcccggcttcacagtaccccctgtatctggccacaggaacttccgctcagcagctagactccagcttctctactaatggaacccttgagatttttgaggttgactttagagatccgagcttggatctgaagcaccgtggtgtactgtcagctctgtctagatttcacaaactggtgtggggatcctttggatcgggtctcctggagagttccggcgtcatcgtgggagggggcgacaatgggatgttgatcttgtataacgtgacgcacatcttatccagcggaaaggagcccgtaatcgcccaaaaacagaaacatacgggtgcagttcgcgcattagacctgaaccccttccaggggaacctcctggctagtggcgcaagtgactccgagattttcatctgggatctgaataacctcaacgtgcctatgacattgggtagcaagtcacagtaccatgaacaaccacctgaagacattaaggctttaagttggaaccggcaggctcagcatatcctgtcctccgctcatcctagcgggaaagccgtggtgtgggacttgcgcaagaatgaacccatcatcaaagtgtctgaccactccaatcgaatgcattgctcaggcctggcttggcacccagatatcgccactcagctcgtgttgtgctcagaggatgatagactaccagtgatccagctctgggacctgaggtttgccagcagtcctttgaaggtcctggagagccactcacggggtattctcagtgttagttggtcccaagctgacgcagagcttctgcttacaagcgcaaaagactctcagatcctctgccgcaacctcggctcgtctgaagtagtgtacaagctgcctacgcagtctagctggtgtttcgacgtgcaatggtgccctcgagacccgtccgttttttccgctgcttcatttaatggatggattagtctgtatagtgtgatggggagatcatgggaagtgcaacacatgcggcaggctgacaaggtgtag

SEQ ID NO: 15279 - DNA, 3540 bp, Artificial Sequence
  Description of Artificial Sequence: Synthetic coding sequence
atgaagttgaaagagttagaacgtcctgctgtccaagcctggagcccagcgtctcagtacccgttgtatctagccactggcacctcggcccagcagttggactcgagcttctcaacgaacggaacgctggaaattttcgaggtagactttagagatccatcattggacttaaaacaccgaggcgtgcttagtgcactgagtcgatttcacaaactagtgtggggctcctttggcagcggattgttggagagctccggcgtgatagtcgggggcggcgataacggtatgctaattctgtacaatgtgacccatatactgtcaagtggaaaggagcccgtaatagctcaaaagcagaagcacaccggagccgtaagggctctggacctgaatccgttccaggggaatctattagcgtccggagctagcgatagtgaaattttcatatgggacctgaataacctcaacgtccctatgactctgggctccaaatcacagcagcctccggaggatatcaaagctttgtcctggaataggcaggcgcagcacatactgtctagcgcccacccatccgggaaggcggtggtctgggacctgcgaaagaatgaaccaattatcaaggttagtgaccattccaatcgcatgcattgctccgggttggcatggcacccagacattgccactcaactggtgttgtgtagtgaagatgatcggttacctgttatacaactgtgggacctgagatttgcaagttcccctctcaaagttcttgagtctcatagtagagggatcctgtcagtgagctggtcccaggccgacgccgagctcctgcttacgtctgccaaggactcccagatcttatgcagaaacctagggtctagcgaggttgtctataaactgcccacgcagtcgagctggtgctttgacgttcagtggtgcccccgagatccttccgtgttctctgccgctagtttcaatgggtggataagtctctattctgtgatgggcaggtcttgggaggtacagcatatgcgccaggctgataagattagtagctctttctccaagggccagcctctccccccactacaggtccctgagcaagtggctcaggcaccattaatccccccactgaaaaaaccgccgaaatggatcagaaggccaactggagtctcattcgcatttggcggcaagctagtgacatttgggcttccctcaacccctgcccatctggtgccccagccttgtcctcggctcgtgttcatctctcaggtcaccaccgagagcgagtttctcatgaggagcgccgagctacaagaagccctcggcagcggtaacctgctgaactactgccaaaacaaatcccagcaggctcttctccagagtgagaagatgttgtggcagtttctgaaggtcacattggagcaggactcgaggatgaagtttcttaagcttctgggatatagcaaggacgagctccaaaaaaaagtagccacctggctgaagagtgatgtaggtcttggtgagtccccccagccaaaaggcaacgaccttaattcagatcgacaacaagctttctgttctcaagcttcaaaacacaccactaaggaagcttccgcgtcttccgcctttttcgatgagctcgtgcctcagaacatgactccatgggagattcccattaccaaggatattgatggcctattgtcccaggccctacttctaggtgaacttggaccagccgttgagctttgtcttaaggaggaacgctttgccgatgctataatactcgctcaggccggtgggaccgatctactgaagcagacacaagagaggtacctggctaagaagaagaccaagatctcgagcctgctggcgtgtgtagtgcagaagaattggaaggatgtcgtgtgcacctgtagtttaaagaattggcgcgaggccctagccctcctccttacatacagcgggacagagaaatttccagaactctgcgacatgttgggcactcggatggagcaagaaggctcacgcgccctgacatcagaggcccggttgtgctatgtctgttcgggaagcgttgaaaggcttgtagaatgttgggcgaagtgtcaccaggcactgtctccaatggccctgcaggatctcatggagaaagtcatggtgttaaacaggagcttggagcaactgcggggacctcacggggtgagtcccggccctgctacgacgtatcgggtgactcagtatgcaaacctgctagctgcccaaggctccctagcaaccgccatgagtttcctcccccgcgactgcgcccagccgccggtgcagcagctaagagatcgtctcttccacgctcagggatctgctgtgctcggccagcagtccccaccgttccccttccctaggatcgtagtcggcgctacgcttcattccaaggagacctcatcgtaccgtctgggatcccagcccagccaccaggttcccacaccctcccctcgaccccgggtttttacgccacagagttcaccagctatgccactggccccttctcatccctctccataccaaggtcctagaacccaaaacatttctgactaccgagcacccggaccacaggccatccaacctttacccctgagccctggcgtccggccagctagctcacagccccaactcctggggggccagagggtacaggtccctaatcccgtgggctttcctgggacatggcctcttcctggaagccctctacccatggcctgtccgggcatcatgaggccgggttctactagtctgccagagaccccaagactcttcccgctcctgcccctgcgacctcttggtccgggccggatggtttcccacacgccagcccctcccgcttcttttcctgtcccgtacctcccaggagaccctggcgcaccctgtagttccgtgcttcctacgactggaatactgacacctcaccccggacctcaggacagctggaaggaggccccagccccaaggggtaatctccagaggaataaactgcccgagacctttatgccgcccgccccaattacggcccctgtcatgtccttaacacccgagttgcaggggatcctccccagccagcccccagtctcctccgtgtcacacgccccccccggagtgccgggagagctgtcactgcagctgcaacacttaccccccgaaaagatggaacgtaaagaactgcccccagagcatcaaagtttaaaatcatctttcgaggcgctgctgcagaggtgttcactctcagcaaccgatctgaaaactaaaaggaaactcgaggaggccgcccaaaggctggagtatctgtatgaaaagctgtgtgagggcacgctcagcccacacgttgtggctggactgcatgaggtggcccggtgcgtggacgccggttcctttgaacaaggcttagccgtgcatgctcaggtggccggatgcagctcattttccgaagtatccagcttcatgcccatcttgaaggctgtgctgattattgcccataagctgctcgtttag

SEQ ID NO: 15280 - DNA, 1635 bp, Artificial Sequence
  Description of Artificial Sequence: Synthetic coding sequence
atggacgataagggggatccatcaaacgaagaagcacctaaggctataaagcccacctctaaagaattccggaaaacatggggctttaggcggaccacgatagcaaagagggaaggcgccggggatgcagaagcagacccactcgagcctcccccacctcagcagcagctgggcctgagtcttcgtaggagtggtcggcagccaaagcggacagaaagggtggagcaattcttaaccattgctaggcgtcgtggcagaaggagtatgcccgtgtcattggaagactctggagaacccacatcatgtccggccaccgatgctgagaccgcctccgagggcagcgtagagtcagcctcagagacacggagcgggccacagtctgcaagcactgcagttaaagagagaccagcatcctccgagaaggtcaaaggcggcgacgaccatgacgatacctcagattcagattctgatgggctgaccctcaaggagcttcagaacagacttcggcgcaaacgtgagcaggaaccgacagagcggcctctgaaaggaatccagtccagacttagaaagaagcgcagagaggagggccccgccgaaaccgtgggtagcgaagcatccgataccgtggagggagtcctcccatctaagcaggaacccgaaaacgaccaaggagtggtttcacaggctgggaaagatgaccgagaatcgaaattagaaggtaaggcagctcaggatatcaaggatgaagagccaggggatctggggcgtcccaagccagagtgtgaaggctatgatcccaacgcgctgtactgcatatgtcggcagccgcacaacaacaggtttatgatctgctgcgaccgctgtgaggaatggtttcatggggattgtgtaggaataagtgaggcaagaggacgactcctagaacgcaacggggaagattacatttgtcctaactgcacaatcctccaggtgcaggacgagacccattctgagaccgccgaccaacaggaggcaaagtggcgtcccggcgatgcagacggcaccgattgcactagcattggaacaatcgaacaaaagtccagcgaagatcagggaataaaagggaggatagaaaaggctgctaatccttccggaaaaaagaagctcaagatcttccagccagtgattgaagcccccggggcaagtaagtgcattggtcctggctgttgccacgttgctcaaccggacagcgtttattgctccaacgactgcattctgaagcacgcggcggcaacaatgaaatttctttcttctggtaaggagcagaaacccaagcccaaagaaaagatgaagatgaaaccagaaaagccatcattacctaaatgtggcgcccaggctggcattaaaatctcttctgtccataagaggccagctcctgagaaaaaggagactacagtaaaaaaggcagtggttgtcccggcacgctccgaagcactggggaaggaggcagcatgcgagagctctactccctcttgggcctccgaccacaactataatgctgtaaaacctgagaaaactgcggcgccatccccaagcctattgtacaaatgcagtggtaagtactcctactcattgcacccatctctgatcgcttag

SEQ ID NO: 15281 - DNA, 1689 bp, Artificial Sequence
  Description of Artificial Sequence: Synthetic coding sequence
atggatgacaagggagacccaagtaacgaggaggctccaaaagccatcaaacctacctccaaggagtttcgaaaaacctggggattcagacgtaccacgattgccaagagagagggcgcaggcgacgcagaagcggacccgttggaaccacccccgccgcagcagcagctggggctttcgcttaggaggtctggcaggcagccaaaaaggacagagcgtgtggagcagtttctcacgatagcacgaaggcggggaagacgtagcatgccagtcagtctggaagactcaggagaacctacctcctgcccagcaacggatgcagagacggccagcgaaggatccgtcgagtccgcttccgaaaccaggagcggccctcagagcgcttcaacagccgtaaaggaaagaccagcctcatcagaaaaagtgaaggggggcgacgaccatgacgatacctctgacagtgactctgatgggttgacgcttaaggaactacagaatcggcttagacggaagagagaacaggagcccactgagcgacctctgaaaggcatccagtctaggttgcggaaaaaacggcgggaagagggcccagcagaaaccgtgggctccgaagcaagtgacacagtggagggcgtgctgcccagcaagcaggagccagagaatgaccagggtgtcgtgagccaggctgggaaggacgacagggagagtaaactggaaggtaaggccgcgcaggatattaaggatgaagagccaggggatttaggcagacccaaaccagaatgtgagggctacgacccgaacgccctatactgtatctgcaggcagccgcataacaaccggttcatgatctgttgtgaccggtgcgaagaatggttccacggcgactgcgtcgggatctctgaggcccgtggaagattgctcgaaaggaacggcgaagattatatttgccccaattgtacgattcttcaggtccaggacgaaactcatagtgagactgccgatcagcaggaggcaaaatggcgacccggagacgctgacgggaccgattgtacgtctatcggaactatcgaacagaaaagctctgaggaccagggcattaaggggcgcatagaaaaggccgccaatccatcagggaagaaaaagctgaaaattttccagcccgtaatcgaagcccctggggccagcaaatgcataggtcccggatgctgccacgttgctcagcccgattccgtatattgcagcaatgactgtatacttaaacacgccgctgctaccatgaaattcttaagcagtgggaaagagcaaaaaccaaaacctaaggagaaaatgaagatgaagcctgagaagccgtcacttcccaaatgcggggcccaggccggcatcaagatctcctccgtgcataaaagaccggctcccgagaaaaaagaaaccactgtaaagaaggccgtggtggtccccgccaggagcgaggccctagggaaggaagcagcctgtgaatcgtcgaccccaagttgggccagcgatcacaattataacgctgtgaagcccgagaaaacagcagccccatctccaagtctgctttacaagtgtatgtatcacctcggtgtggggctcctggatcccagtcgcagcttctggatcgcgataccttgggcctgcccggggctcggcgtcgccgccctgtgttag

SEQ ID NO: 15282 - DNA, 1689 bp, Artificial Sequence
  Description of Artificial Sequence: Synthetic coding sequence
atggacgacaagggcgatcctagtaatgaagaagcgccgaaagccatcaaaccaacctcgaaagaattcaggaaaacctggggctttcgacgaaccaccatcgccaagcgcgagggagcaggtgatgccgaagccgatcccttagagcctccacctccccagcagcagctcggactttccctccgcaggagtgggagacaacccaagaggacagaacgggttgaacagtttctgaccatcgcaagacggagaggccggcgtagcatgccggtgtccctcgaggattcaggggaacccacctcatgccctgctacagatgctgagaccgctagtgaaggctcggtagaatctgccagtgaaacaagaagcggcccccagtctgcatcaacggcggtgaaggagcggcctgcatcctcagaaaaggtcaaggggggagatgaccacgatgacactagtgacagcgatagcgacggacttacgcttaaagaactgcaaaaccgcctaagacgaaagcgcgagcaagagccaaccgaacggccccttaagggaattcagagcaggcttcgcaaaaaaagaagggaggagggtcccgccgaaacagtcggctccgaagccagcgacactgtagagggcgtcctgccaagtaagcaagagcccgaaaatgaccagggcgtagtgtcgcaggccggcaaggatgacagagaaagcaagctcgagggtaaggccgcccaggatatcaaagacgaagaaccgggcgacctgggcagaccaaagccagaatgcgagggatacgatccaaatgcactctattgcatttgtcgacagccccataataatcggtttatgatctgttgtgacagatgcgaagaatggtttcatggagattgcgtaggaatttcggaggcacgcggccggctgctggaacgcaatggtgaagattatatctgcccaaattgcaccatcctgcaggttcaggacgagacccacagtgaaaccgctgaccagcaggaggctaaatggagaccaggcgacgcagacggtacagactgcacctcaataggcaccatcgagcaaaagagttcagaggatcagggtatcaagggtcggattgaaaaggcagccaaccccagcggaaagaagaagctcaagatcttccagcctgtgatcgaagccccgggagccagtaagtgtattggccccggatgctgccatgtagcccaacccgattcagtttactgttctaatgactgcattctgaaacatgctgccgccacgatgaagtttttgagtagcggtaaagaacaaaagcctaagcccaaggagaaaatgaagatgaagcctgagaaaccatccttgcctaagtgcggagcgcaagccggaatcaaaatatccagcgtacataagcggcctgctcctgaaaagaaggaaactacagtgaaaaaggctgtggtagtgcctgccagaagcgaagccttgggcaaggaggctgcatgcgaatcttccacacctagttgggcctcggaccacaactataatgcggtgaagccggagaagaccgccgcacccagcccgagtctgctgtacaagtgcatgtatcatctcggtgtaggacttctggacccaagtcggtccttttggatagccattccgtgggcctgcccgggactcggagttgccgcactctgctag

SEQ ID NO: 15283 - DNA, 1272 bp, Artificial Sequence
  Description of Artificial Sequence: Synthetic coding sequence
atggaagacaagcgttctttaagcatggcgagatgtgaagaacggaactcccgtgggcaagatcacgggctggagagagtcccattcccgccccagctgcagtccgaaacctacctgcatcctgcagacccttctccagcctgggacgatcctggaagtactggctccccgaatcttcgcctgctgaccgaggaaatcgcctttcaaccactggctgaagaagcctcatttcgcagacctcaccccgacggtgacgtgccgcctcagggcgaggacaatctcctgtcccttccttttccccagaagctttggagattagttagttccaatcaattctcaagtatttggtgggacgacagcggtgcatgcagggtcataaaccagaaactgtttgagaaagagatcctgaagcgcgacgtcgcgcacaaggtgtttgccacaaccagcatcaagagcttttttcgccagttgaatctttatggctttcggaagcggcggcagtgcacattccgcacctttacccgtatattctccgctaaaaggctcgtgtccattctgaacaagctggaattctattgtcatccctatttccagcgggactccccgcacctcctggtaagaatgaagagaagggtgggagttaaatccgccccacggcatcaagaagaagacaagcccgaggccgccgggtcttgtttggcacctgcagacaccgaacaacaggatcacacttccccaaatgagaacgatcaagtaacaccccagcacagagagccagcaggtccaaatacccagattcgtagcggctccgcaccccctgcgactccagtcatggttcctgattccgctgtggccagtgataactcccccgtgacccagccagcaggagaatggagcgagggatctcaggcccacgtgactccggtcgcggctgttccaggtcctgctgccttgcctttcctgtacgtgccaggaagccctacacagatgaattcttacggccctgtagtggctctgcctactgcatcacggagtacgctggccatggacaccacaggactgcccgccccgggtatgttgcctttttgccatctgtgggtcccagtcaccctggtggcagcaggagctgcgcaaccagctgcaagcatggtgatgtttccccacctgcccgctctgcatcaccactgtccccattcccaccgcacctcacaatatatgccagccagtgatgggccacaagcatacccagattatgccgatcagtcaacttag

SEQ ID NO: 15284 - DNA, 675 bp, Artificial Sequence
  Description of Artificial Sequence: Synthetic coding sequence
atgcccacacttttcaaaggggtttggggagtggtggagcactcccgagctttggggcgcttttgcccagcctgcctgccgagtggaccacacctgcacacccagcccgcgttaggcaccgccgagatgacgctcctctcatcccagagctcctcactcgtggccccctctggttccgtatcagccgaaaatcctgagcagcgtatgctcgaaaaaagggcaaaggtaatagaggaactgctgcagaccgaaagggactatataagagaccttgagatgtgtatcgagcggatcatggtgccaatgcagcaggcacaggtgcccaatatcgattttgaggggttattcgggaatatgcaaatggttatcaaagtgtcaaagcagctgcttgccgccctggagatcagcgacgccgtcgggcctgtgttcttgggccatagggatgagttagaggggacctataagatctactgtcagaaccacgatgaggctatcgctctgctcgagatttacgagaaagacgagaaaatccaaaaacatctgcaggattccctggccgatctcaattcactcgtgctgaaaaagggttgcacaaattatatcaaccttgggagtttcctaatcaaacctgtgcaaagagtgatgcgttatcctctgttactgatggaactttag

SEQ ID NO: 15285 - DNA, 1878 bp, Artificial Sequence
  Description of Artificial Sequence: Synthetic coding sequence
atgcgcctgcctgaacgtcacggcggcccccagggcagcctctgcctgatggatccatgttgccccctatctctcgctctacaggatttagtggaacgagattgcaacggagacactcctaacctcagcttctaccggaacgaaatccggttcctgccgaacggctgttttatcgaagacatcctccagaattggaccgacaactatgacctgctggaggacaatcacagttatattcaatggctatttccgctaagggagcccggtgttaactggcatgccaaacccctgactctgcgcgaagttgaggtcttcaagtcttcacaggaaatccaggagaggctcgtcagggcatacgagctgatgttggggttctatgggattagactggaagatagaggaaccggtactgtgggcagagcccaaaactaccaaaagcgctttcaaaacctcaactggaggtctcataataatctacgcattacccggatcttgaagagtctgggtgaactcggactggagcatttccaggcacctttagtcagatttttcctggaggagacgctggtgcgccgtgaactgccgggggtaaggcagagcgccctcgactacttcatgtttgctgtaaggtgtcggcatcaacgaaggcagctggtacatttcgcatgggagcattttagaccccgctgtaaattcgtctggggaccacaagacaagctgagacgctttaagccctcttcactcccccacccgctggaaggctcaaggaaggttgaggaagaggggtctccaggagacccggaccatgaagctagcacgcagggtcggacctgtggaccggagcactctaagggcgggggccgtgtggacgaaggcccgcagcctagaagcgtcgaacctcaagacgccggacctctggaacgctctcagggcgatgaggccggggggcacggtgaggaccgtccagagcctctgtctcctaaagagtctaagaagcggaaactggaactatcccgccgagagcaacctccgaccgagcccggacctcagagtgcgtctgaggtggagaaaatagcccttaacttggaaggctgtgcactgagccaagggagcctgcgtactggcacgcaggaggtgggagggcaggaccctggtgaggccgtccaaccctgtaggcagccgctgggcgccagggtggcggacaaagtcagaaagcgccggaaagtggacgagggggctggtgacagcgctgctgtggctagtggcggagcgcagactcttgccttggccggcagtcccgcaccttcaggccaccccaaagctggacactccgaaaacggcgtcgaggaggacacggaagggcgcaccggccccaaagaaggaactcccggttccccttctgagacccccggaccctcacctgccggaccagccggagacgagcctgccgaaagcccttctgagactcccggccctcggcctgcaggccccgccggtgatgagcctgccgaaagccccagcgaaacccccggcccacggccggctgggcccgctggggatgaacccgctgagagtcccagcgaaactcccggtccttcccctgccggtcccaccagagacgaaccggctgagtctccatctgagactcccggccccaggcctgccggcccagctggagacgagcccgcagagagtccttctgagacaccaggccccaggcccgctgggccagccggtgatgaaccagctgaatcccctagcgagacacctggccctagccctgccggccctacccgggacgagcctgcaaaggctggagaagccgccgagctgcaggacgcggaggtggagtctagcgctaaaagtgggaagccttag

SEQ ID NO: 15286 - DNA, 1386 bp, Artificial Sequence
  Description of Artificial Sequence: Synthetic coding sequence
atggatgatcccgactgcgactccacctgggaggaagacgaggaagatgctgaggatgccgaggacgaggactgtgaggacggagaagcagccggcgctcgtgatgctgatgctggcgatgaggatgaggagtccgaagaaccccgagcagctcgtcctagttctttccagagtcgaatgaccgggtctaggaattggcgggccacccgggatatgtgcaggtaccgccataactaccctgatttagttgagagggactgcaacggagacacacctaatctctcattttatagaaacgagatcagatttctgcccaatggatgttttattgaggacattctacagaattggaccgacaactatgacctattagaggacaaccactcatatatacaatggctgttccctttgcgcgaacccggagtcaactggcatgccaagcctctgacacttagggaagtcgaggttttcaaaagttctcaggagatccaggagcggcttgtgagggcgtatgagctgatgttaggcttttatgggataaggcttgaagatagaggtactggcactgtgggaagggcccagaattatcagaaacggttccagaacctgaattggcggagtcacaataacctccgcattacccgaatactcaagagtctcggcgagctaggcttggagcacttccaggctccactggtgcggttcttccttgaagagaccctggtaaggagggagttgcctggcgtgcgccagagcgcgctcgattattttatgtttgccgttaggtgtcgtcatcagcgaaggcaactggttcacttcgcctgggagcactttaggccccgttgcaagttcgtgtggggcccccaagataagctgaggagatttaagccctcatccctcccacaccctttagagggcagcaggaaggtagaagaagaagggagccccggggaccccgatcacgaagcgtcaacacagggcagaacatgcggccctgaacacagtaagggaggagggagggtcgatgagggcccccagccccgttctgtggaaccccaggacgcaggcccattggaaaggtcccagggcgacgaagcgggtggccatggagaggatagacccgaacccctcagccctaaagaatccaagaagagaaaattagaactgtccaggcgggagcagccccccaccgaaccaggtccgcagtcagcgtccgaagttgagaaaatcgcgctcaatctggaaggctgcgccctgtcccaaggttcactgcgaacagggacacaggaagtcggaggtcaggaccccggagagagctcttgtccctgttgtaggggctggggactgaggagctgttgtggattgccttctggctctgcttcctag

SEQ ID NO: 15287 - DNA, 1539 bp, Artificial Sequence
  Description of Artificial Sequence: Synthetic coding sequence
atgccctctccaagccgatccggacgctctaggtgcctcaaggcaccacggaggtctcggagcggactgagcggtcctactagcagctgctgggcgtcaacaatccgcctggaggatcgcggcaccggcaccgtgggtcgcgcgcagaactaccaaaaacggtttcaaaacctcaattggcgcagccacaacaacctgagaatcacccggattttgaaaagcttaggcgaactgggactcgagcacttccaagcgcccctcgtcagattctttcttgaagagacactcgtcaggagggaattgcccggggttagacagtccgctttagactattttatgttcgcggtgcgttgtcgccatcagaggaggcaattagttcactttgcctgggagcactttagacctcgctgcaaatttgtgtgggggccccaggacaagctgcgacggttcaaaccatcatcattgcctcacccactggagggatcacggaaggtggaagaggaggggagcccaggagatcccgaccacgaagcctctacacaggggcgcacctgcggtcccgaacacagcaagggtgggggtagagtcgatgagggtccccagccccggtctgtcgaacctcaagacgctggcccgctcgagcgctcccagggagatgaggccggcggccacggtgaggatagacctgagccattgagccctaaggagagtaagaaacgcaagcttgaactgtcccgacgcgaacaacctccgactgagcctggcccccagtctgcatccgaggtggagaagatcgccctgaatctcgaagggtgtgccttaagccagggatctctcagaactggtacacaggaggttggtggccaggatcctggcgaggcagtgcagccttgccgccagccactgggcgcccgtgttgctgacaaggttaggaaaaggcggaaagtggatgagggcgccggggatagcgccgctgtcgcttcaggtggagcccagactctggctctggccggaagccctgctcctagtggccatcctaaagcaggtcactccgagaatggtgtggaagaagacaccgaaggtaggacaggcccaaaggagggcacgcccggctctccatccgaaactcctggtccatctcctgctgggccagcaggagatgagcctgcagaaagccctagcgagactcccggcccccggcccgctggaccggcgggagatgagccagctgagtccccctctgagactccaggaccgagtccagctggcccaacccgggacgagcccgccgagtctccttccgagacccccgggccacgtccagccggacctgcgggagacgagcctgctgagtccccctccgaaaccccggggcctcggcccgccggcccggccggagatgagcctgctgaaagcccctccgaaacgcccggaccgagccccgccgggccgacccgggacgagccagcaaaggccggagaagctgctgaactacaggacgccgaggtggagtcctcggcgaaaagcggaaaaccgtag

SEQ ID NO: 15288 - DNA, 312 bp, Artificial Sequence
  Description of Artificial Sequence: Synthetic coding sequence
atgggacagcaaagttccgtgcgccgcctcaaacggagtgttccctgtgagagcaatgaggcaaatgaagccaacgaagcgaataagaccatgcccgagacccctacaggtgatagcgacccccagcctgccccaaagaagatgaagaccagcgagtcctccaccattctcgtcgtgcggtaccggcgcaatgtgaaacgaacatcccccgaagagttggtgaatgaccatgctcgggaaaatcgtattaaccccgatcaaatggaggaagaagaattcatcgagatcacgactgaaaggccaaaaaagtag

SEQ ID NO: 15289 - DNA, 1776 bp, Artificial Sequence
  Description of Artificial Sequence: Synthetic coding sequence
atggagaaagccgtgaacgatgggtctcactcagaggagctgttttgtcacctcaagacgatttctgaaaaggaagacctgccccggtgtacctccgagtcacacttatcttgtctgaaacaagacattctaaacgaaaaaactgagctggaggctactcttaaagaggctgagctggtaacccactctgtggagctgctacttcctctttttaaagacaccattgaaaagataaactttgaaaatgctaacctgtcagccctcaacttgaagatcagcgaacaaaaagaaattctgataaaagaattggatactttcaaatcagtcaagctcgctctggagcacctgcttcggaagagagactataagcagactggggacaacctcagctccatgcttctagagaatctgaccgataatgagagcgaaaacaccaacctcaagaaaaaggtattcgaaaaggaagcccacattcaggagctgagttgcttatttcagtctgaaaaggcaaacactttgaaagcaaacaggttctcccagtccgtgaaggtggtgcatgagcgtctccagatccaaattcacaagcgggaagccgaaaatgataagctcaaggaatacgtgaagagtctggagactaaaatcgctaaatggaacctccagtcccgaatgaacaaaaacgaggcaattgtgatgaaggaggcctcacgacagaaaaccgtggctctgaagaaggcgtccaaggtgtacaaacagagactggatcacttcacaggtgcgattgaaaagcttactagccagataagggaccaggaggctaagttaagcgaaactatctccgcctctaatgcatggaaatctcactatgagaaaattgttatcgaaaagacagagcttgaagtgcagatcgagactatgaaaaagcagatcatcaatttactagaggaccttaaaaagatggaggaccatgggaagaatagttgtgaagaaatcctcagaaaagtccactcaatcgaatacgagaatgagacattgaacctcgagaacactaagctgaagactacactggccgccctcaaggatgaggtagtgtccgttgaaaacgaactgtcggaactgcaggaagtcgagaagaagcaaaagacactcatcgagatgtataagactcaggtgcagaaactgcaggaggcagccgagattgtgaaatcacgatgcgagaatttgctgcacaagaacaatcaaattacaaagactaagaataagaatgtcgagaaggtggacggcaaccacaatcttctgacaaaactctctctcgaggaggaaaactgccttatccagctgaagtgcgaaaacctgcaacagaagctcgagcaaatggacgccgaaaacaaggagcttgaaaaaaaactggctaaccaagaggaatgcctgaaacacagcaacctgaaatttaaggagaaatcagccgagtatacagctcttgctagacaactggaggccgccttagaagaagggcgacagaaggtggctgaagaaatcgagaagatgtcttcccgtgaatcagcgctgcaaatcaagatcttggatctggagaccgaactccgtaagaaaaatgaggaacagaatcagctggtgtgcaagatgaacagcaaagcccagcaccaggaggtgtgcctcaaggaagtacagaattccctcgagaaatccgagaaccagaatgagtctattaagaactacctgcagtttctgaagacttcctatgttacaatgttcgagtag

SEQ ID NO: 15290 - DNA, 1935 bp, Artificial Sequence
  Description of Artificial Sequence: Synthetic coding sequence
atggagaaggccgtgaatgacggatcccacagcgaggagcttttctgtcacctgaaaacaatcagcgaaaaggaagaccttccaagatgtacctctgaaagccacctgagctgcttaaagcaggacattctgaatgaaaagaccgagttggaggcaaccttgaaagaggcagagcttgtcacccatagcgttgaacttctgctaccactgtttaaggacacgattgaaaaaattaacttcgaaaacgcaaacctttcagccttgaacctgaagatatccgagcaaaaggagatcctaatcaaggaattggatacctttaaaagcgttaagttggctctagagcacctgctgcgcaagcgcgactacaagcagaccggtgacaacttatcatccatgctacttgagaacctaacggacaacgaatccgaaaacactaatttaaagaaaaaggtgtttgagaaggaggctcatatccaggagttatcttgcctgtttcagtcggaaaaagccaacacactgaaagccaatcgcttttcgcaatccgtaaaggtagtccatgagcggcttcagatccagatccataaaagagaagcagagaacgataagctgaaggagtatgtgaagagccttgagactaaaattgcaaaatggaatctccagagcaggatgaataaaaatgaagcgattgtgatgaaagaagcctcacggcagaaaacagtcgccctgaagaaggcgtcaaaggtctataaacaacggttggaccatttcaccggggccatcgagaagcttacctcccaaattagagatcaggaagccaagctctcggaaaccatctctgctagcaatgcctggaaatcacactatgaaaaaattgtcatagagaagaccgagctagaggtccaaatcgagactatgaaaaagcagatcataaacctccttgaggatctcaagaagatggaggatcacggaaagaactcatgtgaggaaattcttaggaaagtgcactctatcgaatacgaaaacgaaactcttaatcttgagaacacaaagctcaaaacgacgcttgcggcgttgaaagacgaagtcgtcagcgttgaaaatgaactatctgagctacaagaggtggagaagaaacagaagaccttgatcgaaatgtacaagacccaggttcagaagctccaggaagcagcagaaatagtgaaaagcaggtgcgaaaacctcctgcacaaaaacaaccaaattactaagacgaagaacaagaacgtggaaaagatgaggggacaaatggaatcccacttaaaggaactggaaagggtttgtgactctcttacagccgccgagcgcaggttgcatgagtgccaggagtctctgcaatgctgcaagggaaagtgcgccgaccaagaacatacgatccgcgagctgcaggggcaagtcgacggtaatcacaatctgctcacaaagctcagcctggaagaggaaaactgcctgattcaactcaagtgcgaaaacctacagcagaagcttgagcaaatggacgcagagaacaaagagttggaaaagaagctcgccaaccaagaggaatgcctcaagcactctaacctcaagttcaaagaaaaaagtgccgaatacaccgctctcgcacggcagttagaggcggccttagaggaggggagacagaaggtggctgaagaaatcgaaaagatgtcttcacgtgagtccgctctgcagataaagatcctcgacttggagactgagcttcggaagaaaaacgaggagcagaatcagcttgtgtgcaaaatgaattcaaaggcccaacaccaggaagtatgtctcaaggaggttcaaaactcactggagaagtcagagaaccagaatgagagcatcaaaaactaccttcagtttttgaagactagttatgtaacaatgtttgaatag

SEQ ID NO: 15291 - DNA, 2526 bp, Artificial Sequence
  Description of Artificial Sequence: Synthetic coding sequence
atgatggctgacggggccgccgcaggagccggggggagcccaagcctcagagaactccgcgccaggatggtggctgcagcgaacgaaatagccaaggaaagaagaaaacaagatgtagtgaacagggttgcaacccactccagcaatatcagatctaccttcaagcccgttattgatgggtcaatgctgaagaacgatattaagcagcgcctcgctagagagaggagggaggagaagcgccgccagcaggatgcgaacaaggaaacacagctgctggaaaaggaacgcaagacaaagctgcaatatgagaagcagatggaagagaggcagcggaagctcaaagaacgcaaggagaaggaggaacaaagaaggatcgcagctgaggagaagcgccaccagaaagatgaggcccaaaaagagaagtttactgctatcttgtacaggacactagagaggcgacgactggccgatgactaccagcagaagcggtggagttgggggggaagcgccatggccaacagcgagtctaaaaccggcaagacagataaggagcgcagtagcagtttaaatcggagagactcaaacctccatagctctaccgataaggaacaagctgagcgcaagccccgggttacaggggtgaccaactatgtgatgcagtatgttacagttcccttgaggaaatgcaccagcgacgaactgagagcagtgatgttccccatgtcaacaatgaagattccacctcagactaaagtcgaagagtcccctctggaaaaggtcgagacacctccaaaagccagcgtcgatgctccccctcaagtgaatgtggaggtattctgcaacaccagcatggaagccagtcccaaggcaggcgtcgggatggcaccagaggtgtcaaccgattcctttcctgttgtgagtgtagacgtttcaccggtggttagcacgtatgatagcgagatgtctatggacgccagccctgagttgtccattgaagctctccctaaggtagatttggaaaccgttccaaaggtgtctatagtggcttccccggaggcatccctcgaggccccccctgaggtgagcttggaggccctcccggaagtgagtgtggaagccgctcccgaggggagccttgaggcccctccgaaggggtcagccgaggtagcccctaaggaaagcgtgaaaggaagcccaaaggagtctatggaagccagtcctgaagccatggttaaggcttccccaaaaacgtcgcttgaagcaagcatggaagccagtcccaaggcaaaggcccgtgacgctcccaaaaagtccgaaatggacaaacaagcactcatccctattgcaaagaagaggcttagctcctatacagaatgctacaagtggtcctccagccccgaaaacgcatgcggcctgccctcccctatcagcaccaataggcagatccagaaaaattgtcccccaagccctctccctttgatcagtaaacagtccccacagacatcatttccctacaagataatgcccatccagcataccttgtctgtgcaaagcgcctcttccaccgtgaagaaaaagaaagagaccgtatccaaaactactaaccgatgcgaggcactctcacaacggcacatgatttatgaggaatcaggcaacaagtcgaccgcagggatcatgaatgcggaagccgcaactaagatactcactgaactccgtcggctggccagggaacagcgcgaaaaggaggaggaggaacggcaaagggaggaaatgcaacaacgggtgataaagaagagtaaggacatggccaaggaggcagtaggcggccaggctgaagaccatctgaaactaaaggacggacagcagcagaacgaaacgaagaagaagaaaggctggctggaccaggaggatcaagaagccccgctgcagaagggggatgccaaaattaaggcccaagaagaagcggacaaaagaaaaaaagaacatgagcgtattatgctccagaatctgcaagaacgcctcgagagaaaaaaaagaattgaggagatcatgaagagaacccggaagacggacgtgaatgctagtaaggttaccgaaacatccagtcatgatatttatgaggaagcggaggctgataacgaagagtccgataaggacagcctaaacgaaatgttcccctcagccatcctgaatggtacaggaagtcctactaagttcaagatgccatttaataacgctaagaaaatgacccataaactggtcttcctcgaagatgggaccagtcaggtgcggaaggagcccaaaacatacttcaacggcgacctcaaaaatttcaggcagaaatccatgaaggatacaagcatacaagaagtcgtcagtaggcccagttctaaaagaatgacgagccatacgactaagacacgcaaggctgacgagaccaatactacctctcgctccagcgcgcaaactaagtctgagggattccatgacattcttccaaagtcatctgacacatttcggcagtag

SEQ ID NO: 15292 - DNA, 2577 bp, Artificial Sequence
  Description of Artificial Sequence: Synthetic coding sequence
atgacaagcccccgcgtggcggctgcaaatgagatcgcgaaggagagacgcaaacaagacgttgttaacagggtggcgactcacagttccaacatccgctccactttcaaacctgtaatcgacggaagtatgttaaaaaatgacattaagcagcggctcgctcgagaaaggagagaggagaaaagaaggcagcaggatgccaacaaagagacacagctgctcgaaaaagaacgaaagacgaaattgcaatacgaaaagcagatggaagagcgccagcgtaagttgaaagaaaggaaggagaaggaagagcagcgacggattgccgcagaggagaagcggcaccagaaggatgaggcacagaaagaaaaattcaccgccatactgtatcggacactggaacgcaggcggctggccgacgactatcagcagaagaggtggagctggggaggaagtgcgatggcaaactcagaatccaaaaccgcaaataagcggagcgccagcactgagaaattagagcagggaacgagtgccctcatccgacagatgcctctatcaagtgctggtctccagaactcagtagccaaacgaaaaacagataaagagaggagctcaagcctcaacagaagagatagcaatctacactcatccaccgataaagagcaggctgaaagaaaaccacgagtgaccggggttactaactatgtaatgcagtatgttacggtcccactccgcaagtgcacctctgacgagcttcgcgctgtgatgttccctatgtccacaatgaagataccacctcagaccaaagtcgaggagtcgccgctggagaaagtagagaccccccctaaggcttcggtagatgccccgcctcaagtgaacgtggaagtgttctgtaacactagcatggaggcctcccctaaagctggagttggaatggcaccagaggtttctacggatagttttccagtggtaagtgtagacgtctcgccagtcgtgtcaacctatgacagtgagatgtctatggatgcttcacccgagctgtccattgaggctctgcccaaggtcgatctggagaccgtccccaaggtaagtatcgtggcatccccagaggctagtttggaagcccctcctgaagtgtccctcgaagccctccccgaggtatcagtggaggctgctcccgagggctccttagaagccccccccaaagggtctgctgaagtcgcaccaaaggagtctgtgaaggggtctcctaaagagagtatggaggcctccccggaggcaatggtcaaggccagccctaagacttcgctggaggcctccatggaggcctctcctaaagccaaggcacgagatgcccccaagaagagcgagatggataagcaagcgctgataccaatagccaagaaacgactgtcctcctacaccgagtgctataagtggagtagctctccagagaacgcctgtggattgccgagtccaataagtacgaatcgccagatccagaaaaattgccctccttcaccactgcccctcattagcaaacagtctcctcaaaccagcttcccctataagatcatgcccatccaacatactttatcagtacagagtgcttccagtaccgtgaaaaaaaagaaagaaacagtgtctaagaccaccaaccgttgtgaagcactttcccagcgccatatgatctatgaagaaagcggcaataagtccacagctggtattatgaatgccgaggcagccacaaagattctgacggagctgcgccgtctggccagggaacagcgagagaaagaggaggaggagaggcagcgcgaggagatgcagcagcgggttatcaagaagtctaaagatatggcaaaggaggcagttggcggacaggctgaggatcacctgaaactgaaagacggccagcagcaaaacgagacgaagaagaagaaggggtggctcgatcaggaggaccaggaagcccctctccagaagggggacgctaaaattaaagcacaggaagaggctgataagagaaaaaaggaacacgagcgtatcatgctgcagaatctgcaggagcgcctagaaaggaaaaagaggattgaagaaataatgaagcgcactaggaaaactgacgtgaacgcgtccaaagtaaccgaaacctccagccacgacatatacgaagaggccgaggctgataacgaagagagtgataaggactcactgaacgagatgttccctagtgccatattaaacgggaccggctctccaacaaaattcaaaatgcctttcaacaacgcgaaaaaaatgacccataagctggtcttcctggaggatggtacttctcaggtgcgaaaggaaccaaaaacatattttaacggggacctgaagaactttagacaaaaatcaatgaaggacacttcaattcaggaggtggtctcccgtcctagttccaagcggatgacttcccatacaacgaagacccgaaaagccgacgaaaccaacacaaccagcaggtcatctgcccagaccaaaagcgaaggttttcacgatattctgcctaaatcaagcgataccttccgccagtag

SEQ ID NO: 15293 - DNA, 948 bp, Artificial Sequence
  Description of Artificial Sequence: Synthetic coding sequence
atgcctctgaagctgcgaggaaaaaaaaaggctaagtctaaggaaactgcaggactggtcgagggggagccaaccggagccggcggtggttcactgtccgcttctcgtgccccggctagaagacttgtgttccacgctcagctggcccatggcagtgctaccgggcgtgtggagggattcagttccatccaagaactgtatgcccagatcgccggagccttcgaaatctcaccttctgagattctgtattgtacactgaacacccctaagatcgatatggaacgactgttaggcggacagctgggtctggaagacttcattttcgcccacgtgaaaggcatcgagaaagaggtgaacgtctataagagcgaagactcactgggtctgaccatcactgataatggtgtcgggtatgcttttattaagcggattaaggacggcggtgtcattgattctgtcaaaacgatttgcgtgggggatcacatagagtcgatcaatggcgagaacattgtgggctggcgtcactatgatgtggcaaaaaaattaaaggagctcaaaaaagaagaactatttactatgaagctgatcgagcctaagaaagctttcgaaatcgaactccgtagcaaagctggcaagagttcaggcgagaagataggatgcggtagggccacgcttcgtcttcgcagtaagggcccagcgacagtggaagaaatgccaagcgagactaaggccaaggccatagagaaaattgacgacgtgctggagttatacatgggcattcgcgatatagaccttgcaacgacgatgtttgaggcaggtaaggacaaagtaaacccagatgagtttgctgtggcccttgacgaaacacttggggattttgcgtttcccgatgagttcgtcttcgatgtgtggggagttattggggacgccaaacggcgcggtctgtag

SEQ ID NO: 15294 - DNA, 2487 bp, Artificial Sequence
  Description of Artificial Sequence: Synthetic coding sequence
atgacggggagcaattcccatatcaccatcctgaccctgaaagtcttacctcatttcgaatccctgggcaaacaggaaaagattccaaataagatgagcgcatttcgcaaccactgcccgcacttggactcagtgggtgaaattacaaaagaggacctcatacagaaaagcctcgggacctgccaggactgcaaagtgcaggggcccaatctgtgggcctgcttggagaatcgatgttcatatgtgggctgtggggaaagtcaggtcgaccactctaccatccacagccaggaaacaaagcattatctgaccgtcaacctgactacactgagggtttggtgttatgcctgttccaaggaagtttttctggatagaaaattaggaacccagccgagtttaccccacgtgaggcagcctcaccaaatccaggagaactcggtgcaggatttcaagataccctccaatacaactctgaagacccccctggtggcagtctttgatgacctggatattgaggcagacgaagaggacgagctgcgcgccagaggcctcactggcctgaaaaatatcgggaacacatgttatatgaatgccgcactgcaggccctgtctaattgccctccccttacccaattctttctggactgtggcggtctcgctagaactgacaagaagcccgcaatctgcaagtcttacctgaaattaatgaccgagctgtggcataagagtcgtcccggttctgtggtgcctaccactctgtttcaggggattaaaacggtcaaccccacattccggggctactcccagcaggacgcccaggagttcctcagatgcctgatggatctgctgcacgaagagctcaaagagcaagtgatggaggttgaggaagacccacagacaatcactacggaagagactatggaggaggacaaaagccagtctgacgtggacttccagagttgtgagtcctgctccaattctgatcgtgccgagaacgaaaacggctccagatgctttagcgaggacaataatgagacaactatgttaattcaggatgacgagaacaattctgagatgtcaaaggattggcaaaaagagaagatgtgcaacaaaattaataaagtgaactctgagggcgaattcgacaaggatcgtgattccatctccgagacagtcgacctcaacaaccaggagactgtcaaggtccaaattcattctcgagcgtccgaatacattactgatgtgcactccaatgacctcagtaccccacagatactgccaagcaacgaaggcgtcaaccctcggctctctgcaagtccaccgaaaagtggcaacctgtggccaggcctcgccccgccccacaagaaagctcagagcgcatcccctaagcgtaaaaagcagcataagaagtacaggagcgttatttccgatatatttgacggtacgattatcagctcagtgcagtgcttaacgtgcgaccgggtgtctgtgactttggagacatttcaggatctgagcctaccgatccctggaaaggaagacctcgcaaagcttcactcgtcctctcatccaacatctattgtaaaagccggcagctgcggcgaggcatacgccccacaggggtggatcgccttcttcatggaatacgtcaaaagctggttctggggacccgtcgtgaccttgcaggattgcctcgccgctttctttgcacgtgatgagttaaaaggcgacaatatgtactcctgtgaaaagtgtaagaaactaagaaatggcgtgaaattctgtaaggtgcagaactttccagaaatcctgtgcattcatctcaaacggtttcgacacgaactcatgttcagcaccaagattagtacccatgtctccttccctctggaaggcctcgacctacaaccattcttagctaaggactcacctgcacagatagtcacctacgatttactctcagttatttgtcaccacggcactgcctcctcagggcactacatcgcgtactgccggaacaacttaaacaatctgtggtacgagttcgatgatcagagtgtcactgaggtgtctgagtctactgtgcagaacgcagaagcatacgtactattctataggaaaagtagtgaagaagcgcagaaggaaaggcgaagaatctccaatctgttaaacattatggagccaagtcttctgcaattttacatcagtcgccagtggctcaacaaattcaaaacttttgcagaaccgggaccaatttccaacaatgacttcctgtgcattcacggcggagtcccacctaggaaggctggttatatcgaggatttggtcttaatgctcccccagaatatctgggacaacttatactcaaggtatggcggtggacctgctgtgaaccatttgtatatatgtcatacttgccagatcgaggccgaaaaaatcgagaagcgaagaaagactgagctggagatcttcattagggttaagaagtag

SEQ ID NO: 15295 - DNA, 2829 bp, Artificial Sequence
  Description of Artificial Sequence: Synthetic coding sequence
atgacagggtccaatagccacatcactattctgacactgaaggtgctgcctcacttcgagagtctcgggaagcaggagaagatcccaaacaagatgtccgccttcagaaaccattgtcctcacctcgatagtgtgggtgagatcacaaaggaggatttaattcaaaaatcactgggcacttgccaggactgtaaggtccagggaccaaatctttgggcttgtctggaaaacaggtgctcctatgtaggatgtggggagtcccaggtggatcatagcacaatccactctcaggagaccaagcattatctgaccgtgaatctaactactttacgagtatggtgctacgcttgcagcaaagaagtatttcttgacagaaagctcggaacgcagccgtccctgccacatgtgagacagcctcatcaaatacaggaaaacagtgtacaggacttcaagatcccttcgaacactacactgaagacacccctggttgctgtatttgatgaccttgacatcgaagctgatgaagaggacgagctccgggcaaggggccttactggactaaaaaacatcggaaatacctgctatatgaacgccgcgttgcaggccttgagcaactgcccccctttaactcaattttttctcgactgtggagggctcgcccgcactgacaagaagccagctatctgcaagtcgtatttaaagctcatgaccgaactttggcacaagtccagacccggcagcgtggtgcctacaaccctgtttcagggtatcaaaacagtcaatccaacgtttcggggatattcacaacaagacgcccaggagtttctaaggtgcctcatggacctgcttcacgaggagctgaaggaacaggttatggaggtcgaagaggatccccagaccatcaccactgaggagactatggaagaagacaaatcgcagtccgatgtggattttcagagctgcgaaagctgtagcaactcggaccgagccgagaatgagaacggcagtagatgtttctccgaggataataatgagacaacaatgctgatccaagatgatgaaaacaatagtgagatgagcaaagactggcagaaggagaagatgtgcaacaagattaataaggtgaatagcgagggcgagttcgacaaagaccgtgactccatctctgaaaccgttgatctgaacaatcaggagacagtcaaagtccagattcattcccgcgcctctgagtatatcacagatgtgcacagcaacgatctctccaccccacagattctgccttcgaatgagggggtgaaccctaggctgtctgcctctcctcccaagtccggcaacttgtggccaggactggctcctccacataaaaaggcccaatccgcctctcctaaaagaaagaaacaacacaagaagtataggtccgtcattagcgacatttttgacgggaccataatctctagcgtccagtgcttgacctgcgatagggtcagtgtgaccttagagaccttccaggacctgtccctacccattccaggcaaagaagacctcgcaaaactccatagctctagccaccctacaagcatcgtgaaggccggctcatgtggggaagcatatgcaccacaggggtggatcgcattcttcatggaatacgtgaaacgattcgttgtctcctgcgtacctagctggttctggggtccagtggtcaccctccaggactgcctcgccgccttctttgcccgagacgaactgaaaggtgataacatgtacagctgcgaaaaatgcaagaagctacggaacggggtgaaattttgcaaggtacagaacttcccagagatcttatgcattcatctgaaaagatttcgccatgagctcatgtttagtacaaagatttccacccacgtctcctttccactcgagggcctcgacctacaaccgttcctggcaaaagacagcccagcacaaatcgtcacctacgacttgctttccgtcatctgtcaccatggtactgcttccagtgggcattacatcgcttactgtcgaaacaatctgaacaatctgtggtatgaatttgacgaccagtctgttaccgaagtcagcgagtcaaccgtccagaatgctgaagcttacgtgctgttctatcgaaaatcctcagaggaggcccaaaaggaaagaagacggatcagtaatcttctgaatataatggagccttctctgctgcagttttacatatcaaggcagtggctgaataaatttaagacttttgccgaacctggcccaatttctaacaatgacttcttatgtatccacggaggcgtgccacccagaaaagcgggatatatcgaagatctagtgctgatgttaccgcagaacatttgggacaacctgtattccagatatgggggtgggccggccgttaatcatctgtacatttgccatacctgtcaaatcgaggcagagaagattgaaaagcgacgaaagactgagcttgagatctttatcaggctgaaccgggcatttcagaaggaggactcacctgccaccttttactgtatttcgatgcagtggttccgggaatgggaaagcttcgtgaaagggaaagacggtgatccacctggccccatcgataacactaaaattgctgtaactaagtgcgggaacgtgatgctgcgtcagggcgcagattccgggcagatcagcgaggaaacctggaactttctccagagcatttacggtggaggcccagaggttattcttagaccacccgtggtacacgtcgaccctgacatcttacaagcagaggagaagattgaggtggaaacacggtcactctag

SEQ ID NO: 15296 - DNA, 2736 bp, Artificial Sequence
  Description of Artificial Sequence: Synthetic coding sequence
atgtctgcatttagaaatcactgcccccacctggacagcgtaggtgagataaccaaggaagacttgatacaaaaaagcctgggcacatgtcaggattgcaaggtgcagggccccaacctgtgggcctgcctcgagaatcggtgcagctacgtcggttgtggggaatcccaggtagatcactctactatacatagccaagagactaaacactatttgaccgtaaatcttacaacacttagagtgtggtgctacgcatgctcaaaggaagtgtttttggatcgcaaactcggcacacagccaagtcttccacacgtgagacaaccgcaccaaatccaggagaacagtgtccaggacttcaaaattcccagcaacaccacactcaagactccgttggtcgccgtattcgatgacttggacattgaggccgacgaggaagatgagcttcgggccagggggctcactgggctaaagaacattggcaatacttgttacatgaacgctgccctccaggctctcagcaattgccctccattaacacagttttttttggactgcgggggcctagctagaactgataaaaaaccggcaatctgcaaaagctatcttaaactcatgaccgaactctggcataagtctcggccagggtcggtcgttccaacaaccctcttccaaggcatcaaaacagttaaccccacattccggggatattcccagcaggacgcgcaggaattcctgcggtgtctgatggatctgctgcatgaagagctcaaggaacaggttatggaagtggaagaagatcctcaaactattacaacagaggagaccatggaagaggataagtctcagtctgatgtagatttccagtcttgtgagtcttgctccaatagcgaccgggccgaaaacgagaacggaagccgttgctttagcgaggacaacaacgagacaactatgctgattcaggatgatgagaacaactctgaaatgagtaaggactggcagaaagaaaagatgtgtaacaagatcaataaagttaattccgaaggggagttcgataaagatcgggattcaatctccgagaccgtcgacctgaataaccaggaaacggtgaaggtgcagatacactctagggcttccgagtacataaccgacgtgcatagtaacgatctgtccacacctcagatcttgccatccaacgaaggggtcaacccgcggctttccgcgtctcctcctaagtctggtaacctgtggcctgggctagctccaccccataaaaaggcccagagcgcctctcctaagcgcaaaaagcagcataagaagtaccggagtgtcattagtgacattttcgatggcaccattatatccagcgtgcagtgcctcacctgcgaccgcgtgtccgtcaccctggagacattccaggatttatcgttgccaataccgggaaaagaggacctggccaagttgcattcatcatcacaccccacatcaatcgtgaaagccggttcatgtggggaagcttatgcccctcagggctggattgcattcttcatggagtatgtgaagcggtttgttgtgagttgcgtgccaagctggttctggggtccagtggtgaccctacaggattgtcttgctgcgttttttgcccgtgatgagctaaagggcgataacatgtacagctgcgagaagtgcaaaaagctccgcaatggagtgaagttctgcaaggtgcagaactttcctgaaatcctctgcatccatctgaagagatttcggcacgagctcatgttcagcacaaaaataagcacccacgtcagttttcctctcgagggacttgatttacagccgtttctagcaaaagactcccccgcacaaatagtgacatacgacttactatctgttatttgccaccacggcaccgctagcagcggccactatatagcctactgccggaataacctcaacaacctgtggtatgagtttgacgaccagagcgtgaccgaggtcagcgaatccactgtccaaaacgctgaggcttacgtattattttaccgcaagtccagcgaggaagcgcagaaggagagacggcgcatttccaacctgctcaacattatggagccctcactcttacagttctatatttctagacagtggctgaacaagttcaaaactttcgctgaacctggtcctatctccaacaatgattttctttgcatacatggcggcgtgccgccccgtaaggccgggtacatagaagatctcgtcctgatgctgccacaaaatatttgggataacttgtattctcgctacgggggtggtcctgccgtaaatcacctctatatctgccatacatgtcagatcgaggccgagaagattgagaaaagaagaaagactgaactggaaatcttcatacgactcaatagggcttttcagaaggaggattcccccgcgacgttctactgcatatccatgcagtggtttcgggagtgggagagcttcgtgaagggcaaagatggcgacccacctggccccatcgacaacactaagatcgcagtgaccaagtgcggaaatgtcatgttgagacagggagcagactcaggccaaatcagcgaggagacttggaatttcctgcagagtatctacggaggtgggcctgaggtaattctgagaccgcccgtagtccacgttgatcccgatatcttacaggcagaggagaaaattgaagtggagacccggtcactgtag

SEQ ID NO: 15297 - DNA, 465 bp, Artificial Sequence
  Description of Artificial Sequence: Synthetic coding sequence
atggctcctcccgttagatactgcatcccaggagaacggctttgtaacctggaggagggatccccggggtcaggaacttacacacgccacggctatatattctcatccctcgcaggctgtctcatgaagagcagcgaaaacggggcattgccagtggtctctgtggttagggagacagagtctcagctgttgcccgacgttggcgccatcgtgacttgcaaggtggagatatacaaatctttcaggccgggagacattgtgttggctaaggtaatttccctgggagacgcccaatccaactacctgttaactaccgctgaaaacgagcttggcgtagttgtcgctcactcggagtccggcattcaaatggtgcccatcagttggtgtgaaatgcagtgccctaagacacatacaaaggaatttcgtaaggtggcacgggtgcaaccagaattcttgcaaacctag

SEQ ID NO: 15298 - DNA, 513 bp, Artificial Sequence
  Description of Artificial Sequence: Synthetic coding sequence
atggcccctccagtgaggtactgtatcccaggagagcgcctgtgtaacctggaggagggatcaccaggaagcggtacgtacacacgacacggatacattttctcaagcctggctggctgtcttatgaagtcatctgagaacggtgcagtgtctagcatcaattcccggttcgcaaaagtccatatcttatacgtaggatcaatgcctctgaaaaactcattcaggggcacaataagaaaggaggatgtcagggccactgaaaaagacaaagttgagatttataaatccttcaggcctggcgacatcgttttggccaaagtgatcagtttgggcgacgcacagagcaactacctgttaaccaccgccgagaatgaactcggagttgtggttgcacattccgagtcaggaatacagatggtgcccatcagctggtgcgaaatgcagtgtcctaagacacacaccaaagagttccgcaaagtagctagagtgcagcccgaattcttacaaacatag

SEQ ID NO: 15299 - DNA, 537 bp, Artificial Sequence
  Description of Artificial Sequence: Synthetic coding sequence
atggctcctcccgtacggtattgcattccaggtgagaggctgtgcaacttagaggaaggatctcctggatctggaacatacacacgccatgggtatatcttcagtagcctggcaggttgtctgatgaagagctctgaaaacggggctttgcctgtggtctccgtcgtgcgggaaacagagagtcagctcctcccagatgtcggagctatagtgacctgtaaggtgtccagtatcaattcacgtttcgccaaagtccacatcctttacgtcgggtcaatgcctctgaagaatagttttagaggaaccattcgtaaggaggatgttcgagcaaccgaaaaagacaagatttctctgggtgacgcccagagtaactatcttctgacgacagcagagaacgagttgggagtagtggtggcccacagtgaatctggaattcagatggtgcccataagctggtgcgaaatgcagtgtccaaaaacacacacaaaggagtttcgtaaagtggcccgcgtccagccagaattcctgcagacctag

SEQ ID NO: 15300 - DNA, 2811 bp, Artificial Sequence
  Description of Artificial Sequence: Synthetic coding sequence
atggcggcagcaagggaccctcccgaagtgtctctgcgagaggccacccaacggaagttacggcgattctccgagctcaggggcaaactggttgccaggggtgagttttgggacattgtggcaattacggcagcagacgagaagcaagagctggcctacaaccaacagttaagcgagaaactgaagagaaaggagctgccgctcggcgtgcaataccatgtgtttgtagatcccgccggggcaaagattggaaatggcggcagtactctatgcgccttgcaatgtttagaaaagctgtatggggacaaatggaatagctttacaatcctgctgattcactctgacgagtggaaaaagaaggtgtcggagtcttacgtcatcacaattgagagacttgaagatgatctacagataaaagaaaaagaacttacagaactgaggaacatcttcggatccgacgaagcatttagcaaggtgaatctgaattaccggactgagaacggccttagtctgctgcacctgtgttgcatatgcggcggaaagaaatctcatatcaggacgcttatgctgaaaggacttcggccgtctaggctgactaggaatggcttcactgcgctgcatctggccgtctataaagacaacgctgagcttatcactagcctgcttcactccggagccgacatccagcaggtcggatatggcggccttacagctctgcatatcgccactatcgccgggcatctggaggcggccgatgtacttttgcagcatggggccaacgtgaacatacaagacgcagtattttttactcccttgcacatcgccgcctactatggacacgagcaggttacgcggctcctgctgaaatttggtgccgacgtaaacgtgtctggcgaagtcggagacagacctcttcacttggctagtgctaagggtttcctgaacatcgccaagctgcttatggaagaagggtccaaggctgatgttaacgcccaggataatgaagatcatgtgccactgcacttctgttcgcggttcggacatcacgacattgtgaaatatttattacagagcgacctggaggtgcagccgcacgtcgtcaacatctatggcgatacacccctgcacctggcttgttacaacgggaagtttgaggtagccaaggaaatcatccagatcagcggcaccgagtctctcaccaaggagaatattttttctgagacagcctttcactccgcctgtacatacgggaaaagcattgatttggtgaagtttctgttggatcagaacgttatcaacattaatcaccagggtagagacggacatacgggcctgcatagcgcttgctaccacggccacatcaggcttgttcagtttctcctcgacaacggcgcagatatgaatctggtggcatgcgatccatcacgctcttctggggagaaggacgagcaaacgtgtctgatgtgggcatacgaaaaaggtcatgacgcgatcgtgactctgctaaaacattacaaaaggcctcaggacgaattaccctgcaatgaatattctcagccaggcggagacggctcatacgtgtctgttccctcgcccctggggaaaatcaagagcatgacaaaggaaaaggcagatatcctgctcttgagggcgggtttaccatcacacttccacctgcagctgtcagagattgagtttcatgagatcattggttcaggaagttttggaaaggtgtacaaaggcagatgcaggaacaagatcgtcgccatcaagcgctatcgagccaacacgtattgtagtaagtcagacgtggatatgttctgccgcgaagtgtccatcttatgtcagctcaaccatccgtgcgtgatccagtttgtgggcgcgtgcctcaatgacccgtctcagttcgctattgttacacagtatatttccgggggcagtctttttagcctgctccatgaacaaaaacgaatcctggatttgcaatcaaaactaataattgcagtggatgtggcaaaaggcatggaatatttacataaccttactcaacctatcatccacagagatcttaatagccataatatactgttatatgaagacggccatgctgttgtcgccgattttggcgaatcccgcttcctgcaatcacttgacgaagataatatgactaagcagccaggtaatctccgctggatggcccccgaggtttttacacagtgtacacgctacactatcaaagctgacgtgttctcatacgccctctgcctttgggagattctaaccggtgagataccatttgcccatcttaagccggctgccgctgccgcagacatggcttatcatcacatcaggccaccaatagggtactctatccccaaacccatctcttctcttctgattagaggctggaatgcctgccccgaggggcgtccggagttctcagaggtggttatgaaattagaagaatgcttgtgcaacatagagctcatgagtccggcgagctccaattcttcaggcagtctgtccccctcgtccagcagtgattgcttggtcaacagaggaggacccggaagatctcacgtcgctgctcttagatctcggttcgaactggaatacgccttgaacgcacgttcttacgccgcactgtctcaaagcgctgggcagtattcatcacagggcctcagtctcgaggagatgaagaggagcctgcagtacaccccaatcgataaatatgggtatgtctctgatcccatgtcatcgatgcatttccacagctgccggaatagtagctcttttgaagatagttcttag

SEQ ID NO: 15301 - DNA, 510 bp, Artificial Sequence
  Description of Artificial Sequence: Synthetic coding sequence
atggcagctgccagagacccacctgaggtgagtctgagggaagcaacccagaggaaattaaggcgcttcagtgagcttcgcgggaagctggtcgctcgaggcgagttttgggacattgtggcaattacagcggccgatgaaaagcaggaattagcatacaatcagcagctgtccgaaaagttaaaaaggaaggagctccctcttggcgtccagtaccacgtgtttgttgaccctgccggagctaaaattggtaatggaggatctaccttgtgcgctctgcaatgcttggagaagctgtatggtgataagtggaactcctttaccattctgttgattcattccgtgagcttccaaatctaccagaacgccctggctaagcaccccgtctctttcaaagcttattggatccaggacgtactctggcacctagcgcaactctggtccatccctgattggggattgatgtttcagcttggaaaaactgccctcttggtggtgctgacgagctag

SEQ ID NO: 15302 - DNA, 1785 bp, Artificial Sequence
  Description of Artificial Sequence: Synthetic coding sequence
atggctgcggcccgcgatccgccagaagtgtccttgcgggaggccacccaaaggaaactgcggcgcttttcagaactcagagggaagctagtagcgagaggggagttttgggacattgtcgccatcacagccgctgatgagaagcaagagttagcttataaccagcagctaagtgaaaagctcaaaaggaaggaactacctcttggtgtccaatatcatgtgtttgtggatccggctggcgcgaagataggcaatggagggagtactctctgtgcacttcagtgcttggagaagttgtatggtgataagtggaactcttttactatcctgcttattcatagtggaggctattcccagagactgcccaacgcaagcgcactggggaaaatattcactgcattgcctcttggcaatccaatttatcagatgctcgaactcaagctcgccatgtatatcgatttcccgctgaacatgaatcccggaatccttgtcacatgcgccgacgacattgagctctattctataggggaattcgaattcatcagatttgacaagccaggcttcactgctctcgctcatccgtcctctttgaccatcggtaccacacatggcgtttttgtcctcgaccctttcgacgatctgaaacatcgggatctggagtaccggagttgccacagatttcttcacaagccctctattgaaaagatgtatcagttcaatgctgtttgtagaccgggcaatttctgccagcaagactttgccggcggtgacatcgcggatttgaagctggattcggattatgtgtataccgatagtctgttttacatggaccataagtctgcaaagatgttgcttgctttctacgagaagatcggcaccctttcttgcgagatcgatgcatacggcgactttttgcaagccctgggaccgggcgccacagtcgagtacacacgtaatacatctaatgtcattaaagaggaaagtgaactcgtcgagatgcggcagcgcattttccatctgctgaaaggaactagtctcaatgttgtggtgctgaataactctaagttctaccatattggaaccacggaagagtacctgttctacttcacctccgataattcactcaaaagcgaactgggtctccaatcaattaccttctcaatcttccctgatatccctgagtgttcagggaaaacctcttgcattattcagtccattttggattccaggtgctctgtggcccccgggagcgtcgtcgaatattctagactgggacccgacgtcagcgtgggggaaaactgcattatatctgggtcatacatcctaacaaaggcggccctgcccgcacattcttttgtatgcagtttaagcctgaaaatgaaccggtgccttaagtatgccacgatggcattcggcgtgcaggataatctcaagaagtccgttaagactctgtctgacatcaaactgctccagttctttggggtctgtttcttgagttgtctcgacgtttggaacctgaaggttacagaggaactgttttccggtaataagacctgcctctctctatggaccgctcggattttccccgtgtgctcttcactgagcgactccgtcataacttcactgaagatgctgaatgctgtgaagaataagagcgcatttagtctcaactcctacaagctgctgtccatcgaggagatgctgatatacaaggatgtggaggatatgattacttacagggaacagattttccttgagatcagcctgaagagctccctgatgtag

SEQ ID NO: 15303 - DNA, 588 bp, Artificial Sequence
  Description of Artificial Sequence: Synthetic coding sequence
atggccccccctgtgcgatactgcatcccgggcgaacggctgtgtaacctagaggagggcagccctggctctggcacgtatactcgccacggctacatatttagctcactggcggggtgcttaatgaagagctccgagaacggagccctgccagtcgtctcagtggtcagggaaaccgagtctcagctgttacccgatgtcggcgcaattgtgacctgcaaggtgagctcaatcaacagccgctttgccaaagttcacatcctttacgtgggatccatgcctctcaagaattccttcagaggcacaatccgcaaggaagacgtacgggctaccgagaaagacaaagtggaaatttataagtcattccgcccgggagacatcgtcctggcaaaggtcatatctctgggggatgctcagagcaactatcttttgactactgcggaaaatgagctaggcgtggtcgtcgcccattctgaatccggcatccagatggtgccaatatcatggtgtgaaatgcaatgtccaaaaactcataccaaagagtttcggaaagtggctcgcgtccagccagaattcctgcaaacttag

SEQ ID NO: 15304 - DNA, 1626 bp, Artificial Sequence
  Description of Artificial Sequence: Synthetic coding sequence
atgaccggcgagaagattcggagtctacgccgggatcacaagccatccaaggaagaaggcgacctgctggagcctggcgacgaggaggcagcagcagcacttggcgggactttcactagatctagaatcgggaaaggtggaaaagcctgtcacaagatcttctcaaatcaccaccacaggctccaattgaaagctgcccctgcgagcagcaatcctccaggcgcacctgccctgcccctccataactcctcagtaacagccaactcacaatcccccgctcttctggcggggaccaatcctgtggctgtggtagccgacggcgggagctgtcccgcccattacccagttcacgaatgtgttttcaagggtgacgttcgtcggctgagctccctcataaggactcacaatatcggtcagaaagacaatcatggcaacactcccctccatttggctgtgatgcttggaaacaaggagtgtgctcacctgcttctggcccacaacgcccccgttaaagtcaagaacgcccagggttggagcccactggctgaagcaatatcttacggcgacagacagatgattacggcactcctgcggaagctgaagcagcagagccgagaaagcgtcgaggagaagaggccacgtctgctgaaggcattgaaagagttaggcgatttttatctcgagctgcactgggacttccagagctgggtgcctctgctcagtcgaatcttgccttcagacgcgtgtaaaatctacaagcagggtattaatattcggctggatacaacacttatcgatttcacagacatgaagtgccagcgaggcgacttaagcttcattttcaatggcgacgctgccccctcagagagttttgtggtcctcgataatgaacagaaagtctaccagaggatccaccatgaggaaagcgagatggagacagaagaggaggtcgacatcctgatgagctcagatatctattccgctaccctctcgactaagtctatttctttcacaagagcacagactgggtggctgttccgcgaggataagactgaaagagtggggaatttcctggccgatttctacctcgtcaatggcctagtgctggagtcccgcaagcgcagagagcacctgagtgaggaggacatcctgaggaacaaggcaataatggagtcactgtccaagggcggtaacataatggagcagaattttgagcccatccgccggcagagcctcaccccccccccccaaaacactatcacatgggaggagtacatctccgccgagaacgggaaggccccccatctgggccgcgagctggtgtgcaaagaaagtaaaaagacatttaaggccaccatcgccatgtctcaggagttcccactaggcatcgagctactcctgaacgtgcttgaagtcgtggcccctttcaagcacttcaataagcttagggagttcgtgcagatgaagctgcccccagggtttccagtgaaactcgatatccccgtgttccccacaattactgctaccgtgacattccaggagttccggtatgacgaatttgacggtagcatatttactatcccagatgattacaaggaagaccccagcaggttccctgatctttag

SEQ ID NO: 15305 - DNA, 840 bp, Artificial Sequence
  Description of Artificial Sequence: Synthetic coding sequence
atgccctgtcggcgagaggaggaggaggaagccggcgaggaggccgagggggaagaagaggaagaagattccttcctgttgctgcagcaatctgtagccctaggctcatcgggggaggtggacaggctagttgcccagatcggtgagacccttcagctcgatgccgcccagcacagccctgcgagtccctgtgggccacccggtgctccattgcgagcaccgggacccctggccgccgcagtgcccgccgacaaggcgcgcagcccagcggtcccactgctcctgcccccagcactggccgagaccgtgggaccggctcctccgggtgtgctcagatgcgcactgggtgatcggggccgggtgcgcgggcgggcagccccttattgcgtggcagagctcgcgaccgggcccagcgccttgtctcccttaccacctcaggccgaccttgatggccctcccggcgccggcaaacagggcataccccagcccctctcgggaccttgccgaagagggtggttacgcggcgcggccgcatcaagaaggcttcagcagcgtcgcggttcccagccagagacacgcacaggcgacgatgatccccatagattgctgcagcagctggtcctgagcggaaacctgatcaaggaggccgtccgcaggctccacagtcgcagactacaacttagagcaaaactcccacagcgaccacttctgggcccattgtccgctccggtccatgaaccgccctcaccacggtcaccaagagctgcctgttccgatccaggcgccagcggcagggcccaactccggacgggagacggcgtcctcgtccctggctcatag

SEQ ID NO: 15306 - DNA, 1209 bp, Artificial Sequence
  Description of Artificial Sequence: Synthetic coding sequence
atgccactccatagctctcttgggaataagtccgaaaccctctcacagaagaaaaacaacaacaacaaagaaaaaactaagagaaattcaagaaaccctccacgcaccgctttgaaagaaggtaagatggaagagttgtctcaggcactcgcctcttcatttagcgtgtcgcaggacctcaacagcaccgccgcgccccaccccagactgtcccagtacaagagcaagtactctagcctggaacagtccgagcgcaggcgtagactcctcgagttgcagaaatccaaacgactcgactatgtgaatcatgctaggcgactcgcagaggatgactggacgggcatggaatctgaagaagaaaataaaaaggacgatgaggaaatggatatagatacagtgaagaaactgcccaagcattacgcaaatcaactcatgctttccgaatggctgatagatgtgccttccgacttggggcaggagtggatagttgtggtctgtcctgtgggaaaaagagccctcatcgtcgccagcaggggaagcacctccgcctacactaagagtgggtattgtgtaaacagattcagctcacttctgcccggaggcaacagacggaactcaacagcaaaagattacactatcttggattgtatatataatgaggtgaatcaaacttactacgtgttggatgtaatgtgttggaggggccatcctttttatgactgtcaaaccgatttcaggttctattggatgcatagcaagctccccgaagaggagggtctgggagaaaaaacaaagctaaacccctttaagttcgtgggtctgaaaaacttcccctgcacacctgaaagtctatgcgacgtgctgtccatggacttccccttcgaggttgacgggctgctgttttatcataagcagacacactactcaccagggagtacaccattagtggggtggttgcgcccctatatggtgtctgacgtgctcggcgtcgctgtgcccgctggcccattaactactaagcccgactacgccggacatcagctgcagcagatcatggaacataaaaaaagtcaaaaagaaggcatgaaggagaagctaacgcacaaagcctcagagaacggtcactatgagctggaacacctttccacccccaagttaaaagggtcatcacactcacccgatcatcctggttgccttatggagaactag

SEQ ID NO: 15307 - DNA, 1107 bp, Artificial Sequence
  Description of Artificial Sequence: Synthetic coding sequence
atgtctctatttggcaccacctcaggatttgggacgagcggaacctctatgttcggatccgcaaccaccgacaatcacaatcccatgaaggacatagaggtcacaagctctccagatgatagcatcggttgtttgtcattttctccgcctacccttcctggcaattttctgatcgccggttcatgggctaatgacgtgagatgttgggaggtacaggactccggacagaccattcccaaagcccagcagatgcataccgggcctgtccttgacgtgtgctggtccgatgacggcagtaaagtgttcacagctagctgcgataagaccgctaaaatgtgggacctatcttccaaccaggctatccaaatcgcacaacatgacgccccagtgaagacgatccattggataaaagcgcctaactacagctgtgtcatgaccgggtcctgggataagactttgaagttctgggacacccgtagcagcaatcccatgatggtgctgcagcttccggaaagatgctattgcgctgatgtcatctaccccatggctgtcgtggcaaccgcggaacgcgggctgatcgtgtaccaactcgagaaccaaccatcagaatttaggcgcattgaatctcccctcaagcatcagcaccgctgtgtggctatattcaaggacaagcagaacaaacccaccggcttcgctcttggatctatcgaaggccgggtggcgatccactatatcaacccaccaaatccagcgaaggacaacttcacattcaaatgccaccggagcaatgggacaaacacttctgcgcctcaggacatctatgcagtgaatggaattgcatttcatccagtgcacggaacactggccaccgttggatccgacggcaggttcagcttttgggataaagacgctcgcaccaagctgaaaacctcagagcagttagatcagcctatatcagcttgttgctttaaccacaatgggaatattttcgcatatgcgagcagctatgattggagcaaaggccatgagttttataatcctcagaagaagaattacatcttccttaggaatgctgccgaagagttaaaaccacggaacaagaagtag

SEQ ID NO: 15308 - DNA, 552 bp, Artificial Sequence
  Description of Artificial Sequence: Synthetic coding sequence
atgaggaagtcatcgtgtgtggaaagcttcgatgaccaacgccgaatgagtctccacctccatggggccgattgcgatccgaagacccagaacgaaatgaacatttgtgaagaggagttcgtggaatacaaaaaccgtgacgctatcagcgccttaatgccactgtttagcgaagaggagtcatcggacggaagtaagcataacaatggcctgccagatcatatctcggcgcagctgcaaaacacctacacattgaaagccttcacagtgggtagcaagtgcgtggtgtggtcaagcctccggaacacctggtctaaatgcgagatcctggaaacagcagaggaaggaactagggtcctaaacctaagcaacgggatggaggagatcgtcaacccagaaaacgtctggaacggcattcccaagcttgataagagcccccccgaggcagtgtcacagagagtgggaaaggacctgtactttatgtcagtgggggacacgaccatcaaggaaaaaggatttggtggcgatggcgatctgacagtggacttatag

SEQ ID NO: 15309 - DNA, 1821 bp, Artificial Sequence
  Description of Artificial Sequence: Synthetic coding sequence
atgcccagtcctcaactcctcgtcctgttcggcagccagacaggaaccgcccaagacgtttctgaaagacttggccgggaggcaagacgccggaggctaggctgccgagtgcaggcgttggactcataccctgtggtgaacttaatcaatgagcccctggtgatatttgtgtgtgccacaactggacagggcgacccacccgataatatgaagaacttttggagattcattttcagaaaaaatctcccatcaactgctctttgccaaatggacttcgccgtgttgggtcttggagatagctcttatgcaaaattcaatttcgtagctaaaaagctgcacagacgacttctgcagctcggtgggtcagccctgttgcccgtctgcctgggggatgatcaacatgaactcggacccgatgccgccgtcgacccctggttgcgggacttatgggatagggttctgggtctgtacccacctccccccgggctgactgagatccccccaggcgtgcctctaccctccaagtttacacttctcttcttgcaggaggccccatcaacagggtctgagggccagagggtagcccaccccggcagccaggaaccacctagcgagagcaagccctttctagcaccaatgatcagcaatcagagagtgacaggaccttcccattttcaagatgtgaggctgatcgagttcgacatactgggctcaggcataagctttgcggctggcgacgttgtgctaatccagccctcaaatagcgcagcgcacgtccagcggttttgccaggttctgggcctggaccctgaccagctttttatgttgcaacccagagagccagacgtgtccagccccacccggcttccccagccttgttccatgagacatctcgtctctcactacctcgatattgcttccgtgcccagacggtctttctttgagttactggcctgtttgtcattgcacgagctggaaagagaaaaactgttggagttctcctccgctcagggacaggaagaactgttcgagtactgtaataggccccggaggaccatcctcgaagtcctttgtgattttccacacactgcggcagccataccgcccgactacctcctggatctgattccggttatccgcccccgggctttctccattgcctcctctctactgacccacccctccagattgcagattttagtggctgtggtccagtttcagactcggctaaaggagccacggcgtgggctctgctccagctggctggccagccttgatccagggcagggtccagtgagagtgccactgtgggtcaggcctgggtctctggccttccctgaaacaccagacacacctgtaatcatggtaggccccggaaccggagttgccccattcagagcggccattcaggaaagggtggcccagggacagacaggcaattttctgttctttggctgccgctggcgagatcaggatttctattgggaagccgaatggcaggagttagagaaacgcgattgtcttaccctcattcccgccttcagtcgagagcagccacctgctctgtttagcgcactgcaggagcaaaaggtatatgttcagcaccgactgcgcgaacttggatccttggtatgggaactcctggaccgacagggtgcctacttctacctggccggcaatgcaaaatcgatgcccgctgatgtctctgaggctctgatgtcaatcttccaggaagagggaggactgtgtagtcctgacgctgcagcctatctggcacgcctccagcagacacgtcgctttcagacagagacgtgggcttag

SEQ ID NO: 15310 - DNA, 420 bp, Artificial Sequence
  Description of Artificial Sequence: Synthetic coding sequence
atggccgagtctgactgggatacagtcactgtcctgagaaagaaaggccctactgccgctcaggctaaatctaagcaggccatcctggcggctcagcggagaggggaggacgtggaaacgtcaaagaagtgggccgcaggccagaataaacagcattcaattacgaaaaacactgctaaacttgaccgggagaccgaggagcttcaccacgatcgtgtaactctcgaggtcgggaaggtaatccagcagggacgacaaagtaaaggcctcacacagaaggacctggccacaaaaatcaacgaaaaaccacaggtgattgccgactacgaatctggcagggctatcccaaataatcaggtgttagggaagattgagagggccatcggggaatgcccctcgacactgcgaagagtgcgctag

SEQ ID NO: 15311 - DNA, 426 bp, Artificial Sequence
  Description of Artificial Sequence: Synthetic coding sequence
atggcagagtccgactgggataccgtcacggtgcttcgcaagaagggccccacagccgcccaggccaagtcaaagcaggctattctggctgcgcagaggcggggtgaagacgtggagaccagtaaaaagtgggctgctggacagaacaagcagcactcgatcacaaagaatactgcgaaactcgaccgggaaaccgaagagttgcatcatgaccgcgttaccctggaagtgggcaaggtcatccagcagggccgacagtccaaaggcctgactcagaaggatctagctaccaagatcaacgagaagccacaggtaattgcagattatgagagcggcagggctataccaaacaaccaggtattaggcaagatcgaacgcgccatcgatgtgggcacgcgttctgcccgtgtcctgagggcccagtag

SEQ ID NO: 15312 - DNA, 150 bp, Artificial Sequence
  Description of Artificial Sequence: Synthetic coding sequence
atggctactcagagaaagcacctcgtgaaggattttaatccatatatcacctgttatatctgtaagggatacctaataaaaccaaccactgtgacagagtgcttgcacacaagcgctgagagttattggatgtccacatggatgagctag

SEQ ID NO: 15313 - DNA, 960 bp, Artificial Sequence
  Description of Artificial Sequence: Synthetic coding sequence
atgatggtgctgaaggtagaggaacttgtgaccgggaagaagaacggaaacggggaagcgggagaatttctgccagaggattttagggatggggagtacgaagccgctgtcacgctcgaaaagcaggaggaccttaaaacacttttggcacatcccgtgactctgggggaacagcagtggaagagcgaaaaacagcgcgaggcagagcttaagaagaaaaagctcgaacaacgatcaaaactcgagaatctcgaagacctggaaattattattcagctgaaaaaaagaaaaaagtaccggaagacgaaggtacccgtcgtaaaagagccagagcccgagatcatcacggagcctgtcgacgtccctacttttctcaaagcggcactggagaacaagcttcctgtggtagagaaattcttatctgataaaaacaacccagacgtgtgtgacgaatacaaacgcacagcgctgcatcgcgcctgcctggagggccacctggccatcgtagagaaactgatggaagctggtgcccagatcgagttccgtgatatgcttgagagtaccgctatccattgggctagcagaggggggaacctcgacgtactcaagctgctccttaataaaggcgcaaagatcagtgctagggacaaactactgagcactgctcttcatgttgccgttcgaacaggtcattacgaatgtgccgagcaccttattgcttgcgaagcagacctcaacgctaaggaccgcgagggagacaccccactgcacgatgctgtgcgcctgaacagatataaaatgatccgcctactgatcatgtatggggctgacctcaacattaagaactgtgctggtaagacacctatggatctcgtgttgcactggcagaatgggaccaaggccatctttgattccttacgcgagaatagttataaaacttcccgcatcgctaccttctag

SEQ ID NO: 15314 - DNA, 1089 bp, Artificial Sequence
  Description of Artificial Sequence: Synthetic coding sequence
atgtcggggtaccagcggaggcccggagctacacccctgagcagagcgcgaagtcttgctattcctgatgatgacagattcgaagacctggaagaggccaaccccttttcgttccgtgagttcttgaaaaccaaaaatctaggacttagcaaggaagatcctgccagcagaatctacgctaaggaagcatcacgccactctctgggcctggatcacaacagcccgccgagccagacaggtggttatggactcgaatatcagcagccgttctttgaagatccaacgggggcaggagacctgttggatgaagaagaagatgaggatacagggtggtcaggggcttacttaccttccgctatagagcaaacccaccccgaacgggtgcctgccggcacctccccatgcagcacttacctcagtttcttctctaccccctccgagttggcaggccccgagtcccttccaagctgggctctttctgataccgactcgcgcgtgagcccggcatcaccagcgggttccccatccgccgacttcgcagttcacggtgagtcactgggagataggcacctgaggacgctccaaattagctacgacgcactgaaagatgaaaactccaagctccgtcggaagctcaatgaggtgcagtcttttagtgaagctcagaccgagatggtgaggacactcgagaggaagttggaggctaagatgatcaaggaagagtctgactaccatgacctggagtcggtggtgcagcaggtcgagcagaaccttgagttgatgactaaacgcgctgtgaaagcggagaatcacgtggtaaagttaaaacaagagattagtctactacaggcgcaagtgtccaactttcagcgggagaacgaggcactgcgttgtggtcagggggcctccctgactgtggtcaaacagaacgcagatgtggcactgcagaacctgagggtggtgatgaattcagcacaggcaagtatcaagcaactggttagcggcgcagaaaccctaaatttggtggcagagatcctcaaatctatcgatcgaatatcagaggtcaaggacgaggaagaagactcttag

SEQ ID NO: 15315 - DNA, 5463 bp, Artificial Sequence
  Description of Artificial Sequence: Synthetic coding sequence
atggaatctaattttaatcaagaaggcgtgcctagacccagctacgtgttttccgccgatcctatagccagaccctctgaaatcaatttcgacggcattaagctggatctcagccatgagttcagcctggttgcccctaataccgaggccaacagtttcgaatctaaagactatctgcaggtgtgtcttaggatcaggccgttcacgcagtccgagaaggagttggagtccgagggctgcgtgcacatcctggactctcagaccgtcgtcctcaaagaaccacaatgtatcctcggacgattgagcgaaaagtcgagtggccagatggcgcaaaaattctcatttagtaaggtattcggccctgccactacacagaaggaattttttcaggggtgcattatgcagccagttaaggaccttctgaaaggacaaagccgactgatctttacttatggtctcaccaactcaggaaagacttacactttccagggaacagaggagaacattggaatcctccctaggacattgaatgtgttgttcgattctctccaagagaggctgtacacaaaaatgaacctgaagccccacagatccagggaatacctaagactgtccagtgaacaggagaaagaggagattgcatccaaatcggccctccttcggcagattaaggaggtgaccgtgcacaacgactctgacgatacactgtatggcagcctgacgaattccctgaacatttctgagtttgaggagtctatcaaagactacgaacaagcaaatctgaacatggccaactcaatcaagttctctgtttgggtgtctttcttcgagatatacaatgaatatatatatgatttattcgtgcccgtaagtagtaagtttcagaaacggaaaatgctgcggctgtcccaggatgtgaaaggctacagtttcattaaagatttacaatggatccaggttagtgatagcaaggaagcgtacaggctcctgaaactgggcatcaagcaccaatcagtcgcctttactaagctgaacaacgcctcctcgcgcagtcactccatttttacagttaagattctccaaatcgaagactccgagatgagtcgtgtgatcagggtgtctgaactctcactctgcgatcttgcaggcagcgaaagaacaatgaagacccagaacgagggcgagcgactgcgcgaaacgggtaatatcaataccagcctgctaacactgggcaagtgcattaacgtgctcaagaattcggaaaaaagcaaattccaacaacacgttccatttcgcgagagtaagctaactcactacttccaatcttttttcaacggtaaaggtaaaatttgcatgattgtgaatatatcccaatgttacctggcttacgacgaaaccctgaatgtgctgaagttttccgctatagcacagaaagtctgtgtcccggacacccttaatagctcacaggaaaaattgttcggacccgttaaaagctctcaagatgtgtcactggattcaaatagcaacagcaagatactgaacgtcaagagagcaaccatctcctgggagaattccctggaggacttaatggaagatgaggatctggtggaagagctagaaaacgcggaggagacacaaaacgttgagacaaaacttttggatgaggacctggacaagaccctagaagagaataaagctttcatctcacatgaagaaaagaggaaactgcttgatttaatcgaggacttaaaaaagaagctgatcaatgaaaagaaagagaagctcactctggagttcaaaatacgtgaggaagttactcaggaatttacacagtattgggcgcagcgggaggctgactttaaagaaaccttgctgcaggagcgagaaatcctggaggaaaatgccgagcgtcgtctggccatatttaaagacttggtggggaagtgtgacactagggaggaagccgccaaggacatctgtgccaccaaggtcgagaccgaggagactcataactacgtcggctttgaagatatcatcgacagcctgcaggataatgttgcagacattaaaaagcaagcggagatcgctcatctatacattgcctctttgcccgacccacaggaggccacagcatgcctggagctgaagtttaatcagatcaaagccgaattagccaagacaaagggtgaattgatcaaaactaaggaagaactgaagaagcgagaaaacgaaagtgatagcttgatccaggagttggagacatctaataagaaaatcatcactcagaatcaacggatcaaggaactgatcaatataatcgatcagaaggaggatactattaatgaatttcaaaatttgaagtcccacatggagaacaccttcaaatgcaacgacaaggccgacacctccagtctgattatcaataataagctgatttgtaatgagaccgtcgaggtcccaaaagattccaaaagcaaaatttgtagcgaacggaagcgggtcaacgaaaacgagctccagcaggacgaaccccccgccaagaagggctccatccatgtgtccagtgcaataaccgaagaccagaaaaagtcggaggaagtgagaccaaatatcgccgaaattgaggacatacgagtactgcaagaaaataacgagggcctccgcgctttcctgctcacaatcgaaaacgagctgaagaatgagaaggaggagaaagccgagctcaacaaacaaattgtccacttccagcaagagttgtctctgtcagagaagaagaacctgacactgtcaaaggaggtgcagcagatacagtccaattatgatatagctatcgccgaacttcacgttcagaaatccaaaaatcaggaacaggaggagaagatcatgaagctctcaaatgagatcgagacagccacccgatcaattaccaacaacgtaagccagataaagctaatgcacacaaaaattgacgaattgcgtacccttgactcagtgtctcagatttccaacattgacttactgaacctgcgcgatctgagcaacgggtctgaggaggataacctgccaaatacccagctggaccttctagggaatgactacctggtgagcaagcaagtcaaggaatacaggatccaagaacccaatagagaaaattccttccactccagtattgaggccatttgggaggagtgtaaggagatcgtgaaggcttcatccaagaaaagccaccagattgaagagctggaacagcagatcgagaagctgcaggcagaggtaaaggggtacaaggatgagaacaatcgcttgaaagaaaaagagcataaaaaccaggatgacctgctaaaagagaaagaaactctgattcagcaactaaaggaggagctccaagagaagaacgtgaccttagacgttcagattcagcatgtggtggagggaaagcgagctctgagtgagcttacacagggtgtgacctgctacaaggccaaaatcaaggaactggaaaccatcctggaaacacagaaggttgaatgtagtcactcggccaaactcgagcaggacattcttgagaaagagagcatcatccttaaactggaaaggaacctcaaggagttccaggaacatctgcaggatagcgtgaaaaataccaaagatttgaatgtgaaggaactcaaactgaaagaagagatcacgcagctgaccaacaatctccaggacatgaaacaccttttgcagctgaaagaagaagaggaggagactaaccgccaggagaccgagaagcttaaggaggagctgtctgcttcctccgctcgtacacagaacttgaaggctgacttgcagcggaaggaggaggattatgccgacctgaaggaaaagttgactgatgcaaagaaacagattaagcaagtacagaaggaggtctccgtcatgagggacgaagataagctgttgagaataaaaatcaacgagctggagaagaaaaagaaccagtgctcccaggagctggacatgaaacagcggactatccagcagctgaaagaacagctgaataaccagaaggttgaggaggcaatccaacagtacgaacgggcatgcaaagatctgaacgtcaaggaaaagatcattgaggatatgaggatgactctcgaagagcaggagcagacacaggttgaacaagatcaggtgctcgaggccaagttggaggaggtcgaacggctggcaacagagctggaaaaatggaaagagaagtgcaatgatctggaaaccaaaaacaatcaacgctcaaataaagaacatgagaacaatacagacgtgttagggaagttaactaatctgcaggatgagcttcaggagagtgagcagaagtataacgccgacaggaaaaaatggttggaagagaagatgatgctcatcacacaagccaaggaagcagaaaatataagaaacaaggaaatgaaaaagtatgcggaagaccgggaacgtttcttcaagcagcagaatgagatggaaattctgaccgctcagctaacagaaaaggattctgatctgcagaagtggagagaggagagggatcagcttgtggccgccctggagatacagttaaaggcgctcatttcttccaacgtacagaaagataacgagattgaacagttgaaaagaataatctccgaaacgtccaaaattgaaacacagataatggatatcaagccaaagcggatcagttcagcggatcctgacaagctccagacagagccgctgtctacctcatttgagatttctcggaataaaattgaggacgggtccgtggtccttgattcctgtgaggtgtcaaccgagaatgatcagagcacgcgattcccaaaaccagaacttgagattcaattcacccctctccagcccaataagatggccgtgaagcatcctggatgtacaactccagtgaccgtgaagattccaaaagctagaaagcggaagagcaatgagatggaggaggacttggttaagtgtgagaataagaagaacgctactccgcgcacaaatctgaaattccctatctctgacgatcgcaattctagcgtcaagaaggagcaaaaggtggctattaggccaagctccaaaaagacatattccctgaggagtcaagcctctatcattggcgtcaacttagcgactaaaaaaaaagagggcacactccagaaatttggagactttcttcaacacagcccctccatactccaatccaaagcgaaaaagattatcgagacgatgagctccagtaaacttagcaatgtggaagcaagcaaagagaatgtcagccagccgaagagggccaagaggaagctgtacacatccgaaatttcatctcccatcgacattagtggtcaggtgatactgatggaccagaagatgaaggaaagcgaccatcaaatcattaaacgtcgtctcaggacgaagaccgcgaagtag

SEQ ID NO: 15316 - DNA, 1485 bp, Artificial Sequence
  Description of Artificial Sequence: Synthetic coding sequence
atgaagttgggcaagaaaccaatgtataaaccggtggatccctatagtaggatgcagagcacttataactacaatatgagaggcggggcttaccctccgagatacttctacccatttcctgttcctcccctcctttatcaggtggagctgagcgttgggggtcagcagtttaatggtaaagggaagactcgtcaggctgccaagcacgatgctgccgcaaaggccttacgcattttgcaaaacgagccccttccggaacggttggaggttaatggtcgtgagagcgaagaagaaaatctaaacaagagcgaaatctcccaggtttttgagatcgcactgaagaggaacctccccgtgaatttcgaggtcgcacgagagtccgggcctcctcatatgaaaaatttcgtgactaaagtaagcgtgggcgaatttgtaggcgaaggagagggcaagagcaaaaaaatttcaaagaagaatgccgcaattgctgttctggaggagcttaagaaactaccccccctgccggcagtggaacgagttaaaccccgtatcaagaaaaaaaccaagcctatagtgaagacctcgccagagtatgggcagggcatcaaccctatttcacgactggcccagatccagcaggcaaaaaaggagaaagagccagagtataccctgctgactgaaaggggattgccgagacggcgagagttcgtgatgcaagtaaaagtgggcaatcacaccgctgaaggcacagggactaacaagaaggtggcgaaacgtaatgccgccgagaacatgctggaaatattaggcttcaaggtgccccaggcccaacccactaaacccgctttaaagtcagaagaaaagaccccgatcaagaagcccggtgatggaagaaaggtgaccttctttgagcctggctcaggggacgaaaatggaacttcaaacaaagaggacgaatttcgcatgccctatctgtcacaccaacagttgccagctggaattctgcctatggttccagaggtggctcaggctgtgggggtgtcacagggacaccacactaaggacttcacaagagcagcaccaaatcccgccaaagctacagtcaccgcgatgattgcaagagaactcctttatggcggcaccagtcccactgccgaaaccattctgaaaaataatatctcctctggccacgtgccccacggccccctgacaagaccgtctgaacagctagactacttgtcgcgcgtgcaaggtttccaggtggagtacaaagatttccccaagaacaataagaatgagtttgtgtcgcttattaattgcagctcacagccaccactaattagccatggaatcggtaaagatgtagagtcctgtcatgacatggctgccttaaacattctgaaactgttgtccgagttagatcagcagagtaccgaaatgccacggaccggtaatggtcctatgtctgtgtgcggtaggtgctag

SEQ ID NO: 15317 - DNA, 1509 bp, Artificial Sequence
  Description of Artificial Sequence: Synthetic coding sequence
atgaaattaggcaagaaaccaatgtataaaccggttgatccatattccaggatgcagagtacctataattataacatgcgcggcggtgcatatccccccaggtacttctatccttttccagtcccccctctgctgtaccaagtggagctgagcgtgggcggtcagcaattcaacggcaagggaaagactaggcaggcagcaaagcatgatgcggcagccaaggccttacgcatcttacaaaatgaacctctccctgagcgattggaagtgaacggaagagaatccgaggaagagaatttgaataaaagcgaaatatcacaggtgtttgagatagcgttgaagaggaacctgcctgtaaattttgagagcttccctctaaaacaggtcgcaagagagagcgggcctcctcatatgaaaaacttcgtgaccaaggtaagcgtgggagagttcgtgggggaaggagaaggaaagtccaagaaaatctccaagaaaaacgctgccatcgccgtgttagaagaactgaaaaagcttcctcccctgccagccgtggagcgagttaaaccacgcatcaagaagaaaacaaaaccgattgtaaagccacagacatcacccgaatatggacaaggcataaatcccatcagcaggttagctcagatccagcaggcaaagaaggaaaaggaacctgagtacaccctgctaactgagaggggactcccacggcggcgagaatttgtcatgcaggtcaaagtgggaaaccataccgctgaagggaccggcaccaataaaaaagtggcaaagagaaatgctgcagagaatatgctcgagatacttggattcaaggtgccccaggcccaacccacaaagcctgcactcaagtctgaagagaaaactcccatcaaaaagcctggtgatggccggaaagtgactttctttgagcccgggtcgggagatgagaatggcacgagcaataaggaagacgaatttcgcatgccgtacctgagccatcagcagctaccggcaggtattctgcctatggtgccagaagtcgctcaggccgtcggggtcagccagggccaccatacaaaagatttcaccagagctgccccgaaccctgcaaaggcgactgttaccgctatgatcgcccgagaactgttatacggtgggacctctcccaccgccgaaacaattctcaaaaacaacatttcgagtggccatgttccacacggtcccttaacgagaccctctgaacagctggactatctttctagagtgcaaggcttccaggtagaatacaaggatttccctaagaacaacaaaaatgagttcgtttcactgatcaactgttcgagccaaccacctctgatttcccacggcatcggaaaggacgtggagtcttgccatgacatggccgccctcaacattctgaaactgcttagtgaactggatcagcagtcaaccgaaatgccccgcacaggaaatggtcccatgagtgtgtgtggccggtgctag

SEQ ID NO: 15318 - DNA, 1491 bp, Artificial Sequence
  Description of Artificial Sequence: Synthetic coding sequence
atgaaattgggcaaaaagcccatgtacaaaccagtggacccttactcacgaatgcagtcaacctataactacaacatgagggggggagcttatccaccaaggtacttttacccctttcctgtgccaccacttctgtaccaagtggaactctcggtgggcgggcagcagtttaatgggaaagggaagacccgccaggcagccaagcacgatgccgctgcaaaagcattgaggatcttgcagaatgaacctctccctgaaagactcgaggtcaacggacgcgagagtgaggaagaaaatctcaacaagtctgagatctcacaagtcttcgaaattgctttaaaacgcaacttgccggtgaattttgaggtggcccgggagtccggtccaccacatatgaagaatttcgtcacgaaggtgtccgttggcgaattcgtgggagaaggcgagggtaagtccaaaaaaatttcgaaaaagaacgcggcgatcgcagtattggaagagctaaaaaaactccctcccctcccggctgtcgaacgggtcaaaccccggattaagaaaaagaccaagcccatagtgaaacctcagactagccctgagtacggacagggtattaacccaattagccgcctggcacaaatccagcaggcaaagaaggaaaaggagcctgagtacacgctcttgactgaaagaggtctcccccgacggagagagtttgttatgcaggtgaaagtcggaaaccacacagcggaggggacgggaacaaacaagaaggtggccaaacgaaatgccgccgaaaatatgctggaaatactagggttcaaggtccctcaggcccagcccactaagcccgccttaaaatccgaggagaaaacccctataaaaaagcccggggatggccgtaaggtcacgtttttcgagcctggctccggcgacgagaatggaacgagtaacaaggaggatgaattccgcatgccctatttgtcccaccagcagttgccagcgggaattctgcccatggtgccagaggtcgcccaggcagttggggtgtctcagggccaccacacgaaggacttcactagagccgcaccaaatcccgctaaagctactgtgacagccatgatcgcccgcgagctgctctacggaggaactagccccacagcagagacgatactgaaaaacaacatttcctcaggacacgtgcctcacgggccactgaccaggccttcagagcagctcgactacctgtcacgggtgcaggggtttcaagttgagtacaaagacttcccaaagaacaataagaatgagttcgttagcttgatcaactgctcctcccagcctcctctcattagccacgggatcgggaaggacgtagagagctgccacgacatggcagctttgaacattctgaagctactatcagaactcgatcagcagagcacggagatgcctagaactgggaatggtccaatgagcgtctgtggacgatgttag

SEQ ID NO: 15319 - DNA, 1473 bp, Artificial Sequence
  Description of Artificial Sequence: Synthetic coding sequence
atgtccgaggttaccaagaacagcctagaaaaaatcctgccacaactgaaatgccacttcacgtggaacctgtttaaagaagattccgtctctcgtgatctggaggatagggtttgcaaccaaatcgagtttcttaataccgagttcaaggccaccatgtataacctcctggcgtatataaagcacctggacgggaataacgaagcagccttagagtgtctgagacaggctgaggagttgattcagcaggagcatgcagaccaggccgagataaggagcctggtcacatggggcaactacgcttgggtatattaccacctgggccgtctgtcagacgctcagatttacgtcgacaaggtgaaacagacatgtaagaagttttccaatccttattcgattgaatactcggagctggattgtgaggagggttggacccagcttaagtgtggtcggaacgaacgcgctaaggtgtgcttcgaaaaggctttggaggaaaagcctaacaatccagagttttcttcgggtctagccattgcaatgtatcacctggataatcatccagagaaacaattctccacggacgtgctcaaacaggcaatagagctcagtcccgataatcaatatgtgaaggtgctgctcggtttaaagctgcagaagatgaataaggaagccgaaggcgagcaattcgtggaggaggccctggaaaaatcaccttgccagaccgatgttctccgatctgccgcaaaattctacagacgaaaaggcgatctagataaggccatcgaactgttccagcgagtgctagagagtacgcccaataacgggtacttatatcaccaaatcggctgttgttataaggccaaggttagacagatgcaaaatacgggggaaagcgaggcatccggaaacaaggagatgatcgaagcgctgaagcagtacgcgatggattactctaataaggcattggaaaagggactgaatcccctgaatgcatactctgatctagccgagttcttggaaaccgaatgctatcagactccctttaataaagaggtccccgacgctgagaagcagcaatcccatcagaggtactgcaacttgcaaaaatacaacgggaagagcgaggatactgccgtccagcatgggctggagggactctccattagcaagaagagcacagacaaggaggaaataaaggaccaaccccaaaacgtaagcgaaaacctgttgccgcagaacgcccccaattactggtatttacagggcttgatacacaagcagaatggagacctgttgcaggccgctaagtgctatgaaaaagaacttggacggctgctaagggatgcccctagcggaatcggctctatctttctgagcgcctcagagcttgaggatgggtcagaggaaatgggacagggcgccgtgagcagctccccgcgagagctgttgtctaatagcgaacaactgaattag

SEQ ID NO: 15320 - DNA, 1473 bp, Artificial Sequence
  Description of Artificial Sequence: Synthetic coding sequence
atgtcagaggtgaccaaaaacagtctcgagaagatccttccccaactcaaatgtcactttacctggaatctgttcaaagaggacagtgtgtcccgcgacctggaagatagggtttgtaaccagatcgagttcctcaatactgaatttaaggctactatgtacaatctgttagcatatattaaacatcttgacgggaacaatgaggctgcgctagaatgccttaggcaggctgaagaattgatacagcaggagcatgcagatcaggcggagattcgaagtctggttacgtggggcaattacgcatgggtttactatcacctggggcggttatcagatgcccaaatctacgtggacaaggtcaaacagacatgtaaaaagttctcaaacccttacagtatcgagtattctgaattagattgtgaagagggctggacacagcttaagtgcggtaggaacgagagggcaaaggtctgctttgagaaggccctggaagagaaaccaaacaatccagaatttagttccggactggccatagcaatgtaccacctggacaaccatcccgaaaaacagttctctacagacgtgctgaagcaggccatagagctgtctcccgacaaccagtatgtaaaagtactcctgggcctgaagctgcaaaaaatgaacaaggaagctgaaggcgagcagttcgtggaagaggctctggaaaagagcccatgccagacggacgtgctgcgatcagccgccaagttttacagacggaaaggcgacttggacaaggccattgagctcttccagcgggttctggagtccacccccaacaacgggtacctgtatcatcaaatagggtgttgctataaggccaaggtgaggcaaatgcagaataccggggagtctgaggccagcggaaacaaggaaatgattgaggcgctcaagcagtatgccatggattactctaataaggccctcgagaaggggctgaacccgctgaatgcatattctgacttggctgaattcctggagacagaatgctaccaaactccattcaacaaagaagtgcccgacgccgaaaagcagcaaagccaccaaaggtattgcaatctgcagaaatataacggaaagtcggaagacaccgctgtgcaacatgggctagaaggcctgtcgatttccaaaaagtctacggacaaagaagaaatcaaagaccagccccagaacgtgagcgaaaacttgcttccccagaatgcgcccaactactggtaccttcagggcttgatccacaagcaaaacggggaccttcttcaagccgccaagtgttatgaaaaggaactcgggaggctactgagagacgcaccatctggtatcgggtctatatttctctccgcttctgaactggaagacggatcggaggaaatggggcagggcgctgtgtcctcttcccctagggaattattgtctaatagcgagcagttgaattag

SEQ ID NO: 15321 - DNA, 1509 bp, Artificial Sequence
  Description of Artificial Sequence: Synthetic coding sequence
atgaaactaggcaagaagccgatgtacaaaccagtggacccctattctcgcatgcaaagcacatataattacaatatgcgcggcggcgcataccctcccaggtacttttacccgtttccagtgccccccctgttgtatcaggtggagttgagcgttgggggtcagcagttcaacggaaaagggaaaacgcgacaggctgcaaaacacgacgccgcagccaaggctctgcggatcttgcagaacgagcccctgcctgaacgcctggaggttaacggaagagagtcagaggaggagaacctgaacaagtccgaaatcagtcaggtttttgaaatcgctctgaaaagaaatctgccagtcaacttcgagtcttttcctttgaaacaagtagcccgggaatccggcccgcctcatatgaaaaactttgtcactaaagtctccgtgggggagttcgtcggagagggggaaggtaagtcgaagaagatttctaagaagaacgccgctatcgccgtgcttgaagaactgaaaaaactgccacctttgcccgccgtggagcgcgtgaagccgcgaataaagaagaagactaaaccgatagtgaaacctcagacatcacccgagtatggacagggaataaatcctatctcacgcctcgcccagatccagcaggcaaagaaggagaaagaacccgagtatacccttctgaccgagcgcggactgccaaggagacgggaatttgtgatgcaggtgaaagtgggcaaccacacggctgaaggaacaggaacaaacaaaaaggtggctaagcgaaacgccgctgagaacatgctggagatactcgggtttaaggtgcctcaggcgcagccaacaaaacctgcactcaagtcagaggagaagactcctattaagaaacctggcgatggtcgtaaggtcactttcttcgagccagggtctggagatgaaaatggaaccagtaataaggaagatgaattccgcatgccatatctgtctcatcagcagctcccagccgggatcctgcctatggtgcctgaagtagcacaggcagtcggcgtctcacaggggcaccacaccaaggactttacaagggccgcaccaaatcctgcaaaagcgaccgtcacagctatgattgcccgcgagctcctgtacggtggcacgtctcctactgctgagacaatcctgaagaacaatatcagctccggacatgttccacacggacccctcacgcgcccatctgagcagcttgattacctgagtcgggttcagggctttcaggtggagtacaaggattttccaaagaataataaaaatgaattcgtatcactgataaactgttcctcccaacctccattaatctcacacggcatcggaaaggacgtggaaagctgccacgacatggccgcgctgaatatattgaaactcctgtccgaactggaccagcagtctactgaaatgccccggaccgggaacggacccatgagcgtctgcggacgatgctag

SEQ ID NO: 15322 - DNA, 654 bp, Artificial Sequence
  Description of Artificial Sequence: Synthetic coding sequence
atggcggaaggatcccagagcgccccagaggctggaaatgatatgggcaatgacgacgccatcggaggcaacgtaagcaaatatatcgtgctgccaacaggctactgcggtcaaccaaagaagggccaccttatatttgatgcctgcttcgagtcaggcaatttggggcgcgtggaccaggtatcagagtttgagtacgacttgtttataaggcccgatacctgtaatcccagatttcgtgtttggttcaactttacggtggagaacgtgaaagagagtcagcgcgttattttcaatatcgtgaacttcagcaaaacgaagagtctttatagggatgggatggctccaatggtgaaatccacgagtcgaccgaagtggcagcgcctacctcccaagaatgtatattactatcggtgtcccgatcacagaaaaaattatgtgatgtcttttgccttctgctttgacagggaagaggacatataccagttcgcctactgctacccttacacatacacacgtttccagcattatctagattcactgcagaaaaggaacatggactatttcttcagggagcagttgggacaatcagtgcagcagcgcaagctggacctcctgaccatcacttcgcctgctggtcgatggtcttggtag

SEQ ID NO: 15323 - DNA, 963 bp, Artificial Sequence
  Description of Artificial Sequence: Synthetic coding sequence
atggcagagggaagtcagtcagcaccagaggctggcaacgatatgggcaacgatgatgcaattggtggcaatgttagtaagtacattgttctgccgaccggctattgcggtcagccaaagaagggtcatttgatatttgatgcttgcttcgagtctggcaatctgggccgagtggaccaggtaagtgaattcgaatacgatcttttcatcaggccagacacttgtaatcctagatttcgggtctggttcaacttcactgtcgagaatgtaaaagagtcccagagagtaatcttcaatatcgtgaactttagcaaaacaaagtcactgtatcgtgacgggatggccccgatggtgaagtcgacctcccgaccaaagtggcagaggctcccacctaagaatgtttattactaccgctgtcccgatcaccgcaaaaattatgtgatgtcattcgctttctgtttcgaccgagaagaagacatttaccaatttgcctactgttatccatatacctatacccgcttccagcactacttggattccctgcaaaaacgaaacatggattattttttccgggaacagctcggacagagcgtgcaacaaagaaagctggatttactcacaataacatctcctgataatctccgcgagggcgccgagcagaaagtggttttcattaccggacgggtgcaccccggggagaccccgtctagctttgtctgccaaggcatcatcgactttctggtgtctcaacaccctattgcctgtgtactaagggagtatcttgtgttcaagatagcgcccatgctcaaccccgatggagtgtacctgggaaattacaggtgcagcctgatgggctttgacctgaaccgacattggctggaccctagtccttgggtgcacccgaccctgcatggtgtaaagcagctgatagtgcagatgtacaatgaccccgttagcaattag

SEQ ID NO: 15324 - DNA, 1512 bp, Artificial Sequence
  Description of Artificial Sequence: Synthetic coding sequence
atggcagagggaagccagtctgcccctgaggccggtaacgatatgggaaacgatgatgcaatcggcggtaacgtgtccaaatacatagtcctgcccaccggttattgcggacagcccaaaaagggccacctgatctttgacgcatgtttcgagagcggtaacttaggacgggtagatcaggtctcagaattcgagtacgacttattcattcgcccagacacctgcaaccccagattccgagtctggttcaacttcacggtagaaaacgtaaaggaaagtcaaagagtcatcttcaatatcgtgaattttagcaaaacaaaatccctctaccgggacgggatggcccccatggtaaagtccactagccggccaaaatggcaacgtctgccacctaaaaatgtttactactacagatgtcccgaccaccgaaagaattacgtcatgtctttcgctttttgctttgatagggaggaggacatctaccagtttgcctattgttacccgtacacctatacccgttttcagcattacttagatagcctccagaagcgcaatatggactacttcttccgcgagcagctgggccagtccgtgcagcagcgaaaactagatctgctcactattaccagtccagataacttacgcgaaggagccgagcaaaaggtggtgttcatcactgggcgagtccacccaggggagacacctagttccttcgtttgtcagggtattatagactttctggtgagtcaacacccaatcgcctgcgtcctaagagagtatctagtgttcaagattgctcctatgctgaatccggatggggtgtatctcggcaactaccggtgtagccttatgggcttcgatctgaatcgccactggttagacccctcaccttgggtgcaccccaccctccatggcgtgaaacagctcatcgtgcagatgtacaatgaccctaaaacgtctctggaattttacatcgacattcacgcccattccactatgatgaatggtttcatgtacggaaacattttcgaggacgaggagcgctttcagaggcaggctatttttccgaagctactttgtcaaaatgccgaagatttttcgtacagcagcacgagtttcaaccgggacgctgtgaaagcaggcaccggaagaagattcctcgggggcctgcttgatcacacaagctattgctacacgctagaagtgagtttctatagttatatcatctctgggactaccgccgctgtgccatacactgaagaggcgtatatgaaactggggaggaatgtagcccggacgtttctggactattatcgccttaatccggttgtggagaaggtggccataccaatgcctaggctcaggaacaaggaaattgaggtccagcgacgcaaggaaaagtctccaccatacaagcacccgctattgcggggcccagcctcgaattatcccaattccaaaggggataagaaatcttccgtgaaccataaagatcctagcacacctttctag

SEQ ID NO: 15325 - DNA, 1734 bp, Artificial Sequence
  Description of Artificial Sequence: Synthetic coding sequence
atgagccaggtccaggtccaggtccaaaaccccagcgccgccctttccggcagccagatccttaataagaatcaatccttactgagccagcctctgatgtcaattccttcaacaacatcatccttgccctctgaaaacgcaggaaggccaatccaaaattccgcactgccatctgctagcattaccagtacttctgccgctgccgaatccatcactcctaccgtggagctgaatgctctatgcatgaaactgggcaagaagccaatgtataagcccgtcgacccttactcacgaatgcagtctacatataactataatatgagaggcggtgcctaccctcctaggtacttttatcctttcccagtacctcctcttttgtatcaggtcgagctttctgtgggcggccagcagtttaacgggaaaggaaagacccggcaggccgcaaagcacgatgcggctgcaaaggcactgagaatacttcagaacgaacctctcccagaacgcctcgaggtgaacggtagggagagtgaagaggaaaacttgaacaagagcgagatttctcaggtattcgaaatagctctgaagaggaatcttccagtcaactttgaagtcgctcgcgagtcaggccctccccatatgaaaaactttgtgacgaaggtgtctgtgggagaattcgtgggagaaggagagggaaaaagtaagaaaatttctaagaagaatgctgccatcgccgtgctggaagagctgaagaagctgccacctctcccagctgtcgaaagagttaagccacgaattaagaagaagactaagccaatcgtgaaacctcagacctcacccgagtatggccaaggaatcaaccccatcagtcgcttggcacagattcagcaagcgaagaaggagaaagagcccgagtacactcttctaactgaacggggactgcccagaagaagggaattcgtaatgcaagtcaaagttgggaaccatacagcagagggaaccggcaccaataagaaggtggcaaagagaaatgccgccgagaacatgctggaaatcctggggtttaaagttccccaggctcaaccgacgaagccagccctgaagtccgaggagaagacaccaatcaagaagcccggcgatggccgaaaagtaacgtttttcgaacctggcagcggggacgaaaacgggacaagtaacaaagaggacgagtttaggatgccttatctaagtcaccagcagttaccagccgggattctgccaatggtacccgaagtcgcccaggccgtgggggtgtctcagggccaccacaccaaagacttcacccgtgcagctccaaatccggccaaggcgactgtgaccgccatgatcgcccgagaactgttatatggaggaacgagtcctactgctgagacaattctgaagaataatatcagctccgggcacgtccctcacggccccttgacccggccttccgaacagttagactacctcagtcgcgtacagggattccaggtggagtataaagacttccctaagaacaacaagaatgaattcgtgagcctgataaattgctcctcccagcccccacttatatcccacggcattggcaaggatgtggagtcatgccatgacatggctgctctgaatattctgaaacttttatccgagctcgatcagcaaagtacggagatgccaaggaccggcaacggcccaatgtctgtttgcggccgatgctag

SEQ ID NO: 15326 - DNA, 852 bp, Artificial Sequence
  Description of Artificial Sequence: Synthetic coding sequence
atgtctggtgcagtgctgttggagagggagcggttgacatcaggcacaacctggcatacagcaggtctgctgtggcaactgcgcccctccgacgtcgaagtagagctgctagctcacacaaggcgcgtggtaagtagggagctggaagaggaaacagggttgcataccggatggatccaaaacggcggcctgttcattgcaagcaatcggcagcggcttgatgagtataagcgtctgatgagcttggggaaagcttatggcgtcgaaagccacgtattgtcccctgccgaaacaaaaaccttgtatcccctgatgaacgtagacgatctgtacggaacattgtatgtgccgcacgatggcaccatggaccccgccgggacctgcacaacgctagccagagcagctagcgcacggggggcccaggtcatcgagaactgtcctgttaccggtattcgggtttggactgacgatttcggggtccgccgtgtggctggagtggagacccagcacgggtccattcagacaccctgtgtcgtaaattgtgctggcgtatgggcctcagccgtggggcgcatggccggcgtgaaagtacctctcgtggcaatgcatcacgcttatgtcgtgactgagcgaatcgaaggaattcagaatatgccaaacgttcgtgaccatgacgcctcagtttatctacggctgcaaggcgatgccctctccgtcggcggatacgaggccaaccccattttttgggaggaggccgtgaaataccgaccacgcgctgcaggaggcctctgtcttaaaacgagcacagagaaggtctgcgcagtctggtcagatgatcttcgtcgggcctag

SEQ ID NO: 15327 - DNA, 1107 bp, Artificial Sequence
  Description of Artificial Sequence: Synthetic coding sequence
atgtcttacttcgggaagttctatctcgtgggactggacgcgcgcaaagccgcagattggctcttcagcgctgacgtaagtcggcctccaggatcaactgtttatacctgcatgctaaaccatcgcgggggaactgagagcgatcttacagtgtcacgtctcgcgccttcccaccaagccagccccttagcacctgccttcgaaggcgatggttattatctagccatggggggagcagtggcccagcacaattggtctcatattactacagtccttcaggatcagaagtctcaatgtcaactgattgactccagtgaagatttgggaatgatatctatccaaggtccggcaagccgggcaatactgcaggaagtacttgacgcagatctgtccaacgaggctttcccgttctcaacacataagctgctccgtgctgcggggcatttagtgcgtgcgatgcgtctgagctttgtcggcgagctgggctgggaactgcatattccaaaagcctcttgtgtgcctgtgtatcgagccgtgatggcagccggagccaaacatgggctaatcaacgcaggctatagagccattgatagtctgtctattgagaagggctaccggcattggcacgctgacctacgtccagatgactcacccctggaagcaggcctggccttcacctgcaagcttaagagccccgtgcctttcttggggagggaggccctggaacagcagcgcgctgccggccttagacggcggctggtctgtttcacaatggaggaacccctgtggacaaggcctcaccccgctgtcagcggggcacctgcctttagcaccgccagttcttcaaaggtaccaatgttcggattagaggccatctggaggaacggccaggtggttgggcacgttcgacgggccgattttggattcgccatcgataaaactattgcctacggatatattcatgatccctccgggggccccgtgagtttggactttgtgaaatcaggagattatgctctggagcggatgggggtcacatatggtgcccaggcccacttaaagagtccatttgaccccaacaataaacgcgtgaagggaatttactag

SEQ ID NO: 15328 - DNA, 2757 bp, Artificial Sequence
  Description of Artificial Sequence: Synthetic coding sequence
atggcttcattatcaagggccctcagggtggcagccgctcacccccgccagtctcctactcgcggcatgggcccctgtaacctttccagtgcggccggacccaccgcggaaaaatcggtcccttatcagaggactttaaaggagggccagggtactagtgttgtggcccaggggccatcaaggccacttcccagcactgctaacgtggtagttatcggcggcggctctctgggctgccagaccctctaccatctggctaaactgggcatgtccggagctgtgcttctggaaagggaacgactgaccagcggtaccacctggcacacagcgggattactctggcaactaaggccttccgatgttgaggtggagttgctggctcacaccagaagagttgttagtagggaacttgaagaggagaccgggctgcataccggatggatccagaatgggggactctttattgctagtaaccggcagcgactcgacgagtacaaacggctgatgagccttgggaaggcctacggggtcgagtcccacgtgctgtctccagctgagactaaaacactttaccccctgatgaatgtcgatgatctctatggcactctgtacgtgccccacgatggaacaatggaccctgcaggaacatgcaccacactcgcccgggccgccagtgcccggggtgctcaagtgatcgaaaactgccccgttactgggataagggtttggactgacgatttcggtgtcagaagagtcgccggtgtggaaactcaacatgggtcgattcagaccccctgcgtagttaattgcgctggagtatgggcatccgcagtggggcggatggctggcgttaaggtgccactggtcgcaatgcatcatgcctacgtagtgacggagcgtattgaggggattcagaacatgccaaatgtccgggatcacgacgcctctgtctaccttcggctccagggcgatgccctgtcagtgggggggtacgaggccaaccctatcttctgggaagaagtgtctgacaagttcgcctttggcctctttgacctggactgggaggtctttacacagcatatagagggagcaattaaccgggtacccgtcctcgaaaaaaccggcattaaatcaactgtgtgcggcccagagagcttcacacccgatcacaagcctttaatgggggaagcacccgagctgagaggttttttcctgggttgtgggttcaatagcgctggtatgatgcttggggggggttgcggacaggagctggcccactggattattcacggacggccggagaaggacatgcatggctatgatattagaaggtttcatcactccctgacagatcatccacggtggatcagggagcgaagtcatgagagttacgcgaagaattactctgtagtattccctcacgatgaaccattagccggtcggaatatgcgcagagatcctctccacgaagagctgctgggccagggttgcgtgttccaggagcgacacgggtgggagcgcccaggctggttccacccaaggggcccagcccctgtgcttgaatacgactattacggtgcttacggaagcagagcccatgaagattacgcgtaccggcggctcctggctgacgaatatacttttgcctttcctccccaccacgataccattaagaaggagtgccttgcatgtagaggagccgctgctgtcttcgatatgtcgtatttcggaaaattttacttagtgggattagatgcgcgaaaggctgctgactggctgttctccgcagatgtaagtagaccacccgggtcaacggtttatacctgcatgttaaaccacaggggcgggacagaatccgatctgactgtctctcggctggccccttctcaccaggccagtcccttggctcccgccttcgaaggcgacgggtactacctggcgatgggtggagcagtagctcagcataattggtcccatattaccaccgtgttacaggaccagaagagtcagtgccaactaatcgatagcagcgaagacttgggcatgatttctattcagggccctgcatctcgtgccatcctccaggaggtgttagacgcagatctgtcaaatgaagctttcccattcagcacccataagctccttagggcggctggacatctggttagggcaatgcggctgagctttgtcggggaactcggatgggagctccatattcccaaagcatcttgtgtacctgtctacagagcagtgatggcggctggtgctaagcacgggcttataaatgccggttatcgtgccattgattcgctaagcattgagaaggggtatagacactggcacgctgaccttcgcccggatgattcaccattggaggccgggttggctttcacttgtaaactgaagtcacctgtgccctttttggggcgggaagccctcgagcagcagcgcgctgccgggcttcgtagacgcttagtctgcttcacaatggaggacaaagtgcctatgtttggattggaagccatttggcggaatggccaagtggtgggacacgtgcggagagcagactttggcttcgccattgacaagactattgcctacggctacatccatgacccctctggcggccccgtgagcctggatttcgtgaagtctggcgattatgcccttgagagaatgggggtgacatacggcgctcaggcccacctcaagtctccctttgatcctaacaacaaacgggtcaaagggatttactag

SEQ ID NO: 15329 - DNA, 720 bp, Artificial Sequence
  Description of Artificial Sequence: Synthetic coding sequence
atggaaggcaccgtcgagtctcagacccccgaccttcgtgacgtggaaggaaaagtcgggaggaaaactcctgagggcctcctgcgtggcttgaggggggagtgcgaactgggcaccagtggggccctgctgctgccgggagcaagttcaactggtcacgacctgggggacaagatcatggccctgaaaatggagctggcttatctgcgggccatcgatgtaaaaatcctccagcagcttgtgacactgaatgaaggcatagaggcggtgcgctggttgctagaagaacggggcactctgacatcgcactgctcaagtctgacatctagtcagtattcgctgaccggaggatcccctggcagaagtcgacgaggtagctgggattcactgccggacacttccacgacagacagacttgactctgttagcatcgggtcattcctggacacggtagcaccatccgagctggatgagcagggcccccccggcgctccacgatcagaaatggattgggctaaggtgatcgccggcggcgaacgggctcgcacagaagtggacgtggctgccaccagactgggaagtctgagggcggtttggaaacctcccggcgagagactacagggtggaccgcctgaatccccggaggacgaaagcgccaaacttggctttgaagcacattggttttgggagcaatgtcaggatgatgtgacattcttatag

SEQ ID NO: 15330 - DNA, 294 bp, Artificial Sequence
  Description of Artificial Sequence: Synthetic coding sequence
atgtcttcaggaaacgcaaaaataggccacccagcacccaatttcaaagccaccgctgacgaggggatctcttttagagggctgttcattattgacgacaaggggatactccgccagataaccgtgaacgacctccccgtcggacgatcggtggatgagactctccgtctagtgcaggctttccaattcacggataaacatggcgaagtttgccccgccgggtggaagccgggctccgacacaattaagccagatgtgcagaaaagcaaggagtatttctctaaacagaaatag

SEQ ID NO: 15331 - DNA, 1668 bp, Artificial Sequence
  Description of Artificial Sequence: Synthetic coding sequence
atggatcggtctaagagaaactctatcgcgggctttcccccacgggtagagcgactggaagaattcgaaggcggaggcgggggcgagggcaacgtatcccaggtgggccgagtctggcccagcagctatcgtgcactgataagtgcatttagcaggctgacacggctggacgatttcacatgtgagaagatcgggagcggatttttttctgaagtgttcaaagttcgacatcgtgccagtggccaggtgatggctctgaaaatgaatactctgtcatctaatcgagcgaacatgttaaaggaagtgcagttgatgaaccggctgagtcaccccaatatcctaaggtacattaatagcggcaatcttgagcaactgctagactccaaccttcacctgccatggaccgtgagagtgaagctagcgtatgacattgccgtcggcctatcttacctacacttcaagggaatttttcaccgcgatctgacgtctaaaaactgtctaataaagcgggatgaaaatggctattcggcagttgtcgcagatttcggactcgcagaaaaaatcccggatgtctcgatgggatcagagaagcttgcagtagtgggatctccattctggatggcccctgaggtcttgagggatgagccctacaatgagaaagccgacgtattctcctacgggattattctttgcgaaataatcgcaaggatacaagccgacccggattatctccctcgcaccgaaaatttcggactggattatgatgctttccagcatatggttggtgactgtcctcctgactttcttcagttgactttcaattgttgtaatatggacccaaaattgcgaccctccttcgttgagataggcaaaactctggaggaaatactgagccgactccaggaagaagaacaggaacgcgataggaagctgcaaccaactgctaggggcctactcgaaaaagctcctggggtcaaaagactcagcagtctggacgacaagattcctcacaaaagcccatgcccgcggagaaccatctggctctctcgcagccaatcagacatttttagtaggaagccgcccagaacagtgagcgtgttggacccttactaccgaccccgggacggggcagccagaacgcccaaagtgaaccctttcagtgcaaggcaggatctcatgggcggcaagatcaagttctttgatctgccaagtaagtccgtcatctccctggtgttcgatttagatgcaccaggacccggtacaatgccgctggctgattggcaggaacccttagcaccaccaattcgccggtggaggtctctgcccggctccccggagtttctgcatcaggaagcttgcccgttcgtcggtcgcgaggaatcactgtctgacggcccccctcccaggctgtcaagtctcaagtaccgcgtgaaggaaatcccaccattccgggccagcgctctgcctgctgcccaggcccatgaagcgatggactgtagtattcttcaggaggagaacgggttcggaagcaggccacaaggcacatcaccctgccctgcaggagcttccgaagagatggaggtcgaagaaaggcccgccggatccaccccggccactttttccacctcaggcatagggttgcagactcaaggtaagcaggacggctag

SEQ ID NO: 15332 - DNA, 1629 bp, Artificial Sequence
  Description of Artificial Sequence: Synthetic coding sequence
atggatcgctctaaacgcaattccattgcaggtttcccccccagggtggagcggctggaagaattcgagggaggtggaggcggcgagggcaatgtgtcccaggtaggaagagtctggccttcttcttatcgcgccttaatctccgccttttcacgcctgacgcgacttgatgatttcacctgcgagaagatcggctccggcttcttcagtgaagtgttcaaggtgaggcatcgggctagcggccaggttatggccctcaagatgaacacattatcttccaacagggccaatatgctcaaagaggtccagctgatgaatcgcctctctcaccctaacattctgagatttatgggcgtgtgcgtgcatcaaggacagctgcacgcgttgacagaatacatcaactctggcaatttggaacagctgctggattccaacctgcatctgccatggactgtacgcgtgaagttggcctatgatattgcagtgggactgtcctatctgcactttaaagggatcttccaccgcgatctgacgagtaaaaattgcttaattaagagagatgagaacgggtactccgcggttgttgcagattttggacttgcggagaaaatccctgacgtgtccatgggctctgagaagttggcagtcgtgggaagccccttttggatggcacccgaagtgttacgggacgagccttataacgagaaagccgacgttttcagctacggcatcatcctctgcgagatcatagcccggattcaggccgatcctgattatctacctcgtacggagatggaccccaaattgcgcccctcctttgtggaaatcggtaaaacgctggaagagatcctcagccggttacaggaagaggaacaagagcgggaccgaaagctgcagccaactgccaggggcctccttgagaaagcacctggagtaaagcgcctctcgtccctcgatgataaaatcccacacaagtctccatgcccaagacgaacaatctggttgtccaggagtcaatcagacattttttcccgtaaaccccccagaacagtttcagtgctggatccctactacagacctcgggacggagccgcacgaacccccaaggtcaatccattctccgcaaggcaggacctgatgggcgggaagatcaaattcttcgacttaccctcgaagtctgtaatatccttggtctttgatctggatgcacccgggccagggaccatgccgcttgctgactggcaggaaccactcgctcctcctatcaggaggtggaggagcttgccaggcagccctgagtttctacaccaggaggcctgtccatttgttgggcgcgaagagagtctgtcagacggaccacccccacgcctgtccagcctcaagtatcgagtcaaagagataccaccctttcgggcatcagccctcccggccgcccaggctcatgaagcaatggactgttctatcctacaagaggaaaacggtttcgggtctcgacctcagggaacctcaccttgcccggcaggcgcgtctgaagagatggaggtcgaagaaagacctgcaggctctacacctgctacattcagtacatctggcataggactccagacacaaggaaaacaggatgggtag

SEQ ID NO: 15333 - DNA, 1716 bp, Artificial Sequence
  Description of Artificial Sequence: Synthetic coding sequence
atggaccgcagtaagcgcaactcaatcgcaggcttcccgccaagggtggagcggctcgaggaatttgagggtggcggaggcggggagggaaacgtcagccaggtgggaagggtgtggcctagcagctatcgcgccttgatcagcgcttttagtagactgactagactcgatgattttacttgtgagaaaattggttctggcttcttcagtgaggtctttaaagtacgccatcgggccagtggccaagtgatggcgttgaaaatgaatacactatctagcaatcgcgcaaatatgctgaaggaagtgcaactgatgaacagattatcgcaccctaatatcttacggttcatgggggtctgtgtccatcagggacagctccacgctctcaccgaatacattaactctggtaatcttgagcaactgctggatagtaacttgcacctgccgtggacagttcgtgtcaagttagcctacgacattgccgtgggactgtcctatctgcacttcaaggggatctttcacagggacctgacatccaagaactgtttgattaaaagagatgaaaacggatactcagccgtcgttgccgacttcgggctcgcagaaaaaatccccgacgtcagtatgggctctgagaagctcgcagttgtgggtagcccattctggatggctccagaagtcctgagagatgaaccatacaatgagaaagctgatgtctttagctacggaatcatcctctgcgaaatcatcgcccgcatccaggctgatcctgattacctacccaggacggaaaacttcggccttgactatgatgctttccaacacatggtgggggattgcccccccgacttcctgcagcttacctttaactgttgcaacatggacccgaagcttcgaccttccttcgtggagatcggaaagaccttggaggagattctctctcgcttacaggaagaagaacaggaacgggacagaaagctgcaacccacagcaagaggactgctcgagaaagccccaggtgttaaacggttatcttctctggacgacaagatcccacacaagagcccctgtcctcgacgaacaatctggctcagtcgtagccaatccgacatttttagtcggaaaccaccacggacagtgagcgtgttggatccctattatagacctcgcgacggggccgcgcggacaccaaaggtcaatccattttcggcccgccaggacctcatgggcggtaagatcaaattttttgacttaccctcaaaatccgtgatttccctagtgttcgatctggatgctcccggaccaggaaccatgcccctcgcagattggcaggagcccctcgcccccccgattcggagatggagaagcctgccagggtcccccgagttcttgcatcaggaggcgtgcccctttgtcggccgggaagagtccttatcggatggaccaccaccccgtctcagcagccttaagtaccgcgtcaaagagatccctccatttcgggcttcagcgctgcctgccgcccaggctcacgaggctatggattgctccatactgcaggaggagaacgggttcgggtctaggccacagggtacgagcccctgtcccgccggcgcctccgaggaaatggaggtggaggagcgacctgcaggatccacgccagccacctttagcacctccggaataggccttcagacacagggaaagcaggatggttag

SEQ ID NO: 15334 - DNA, 1416 bp, Artificial Sequence
  Description of Artificial Sequence: Synthetic coding sequence
atgttaggctcctgggggtgctaccggtatgctaaattattctcctgctccctttccacacatgcccgatttatcaaaattctcgacagtgtcctccaccatctggtccctgcctgggaccacaccctgggcacattttctgagataaaacaggtgaagcaatttttgctattaagcagacagcgccccgggctggtggcacagtgtctgcgagatagtgaatcctctaaacctagtttcatgccaaggttatatatcaacaggaggcttgccatggaacacagagcgtgtccaagtcgggacccggcctgtaagaatgcagtgttcactcaggtttacgaaggcctcaaaccttcagataaatacgagaagcctctggactacaggtggcctatgagatacgaccagtggtgggaatgcaaattcatcgccgagggtattattgaccagggcgggggattccgggattctttggccgacatgtccgaagagctttgcccaagtagcgctgacacccccgtccctctaccgttcttcgtgcgcaccgcaaaccaggggaacgggaccggtgaagcccgcgatatgtatgtccccaaccctagctgcagggatttcgcaaagtatgagtggatcggccagctcatgggtgcggctctcaggggcaaagaattcttagttctggccctaccggggttcgtgtggaagcagctctctggagaggaagtgagttggagtaaggattttcctgcagtggattcagtgttagtcaagctgttggaggtcatggagggtatggataaggagacattcgaatttaaatttgggaaggaattaaccttcaccactgtcttaagcgatcagcaggttgtggaactgataccaggtggcgccgggatcgtcgtcgggtatggagatcgcagccgattcatacagctagtgcaaaaagcccgcctcgaagagtctaaggaacaggtcgcagccatgcaggcaggcctacttaaggtggtgccacaggccgtcctagatctcctcacctggcaagagttggagaaaaaagtgtgcggggaccccgaagtgaccgtggacgcccttcggaaattgacgcgatttgaagattttgaacccagcgacagccgggtgcagtatttttgggaagctctgaacaattttaccaatgaagaccggagtcggtttcttagatttgtaacagggcgaagtcgcctccctgcaagaatctacatctacccagataagttgggttacgagacgactgacgcactgcctgagtcttcaacttgcagctccaccctctttttacctcactatgcatcagcaaaggtctgtgaagagaaattacggtacgcggcttacaattgcgtggctatcgacacagatatgagcccttgggaagagtag

SEQ ID NO: 15335 - DNA, 825 bp, Artificial Sequence
  Description of Artificial Sequence: Synthetic coding sequence
atggccgcaccagaagccgaggtgctctcttctgcagccgttcctgacctggaatggtacgaaaaaagcgaagagacacatgcatcacagatcgaactcctagagacttctagcacccaggaaccgttaaacgcttcagaggccttttgtcccagagactgcatggttcccgtggtgttccccggaccggtctcacaggagggttgttgccagtttacctgcgagttactgaaacacataatgtaccagcgacaacagcttccgttgccttatgaacagctcaaacacttttacaggaagccgagcccccaagcagaggaaatgctgaagaaaaagcctcgcgccacaaccgaagtttcttccagaaagtgccagcaggcgctcgctgagcttgaatcagtcctgtcccacttagaggacttcttcgctcgtacacttgtgcccagggtcctcattcttctgggaggcaacgccctttctccgaaggagttttatgaactggacttgagcttgttagccccatactccgtagaccagtctcttagcactgcggcctgccttcgaagactcttccgggccatttttatggctgacgccttctcagaactgcaggcccctccattaatgggaacggtggtgatggcccagggtcaccgcaattgtggagaggattggttccggcccaaactgaattatcgggtcccatccagggggcacaaactgaccgtgactctgtcttgcggacgaccaagcatcaggacaacagcctgggaagactacatctggttccaagctcccgtaactttcaaaggatttcgggagtag

SEQ ID NO: 15336 - DNA, 2586 bp, Artificial Sequence
  Description of Artificial Sequence: Synthetic coding sequence
atggcgggaccaggccctggcgccgtgctcgagtctccgagacagctcctcggaagagttcggtttctcgcagaagcggccaggtcattacgggccgggcggccattacccgctgcgcttgcgttcgtgcctcgggaggtgctatacaagctgtacaaggatcctgccggcccatcccgagtgctgctccctgtctgggaagccgaggggttgggcctgcgggttggagcggctggaccagctcccggaactggcagcggcccactgagggccgctagggatagcatagaactgcggcggggcgcttgcgtcagaacaacaggagaggagttgtgtaacggccatggactgtgggtcaagctgaccaaggagcaactagcggagcacttgggcgactgcggactgcaggagggctggctgctcgtctgccggccagctgaaggtggagcccggttagtgcctattgatactcccaatcacctacagcggcagcagcagcttttcggagtggattatcgtcctgtactgcgctgggagcaggtcgtggatctcacgtattcccaccgtctaggctcccggccccagcccgccgaggcctacgctgaagcagtgcagcggctgttgtacgtccctccaacctggacttatgaatgcgacgaggacctgattcacttcctgtacgatcacctgggaaaggaggacgagaatctcggctctgtgaagcaatacgtcgaatccattgatgtcagttcttatacggaggagtttaatgtatcatgtctgacggatagtaacgctgacacctattgggagtccgatgggtcacagtgtcaacattgggtgcggctcaccatgaagaagggaaccatagttaaaaaattactgctaaccgtggacacaacagacgataatttcatgccaaagcgggtcgtggtgtacggtggagagggagacaaccttaagaagctgtcagacgtatcgatcgatgaaacattgattggagatgtgtgcgtgctcgaggatatgaccgtgcacttaccaattattgagatccggatcgtggagtgcagagatgacggaatcgacgtgcgcctgagaggcgtaaaaatcaagtcctcaagacagcgcgagctcggactaaatgcggaccttttccagcctacaagccttgtccggtatcccaggctggaaggaacagatcctgaagtcttatataggagggcagtgctgctgcagcggtttatcaaaatcttagactccgttctgcatcacttggttcctgcttgggatcacacactgggcacgtttagcgaaattaaacaagtcaaacagtttctcctgctctccaggcagcgtcctggtctggtcgctcagtgtctgagagacagcgagagctcgaagccaagctttatgcctcggctgtatattaacaggcgtctggcaatggagcatagagcatgccctagtagggaccccgcgtgtaaaaacgctgtttttactcaggtctacgaggggctcaaaccatccgacaaatacgaaaaacccctggattatcgatggccaatgagatacgatcagtggtgggaatgcaagttcatcgcggagggaataatcgaccagggcgggggctttcgtgactccttagcagatatgagcgaggagctatgtccctccagcgcagatacccctgtgcctctgcctttctttgtgcgcaccgcaaatcaggggaacgggacaggggaagctcgagacatgtacgtccccaatcctagctgtagggactttgccaaatacgagtggattgggcagttgatgggtgccgcactgagaggcaaagagttccttgtcctagcattaccaggattcgtatggaaacaactgagcggggaggaggttagttggagtaaggatttccccgcagttgactccgtactcgtaaaactattggaggttatggaaggaatggataaagaaaccttcgagtttaagttcggaaaagagctgaccttcacaacagtcctcagtgatcagcaggtggtagagctcatccccggaggggctgggatagtggtaggttacggggaccggagcagatttattcagctggtgcagaaggctcggctggaagaaagtaaggaacaggtggccgcaatgcaggccgggctcctcaaggtggttcctcaagcagtcctggatcttctaacttggcaagagttagagaagaaggtatgtggcgatccagaggtgacggtagacgccctccggaagctcacacgcttcgaggattttgaaccgagtgacagccgcgtgcagtatttctgggaagcattaaacaacttcacaaatgaggatagaagccgtttccttcggtttgtgacaggcagaagccgcctgccggctcgcatatacatctaccccgacaaactggggtatgagacaaccgatgctctgcccgaatctagtacatgctcgagtaccttgtttctgccccattacgcctcggccaaggtctgtgaagagaagcttcggtatgcagcctacaattgtgttgcaatagatactgatatgagtccatgggaagagtag

SEQ ID NO: 15337 - DNA, 1197 bp, Artificial Sequence
  Description of Artificial Sequence: Synthetic coding sequence
atggagagtgttctgtccaagtacgaggatcagattaccatctttacagattaccttgaggaatatccagacaccgatgaattagtgtggatcctcggcaagcagcacctcctcaagacggagaagtctaaactcctcagcgacatatccgcccggctctggttcacctaccgccgaaaattcagccctataggaggtaccggcccaagttctgatgcaggctggggttgtatgcttagatgcggtcaaatgatgcttgcccaagctctgatatgtcggcatctggggagggactggtcttgggaaaaacagaaggagcagcctaaagagtaccaacgcatactgcagtgttttctggacaggaaggattgttgttacagcatccaccagatggcccaaatgggggtgggcgagggaaagagcatcggggaatggtttggtccgaacacagtggctcaggtactcaaaaagctggccctgtttgacgagtggaactcactcgcagtgtatgtgtctatggacaacacagtggtgatcgaagacattaaaaaaatgtgcagggtgctccctctaagcgccgatacggccggagaccggccacccgactcgctgactgcctccaaccagagtaaaggcactagcgcttactgctccgcttggaagccactgctcctaatagttccactaaggctcggcattaaccagataaatccagtttacgtggatgctttcaaagaatgctttaaaatgcctcagtccctgggggctctgggcggcaaacctaacaatgcctactattttataggatttttaggggacgagctcatctttctagaccctcacaccactcagacctttgtagataccgaggagaatggcacagtgaatgaccagacctttcattgtctgcagagcccacaacgcatgaacatattaaacctggacccatccgtcgccctcggctttttctgtaaggaggaaaaggatttcgataattggtgctcactagtgcagaaagaaatccttaaggagaacctgagaatgtttgaattagttcagaagcacccatcccattggccaccatttgtgccaccggccaagcctgaagtgacaactacaggggctgaattcatagatagcaccgagcagctggaagagttcgacttagaagaagactttgagattctctctgtgtag

SEQ ID NO: 15338 - DNA, 1701 bp, Artificial Sequence
  Description of Artificial Sequence: Synthetic coding sequence
atggatctgcaccgagcagcttttaaaatggagaatagtagctatctgccgaatccacttgcgtcccctgccttaatggttctggcatcaacagcggaagcaagccgggacgcttcgatcccttgccaacagccccgaccttttggagtgcctgtgtcagttgataaggacgtgcacattccttttacgaacggatcttacacttttgccagcatgtatcatagacaggggggtgtccccggcactttcgccaaccgtgactttccaccaagcctcctgcatttgcacccgcagttcgctccccctaacctggactgtactccaatctccatgctcaatcattccggtgtaggcgccttcaggcctttcgcttctactgaagacagggagtcgtaccaaagcgctttcaccccagcaaaaagactgaaaaactgtcatgacactgaatcccctcacctaagattttccgacgccgatggcaaggaatatgacttcggcactcaattaccctcgtcgtccccaggttccctgaaagtggatgacaccggcaagaaaatcttcgctgtatctggtctgatttctgaccgcgaagccagcagttcccctgaagatcgcaacgaccggtgtaagaagaaggctgccgctctctttgactcacaggctcctatctgccctatttgccaggtgcttctgcggcctagtgagctgcaagagcacatggagcaggagctggagcagcttgcacagcttccatcctccaagaatagccttctcaaggacgccatggctcccgggactcctaaatctctgctgttaagtgcctctattaagcgagaaggagagtctcccaccgcctcgccacactctagcgccaccgacgacctgcaccattccgaccgctatcagaccttcctgagggtccgagccaacagacagactaggctgaatgcgcggatcggcaagatgaagcgtcgcaaacaagacgaggggcagcgcgaagggtcctgcatggctgaggatgatgccgtggatatcgagcatgagaacaataaccgctttgaggagtacgagtggtgtgggcagaagcggattcgtgccacgacactgctggaggggggtttccggggatccgggttcatcatgtgttccggtaaagaaaaccctgacagcgatgcagacctggatgtcgatggcgatgatacccttgagtatggcaagccgcaatatactgaagcggatgtgatcccttgcactggagaagaaccgggggaggctaaagagcgagaagcattacgaggtgctgtgctaaacggtggaccccctagtacacgaatcacgccagagtttagtaagtgggcttccgatgaaatgccttccacctcgaacggtgagtcgtctaagcaggaggccatgcagaaaacttgcaaaaactcagatatcgaaaagattacagaggattccgctgtgaccaccttcgaagctctcaaggctagggtcagagaattagagcgtcagctgtcgcggggtgatcggtataagtgtcttatatgtatggatagttactctatgccactgaccagtatacagtgttggcacgtgcattgcgaggaatgctggcttcgtactttgggcgccaaaaaactttgtccacagtgcaacaccataacggcccccggcgacttgagaaggatttacctgtag

SEQ ID NO: 15339 - DNA, 930 bp, Artificial Sequence
  Description of Artificial Sequence: Synthetic coding sequence
atgccgcgagcccgctctgggcggcgctcccggggggctgggggccgggaggaaacctttctcagggttcgtgccaacaggcagacacgtttaaacgcccggattggaaagatgaaacgacgtaagcaggatgagggtcaggtttgcccactgtgtaatagaccgcttgctggatccgagcaggagatgagtcgtcacgtggagcattgtctgtccaagagagagggatcctgtatggccgaggacgatgccgttgacattgagcacgagaataacaacaggttcgaagagtatgaatggtgtggccaaaagagaattagagcaactaccctgttggaaggggggttcagagggagtggattcatcatgtgtagcggaaaggagaatccggactccgatgctgacttggatgtggacggtgacgatacgcttgagtacggaaagcctcaatatactgaggccgatgtgattccttgtaccggcgaagagcccggggaggccaaggagcgggaggccttacggggggccgtgctgaatggcggtcctcctagcaccagaattacaccggagttttctaagtgggctagcgacgccgaaatgccttctacatccaacggagagagcagtaagcaggaagccatgcagaaaacctgtaaaaacagcgacatcgagaagatcaccgaggactccgccgttactactttcgaggcgttgaaggcgagagtccgcgagttagaacgtcagctaagccgtggcgacagatacaagtgcctgatctgtatggatagttactctatgccactaacaagcatccagtgctggcacgtgcattgtgaggagtgttggctaaggacactgggcgcaaaaaagttgtgcccccagtgtaacacaattacagcaccaggagacctccgacgcatttacctgtag

SEQ ID NO: 15340 - DNA, 1125 bp, Artificial Sequence
  Description of Artificial Sequence: Synthetic coding sequence
atggaatccgtgcttagcaagtatgaagaccaaattaccatcttcaccgactatttggaagagtacccagatactgacgagctcgtctggatcctgggcaagcaacacctgttaaagactggagggaccggaccaagcagcgatgcgggttggggttgtatgcttcggtgtggccaaatgatgcttgcccaagcactgatttgccgccatctgggccgggattggagctgggagaagcagaaggaacaacctaaagaataccagcggatcctgcaatgcttcctggaccggaaggactgctgctacagcattcatcagatggcccagatgggcgtgggagaagggaaaagtattggagaatggttcggcccgaacaccgtggcccaggtcctgaagaagctggctctgttcgatgagtggaactctctggccgtttatgttagtatggacaatacagtcgtgattgaagatatcaaaaagatgtgtcgggtgctgcccttgagtgcggacacagcgggtgataggcctccagattctctcacagcctccaatcagtctaaagggacatccgcctactgcagtgcatggaaaccacttctcctcatagttcctctccggctggggattaatcagattaaccctgtctatgtcgatgccttcaaagaatgttttaaaatgcctcaaagtttaggtgcactcggtgggaagcccaataatgcttactattttatcgggtttctgggagatgagctgatcttcttagatccacatactactcagacattcgtggacaccgaagagaacggcaccgtgaatgatcagacctttcattgccttcaaagccctcaacgaatgaatatcctgaatcttgatccatctgtggccctggggttcttttgtaaagaagagaaagattttgacaattggtgttccctggtgcagaaagaaatattaaaggaaaatctccgcatgttcgaactggtccagaaacaccctagtcactggccaccatttgtgcctccagccaaacctgaggtgaccacaaccggagctgaatttatcgacagcaccgaacagctcgaggaattcgatctggaagaagactttgagatactttccgtatag

SEQ ID NO: 15341 - DNA, 558 bp, Artificial Sequence
  Description of Artificial Sequence: Synthetic coding sequence
atggaaggctgtgttagcaacctcatggtttgtaacctcgcttattctgggaaactcgaagagttgaaagagtcgatacttgcggacaaaagtctcgccacacgcacagatcaagactctcggacggcgctgcattgggcttgcagcgctggccacaccgagattgtcgagttcctcctccaattgggagtccccgtgaatgataaggatgatgccgccagcaaaaataggcatgagattgcagtgatgttgttggaaggaggtgccaaccccgatgccaaggaccattacgaagcaacagccatgcacagggcagcagccaaaggcaatctcaaaatgatccacatcctgctatattacaaggcgtctactaatattcaagacaccgaagggaataccccattacacctcgcgtgtgacgaagagcgtgttgaagaggcaaagttactcgtttcacagggtgcttcaatttatatagagaataaggaggagaagaccccactgcaggtagcaaagggcggattaggattgatcttgaagcggatggtggaggggtag

SEQ ID NO: 15342 - DNA, 333 bp, Artificial Sequence
  Description of Artificial Sequence: Synthetic coding sequence
atggaggggtgcgtctcaaacctcatggtctgcaacctggcgtacagtggaaagcttgaagaactgaaagagtctatccttgccgataaaagtcttgcgaccagaaccgaccaggacagtagaacggctcttcattgggcttgctccgcggggcataccgagatagtcgagtttctacttcagctcggcgttccggtcaacgataaggatgacgcagccagtaagaaccgccacgaaattgctgtgatgctgctggagggaggtgcaaaccccgatgcgaaggaccactatgaggctaccgccatgcatcgggcagcagcaaaagacacctag

SEQ ID NO: 15343 - DNA, 546 bp, Artificial Sequence
  Description of Artificial Sequence: Synthetic coding sequence
atggttctgggtgctggatggggctgggcctatcaactgcaccttctccaggccctcaagcgcaagccggacctcttcttgtgcgaaagactcgacgtgaaggcagtgttccagtgtgcagttcttgccttgaagttcccagaagcccccacggtgaaggcaagttgtggcttcttcaccgagttacttcccaggtgcggtgaagtggaaagcgtgggtaaagttgtgcaggaggatggtaggatgctgctgattgccgtgctggaagctatcggcggacaagcttcacggtcgctcatggattgctttgctgatatcctgtttgcactcaacaaacactgtttcagcttgctgagtatgtggatcaaagaggctctgcagcctccaggctttccaagtgcgcggctgtcacctgaacagaaggatacattcagtcagcagattctgagagagagggtaaacaagaggcgggttaaggagatggtgaaagagttcacattgctgtgcagaggcctacacgggaccgactataccgcagactattag

SEQ ID NO: 15344 - DNA, 2892 bp, Artificial Sequence
  Description of Artificial Sequence: Synthetic coding sequence
atggaaaggagggaggagcagcccggcgcagcaggtgccggcgcggctcctgcattggactttactgtggagaatgttgaaaaggctctgcaccagttgtattacgatccaaacattgagaataagaatctggcccagaagtggttgatgcaagctcaggtgagtccgcaagcctggcatttttcctggcaattactccaacctgataaggtgcctgaaattcagtatttcggggccagcgctctgcacatcaagatctctcggtactggtccgatattcccactgaccagtacgagtctttaaaggcacaactgtttacgcagatcacccgttttgcgagcgggtctaagatagtgctcacacgactatgtgtggcactagcttcgctagccctgtccatgatgcccgatgcatggccatgcgcggtggcggatatggtgaggctgtttcaggccgaggattcaccagtggatggccagggcaggtgcctggcactcctggagttgctcaccgtgctgcccgaggagtttcaaacgagccgtctgcctcagtaccgcaaaggcttagttcggacttcccttgctgtagagtgcggcgcagtcttccctttactggaacagctcctgcaacagccatctagcccttcctgcgttcgccagaaggtactcaagtgcttctcgagttgggtgcagctcgaagtaccccttcaggattgcgaggccttgatccaggctgcttttgcggccctccaggattctgagctcttcgactcaagtgtggaggctatcgtgaatgcgatctcacagcctgacgcccagcggtatgtcaatactctcctcaaactgatcccactggttctcggactgcaggagcaactcaggcaggccgtgcaaaatggggacatggagacctcacacggtatatgtaggattgccgtggctcttggtgagaatcacagcagagcattactcgatcaagtcgagcactggcagtcttttctggcgctcgtgaatatgatcatgttctgtacaggaatcccggggcattatccggtcaacgaaacaacctcctcactgaccttgacattttggtatactctccaggatgatatactgtctttcgaggccgagaagcaggctgtttaccagcaggtctatcgtccagtgtatttccagcttgtcgatgttttactgcataaggcacagtttcccagcgacgaagaatatgggttctggtcatcagatgagaaggagcagtttcggatctaccgcgtggacatctccgacacacttatgtacgtgtatgaaatgctgggcgcagagctgctttctaacctgtatgacaaattgggcaggctcctgacctcttccgaggaaccatactcatggcagcatacagaggccctactgtacgggttccaatccatcgctgaaaccattgacgtgaactatagtgatgtggttcctggtctgatcggcttgattccgaggatcagtatctcaaacgtacaattagctgacactgtcatgttcacgattggcgccctaagcgagtggctcgccgatcaccccgtgatgattaacagtgtccttcccttggtcctgcatgcccttgggaacccagagctctcggtgtcttctgtaagcacactcaaaaagatctgtcgggagtgtaagtatgatctcccaccatacgcagccaacattgtagctgtgtcacaggacgtgctaatgaaacagatccataagacttcacagtgtatgtggttgatgcaagctcttggttttctactgagtgctcttcaagtcgaggaaattctgaaaaacctgcacagcctcatcagcccatatatccaacagctggaaaaactggctgaggagatccctaacccatctaacaagctggccatcgtgcatatcctgggactgctgagtaacctgtttacaacactggacatctcgcaccatgaggacgatcatgagggacccgagcttcgcaaactgcctgtccctcagggcccaaacccagtagtggtggtcctccagcaggtttttcagctcattcagaaggtcctgtctaaatggctgaatgacgcccaggttgttgaggccgtgtgcgccatcttcgagaaaagcgtcaagactctgctagacgattttgcacctatggtgccccagctttgtgagatgcttggtcgtatgtatagcacaatcccccaggccagcgctctggatttgacccggcaattagttcacattttcgctcacgagccagcacactttccaccgatagaagccctgtttctacttgttactagtgtgactctgactctttttcagcagggccctcgggatcatccagatattgtggatagtttcatgcagttgctagcccaggcactaaagagaaaaccagaccttttcctatgcgagaggctggatgtcaaggctgtttttcagtgtgctgtgctggccctgaaattcccagaagccccaactgtgaaagcttcctgcggtttttttacagaactcctccccagatgcggcgaggttgagagcgtgggaaaagtcgtgcaggaagatggccggatgctgctcattgccgttcttgaggcgatcggaggccaagcatcaagatccttgatggactgtttcgccgacatattgtttgcccttaataagcactgcttcagcctgctctccatgtggatcaaagaagccttgcagccccccgggtttccatctgctaggctctcacccgaacagaaagatacctttagtcagcagatcttgcgagagagggtcaacaagaggagggttaaggagatggtcaaagaattcactttgctttgcagaggactccacgggaccgattacaccgccgactactag

SEQ ID NO: 15345 - DNA, 2907 bp, Artificial Sequence
  Description of Artificial Sequence: Synthetic coding sequence
atgaggctgcttcggcataccgaaagcgagcagtggttccataggttcccactgtgccctagtcttaccttttgggccccagttgccatgtggccacagacacactgcgtggggggtagatcttccggcctcactaaatggacatactctttcagtgcttctcttcaagatggctcttttccatatgatagcgttccctggcagcaaaatactaaccagccccctgggagtctttctgtggtcaccacagtttggggcgtgactaatacgagtcagtcccaggcggatgtgctgatcccccacgcgacttgtagacctggtcctctcttaatcaccgcatgggagccctacgggcaatgccagcaaccccacgaaagcagacgccagccccatggagtcggccatgatcaccagcagccccgcccccagttaccgacagtgtgcggagcagcagctgcagtcctctcccagggttggccgcgtagcgccctacatccggcagaacacgtatggcccgctcagttgccacggcaacgcggactgtgggggcagccggccgccgccgctgctgccgcagctgtggctgccgccgccgccacagcaacagctaccgctacagccaccgttgccgctttgcaggagacgcaaaacaaggacattaatcagtatggccccgccccagtgttgttgcccgacctgctgaaagatggccttggggacgaagagagaggtgcaccaattgggatgcagaacagcatgaatcccgcatccatggcagctgggatgactcctagcggtatgagcggcccaccaatgggcatgaaccaaccccgccccccaggaatctcacccttcggaacccacggccagcggatgccacagcaaacatacccggggccccgaccacagtctctccccatccagaacatcaagcggccctaccccggcgaacccaattacggcaatcagcagtacggcccaaactctcagttccccacacagccaggccagtaccccgctccaaaccccccccgcccactgaccagcccaaactatcccggtcagaggatgccttcccagccctcgtctgggcaatacccacccccaaccgtaaacatgggccagtactacaagcctgagcaattcaacggacaaaacaatacattctccggtagcagctatagcaactatagccagggaaacgttaaccggccgcctagacccgtgcccgtcgccaattacccccactcacctgtgcccggtaatccaacacctcccatgacccccgggtcctctattccgccttatctcagcccttcccaggacgtgaaaccaccattcccaccagatattaaacccaacatgagcgcactccccccaccccccgaccacaatgacgaactccgattgacgttcccggtgcgcgacggggttgtcttggagcctttccggcttgagcacaatctggctgtttctaaccacgtattccacctgcggcccaccgttcaccagacgctcatgtggtccgacctggaactacagttcaagtgttaccaccacgaggatcgtcaaatgaataccaattggccagcctctgtgcaagtatccgtcaacgctacccccctaaccatcgaaaggggggacaataagacctcccataaacctctgcacctgaagcatgtgtgtcagcctgggcgtaacactatccagattaccgtaacggcatgttgctgctcccacctctttgtgttgcagttagtgcacaggccatccgtgcggtcagtactgcagggactgctgaagaagaggctcctcccggctgaacattgcatcaccaagaagaggaacttttctagcgttgctgcatcaagcgggaataccaccctgaacggagaggatggtgtggaacagaccgctatcaaggtttcactgaagtgtccaatcaccttcagacgcatacagctgccagcccgtggtcacgattgtaagcacgtgcagtgtttcgacctcgagtcctacctccagctcaattgcgaaaggggaacatggcgctgccccgtgtgcaagactgcattactggagggtcttgaggtggatcaatacatgtggggtattctgaatgcaattcacagcgagttcgaggaggttacaatcgatcccacatgcagttggagacccgtccctatcaagagtgacttacacattaaggatgacccagacggtatcccttcaaaacgcttcaagactatgtccccttcacagatgattatgccgaacgtcatggagatgatcgcagcgctgggcccaggaccgtcaccataccccctaccgccgccccctggaggtacaaattccaatgattactccagtcagaataactaccagggccacggtaattttgattttccacacggtaaccccggcggtacatccatgaatgattttatgcatggccccccgcaattaagtcatcctcccgatatgcccaataatatggctgctctggagaaacccctgtcccaccccatgcaagagacaatgccgcatgctggctcttcggatcaaccacacccaagtattcagcagggcctgcatgtaccgcatccgagctctcagagcggcccgcccttgcaccactctggcgcacctcccccaccaccctcgcagcccccgcgacagccgccgcaggctgccccttctagtcacccacactccgatttgaccttcaacccgagctcagcacttgagggccaggctggcgcgcaaggggcatctgacatgcctgagcctagcttagacttgcttcctgaacttaccaaccccgacgagctgctgtcttatctggaccccccggacctgcctagtaacagcaatgacgacttattgagcctgttcgaaaataattag

SEQ ID NO: 15346 - DNA, 603 bp, Artificial Sequence
  Description of Artificial Sequence: Synthetic coding sequence
atggcgatggagatgagactgccagtcgcacgcaaacccctgagtgaacggctgggaagggacaccaagaagcacttagtcgtccctggcgatacaattactaccgacactgggttcatgcgaggccacgggacttacatgggagaagagaaacttatcgctagcgtggccggatcggttgaacgtgtgaacaaactgatttgcgttaaggccctcaaaacccgatacataggtgaggtcggagatatcgtcgtgggccggataactgaagtacaacagaagagatggaaggtggaaaccaacagtcggttggatagtgtactgttgctgagtagcatgaatttacctggcggtgaactgcgccgccggtcagccgaggacgaactggctatgcgaggcttcctgcaggagggggatttgatcagtgcggaggtgcaggcagttttctctgacggtgctgtttctctacataccagaagtctgaagtacggtaagactcacttccatgaccttccatgtggcgccagcgtcatcttgggcaataatgggtttatttggatataccctactcccgaacataaagaggaagaggccgggggctag

SEQ ID NO: 15347 - DNA, 792 bp, Artificial Sequence
  Description of Artificial Sequence: Synthetic coding sequence
atggcaatggaaatgagactgccagtcgcccgaaaacccctttcggaacgcctcggcagggatacaaagaaacacttggtggtgcctggagatacaatcactacggatactgggtttatgaggggccacggaacatacatgggtgaggagaaacttattgctagcgtagcgggctctgtcgaacgtgtgaacaagctgatttgtgtgaaggcactcaagacgcgatacatcggagaggtgggtgacattgtggtcggcagaattacagagaggaggcggagcgcggaggacgaactggctatgaggggctttctgcaggagggggatctgatatcggccgaggtccaggccgttttctctgatggtgcagtctcccttcatacgagatctctcaaatatggcaaactgggacaaggcgtcctcgtccaggtgtcaccatcactcgtcaaacgccagaagactcactttcacgacctgccctgcggggcctcagttatcctgggaaacaatggttttatatggatttatccaacgcctgagcacaaagaagaagaggccggaggattcatcgcaaacctcgagccggtttcactggcggatagggaggtcatatcccgtctgcggaactgcatcatcagtctggtcacacagcgcatgatgttgtatgatacgagtatactgtactgttacgaagcctccctgccccatcagattaaagacattttgaagccagaaatcatggaagagattgtgatggaaaccaggcagcggctcctggaacaagaaggctag

SEQ ID NO: 15348 - DNA, 858 bp, Artificial Sequence
  Description of Artificial Sequence: Synthetic coding sequence
atggccatggagatgcgtctcccagtcgctagaaagccattatccgagcgattgggccgggacacaaagaagcatttagtcgtacccggtgacaccattaccacggacactgggttcatgcgcggccacggaacttatatgggcgaggaaaaactaattgcctctgtggccggctctgtggagagagttaacaaactgatctgtgttaaagcactcaagactcgttacataggcgaggtcggcgatatcgttgtgggtcgcatcacggaggtgcaacagaaacgttggaaggtggaaactaacagcaggcttgattcggtgcttctgctgagttctatgaatttgccaggtggggaattacgcaggcgcagtgcagaagatgaactggcaatgcgcggatttttacaagagggggatctaatttcagccgaagttcaggccgtattctctgatggcgcggtatctttacacacacgatctttgaaatacgggaaagtgagtccaagcctggtaaaaagacagaagactcacttccatgacctaccctgcggagctagcgtgattctcgggaataatggatttatctggatctatccaaccccggaacataaagaagaagaagctggcggtttcatcgccaacctggaacccgtgagcctggctgatcgggaagtgatttctaggctgaggaactgcattatttctcttgtcactcagcgcatgatgctttatgacacatctattctctactgttatgaagccagtcttcctcaccagataaaagacattctcaagccagagatcatggaagaaattgtcatggaaacaaggcaacgacttctcgagcaggaaggatag

SEQ ID NO: 15349 - DNA, 882 bp, Artificial Sequence
  Description of Artificial Sequence: Synthetic coding sequence
atggcaatggaaatgaggctgcccgtagctaggaaaccactcagtgaacggttgggccgcgacacaaaaaaacatctcgtggttcccggcgacaccatcacaacggacacaggttttatgagaggacacggcacgtatatgggggaggaaaagctgattgcctctgtggccggttcggtcgaaagagtgaacaagctgatatgcgtcaaggctctaaaaacaaggtatatcggagaggttggcgacatcgtggttggacgcattacagaggtgcagcagaagcgctggaaggtcgagactaattcgcgtctcgacagcgtgctcttgcttagctccatgaatctgccagggggggagctgcgtcgccgtagcgcagaagatgaactcgctatgaggggcttcctgcaggagggggacctgatctctgccgaagtgcaggccgttttctccgatggcgccgtttcgctgcatactagaagcctgaagtatggaaagcttggacagggcgttttggtgcaggtctcaccgtccctggtaaaacggcagaaaacgcatttccacgacctgccctgcggcgcttctgtgatcctcgggaacaacggcttcatctggatctaccctacccctgaacacaaggaggaggaagcaggggggtttatcgcaaatttggaaccagtttccttggcagacagggaagtgatctcccgtctccgtaactgtatcatctccctggtgacccagcgcatgatgctgtacgacacgtcaattctgtactgttatgaagcctcacttccgcatcagattaaagacatccttaagcccgaaataatggaagagatcgttatggaaactcgacaacgcttgcttgagcaggagggttag

SEQ ID NO: 15350 - DNA, 3195 bp, Artificial Sequence
  Description of Artificial Sequence: Synthetic coding sequence
atggcctctgagtctgagaccctgaatcctagcgccaggattatgacgttttatcctacgatggaagagtttcgcaatttctcgagatacatagcttatattgaatcccagggtgcacatcgtgctgggctcgcaaaggtggtgcctccaaaggaatggaaaccccgagcctcttatgacgacatcgatgaccttgtcatcccggcaccaattcaacaactggtgacgggtcagtccgggctatttactcagtacaatatccagaagaaagccatgactgtgcgcgagtttaggaagatcgccaattcagataaatactgcactccaagatactcggaattcgaggagctcgaacgtaagtactggaaaaacctcaccttcaacccgccaatctacggagccgatgtgaatgggactttgtacgagaagcacgtggacgagtggaacatcggtcgccttcgcactatactcgacttagtagagaaggagagcgggatcactattgagggcgtgaataccccctacctttactttggtatgtggaagacttcattcgcttggcacacagaagatatggatttatacagtatcaactacttgcactttggtgagcctaagtcgtggtatagcgtccctcccgagcatggcaagaggttggagagactcgccaagggcttcttccccgggagcgcacagagttgcgaggccttccttagacataaaatgacgctcatatcgcccctcatgctcaagaaatacggtattccattcgataaggtgacacaggaggcaggcgagttcatgattacctttccctacgggtaccacgctggttttaatcatgggttcaactgcgcagagagtaccaacttcgctacacggcgttggatcgaatacggcaagcaggccgtgctatgctcttgcaggaaagatatggttaagatctccatggacgttttcgtgagaaaattccagcctgaacgttacaaattgtggaaagcaggcaaggataacaccgtgatcgatcacaccctgcctactccagaagctgctgaattcctgaaagaaagtgagctgcctcccagggccggtaatgaagaagaatgccctgaggaagatatggagggcgtagaagacggcgaagaaggggacctgaaaacaagcctggcgaaacacaggatcggcacaaaacgccatcgggtgtgtttggaaatcccacaagaggtgagccaaagcgaattattccccaaggaggatctcagctctgagcagtacgagatgactgaatgccctgccgccctggcaccagtgaggcccactcacagcagtgtcaggcaggttgaggacggactgacttttcccgattattccgacagtaccgaggtcaagtttgaagaacttaaaaacgtcaaactggaggaagaagatgaagaagaggagcaagcagcggcagcactagacctctctgttaacccagcttcagtcggaggtcgcttggttttcagcggttctaagaaaaagtcgagctccagcctcgggtccggatcgagtcgagatagcatttcatcagattcggaaactagtgagccactcagctgtcgcgcgcaaggtcagactggtgtattgactgtacattcctatgctaagggtgacggcagggtgacagtgggcgagccttgcactaggaaaaaaggatcagcagctcggtccttttcagaacgcgagctggctgaagttgctgatgaatacatgttcagcctagaggaaaataaaaaatcaaaaggtcggcgtcagcctttgtcaaagctccccaggcatcacccgctagtgcttcaggagtgtgtgtcagatgatgagacatccgaacagctcacccctgaggaggaggccgaggagactgaagcctgggccaaaccacttagtcagctgtggcaaaatcgcccgcccaatttcgaggcggaaaaagagtttaatgagaccatggcccagcaggcaccccattgcgctgtgtgcatgatttttcaaacctatcaccaggtcgagttcgggggcttcaaccagaattgcgggaacgcatccgatctggcgccccagaagcaacggactaagcctctcatcccggagatgtgttttacttccacgggctgttccaccgatattaacctctcaaccccctacctcgaggaagacgggactagcattcttgttagttgcaagaaatgtagtgtgagagtgcacgcatcatgttatggggtgccacccgccaaggcctcagaagattggatgtgttctaggtgttccgccaacgccctggaagaagattgttgcctgtgctctttgcggggcggagccctacagagggcaaacgatgatcggtgggtgcacgtctcctgcgcggtcgcgatcctggaagcaagatttgtgaacatcgcagagcgtagccctgttgatgtttcaaagataccacttcctcgattcaaactcaaatgcatcttttgcaaaaaaaggaggaaacgcaccgcaggctgctgcgttcagtgtagccatgggcgctgcccaacagcgttccatgtgagctgcgcccaggctgccggcgtgatgatgcagcccgatgactggccttttgtcgtatttattacatgctttaggcacaaaatacctaatctcgagcgcgcgaaaggagccctccagtccatcactgccggacaaaaggtcatctcgaaacataaaaacgggcgcttctatcaatgcgaggtcgtgaggttgactactgaaacattctacgaggttaactttgacgatggctctttttcagataacctgtatccggaagacatcgtgtcccaagattgtcttcaattcggtccaccggccgaaggtgaggtcgtgcaggtgagatggacagatggacaagtgtatggcgccaagttcgtggcgtcccacccaatccagatgtatcaggttgaatttgaggatggatcacagctggtcgtgaagcgggacgacgtttataccctggatgaggaactgcccaagcgcgtgaaatcgcgcctgtccgtagcgagtgacatgcgcttcaacgaaattttcacggaaaaggaagtcaaacaagagaagaagcgacagcgcgtgattaacagccggtatcgtgaggattatatagagcctgctctgtaccgagcgatcatggaatag

SEQ ID NO: 15351 - DNA, 2745 bp, Artificial Sequence
  Description of Artificial Sequence: Synthetic coding sequence
atgggtgacagtagagacctttgtccgcacctggacagcataggcgaggttactaaggaagatctgctcctcaaatcaaagggcacatgtcagtcctgtggtgtgacaggtccaaacctctgggcatgcttacaagttgcttgcccatatgtcggctgcggcgaatctttcgctgatcacagtactatccacgcacaggcaaaaaagcataacctgaccgttaacttgacgacatttcggctgtggtgttacgcctgtgagaaagaagtttttctggagcagagactggctgcgccccttctgggcagctcctccaaatttagcgagcaggactccccaccaccatcccaccctttgaaggccgtgccgattgctgtagcggacgagggagagtccgaaagcgaggacgatgatttaaagcctcgtggtcttaccggcatgaagaatctgggcaattcatgttacatgaacgcggccttgcaagcactctctaactgtcctccactgacccagttcttcttggaatgtgggggactcgtccggactgacaaaaagcctgccctttgcaagagctaccaaaaactggtgtctgaggtgtggcataagaagcgaccgtcctatgtagttccaacgagcctcagccacgggatcaagctcgttaatcccatgttccgaggatatgctcagcaggacacccaagaatttttaagatgtctgatggaccagctgcatgaagagctgaaggagccagtcgtggccactgtcgccttaacggaggctcgggactccgactcatctgacacagacgaaaagagggagggcgaccgatcaccgagcgaggacgagtttctgtcctgcgatagtagcagtgacaggggggaaggggatggacaaggccgggggggcgggagttctcaggcagagactgaactgttgatacccgatgaagcaggaagggcgatctccgaaaaagagcggatgaaagacagaaagtttagttgggggcagcagaggactaactcggaacaggttgatgaagacgccgatgtggatacggctatggctgccctggatgaccaacctgccgaagcacaaccaccatcgcccagatcttcctctccttgccggactcctgagccagataacgatgcccaccttcgaagctcctcacggccttgtagcccagtgcaccaccatgagggccacgccaagctgagttcatcccctcctagagcaagcccggtgcggatggctccatcttacgtgctgaagaaagcgcaggtgctgtctgccggatcacgaaggcgcaaggagcagaggtatcgaagcgtgatatccgacatttttgacggaagcatccttagtttagtccagtgtttgacatgcgatagggtctcaactacagtggagacgtttcaggacttatcactgcctattccgggaaaagaagatctggctaagctgcactctgccatctatcagaatgtcccagctaagccgggcgcgtgtggcgattcctacgcagcgcagggctggctcgccttcattgtcgagtatattagaagattcgtagttagttgcactccttcatggttctggggacccgttgtgacccttgaagactgcctggccgcattttttgcagccgacgaacttaagggcgacaacatgtactcctgtgaacggtgcaaaaagctgagaaacggtgtgaaatactgtaaggtgctgcggctacccgaaattctttgcatacacctcaaaaggttccgtcatgaagtgatgtactcattcaagattaacagccacgtcagtttccctttggagggtctggatcttagaccatttctggccaaagaatgcacctctcaaattaccacttacgacctgctatccgtcatctgccaccacgggacggctgggtctggtcactatattgcatactgccagaatgtcattaacggacaatggtacgagtttgatgaccaatacgttaccgaagtccatgaaacggttgtccaaaacgccgaggggtacgtgctgttctacaggaaatcatccgaagaggcaatgcgggaacgtcagcaggtggtcagtcttgctgctatgcgagagccatctcttttgagattttacgttagccgagagtggctcaataaattcaatacgtttgccgaacctggccctataaccaaccagaccttcctctgctcccacggggggatacctccccataaataccattacatcgacgaccttgtcgtgattctacctcaaaacgtctgggaacacctgtacaatcgcttcggcggcgggccggccgtcaatcatctgtacgtctgtagtatctgccaggtggaaatcgaggccctcgcgaaacgcaggagaatcgaaatcgacaccttcatcaaacttaataaagcatttcaagcagaggagtcccctggagtcatatactgtatcagcatgcagtggtttcgagaatgggaagcattcgttaaggggaaggataacgagcctcctgggcctatcgataatagccggatcgcccaggtcaaaggttccgggcacgtccaactgaagcagggcgccgactatgggcaaatctccgaagaaacatggacctacctaaacagtctctatggcggcggcccagagatcgccatccggcagtcagtggcacagcccctcggcccagaaaatttgcacggggaacagaaaatcgaggccgagacacgcgccgtgtag

SEQ ID NO: 15352 - DNA, 1215 bp, Artificial Sequence
  Description of Artificial Sequence: Synthetic coding sequence
atggactttaatatgaaaaaactggcaagcgatgcaggcatcttctttactcgggccgtgcagtttactgaggagaagttcggacaggcagagaagactgagctggacgctcactttgaaaatctgctggccagggctgatagtactaaaaactggacagagaagatccttcgacagactgaggtgttgctccagcctaaccctagcgcgcgcgtggaggaattcctgtacgagaagctggaccgcaaggtgcctagccgagtgaccaacggcgagctgcttgcacagtacatggctgatgcggccagtgagttgggacccactaccccatacggcaagaccctgattaaagtagctgaagctgaaaagcagctgggagcggcagagcgggacttcattcatactgcgtccattagtttccttacacccctgcggaactttctggagggggattggaagactatatcaaaagaacgccgcctgttgcagaatagacgcctggatctcgatgcttgcaaagctcgcctgaagaaagccaaagctgccgaagccaaagcaacgtgcgagggcgacaccgtgccagacttccaggagactaggccacgaaactacatactgagcgcatccgccagcgcactgtggaatgatgaggtagataaggcagaacaggaactccgggttgcccaaacagagttcgacagacaggctgaagtgacaaggctacttctcgaaggaattagttccacccacgttaatcacttaagatgtctccacgaattcgtgaaatctcaaacaacttactatgcgcagtgctatcggcacatgctggacctccaaaaacaactaggctcttcccaaggcgcaatctttccagggaccttcgtgggtaccacagagccagcatccccacctttaagttccaccagcccaacaacagcggcggcaacgatgcccgttgtcccctcagtcgcatccctggcaccaccaggggaggctagtctgtgtcttgaggaggtggcgcctccagcaagtgggacccgcaaggccagagtgctctacgactacgaggccgccgacagtagcgaactggcactcctggccgatgaattgataactgtgtactcattaccaggcatggatccagactggctgattggggagcgtggaaacaaaaaaggtaaagtcccggtgacatacctggaactcttgtcatag

SEQ ID NO: 15353 - DNA, 1188 bp, Artificial Sequence
  Description of Artificial Sequence: Synthetic coding sequence
atggacttcaatatgaagaagcttgcgtccgacgccggcattttctttacacgcgccgttcagttcactgaagaaaaattcggacaggccgaaaagaccgagctggacgcccactttgagaatcttcttgcccgtgccgactctaccaagaattggactgaaaagatcctgcggcagactgaagtgcttctccagcccaacccctcagctcgcgtcgaggaatttctgtatgagaaactagatcggaaagtgcctagcagagtgactaacggcgagctccttgcacagtacatggccgacgctgctagcgagcttggacctacgaccccctacgggaagacgcttatcaaggtcgcggaggctgagaagcagctgggcgccgcagaacgggactttatccatacagccagtatttcgtttctcacacccctaagaaactttctggagggtgactggaagactatttccaaggaaagaagactgctgcagaaccgccgtctggatctggatgcttgcaaggccagattaaaaaaagctaaggctgctgaagccaaggccaccactgtgccggacttccaagaaacaagaccaaggaactatattctctcagcttccgcatcagccttgtggaacgatgaagtcgataaagcagagcaagagctgagggtcgcacaaacagagttcgatcggcaggcagaagtgacacgcttactcctagaaggaatcagtagtacgcacgttaaccacctgagatgcctccacgagttcgttaaatcacagactacttactacgctcagtgctacagacacatgctggacctacagaagcagctggggaggttccctggaacatttgtgggtaccaccgagcccgcgagtcctccactttcctccacatctcctacaaccgccgcagctacaatgcccgtagtgccttccgttgcatctctggcacctcctggcgaggcatccctttgtctggaagaagtcgcccccccagccagcggcacgagaaaagcaagggtgttatacgattatgaggccgcagactccagcgagctggcactgctggcagacgaattgatcacggtatattctctgcctggaatggaccccgactggctgattggtgagaggggtaataaaaaggggaaagttccggtgacatacctggaactgctgtcttag

SEQ ID NO: 15354 - DNA, 1188 bp, Artificial Sequence
  Description of Artificial Sequence: Synthetic coding sequence
atggattttaacatgaagaaactggcgtccgatgcagggattttctttactcgggctgttcagtttaccgaggagaaattcggacaggccgagaagaccgagttagatgctcacttcgagaatcttctggctcgtgctgatagcactaaaaactggactgaaaagatcctacgacagacagaggtgctcctgcagcccaatccctctgctcgcgtggaggagtttctttacgagaagcttgatcgtaaagtcccaagccgggtgactaatggggagctgctggcccaatatatggccgatgccgccagcgaactaggccctaccacaccatatggcaagactctcattaaggttgccgaagctgaaaaacagcttggcgcagctgaacgcgatttcatccacacagctagcatttccttcctgacgcctctccgcaacttcctcgagggcgattggaaaactatcagtaaggagcgtcggctgcttcagaatagaagactcgatttggatgcttgcaaagcccggttaaaaaaagcaaaagccgcagaggcaaaggctacaacggtgcctgatttccaagagacccgcccgcgtaattacatcctctctgcctcagcttccgccttgtggaatgatgaggtggataaggctgagcaggaactccgcgtggctcagactgagttcgatcgccaggcggaggtcactaggctgttgttagagggaatctctagtacgcatgtcaaccacctgcggtgccttcacgagttcgttaagtcccagactacctactatgcccagtgttatcgacacatgcttgatctgcaaaaacagttagggcgatttcccggcacatttgtcggaaccaccgagcccgcaagtccacctctgagctcaacctccccaactactgcggccgctactatgcccgtcgtgccatcggtcgcctcactggcccccccaggagaggccagtctgtgcctggaagaggtggcgcctcctgcctctggtacgagaaaggctcgcgtgctgtacgattacgaagcagccgactccagtgaacttgctctactggcagacgagctcattactgtctactcactcccagggatggatcctgactggctgattggagagaggggcaacaagaaaggaaaagtccccgttacctaccttgagcttctgagctag

SEQ ID NO: 15355 - DNA, 615 bp, Artificial Sequence
  Description of Artificial Sequence: Synthetic coding sequence
atgtcctggacatgccctaggtgccaacagcctgtattcttcgccgagaaagtgtcctctcttggcaaaaactggcacagattttgcctcaagtgcgagaggtgccatagcatccttagccctggggggcatgcagaacacaacggaaggccatattgccataaaccctgttatggagcactgttcgggccccgaggcgtgaatataggtggggtcggaagttatttgtataaccctcccactccctcccccggatgcactacacccctctcaccatcttcattctcaccaccgagaccgaggactggattaccacaaggaaagaagagcccaccccacatgaagacatttacaggagaaacttctctgtgtcctgggtgcggagaacccgtctattttgccgagaaagtcatgagtctgggccggaactggcacagaccctgcttgcgctgccagaggtgccataagacattaacagcggggtcccatgctgaacacgacggagtcccttattgtcatgtgccgtgctatggttatctttttggccccaagggagtcaacatcggtgatgtgggctgttatatttatgacccggtgaagatcaaattcaagtag

SEQ ID NO: 15356 - DNA, 1221 bp, Artificial Sequence
  Description of Artificial Sequence: Synthetic coding sequence
atggaaagtcttaggggctatacccacagtgatattgggtaccgctctttggccgtgggtgaagacatagaagaagtgaacgatgaaaagttgactgtgaccagcctgatggcacgaggaggtgaagatgaagagaacacacgctccaagccagagtacgggaccgaggcggagaacaatgtaggaaccgagggatccgtcccatctgacgatcaagatcgtgagggaggtgggggccacgaacccgaacagcagcaggaggaaccccctctgaccaaacccgaacagcagcaagaggagcccccactgctcgagttaaaacaagagcaggaggaacccccacagactaccgtggagggacctcagcccgctgaggggccccagaccgctgagggcccacagccccccgaacgcaagagacgcagaaggactgcttttactcagttccagcttcaggagctagagaattttttcgatgaaagtcaatacccagacgtggtggccagggagaggctggctgctcgcctgaatctgacggaagatcgggtgcaggtgtggttccaaaatcgacgagcaaagtggaaaaggaatcagagagtgctgatgctacggaacacggcaactgccgacctggcccaccctttggatatgttccttggcggcgcctattacgccgcgcccgcgctggacccagctctctgtgtgcatctggtacctcagctaccccgcccccccgttctccctgtcccaccgatgcctcctcgccctcctatggtgccgatgcccccgcgccccccaatagctccaatgcctcccatggcaccagtgcctcctggctcgcgaatggcgcccgtccccccaggtcccaggatggctccggttcccccttggccgcccatggctcccgtgccgccatggcctcccatggctcccgtgcctaccggaccacctatggcacctgtgccccccggacccccgatggcgcgggtcccacccggtccacccatggctcgggtgcctcccggacctcctatggcacctctgccgccgggacctcctatggcccccttaccccctggtccgcctatggcccctctgccacccggccctcctatggcacctctgccgccaaggtctcacgttcctcatactgggctggcaccagtacatattacttgggccccagtgatcaactcatactacgcatgcccatttttctag

SEQ ID NO: 15357 - DNA, 873 bp, Artificial Sequence
  Description of Artificial Sequence: Synthetic coding sequence
atgagtccttcggccaaaaagcgacccaaaaacagtcgagtatctaagatgcaggacgaaaaactccgcgatgaaacagagcagccagtttcaaaggttattgagcgaaacaggctacgaaccgtgcttaagaacttgtccctattaaaacttctgaagagctccaaccgacgcatacaggagctgcacaaactggccaaaaggtgctggcatagcttattatccgtcccgaagatcctgagaatatcaagtggggagaactccgcatgtaataaaaccaagcagaataacgaggagttccaggaaatcggttgctccgagaaagagcttaagagcaaaaagcttgagagtaccggggatccaaagaagaaggaatataaagagtggaagagccaagtgcagagtggaatgagaaacaaggagaaaacatctctcgcggctatgccccgaaaagaaaaacacatagaacctgaggtccctaggacctccagggacgactccctcaatcctggcgtgcaaggtcgccagccccttaccgaagggccacgcgtgattttcattaaaccatacaggaacaggacccctatggggcacatgaagcaactggatgtggccgatcagtggatctggtttgaggggttgcctactcgcattcaccttcctgcacctagagttatgtgcagaagcagcaccctgcgatgggtgaagaggcgctgtacccggttttgtagcgccagcttggaaatgccaatgtggcacccatataaggtggatgtgacatggacccgcgctaggggcgcttctcgcggttggaggtcccggcaccaactgaagggacggaatggctggagaaatagtcgcgtgtacaaatag

SEQ ID NO: 15358 - DNA, 1644 bp, Artificial Sequence
  Description of Artificial Sequence: Synthetic coding sequence
atggcaggaacaaaaaataaaacaagagcacaggcaaagaccgaaaagaaggccgccatccaagcaaaagctggtgcagagagggaagctaccggcgtggtaaggcctgttgcgaagaccagagccaaggcaaaagcgaaaacaggtagtaagactgacgccgtcgcagagatgaaggccgtctcaaaaaacaaggtggtcgcagagaccaaagaaggcgccctctctgagcctaaaaccctcggtaaggccatgggtgatttcacaccaaaagccgggaatgagagcactagctctacctgtaaaaacgaggcaggtactgatgcatggttttgggcgggagaggaggctaccatcaatagctggttctggaacggcgaagaggccggtaattctttttcaaccaagaacgataagccagagatcggagcacaggtgtgcgctgaggaactcgaacccgccgccggtgctgactgcaagcctcgtagtggagccgaagaggaggaagaggagaacgtaatcggaaactggttttgggaaggcgacgatacctccttcgatcccaaccccaagccagtgtcacgtattgtgaagcctcagcctgtgtatgaaataaacgaaaagaacaggccaaaagactggtccgaggtgacgatctggcctaatgccccagcagtgacccctgctgttcttggttttcggagtcaggcgccctctgaggctagcccgcccagctatattgtactggccagtgctgaggaaaacgcatgcagcctgcccgtggcgaccgcctgtcggccctctcggaacactagaagctgctcccagcccattccagagtgccggtttgacagtgacccatgcatacagactattgatgagataagacgacaaattaggatccgcgaagtgaacgggatcaagccctttgcttgcccttgtaagatggaatgttacatggattccgaggaatttgagaaactcgtaagcttgttgaagtccaccacagatcctctaattcataaaatcgcaaggatcgccatgggcgtccataatgtccacccattcgctcaagaattcatcaatgaagttggtgtggtcaccttgatcgaatccctgttgagcttcccatctcctgaaatgaggaaaaagaccgtgattacgctgaatccaccctcaggcgacgaacggcaaaggaagattgagcttcacgttaagcacatgtgcaaagaaaccatgtcgttccctttaaactccccaggtcagcaatctggtttgaagattctgggtcaactcaccactgattttgtacaccactacatcgtggctaattactttagcgagttgttccaccttttgtcttcaggaaactgtaagacacgcaacctcgtgcttaaactgctgctaaatatgagcgagaatcctacagcagctcgcgacatgatcaacatgaaagctttagcggctctgaagctgatcttcaaccaaaaagaggccaaagccaatttggtcagtggcgttgccattttcatcaacattaaagaacatatcagaaagggaagcattgtggtggtagatcacctctcttacaatacacttatggctatcttcagagaagtaaaagaaatcatagagaccatgtag

SEQ ID NO: 15359 - DNA, 1881 bp, Artificial Sequence
  Description of Artificial Sequence: Synthetic coding sequence
atgtgctccacactgaaaaaatgcggcacatatcgcacagaggtggcagaatgtcatgaccacggatccactttccaggggagaaaaaaaggcgggtcttccttcagagacaacttcgataaacgctcctgtcactacgagcacgggggctacgagagacccccgtcccattgccaggagaacgacggaagcgttgagatgcgcgacgtccataaagatcaacagcttcgtcacaccccttactcgatcagatgcgagcggagaatgaagtggcattccgaagacgaaatccgaattacgacctggagaaaccggaagccaccagagaggaagatgtcgcagaatacacaggacgggtacacccgtaactggtttaaggtcaccatcccgtatggcatcaaatacgataaagcctggttgatgaatagcatccagagtcactgctcagatcgctttacccccgtggactttcactatgtccgcaatcgagcgtgtttcttcgtgcaggacgcatccgcagcatctgccttgaaagacgtctcttataaaatctatgatgatgagaatcaaaagatctgcatctttgtcaatcattctaccgccccatactctgtcaagaataaactgaaacctggccagatggaaatgcttaagctgacaatgaataaacgttacaatgtatcacagcaggctctcgatctgcagaaccttcgtttcgatcccgatctcatgggccgtgatattgacatcatcctgaaccgtcggaattgtatggctgcaaccctgaaaattatcgagcggaatttcccggaactcctttccttaaatctgtgtaacaacaagctttatcagctagacggtctcagtgacattaccgaaaaggcccctaaagttaaaaccctcaacctttccaagaacaaactcgagagtgcctgggaactgggcaaggtgaaagggctgaagctggaagagctttggctggaggggaaccctctgtgttccacattttcagaccaatctgcctacgtctcagctattagggattgcttccctaaactgctgcgccttgacggaagggagctgtccgcacccgtcatagttgacattgacagctccgaaactatgaaaccctgcaaggaaaactttacaggctccgagactttgaagcatttggtgctccagtttctgcagcaatactacagcatctatgactcaggagacaggcagggccttttgggggcctatcacgacgaagcctgcttcagcctggccattccctttgaccccaaagattctgcccccagcagcctgtgcaagtactttgaagacagtcgaaatatgaagacactgaaggacccatatcttaaaggggagctcttgaggcggaccaagcgcgatatcgtggactccctctctgccctgccaaagacccagcacgatctctcatcaatcctcgtggacgtctggtgtcagacggaaaggatgttgtgtttttccgtgaacggcgtgttcaaggaagtggagggccagagccagggcagcgtgctcgctttcacccgcacatttatcgctacaccaggcagctctagcagtctatgcatcgtgaacgacgagttgtttgtgagggacgccagccctcaggagacacagtcagcattctcaatacccgttagcacactgtcaagttcaagcgagccctccctatcccaggaacagcaggaaatggtccaggctttcagcgcacagtcaggcatgaagcttgaatggtcccagaagtgccttcaggataatgagtggaattacacacgcgcagggcaggcttttacaatgctccagacagagggaaagatccccgccgaggccttcaagcagattagctag

SEQ ID NO: 15360 - DNA, 1881 bp, Artificial Sequence
  Description of Artificial Sequence: Synthetic coding sequence
atgtgttccaccttgaagaaatgtggaacatacaggaccgaagttgcggaatgccatgatcacggcagcacattccaaggaagaaagaaggggggatcttcttttcgagataattttgataagcgcagttgtcactatgagcacggaggctatgaaaggcctccatcacattgccaggaaaatgatggttctgtcgaaatgagagacgtccacaaggaccagcagctgcggcacaccccgtactccattcgttgtgaacggcggatgaaatggcacagtgaggacgaaattcgtataacaacctggaggaatcggaaaccccctgaaagaaagatgtctcagaatactcaagacggatataccaggaattggttcaaagtgaccatcccttacggcattaagtatgataaggcatggctgatgaactcaatccagtcccactgttcagaccggttcacgcctgtggacttccattatgtgcggaacagagcatgtttttttgtccaggatgcaagtgccgcgtccgcactgaaagatgtatcgtataagatctatgatgatgagaaccagaagatttgtatcttcgtgaatcattctaccgccccatattcagtgaagaacaagctgaaacctggacagatggaaatgcttaaactcactatgaataagagatacaacgtgtcccagcaagcccttgatttgcagaatttacggttcgacccagacctgatgggcagggatattgatatcattttgaaccggcgaaactgcatggcagctactctgaagataattgagcgcaacttccctgaactgttgagtcttaatctctgtaacaacaaactgtatcaactggacggtttgtctgatatcaccgaaaaagccccaaaagtcaagaccctcaatctcagtaagaacaagctggaatcagcgtgggagttggggaaggtgaagggcctgaaactggaagagctgtggcttgagggaaaccctctgtgttccacattttctgaccaatctgcgtatgtctccgccatccgggattgcttcccaaaattgctccgtctcgatggaagagaactgagtgcacctgtgatcgttgacatcgacagttcggagacaatgaaaccctgcaaagaaaacttcaccggaagtgagacccttaagcaccttgttctccagtttctgcagcaatactatagcatctacgactccggcgatcgtcaaggcctgctaggagcctatcatgacgaagcttgtttttccctggcaatcccatttgaccctaaagacagcgcaccctcctccctgtgtaaatactttgaagactcaagaaacatgaagaccctaaaagatccttacctcaagggtgaattgctccgcaggacaaagagagacattgtggactccttgtctgccctgcccaagacacagcacgacctcagttctatactcgtagatgtctggtgtcagaccgagcgtatgctgtgtttcagtgtgaacggagtttttaaggaggtggagggccagtcccagggcagcgtcctcgccttcaccaggacattcatcgcaacccctgggtctagctccagcctctgtatcgtgaatgatgaactgtttgtcagagacgcctcgccgcaggaaacacagagtgcttttagcattcctgttagcactctaagcagctcttcggaaccatctctatcgcaagagcaacaggagatggtacaagcattctccgctcaaagcggtatgaagttggagtggtcacagaagtgtcttcaagacaatgagtggaattacacccgcgcgggccaggcgttcacaatgttgcagactgagggcaagattcccgctgaagccttcaagcagatttcctag

SEQ ID NO: 15361 - DNA, 1230 bp, Artificial Sequence
  Description of Artificial Sequence: Synthetic coding sequence
atgaagtggcacagtgaggatgaaatacgcatcacaacttggcgaaatcgtaaaccccctgagaggaagatgtcgcaaaacactcaagacgggtacacacgcaactggttcaaagttactatcccctacggtatcaagtatgacaaagcttggcttatgaattccatacagtcacattgcagcgaccgtttcactcccgtggatttccactacgttaggaatagagcctgctttttcgtccaggatgcctctgctgcatcagctctgaaggatgtatcatacaagatctatgacgacgagaatcaaaaaatttgcatctttgtcaatcacagcaccgcaccttattctgttaaaaacaagctgaaaccaggccagatggaaatgttgaaacttacaatgaataaacgctataacgtctcacaacaggcgctggatctgcagaacctgcgattcgatccggacctgatgggcagagacattgacatcattctgaaccgacgcaactgtatggccgctactctcaagatcatcgagaggaatttccccgagctcctgtcattgaacctatgtaacaacaagctttaccagcttgacggtttatccgacatcacagagaaggcaccaaaagtcaaaaccttaaatcttagcaagaataagctcgaaagtgcttgggagctcggtaaggttaaaggcctaaagctggaagagctgtggctcgaaggcaatccgctgtgtagtacattctccgaccagtcagcatatgtatctgccatcagggactgctttcctaaacttttgcggctcgacggccgcgaactctccgcacccgtgatcgtagacatcgatagttcggaaacaatgaaaccatgcaaggaaaacttcacaggatctgaaactcttaaacacctggttttacaattcctgcagcagtactactcaatctacgacagtggggaccgacagggtctgctaggcgcttaccatgacgaagcttgtttctcactggcaattcctttcgacccaaaggatagtgcccctagttcattgtgcaagtacttcgaagacagtagaaatatgaagactctcaaggacccctatctgaagggagagcttttgcgcaggactaaacgggatatcgtggactctctctccgcgctgcctaagactcaacacgacctgtcttctatcctggttgatgtttggtgtcagactgtcccaagtggacagtag

SEQ ID NO: 15362 - DNA, 1326 bp, Artificial Sequence
  Description of Artificial Sequence: Synthetic coding sequence
atggcttcagttgccgccgctcgagccgtccccgtaggctctggcctcagaggcctccagaggactctccccctggtggtgatcctgggggccactggcactgggaaatcaacactcgcactgcagctcggtcagcggttagggggtgagatcgtgagcgctgactcaatgcaagtgtacgagggccttgacattatcacaaacaaagtcagcgcgcaggaacagcgaatttgtagacatcatatgatttcatttgtggaccctctggtgacaaactacacagtcgtggatttccggaacagggccacagcactgattgaagacatttttgcaagggacaagattcccatagtggtaggtggcaccaattactacatcgagtcactgctctggaaagtcctagtgaatacaaaaccccaggaaatggggacggagaaggtgatcgataggaaggtggaactggagaaagaagacggtcttgttctacataagagactctctcaggttgatcctgagatggcagcaaaactccaccctcacgacaaaagaaaggtggcgagatccctccaggtgtttgaagagacaggcatttctcactcagaattcttgcacagacaacacacagaggagggaggcggaccattggggggaccactcaaattctcaaatccctgcatcctctggctgcacgccgatcaagcagttctggacgagaggctggacaaaagagtggacgacatgttggctgcgggtctgttggaggaactgcgggactttcatcgccgctacaaccagaaaaacgttagcgaaaattcgcaggactaccagcacggaatctttcagtcaattggctttaaggagtttcatgagtacctgatcacagaaggcaagtgcacattagagacctcgaaccagctgctaaaaaaggggccaggccccatcgtgccccctgtgtatgggctggaagtctcagacgtgtcaaagtgggaggaatccgtgctggaaccggcgcttgaaatcgttcaaagtttcattcagggacacaagcctaccgccacccccatcaagatgccatacaacgaagccgagaataagaggtcctatcatctgtgtgatctgtgcgatagaatcattatcggagatagggagtgggccgcacatatcaaaagtaaaagtcatttgaaccagcttaaaaagcgccgccgcctcgacagcgacgcagtgaatacgattgagtctcagagcgtgtcccccgatcataataaggagcctaaggagaaggggtcccccgggcagaacgatcaggagctcaaatgcagcgtctag

SEQ ID NO: 15363 - DNA, 1158 bp, Artificial Sequence
  Description of Artificial Sequence: Synthetic coding sequence
atggcaagcgtagctgcagcccgggcggtgcccgttggctctggactacggggtttgcagcgaactctgcccctcgtcgtcatcctaggggcgaccggcaccggaaagtcgacactggctctgcagctaggacagagactgggcggcgagatcgtttccgcagattctatgcagccccaggagatggggaccgaaaaggtgattgatcggaaggtggaactcgaaaaagaggacggacttgtgcttcataaacggctgtcacaagtagaccccgaaatggcagccaaactgcacccccatgataagcggaaggtcgcacgatcactccaggttttcgaggagactggtatctcccactccgagtttctccaccgccagcacaccgaggaaggcggcggaccgctggggggacctttgaaattctccaatccatgtatcctgtggctccacgctgaccaagccgacgaaagactagataagcgcgtcgacgatatgctcgccgcaggattgctggaggagctccgcgacttccacagacgctacaaccagaaaaatgtgtcagaaaactcacaggattatcagcacgggatctttcagagcattggattcaaggagtttcacgagtatctgattaccgagggtaaatgtaccctagagacaagtaatcagctattaaagaaaggtatcgaagccctgaagcaggtaacaaaaagatatgctaggaaacaaaatcggtgggtcaaaaacagatttcttagccggcccggcccaattgttccccccgtctatggcctcgaggtctctgacgtctctaaatgggaggagtcagtactcgagcctgctctcgagatcgtccagtctttcatccaaggccataagcccactgccacaccaatcaagatgccctacaacgaggctgagaacaagcgaagctaccacctgtgcgacttgtgtgatcggattataattggagatagagagtgggctgcgcacattaaatctaagtcccatttaaatcagctcaaaaaacggcgccgcctggacagcgacgcagtgaatacaattgagtcccaatctgttagcccagatcacaacaaagagccaaaggagaagggctctccaggtcagaatgatcaggagcttaagtgctccgtttag

SEQ ID NO: 15364 - DNA, 987 bp, Artificial Sequence
  Description of Artificial Sequence: Synthetic coding sequence
atgaaacgtcccaaagaaccttctgggtccgatggggagtccgatggacccatcgatgtgggacaagagggacagctttctcagatggcgagacctttaagcactccctccagctcccagatgcaggctcggaagaagcatcggggcattatcgaaaaacgccgaagggaccggatcaacagttctctctccgagctcagaagactggttccaaccgcctttgagaaacaagggtcctctaaacttgagaaggctgaggttctgcagatgactgtcgatcatctcaaaatgctgcatgccaccggagggactgggtttttcgacgcgcgggcattggcagttgattttagaagcatcggatttcgcgagtgtctgactgaagtcatccgctacttaggcgtgctagagggcccttccagtagggctgatccagtccgcattaggctccttagtcatctgaattcctatgcggccgagatggagccctcacccacccctacaggccccctcgcgtttccggcttggccctggtccttttttcactcatgccccggccttcctgctctgtccaaccagctagccatcctcggccgggtgccatctccagtgttgcccggagtgtctagcccagcatatccaattccagcgctgcggaccgcacctctgcgccgggcgacagggattatcttgcccgcccgcagaaacgtgctgccatcgagaggagcctcttccacccgaagagcaagacccttggagcgccctgctacccctgtccccgtggcaccctcctcccgcgctgcccggagctcccatatcgctcccctgttgcagtctagtagtcctacccctcccggtccaacagggtccgccgcttacgtggcagttcctacaccgaacagctcctcccctggccctgcagggcggcctgccggagctatgctctatcacagttgggtctccgaaattactgagatcggggctttctag

SEQ ID NO: 15365 - DNA, 2262 bp, Artificial Sequence
  Description of Artificial Sequence: Synthetic coding sequence
atggagactttcgagcctatttctcaagagcccttaagtcaggcctcttatgataaggcaccagacccggtacccgaactgcaggacagtttttatgccgagctgcaaagggcggagtccttacaggagaaaagtatcaaagaggcaaaaactaagtgcaggaccattgcctccttactgaccgccgctccaaacccccactcaaagggcgtccttatgtttaagaagcggaggcagcgagcaaagaagtacaccctggtttccttcggcgcagcagccggcactggagctgaggaggaggatggggtgccaccaacatctgagagcgagctggacgaggaggcattctctgacgcccgcagtctgacgaatcagtcagattgggactcaccatatttagatatggaactggcccgcgcgggcagccgcgccagtgaagggcaggggtcaggcctgggcgggcagctgtcagaagtgtctggccgcggcgtgcagctttttgagcagcagcggcagcgggccgactcctctacgcaagagctagcacgagtggagcctgccgctatgttaaacggggaagggttacagagccctcccagagcacagagcgctccacccgaagccgctgtcctgccaccatctcccctgccagcgccagtcgcgtcgccccgaccattccagccgggtgggggcgctcctaccccagccccctccatttttaacaggtctgccagaccctttactccgggcttacaggggcagcggcctactaccacatctgtcatctttagacccctcgcacctaagcgcgctaacgattcattaggcgggctgtcaccagcaccacctcctttcctgagtagtcaaggccccactccccttccaagcttcacgagcggggtgccttcccacgcccctgtgtcgggcagtccttcaactcctcggtcttcgggtcccgtcaccgcaacaagctctttgtacatccccgctcccagcaggccagtgacgcctgggggggcccccgagccgcctgctcctccatccgcagccgcaatgacatccaccgcttccattttccttagcgcacccctgcgcccctccgcgcggcctgaagctcctgcgcccggacctggcgcgccagaacccccctcagctagagagcagcgtatttccgtaccagccgcccggaccggcatactgcaggaggccagacgcagggggacccgaaaacaaatgttccgccctggcaaagaagaaacaaaaaatagtcctaaccccgaactcctaagtcttgtgcagaatctcgatgagaagccaagggcaggaggagctgagtcggggccggaggaagatgcactgagccttggcgctgaagcatgcaactttatgcagcctgtgggggctcgatcctacaaaacgttgcctcatgtgacaccaaagacaccccctccaatggctccaaagacccccccacccatgacaccaaaaactccaccacctgtggcccccaagcccccttctcgcgggctcctcgacggactggttaacggggccgcaagtagcgctggcatcccagagcccccccgcctgcagggaagaggtggagagttgttcgcaaaaagacagagtagagccgatcgctatgtggtggagggaacccctggtcccgggctcggtccaagaccgcgtagccccagccctactccatcactgccaccgtcctggaagtactcccccaatattcgggcacccccccctattgcctacaatcccctcctcagcccctttttccctcaggcagctcgaacacttcccaaagcccaaagccagggcccgagggccacccctaagcaagggatcaaggcgctggattttatgcggcaccagccctatcagctgaagaccgccatgttttgtttcgacgaagtccccccaacccctggccctatcgctagcggtagccccaagactgccagagtccaggagattcgccgctttagcacgccagccccccagccaaccgccgaacccctggccccaacagttctggcccccagggctgctacgacgctggacgagcccatatggcgcacagagctggcctccgctcctgtgccctccccagcaccacctcctgaggctccccgtgggctgggtgcctccccttcaagctgtggctttcaggtggccagacctagattttccgccactaggactggcctgcaggcccatgtatggcgacccggagccggccatcagtag

SEQ ID NO: 15366 - DNA, 1041 bp, Artificial Sequence
  Description of Artificial Sequence: Synthetic coding sequence
atggagtccgtgagctgcagtgctgcagcggtcaggaccggcgacatggagtcacagagagaccttagtcttgtgccggagagactccagagacgggagcaggagcggcagctggaggtggagcgccggaaacagaagcgccagaatcaggaggttgaaaaagaaaatagccatttctttgtagccaccttcgtgagagaacgagccgctgtagaagagcttctagagcgcgctgaatccgttgagaggctcgaggaggctgcgtctaggctgcagggactccaaaagttgattaacgattcagtttttttcttggctgcatacgatttgcgccagggccaggaagcactggctcggctgcaggccgcattggcggagagacgccggggcttgcagccgaagaagcggtttgccttcaagaccagaggtaaagatgccgcatcaagcactaaagtggacgctgccccagggattcctcccgctgttgaaagtatccaagacagtcctctgcccaagaaagccgaaggcgacctggggccctcatgggtctgcgggttttccaaccttgaatctcaggtgttagaaaaacgtgcatctgaactgcatcaaagggacgtcctcttgacagaactgtcaaattgcacagtgcggctctacggtaacccgaacactctgagattgaccaaagcccatagctgtaagctgctgtgtggtcctgtctctacctccgtgttcttggaggactgtagtgactgcgtgctcgcagtcgcgtgtcagcagttgcgcatccactctacaaaggacaccagaatttttctgcaagtgacgtcaagagcaatcgtcgaagactgcagcggaatccagttcgctccctacacatggagctacccagagattgacaaagactttgagtccagtggcctggaccgctccaaaaacaactggaatgatgtggatgatttcaattggctggcaagggacatggccagccccaactggagcatattaccagaagaggagcgaaatatccagtgggattag

SEQ ID NO: 15367 - DNA, 1569 bp, Artificial Sequence
  Description of Artificial Sequence: Synthetic coding sequence
atgagtcctcagaaaagggtgaagaacgtccaagctcagaacaggacgtcccagggatctagctcctttcagaccaccctatcagcatggaaagtaaagcaggacccttcaaattcaaagaatatatcaaagcatggacagaataatcccgtgggggattatgagcacgcggacgatcaggcggaagaagatgccctacagatggccgtaggctattttgagaagggacctataaaagcttcccagaataaggacaaaacccttgaaaagcaccttaagactgtcgagaacgtcgcttggaaaaatggcctcgcaagtgaggaaattgacatcctgctcaacatcgcactatccggcaagttcggcaacgccgtgaacactcggattctgaagtgcatgatcccagcaaccgtcattagtgaggatagtgtcgttaaggcggtatcctggctgtgtgtaggaaagtgcagtggcagcacaaaggtactgttttataggtggctggtcgcaatgtttgattttatcgatcggaaggaacagatcaacctgctgtatggcttctttttcgccagtctgcaggatgacgcactatgcccctacgtgtgtcatttgttgtatttgctcacaaagaaggaaaatgtgaagcccttcagagttcgtaaactcctggacctgcaggctaagatgggcatgcaaccccatctgcaagcactgcttagcttatacaaattcttcgctcctgcactgatcagcgtatctctgcccgtcagaaagaagatttatttcaaaaacagtgagaacctgtggaaaaccgccctcttagctgtgaaacagcggaatagggggccatcgcccgaaccgcttaagctcatgctgggccccgctaatgtgcggccgttgaaacgcaagtggaacagcctttcggtgattcctgttctgaattcctctagctacactaaggagtgcggaaagaaagagatgagtctgtccgactgtctgaacagatcaggatctttcccacttgagcaactgcagtcctttccacagctcctgcaaaatattcattgcctggaactgccgtctcaaatgggctctgttttgaacaacagcctgctcctgcactatataaactgtgttagagacgaacctgtcctccttcggttctattattggctcagtcagacccttcaggaggagtgcatatggtacaaagtgaacaattacgaacacggcaaagagttcactaactttcttgataccattatacgcgccgagtgtttcctgcaggagggcttctactcctgcgaagcatttttatacaagagcctcccattgtgggacggcctatgctgcagatcccagttcctccagctggtttcgtggattcctttctcttcgttttccgaagttaaaccactactgttcgaccacctcgcccagttgtttttcacctccaccatctatttcaagtgctcagtcctgcagtctctcaaagagctgcttcagaactggcttctgtggctgagtatggacatccacatgaagcccgtgaccaattctcctctttag

SEQ ID NO: 15368 - DNA, 2271 bp, Artificial Sequence
  Description of Artificial Sequence: Synthetic coding sequence
atgtccccgcagaaaagagtaaaaaacgtgcaagctcagaaccgcacgagtcaggggtctagcagctttcaaacaacactcagcgcctggaaggttaaacaggacccctccaacagcaagaacatctccaagcacggacagaacaatcctgtcggggactacgagcatgcggacgaccaggccgaggaagatgccctccagatggcggttggatactttgaaaaagggcccataaaagccagccaaaataaagacaagacactggaaaagcatctgaagacggtcgagaatgtggcctggaaaaatggccttgcaagtgaagagatcgacatcctacttaacatcgccttgtccggcaagttcggaaacgccgttaatacgcgcattctcaaatgcatgattcctgctacagtgattagtgaggacagcgtggtcaaggccgtgagctggctgtgcgtgggtaagtgtagtggatctactaaagtgctattctatagatggctagtggcaatgtttgactttattgatcgtaaggaacagataaacctcctttatggcttctttttcgcgagcctccaagacgacgccctctgtccctatgtatgtcacctcctatacctgctgaccaaaaaggaaaatgtgaagcctttcagggtcaggaaactcctcgacttgcaggctaagatgggaatgcaaccgcacctccaggccttgctgagtctgtacaaatttttcgcacccgccctgatttctgtgtcattgcccgtcagaaaaaagatttacttcaagaactccgagaatctgtggaagacagcactgctggccgttaaacaacgaaatcggggaccaagccctgaacctctcaagttaatgctaggcccagccaacgtgaggcccctgaaaaggaaatggaattccttgtctgtcatacccgtcttgaactccagttcctatacaaaggaatgtggaaaaaaagaaatgtcactcagcgactgtttgaatcgcagcggcagctttccgctcgaacagctgcagagcttcccacagcttctgcagaacattcactgtttggaattgccatcacagatgggttcagtactgaataatagcctgctattacattatattaactgcgtacgtgacgagccagtgctgctgcgattctactattggctgtctcagactcttcaggaggaatgcatctggtacaaagtcaacaattacgagcatggcaaagagtttactaacttcttggataccataatcagagccgaatgttttctgcaggaaggattctatagttgtgaggcttttttgtataagagcctgcccttgtgggatggcctgtgttgccgcagtcagttcctccaactcgtctcttggatacccttcagtagttttagcgaggtcaagcccttactgtttgaccacctggcgcagttattctttacttcaaccatttatttcaaatgcagtgtgctccagtcattgaaagaattactgcagaattggttgctgtggctgagcatggacattcatatgaaacctgtgactaattcccccctggagacaactctgggtggcagtatgaattccgtcagcaagctcatccattatgtaggatggctatcgacgaccgccatgcgactggagtctaataatactttcctgctccatttcatactcgatttctatgagaaagtgtgtgacatttacatcaactacaacttacccctggtagtattgtttcctcctggcattttctactcagccctcttgtcacttgatacttccattctgaaccagttgtgcttcattatgcaccggtacagaaaaaatctgactgccgctaaaaaaaacgaactggttcagaaaacgaagtcagagttcaatttctcatctaagacttaccaggaattcaaccattatctgacctcaatggtcggatgtttgtggactagcaaaccttttggtaagggaatctacatcgatcccgaaatcctggagaagacaggagtagctgagtataagaatagtcttaatgttgtccaccatccatcttttctctcatacgcagtgtcctttctgttacaagaatccccagaagagagaaccgttaacgtgtccagtataagggggaaaaagtggagctggtatcttgattatttattttctcaaggactccaggggctgaaactctttataaggtctagtgtccaccacagctctatccctcgggccgaaggaattaactgtaacaatcagtactag

SEQ ID NO: 15369 - DNA, 933 bp, Artificial Sequence
  Description of Artificial Sequence: Synthetic coding sequence
atggctgatgctgctgccaccgctggcgcaggaggttccggtactcggtctggtagtaagcagtcgactaaccctgccgacaactaccatctggctagaaggagaacgctccaggtagtggtatcctccctcctgaccgaggccggttttgagagtgccgagaaagcaagtgtggaaaccctcactgagatgctgcaaagctatatatcagagatcggacgctccgcaaaatcttattgcgagcatactgcacgtactcagcccaccctttctgacatcgttgttaccttggtggagatgggatttaatgtcgacaccctccctgcttatgctaaacgatcccagagaatggttattaccgcccctccagtgacgaatcaacctgttacacccaaagctctgacggccgggcagaacaggccccaccctccacacatcccctctcactttccggagtttccggatccacacacctatatcaagacaccgacatatagagagcctgtgagtgattaccaggtgttaagggagaaggcggccagtcagcggagggacgtggaacgcgcgctgacaaggttcatggccaaaaccggcgaaactcaatccctttttaaagatgatgtatccactttcccattaatcgctgcacggccgtttactatcccttacttaacggcgcttttgccttctgaattggaaatgcagcaaatggaagagactgactccagtgagcaggacgagcagaccgatacagaaaatcttgctctacacattagtatggaggactcaggggccgagaaggaaaacacaagcgtgctccaacagaacccttcactctccggctcgaggaacggagaagaaaatatcattgacaatccctacctccggcctgtcaaaaaacctaaaattagacgtaagaagagcctctcttag

SEQ ID NO: 15370 - DNA, 1935 bp, Artificial Sequence
  Description of Artificial Sequence: Synthetic coding sequence
atggaggaaacaatgaagttggccacaatggaggacacggttgagtattgtctctttctcatcccagatgaatctagggactccgataagcataaggagattctccagaagtacatagagcggattattactaggttcgcccccatgttggttccatacatttggcaaaaccaaccctttaacctaaagtacaaaccagggaaaggaggagttccggctcatatgtttggagtgacaaagtttggtgacaatattgaggatgaatggttcatcgtctacgtgatcaagcagatcacaaaagagtttcctgaacttgtggcccgtatagaggacaatgacggtgagttcctgctcattgaagcagcggacttcttgcctaagtggctcgacccagaaaactcaacgaatcgtgtcttcttctgtcacggcgagctgtgtatcatccctgccccccggaaatcaggtgccgagtcctggctacctactacaccccctaccatacctcaggccttgaacattatcaccgctcattctgagaagatccttgcatctgaatccatccgggctgcagtgaacagacgaatccgcggctaccccgagaagattcaggcttctctgcatagagcccactgttttctccctgccggaatcgtggccgtattgaaacagcgaccccggctggtggctgcagctgtgcaagccttttatttaagggaccctattgacctcagagcctgtagagtgtttaaaacgtttctgcccgagaccaggattatgacgtccgttacatttacaaaatgcctgtacgcacagttggtacagcaacgcttcgttcccgaccgacgttcaggttaccggttgccaccccctagtgacccccagtaccgggctcatgaactcggtatgaaactggctcacggattcgagattctgtgcagcaagtgtagcccccacttctcggactgtaagaaatccctggtcactgcaagtccactttgggctagcttcctggagagtttaaaaaagaacgattatttcaaaggcttaatcgagggctccgcacagtatcgggagaggcttgagatggccgaaaattatttccagctgagcgttgattggccagaatcatcactggcaatgagccccggtgaggagattcttacattgttacagactatcccctttgacatagaagaccttaaaaaagaagcagcaaatctgccacccgaagatgatgatcagtggctggacttatcaccagatcagctcgatcagctgctgcaagaggcagtgggcaagaaagagagcgagtcagtatcaaaagaggagaaagagcaaaactatgatttaaccgaagtctctgaatcaatgaaggcctttatttcaaaggtgtcaacacataagggcgcagaactgcctagggagcctagtgaggcgcctattacctttgacgctgactcgttccttaactatttcgataagatcttgggacctcgtcctaacgaatccgattctgatgatctcgatgatgaggacttcgaatgcctggatagcgacgacgacctcgacttcgagacacacgaacccggagaggaggcttcactgaaggggaccttagataatctgaagagctacatggcccagatggatcaggaactcgcccatacgtgcatttctaagtcttttaccacacgtaatcaggtggagccggtgtctcagactactgacaataatagtgatgaggaggacagtggcacaggtgagtctgtgatggccccagtcgatgtggacctcaatcttgtctcgaacatactggaatcgtattcctcccaggctggactggccggtcctgcctcaaatctgctgcaaagcatgggagttcagctaccagacaacactgatcaccgcccaacctccaaaccaacaaaaaactag

SEQ ID NO: 15371 - DNA, 2163 bp, Artificial Sequence
  Description of Artificial Sequence: Synthetic coding sequence
atgagcgtgtccggtaagaaagagtttgacgtcaaacagatactgaggttgcgatggagatggtttagtcacccatttcagggtagtacaaacactggatcgtgtcttcagcaagagggctacgagcatagaggaacacctgtccagggacggttgaagagtcactcgcgggatcgcaacgggttaaagaaatccaattctcctgtgcaccacaacattttagcccctgtgccaggaccggctcccgcccaccagcgtgcagttcagaacctgcagcagcataacttgattgtacatttccaggcaaatgaggacactcccaaaagcgttcccgagaaaaacctctttaaggaagcctgcgagaagcgagcccaagacttagaaatgatggcagatgataacatcgaggattccacagctcgcttagacacacagcacagtgaagatatgaatgccacccggtcagaggagcagtttcatgtcatcaaccacgcagagcagacccttcgcaagatggagaattacttaaaggagaagcagttgtgtgatgtgctcctcatagcaggccacctgagaatcccagcccatcgcctcgttcttagcgcggtgtctgattactttgcggctatgtttaccaatgacgtgttggaggccaagcaagaagaggtgaggatggagggcgtggatccaaacgccctaaacagcttggttcagtatgcttataccggtgtactccagcttaaagaggataccatagaatctttgctcgcagcagcatgcttgctgcaactgacacaggtgatcgacgtttgttcgaattttttgattaagcagctgcatccatctaattgtctcggaatacggagcttcggcgacgctcagggttgtactgagctgttaaatgtcgcccataagtacaccatggagcatttcattgaagtgataaaaaatcaggagttccttctgctgcccgctaacgagattagcaagctcctctgcagcgacgatatcaacgtaccagacgaagagacgatcttccatgccctgatgcagtgggtgggtcatgacgtacagaatcgacagggggaattgggaatgctcctctcatacattcggctgcccctgctgccaccccagctcctggcggacctggagaccagcagcatgtttacaggagatctggaatgtcaaaagctcctgatggaagctatgaagtaccatctcctcccagagagaagatccatgatgcagtccccaaggacaaagcctagaaagtctacagttggcgctttgtacgccgtgggtggtatggacgccatgaaaggaacaacaacaattgaaaagtacgacctgagaactaattcctggctccacattggaaccatgaatgggaggaggctgcagttcggggtggccgtaatcgataacaagctgtatgtcgtgggtggacgagatgggttgaagaccttgaataccgtggagtgttttaatcctgttggcaaaatatggacagtgatgccacccatgtcaacccacagacacggccttggcgttgcaacacttgaaggccctatgtacgccgtggggggccacgacggctggtcatatctgaataccgtggagagatgggacccagagggacgacagtggaattacgtggcatccatgtccactccccgatccactgtgggcgtggtggcactgaacaataagctttacgcaattggcgggagggacggaagtagctgcctaaagtcaatggagtactttgatccccataccaacaagtggtcgctctgcgccccaatgagcaagcgccgcggaggtgtgggcgtcgcaacctataatggcttcctgtatgttgtcggaggacacgatgcccctgcgagtaatcattgtagccgcctgtctgactgcgtcgaaaggtatgatccaaaaggcgattcatggagcactgtggcacctctgagcgtgccacgggacgccgtcgcagtgtgcccattgggagacaagctgtacgtggttgggggatacgacggtcatacatacctcaataccgtagagagctacgatgcccagaggaatgaatggaaggaatctatgcaggagctcctccagaatttttatacaactcagaaactgaaagaaaccctggggcattag

SEQ ID NO: 15372 - DNA, 2157 bp, Artificial Sequence
  Description of Artificial Sequence: Synthetic coding sequence
atgagtgtatctggaaagaaggaattcgacgttaagcagatcctccgcctgcggtggaggtggttttcgcacccatttcagggatcaaccaatactggttcatgcctccaacaggagggttacgaacatagaggcaccccagttcagggcagactcaagagtcactcaagggaccggaacggacttaagaagtcaaatagcccagtgcatcacaatatcctggcacccgtgccaggcccagcaccagcacaccagcgtgcagtccagaaccttcagcagcacaacctgatcgtgcacttccaggcgaacgaggacacccccaaaagcgtgccagaaaaaaacctgttcaaagaggcctgcgaaaagcgggcacaggaccttgaaatgatggccgacgataacatcgaggactctactgctcgcctggacactcagcactctgaggacatgaatgccacgcgtagcgaggagcagtttcacgtgataaatcatgctgagcagaccctgcgaaagatggaaaattatctgaaggaaaaacaactttgtgacgtgttgctcattgccggacatctgcggatccctgctcacagactcgtgctctcagccgtcagtgattatttcgcagccatgtttacaaacgacgtgctcgaagctaaacaggaggaagtcaggatggaaggcgttgatcccaatgccctgaacagcctcgtccaatacgcctacaccggtgtgctacagcttaaggaagacacaatagagagtttgctggccgcagcgtgcctgttgcagcttacccaggtcattgacgtttgttcaaatttcctgatcaagcagttgcaccccagcaactgtctcggaattagaagctttggtgacgcccaagggtgcaccgagctcctgaacgtggcacacaagtatacaatggagcactttatcgaggtcatcaaaaatcaggaatttctgcttttgccagccaacgagattagcaagctcctgtgtagcgatgatatcaacgttcctgatgaggaaaccattttccatgccctgatgcaatgggtaggtcacgacgtacagaaccgccaaggcgaactgggtatgcttttgtcatacataagattgcccctgctacctccacagctcttagccgatctggaaacgagctcaatgtttactggcgatttagagtgccagaaacttctgatggaggctatgaaataccaccttctgccggagagaagatcaatgatgcaatccccaaggaccaagccccggaagtcgacagtaggagccctttatgccgttggggggatggacgctatgaaggggacaactactatcgagaaatatgatctgcgcactaactcttggttgcacattggaaccatgaacgggcgcagactacagtttggtgtggcagtcatcgataacaaactctacgttgtcggcggacgggatggcctgaagaccctgaacaccgtggagtgctttaacccggtaggcaagatctggactgtgatgcccccgatgagtacacatagacatgggctaggtgtcgcgacactcgaaggtcccatgtatgccgtaggaggacatgatggctggtcttatctgaacactgttgagagatgggaccctgagggacgccagtggaattatgtggccagcatgtcaaccccgaggagtaccgtgggagttgtcgctttgaataataaactgtacgccatcggcgggcgcgacggcagctcctgtctcaaatcaatggagtatttcgatccgcataccaacaagtggagtctgtgcgcgcctatgtccaagcgcagggggggcgtgggcgtggccacatacaatggctttctctacgttgtggggggccacgatgccccagcttccaatcattgcagtaggctgtctgattgcgtcgagaggtacgatcctaagggagatagctggagcaccgtggccccgttgtccgtgcctagagatgctgtcgctgtttgcccacttggcgataaactttacgtggtgggagggtatgacggacatacctacttgaatactgtggaatcttacgacgcgcagaggaatgaatggaaggaagaagtgccggtgaacattggcagggctggggcatgcgtggtggtcgtaaaacttccttag

SEQ ID NO: 15373 - DNA, 1134 bp, Artificial Sequence
  Description of Artificial Sequence: Synthetic coding sequence
atgaacggccctgtcagccccaaatctaaggcccgcccgtcctcacccagcaccagctggcacagaccagcaagcccctgccctagccctggaccaggacacactctccccccaaaacccccaagcccgcgcggcactacagcctctcctaagggtcgggtacgaagaaaagaagaggctaaggagagcccttctgccgccggacctgaagataagagtcaatctaaacggagagcttccaacgaaaaggaaagtgcagcacctgcctctccggcgccttctcctgccccttccccgacccccgcacccccccaaaaggagcaacctccagccgagaccccaacagcaccagcgcctcccgtcacccccagtaagccaatggctgggaccacagatcgggaggaggcgacacgattattggcggagaaacggaggcaagccagagagcaacgggagcgtgaggagcaggagagacggctccaggccgaaagggacaaaaggatgcgggaggaacagctggcaagggaagcagaagcacgagccgagcgagaagccgaggcccgtagacgcgaggagcaggaggcccgcgagaaggcccaggccgaacaggaggagcaggagcgcttacagaagcagaaggaagaggcagaggcaaggtctcgagaagaagccgaacgacagaggctcgaaagagaaaaacacttccaacagcaggagcaggaacgccaggagagacgcaagaggctggaagagatcatgaaaagaacccgcaaaagcgaagtctctgagactaaaaagcaagactccaaggaggctaacgcaaacggcagtagccctgagcctgtgaaggccgtggaagcacgcagccccggtctgcaaaaggaggcagtgcaaaaggaagaacccataccccaagagccccagtggagcttgccctctaaagagcttccggcatctcttgtcaacggcctgcagcccttaccggcgcatcaggaaaatgggttcagtaccaatggtccttctggcgacaagagtctgtctaggacccccgaaactcttctgccgttcgccgaagccgaagccttccttaaaaaagcagttgtacagagtccccaagtcactgaggttttatag

SEQ ID NO: 15374 - DNA, 2427 bp, Artificial Sequence
  Description of Artificial Sequence: Synthetic coding sequence
atggaaagcggcccaagggcagagctcggggccggggctccccctgcagttgtggcacgtacaccccctgaaccacgaccttccccagagggagaccctagcccaccccctccacccatgtctgctctggtcccagacacccccccagatacccctcccgctatgaagaacgccaccagctctaaacaactacctctcgaacctgaaagccccagtggacaggtcggtcctcggccggcacctccccaggaagagtctccctcgtccgaagccaaaagccgtgggccaactccaccagccatggggccccgtgacgcccgaccccctcgccgttcttcacaacccagcccaacggcagtacctgcctcagattcgccccccactaagcaggaagtgaaaaaagccggagaacgtcacaaactggccaaagaaaggcgagaggaaagggctaagtacctggccgccaagaaggcagtgtggctggagaaagaggagaaagccaaggctctgagggagaaacagttgcaggagagacggcgaaggctggaagagcagcgactaaaagcggagcagcgaagagctgccctggaggagaggcagcggcaaaagttagaaaaaaacaaagaaaggtatgaagctgcaattcaaaggtcagtcaaaaagacatgggcggagatccgacagcagcgatggtcctgggctggggcgttacaccattccagtcctggacacaaaacatccggttcccggtgcagcgtaagtgccgttaatctacctaagcacgtggattccataatcaacaagcggctgagtaaatcgtccgctacactgtggaactcgccttctcgtaacaggtcccttcagctgagtgcctgggaatctagtattgttgataggctgatgacgccaaccctgtcgttcctggcccggagtcgcagcgctgtgactctgccgagaaacggtcgggatcaggccgtgcccgtttgcccgcgctcagcttctgccagtccgctgactccatgctcagtgacacgtagcgtgcacaggtgtgcacccgccggagaaaggggcgaaaggagaaagcctaatgctgggggatctcctgcgcccgttaggaggcggccagaggcaagtcctgttcagaaaaaagaaaagaaagataaggaaagagaaaacgagaaagaaaaaagcgccctggccagggagcggtctctcaagaagaggcagtccctgcccgcttctcctcgggcgagacttagcgcctccaccgcgagcgagttatcacctaagagcaaagccaggcccagttccccgtccacaagctggcatagacccgcatctccatgtcctagtcccggccctggacacactctacctcccaagcccccaagcccacggggcaccactgcctcaccgaaaggccgggttaggcggaaggaagaggcaaaggaaagcccgtcagctgctggtcccgaggacaaaagccagagcaaacgacgagcgtctaacgagaaggaatccgcggctcccgccagtccggccccttcacctgctcccagtccaacccctgcccctcctcaaaaggagcagccccctgctgaaacaccaaccgatgccgctgtcttaacttcaccccccgctccagccccgcctgtgactcccagtaaaccaatggccgggaccaccgaccgcgaggaagccacccggctgctcgcagagaagcgccggcaggcccgcgagcagagggagagggaggagcaggaacggaggctacaggcagaaagggacaagaggatgcgagaggaacagctggcccgagaagccgaggcccgcgctgagcgcgaggccgaggcccgaaggagagaggagcaggaagcccgggaaaaagcccaagctgagcaagaggagcaagaacgccttcagaagcagaaggaagaagcagaagccagaagccgtgaggaagccgaacgccagagattggagcgagagaagcacttccagcagcaggagcaagaaaggcaggaacgcagaaagcggctggaggagattatgaaacgaacacgaaagtcagaagtctcagagacaaaaaaacaggactctaaggaggctaacgcaaacggcagttcgccagaacccgtgaaagccgtggaggcgagatcgccgggactacagaaggaggccgttcagaaagaggaaccaatcccacaagagcctcagtggtctttgccatccaaggagctgcctgccagcctcgtgaacggcttgcagccgcttcctgcccaccaagagaacggtttttccactaacggaccctccggggataagtcactcagtaggacaccagaaacactgttgccttttgccgaggctgaggctttcctcaaaaaggccgtcgtccagtcaccacaggtaactgaggtattgtag

SEQ ID NO: 15375 - DNA, 2526 bp, Artificial Sequence
  Description of Artificial Sequence: Synthetic coding sequence
atggaatccgggccccgcgccgagctcggcgcaggggctccccccgcagtggtagcccgcactccacccgagccgcgcccctccccggaaggcgatcccagtcctcccccgccccctatgtctgcactagtgcccgatactcctccggatacccccccagctatgaaaaacgctacaagcagcaagcaactcccactagaacctgagtcaccgagcgggcaggtaggcccccgccccgccccacctcaggaagaaagccccagttccgaggcaaagagtcggggacccacacctcctgccatggggccccgcgacgcccgtcctcctcggcgctccagccagccttctcccactgccgtcccagcatcagacagtccccccaccaagcaggaggttaagaaggcaggtgagaggcacaagctggccaaggaacgcagggaggaaagagccaagtaccttgccgctaaaaaggcagtctggctggaaaaagaggagaaggccaaggctctgcgtgaaaaacagctgcaagaaagaagacggcggctggaagagcaacgattgaaggcagagcaacggagggccgccttagaagaaaggcagcggcagaagcttgaaaaaaacaaagagcgttacgaggctgccattcagaggagtgtcaagaagacatgggctgagatacgacagcagcgatggtcatgggccggagccctccaccactcatcgccaggccataaaacttccggctctagatgctctgtgtcagctgtgaatctgcctaaacacgtggattcaatcattaacaagaggctgtcaaagtcatctgcaacattatggaatagcccttcaaggaataggtcgcttcaattgagcgcgtgggagtcaagcatcgtggacagactgatgactcctacactctcattcctcgcacggtctcgctctgcggttacacttccccgcaatggtcgagatcaaggcagagggtgcgaccctggaagggggccaacctgggggcgggcgggagcatccttggccagggggccacagcccgatcgaacacatccaagcgccgccgtccctgtgtgtcctcggagtgcctcggcctcacctttgactccttgctctgtgactcggagcgttcacagatgtgcacccgcgggcgagagaggcgagaggagaaagcccaacgcaggagggagccccgcccccgtcagacgacggcctgaggcctcccccgtccaaaagaaggaaaaaaaagacaaagaacgggaaaacgaaaaggaaaaatctgctctcgcgagggaacgctctctcaagaaacgccaaagtctccctgcctctcctcgggctcggctgagtgcgtccacagcatcggaactgtcacccaaatcgaaggcgagacctagctccccatcgacctcctggcacagacctgcttccccctgtccctcacctggtcctggtcacaccttgcctccaaaacccccctcacccaggggcaccacggcatcccccaaaggaagggtgaggcgtaaggaagaagccaaagagtctccatccgcagcaggcccagaggataagtcacagagcaaacgacgtgccagtaacgagaaagagtctgcagccccggcttcccctgccccttccccagctccatctccaactcccgcaccgccgcaaaaagagcagccccctgccgagaccccaacagatgccgccgtcctgacttcacccccagcgccagcacctccagttacaccttcaaagcctatggccggcactactgatagagaagaggccacgcggttgctggccgagaagagacggcaggctagagaacagagagagcgggaagagcaggagcggaggcttcaggccgagcgcgacaagaggatgagagaagaacagcttgctcgcgaagccgaggcaagagccgagagggaggcagaagctcgtaggagggaggaacaggaagcccgggagaaggcccaggctgaacaggaggagcaggaaaggctgcagaagcagaaagaggaggctgaagcacgcagtcgcgaggaggccgagagacagagactggagcgggagaaacactttcagcagcaagagcaggagcgtcaggagaggaggaagagactcgaggaaattatgaaaaggactcggaagtccgaggtaagtgagacaaaacagaagcaggattcaaaggaggccaatgccaatggcagcagccctgagccggtgaaagcagttgaggcccggtccccaggcttacagaaggaggccgtccagaaggaggagccgataccccaggagccccagtggtctctgccttccaaagaactgcccgccagcctcgtcaacggtctacagcctctacctgcccatcaggagaacggattcagtacaaatggcccttccggagataagagcctctcacgaactcctgaaacactgctgcctttcgcagaagctgaggcatttctgaaaaaagccgtggtccagagtccacaggtaacggaggtcctttag

SEQ ID NO: 15376 - DNA, 495 bp, Artificial Sequence
  Description of Artificial Sequence: Synthetic coding sequence
aacttgccaaagcatgtagatagtataattaataaacgccagcgactggaacgtgaaaagcacttccagcaacaggaacaggaacgtcaagagaggagaaaaaggctcgaagagattatgaaacggaccagaaagagcgaggtgtccgaaacaaaaaaacaggatagcaaagaagctaacgccaatggaagctcaccagagcccgtcaaagctgtggaagctaggtcacctggcttgcagaaagaagcggtgcagaaggaagaaccgatccctcaggagccccagtggtcgcttcctagtaaagagctgcccgcctccctagttaatggtttgcagcccctgccagcccatcaggagaatggattctctaccaatgggccatccggcgacaaaagcctgagcagaacgccagaaactctcctgccattcgccgaagccgaggccttcctcaaaaaagccgtcgttcagtcaccccaggtcacggaagtgctgtag

SEQ ID NO: 15377 - DNA, 345 bp, Artificial Sequence
  Description of Artificial Sequence: Synthetic coding sequence
atggttatacgcgtgtatattgcctcttcatctggcagcacggctattaaaaagaagcagcaggacgtgttgggattcctggaggctaataagataggctttgaggaaaaagacatcgctgctaacgaggagaacagaaaatggatgcgcgagaatgttcccgagaactctcgaccggccactggctaccctttacctcctcagatcttcaatgagtctcagtacagaggagactacgatgctttcttcgaggccagagaaaacaatgctgtttacgccttcctcggactgactgccccccccgggagtaaagaagccgaagtccaggcgaaacagcaggcttag

SEQ ID NO: 15378 - DNA, 537 bp, Artificial Sequence
  Description of Artificial Sequence: Synthetic coding sequence
atgtcagggttttctacagaagagcgggctgcgccattctctcttgagtaccgagtatttttgaagaatgaaaaaggccagtatatatcaccgttccacgatatccctatttacgctgacaaagacgtcttccacatggtggtagaagttccccgatggtccaatgcaaagatggagatagctaccaaggaccctttgaatcctatcaagcaagatgtgaagaaaggaaaattgagatacgttgccaatctgtttccctacaagggatatatctggaactatggtgcgatcccacagacttgggaggaccccggccacaatgacaaacacaccggctgttgcggcgacaatgaccccatagacgtgtgcgaaatcgggagtaaggtttgcgcccggggtgaaattatcggagtaaaggttcttggcatcctggccatgatagatgagggtgagaccgactggaaagtaattgccattaatgttgacgacccagatgcagcgaattacaatgtgtgcaacagcgtggtaatcctgtag

SEQ ID NO: 15379 - DNA, 870 bp, Artificial Sequence
  Description of Artificial Sequence: Synthetic coding sequence
atgtccggctttagcacggaagagagggcggctcctttttcacttgaatatcgagtgtttctgaagaacgagaagggacagtatatctctccttttcacgacatccctatctacgctgacaaggacgtcttccacatggtggtggaagttccccgttggagcaacgctaaaatggaaatcgccaccaaggacccactgaatcctataaagcaagatgtcaagaagggcaaactgcggtatgtggctaatcttttcccatacaaaggctacatttggaactatggcgctatcccccagacatgggaagaccccggccataacgacaagcacaccggttgctgtggcgataacgatcccatcgatgtgtgcgaaattggcagcaaggtatgcgccagaggagagatcatcggagtaaaagtcctggggatactggctatgatagacgagggggagacagactggaaggtcatcgcgattaacgtggacgaccctgacgcggctaattataacgacataaacgatgttaaacgcctgaaaccaggatatctggaagcaacggttgactggttcagaagatacaaggttccagacggcaagcccgaaaacgaattcgctttcaatgcggagtttaaggacaaggacttcgccatcgacatcatcaagtctactcacgaccactggaaggccctggtgaccaaaaaaaccaacgggaaaggtatcagttgcatgaacaccaccctttctgaatccccttttaagtgcgaccctgatgccgctcgtgcgatcgttgacgcccttccgcccccatgtgagtcagcctgcacagtgcctactgatgtggataagtggttccatcaccaaaagaactag

SEQ ID NO: 15380 - DNA, 2103 bp, Artificial Sequence
  Description of Artificial Sequence: Synthetic coding sequence
atgaccgagcgatgttccctctggtcagctctctccgccgccgcatgttgcttctacagaggatccttcgtgcaattcagtaaagagaagtacatcctggatagttcccctgaaaaactccacaaggaattggaagaggaactcaaactctccagtaccgacctcaggtcccatgcatggtatcacggtaggatcccacgagaagtatccgaaacactggtccagcgcaatggtgacttcctgatacgcgattccctgaccagcctgggagactacgtcctgacatgccgctggcgaaaccaagccttgcactttaaaatcaacaaagtggtcgtgaaggcaggtgaaagctatactcacattcagtatttatttgagcaggaatcattcgatcacgtacctgcgctcgtccggtaccacgttggctctaggaaagctgtgtcagagcagtcgggggctatcatttactgtcccgtaaaccgaactttccccctccgctaccttgaagctagctatggcctcgggcagggctcatccaagccggcttccccagtgtcccccagcggcccgaaaggatctcatatgaaaagaaggtctgttacaatgactgatggcttaaccgctgacaaggtgacacggagcgatggatgcccgacttccacatcgctgccccggcctcgggatagcatccgatcctgcgcgcttagtatggaccaaatccccgatctccatagccccatgagtcccatctcagagtcaccatctagcccagcatattcgacggtgactcgagtccatgcagcaccggccgccccatccgccaccgccttgccagcatcaccagttgcccggaggagcagtgaaccccagctctgtcctggctctgcccccaagactcatggagagtctgacaagggcccccacacttcgcccagccacactctgggcaaggccagcccaagcccatccctgagctcctattctgaccctgactccgggcactattgccaacttcaacctccagtgagaggcagtagggaatgggccgccactgagacttcgagccagcaggcccgttcttacggagagcgcctgaaggagctgtcagagaatggcgctcccgaaggcgattgggggaagacctttaccgtccctatcgtagaggtgacaagcagctttaatccagccacatttcaatccctcctgataccacgcgacaatagacctctggaggtggggctcctccggaaggtgaaggagttattagcggaggtcgacgcccggactctggctcgccatgtgacaaaggtggattgccttgttgctaggatcctgggagtgacaaaagagatgcagaccctgatgggcgtccgctggggtatggagctgctgaccctccctcatggacgacagctgcggctagatctgctggagcgctttcacactatgtccattatgctggccgttgatattctcggttgcactggctccgccgaggaacgcgctgcgcttcttcataaaacaatccagttggcagcggaactccggggtacgatgggtaatatgttttctttcgccgcagtaatgggcgccctggacatggcacagatctccagactggagcagacctgggtgaccctaagacagcgtcataccgaaggtgccatactgtacgaaaagaagttgaagccgttcctcaagtcactcaacgagggaaaggaggggccacctttgtcgaacaccacgtttcctcacgtgttacccctgatcactctcctcgaatgtgattccgcgcctcccgaagggcctgaaccatggggaagcacagagcatggcgttgaagtcgtcttggcccacctcgaagcggcaagaacagtggcccaccacggaggcttgtatcacactaacgccgaagtgaagctgcaaggctttcaggctagaccagagcttcttgaagtgtttagtaccgagttccagatgaggctcctctggggttcccagggagcctcctcctctcaagcaagacgctatgagaaatttgataaagtgctcacagccttaagccataaacttgagcccgccgtaagaagtagtgagctctag

SEQ ID NO: 15381 - DNA, 2379 bp, Artificial Sequence
  Description of Artificial Sequence: Synthetic coding sequence
atggcccccgctctgcccagcccacacaaggcagtcgcccgacctgagcttcttctggacactgccgctcactcaggcaaactcagagctcccgatggcggtgagggtgccgaatgcgccggtcacaatggcggtccttcctggggcgtcggccaaggacagtcacaagagccctcgcgacaagggatcccacaggccccttggttggtctcctggcagcgacgcggttttccaccttcttctttctgtccaggtcctttgaggacagagaagcttcgggcgggccgctgtccattactgctatgcggcggagccgccggcgagcctgaggcgggcagcgattatgtgaagttttctaaagagaagtacattctcgattcatcaccggagaaactccacaaagaactggaggaggaattgaagttgagtagcaccgacctacgttcacacgcctggtaccacggacgtatacctagggaagtgtctgaaactctggtgcaaaggaatggcgattttctgatcagagactcactgacctcccttggcgactatgtcctaacctgccggtggcggaaccaggctctgcatttcaagatcaacaaggtggtagtgaaggctggggaaagctacacccacatccaatatctgttcgaacaggaaagcttcgaccacgttcctgccctggtcaggtatcatgtgggctcaaggaaagcggtcagcgaacagtcaggcgccattatctattgccccgtgaatcgcacatttcctctgagatacctggaggctagttatggtctcggccagggtagctccaagccggcgagtcccgtgtcaccttccggccccaagggctctcacatgaaacgcaggtctgtgactatgacagacggactgactgctgacaaagtcaccagatcagatggctgccctacatccaccagtctgccgcgaccccgtgatagtattagaagttgtgcccttagcatggatcagatcccagacctgcacagtcccatgtccccaatcagcgagagtccgagttctcctgcctacagtaccgttacccgggtgcacgcggcaccagcagcccctagcgctacagcactgcccgctagccccgtagctagacgcagcagcgagccccaactgtgccctggatccgcaccgaaaacacacggcgagtctgacaaggggccacacacctctcccagccacactctgggtaaggcaagtccgtctcctagcctctcatcctattcagatccagattctggacactattgccagttgcagccacctgtacgagggagtagggaatgggctgcaaccgagacgtcttctcagcaggcacgaagttatggagaacgccttaaggagctgagcgagaatggcgcgcctgaaggcgattggggcaagacctttacagttccaattgtggaagtgacctcatcctttaatcctgcaacctttcagagcctgctgattcctagagacaacaggcctctggaggtggggctcttaaggaaggtgaaggagcttttggcagaagtggacgccagaacgctcgcacgccatgttacaaaagttgattgtctggtcgctaggattctgggtgtgacaaaggagatgcaaacacttatgggcgtgcggtggggtatggagcttctcactctgccgcacggacgccagctccgcctcgatctcttggagcgttttcacaccatgagtataatgctggcagtggatatactggggtgcacggggtctgccgaggagcgggcagcactactccacaaaaccattcagctggccgcagaactacgaggcactatgggaaatatgttttctttcgctgccgttatgggagccctggacatggcgcagattagcaggctggaacagacctgggtgacactcagacagagacacaccgaaggcgccatactgtacgagaaaaaacttaagcccttcctgaagagtctcaatgagggtaaagaggggccacctctgtctaacactacatttcctcatgtgctgccgctgatcaccctgttggaatgtgactcggccccacccgaaggacccgaaccctgggggagcacggagcacggtgtcgaggtcgtactcgcgcacctggaagctgcacggacagtcgctcatcatggggggctgtaccacactaacgcagaggtgaaacttcagggctttcaggccaggcctgaactgctcgaagtcttctccaccgagtttcaaatgcggctgctgtgggggtcccaaggtgcgagtagctcccaggcccggagatatgaaaaatttgataaagtgctgacagctctgtctcataaactcgagccagccgtgcgctctagcgagttgtag

SEQ ID NO: 15382 - DNA, 2112 bp, Artificial Sequence
  Description of Artificial Sequence: Synthetic coding sequence
atgacagccgttggacgcaggtgccccgccctgggatcccgcggcgcagcgggagaaccagaagcaggcagtgactatgtgaagttcagtaaggagaagtacatcctggattccagccctgaaaagctgcacaaggaattggaagaagaactgaagctgagctctaccgatctccgttcacatgcatggtaccatggaagaattccgagagaggtgagcgagacgctggttcagcgaaatggtgactttctgatccgcgattcactgacatcccttggagattacgtattgacgtgccggtggagaaaccaggctctccacttcaagattaacaaggtggtggttaaggccggtgaatcttatacgcacatacagtacctgtttgaacaggagtccttcgaccacgtccctgcactcgtgagataccatgtgggctctagaaaagctgttagcgaacagagcggcgcgattatatactgtcctgtgaaccgcacctttcccttgcggtatctggaggcaagctacggacttggccagggctcctcaaaacccgccagcccagtctcaccatccggacctaaaggatctcacatgaaacgccgctcggtgacaatgaccgatgggctcacagccgataaagttactcggagcgacggatgcccaacatcgacctcacttcctcgcccacgcgactcgattagaagttgcgccctgagtatggatcaaattcctgatcttcacagcccaatgagcccaataagtgaatctccttcatctccagcatattccaccgtaaccagagtacacgccgcaccagccgcccctagcgctactgcactcccagcttctccagtcgcacgccgttccagcgaacctcagctatgccctggctccgcccccaagacacatggcgaaagcgacaagggaccacataccagcccatctcacactctggggaaggcgtcccctagtccttctttatcgagctatagtgacccagactcggggcactactgccagttacagcctccagttcggggcagtagagagtgggcggctaccgagacttctagccagcaagctcgcagttatggggaacggttgaaggagctatctgaaaatggcgcacccgaaggagactggggcaagactttcaccgtcccgattgtggaggtgaccagctcttttaaccctgccaccttccagagtctgctgattccacgcgataaccggcctctagaggtgggtttgcttcggaaggtgaaggaactcctggcggaagttgacgccaggacactggccaggcacgtgacaaaggtcgattgtctcgtcgcccggatactcggggtgactaaggaaatgcagacactgatgggcgtccgatgggggatggaactcctgactctccctcatggcagacaattgagactggacctcctggagcggttccatacgatgagtatcatgcttgctgtagacatcctgggctgtaccggctccgctgaggagcgtgctgccttactccacaaaacgatacagctagccgccgaactgcgaggaaccatgggcaacatgttctccttcgctgctgtgatgggcgccctggacatggcacagatctcaaggcttgagcaaacatgggtgacactgagacagcggcatacagagggagccatactgtacgagaaaaagctgaagcctttcctgaagtcactgaacgagggcaaagaaggtcctcctttgtcaaatacgacatttcctcatgtgcttccactaataaccctgttagaatgcgattctgccccgcccgaggggcctgagccatggggatccaccgagcacggcgtggaagtagttctcgcccacttagaggccgccaggactgtcgctcaccatggagggctgtatcacactaatgccgaggttaaactgcaggggttccaagcaagacccgagctgctggaggtgttctccaccgaatttcagatgcgtctgctgtggggttcccaaggagcatcatcatcacaggcaagaaggtatgagaaattcgataaggtactcacagctttatctcacaaattagaacccgctgtcaggtcctctgagctttag

SEQ ID NO: 15383 - DNA, 1869 bp, Artificial Sequence
  Description of Artificial Sequence: Synthetic coding sequence
atggaccaattgcctcagaaaaatctgctacggctgcatccggctggttcagcaggatgcagtaccggcgttgagtcctcctcgatggacggcttctggatggaggtggaacagatccagcagagggacgaactccgagaggaagattccggaggcaacgaaggccagctcccggaggagggagaggccgaatctcagtggctccaggacactggattatcaggcttattgggagggttaggtctggacggtgatcatcaggagctgctgagcactctgacacagacgcaggtcgccgcggtttgtcgccgcctggatatctacgccaggagcgtgcgcaggcagcacaagacccccgtgcgtgacgttagagatgtgttcggtgttttcaattccggtaagatgtcatccgaaaacggcgatagtgggatgaagggtgcacagctgtccagcggcgcttccaagttccccccagctgcagaaccaggcggacttcaggagcaagcaggtcgcgaagaggcttttaatatggattccgcctactcggaacaggccgccgtgctgctgcagaggagtcggccgtcacgcgggggcaccagcgcatggggaaaatgttctctgcccaagtttacagttcccaaagggcggctgggagtgacgagaatcggggacttaagccttcaggacatgcgaaaagtcccgtccctggctctgatcgagttgactgccctctgcgacatcttgggattggatctcaaaaggtcaaaagctgggaaatggaaggccgctgagactcgactgtttggagtccccttggattctctgttggaggcggatcacaaagttctcccatccacccaggttccgttggtgcttcaggcactcctgagttgtctcgaaaaaagagggttggacatggagggcatcctgcgcgtgcctggatcccaggccagagtgaagggtctggagcagaagctagagagggatttctatgccggccttttttcatgggatgaggtacaccacaatgatgcctcagacctgttgaagcgctttatccgaaaactgccaacacccttactaactgccgaatatctcccggccttcgctgtcgtccctaacattcccaacctgaaacagcggcttcaagtgctccacctgctgattttaattctgcctgagccgaaccgaaacgcattgaaggcgctcttggaattcctcaggaaggtggtggctagggagcagcacaataaaatgacactccgcaacgtgagcacagttatggcgcctaatcttttcctccatcaggggcgaccacccaaattgcctaagggcaaggaaaaacagcttgcggagggggctgccgaggtagtccagataatggtgcattatcaggacctgctttggactgtagcatcgttcctcgtggctcaggtgcgcaaactaaacgattcgagctcccggcgtccgcaactttgtgacgccggcttgaagacctggctgagacggatgcatgcagaccgcgataaagccggagatggccttgaggcaacacctaaagtcgccaagatccaggttgtatggccgatcaaagatcctctgaaggttcctctgaccccctctactaaggtagcacacgttctcaggcagtttaccgaacatctctctcctggaagtaaggggcaggaggacagtgaggatatggacagtttattgctgcaccacagatctatggagagtgccaacatcctgttgtatgaggttggggggaatataaacgagcaccggttggatcctgacgcgtatcttttggatctgtacagagctaatcctcacggggaatgggttcttaaacaaaatcctacgtag

SEQ ID NO: 15384 - DNA, 846 bp, Artificial Sequence
  Description of Artificial Sequence: Synthetic coding sequence
atggcaaccgaactgcagtgtcctgactcaatgccctgccataaccagcaggtgaattcagcgagtactccaagcccagagcaactcaggccaggagatttgatccttgatcacgctggcggcaatagagccagtagggccaaggtcatccttctgaccggatatgcgcactcctctttgcctgccgagttagactccggtgcttgtggggggagctctctgaacagtgaaggtaacagcggatccggagatagttcaagctatgatgctccggcgggcaattctttcctcgaggactgtgagctgtcccgacaaatcggcgcccagctgaaactccttccaatgaacgatcagatcagagaactgcaaacaatcatacgtgacaaaactgctagcaggggcgactttatgttttctgctgacaggcttattcggcttgtggtagaagaaggattgaatcaactcccatataaagagtgtatggtgacaacaccaactggatacaaatacgagggagttaaattcgaaaaaggcaactgcggcgtctctatcatgcgaagcggcgaagccatggagcaggggctgagagattgctgtcgatcgatacgcatcgggaaaatcctgattcagtcagatgaagaaacgcagagagcaaaggtgtattacgcaaaatttccccctgatatttacagacgaaaggtgctgttaatgtatccaatactatccaccgggaacacagtgatagaggcagtgaaggtgctgatcgaacacggtgtacagccttcagtaataatcttattatctttgttcagcaccccgcatggggagttttccatgaggcaatag

SEQ ID NO: 15385 - DNA, 930 bp, Artificial Sequence
  Description of Artificial Sequence: Synthetic coding sequence
atggcgacagagctgcaatgccccgactctatgccttgccataaccagcaggtgaattctgcgtccacgcccagtcccgaacagctgaggcccggggacctgatcctggatcatgccgggggcaatcgagctagccgagccaaggtgatccttctcactggctatgcccactccagccttccagctgaacttgactccggggcttgtgggggctcatctttgaatagcgaaggaaacagtgggtccggtgactcgagcagttacgacgcaccggccgggaattcgttcttggaagattgtgagttgtccagacagatcggcgcgcaactaaaactgctgcctatgaatgaccagatcagagagttgcagaccatcatcagagacaaaactgcctcccgcggtgactttatgttttccgctgaccggctcatacggctggtggtcgaagaggggcttaaccagctcccatataaagaatgcatggtgactacacctacaggatacaagtatgagggcgtgaaattcgaaaaggggaattgcggggtgagcataatgagatcaggtgaagcaatggaacagggcctgcgcgattgctgccgaagcatcagaattgggaaaatactgatccaatccgacgaggagacgcagagggcaaaggtgtactatgcaaaattcccccccgacatctatcgccggaaagtcctgctgatgtacccaatcctcagcacaggaaatacagtcatagaagctgtaaaagttctcatcgaacacggagtccagccctcggtgattatcttgctcagcttgttttcaactcctcacggtgcgaagtctataatccaagagttccctgagatcacgattctaacaaccgaggtccacccggtcgcaccaactcatttcggacagaaatacttcggcactgattag

SEQ ID NO: 15386 - DNA, 633 bp, Artificial Sequence
  Description of Artificial Sequence: Synthetic coding sequence
atggtgagcgggagcgaacagaagttcctgattggtctcggaaagtctcagatatatacatgggacggtcgccagagcgaccgctggattaaactggatctgaagaccgagttgcctcgggacactttgttgagcgttgaaatagtacacgaattgaaaggagagggcaaggcacagaggaagatttctgctatacatatccttgatgtcctagtactgaatggaactgatgttcgcgagcagcatttcaaccagcgaattcagctggccgaaaagttcgtcaaggccgtctcaaaacccagtaggcccgacatgaaccccatccgagtgaaggaggtctacaggctcgaggagatggaaaaaatcttcgtgcggctcgagatgaagattataaaagggtcctctggcactccgaagttgtcatatactggtagggacgacaggcacttcgtccctatgggcctttacatcgtgaggacagtgaacgagccctggaccatgggcttcagcaaatccttcaagaagaaattcttctataataaaaaaacaaaggactcgaccttcgacctcccagccgattccattgctcctttccatctgcctagtctggcctgtttgtctaaaatggattag

SEQ ID NO: 15387 - DNA, 1119 bp, Artificial Sequence
  Description of Artificial Sequence: Synthetic coding sequence
atgaagcgcagaacagaccccgagtgcactgctccgatcaagaagcaaaagaaacgggtcgccgagctcgctctcagcttgagctctacttccgatgacgagcctcctagtagcgtgagtcatggcgccaaagcctcaaccacctctctgtctggcagtgactccgaaacagaagggaaacagcactcaagtgatagttttgacgacgcatttaaagcagactcactcgtggaggggacctctagcagatacagcatgtacaacagtgtatcacagaaattgatggccaagatggggttccgggaaggggaagggctgggcaagtattcacaaggcagaaaggacatcgtcgaggcctcttcgcaaaagggtcgtagaggattggggctgacattgcgaggcttcgatcaggagctgaatgtggattggcgagacgagccggaaccaagcgcatgtgaacaggtgtcctggttcccagagtgtactacagagatccccgacacacaagagatgtctgactggatggtcgtcggaaaaaggaagatgataattgaggacgagacggagttctgcggggaagagctcctgcactcggtcctgcaatgcaaaaagccactcgtaaaagatagggaagcagagctgctgtattttgcagacgtatgtgccggacctggagggttttcagagtatgttttgtggcgcaagaagtggcacgcaaaaggtttcggaatgacactaaaaggcccaaatgacttcaagctggaggacttttactccgcgagcagcgagctttttgagccctattatggtgaaggtggaatcgatggcgatggcgacatcacccggccagagaatatttccgccttccggaactttgtgctcgataacactgataggaagggggtgcatttcttgatggccgatgggggcttttctgtcgaagggcaggaaaacttacaggaaatcctgtctaagcagctcctcctctgtcagtttctaatggctctgtctattgtccggaccggagggcacttcatatgcaaaaccttcgatctcttcacccctttttcagtgggcctggtgtacctgttatattgttgcttcgagcgggtctgttag

SEQ ID NO: 15388 - DNA, 615 bp, Artificial Sequence
  Description of Artificial Sequence: Synthetic coding sequence
atggctgggtacctttccgagagcgatttcgtgatggtggaagagggtttttctacacgtgatttattgaaggagcttaccctgggcgccagccaggccactacagacgaggtcgctgccttttttgtcgccgacctcggcgctattgtgcgtaaacacttctgtttcttaaaatgtttgccacgggttagaccattttacgcggttaaatgcaatagctctcctggagttctcaaagtgctggcccaactgggactaggcttctcctgtgcaaacaaaattgccagcgttataaacagcgcactagatctgtacttcccggaaggatgcggagtcgacatctttgctgagctaggccgttattatgtcacaagcgctttcacggtggccgtcagtattatcgctaagaaggaagttctcttggaccagcccggtagagaagaagagaatgggtccacctcaaaaaccatcgtttatcacctggatgagggcgtgtacggcattttcaactcagtgctcttcgacaacatttgccccacacctatactgcagaaatcaaaaaaccatagcccatgttatatgagcctggaatctattcacttcattgctgtgtag

SEQ ID NO: 15389 - DNA, 1443 bp, Artificial Sequence
  Description of Artificial Sequence: Synthetic coding sequence
atggctggttatttgtccgagtccgatttcgtcatggtggaagaagggttctcaaccagagacctgctaaaggaactgaccctcggtgctagccaggccaccactgacgaggtggctgcgtttttcgtggccgatctaggcgccatcgttcgaaaacacttctgcttcctgaagtgcttaccacgggtgcggcctttctatgctgtgaaatgcaatagcagcccgggcgtcctcaaagtcttagcccaactgggccttggctttagttgcgccaacaaagctgagatggaactggtacagcatatcggtatccccgcgtcaaaaatcatttgcgcaaatccatgtaaacagatcgctcaaatcaaatacgccgccaaacatgggatccaactgctctcgtttgataacgaaatggagctggccaaagtggtgaaatctcacccatccgctaagatggtcctgtgtattgccaccgatgacagccactctctcagttgtctgtccctgaagtttggcgtgtctctcaaatcttgtagacacctgctggagaatgccaagaagcaccacgttgaagtggttggggtctcatttcacatcggaagtgggtgtccagatcctcaagcttacgcacaatctattgcggacgccaggctggtttttgagatgggcaccgagctgggtcacaagatgcatgtcctggatttgggaggaggctttcccggaaccgagggcgccaaggtcaggtttgaggagatcgcaagcgtcataaatagtgcactggacctgtatttcccggaaggttgtggggttgacatcttcgcagagctaggtagatactatgtgacctccgcttttaccgtcgccgtgtccataattgccaagaaagaagtcctgctggaccaaccaggaagagaggcacccttaccaccacctcatatcgccacctgcgcagcctctgaacctagcccccctgcagaagaaaacggttcaacttctaagacaatcgtttaccacttggacgagggagtctacggcatcttcaattcggttctctttgacaatatctgccctaccccaatcctgcagaaaaagcctagtaccgagcaacctctttacagcagctccctgtggggacccgcagttgatggatgtgactgcgtggccgaaggattatggctaccccaactccacgtcggggattggctagtcttcgataatatgggcgcctacacggttgggatgggctctccattctggggaacacaagcatgccacattacgtacgctatgagcagggtggcctgggaggccctgcgacggcagttaatggctgctgagcaagaagacgatgtggagggcgtatgtaaaccactttcttgtgggtgggagattaccgacactctgtgcgtgggccctgtgtttacccctgcttcgatcatgtag

SEQ ID NO: 15390 - DNA, 1383 bp, Artificial Sequence
  Description of Artificial Sequence: Synthetic coding sequence
atggccgggtatctatcggaatccgactttgtgatggttgaagagggctttagtactcgcgacctgctcaaagagctgacactgggcgctagtcaggcgaccacggacgaggttgcggcctttttcgtggctgaccttggtgccattgtacggaagcatttctgttttctcaaatgcctccctagagtcagaccgttttacgccgtaaaatgtaactcttctcccggagtgcttaaggtgttagcccagttgggtctcggcttctcctgtgcaaacaaagcagagatggagctggtccaacacatcggcatccctgcaagcaagattatctgcgcaaacccctgcaaacagatcgctcagattaaatacgcggcaaaacacggcatacagctgctctccttcgacaatgagatggaactagcaaaggtagtgaaaagccatccctccgccaagatggtgttgtgtatagcgaccgacgattcgcactccctgagctgtctttccttgaaattcggcgtgtctttgaagagttgtcggcacttgctcgagaacgccaagaagcaccacgtggaggttgtgggagtttcattccatatcgggagtgggtgtccggatccacaggcttatgcccagtccattgcggacgctcggctcgttttcgagatgggaacagagctagggcacaaaatgcatgtcctggatttaggcggaggtttccccggaactgagggagcaaaggtcaggttcgaggaaatcgcctcagttatcaacagcgcattggatttatacttcccggagggatgcggagtagacatctttgctgagttgggccgttactacgtgacctcagcctttacggtggctgtgtcaataattgccaaaaaggaagtgctcctggatcagccaggccgcgaggaagaaaacgggtcaacctctaagacaattgtctatcacctggatgaaggtgtctacgggattttcaatagcgtgttgttcgataatatatgtccgacacctatcctgcaaaaaaagccatccacagagcagcctctctactcatcttccctatggggccctgctgtggatggatgtgattgtgtcgccgaaggattgtggctgccacagcttcacgtgggagactggctcgtctttgataacatgggagcctacaccgttggaatgggaagcccattttggggaacccaggcttgtcacatcacctacgcgatgagccgcgtagcttgggaagcactaaggcgccagcttatggctgctgaacaagaggacgatgtggagggggtctgcaagcctctctcctgtgggtgggaaattacagatacactctgtgtaggacctgtgttcacccccgcctccattatgtag

SEQ ID NO: 15391 - DNA, 2508 bp, Artificial Sequence
  Description of Artificial Sequence: Synthetic coding sequence
atgaagcggagaaccgatccagagtgcaccgcccccattaagaaacagaaaaagagggtggctgagctggcgttatccctgtcctccacttccgatgacgagcctccttcgagcgtttctcacggagcgaaagccagcactacatccctctcaggatcagattctgaaactgagggaaagcagcattcgtcagacagtttcgatgacgcatttaaggctgatagcctggtcgagggcacttcatccagatattcaatgtataattcagtcagccaaaagcttatggccaagatgggatttagagaaggagaaggtctggggaaatactcccagggtaggaaggatatcgtggaggcctcttcacagaaaggtaggcgaggattgggactcaccctcaggggctttgatcaggaactgaatgtggactggcgagatgagccagaaccgtcagcgtgtgaacaggtcagctggttccccgagtgcactacagaaattcccgatacacaggaaatgtccgattggatggtggtaggtaaaaggaagatgattattgaggacgagactgaattttgcggagaggagcttctccattctgtcttacagtgcaaatcagtgttcgacgtgctggacggggaagaaatgcgtagggctcgtactagagctaacccctatgaaatgatccgaggagttttctttcttaatcgggccgcaatgaaaatggcaaacatggacttcgtgttcgacaggatgtttacaaatccgcgtgactcctacggcaaacccttggtaaaggatcgggaggccgaactgctgtacttcgccgacgtttgtgctggacctgggggattttctgaatacgtgctgtggaggaagaagtggcacgccaaagggtttggcatgaccctcaaaggtcctaacgactttaagttagaggatttctatagtgcttctagcgaactgtttgagccctactacggggaaggaggtatcgatggggacggcgacattacacggcccgagaacatctctgcttttcggaacttcgtgctggataatacagaccggaagggagtgcactttctcatggcagacggcgggttttccgtggagggacaagaaaatctgcaagaaatcttgtccaaacagcttctactgtgtcagtttctgatggccctttcaatcgtacggaccggcggtcacttcatctgtaaaacctttgacctcttcacaccgttctccgtgggtcttgtgtacctgctgtattgctgcttcgaaagggtttgcttgtttaaacccatcacatcccgccctgccaatagcgagagatatgtggtgtgcaagggtttaaaggtgggaattgacgacgtgagagattatctgtttgcagtgaatatcaaactgaatcaactgcgcaacactgactcagacgtcaacttagtggtgccactggaggttattaaaggagaccacgagtttactgattatatgataagaagtaatgaaagccactgctcactgcagataaaggcactggccaagatccacgcctttgttcaggacactactttgagcgagccaaggcaggctgaaatccgtaaagaatgccttcgattgtggggaatcccggaccaggcacgcgtcgctccttcctccagcgatccaaaaagcaagtttttcgagcttattcaggggacagaaattgatattttttcctataagcctacacttttgacttctaagacactggagaagatcaggccagtgttcgactatcggtgtatggtgtcagggtccgagcagaagtttctaattgggctaggcaaaagtcaaatctacacttgggacggacgtcagtcagatagatggattaagctggacctgaaaacagagttgcctcgggacactctgttgagtgttgaaatcgtgcacgaattaaagggcgaaggtaaggcccagcggaagatttccgcgatccacattctggatgttctggtgttgaacggcacggatgtcagagagcagcactttaaccagcgtatccagctcgcagagaaattcgttaaagcagtgtctaaaccaagtcgccctgatatgaaccctatccgcgttaaagaggtgtatcggctcgaagagatggagaagattttcgtgagactagagatgaagataataaaggggtcgtctgggacacctaagttgagctacacagggcgagacgacagacatttcgttcccatgggcctatatatagtccgcaccgtgaatgaaccttggactatgggcttctctaaatccttcaaaaaaaagttcttctacaataagaagactaaagactctactttcgacttgccggccgacagcatcgctccctttcatatatgctattatggaagactgttctgggaatggggagacggaattagagtccacgacagccagaagcctcaggatcaagataagttaagtaaggaggatgtgctaagtttcatccaaatgcacagggcgtag

SEQ ID NO: 15392 - DNA, 252 bp, Artificial Sequence
  Description of Artificial Sequence: Synthetic coding sequence
tagcaggaactgctgaaggaaaagactcttgctgagcagaatttagaagataccagacagcaattgttagctgctagaagcagtcaagcaaaagcaatcaacacgttagaaacccgggtgagagagctggagcagacactgcaagccagcgaagaacaactccagcaaagcaaaggcattgttgcagctcaggagacccagatccaggagctcgtttcagcctactggagttgctgtataccaggtccctag

SEQ ID NO: 15393 - DNA, 2304 bp, Artificial Sequence
  Description of Artificial Sequence: Synthetic coding sequence
atgttcgctaaactgaaaaagaagattgccgaggaaacagctgtggcccagcggcccgggggcgccacgagaatcccgaggagcgtctccaaggaatctgttgccagcatgggcgcagattctggagatgactttgcaagcgacggctcatccagccgcgaggacttatccagtcagctgttgaggaggaatgagcagattcgcaagttggaagcccggctgtctgactatgccgagcaggtaagaaatcttcagaaaatcaaggagaaactggaaatcgctttggagaaacaccaagattcgtcaatgcgaaagttccaggagcagaatgaaaccttccaggctaatagggcaaagatggccgaaggcctcgctttagcgttggccagaaaagaccaagaatggtctgaaaagatggaccagttagagaaggagaagaacatactgactgcccaattacaagagatgaagaatcagtcgatgaatctcttccagcgccgggatgagatggacgaactggagggattccagcagcaggaactgtcaaagatcaaacacatgctgttaaaaaaagaggaatccctgggaaagatggaacaggagctggaagcaagaacaagagagctgtcaagaactcaggaggagctgatgaacagcaatcagatgtcttcggatctgagccagaaattggaggaacttcagaggcactacagtacactggaggagcaaagggatcatgtaatcgcgtctaaaacgggggccgagtccaaaatcaccgccttagagcagaaagagcaggaactccaggccctgatacagcaactgtcaattgatctacagaaggtcacggccgagacccaggaaaaagaggatgtgatcactcacctgcaagagaaagtggcatccctagagaagcgcctggaacagaatctgagtggtgaggagcacctgcaggagctcctgaaggagaagacgctggcagaacagaacctggaggacacaaggcagcagctacttgcagcccgttcctcccaagctaaagccattaatacactcgaaacacgcgtgagggagcttgaacagaccctgcaggcatcagaagaacagcttcagcagagcaaggggatagtcgcagcgcaggagacgcaaatccaggagctcgcggcggctaatcaggagtcttcccacgtgcagcagcaggccctggctttagagcagcagtttctggagcggacacaggccctggaggcgcagattgtcgctttggagaggacacgcgctgcagaccaaaccactgcggagcagggaatgcgccagctggaacaggagaacgccgcgctgaaggaatgtcggaacgaatatgaacgttcccttcaaaatcatcaatttgaactgaaaaagctgaaagaagagtggtcccagagggaaattgtcagtgtcgcaatggcacaagcattagaggaggtgcgtaaacagcgggaagaattccagcagcaggccgccaacctaacagcgatcatcgatgagaaggagcagaatctcagggagaagaccgaggtgttgttacagaaagagcaggagatcttacagctagaaagggggcacaattccgcattgctgcagattcatcaattgcaagccgagctcgaagccctccggactttaaaggcggaggaggctgctgtcgtagccgagcaggaggatttgttgcggctgcgtggaccactgcaggccgaggcgctatctgtgaatgagagccacgtgacaagccgcgcgatgcaggatccagtttttcagttgccgacagcaggacgcacccccaatggcgaggtcggagcgatggatctcacccagctccaaaaggaaaagcaggatctggaacagcagctgctggagaagaacaaaaccattaaacagatgcagcagcgcatgttagaactgagaaaaacactccagaaggaacttaaaattagacccgacaacgagctgttcgaggtcagggagaagcctgggccggaaatggctaatatggcgccctctgtaacaaacaatacagacctgactgacgcgcgcgagatcaatttcgagtatctgaagcacgttgtgctgaaattcatgtcctgcagggaaagtgaggccttccacctgattaaagctgtttccgtgctgttgaatttctcacaagaggaagaaaatatgctaaaggaaacgctggaatataagatgtcctggttcggatccaaacccgcaccaaaaggttctattcggccctcaatctctaatcccaggataccctggagctag

SEQ ID NO: 15394 - DNA, 291 bp, Artificial Sequence
  Description of Artificial Sequence: Synthetic coding sequence
tgagccaaaattaaggctcgggacctacggggaaaaaaaaaggaggaactactcaagcagctcgacgatttgaaagtcgagctttcgcagctgagagttgcaaaggtgaccggaggagccgcctctaaactgtcaaagatcagggtcgtccggaaatcgatcgcccgggtgttgactgtcataaaccagacacagaaggaaaatctaaggaaattctataaagccgctgccggcggcccttgtatccagatggaccgggtgctgcctcagcctcctgcctgtagctgctag

SEQ ID NO: 15395 - DNA, 1035 bp, Artificial Sequence
  Description of Artificial Sequence: Synthetic coding sequence
atgcggcggcggagggaggaagagggaatccagctgcgcaagcagaaacgagagcagcagttgtttaagcggagaaatgtggagctgataaatgaggaagccgctatgtttgactctctcctgatggacagctacgtgtccagcacaactggggagagtgtcatcactcgcgaaatggttgaaatgcttttttctgatgattccgacctgcaactcgccacaacccaaaaatttcggaagctgttaagcaaggaacctagcccacctattgatgaagtaattaacaccccaagggtggttgaccggtttgttgagtttcttaagaggaatgagaactgcactctacaggcagtttgggctctcgggaatatcgccggagattccagcgtttgccgcgactacgtacttaactgtagcattttaaatccattgctgactttactcacaaagtccactcgccttacaatgacccgcaacgctgtatgggccctgtccaacttatgccgcggcaaaaaccccccccccgaattcgccaaggtcagcccttgcctgccggtgctttcacgattattgttcagtagcgatagtgacctgttggctgacgcctgttgggctctttcgtatctgtctgacggcccaaatgaaaagattcaggccgtaatcgactccggggtttgtagaagactagtggaactcctgatgcacaacgattataaggtggcatctccagctctgcgggccgttggaaacatcgttaccggcgacgacattcagactcaggtgatcctaaactgctctgccctcccatgcctgttacacctactttccagtcccaaggaatccatccgcaaggaggcctgttggaccatttccaatattaccgcaggtaatcgagcgcagatccaggccgtgatagatgccaacatcttccctgtgctgattgagattctgcaaaaggctgaatttagaacccggaaagaggcagcatgggcgataacgaacgctacctccgggggcactccagaacagatctag

SEQ ID NO: 15396 - DNA, 582 bp, Artificial Sequence
  Description of Artificial Sequence: Synthetic coding sequence
atgcctacaacctctaggcccgctctggacgttaagggaggcacctcccccgcaaaggaagatgccaatcaggaaatgtcttccgtcgcatattctaatctggccgtgaaggatcgtaaggctgtggcgattctgcactacccaggtgtggctagtaatggcacaaaagcaagtggcgccccaactagtagctccggttctccaattggttctcccaccactacaccccccacaaagcctcccagtttcaatttacaccccgctcctcatcttcttgcatctatgcacttgcagaagctgaattcacagtaccaggggatggctgctgcaacacccggccagcctggggaagcaggaccgctccagaactgggatttcggcgcccaggcagggggggctgaaagcctgtctcccagtgccggcgctcagagccctgcaatcatcgattcagatcctgttgacgaggaggtgctgatgagcctggttgtcgagctgggcttggatagagcaaatgaattgcctgagctctggctgggacaaaacgaattcgatttcacagccgacttcccttctagttgttag

SEQ ID NO: 15397 - DNA, 1611 bp, Artificial Sequence
  Description of Artificial Sequence: Synthetic coding sequence
atggagaccatggccagtcctggaaaggataactatagaatgaagtcttataaaaacaatgccctcaaccctgaagagatgagacgacggagagaagaggaggggattcaattgagaaagcagaagcgggaacagcagctgtttaaaagacgtaacgtggagctcattaatgaggaagcagcgatgttcgacagcctactgatggattcttatgtatcatcaacaacaggcgaaagtgttattacacgcgagatggtcgagatgctgttttcagacgactctgatctacagctggctacaacccagaaatttcgtaagcttctgagtaaagagccatcaccccctattgacgaagtgatcaatacacccagagtcgtcgatcgttttgtggaattcctcaaaaggaacgagaactgcacactacagttcgaagcggcatgggcgctgaccaatattgcatccggcacttcccaacagacaaagatagtgattgaagccggagctgtgcctatcttcattgaactcctgaacagtgatttcgaagacgtgcaggaacaggctgtgtgggcattaggaaacatcgccggcgattccagtgtctgccgggattacgtgcttaattgcagtatcctgaatccactgttgacactactgacaaagagcacgaggttgacaatgacacgcaatgcggtatgggctctcagcaacctatgccgggggaaaaatccaccaccggagtttgccaaggtgtcaccctgtttgcctgtgctgtccaggctcttattttcatctgattccgatctcctcgcagatgcatgttgggccctgagttatctgagtgacggacctaacgaaaagattcaggctgtgattgattcgggcgtgtgtaggcggctagtggaactcctcatgcacaacgattacaaagttgcttctcctgcactccgtgctgtgggaaacatcgtcaccggcgatgatatccagacgcaggtgattctgaattgctccgctctgccatgcctgctgcacttactgtccagtccaaaggagtccatcagaaaggaggcatgttggacaatcagcaatatcacggcgggaaaccgcgcccagattcaggcagtgattgacgctaacatcttcccagtactcatcgagatccttcagaaagctgagtttcggacaaggaaagaggccgcatgggccattaccaatgctacctcaggcggcactcccgagcaaattagatacttggtctcgctgggatgcatcaaaccactctgcgatctactgaccgtgatggactccaaaatagtgcaagtcgcactgaacgggctcgagaatatcttgcgccttggtgaacaggagggcaagagatcaggatccggagtgaacccctactgcggcttaatcgaagaggcctatggcttagataaaatagaattcctgcagagccatgagaaccaggagatttatcagaaggctttcgacctgattgaacattatttcggcgttgaagacgatgacagctctcttgctccccaggtggacgagacacagcaacagtttatctttcagcagcccgaggctcctatggagggatttcagttatag

SEQ ID NO: 15398 - DNA, 2769 bp, Artificial Sequence
  Description of Artificial Sequence: Synthetic coding sequence
atgatcactagcgcagccgggatcatttccctgctcgacgaagatgagccacagcttaaagagttcgctctgcataaactcaacgcggtggtcaacgacttttgggcggagatttccgagtctgtggacaagatcgaagtcctgtacgaggacgagggattccggtcacggcagtttgccgctctcgtggctagtaaagtgttttaccatctgggcgcatttgaagaatccctgaattacgctctgggggccggagatctctttaacgtcaacgacaattctgaatacgtggagacaatcatagccaaatgtatcgatcactacacaaagcagtgtgtagaaaatgcggatcttccagaaggagaaaaaaagccaattgatcaacgcctcgagggaattgtgaacaaaatgtttcagcgatgcctcgatgaccacaagtacaaacaggcgattggcatcgcccttgaaactcggagactcgacgttttcgaaaagaccatactcgagtctaatgatgtgcccgggatgctagcatactctttaaagctctgtatgagcctcatgcagaacaagcagttccggaacaaggtcttgagagtgctggtcaagatttacatgaacctggagaagcccgatttcattaacgtgtgccagtgtctaatcttcttggacgatcctcaagctgtcagcgatattctggagaaactggtgaaggaagataatctactcatggcttatcagatctgttttgacctctacgaatctgcctcccagcagttcttgagcagcgtcatccaaaacttaagaactgtgggaacccctattgccagtgtcccggggagcactaataccgggaccgtgcctggatctgaaaaggatagcgacagcatggagaccgaagaaaaaacatctagcgcatttgtaggcaaaacacctgaggcttcccctgagcctaaggatcaaacactgaaaatgattaagatcctgagtggggagatggcgattgaactgcacctgcaattcctgatccgaaacaacaatacagatttgatgatcttgaagaatacgaaggacgctgtgcgaaacagtgtgtgccacacagcaactgtgattgccaacagcttcatgcactgcggaactaccagcgatcagttcttgcgagacaatttggaatggctggcacgggccactaactgggccaaattcactgccaccgcatctttgggagtgatccacaagggtcacgagaaagaggccctacagcttatggccacttatctgccaaaagataccagccctggctcagcatatcaagaggggggcggcctgtacgctctgggactgattcatgccaatcacggcggggacatcatagattatttgttaaaccaactgaagaatgcgtccaacgacattgtacggcatggagggtccctgggtctgggtttggccgccatggggacagcacgccaggacgtgtacgacctcttgaagacgaatctctaccaggacgatgcagtgactggcgaagcagccggcttggcactggggcttgtaatgctggggagtaagaacgcacaggccattgaagacatggtgggatacgcccaggagacacaacatgagaagattctgcgggggcttgctgtgggcatcgctctggtgatgtacggaagaatggaggaggcagatgccctcattgagtctttgtgcagagataaggaccctatcctgaggcgcagcgggatgtacacagtagccatggcgtattgtggcagtggaaacaataaggctatccgccgactcctccatgtggctgttagcgatgtgaacgacgacgtgcgtagggccgcagtggagtccctcggctttatcctcttcagaacccctgagcagtgcccctcggtagtgagcctgctgtctgaatcttataatccccacgtgaggtacggagcagcgatggccctcggaatttgttgcgccgggaccggaaataaggaggcgataaatctgctagagccaatgaccaacgatccagtcaactatgtgaggcaaggggccctgattgcatcagccctgattatgatccagcaaaccgaaatcacttgtccaaaagttaaccagtttcgacaattgtacagtaaggttatcaacgacaaacatgacgatgtcatggccaagttcggcgctattctcgcccagggcatcctggacgccggaggtcataatgtcaccatcagcctccagtcacgcaccggacacacccatatgcctagtgttgtgggcgtccttgtcttcacacaattttggttctggttcccacttagtcacttcttgagcctggcctatacacccacatgtgttattggactcaacaaagatttgaaggtatccactgctgtgctctctatcaccgctaaggccaagaagaaggagaaggagaaagagaagaaggaggaagagaagatggaggtcgatgaagcagaaaagaaggaggaaaaggaaaaaaagaaggagcccgagccaaattttcagctgttggacaaccctgcacgtgtgatgcccgcacaactgaaggtcttgactatgcccgaaacctgtcggtaccaaccattcaaaccgttgtccatcggtggaatcatcattcttaaggacacatctgaggatatagaggagctggttgagccagtcgctgcgcacggacccaaaatcgaggaagaggagcaagaaccagagcccccagaaccctttgagtatattgatgactag

SEQ ID NO: 15399 - DNA, 1227 bp, Artificial Sequence
  Description of Artificial Sequence: Synthetic coding sequence
atgccagaagagcaagctttcagcgtgctggtcaaaattatgttcgattacggcttgcgagagctgttcaagcagaacttcgaagatttgcattgtaagttctaccagcttgagaggcttatgcaggagtacatacctgacttatataaccattttctggatatttcactggaagctcacatgtacgctagtcagtggttcctcaccctgttcaccgccaagttcccactgtacatggtcttccatattattgatcttctgctctgtgaggggatatccgttatatttaacgtagcccttggccttttgaagaccagtaaggatgatctactccttaccgattttgagggcgccttaaaattttttcgcgtgcaactgcccaagcgctatcggagcgaggagaatgctaagaaacttatggagctggcctgtaatatgaagataagccagaagaaactgaaaaaatatgagaaagaatatcatacaatgcgagagcagcaagcccaacaggaggaccctattgagcgtttcgagcgggagaaccggcggctccaagaggccaatatgcgcctggaacaagaaaatgacgatttggcacatgagctcgtgacttcaaagatagctttaaggaaagatctggacaatgctgaggagaaggcagacgctctgaacaaagagcttctgatgaccaagcaaaaattgatcgacgcagaagaggagaagcggcgcctggaagaagaatctgcacagctgaaggagatgtgccgacgagagttagacaaagctgaaagcgaaatcaaaaagaacagctccattataggagattacaaacagatctgcagtcagctcagtgagcgcctggagaagcaacagacagctaacaaagttgagattgagaagatcaggcagaaagtagatgattgcgaaagatgtagggagttttttaataaggaaggaagggtcaaaggaatcagctcaaccaaggaagtgttggacgaagatacggatgaagaaaaagagaccttgaagaatcagttgagagagatggaactggagttggctcagacaaagcttcagcttgtggaggccgagtgcaagattcaggatctcgaacaccatttaggactggccctgaatgaggtacaagcggccaaaaaaacatggtttaacagaacgctcagctctatcaagacagcgacaggggtgcagggtaaagaaacgtgctag

SEQ ID NO: 15400 - DNA, 3210 bp, Artificial Sequence
  Description of Artificial Sequence: Synthetic coding sequence
atggacgacaaagcttcagttggcaaaatcagcgtgagtagcgacagcgtgtcgacactcaatagtgaggattttgtcctggtgtcccgccagggcgacgagaccccttccaccaataacggtagtgacgacgaaaagactggcctgaaaatcgttggaaatggctcagagcagcagctgcagaaagagctggccgacgtactgatggacccccccatggatgatcagccaggagaaaaagagctggtcaagcgttcgcagcttgacggtgagggcgacggccctctctccaaccagctgagtgccagttctaccattaatccggtgcccttggtgggactgcagaagcccgagatgtctctgcccgtaaagcctggacagggagactctgaggcatctagtccctttacgcctgtcgctgacgaagactcagtcgtcttttcaaagttgacctatctgggctgcgcgagtgtgaacgcaccgcgctccgaggtggaagcgctgcggatgatgagcattctgagatctcagtgccagatctccctcgacgtcaccctgagcgtaccgaatgtgtcagagggaatcgttcgattgctggacccccaaacgaatacggagattgcaaactacccaatatataaaattctattctgtgttaggggacatgatggcactccggagagcgattgcttcgcttttacagagtctcactataacgccgaactcttccgtatacacgtcttccggtgcgaaattcaggaagccgtcagccgcatcctgtacagcttcgcaactgctttccgccggtccgccaagcagacacccctctctgctaccgcagccccacagacccccgattctgacatcttcaccttcagcgtctccttggagatcaaagaggacgacgggaaggggtacttctccgcggtcccgaaagacaaggaccgccagtgcttcaagttgagacagggcatcgacaagaaaattgtgatttacgtgcagcagaccaccaacaaagagctggccatcgagcgctgcttcggcttgttgcttagtcccggcaaagacgtacgaaattccgacatgcacttactggatctcgaatcaatgggaaaaagtagcgacggtaagagttatgttatcacaggcagctggaatcccaaatcgcctcatttccaggtggtcaacgaagaaacgcctaaggataaagtgctgtttatgactacagccgtggatctggtcatcaccgaggtgcaagaaccggttagatttctcttagagaccaaggtgagagtgtgctcccctaacgaacgcctcttttggcctttttccaagcgcagcacaaccgaaaattttttcctgaaactgaaacagatcaagcagcgagagcggaagaataacacagatacgctgtacgaggtcgtctgtctggaatccgaaagtgagagggagcgtcgaaaaacgaccgcatctccttcagtccggctcccccaatcagggagccagtccagcgttatccccagcccaccggaagatgatgaagaggaggacaacgatgagccgttgctgtcaggatctggcgacgttagtaaggagtgtgccgagaagatcttggagacctggggagaactgttgagtaaatggcacttgaatctaaacgtgagaccaaaacagttgtcttccttagttaggaatggagtgccggaggctctccgaggtgaagtttggcagttgcttgctggatgccacaataatgatcaccttgtcgagaagtatcgaatcctgattaccaaggagtcaccgcaggactcagcaatcacacgggatattaacagaacctttcccgcgcatgactacttcaaggacaccggaggggacggccaggactctctctacaagatctgtaaggcttattcggtctacgacgaagagattggctactgccagggtcagtctttcctggctgctgtcttgctcctgcacatgcctgaggagcaggccttctcagtccttgtgaaaatcatgtttgactatggactgagggaactattcaaacagaacttcgaagacttacactgcaagttctatcagctggagcggttgatgcaggagtacatccctgacctgtataatcacttcctcgatatttccctcgaggcgcacatgtatgcttcccagtggttcctcaccctgttcactgccaagttcccactttacatggtttttcacatcatcgacctactgctgtgcgaagggatcagcgttatctttaatgtggcacttggtttgcttaagaccagtaaggatgatctcctgctgactgattttgagggggctcttaaattttttcgggtgcagctgccaaaacgttatcgatcagaggagaatgcaaaaaaattgatggagctggcttgtaacatgaaaatatcccaaaagaaactgaagaaatacgagaaggaataccacaccatgagggaacagcaggcccagcaggaggacccgatagagcggtttgaaagggagaacaggcggttgcaagaggcaaatatgcgcctggagcaggagaatgacgatctggcccacgagctggtgacttccaagattgcactgagaaaagatctggacaacgctgaagagaaagctgacgccttgaacaaggagctgctcatgacaaagcaaaagctcatagacgcggaagaggaaaagcggcgcctggaggaggagagtgctcagcttaaggaaatgtgtaggagagagttagataaggccgaatctgagatcaagaaaaactcgtccatcattggagactacaaacagatctgcagtcaactgtccgagcgccttgagaagcagcagacggcaaataaagtcgagattgaaaaaatccggcagaaggtagatgactgtgagcgttgtagagagtttttcaacaaggaaggaagagttaaaggcatctcatcaactaaggaggtcctggatgaggacactgatgaggagaaagagacactgaagaaccagcttagagaaatggaactcgaactagcccaaactaaactccaactagtggaagctgaatgcaaaatccaggacctggagcatcacctcgggctggcgctgaatgaggtccaggcggctaagaaaacctggtttaaccgaactttgtccagcatcaagaccgctactggcgtccagggaaaggagacctgctag

SEQ ID NO: 15401 - DNA, 2808 bp, Artificial Sequence
  Description of Artificial Sequence: Synthetic coding sequence
atgcagaggaaattggtgaccctagtcaactgccagttagtcgaagaagaaggtcgagtcagagcgatgagggccgcccggagtctcggtgagcgaacagtgaccgaactgattctgcagcatcaaaatccccaacaattgagcgccaacctatgggctgccgtcagggccagaggatgccagtttctcgggcctgccatgcaggaagaagccctgaagctggtgctactggcattagaggacggctcagcgctctcccggaaggtcctggtgctctttgttgtacagaggctagaaccacggttcccccaggcatctaagacctcaatcggccatgtggtgcaacttctctacagagctagctgcttcaaagtgaccaaacgcgacgaagactccagcctgatgcagctgaaagaggagtttagaagctacgaagccctgcgcagggaacatgacgcccagatcgttcacattgcaatggaggcagggcttaggattagtcctgaacagtggtcctcgttgctttatggggaccttgctcataaaagccacatgcagagtattatagataagttgcagagtccagaatcttttgccaagtccgtccaagagctcacaatcgtgttgcagaggacaggtgacccggctaacttgaaccggctgaggccccatctggagcttcttgctaatatcgaccccaaccctgatgcagtgtcacccacatgggaacagctggaaaacgccatggtcgccgttaaaacggtggtccatggcctggttgatttcatccaaaattactctaggaaaggacatgagacgccgcagcctcagccaaacagtaagtataagaccagcatgtgcagggatctgcgacagcaaggtggttgtccaagaggtaccaactgtacattcgcacactctcaggaggagctggaaaaatacagactccgtaataagaagataaacgcaaccgtccgaacctttccactcctcaataaagtcggcgttaacaataccgtgactaccaccgcagggaacgtgattagtgtcatcggctccacagagacaactggaaagatcgtaccctcaaccaacgggatttctaacgcggaaaactccgtttcacaacttatctcccgcagtactgacagcaccttgagagcactagaaacagtgaagaaggtcgggaaggttggagccaacggccagaatgccgccggcccgagcgcggactcagttactgaaaataagattggatcacccccaaaaacacccgtgtccaatgtggctgcgacaagtgccggtccaagtaacgtgggaaccgagcttaactccgtcccccagaaaagcagcccattcctgacgagggtcccggtatatcccccccacagtgaaaacatccagtactttcaggaccctaggacccagatccctttcgaagtcccccaatatccccaaacgggatactacccgccacccccaactgtgcctgccggcgttgctccctgcgttccgcggttcgtgaggtcaaacaacgtgccagagagtagcttgcctccagcctcaatgccttatgccgaccactatagtactttttcccctcgcgaccgaatgaatagtagcccgtaccagccaccgccacctcaaccctatggacctgttccgcctgtgcctagcgggatgtatgcgccagtgtacgactcgagaagaatctggagaccacccatgtaccagcgcgacgatatcatcaggtcaaattctttacctccaatggacgtcatgcacagctccgtttatcagacgagcctgcgcgaaaggtataactccctggacggttactattctgttgcttgccagcctccgagcgaaccccgaaccactgtgccgctgcctagagagccttgcggtcacctcaagacgagttgcgaggagcagatcagacggaagccagatcaatgggcacagtaccacacacagaaggcccccctggtgtcatctacgttacccgtcgctacacagtcaccaacacctccatctcccctattttcggtggattttagggctgatttctcagaatctgtgtctggcacgaagtttgaagaagatcatcttagtcattactccccttggtcttgcggcacaattggcagttgcattaacgctatcgattccgagcctaaggatgtcatcgccaactctaacgcggtcttaatggacctggacagcggagatgtaaaaaggcgagtgcaccttttcgaaacccagcggaggacgaaggaagaggatccaatcattccgttctcggacggcccaattatcagcaagtggggggctatcagcaggtctagtagaaccggctaccacacaactgaccccgtgcaggccaccgccagtcaggggtcggctactaagccaatatccgtgtctgattatgtgccatatgtaaacgccgtggacagtagatggagcagttatggcaatgaagccactagttctgctcattacgtggagagggacagattcattgtgactgacttgtccggacaccggaagcactcaagcacaggagacttgttatcgctggagctgcaacaggctaagagcaatagcctcttgctgcagcgagaggcaaacgccctggctatgcaacagaagtggaacagcctggatgagggcagacacctcaccctgaacctgttatccaaggagattgagttgcggaatggtgaggtgaagaaactgaacctgtcggcgagttgccttatgtacctgttttctgcagccgccagctggctgtaccactattag

SEQ ID NO: 15402 - DNA, 1437 bp, Artificial Sequence
  Description of Artificial Sequence: Synthetic coding sequence
atgcccgtgcaagcagcacaatggaccgagttcctgtcatgcccaatatgttacaatgagttcgacgagaatgtgcacaaacccatcagcctcggctgctctcatacagtgtgcaagacctgtctgaataaattacacagaaaggcctgccctttcgatcagacagcaattaacaccgatatcgatgtcttgcctgtgaatttcgccctactgcaactggttggagcccaggtgcccgaccatcagtctataaagctgagcaaccttggggagaataaacattatgaggtagcaaaaaaatgtgttgaagacttggctctgtatctgaaaccgctgtccggcgggaagggagtggcatcactgaaccagtcagcgttatcccggccgatgcagcggaaattagtcacactcgtcaactgtcaactcgtggaggaggaaggtcgcgtgcgcgccatgcgcgctgctagatctttgggagagaggaccgtgactgaattgatcctccagcaccagaacccacagcaactctctgcaaacctgtgggctgcggttagggcacggggctgtcaatttctggggccagctatgcaggaagaagctctcaagttggtgttactggccctcgaagatggtagtgcgttatcaaggaaagtgcttgtgctttttgtagtccaacgacttgaacctaggtttcctcaagcctcaaaaacttctataggccacgttgtccagcttctctaccgcgccagttgtttcaaggtgaccaagagagatgaagattcatcccttatgcagctgaaagaagagttccgctcttatgaggccctgcgaagggagcacgacgctcagattgtacacattgccatggaagccgggctccgcatttcccctgagcagtggagttccctgctgtacggggacctcgcccacaagtctcacatgcagtctattattgacaaactccagagcccagagtcttttgcgaaatctgtgcaagagctcactatcgtgctgcagcgcacgggggaccccgccaatctgaatcggctgcgaccacacttggaactcctggcgaatatcgaccctaatccggacgctgtctcccccacatgggaacagctcgagaacgccatggtcgccgtgaagaccgtggtgcacggacttgtggactttattcagaattacagccggaaaggccatgaaacaccgcagccccagcccaattccaaatacaagacatccatgtgtcgcgatttacggcagcagggtgggtgccctcgcggaactaattgcacattcgcccactctcaggaagagctggagaaataccggctgcgcaacaaaaaaatcaatgctactgaagttttgaaacagcagggaaaattattccaggtccagacagaatttcagatgcagaagactgtctttccatcctag

SEQ ID NO: 15403 - DNA, 3576 bp, Artificial Sequence
  Description of Artificial Sequence: Synthetic coding sequence
atgcccgtgcaagccgcccagtggaccgaattcctcagctgtcctatatgttataacgagtttgatgagaacgtccataagcccattagtctcgggtgttcccatacagtctgtaaaacatgtctgaataagctgcacagaaaagcgtgccctttcgaccagactgcaataaacactgatattgacgtgttgccagtgaatttcgctctcttgcaactcgtgggagcgcaggtgccagaccatcagtctatcaagctgagcaacttgggggagaataaacactacgaggtggctaagaagtgtgtggaagaccttgctctgtatttgaagcccctgtctggtggaaagggtgtggcttctctaaatcaaagcgccttgtctaggcccatgcagaggaagctggttactttagtgaactgccagctggtcgaggaggagggcagagtccgggcaatgcgtgcagcgagatcgctgggggagcgcacggtgacagagctaattctgcagcaccagaaccctcagcagcttagtgccaacctctgggctgccgttcgcgcccgaggctgtcagtttctgggccccgcgatgcaagaagaggccctgaaattggtactgttggctctagaggacggctcggcactgtctcgaaaagtgctggtgctcttcgtggtgcaaagactggagccgcgcttccctcaggcgagcaaaacatctatcgggcacgtcgtgcagcttctctatcgcgccagttgtttcaaagtaaccaagcgcgacgaagactcaagtcttatgcagttgaaagaggagtttcgaagctatgaggccctccggcgggaacatgatgctcaaatagtgcacatcgctatggaagctggcctcaggatcagtccagagcagtggtctagtctactgtacggtgacctggcccacaaatctcatatgcagagcatcatcgataagctgcagtcccctgaatctttcgcaaaatcagttcaggagctcaccattgtgctgcagcggacaggcgacccagccaatctgaataggctgcggccccatctggagctgttggcaaatatagatccgaacccggatgctgtgtcaccgacctgggaacagctggagaacgccatggtggcagtgaagaccgtcgtacacggactggtggatttcatacagaattactcccgcaaggggcacgaaacaccgcagcctcagccaaactctaagtacaaaacttcaatgtgcagggatctgagacagcaaggcgggtgtcccaggggaacaaattgcacctttgctcatagccaggaagagctggagaagtatcgcctgagaaacaaaaaaatcaacgcgacagtacggaccttcccactgctgaacaaagtcggtgtgaataatacagttacaacaactgccggaaacgtcatctccgttattggcagcactgagacaacagggaagatcgtgccttccactaacggcatatccaacgctgagaattctgtgagccagctgatctcacgaagcaccgacagcaccttacgtgcactggaaacggtgaaaaaggtgggcaaggtaggcgcaaacggccaaaacgccgctggcccatccgctgattctgttactgagaataagattggctcccctcccaagaccccagtgagcaatgtggccgcaacttccgccggaccttccaacgttggtacagagctaaattctgttcctcagaaatcatccccctttctcacccgggtgccagtgtacccccctcactctgaaaacattcagtacttccaggatccccgcacacagattccctttgaagtgcctcagtatcctcaaaccggctactatccccctccgcctacagtaccagcgggggtcgccccctgcgtcccgcgttttgtaagatctaataacgtccccgagtctagcctgccccctgcctctatgccctatgccgaccactattcaaccttcagtcctcgcgacagaatgaattccagcccttaccagcccccacccccccagccttacggccccgtgccccccgtgccttctggtatgtacgccccagtatatgactccagacgcatttggcgtcctcctatgtaccaacgtgacgatattatcagaagtaattccttgccccctatggacgtgatgcatagtagcgtataccagacctcgcttagagagagatacaactccctggacgggtattattcagtggcctgccagcctcctagtgagccccggactaccgtgccattgccccgcgagccctgtggccatttgaaaactagctgtgaagagcagattagaagaaagccagaccagtgggcccagtatcacacacagaaggctcctcttgtaagctctaccctgcccgtggcaactcaatccccaacaccacctagcccactcttttccgtggatttcagggcagacttctcagagtccgtgtccggcacgaagtttgaagaagaccacctgtcacactattctccgtggtcctgcggcacaattgggtcttgtatcaatgccatcgattctgaaccaaaagacgtcatcgcaaattcaaacgccgtactgatggatttggatagcggggatgtgaaacgaagggtccatctctttgaaacgcagagaaggactaaggaagaggatcccataattccattctctgatggccctatcatcagcaagtggggtgccatttccaggtcgtctaggactggatatcataccaccgaccctgttcaggctactgctagtcagggttcggctaccaaaccaatcagcgtgtccgattatgtgccgtacgttaatgccgttgacagtagatggtcctcgtatggtaacgaggccacatctagcgcccactacgtagagcgggataggtttattgttaccgacctctcaggccatcgaaaacattcctctactggcgatctgctcagccttgagcttcagcaggctaagtcaaacagcctgctcctacagagagaggcgaatgctctcgcaatgcaacagaaatggaactccctcgacgaaggccgccacctgactctgaaccttctgagcaaggaaattgagctgcgaaacggtgaattgcagtccgattataccgaggacgcaactgatactaaacctgatagagacatagagctggagctctccgcactggataccgatgagcccgatggacaaagcgaacccatagaggaaatccttgatatccaacttggaatctcttcccagaacgatcaactgctgaatggcatggctgtggaaaatggccatccagtgcagcagcaccaaaaggaaccccctaaacagaagaaacagagcttaggcgaggatcacgtgattctggaggaacagaaaactattcttcctgtgacatcttgcttctctcagcccctccccgtgtctatcagtaacgcaagttgtctgcccatcactacatcggtgtccgctgggaatcttatcctgaaaacccatgtgatgtccgaggataaaaatgacttcctaaagcctgtggccaacggcaagatggtcaactcttag

SEQ ID NO: 15404 - DNA, 1569 bp, Artificial Sequence
  Description of Artificial Sequence: Synthetic coding sequence
atggcagcctcagctaaacgcaagcaggaggagaagcacctgaagatgctgagagatatgacggggctgccacataaccgaaagtgttttgactgtgaccagcgggggccaacttacgtaaacatgaccgtcggctcattcgtgtgtacaagctgctccggatcattgcggggactgaaccccccgcaccgagtcaaaagcatctcaatgactacattcacgcagcaagagatcgaattccttcagaagcacggcaacgaagtttgcaagcaaatatggctgggactgttcgatgatcggagctctgcaatccctgatttcagagacccacagaaagtgaaagaatttctgcaagaaaagtacgaaaaaaagaggtggtatgttccccccgagcaggccaaagtggtggccagtgtccacgccagcattagtgggagcagcgctagctccacttcatcaacgccagaggtgaagccgctgaaatcattgttgggtgattctgcaccaaccctacacctgaacaagggcacacctagccagtccccagtggttgggcggagtcaggggcagcaacaggaaaaaaagcagttcgaccttctctctgacctagggtcagatatttttgcggctcctgccccccaaagtactgctacagcaaactttgctaattttgcgcactttaatagccacgcaggtggaagcgccgccagcgtgaatgcgaattttgcgcactttgataattttcctaagtccagcagcgcagattttggcacctttaatacatcccagagtcatcagacagcttcagcagtgtcaaaagtaagtacaaataaagctgggctacagacggcagacaaatacgccgccctggccaacctggataatattttcagcgctggacagggtggggaccagggtagcggattcgggactacaggcaaagcccccgtggggagtgtggtgtctgtcccctctcaatcttcagcttcttccgacaagtatgccgccctggccgagctcgactcggtcttctcgagtgctgccactagtagcaatgcttatacgtctacctccaacgcgagcagtaacgttttcggaaccgtccccgttgtggcctctgcccagactcagccagcgtcctcttctgtgccggccccttttggcgccacgccctcaacgaaccccttcgtcgccgccgctggcccatctgtggcttcctccacaaatccatttcagaccaatgcacggggcgcaacagctgcaacttttggcacagcatcaatgagcatgcctacaggcttcggcacccccgcaccttactcccttcctacatccttttctggttctttccagcagccagccttccccgcacaggccgctttccctcagcagaccgcattctcccagcagcccaatggagcggggtttgccgcattcggacagacaaagcccgtggtcacgccgtttgggcaagtggccgccgctggtgtcagcagcaatcctttcatgaccggagcacccactggtcagtttcctacaggatcatcttccactaacccatttctgtag

SEQ ID NO: 15405 - DNA, 1524 bp, Artificial Sequence
  Description of Artificial Sequence: Synthetic coding sequence
atgcaagacgatagcattgaggctagtacaagtatttctcagttgctgcgtgaatcctatctggctgaaacacgccaccgaggaaataacgagcggagcagagctgagcccagcagtaacccctgtcactttggaagccccagtggggctgctgagggtgggggcggacaggatgacctcccggacctttccgcttttcttagccaggaagaactcgatgagtccgtgaacctcgctcggctcgcaatcaactacgatcccctggaaaaggcagatgagacacaagcccggaagagactgtcgccagatcagatgaagcactccccgaatctaagcttcgagcccaacttttgtcaagacaaccctagatctcccacctcttctaaggagtccccacaggaggcaaagaggccccagtattgcagcgaaactcagtctaagaaagtttttctgaacaaagctgcagactttatcgaggaattgtcatcactgtttaagagccactcctcaaagcgtatcaggcccagagcctgtaagaaccataagagcaagctggagagtcagaacaaggtgatgcaggagaattcctcctcgttctccgatctgtcagagcgcagagagcggtctagcgtgcccattcccatccctgccgatacacgggataacgaggtaaaccacgccctggaacagcaggaggcaaagcgaagagaggccgaacaggccgcatcagaggctgcggggggtgatacaactcctggcagcagtccgtccagcctgtattacgaggagcctctcgggcaacccccacgattcacgcagaagctgcgctcgagagaggtgccggaagggacacgtgtccagctggattgtatcgtggtcggcattccgcctccacaagtccggtggtactgcgaagggaaggagctggaaaactctccggatattcatattgtgcaggctgggaatttacactccctgactatcgcagaagcttttgaagaggatactggaaggtacagctgtttcgctagcaatatctacgggactgactctaccagtgctgagatctacatcgagggcgtgagctccagcgactccgaaggcgacccgaataaagaggaaatgaatagaatacagaaaccaaacgaggtgtcatctccgcctacaaccagcgccgtgattcccccagcggttcctcaggcccagcatctggtagcccagcctcgcgtggcaaccatccagcagtgccagagcccaactaattacctgcagggactcgatggaaaacctataatagcggcaccagtgttcactaagatgctacagaatttgtctgcttccgaaggccagctagtcgttttcgagtgcagagtcaagggagccccctccccaaaagttgagtggtacagagagggaacacttatagaggacagtcctgattttagaatcttgcagaaaaaaccaagatccatggcagaaccaggaaaggatgactttaatttcaacttactggtgtatgaatag

SEQ ID NO: 15406 - DNA, 3150 bp, Artificial Sequence
  Description of Artificial Sequence: Synthetic coding sequence
atgttgtgttggggcaatgcctcctttgggcagcttgggctcggcggcattgatgaggagattgttctggaaccgcgtaaaagtgattttttcattaataaaagagtaagggatgttggatgcggcctgcgacatacagtgtttgtgctggacgatgggaccgtgtatacctgcggctgtaatgacctgggtcagctcggccacgagaagtcacggaaaaaacctgagcaggttgtggctctggacgcacagaatatcgtggctgtttcttgtggcgaagctcacacgctcgcactgaacgacaagggccaggtgtatgcttggggattagattcagacggtcagttagggctggtggggagtgaggagtgcatcagggtgccgagaaatataaagagtctgagcgacattcagatcgtacaggtggcctgtggctattaccactctcttgccctttccaaggcaagtgaggtgttctgttgggggcagaataagtacggccagctcggactgggtacagactgcaaaaagcagacctccccccagctcctgaaaagcctgctaggcataccctttatgcaagtcgctgcagggggcgcccattctttcgtacttaccctgagcggggccattttcggatggggaagaaataaatttgggcaacttggcctgaacgacgaaaacgacagatacgttccaaacctcctaaaatctctgcgctcccagaagattgtgtatatctgttgcggcgaagaccacaccgccgctttgacaaaggaagggggtgtctttacttttggggcgggggggtacggacagttgggacacaactcaacctcccatgaaattaacccccgaaaggtgtttgagctgatgggatccatcgtcacagaaatcgcatgcgggcgccagcatacaagcgccttcgtgccgagctccgggagaatctattcattcggattgggcgggaacggacagctagggacaggcagcacatccaataggaaatcaccctttactgtcaaaggaaattggtatccttacaacggccagtgcttaccggacattgactcagaggagtatttctgtgttaagcggatcttcagtggaggtgatcagtccttctctcactatagcagcccccagaactgcggtccgcctgatgacttccgttgtcccaatcccacaaagcagatttggaccgttaacgaagccctgatccaaaagtggctgtcatatccttccggaaggtttccagtggagatcgcaaatgagattgacggcaccttcagcagtagtgggtgtctgaacgggtccttcctggccgttagcaatgacgatcactatcggactggcaccagattctctggcgttgacatgaatgccgcccggctgctctttcataaactcattcagcctgaccatccccagatctcccaacaggtggccgcttctctcgagaagaatctgattccgaaattaaccagctctctgcccgacgtggaggcactgaggttctacttaaccttaccagagtgcccattgatgagcgatagcaacaactttaccacgatcgcaatccctttcggcaccgccctcgttaatctggagaaagcacccttgaaagttttggaaaattggtggagcgtgctcgagccaccactcttcttaaaaatcgtagagctgtttaaggaggttgtcgtgcatctgcttaaactgtataaaatcggcatcccaccgagcgaacgtcgcattttcaactccttcctgcatacagctttaaaagtgctagaaatcctgcacagagtgaatgaaaagatgggccagataattcagtacgataaattctatatacacgaagtgcaggagctgatcgacatccgcaacgattatatcaactgggtgcagcaacaggcttacggtatgctagcggacatcccagtgaccatctgtacctacccattcgtattcgatgcccaggcaaaaacaacgctgttacagactgatgctgtattacagatgcagatggctatcgaccaggctcatagacaaaatgtatccagcctcttcctgccggtcattgagtccgtgaacccctgcctcatcctggtggttaggagagaaaacattgtgggtgatgcgatggaagtgctccggaaaactaagaacatcgactacaaaaagcctctgaaggtgatttttgtaggggaggacgcagtggatgcgggtggtgttaggaaagagttttttctgctgatcatgcgcgaactcctggaccctaaatatggaatgttccgctattatgaggacagcagacttatctggttctccgacaagacttttgaggatagcgatctgtttcaccttatcggcgtaatttgcggtctggcgatctataattgtactattgtggacctgcattttccattggccctgtacaagaagctgcttaagaaaaagccttcactggatgatctcaaagaattgatgcccgatgttggccgcagcatgcaacagctgttagattatcctgaggacgatatcgaagagaccttctgtctcaatttcacgattaccgttgagaactttggagccacagaagtgaaagaactcgttcttaatggtgccgataccgccgtcaacaagcagaacaggcaggaattcgtggacgcctacgtagactatatctttaacaagagcgtcgccagcctgtttgacgcctttcacgctggatttcacaaggtatgtggtggtaaagtgctgctactcttccagcctaacgagttgcaggcgatggtgatcggtaacaccaattacgattggaaggagcttgagaagaatactgagtataagggggaatattgggcagaacaccccacgattaaaattttttgggaggtgtttcatgagttgcctttagaaaaaaaaaagcagttcctactgttcctgaccggcagtgacagaatccctatcctgggtatgaaatctctcaagctggtcatccagtctactggaggtggcgaagaatatctgccggtgtcccatacatgtttcaacctgctggacctgcctaaatacactgaaaaagaaacactccgctccaaactcatccaggctattgaccacaacgaagggtttagcctcatctag

SEQ ID NO: 15407 - DNA, 726 bp, Artificial Sequence
  Description of Artificial Sequence: Synthetic coding sequence
atgaattccgggcgccccgaaacaatggagaatttgcccgcactctataccatttttcagggcgaagtcgctatggttacggactacggggcttttataaagatccctgggtgccgcaaacaagggttggtacataggacccatatgagcagttgcagagtcgataaaccctctgaaattgtggacgtgggcgataaggtgtgggtgaagttaattggtagagagatgaaaaacgacagaataaaagtgagtctctccatgaaggtcgtgaaccagggcactggcaaggatctggaccctaacaatgtaatcattgagcaggaagagcgtaggagacgctcctttcaggattacactggtcagaaaatcacgttggaggctgtactcaatactacctgcaagaagtgtggatgtaagggccactttgccaaagactgcttcatgcagcccggaggcacaaaatactcactcattcctgacgaagaagaggaaaaggaggaagctaagtccgctgaattcgaaaagccagaccctacaagaaacccatccaggaaacgcaaaaaggagaagaaaaagaaaaagcaccgggaccggaagagcagcgatagcgattcatccgattccgaatcagataccgggaaacgtgcaaggcacacatcaaaggactctaaggccgcaaaaaagaaaaaaaagaaaaagaagcacaaaaagaagcataaagaatag

SEQ ID NO: 15408 - DNA, 870 bp, Artificial Sequence
  Description of Artificial Sequence: Synthetic coding sequence
atgatcatcaactggaaccaggttagtgttctgtggaagtgcctcctgaagcagagtgcaagctatcaggacaggcgccagtcatggcggcgcgcttccatgaaagagaccaaccgcaggaaatcattacacccgatccaccagggtattactgagctgagcaggagcatctcggttgacttagccgagtctaagagactgggctgtctgcttcttagtagctttcagtttagcatccaaaagctggaaccattccttcgggataccaaagggttcagcctcgagtctttcagagcgaaagccagctcgctgagcgaggagctgaagcatttcgccgatggcctcgagactgacgggactctgcaaaaatgcttcgaggactccaatgggaaggcctcggatttctctcttgaggcttccgttgctgagatgaaggaatatatcacaaaattttctctggagaggcagacctgggaccaactactcctgcactaccaacaggaggccaaggagatactgagtcggggctcaaccgaagcgaaaattactgaagtgaaggttgaacctatgacgtacctgggatcttctcagaatgaggttctaaatacaaagccagactaccagaagattctgcaaaatcaatccaaggtcttcgattgcatggaacttgtgatggacgaactccagggtagcgttaagcagttgcaggcttttatggatgaaagcacacaatgcttccagaaagtctccgtgcagctcgggaagagaagcatgcagcagcttgaccccagcccagctaggaaactcttgaagctgcagctgcagaaccccccagcaattcacggaagcggtagtgggagctgtcagtag

SEQ ID NO: 15409 - DNA, 750 bp, Artificial Sequence
  Description of Artificial Sequence: Synthetic coding sequence
atgacttctgtgacaagatcggagataattgatgagctcagtagatctatatctgttgacttggctgaatctaaaaggctgggatgcttgctgttgtcttcctttcagttttcaattcagaagcttgagccctttctccgggacacaaaagggttctctctggagtcattcagagccaaagcctcctccctcagtgaggaactgaaacactttgctgacggcttggagaccgatgggacactccagaagtgtttcgaagattcaaacgggaaggcttctgactttagcttagaagcctcagtggcggagatgaaagaatacattaccaaattttcactggagcgccagacctgggatcagttgttgctgcactatcagcaggaggcaaaggaaatattaagcagagggtcaaccgaggccaaaataacagaagtcaaagtagaacccatgacctacctgggatcaagccagaacgaggtgctcaatacaaagccagactaccagaaaattctccagaatcaatccaaagtatttgactgcatggaacttgtgatggatgaattacagggctccgtgaagcagctccaggcattcatggatgagagtacacagtgtttccaaaaagtttcagtacagctgggtaagagatctatgcagcagttggatcctagcccagcccgtaaattgctgaagctacagctacagaatccaccagctatccatggatccggctcagggtcatgccagtag

SEQ ID NO: 15410 - DNA, 855 bp, Artificial Sequence
  Description of Artificial Sequence: Synthetic coding sequence
atgacttcagtaacacgctctgagatcatcgatgaacagagcgcatcgtatcaggacaggcgtcagagctggcgtagagctagtatgaaggagactaacagaagaaagagcctccaccctattcatcaggggattaccgagctatcccgctctatctccgtggatctggccgagagtaaaagattggggtgtctactgctcagttcgttccaatttagcattcagaagctggaaccatttctccgcgatacaaaaggattctccctggagtcatttagggcgaaagcttctagcctgtcggaagagcttaaacactttgcagacggcttggagacagatggcacactccagaaatgtttcgaagattctaacggaaaagcctccgactttagccttgaggctagtgtggctgagatgaaagagtatatcacaaagtttagtctggagagacagacttgggaccagttgctcctgcactatcagcaagaggctaaagaaatcctgagtcggggatccacagaagccaaaatcacagaagtgaaagttgaaccaatgacttatttagggagctctcagaatgaggtgctcaatacaaaacctgactatcagaaaatcttacagaatcagtcgaaggtgtttgattgtatggagctggttatggatgaactgcagggctccgtcaagcagctgcaggctttcatggacgaatccactcagtgttttcaaaaggtaagcgtgcaactcggtaaaagatcaatgcagcagctagatcccagcccggcgcggaagttactgaagttgcaactacagaaccctcctgccatacatggctctgggagcggctcatgccagtag

SEQ ID NO: 15411 - DNA, 1071 bp, Artificial Sequence
  Description of Artificial Sequence: Synthetic coding sequence
atgacctctgttaccaggtccgagattattgatgagaagggaccagtgatgtcgaaaacgcacgatcatcaactggaaagctcgctgagcccagtcgaagtcttcgctaagacctcggcctctctggaaatgaaccagggggtgagcgaagagcgcatacaccttggaagttctccaaagaagggaggcaattgtgaccttagccatcaggaaaggctgcagagtaagagtcttcacttgagtcctcaggaacaaagtgcttcctaccaggaccggagacagagctggaggagggcatctatgaaggagaccaatcgcaggaaaagcctacacccaatccaccagggtatcacggagctgagtaggagcatctccgtagatctcgctgagtctaaacggttgggttgcctgctgctctctagtttccagttcagcattcagaaattggagcccttcctacgggacactaagggcttcagcctggagtcgtttcgagccaaagccagtagtctgagcgaggagttgaagcacttcgccgacggccttgagactgacggtaccctgcagaagtgtttcgaagatagtaacggtaaggcgagcgatttctccctggaagcatctgtagccgagatgaaggagtatattacgaaattcagcttagagagacaaacttgggatcagctgctgctgcactaccaacaggaggctaaggagatcctcagtcgaggctcgacagaggctaagattactgaagtcaaagtggaacctatgacgtatctgggatcatcacagaatgaagtgctgaacacgaagcccgactaccagaagatacttcagaatcagtccaaagtatttgattgcatggaactcgtgatggacgagctacagggctccgtaaaacagctacaggcctttatggacgaatcaacccaatgcttccagaaggtgtccgtgcaactgggcaaacgcagcatgcaacagctggatccctcgccagccagaaagcttctgaagctgcagcttcagaaccccccagctatccatggcagcggctctggctcttgccagtag

SEQ ID NO: 15412 - DNA, 1071 bp, Artificial Sequence
  Description of Artificial Sequence: Synthetic coding sequence
atgaccagcgtgacacgcagcgaaataatcgacgagaaaggtcctgtgatgtccaagactcatgaccatcagctggaaagtagcctaagccccgtagaagtcttcgccaaaacaagcgcctcgctggagatgaaccaaggagtctctgaagagcgcatacacctggggtcttcccccaagaagggggggaactgcgatttgagccatcaggaacggttgcagagcaagagcctgcacctttcccctcaggaacagtctgctagttaccaggatcgtaggcagagttggcggcgagccagcatgaaagaaaccaatcggcgtaagtcactgcaccccatccatcaggggattacagagttgtccaggagcatttctgtcgacctggctgaatcaaaaaggctcggatgccttctcttgagctccttccagtttagcatccagaagttggagccattcttaagggatacaaagggattctctctcgagagctttagagcaaaagccagctccctcagcgaagaactcaagcacttcgctgatgggctggaaaccgacggcacgctccagaagtgtttcgaggatagcaatggcaaagcctccgatttttctcttgaggcctcagtcgctgagatgaaagagtacattaccaagttctccctggaacgtcagacatgggatcagctgctgctgcactatcagcaagaagctaaggagatcctgagcaggggctcaacagaagcgaagatcaccgaggtgaaggtcgaacccatgacttatttgggttcctcacagaacgaggtgctgaacactaagcccgactaccaaaagattttgcagaaccagtctaaggtcttcgattgcatggaacttgtcatggatgaactgcaaggaagcgtgaagcagctgcaggccttcatggatgaaagtacccaatgcttccagaaggtgagtgtgcagctgggcaaaaggtcgatgcagcaactggatccttcacccgctagaaaactgctcaagctacaacttcagaacccacccgcaatacacggatctggctcagggtcatgccagtag

SEQ ID NO: 15413 - DNA, 1617 bp, Artificial Sequence
  Description of Artificial Sequence: Synthetic coding sequence
atggcagccgccgcatcagttacaggtcgcgtgacttgggccgctagccccatgagaagcctgggactggggcgtcgactctccttgcctggacccaggctcgacgcggtgactgcggctgtcaatcccagcctctctgaccacggcaacgggctgggccgtggtactcgtgggagtggttgctctggcggctccctggttgcagactggggagggggcgcagctgccgcagccgctgtagccctggcccttgctccagccctgagcactatgagacgtgggagctctgaatcagagcttgcggcacgctgggaggctgaggctgtcgccgccgccaaggcagcagccaaggcagaagccgaagctacagctgaaaccgttgctgagcaggtgagggtcgacgcaggtgctgccggagagccagaatgcaaagccggggaggagcagcctaaagttcttgccccagcaccggcacagccctcggccgcagaagaaggtaacactcaggttctccagcgcccgcccccaaccctgccaccttcaaagccaaaacccgtgcagggactatgcccgcatggcaaaccaagagataaaggtcgtagctgtaagagatctagcggtcacggcagtggggagaatggatcacaaagaccagttaccgtggattctagcaaggctaggacatctctagatgcactcaagatcagtatcaggcaattaaaatggaaagagtttccgttcggcaggagactcccatgcgacatctattggcacggcgtttccttccatgacaatgatatcttttccggtcaggtgaacaaattccctggaatgaccgagatggttaggaagatcacactgagtcgtgccgtcagaaccatgcagaacctgtttcctgaggaatataatttctacccacgcagctggatcctgccagatgagtttcaactattcgtcgcccaggtgcaaatggtgaaggacgatgatcccagctggaagcccacattcatcgtaaagcctgacggcggctgtcagggagacggaatctatttgatcaaggacccttcagatatcagacttgcagggaccttgcaatctcgtccagccgtggttcaagaatatatttgcaaacctttgttgatagacaagctaaagtttgacattcgattgtatgtcctgcttaagtctctggaccctctcgaaatctacatcgccaaagatggattgtctagattttgtactgaaccgtaccaagagcctacacccaaaaacctgcatcgcatctttatgcatctgactaattacagtctcaacatacacagcggaaactttatacatagcgattccgctagtaccggatcaaagcgcactttcagcagtattctgtgtcgtttgtcgtcgaagggagtggacattaaaaaggtgtggtctgatataatttccgtggtgatcaaaacagtgattgccttgacaccagaactgaaggtcttttaccaaagcgacatcccaaccgggcgacccggccccacatgttttcaagtaactatcgcttcatcccagcccgcgtttcccgctctcacaggattaaaacgcgccctctggctgcgagtgggctag

SEQ ID NO: 15414 - DNA, 1356 bp, Artificial Sequence
  Description of Artificial Sequence: Synthetic coding sequence
atgacggaaatggtgcgtaagatcactctttccagagctgtccgcactatgcagaacttgttcccagaagagtacatttgtaaacccctgctgatcgacaagcttaaatttgatatccggctgtacgttctgttaaaaagtctggaccctctggagatctatatcgccaaagacgggctgtcccggttctgtacagagccataccaggaacctacgcccaagaatctgcacaggatctttatgcacttaaccaactactctctgaatatccattccggaaattttatccattctgatagtgcttccaccggctccaagcgcaccttctcaagcattctgtgtcgcttgtctagcaagggggtggacataaagaaagtctggtcagacatcatctctgtggtgattaagaccgttatcgctctaacccctgaactgaaagtattctaccagagtgacatcccaaccgggcgtcctggccctacttgttttcaaatcctgggattcgatatcttgctcatgaagaatctaaagccgatactgctagaagttaatgcaaatccctcaatgcgaatcgagcacgagcatgagctgtctcccggcgtgtttgagaacgtgccttcgctcgtggatgaagaagtgaaggttgcggttattagagatactctccggcttatggatcccttaaagaagaagagggagaaccagagccagcagttagaaaagccgtttgcagggaaggaggatgccctggacggggagctgacatcggctcctgactgtaatgccaatcctgaagcacatttgccctccatttgccttaagcaggtctttccgaagtacgctaaacaattcaactatcttcggctcgtggataggatggccaatttgttcatcaggtttctgggcattaagggcactatgaagctgggacccaccggatttcgcacttttattcgctcctgtaagctttctagctcttcgctgtccatggccgcagttgatatattgtatattgacatcactaggcgttggaactcaatgactctggatcagcgagattcagggatgtgtctacaggccttcgtcgaagcctttttttttctggcccaacgcaaatttaagatgttgcctttacacgagcaggtagccagcctgatcgacctctgcgaataccatctgtccctgcttgatgagaagagactcgtctgcggccggggcgtccccagtggcggaagaccgccccatagaggtcctccacaggagccttccccgtctgctcagcctgctggtgataatcccccccctcgcactagttgtgcaaataagctctcccatcccagacacacattgtcctag

SEQ ID NO: 15415 - DNA, 1644 bp, Artificial Sequence
  Description of Artificial Sequence: Synthetic coding sequence
atgaaggtcgtgaaatccgcggaacactacacagagacagctttagacgaaattagactgcttaaatctgtgaggaacagcgatccaaacgatccaaatcgtgaaatggtggttcagctgctggacgactttaaaattagcggcgtcaacggcacgcatatatgtatggtcttcgaagtcttggggcaccacctactgaagtggattataaagagtaactaccagggtctccctctgccttgcgtgaaaaagatcattcagcaggttttacagggattagactacctgcacacgaagtgcagaatcattcatacggacatcaagccggagaacatcctgctatctgtaaatgaacagtacatcaggaggttagccgccgaggctaccgagtggcaacgtagtggcgcgcctccaccatcaggctcagccgtcagcacagccccccagccgaagccagctgataaaatgagcaaaaataagaagaagaagctcaagaaaaagcagaaacgccaggcggagttactcgagaagcgcatgcaggagattgaagaaatggagaaggagagcggaccgggtcagaaaagaccaaataagcaggaagagtccgaatcccctgtagagcggcctctcaaggaaaatcctccaaacaaaatgacgcaagaaaagcttgaagaatcaagcacgatcggccaggatcagacactgatggaacgggataccgagggaggcgcagcagagatcaactgcaacggggtgatcgaagtgataaattacacacagaactccaacaacgagacactgcggcataaagaggacctgcataacgcgaatgactgcgacgtgcagaacctgaaccaggaaagctcgtttctttccagccagaatggggactcaagtacatctcaagagacggactcctgtacccctatcactagcgaggtgtcggacacgatggtgtgccaaagcagtagcaccgtaggtcaatctttttctgaacagcacatcagccagcttcaggagagcattagagcagaaattccctgtgaggacgagcaggagcaggagcataatggaccacttgataacaaggggaagagtaccgcagggaattttcttgtaaaccctctcgagcccaagaatgccgagaaacttaaggtcaagatcgctgacctgggaaacgcctgctggcataagcatttcactgaggatatccagacaagacaatacagaagtctcgaggtgctgatcgggtccggctacaacactcccgccgacatttggtccacagcatgcatggcttttgagttggctacaggagactatctgttcgaaccgcatagtggcgaggagtacactcgcgatgaagatcacatcgtccatatcatcgagctcattggacgtatcccaagaaggtttagcctctcgggtaagtactcccaggatttcttttcacaccgtggcgatttgaagcacataaccaagctaaagccttggggcctatttgaggtcctcgtcgagaagtacgagtggtctcaggaggaggcagctgggtttaccgacttccttctcccaatgctcgaactaatacctgaaaaaagggccaccgccgctgagtgtttgaggcatccatggctaaactcctag

SEQ ID NO: 15416 - DNA, 1968 bp, Artificial Sequence
  Description of Artificial Sequence: Synthetic coding sequence
atggaacgaaaggtcctggcccttcaggcacggaagaagcgcaccaaggccaaaaaggacaaggcccagcggaagtcggaaacacaacaccgcggatcagccccacattctgaaagcgacctgcctgagcaagaggaggaaatcctaggctccgatgacgacgagcaagaagaccccaatgactattgcaagggaggctaccatctcgttaagatcggcgacctttttaacggccgctaccacgtcatcagaaaattaggttggggccacttctccactgtatggctgagttgggacatccagggtaagaagtttgtggcgatgaaagttgtgaagagcgccgagcactatacagagactgctctggatgagatcaggctgctcaagtcagtgcgtaacagcgaccccaatgatcctaacagggaaatggtggtccaactgctggacgattttaaaatctccggggtcaacggtacccatatctgcatggtctttgaagtgcttggccatcatcttctgaagtggatcattaagagcaattatcaaggtctgccacttccttgcgtgaagaaaattatccaacaggttctccagggtctggattacctacatacgaagtgccgaataatccacactgatattaaacccgagaacatacttctgagcgtcaacgaacagtatattcgacgcctggctgctgaagcgaccgagtggcagcgcagtggggcccctcccccctccgggagcgccgtctccactgcaccccaacctaagccagcggacaagatgagcaaaaacaagaaaaagaaactcaagaaaaagcaaaaacgacaggcagaactgctggaaaaacgcatgcaggagatcgaggaaatggaaaaagaatctggtccaggacaaaagcgaccgaacaaacaagaggagtctgagtctcccgtcgagcgtccgctcaaggagaaccctcctaacaaaatgacacaagaaaagcttgaggagtcctccacgataggtcaggaccagaccttgatggagagagatacagaggggggcgctgccgagattaactgcaacggagtgattgaagtaatcaattatacacagaacagcaataatgaaacgcttcggcacaaggaggaccttcacaatgccaatgactgcgatgttcaaaatctaaaccaggagtcatccttcctgagttcccaaaatggggatagtagcacgagtcaagagaccgactcctgcacacccatcacatcagaagtgagcgacacgatggtttgccagtccagttctaccgttggtcagtcattttccgaacaacatatctctcaactccaagagagcataagggccgagattccctgtgaagatgaacaggagcaggaacacaacggtcctttggataataaagggaaatccaccgccggtaattttctggttaatcctctcgaaccaaagaacgcagaaaaacttaaggttaagatagcagacctcggaaacgcctgttgggtccataagcacttcacagaggacattcagactcggcaatatcggtcccttgaggtgctgatcggctccggctataacactcccgctgacatatggtccacagcatgtatggcattcgaattagccactggcgactacctgtttgaaccacactcaggagaggagtacactcgggacgaggaccatatcgcactgattattgaactactcggcaaagtaccccgcaagctcattgtcgccggaaaatacagcaaggaattcttcactaagaaaggggacctgaagcatataaccaagttgaaaccatggggcctgttcgaagtgctggtggaaaaatatgagtggtcccaagaagaagctgcagggtttactgatttcctcctcccaatgttagaattaatccctgagaagagggcaactgccgcagaatgtctgaggcacccatggttaaacagctag

SEQ ID NO: 15417 - DNA, 864 bp, Artificial Sequence
  Description of Artificial Sequence: Synthetic coding sequence
atggccgcttccttgtggatgggggacctcgaaccctacatggacgagaattttatctctcgagccttcgctaccatgggagaaaccgtcatgtctgttaagataatacggaatagacttactggcattcccgcgggttactgctttgtggagttcgcggatcttgccactgccgagaagtgtctgcacaaaattaacggaaaaccactcccaggcgctactccagctaaacgcttcaagctcaattatgccacctacggaaagcagcccgacaattcaccggaatatagtctgtttgtgggggatctgacgcctgacgtggacgacggcatgctgtatgaatttttcgttaaggtatatccttcatgtaggggaggcaaggtggtcctggatcaaaccggggtgagcaaaggctacgggttcgtgaaatttaccgacgaactggagcagaagcgagcactcaccgaatgccagggggccgtgggactgggaagcaaacctgtgcgtctgtcagttgccattcctaaggcctcacgggtcaaacccgtggagtatagtcaaatgtacagctatagctataatcagtactatcagcagtaccagaattactacgcacagtggggctacgaccagaatacgggcagctatagttactcctacccccagtacggctacacgcaaagtaccatgcaaacatacgaagaagtgggcgacgacgccttggaagatccgatgcctcagcttgacgtgaccgaggcaaataaggaattcatggagcaatctgaggagctgtatgatgcactgatggactgccactggcaacccctggatacagtgagttccgaaatcccagctatgatgtag

SEQ ID NO: 15418 - DNA, 438 bp, Artificial Sequence
  Description of Artificial Sequence: Synthetic coding sequence
atggccgaaaggaacgaagaccaccacctgcaagtactgaaggaaagtgaagtcctgctgcaagccaaacgtgccgagctggagaagctgaaatcacaggtgactagtcaacaacaggagatggccgtcctggacagacagctgggacacaagaaggaggaactgcatctcctacagggcagcatggtccaagcaaaagccgacctccaagaggcgctccggctcggggaaacggaggtgactgaaaaatgcaaccacattcgggaggtgaagtcccttctcgaggagttatcttttcagaaaggtgagctgaacgtgcagatcagcgagcgaaagactcagttgacattgatcaaacaggaaatagagaaggaggaggagaacctacaggtggtgctgcgtcagatgtcgaaacacaaaactgcgtttctccaatag

SEQ ID NO: 15419 - DNA, 3024 bp, Artificial Sequence
  Description of Artificial Sequence: Synthetic coding sequence
atgcagcatctgaagagcaagaaaagagaggagcggtggatgagggccagtaaacggcagtccgaaaaagagatggaggagcttcaccataatatcgatgacttattacaggaaaagaaatccctggaatgtgaggtggaggagcttcatcggaccgttcagaaacgccagcagcagaaagactttatcgatgggaacgtggagtcactcatgacagagcttgagatcgaaaagagcctgaaacatcacgaagacattgtcgacgagatagagtgcattgagaagacactattgaaaaggagatccgagctccgcgaggccgacaggctcctggccgaggccgaaagcgaactgtcctgcaccaaggagaaagtctgtctgctcgtggtgtggggtgtgagctccgtttggacgaagaacgcggtggaaaagttcacagacgcgaaacggtccctcttgcagaccgagtctgatgctgaggagctggagagacgcgcccaagagacggctgtgaacctggtgaaggcagaccagcagttgcggtccttgcaggctgatgctaaagatttagagcaacacaagatcaaacaggaggagattctcaaggagattaataagatagtggccgccaaggactcagatttccaatgtcttagcaagaaaaaagagaagctgacagaggaactgcagaaactccaaaaagatatcgagatggctgagaggaatgaagatcaccatctgcaggtgctgaaggagtcggaggtccttctgcaggcaaaacgtgcagaactggagaagctaaagagccaagtaaccagtcagcagcaggagatggctgttttagacagacagctcggccataaaaaggaggaactgcacctgctccagggctcaatggtccaggcgaaggctgatctgcaagaagcattgcggctaggcgaaaccgaagtgactgagaaatgtaatcacattcgagaagtcaaaagtctcctggaggaattatcctttcaaaagggtgagttaaatgttcagataagcgaacgcaagacccagttgaccctcataaagcaggagattgagaaggaggaggaaaacctgcaagtggtcctcagacagatgtctaagcacaagaccgaactcaagaatattctcgatatgttacagctcgaaaaccacgaactgcagggactgaagctgcagcacgatcagcgcgtatctgaactggaaaagacacaggtcgccgttttggaggaaaagttggagttagaaaacctacagcagatatctcagcaacagaaaggtgaaattgagtggcagaagcagcttctcgaacgggataaacgagagatcgagcgcatgacagcggagagtcgagcgctccagagttgtgtggagtgcctgtctaaagaaaaggaggatcttcaggaaaagtgcgacatctgggaaaagaagctggctcagacaaagagagtcttagctgcagctgaggaaaattccaaaatggagcagtcgaatctggagaagctcgagttgaacgtacgcaaacttcaacaggagctggaccagttgaacagggataagttgtctctgcacaatgacattagcgccatgcagcagcagcttcaagaaaagcgagaggctgtgaattctctacaggaggaactggctaacgtgcaggaccacctaaacctggctaagcaggacctacttcacactacaaagcaccaagatgtcctcctctctgagcagacgaggctacagaaggacatatctgagtgggccaaccggttcgaagactgccagaaagaggaagagactaagcagcaacaactacaggtgctacagaatgagattgaggaaaacaagctcaagttggtgcaacaggaaatgatgttccagaggctgcaaaaagaacgcgaatccgaggaaagtaaactcgagactagcaaagttaccctgaaggaacagcagcatcagctggaaaaagagttgacagatcagaagtcaaaacttgaccaggtgctcagcaaggtgctggctgctgaggagcgagtgaggaccttgcaggaggaggagcgttggtgtgaaagcctggaaaagaccctatcccagaccaagcgacagctctcggagagagaacagcagttggtagagaagagcggtgagctgctggctctgcagaaggaagcagattccatgcgcgcggatttctctttgctgcgtaaccaattcctgaccgagcggaagaaggcggaaaagcaggtcgcctccctgaaggaggctttaaagattcaaaggtcgcagcttgagaaaaacctcctcgagcagaaacaagaaaattcttgcattcagaaagagatggccacgatcgagctggtcgcacaggataaccacgaaagggctcgacggttgatgaaagagcttaaccagatgcaatacgagtataccgaactcaaaaaacaaatggctaatcaaaaggatctagaacgtcggcagatggagatatcagacgcaatgaggacattgaagtcggaagtgaaagacgagattcggacaagtcttaaaaacttgaatcagtttctacctgagctaccagccgacctggaagctatcttggagcgcaatgaaaacctagaaggcgagctagagtccttaaaagagaatcttcccttcactatgaatgaggggccctttgaagagaagctgaacttcagccaagttcatattatggacgaacattggcggggggaagccctgcgtgaaaaattacgtcatcgcgaggacaggctgaaggcccagctccggcactgtatgtcaaaacaagcagaggtgctcatcaaggggaagagacaaacagagggcacacttcactcattacggaggcaggtagacgccctgggcgagctggtcacgagcacatccgctgactctgcatctagcccaagcctcagccagctagaatcttctttgactgaggatagtcagctgggccaaaaccaggagaagaacgcgtcagcccgctag

SEQ ID NO: 15420 - DNA, 2985 bp, Artificial Sequence
  Description of Artificial Sequence: Synthetic coding sequence
atgaaagcacaaaagtctgggaaagaacaacagctcgacatcatgaataaacagtaccagcagctggaaagccgcttggatgagattctctcccgtattgctaaggagacagaggaaattaaggatctggaggagcagctgacagagggacagattgctgccaatgaggcccttaagaaagatctggaaggcgtgatttcaggcctacaagagtacctgggcaccatcaaaggtcaggcaacacaggcccagaacgagtgccgaaagctgagagacgagaaggagaccttgctgcaacgtttgacagaagtggagcaagaacgcgatcagttggagatcgtcgctatggatgcagaaaatatgagaaaagaactagccgagttggaaagcgcactccaggaacagcacgaggttaatgcctcccttcaacaaacccagggtgatctaagcgcttacgaggccgaacttgaggccaggctgaatctgcgcgacgcggaggctaatcaattgaaggaagagttagagaaagtgacgcgtctcacacagctggagcagtcagcattacaggccgaactggaaaaggagaggcaggctcttaagaatgccctaggcaaggcccaattttctgaagagaaagagcaggagaacagtgagttgcatgcaaagcttaagcacttgcaggacgataacaaccttctgaaacagcagctcaaagatttccagaatcatctgaaccatgtcgtggacgggcttgtccgtccagaggaagtggcggcacgcgtcgatgagctgcgcaggaaacttaaattgggtaccggagagatgaacatacattctcccagtgacgtcctgggaaaaagcctcgcagatctccagaaacagttctccgagatactggctcggtctaagtgggagcgcgacgaggcccaggtgagagagcgaaaattgcaagaagagatggcactacagcaagagaagctcgctactggccaggaagagttcagacaagcttgcgagcgcgccctggaggcacgcatgaactttgataagcgtcagcatgaggcccggatccaacaaatggaaaatgagatacactacctgcaagagaatctaaaatccatggaggaaatccagggactcactgatctgcaactgcaagaagctgatgaggaaaaggagaggatcctggcccaactccgagagcttgaaaagaagaagaagcttgaagacgccaaaagccaggagcaagttttcggactcgacaaggagctgaagaaactcaagaaagcagtggccacttccgataagctcgctaccgccgaactcactattgcaaaagatcaactcaagagcctgcacggaaccgtgatgaagatcaatcaggagcgggccgaggagctacaggaggcggagcggttttcgcgaaaggccgctcaggctgcccgggatctcacgcgagccgaggctgaaattgagctgctccagaatctgctgcgccagaagggtgagcaatttagattggagatggagaagactggcgtaggcaccggggccaactctcaagtgttggagattgaaaagctcaatgaaaccatggaacgccagaggactgagattgccagattgcagaatgtgctagacctaacgggaagcgataacaagggcggattcgagaacgtgctcgaagagatcgcagaactacgcagagaagtctcttatcagaacgattacattagcagtatggcagacccctttaagcgtaggggctattggtattttatgccaccgccaccctcctcgaaggtttcatcacactctagccaggccactaaggactctggcgtcggcctgaaatactctgcatcaactccggtcagaaaacccaggccaggtcagcaggatgggaaggaaggcagccagccacccccagcctcaggctattgggtatacagtcctatccgatccgggctgcacaagctgtttccgtctcgggatgccgattcgggaggagactctcaggaggaatccgagttagatgatcaggaggaacctccatttgtccctcccccaggctacatgatgtacactgttctacctgacggaagcccagtgcctcaagggatggccttgtacgcccctccccctcctcttcccaacaactcacgtcctctaacccccggcaccgtggtgtatggcccgccacctgcaggagcacccatggtttatggccctcccccacccaacttcagtattccattcatccccatgggtgtcctccactgtaatgtccccgagcatcacaatttggaaaatgaggtcagtcgtctggaagacatcatgcagcacctgaaatcaaaaaaacgagaggagaggtggatgagagcaagcaagcgccaatccgagaaagaaatggaagagttgcatcacaatattgacgatcttctacaggagaaaaagagcttagagtgcgaggtcgaggaattacacaggaccgtgcagaagagacagcagcagaaggatttcattgacggcaacgtggaatcactcatgaccgaactggaaatagaaaagagcctgaagcatcacgaggacattgtcgacgaaattgagtgcattgagaagaccctgttgaagcgccgctccgagctgagggaggctgaccggctgctggccgaggccgagagtgagctgtcatgcactaaggagaagaccaagaacgccgtggagaaatttaccgatgcaaagcgctctttgttgcagacagagagtgacgccgaggagctagagagaagagcccaggagactgcagtgaatctggtgaaggcagaccagcagttgagaagcctccaagctgacgcgaaggacctggagcagcacaagatcaaacaagaagagatcctcaaggagattaataagattgtggccgcgaaggacagcgacttccagtgcctgtctaaaaaaaaagagaagctcaccgaagagtag

SEQ ID NO: 15421 - DNA, 5322 bp, Artificial Sequence
  Description of Artificial Sequence: Synthetic coding sequence
atgaaagcccagaaatccgggaaagagcagcaactggacatcatgaacaagcagtatcagcagctcgagtctaggctggacgagattctatccagaatcgctaaggagacggaagagatcaaagatctcgaggaacaactgacggagggccagattgctgccaatgaggcactgaagaaagatctggaaggagtgatctccggcctgcaagaatatttgggcacaattaagggccaagcaacccaggctcagaatgaatgtaggaagttgagggatgagaaggagaccctgctgcagcggctgaccgaagtggagcaggaaagagatcagttggagattgtagcgatggacgctgagaacatgcgcaaggagctcgctgagcttgagtcagccctgcaggagcaacacgaagtgaatgcatcccttcaacagactcagggcgatctgtcggcatacgaagccgagttggaggcacgtcttaacctgagggacgcagaagccaaccagctgaaggaggagctagagaaggtgactcgtttgacccaattggaacagagcgcccttcaggcagaactggagaaggagaggcaagctctgaagaacgccctgggaaaagcacagttctcagaagaaaaagagcaggagaactccgagttgcacgctaagcttaaacacctccaagacgacaacaatctgctgaaacaacagctcaaggactttcagaaccatttgaaccacgttgtggacggactggtgagacctgaagaggtggccgcacgcgtcgatgaactgagacgcaagcttaagctcggcaccggagagatgaacatccattctccttctgatgtgttaggcaagagcctggcagacctccagaagcagttctcagagatcttagcgcggagcaagtgggagagagatgaagctcaggtaagggagagaaagctgcaggaggaaatggccctacagcaggagaaactcgcgacagggcaagaggaatttaggcaggcgtgtgaacgcgcccttgaagccagaatgaactttgataagagacaacatgaagcccggatccagcagatggaaaatgagatccactacctgcaggaaaacctcaagtccatggaggaaattcaggggctgaccgatttgcagttacaggaagccgacgaagagaaagagcggatcttggcccagctgcgcgagcttgaaaagaagaaaaagctggaagacgctaagagccaggagcaggtgttcggacttgataaagagttaaaaaagctcaaaaaagcagtggccacctcagacaagctggctaccgctgagttgacaatagcaaaggaccaactgaaaagcctgcacggcactgtgatgaaaatcaaccaagagcgcgccgaggaactgcaggaggccgagagattcagcagaaaggctgctcaggctgccagagatctgacccgggctgaagccgaaatagagttgctgcagaatttactacggcagaaaggtgaacagtttagactagagatggaaaagactggcgtgggcacaggggctaattcgcaggtgctggaaatcgaaaagctcaatgagacaatggagcgtcagaggactgaaatcgcccggctccaaaatgtactcgacctgactgggagtgacaataagggcggctttgagaacgtccttgaggaaattgcggaattgagacgggaggttagctaccagaacgactacatcagctctatggcagatccattcaagcgtcgggggtactggtactttatgccgcctcctccatcatcaaaggttagctcacattcttcccaagcaaccaaggactccggtgtcggattaaagtactcagcttcaaccccagttcgaaagcctcggccagggcagcaggacgggaaggaaggcagccagcctcccccggccagcggctattgggtgtattcaccaatacgatctgggctgcataagctatttcccagccgggatgccgatagcgggggcgacagccaggaggagtccgagctggacgaccaggaagagccccccttcgtgccaccccctggctacatgatgtacacagtgctgccagacggatccccagtgccacagggcatggctttgtatgctccccctccacccctacctaataattctcgtcctttgacaccaggcacggtggtttacggtccacctcctgccggagcgccaatggtttacgggcccccaccacccaatttctccattcctttcatccccatgggagttctgcactgcaacgtccctgagcatcataatctggagaatgaggtgtcacggctcgaggatattatgcagcatctgaagtctaagaagagggaagaacgttggatgagagcgtcaaaacggcaaagcgagaaggaaatggaagaattgcaccataatatcgacgatcttctgcaggagaagaaatctttggagtgcgaggttgaagaacttcatcgcacggtacaaaagcgacagcagcagaaggactttatcgacgggaacgtggagagtcttatgacagaattagagattgagaaatcgctcaagcaccacgaagatatagtggatgagatcgaatgtatcgaaaagacattattgaagcgtaggagcgagctgcgagaggccgatcgccttctggccgaggccgagtcagaattgtcatgcacaaaggaaaagacaaaaaatgcagtggagaagtttaccgatgccaagagaagcttgctgcagaccgaatcagatgccgaggaactggagcgccgtgctcaggagacagctgtaaaccttgttaaagccgaccagcagctacgcagtttgcaggcggacgctaaagatctggaacaacacaagatcaaacaggaagagatcctcaaagaaatcaataaaatcgttgccgccaaggactctgattttcagtgcctgagcaagaagaaagagaagttgaccgaagagttgcaaaaacttcaaaaagacatagagatggcagagcgtaatgaagaccatcatttacaggttctcaaggagtccgaagtgcttcttcaggccaaaagagccgaacttgaaaagctaaaatctcaagtgacaagtcaacagcaggagatggctgtgctggacaggcagcttggtcacaaaaaggaggagctgcatctgctgcagggatccatggtgcaggccaaagccgatctccaagaggcactccggttgggcgagactgaggtgactgaaaaatgcaatcacattagggaggttaaatccctgctggaagagctttccttccaaaaaggagagctaaatgtccaaattagcgaacgaaaaacacaactcactctaataaagcaggaaattgagaaagaagaagagaacctccaggttgtcttgaggcagatgtcaaagcataagactgagcttaagaacatcctcgatatgctgcagcttgagaaccatgagctccagggcttaaaattacagcatgaccagcgggtgagcgaacttgaaaaaactcaggttgccgtgttagaggagaagctggaactcgaaaacctacagcagatttcgcaacagcagaagggggagatagaatggcagaagcagctgctggaaagggacaaaagggaaattgagcggatgacagcagagtctagggccctacaatcttgtgtagaatgtctgagtaaggaaaaagaagatctgcaggaaaaatgtgatatttgggaaaaaaagctggcccagaccaaacgagtactggcagccgccgaggagaattcaaagatggagcaaagtaatctggaaaaattggagctgaacgtcaggaaactgcagcaggaactagaccagctgaacagagacaagctgtcactccacaacgatatctctgccatgcagcaacagctgcaagagaagcgggaggcagtcaatagcctccaagaagaactggctaacgttcaggaccatctgaacctcgcgaagcaagacttgctgcatactactaaacaccaagacgtccttctaagcgaacagacaaggttacagaaggacatttcagagtgggcaaatagatttgaagattgccagaaagaggaagaaaccaaacagcagcaactacaggtgttacaaaacgaaatcgaggagaacaagttaaagctggttcaacaggagatgatgtttcagaggttacagaaagaaagggaatccgaggagagcaaattggaaaccagcaaggtgacactcaaggagcagcagcatcagctggagaaggaactaactgatcagaagagcaaactcgaccaggtgttatcaaaagtgctggccgcagaggagagagtgcggaccctgcaagaggaggagcgttggtgcgagtccctcgagaagacgttgagtcagacgaaacggcagctatcagagcgagagcagcagcttgtcgaaaaatcaggggagctcttggctctacagaaagaagccgactctatgagagctgacttcagccttttgcgaaatcagttcttgactgaacgcaagaaggccgaaaagcaggtagccagtttaaaagaggccctgaagatccagcgcagccagctcgagaaaaacctgctggagcaaaaacaggaaaactcatgtatacagaaggagatggccacgatcgaactggtggcacaggataaccacgaacgcgctcgcaggctcatgaaagagctgaatcagatgcagtacgagtacaccgagctgaaaaagcagatggccaatcagaaagacctggagcgaaggcagatggaaatctcagacgccatgaggaccctgaagtctgaagtgaaagacgaaatccgcaccagccttaaaaatcttaatcagtttctacccgagttgcctgccgatcttgaagccatcctcgaacgaaatgaaaatcttgagggagagctcgagagccttaaagagaatttgcccttcacaatgaatgaaggcccgttcgaagagaagttaaatttctctcaggtccatattatggatgaacattggagaggagaggcattacgcgagaagctgaggcacagagaggacagactgaaggcacaattaaggcattgtatgtccaagcaggccgaagtcctgatcaagggtaagcggcagactgagggcacgctccatagcctccgacgccaagttgatgctctgggtgaactggtgactagcacaagtgcagatagcgcctcctcaccgtccctatcacaacttgagtcctccctgacagaagattcacagcttggccagaatcaggagaaaaacgcatccgcccggtag

SEQ ID NO: 15422 - DNA, 2487 bp, Artificial Sequence
  Description of Artificial Sequence: Synthetic coding sequence
atggaaaagcagaagcaggagatcgcaggtaagcaaaaagaaatcaaagacctccagatcgctatagattctttagattcaaaggacccgaaacattcgcacatgaaagcccagaaaagcgggaaggagcagcagttagatattatgaacaagcagtaccagcagttggaaagccggctggacgagatcctgtccaggatagctaaggaaaccgaagagattaaggacctcgaggaacagctcactgaggggcagatcgcggctaacgaggctctgaagaaagatctggagggtgtcatctccgggctacaggagtacttggggacaatcaagggtcaagctactcaggcccagaatgaatgccgtaaactacgcgacgaaaaggagactttactccagagacttaccgaagtggaacaggagcgtgatcaactcgaaatagtggcaatggacgccgagaacatgaggaaggagcttgcggagcttgagtctgccctgcaagaacagcatgaagttaacgcaagcctacagcaaacccagggcgatctgagcgcgtatgaagcagagctggaggctcggcttaacctccgcgacgcggaggcgaatcagcttaaggaggaactggaaaaagtcacacgactgacacagctggaacagtccgcgctccaggcagaactggaaaaagaacggcaggccttgaagaacgccctgggaaaggcacaatttagtgaagaaaaagagcaggaaaacagtgagttgcatgctaagttaaaacatctgcaggacgacaataacctcttaaagcagcagctgaaggacttccagaatcacctgaatcacgtggtagatgggctggttagaccagaagaagtagctgcgcgagtcgatgaactacggcggaaactgaaactgggaacaggagagatgaacattcactcaccttccgacgtgctgggcaaatccctggccgatcttcaaaagcaattctcagaaatactggcccgttcaaaatgggagcgcgacgaggcacaggtcagagaacgcaaactccaggaggaaatggctctgcagcaggaaaaattggcaaccggccaggaggagttccgacaggcctgcgagcgcgctcttgaggcacgcatgaatttcgacaaacgacagcatgaggcaaggatacagcagatggagaacgaaatacactacctgcaggagaatttgaaaagtatggaggagatccaggggctcaccgacctccagctgcaggaagccgacgaagagaaggagcgaatcctggcacaattgagggaactggagaagaagaagaagctggaagacgcaaaatcacaggagcaagtattcggtctcgacaaggagctgaagaaattgaagaaggctgtggctacatccgataagttagctaccgctgaactaacaatcgctaaggaccagctaaaaagtctgcacggaaccgtaatgaaaataaatcaggagcgcgccgaggagctgcaggaggcagaacggttctctaggaaagctgctcaggccgcacgggacttgacccgggcggaagccgagatcgagctgctgcagaacctgttgcgccaaaaaggggaacagttcaggttggagatggaaaagaccggtgtgggtacaggggccaactcacaggtgcttgaaattgaaaagctgaatgaaaccatggaaagacagagaactgaaatcgcaagactccaaaacgttctcgatctgactggatcagacaataaagggggtttcgaaaatgtacttgaagagatagctgaattgaggagggaggtcagttaccagaatgattatatcagctctatggctgatccattcaagcgccgtggatactggtactttatgcctccacctccgtcaagcaaggtgtctagccacagtagccaggctacgaaggacagcggggtgggcctgaaatattctgcctccactccagtacgcaagccgcgccccggacagcaggacggcaaagagggttctcagcccccacccgccagcggatactgggtttactcccctattcgctccggccttcacaagctgtttccgtcaagagacgcagatagcggaggggatagccaggaggagagcgaactcgacgatcaggaagagccgccttttgtccccccccctggatacatgatgtacactgttttgcccgacggcagtccagtgccacagggcatggccctttatgcccctcccccacctctgccgaacaatagccggccactcacacccggcaccgtggtttacgggcctccacccgctggtgctcccatggtctatggaccgcctccacctaatttcagtattcctttcattcctatgggtgtccttcattgtaatgttccggagcatcacaacctcgtgagcgggaagacctacaattctctttctacccttctgccctgggtgaccgataaagtgatctacttgatgtcctag

SEQ ID NO: 15423 - DNA, 6978 bp, Artificial Sequence
  Description of Artificial Sequence: Synthetic coding sequence
atgaagaaaggcagtcagcagaagatcttctccaaagcgaagattccttcctcctcacatagccccattcctagctcgatgtctaacatgcgaagcagaagtctgtcccctctcattgggtccgagacactcccgtttcactccggaggacagtggtgtgagcaggtcgagatcgcagatgagaataacatgttgctggactaccaggatcacaaaggcgccgactcccatgcaggagttcggtatataactgaggccttaatcaagaagctgacgaagcaggataacctggcgctcattaaatcccttaacctgagtttgtcgaaagacggcggcaagaaattcaaatatatagaaaatctggaaaaatgcgtaaagctcgaagttttgaatctttcctacaatctaatagggaaaattgaaaagctggacaagctgttaaagctgagagagctaaatctgtcctacaataaaatctccaagattgagggtatcgaaaatatgtgtaacctgcagaagctcaatttagccggaaacgagatcgagcacatccctgtctggctcggcaaaaagcttaaaagcctgcgcgtgctgaacctgaagggtaacaaaataagctcattgcaagatatctccaagctgaagccacttcaagatctcatttccctcatcctggtggaaaaccctgtcgtcactctcccccactacctgcaattcaccatctttcatttacggtccttggagtcactagaagggcaaccagtgaccacacaggatcggcaagaagcatttgagcggttctcattagaggaggttgagagacttgagagggacttggagaagaaaatgattgaaaccgaggagctaaagtctaagcagaccagattcctggaagaaatcaagaaccaagacaagcttaacaagagcttaaaggaggaagccatgctccagaagcaaagctgcgaagagttaaagagcgatttaaacactaagaatgagctcctgaagcagaaaaccatcgagctgacaagagcctgccagaagcaatatgagctggaacaagagctggccttctacaaaatcgatgccaagttcgaaccactgaattattaccccagtgagtacgccgaaattgacaaggcacctgatgaaagtccctacatcggcaagagccgatataagcggaacatgtttgcaacagagtcatacatcatcgactccgcccaagccgtgcagattaagaaaatggaaccggacgaacagctccgcaatgaccatatgaacctgcgggggcacacgcctctcgatactcaactcgaggataaggaaaagaaaatcagcgccgctcagaccaggctgagcgagctccacgatgagatcgagaaggccgagcagcagattctccgggctactgaggagttcaaacagctggaagaggccatacagttgaagaaaattagtgaagccggaaaggatcttctgtacaagcagctctcgggccgccttcagcttgttaacaagctccggcaagaggccctggatctggaactccaaatggagaaacagaagcaggagatagctgggaagcaaaaggagattaaagacctccagatcgcgattgactctttagatagcaaggatcccaaacactcccacatgaaggcccagaaaagtggaaaagaacagcagctggacattatgaataagcagtaccagcagctagaaagccgcctcgatgagattctgtcacgaatcgccaaggagactgaagagatcaaggatctcgaggaacaacttactgaaggtcagatcgccgcgaacgaggccctcaaaaaagaccttgaaggagtcatttcaggtttgcaagagtatctcggtacaattaaagggcaggccactcaagcccagaacgaatgcagaaagctgcgggatgaaaaagagacacttctccagagactcactgaggtggaacaggagagagaccagttggaaattgtggccatggacgctgagaacatgcgtaaggagctggcggagctcgaaagcgcactgcaggaacagcacgaagttaacgcttctctgcaacagacacagggcgaccttagcgcgtatgaggctgagctggaagctcgcttaaacctcagagacgctgaggccaatcaactcaaggaggaactggaaaaagtgacccggctgacccaactcgaacaatcagcgcttcaggcagagttagaaaaagagagacaagcccttaagaacgcactcggaaaggcgcagttttcagaagagaaggagcaggagaattcagaattacacgcaaaactcaaacatcttcaggatgataataacctgctcaaacaacaactgaaggattttcaaaaccatctcaatcacgtagtggacgggctggtccggccagaggaggttgccgcacgtgtggacgagctgcggcggaagctgaaacttgggacaggcgagatgaatatacactccccatccgacgtcttaggtaagtcactggccgatcttcagaagcagttttctgagatcttagcccgaagcaaatgggagcgagatgaggcccaggttcgggagcgcaaattgcaagaggaaatggcactccagcaggagaaactcgccacaggacaggaagaattcagacaggcatgcgagagagccctggaggcacggatgaactttgataaacggcagcacgaagctcggatacagcagatggagaacgagattcactacctccaggagaatttaaagagtatggaggaaatccagggcctgaccgacctccaactgcaggaggcagacgaggaaaaagagcgcatcctcgcacagttacgggagttagaaaaaaagaagaagcttgaggacgcgaagagtcaggagcaagtcttcggtctggacaaggagctgaagaagctgaagaaagcagtggccaccagcgataagttagctaccgctgagcttaccatcgccaaggatcaattgaaatctttgcatggtacagttatgaagattaatcaggagagggccgaagagttgcaggaagctgagcggtttagtcgtaaagccgctcaggccgcccgcgacctgacccgggctgaggcagaaatcgaactgctccagaatctgctgagacagaaaggcgaacagttcagacttgagatggagaagaccggggtgggcaccggagcaaattcacaggttcttgagatagaaaagttgaacgaaaccatggaacggcagcggaccgaaattgcccggctccagaatgtattggacctcaccggcagcgacaataagggcggattcgagaatgtgcttgaggagattgccgagttacggagagaggtctcctatcagaacgactatattagcagcatggctgatccctttaagcgcagaggatattggtacttcatgcctccaccacccagcagcaaggtttcctcccatagttctcaagcaaccaaagacagcggcgtcggactaaaatacagcgccagtacccctgtgcgcaagccgcgccccgggcagcaggacggcaaagagggctctcaaccaccgcccgcctcaggatactgggtttacagcccaatacgctccggactgcacaagctatttccctcccgagacgcggatagcggaggggacagccaggaggagtcggagcttgacgaccaggaggaacctccttttgttccccctccaggctatatgatgtatacggtgctcccggacggatctcctgtgccacagggtatggcactttacgctccccctcctcctcttcccaataattcccgcccgcttacgccaggcaccgtggtatatggcccgcctcccgccggagcccccatggtgtacggcccccctcctccaaatttcagcattccctttattccaatgggggtgctgcattgtaatgtgcccgaacatcacaacctcgagaatgaagtttccaggctcgaggatattatgcagcatctaaagtcaaagaaaagagaggagcgatggatgagggcttctaagaggcagtcagagaaggaaatggaagaactccaccataacattgacgacctgctgcaagagaaaaagtctctggagtgcgaggttgaggaactgcacagaaccgtgcaaaagcggcagcaacaaaaagattttatagatggcaacgtcgaaagccttatgactgaactagaaatcgaaaagtccctgaagcaccacgaggatattgtcgacgaaattgagtgcatcgagaaaaccctcctaaagcgccggtcagagctgagggaggcagacaggctcctggccgaggccgagagcgaattgtcatgcacaaaagagaaaacgaaaaacgctgtggagaaattcaccgacgccaagcgctccctgctccagaccgaatctgatgctgaggaattggaacggagggcacaagagaccgcagtgaatttggtaaaggcagatcagcaattgaggtcactccaagctgacgcgaaggatttagaacaacataaaatcaaacaagaggagatactgaaagagatcaataaaatagtggcggctaaagacagcgattttcaatgtttgtctaagaagaaggagaagctaacagaggagctccaaaagctgcagaaggacatcgaaatggctgagcgtaatgaagatcaccatctgcaggtgcttaaggaatcagaagtgcttctgcaggcaaaaagagccgagcttgagaagctgaaatcccaggtcacgtcccagcagcaagaaatggcagtgctggacagacagcttggacataagaaagaggagctccatctcctgcagggaagcatggtgcaagcaaaagccgacttacaagaagcacttagactcggggaaacagaagtcactgagaagtgcaatcatatacgggaggtcaagagtctgctagaagaactctctttccaaaaaggtgagttaaatgtccagatttctgagaggaagacacagctcacactgattaagcaagaaatcgagaaggaggaggagaacctgcaagttgtcctgcggcagatgtcgaaacacaaaacagagttaaaaaacattctagacatgctgcaactcgaaaaccatgaacttcaggggctgaagcttcagcacgaccagagggtttccgaacttgagaagacccaggttgccgtgttagaggaaaagttagagctcgaaaacctccagcagatatcgcagcagcagaagggtgaaatagagtggcagaaacaacttttggagagggacaaaagagaaatcgagaggatgacagctgaatcacgcgcgctccaaagttgcgttgagtgccttagcaaggaaaaagaggatctccaggaaaagtgtgacatctgggagaagaaactagctcagactaaacgcgtgctagcagcagccgaagagaacagcaagatggagcaatccaatcttgaaaaattggagctgaatgtgagaaaactgcaacaagaactggaccagttgaatcgggataaattgagcctgcacaacgacatcagtgccatgcagcaacagctccaagagaaacgagaggccgtgaactctctccaggaagagttggccaatgtgcaggatcacctgaacctggctaaacaggatctcttgcacaccacgaaacatcaggatgttctcttatcagagcaaactagactccagaaagatataagtgaatgggctaaccgctttgaagattgtcagaaggaagaagagactaagcagcaacagttacaggtccttcagaacgagatcgaggagaacaagttgaagcttgtgcagcaggagatgatgttccagcgcttgcaaaaagaacgagagtccgaggagtccaagctcgagacgagcaaggttactttaaaagagcaacaacaccaattagaaaaggaactgaccgatcaaaagtcaaaactcgatcaggtcctgtctaaagtgctggcagccgaggagcgggtgaggactctgcaggaggaggagcgttggtgtgaatcactggaaaaaacgttatcccagaccaaaaggcagctgtcagagagagagcagcagctagtggaaaagagcggtgagttgctggccctgcaaaaagaggcagattcaatgcgggccgatttctccctgctaaggaaccagttcttaaccgaaaggaaaaaggcggagaagcaggtcgcgtccctgaaggaggcactaaaaattcagcgctctcagctggaaaagaatctgctggagcagaaacaggaaaactcttgcattcaaaaggaaatggctacgattgaactggtggcacaggataatcatgagagggcacgcagattaatgaaggagctcaatcagatgcagtatgaatataccgaattaaaaaaacaaatggcaaatcaaaaggaccttgaaagacgacagatggaaatcagcgacgccatgcgtaccttgaagagcgaggtcaaagatgaaattcggacatctcttaagaacctgaatcagtttcttcctgagctccctgccgatctcgaggccatcctcgagagaaatgagaacttagaaggcgaacttgaatccttgaaagaaaatctgccgtttaccatgaatgagggaccctttgaggagaaacttaatttctcacaggtgcatatcatggacgaacattggcgtggcgaggcattacgagaaaaacttcggcaccgcgaggaccgcctgaaggctcaattacggcactgtatgtcgaagcaggctgaagtgcttatcaaagggaaaaggcagaccgagggcaccttgcatagcctgcggcggcaggtagatgcactgggagagctggtcactagcacatcagcggattcggcatccagtccctccttaagtcaattggagtcatctcttaccgaggacagccagctggggcaaaatcaggaaaaaaatgcatctgcccgctag

SEQ ID NO: 15424 - DNA, 1359 bp, Artificial Sequence
  Description of Artificial Sequence: Synthetic coding sequence
atgaagaaaggatcccagcagaagatcttcagtaaagccaagatccccagttcgtcccacagcccaatcccctctagcatgtctaatatgcgaagccggtctctgtccccactgatagggagcgagaccctgccctttcacagtggcggccagtggtgcgagcaggttgagatcgccgatgaaaacaatatgcttcttgattaccaggatcacaagggggccgatagccatgccggagtgagatacattactgaagcgctcatcaagaagctgacaaagcaggacaacctcgccctgatcaaatccctgaacctctcacttagtaaagatgggggaaagaaatttaaatatatcgaaaacttggagaaatgcgtaaagctcgaagttctcaatctgtcttacaacctgatcggcaagatagagaagctggataaactgctgaagctgcgtgaactcaacctgagttacaataaaatatctaagatcgaaggaatcgagaacatgtgcaatcttcagaaactgaatctggctggcaacgagatcgagcacattccagtgtggctgggcaagaagctgaaatccctaagggtactcaatctcaagggcaacaaaatctcttccctgcaggacatctctaagctgaagccactacaggatctaatcagcctcattctggtggagaacccggttgtcacactcccccactatctgcagttcacgatcttccatttaaggtccctcgagtcactcgagggtcagccagtgaccacacaagacagacaagaggcattcgagaggttctccctggaagaggtcgagaggctggagcgggacctggagaagaagatgattgaaacggaggagctcaaatcaaaacagactaggtttctggaggaaattaaaaaccaggacaaactgaataaaagtttgaaggaggaagccatgctccaaaagcagtcatgcgaagaattaaaatcagacctcaacacgaaaaacgagctgttaaaacagaaaacaattgagttgacccgggcctgtcaaaagcaatatgaattagaacaggagctcgcattttacaaaatcgatgctaaatttgagcctctgaactattatcctagcgagtacgccgagatagataaagctcctgacgagagcccctacatcggcaaatcgcgatataaacgcaatatgtttgccacggaatcatacatcatcgacagcgcccaagctgtgcagatcaaaaagatggagccagacgaacagctgcgcaatgaccatatgaacttgcgcggacacactccgctcgacactcagctagaggaccataagctggattatcagaactgcatgatgaagtag

SEQ ID NO: 15425 - DNA, 1053 bp, Artificial Sequence
  Description of Artificial Sequence: Synthetic coding sequence
atgtgctgtgatagcgacttcgtcgcaagaaataaatctcaggactccgggatcgctgagatggaagaactgcctgtgccccacaacatcaagatttcaaacatcacctgcgacagttttaagatttcttgggaaatggacagtaagagcaaggaccgtattacacattacttcatcgacttgaataagaaagagaacaaaaattcaaacaaattcaagcacaaggatgtccccaccaaactggtcgcgaaggccgttccactacctatgacagtgcgggggcattggttcctgagtcctaggacagagtataccgtggcagtgcagaccgccagtaaacaggtagacggggactacgtggtctccgagtggtccgaaatcatcgagttctgcaccgctgattacagtaaagttcacctgacgcaattattggagaaagccgaggtgatcgccgggcgaatgttgaagttcagcgtgttttatcggaatcagcataaagaatactttgattacgttcgagagcatcacgggaacgctatgcagccctcagttaaagacaactcagggagtcacggatctcctatctccggaaagcttgaaggcatctttttttcatgcagtactgagttcaatacagggaagcccccccaggacagcccctatggcagatacaggttcgagatcgcagctgaaaagctgtttaatcctaatacgaatctatattttggcgatttctactgtatgtacaccgcttaccattacgttatcctcgttatcgctcccgtaggcagtcccggtgacgaattctgcaaacagcgcctgcctcagctgaactccaaggacaataagttcttgacatgcaccgaggaggatggcgttctggtctaccatcacgcacaggacgttatcctcgaggtgatttacacagatccagtagacctgagcgtcgggactgtggctgaaattacaggacaccaactcatgtccctctcgactgccaacgctaaaaaagatccgtcctgcaaaacttgtaatatcagcgtgggaagatag

SEQ ID NO: 15426 - DNA, 1131 bp, Artificial Sequence
  Description of Artificial Sequence: Synthetic coding sequence
atggaggtcccccgcctggaccacgcactgaatagcccgacatcaccctgcgaggaggttattaaaaatcttagcctggaggcaatccaactgtgtgatcgcgatggcaacaaaagccaggacagcggcattgccgagatggaagaactgcccgtgcctcacaacattaaaattagcaacatcacctgcgattcattcaaaataagttgggaaatggattctaaaagcaaggaccgcatcacacattatttcattgatctgaacaagaaagagaacaagaactccaacaagtttaaacataaagacgtgccaactaaactggtcgccaaggccgtccccctgcccatgaccgtgagagggcactggttcttgtcacctagaaccgagtataccgtggccgtccagacagctagtaagcaggtggacggcgattatgtggtgtccgagtggagtgagataatagagttttgtacagctgactactcaaaggtgcatcttacacagcttctcgagaaagccgaggttatcgctggcagaatgttaaaattttctgtcttttatagaaatcaacacaaagaatattttgactacgtgagagaacaccatgggaacgccatgcagccaagtgtgaaagataacagcgggtcccacgggtctccgatctccgggaagctggaaggcattttcttttcctgctcgaccgaatttaacacaggcaaaccaccgcaggatagtccctatgggaggtaccggttcgaaatcgcggccgagaaactgttcaaccctaacaccaacctgtacttcggtgacttctattgcatgtataccgcgtatcattatgtgatcctggttatcgccccagttggaagcccgggcgacgagttttgtaaacagcgcctcccacagctgaatagtaaagataacaagtttctaacctgtactgaggaggacggggttctggtgtaccatcatgcacaggatgttatcctcgaggtgatttatactgatccagtggacctctcggtcgggacagttgctgagatcaccggtcatcaattaatgagtctgtctaccgctaacgcaaaaaaggacccctcctgcaagacttgtaacatttctgtcggtaggtag

SEQ ID NO: 15427 - DNA, 1263 bp, Artificial Sequence
  Description of Artificial Sequence: Synthetic coding sequence
atgctcaaggccgtcatcttgattgggggacctcagaagggcacacgcttcaggccactcagtttcgaagtgcctaaacccctgttcccagttgcgggggtgccgatgattcaacatcacattgaggcctgtgcccaggtgccaggaatgcaagaaattctcctgattggcttttaccaacctgatgagcctttaacgcagtttcttgaggccgcccagcaagagtttaatcttccagttagatatttacaagagttcgctcccctcggcactggaggagggctctatcactttagagaccagatactggcaggaagtccagaggcattctttgtgctgaacgccgatgtgtgctctgacttcccattgtccgctatgttggaggcacaccgccggcagcgtcatcctttcctgctgttgggtactacggcaaaccgaacccaaagtcttaattatggatgcatcgttgagaacccacagacacacgaggtcctgcattacgtggaaaaaccctccactttcataagcgacattatcaactgcggaatttacctatttagtcccgaggccctgaagccactacgcgacgtttttcagcgcaatcagcaagacggtcaattggaagattcacccgggctgtggccaggtgctggcaccatccgactcgagcaggacgtattcagtgccttggcaggccagggacaaatctacgttcacctcacggatggtatttggtcacaaattaaatccgcgggtagcgctctatatgcttcacgcctgtacctgtctcggtaccaggatactcaccctgagagattggccaaacacacacccggcgggccatggattagagggaacgtttacatccatcctaccgccaaagtggcgccaagcgctgtcctcggaccaaacgtctccataggtaaaggtgtgaccgtgggggaaggggtgaggttacgagagagcattgtcctgcacggggctacactgcaggagcatacctgtgttctacattctatcgtcggttgggggtcaacggtggggaggtgggcgagagttgagggcaccccctccgatcctaaccctaacgatccaagggcacgtatggacagcgagagcctcttcaaggacggaaaattgctgccagcaattaccattttgggttgccgcgtcagaattcctgctgaggtgctgatcctgaacagcattgtactgccccataaggaactctctcgtagtttcaccaaccagatcatactgtag

SEQ ID NO: 15428 - DNA, 411 bp, Artificial Sequence
  Description of Artificial Sequence: Synthetic coding sequence
gatcccctcagctggctgtccgggccatggggccaagtacccgccggtatttgtcctcctcggcatagaggctggtaccacttcagagatcagattctcgccggcagccctgaggcatttttcgtgttaaacgctgatgtgtgctcggacttccccttgagcgcaatgttagaagcacatcgccggcaacgacaccctttccttctcctcggcacaaccgcaaaccgaacgcagtccctgaactacggatgcattgtggaaaacccacagacgcatgaggtgctgcattatgttgaaaagccgtcaacgtttatatccgacataatcaactgcggaatatatcttttttcaccggaggccctcaagccactacgagacgtgtttcaaagaaaccaacaggacggacagtag

SEQ ID NO: 15429 - DNA, 1365 bp, Artificial Sequence
  Description of Artificial Sequence: Synthetic coding sequence
atggaaagaaaggacttcgaaacgtggctggataatattagtgtcaccttcctgtctctgactgacttacagaaaaatgaaaccctcgatcatctgatatccctgagtggcgctgtgcagctgcggcacttatcgaacaatctagagacattgcttaaacgggactttctgaagcttcttccactcgagctttctttttatctactcaagtggctggatccccaaacactgctgacatgctgcctggtgtctaagcagtggaataaagtgatttccgcatgcacagaagtgtggcaaacggcgtgcaaaaatttgggctggcagattgatgattcagtacaggatgccctgcattggaaaaaggtctacttgaaagcgattctcaggatgaagcaactggaagaccacgaggccttcgaaacctcctcacttatcggccattccgcacgggtatatgccctttactacaaggatggcctgttgtgcactggctcagacgatctgagcgcgaaactctgggatgtaagcaccggccagtgcgtgtacggtattcagacacacacctgcgcagcggtcaaattcgatgaacagaagctggtaactgggagtttcgataatacagtggcttgttgggagtggtccagcggcgcaaggacacagcatttcagaggacacactggggcggtgttctccgtcgactacaacgatgaactggatatcctagtttcaggaagtgccgatttcactgtgaaggtctgggccttgtcagctggcacatgtctgaatactcttaccgggcataccgaatgggttactaaagtagtgctccagaagtgtaaagtgaaaagtctccttcactcaccgggcgactatattctgctgtctgctgataaatacgaaatcaagatttggcctatcggtagagaaattaattgcaagtgtttgaaaaccctgagtgtgtccgaagacagatccatctgcctccagcccagactccacttcgatggaaagtacatcgtctgttcttctgcgctgggtctgtaccagtgggacttcgcctcttacgacatcctccgggtgatcaaaaccccggaaattgcaaacttggcgcttttgggctttggagatatttttgccctgctttttgataaccggtacctttacatcatggatctgaggacagagtctttaatcagccggtggcccctcccagaatatagaaagagtaagagggggagcagcttcctcgctggcgaggccagctggctaaacggcctcgatggtcataacgacactggcttagtgtttgctacttcaatgccggatcacagcatccacctggtgctatggaaggagcacggatag

SEQ ID NO: 15430 - DNA, 372 bp, Artificial Sequence
  Description of Artificial Sequence: Synthetic coding sequence
atggaggcagctgagacagaagcagaggccgccgctctggaagtcctcgcggaagtcgctggtatcctggagcccgtcggcctccaagaagaggccgaactccccgctaaaattctcgtggagttcgtggtagatagccagaagaaggacaaactgctttgctctcagctgcaggtcgctgactttctccaaaacattctggcacaagagcggccatggtgcgtccttcagggctgttggagtaccacatgttggaggtgcaaatttgctatgacctcatggcgcaccgctgcttggcgcaaaatccttgagaaggctagcgattttcctcatcttccaaccataatcacaggaaagacagtgaactcttag

SEQ ID NO: 15431 - DNA, 834 bp, Artificial Sequence
  Description of Artificial Sequence: Synthetic coding sequence
atggaggccgccgaaactgaggccgaggctgccgccctcgaagtgttagcagaggtcgccggtattctcgaacctgtgggactgcaggaagaggccgagcttcctgctaaaattctcgtggagttcgttgtggatagccaaaagaaggataaactcttgtgctcccaattacaagtcgcggacttcctgcagaatattctggcacaggaagatactgctaagggtctggaccctctagcgtccgaggacacttctcggcagaaggcaattgcggctaaggaacaatggaaggagctgaaggctacttaccgggaacacgtggaagccatcaaaattggcctgacaaaagcattgacccagatggaggaagctcagcggaagcgcacgcagcttagagaggctttcgaacagcttcaggcaaaaaagcagatggcgatggaaaagagacgagctgtgcagaaccagtggcaactgcagcaggagaagcatctgcaacacctcgcagaagtgtctgctgaggtgcgtgagcgcaagacaggaacccagcaggaactggacagggttttccaaaaattaggcaatctcaagcagcaggccgaacaggagcgagacaaactccagcgctatcagaccttcttgcagctgctgtacactctgcagggaaagctgctcttccctgaggccgaggccgaggcagagaatctgccagacgacaaaccacagcagccaacccgaccgcaggagcagtctacaggagacacaatgggccgggatcccggtgtgtcgtttaaggccgtaggattacaaccagccggcgatgtgaacctgccctag

SEQ ID NO: 15432 - DNA, 1713 bp, Artificial Sequence
  Description of Artificial Sequence: Synthetic coding sequence
atgtcttcaataggcgaggggatcgacttctctcaggagcgacagaaaatcagcgggcttcgcacattagagcagtccgtgggggagtggttggagtcaattggattgcagcaatatgagtccaaactgctgcttaacggtttcgacgatgtgcattttctggggtccaacgtcatggaggaacaggacctacgggacattggtataagcgatccacagcacagacgaaagttgctacaggctgcaagaagcctgcccaaggtaaaagccctaggttatgatggaaacagccctccatctgtgcccagctggttagactctcttggcctacaagattatgtgcacagtttcctgagctcaggttacagttctattgatactgtgaagaacctttgggagctcgagctggtaaacgtgttgaaagtccaactactgggacataggaaacgtattatcgccagcctagcggaccggccctacgaagagcctcctcagaaaccaccccgttttagtcaactgcgctgccaggacctgctgtcacaaaccagctccccgctctcccagaacgattcttgcaccggtagatcagcagaccttctcttgccgcctggtgacaccggacggcggcgacatgacagcctacatgaccccgcggcgccaagccgagccgaaaggtttagaattcaggaggaacaccgggaggccaaactgaccctgcgaccaccctccctggctgcaccatacgcacccgttcaatcttggcagcatcagccagaaaagctcatatttgagtcctgtggctacgaggcaaattacctgggttctatgctcattaaggacctgagaggaactgagtctactcaggatgcgtgcgccaagatgcgaaagtccactgagcacatgaagaagatccctaccattattcttagtattacctataagggtgtaaagtttattgacgcgagcaacaaaaacgtaattgcagagcacgagatacgtaatatctcttgcgctgcacaggatcccgaagatttgtgtacttttgcatatataacgaaagatcttcagactagccatcactactgccatgtcttcagtaccgtggatgtgaacctgacctacgaaattatccttaccctgggacaggcttttgaagtcgcctatcagttggccttgcaggcccagaagagccgcgccacaggggcgtctgccgccgagatgattgaaactaaatcatctaagccagtcccaaagcctcgagttggggtgcgcaagagtgccgtccccctacccccagattcaaggtgctgctactgccatacttgtaccacgcacaggcccagctatctgcctctcccatccgtgtcaccaggagtcaagcttgagcctcccgatatggaccaggacgcccagtcacacgcaagcgtaagctgggtggtggatcccaaaccagattccaaaagaagcctttccaccaatcacacacgcctggaacttgtatgctgctctcaaccggaaaatgagctggtgtccacaatctctggagataagcccaagtccttcctcgagccattgctgttcgtgatgcccactaccgcctacaaccacaattgtcctgaatggaggagtcaaaaggacggaggatgcagcacgtctgagtgtcctcatcatttatgtctggagaaaccaggcgtcctgtccctggagatgtag

SEQ ID NO: 15433 - DNA, 1785 bp, Artificial Sequence
  Description of Artificial Sequence: Synthetic coding sequence
atggagagcaatcacaagtccggcgacggactgtccggcacacaaaaggaggccgcactaagggctctcgtgcagcgtaccggatactccctggtgcaggagaacggacagcgaaaatacggtggccccccccccggctgggatgcggcccctcctgagcgcggctgtgaaatattcattggaaagctccctcgcgacctcttcgaggacgagctgatccccctctgcgaaaaaatcgggaaaatctatgaaatgaggatgatgatggattttaacggaaacaatcgaggatacgcattcgtgacattttctaataaggtggaggcaaagaatgccattaaacagctcaacaactatgagatccgaaatggacgcctcctcggagtgtgtgcgtccgtagacaactgcagactttttgtgggcggcatcccaaagacgaagaagagggaggagattctgtccgaaatgaagaaagtcaccgaaggcgtagtggatgtgattgtctatcctagcgcggcagacaaaaccaaaaatcgcggattcgctttcgtcgaatacgagagccaccgggccgccgcgatggctcggaggaagctcctgcccggacggatccagctgtggggccatggaatcgctgtcgattgggccgaaccagaggtagaggtggatgaggacacaatgagctcagtcaagatcctgtacgtgcggaaccttatgttgagtactagtgaggaaatgatcgagaaggaattcaataatatcaagcctggggccgtggaaagagtgaaaaagatccgagactacgctttcgtgcacttctctaatcgggaagatgcggtggaggcaatgaaggcactgaatggtaaagtgttggacggcagtccaatcgaggtcacactagctaagccagttgacaaggatagttatgtacggtacacacgaggtacaggcggccgcggtactatgttacaaggcgaatacacctactctctagggcaggtgtacgaccccactaccacgtacctaggcgcgccagtcttttatgccccccagacctacgccgctatcccatccctgcacttccccgcgactaagggtcacctgtccaatcgtgccatcattagagcaccaagcgtgcgggagatctacatgaacgtgcccgtcggcgccgccggcgtccgcggacttgggggtagaggctacctggcgtatacagggctggggagggggtatcaagtgaaaggcgataaacgtgaagacaaactttacgacattctgcctggcatggagttgaccccaatgaaccccgtgactctgaaacctcagggaattaagctggccccacagattctggaggagatttgtcaaaagaataactggggccagccggtctaccagctgcactctgcaataggccaagatcagaggcagttatttttatacaagattaccataccagcgctggcttctcagaatcctgctatccatccatttaccccaccaaagttgtcagcttttgttgatgaggctaaaacttacgctgcagagtatacactgcagaccctcggaatccccactgacggaggcgatgggactatggccaccgcagccgctgccgccactgccttcccgggatacgccgtccccaacgcaactgctcccgtttccgccgcccagctaaagcaggccgtgaccctgggacaagatttggccgcatacacaacttatgaagtgtaccccacctttgcagtgactgcccggggggatggctatggtactttctag

SEQ ID NO: 15434 - DNA, 1785 bp, Artificial Sequence
  Description of Artificial Sequence: Synthetic coding sequence
atggaagcagtctgcttgggcacatgtccagaacccgaggccagcatgagtaccgctattccaggactgaaaaagggcaacaatgccctacagtctattatccttcagactctcttagaaaaagagaacggacaaagaaaatacgggggacctcctccaggatgggacgcagcacctccagaaaggggatgtgagatctttattggcaagctgccccgcgatctgtttgaggatgagttaataccgctgtgtgaaaagatcggcaaaatctatgagatgcgcatgatgatggactttaacggaaataaccgcggttacgcctttgtgacattctctaacaaagtggaggccaagaatgccattaagcagctaaataattacgaaatccggaacgggcgactgctgggtgtatgtgcttctgtggataactgccggctctttgtgggaggaatcccaaagacaaagaagagggaagaaattttgagcgaaatgaagaaggtgacagagggtgtggtggacgtgatcgtgtacccctctgccgcagacaagaccaaaaaccgaggcttcgcttttgtggaatacgaaagtcatcgagccgcagctatggccagacgcaagcttctcccgggcagaattcagttatggggtcacggcatagccgtggactgggcagagccagaggtcgaggtggatgaagacactatgagttccgtcaagatcttgtatgttcgtaacctgatgctatccactagtgaggagatgatcgagaaggaattcaataacattaaacccggtgctgtcgagagagtgaaaaagatccgggattacgctttcgtgcacttctcaaaccgggaagacgctgttgaggcgatgaaagctctgaacggtaaggttttagatggttctcccatcgaggttaccctggctaagcccgtggataaggactcatatgtgagatatacccgtggcacaggtggccgcggtacgatgttgcagggggagtacacctactcattgggccaggtttacgatcccacgaccacctacctcggagctccagtcttctacgcaccccagacctacgcggctattccatccttacactttcccgctacaaagggacacctgtccaaccgggccataatccgggccccgagtgtgcgtggcgctgccggcgtgcggggtctggggggacgcggatatctggcgtacaccggacttggccgcggctaccaggtaaaaggcgataagcgcgaagataaattatacgacattctgcccggaatggagcttaccccgatgaatcccgtcacgctaaagccccaaggcatcaaattggctcctcaaattctggaggagatttgtcaaaaaaataattggggccagcctgtgtaccaactgcacagtgccatcggtcaagatcagcgccagcttttcctgtataaaatcacgattccagctctcgcatcccagaaccctgcaatccatccattcacacccccgaagttaagtgcattcgtggacgaggcaaaaacatacgcggctgagtacacattacaaactctcggcattccaacagacggcggcgacggcaccatggccaccgccgctgccgctgccaccgcctttcccggctatgcagttcccaacgcaactgcgccagtgtccgcagcccagctaaaacaggcggtgacactgggacaggatctagctgcatacactacctacgaggtttaccccacattcgccgttactgcaagaggagatggttatggcaccttttag

SEQ ID NO: 15435 - DNA, 1761 bp, Artificial Sequence
  Description of Artificial Sequence: Synthetic coding sequence
atggaaagtaaccataagtctggggacgggttgagcggcactcagaaggaggccgcgctgagagcgttggtgcagcggacaggatattcgctggtccaggaaaatggccagcggaagtacgggggacccccgcccggctgggacgcggcacccccggaacggggttgtgagatcttcatcgggaaactaccgagagatctgttcgaagacgagctgatccctctttgcgagaagataggcaaaatttacgaaatgcgaatgatgatggattttaatggcaacaacagggggtatgccttcgtcaccttctccaataaggtcgaggcaaagaacgccattaagcagctcaataactacgagattaggaatggtaggctacttggggtctgcgcaagcgtggacaactgtagactgttcgttggcggcatacccaagacaaagaaaagagaagaaattctgtccgagatgaaaaaagtaaccgagggagtggtggacgtgatcgtatatccctccgcagcagacaaaacaaagaataggggtttcgcatttgtcgagtacgaaagccaccgtgccgccgccatggccagaaggaagctcttgccagggcggattcagctgtggggccacggcattgcggtagattgggccgaacccgaagtcgaggtggatgaggataccatgtcctctgtgaagatcctctatgtccgaaaccttatgctcagcacttccgaggaaatgattgaaaaggaattcaacaacatcaagccaggcgctgtggaaagggtcaaaaagatccgagattacgctttcgtccacttctccaaccgcgaggatgcagtcgaggctatgaaagcactaaacggtaaggtgctggacggttcacccatcgaggtgactctcgccaagccagtagacaaagactcatatgtgcgatatacaaggggcacaggcggccgtgggactatgttgcagggggaatatacgtacagtctgggtcaggtgtatgatcctactactacctacttgggtgcacctgtgttttacgctccacagacatacgccgctatcccgtcattgcacttccccgctaccaagggacacctctcaaacagggccatcatccgggccccttcggtgcgcggagctgccggagtgcgcgggttaggcggccgcggatatctggcttacacagggctgggcagagggtaccaggtcaaaggagacaaacgggaagataaactgtatgatattcttcccggaatggagcttacaccaatgaatcccgttacacttaagccgcaaggaataaagttggccccccagatcctggaagaaatctgccagaaaaataactggggtcagccagtgtatcagttgcattcggccattggtcaggaccaacggcagctctttctatataaaattacaatccctgcacttgctagtcaaaatcctgcaatacatccttttacgccaccaaagctgtcggcgtttgtggacgaggctaagacttacgcagctgagtacacgctgcagaccctaggaatccctaccgatggtggcgatggcaccatggccactgctgcagcagctgcaacagcctttcctggatacgccgtgccaaatgctactgcccctgtcagtgccgcacagctgaagcaggccgtaacactggggcaggacctggctgcctatacaacatacgaggtctacccaaccttcgccgtcactgcacgtggagacggctacggcacattctag

SEQ ID NO: 15436 - DNA, 1761 bp, Artificial Sequence
  Description of Artificial Sequence: Synthetic coding sequence
atggagtcaaaccacaaaagcggagatggcctgagcggtactcagaaagaggccgccctgagggccttagtgcagcgcacaggctattcactggtccaagagaatggacagcgcaagtacggcggacccccccccggatgggatgcggcaccacccgaacgcggctgtgaaatttttatcggaaaactccctcgggaccttttcgaggacgagttaattcccctgtgtgagaagattgggaagatttacgaaatgcggatgatgatggacttcaacggaaacaatcgagggtacgcattcgttactttctctaacaaggtggaggccaaaaatgcaattaaacagcttaacaattacgaaatccgaaatgggcgcctactaggcgtttgcgccagcgtggacaactgccgcctctttgtcggggggattcctaagacaaagaaacgcgaagagatcctcagcgagatgaagaaagtaaccgaaggcgtggtggacgttatcgtctaccctagcgcagctgataagactaaaaacagggggtttgcatttgttgagtacgagtcacatcgcgccgctgcgatggccagacgcaaactgctgcccggccgaatccagctctgggggcatgggatcgcagttgattgggcagaacctgaggtggaggtagatgaggataccatgtcaagtgtgaaaatcctgtacgtgcgtaacctcatgctgtccacctctgaagaaatgattgagaaggaattcaacaacattaagcccggagcggtagagagagttaaaaagatcagagactatgcctttgtgcacttttctaatagggaagatgccgtcgaggcaatgaaggccctcaatggcaaggttctggatgggtctccaatcgaagtgacactggctaagcccgtcgataaggactcatacgtccggtacacgcgggggacgggtggtagagggactatgctgcaaggcgagtatacttacagccttggacaggtgtatgatcccacaacaacctacttgggggcccctgtgttctacgcacctcagacctatgcggccattcctagcctacattttcccgccacgaaaggacatttgtcaaaccgggccattatcagggccccatctgtgagaggcgctgcaggagtgcgcggtctaggtgggcgcgggtatctggcttacactggtctcgggaggggatatcaggtcaagggtgacaagcgggaggacaaactttacgacattctcccgggcatggaactcactcctatgaatcctgtgacactaaagccccaagggatcaaactcgcacctcagatactggaagagatatgccagaaaaacaattgggggcagccggtttaccagttacattcggcgatcggacaagatcaaaggcagctgttcctgtataagataaccatccctgccctggcaagccagaatccagcgatacacccgttcacaccacctaaactgagtgcattcgtggatgaagcaaagacgtatgctgccgagtataccctccaaaccctggggattcctacagacggaggcgatggtaccatggccactgcggccgcagctgcgactgccttccctggttacgcggtgcccaacgccaccgcacctgtatccgcagctcaactgaaacaggccgtcaccttgggacaggatttggctgcctatacgacttacgaagtgtaccctaccttcgccgtcaccgcaaggggtgacgggtatggtaccttctag

SEQ ID NO: 15437 - DNA, 1542 bp, Artificial Sequence
  Description of Artificial Sequence: Synthetic coding sequence
atgcaaagaacatttgcttggctgctggatcgggtgcaacacctgggggcgcccgttaccctacgggcatcctacctcgagatatacaatgagcaggtgcgcgatctgctgtctcttgggtctccccgtccactcccggttagatggaacaagacacgcggtttctacgtcgagcaactccgtgtggtggaatttggcagtctggaagccttaatggagttactccagacaggcctatccaggcggcggaattccgcccacacactgaatcaggcttcgagccggagccatgcactactaacgctatatattagccgacagaccgctcagcaaatgccctccgtggatccgggcgagcctcccgtcggggggaagctctgtttcgtggatttggcaggatccgagaaagtggctgccaccggctctaggggcgagttaatgcttgaggccaattcaattaatcgcagtttgttggcacttggtcactgtatcagcctactcctggatccacagcggaaacagtcccacattcctttcagagatagtaagctgactaagttgctggcggactcactcggtggcagaggtgttactctgatggtggcgtgcgtgagtcccagcgcccagtgcctccccgaaacactctccacccttaggtatgcatcccgggctcagcgcgtgactactcgcccacaagccccaaaatcccccgtagcaaagcaaccccaaagactggagactgagatgttacagctgcaggaagagaatcggcgattacagtttcagctcgaccagatggattgcaaggcatctggactgtccggagctagagttgcttgggcacagcgcaatctttatggcatgctgcaggaattcatgctcgaaaatgagcggttgcgcaaggagaagtcccaactgcagaacagccgagatctggcccagaacgagcagcgaattctggcccagcaggtgcatgccctagagaggcgccttttatcagcatgctaccatcatcagcagggccctggcttgactcccccctgcccttgcctaatggcaccagcacctccatgccacgcattgccaccactctactcttgcccttgctgtcacatttgtcctctctgtcgagtaccgctggcccactgggcttgcttgccaggagagcatcacttgccccaggtgctcgaccctgaggcctcagggggaaggccgcccagtgcgagacccccgccttgggcccccccatgtagtcctgggtcagccaagtgcccccgggaacggtctcacagcgactggacgcaaacgagagttttagcagagatgcttaccgaggaagaggtggtcccaagtgccccacctcttccggtgcgacctcccaaaacaagccccggactcagggggggcgctggcgtgcccaatctggctcagcgtctcgaggcactcagggaccagatcggatcgagtctacggcgggggcggagccaacccccctgtagcgagggtgcgaggagtccggggcaggtgctgcctcctcactag

SEQ ID NO: 15438 - DNA, 786 bp, Artificial Sequence
  Description of Artificial Sequence: Synthetic coding sequence
atggtgaagggcgagaagggaccgaaaggtaaaaagatcaccctcaaggtggcccggaattgcatcaaaatcactttcgatggaaagaaacggctggacttatcgaagatggggataacaacttttccaaagtgtattctgcgtctctctgatatggacgagctggacctgagccggaacctgatccgtaagattcccgatagcatttccaaatttcagaacttacgctggctggacctgcactccaattatattgataagctgccagagtctattggacagatgacctccttgctgtacctgaacgtgtccaacaatagactcaccagcaacggcctgccagttgagcttaagcagctaaagaatattagggcagtcaacctgggactgaatcatttggactcggttccgactacgctgggtgctctgaaagagctccacgaagtaggcctccacgacaacctgctgaataatatccccgttagcatctctaagctgcctaaattaaagaagctaaacatcaagagaaatccctttcctaagccaggagaatctgagatcttcattgactcaattcggcggctcgaaaacttgtacgtggtggaggagaaagacctttgcgcagcatgtttgcgcaagtgccagaatgcacgcgataacttgaaccgcatcaagaacatggctactacgactccaaggaagacaatcttccctaatctcatctcccctaattccatggctaaggacagctgggaagattggcgcatccgtctgacctccagttag

SEQ ID NO: 15439 - DNA, 1770 bp, Artificial Sequence
  Description of Artificial Sequence: Synthetic coding sequence
atggcgagtagccaacgcgacatggaggattgggtgcaggccattaggcgtgtaatctgggctcccttgggcggcggcaccgctcgccgaagccatgctcaccccctggaacccctgccacctggcatctttggccagagactcgaggaaacagtgcatcatgagaggaaatatggtccaagactggctcctctccttgtcgagcagtgcgtcgatttcattcgtgagcgagggttgacagaggaagggctgttccgcatgccagggcaagcaaatttggtcagggaccttcaagattccttcgactgcggtgagaaacctctgtttgacagcaccaccgatgtgcacaccgttgcttcgctgctgaaactttatctaagagagttgccagaaccggtcgtccccttcgcccggtatgaagatttcctgagttgcgcacaactgctgacaaaggacgagggcgaaggtaccctagagcttgccaagcaggtgagcaacttgccccaggctaattataatcttctacgctacatctgtaaatttctggatgaagtccaggcctactccaacgtaaataaaatgagtgtccagaacctcgccaccgtgtttgggcccaacatcctgcgaccccaggttgaggacccagttacaatcatggagggcacgtctcttgtgcagcacctaatgacagtgctgatcagaaagcactcacagctattcacagctccagtgccggaggggccaaccagtccacgtggcggtctccagtgcgccgtaggctggggctccgaggaggtaactcgcgacagccagggagagccaggaggccctgggctacctgcccaccggacatccagtctggatggagcagctgtcgccgtgttatcccgcaccgcccccaccgggccggggtcacgctgcagtcccggaaagaaggttcagacacttccgagttggaaaagctcttttaggcagcccaggtccctgtctggctccccaaaaggcggcggcagctcccttgaggtcccgatcatcagttcagggggcaattggttgatgaacggactcagctccctgcggggtcaccggcgtgccagctcaggggaccgcctgaaggactctgggtctgtgcagagactcagcacttatgacaacgtgcccgccccagggttagttcctggcattcctagtgtcgcctctatggcttggtcaggagcttcatccagtgaatcttccgtgggagggtctctgtcatcttgcacggcttgtcgggcctctgatagttcagctcgaagctctttgcatacagattgggcgctggaaccctccccactgccctcatcctccgaggatcccaagtcgctcgatttagatcatagtatggacgaagcaggtgcaggggcttccaactcggagccatcagaacccgattcaccaacaagggaacacgcccgcagaagcgaggcactccaaggcctggtgactgaactaagagccgaattatgccggcagcgcacagaatatgagaggagtgtgaaacggattgaagagggcagcgctgatctaagaaagaggatgtcacgtctggaagaggagcttgaccaagagaaaaaaaaatacataatgctggaaataaagctgaggaattccgagcgagcccgtgaggatgcagagaggaggaaccaacttctgcagagagaaatggaggagttcttcagcaccctggggtcactaaccgtaggtgccaagggcgctcgcgcgccgaaatag

SEQ ID NO: 15440 - DNA, 1209 bp, Artificial Sequence
  Description of Artificial Sequence: Synthetic coding sequence
atgagcgcagagggcgctgagcctggccccggaagcggctccggcccaggacctggaccactatgtcccgagcatgggcaggctctgagttggttctgtgggagcgaaagaaggcctgtgtgtgccgcgtgcgcaggcctcggcggcaggtgccgggggcaccggatccgcagggccgaggagagggctgaggagctgagaaataaaatcgtggaccagtgtgaacgcctgcagctgcaatcggcagccattacaaagtatgtggccgacgtcctgccagggaagaatcagcgcgctgtctctatggcctctgcagcccgagagctggtgatccagaggctctctttagtcagaagcctgtgtgagtcagaggagcagcgcctacttgaacaggtgcacggcgaagaggaaagggcgcaccaatctatactgacccagcgcgtccattgggccgaagctctgcaaaaacttgacaccatccggactggcctcgtgggcatgctgacccatctcgacgacctgcagctaatccagaaggaacaagagattttcgaaagaacagaggaggcagaagggatcctcgacccacaagagagcgaaatgttaaacttcaacgagaagtgcactcggtcgcccctgctgacgcaactctgggctactgcagtgctaggaagtctctctggaacagaagacattcgcatcgacgaaagaactgttagtcccttcctccagttgagtgatgacaggaaaacactcaccttctccaccaagaagtcaaaagcatgcgctgatgggcccgagagattcgaccactggccaaacgcactggcagccacaagcttccagaacggactgcatgcttggatggtgaatgtccaaaacagttgcgcctacaaggtgggcgttgccagcggccatttacctcgcaaagggagtggatctgactgccgcctgggccataatgccttctcctgggtgttcagccgctatgatcaggaattccgttttagccacaatggccagcatgaacctctcgggctgctacgggggcctgcccagctgggagtcgtcctggatcttcaggtgcaggagctactattctacgagcccgcctccggaactgtgctctgcgcacaccacgtgtcttttcctgggccattgtttcccgtcttcgctgtggctgaccagactatctcaatcgtgcgatag

SEQ ID NO: 15441 - DNA, 258 bp, Artificial Sequence
  Description of Artificial Sequence: Synthetic coding sequence
atgttgcggcgcaaacccactcggctggagctcaagttggatgacatcgaagaattcgaaaatattcggaaagatcttgaaacaaggaagaaacagaaggaagacgtggaagtcgtcggcggaagtgacggcgaaggagcaattgggttgtccagcgacccaaagtccagggaacagatgatcaatgataggatcggttataagccccaacctaagccgaataatagatccagccagttcggaagtctagagttttag

SEQ ID NO: 15442 - DNA, 744 bp, Artificial Sequence
  Description of Artificial Sequence: Synthetic coding sequence
atgctgagcgatgggtgcggatcagaggaaaagataagtgtcccatcttgctacggcgggattggggccccagtaagccggcaagtgccggcctcccatgacagcgagctgatggctttcatgacaagaaagctgtgggatctggagcagcaggtgaaggcccagaccgacgagatcttaagtaaggatcagaagatcgccgcgctggaggatcttgtgcagactctccggccccaccctgccgaggcaaccctccaacgccaggaggagctggaaaccatgtgcgtacagctgcagaggcaggtgagggagatggagagattcctgtcagattatggcctccagtgggtaggcgagcctatggaccaagaggattctgagtctaaaactgtgagtgagcacggtgaaagagactggatgacagcgaaaaagttctggaagccaggggattccctggctcctccagaagtggatttcgataggctactcgcctctctgcaggatctctctgaacttgtggtggaaggagacacccaggtcactcctgttcccggaggggccaggctcagaacattggagccaattcccctaaaattgtaccgtaacggcatcatgatgtttgatggaccctttcaaccattttatgatccatctacccagcgatgtttgcgcgacatcttggatgggtttttcccatcagagctgcagcggctgtaccccaatggtgtgccttttaaggtgtag

SEQ ID NO: 15443 - DNA, 1464 bp, Artificial Sequence
  Description of Artificial Sequence: Synthetic coding sequence
atgtcctcccccctggcctctttgagcaagacccggaaggtgcccttgccgagcgagccgatgaatccgggccgaaggggcatccgcatttacggcgacgtgccagccagtcacgactcagagcttatggccttcatgacgagaaaactgtgggaccttgagcaacaggtgaaggctcagacggacgaaattctaagtaaagatcagaagatagctgccctggaggacctagtacaaactctccgtcctcatccagctgaggctactttgcagagacaggaggagctcgagactatgtgcgtgcagctccaaagacaggtgcgggagatggaacggttcttatctgactacggtctgcagtgggtgggagagcctatggaccaggaggattccgaatctaagacggtgagtgagcatggggagcgggattggatgaccgctaagaagttctggaaacccggagactccctggcacccccagaagtcgattttgaccgtctgttggcaagcctgcaggatctctctgagctcgtggtggagggggacacgcaagtgacaccagtgcccggcggtgcacgtttgcgtacattggaaccaattcctcttaagttatatagaaatggtatcatgatgtttgacggccctttccagcccttttatgatccatccacccaacgctgcctgcgcgacattctggacggcttcttcccaagtgaattacaaagattataccctaatggagtaccttttaaggtgtcagatctgagaaaccaggtctacctggaggatggtttggatcccttcccgggcgagggccgggtagtgggccgccagctcatgcacaaagcattagatagggtagaggaacaccctgggtctcgcatgactgctgaaaagttcttgaatcggctgcctaaatttgtaattaggcagggagaggtgatcgacatacggggcccaatcagagatacattacagaactgctgcccacttccggcgcgcatacaggaaatcgtggtggagacccctaccctggccgcagagagggaacgctcacaggaatcacccaataccccggccccacctctgagcatgctgcgcattaagtcagaaaatggggagcaagcattcctgttgatgatgcagcccgataatacgattggtgacgtcagagccctgctggctcaagctagggttatggacgctagtgccttcgaaattttttcaactttccccccaaccttgtatcaggatgatacactgaccctgcaagccgcaggcttagttcccaaggcggccctgcttctacgggcgcgtcgggcccccaagtcttccttgaaattcagtccgggtccttgccccgggccaggtccaggcccttcacccgggcctggccctggacctagccccgggccaggtcccggaccgagtccgtgccccggcccaagtccttccccacagtag

SEQ ID NO: 15444 - DNA, 1020 bp, Artificial Sequence
  Description of Artificial Sequence: Synthetic coding sequence
atgtggactgcccgcggtccttttcgccgggataggtggagcagtgaggatgaggaggccgcaggcccatcccaggctctgtcccccctgctgagcgacacaagaaagatagtgagcgagggagaattagatcagctcgcccagatccggcctctaatattcaacttccatgagcagactgctatcaaagactgcctgaagatcctggaagaaaagaccgccgcctatgacatcatgcaggagttcatggccctggaactgaagaatctgcccggggaatttaatagcgggaaccagccatcaaacagagagaagaacaggtacagagatattctgccctacgacagtacgagggtgcctctcggaaagtcgaaagactacattaacgcatcgtatatccggatagtgaattgtggtgaggagtatttttatattgccacccagggtcccctgctgtctaccatcgacgacttttggcagatggttctcgaaaacaactccaatgtgattgcgatgataacccgtgaaatagagggtggaattatcaaatgttatcattattggcccatttcccttaagaagcccctggagctcaaacactttagggtgttcctcgaaaattaccagattcttcagtacttcataatccgcatgttccaggtggtcgagaaaagcactggaacttcacatagtgtaaagcagttgcaattcactaagtggcccgatcatggcacccccgccagtgccgactccttcatcaagtatattcgctacgcccggaaaagccacctgacaggaccaatggtggtccactgctctgccggtataggcagaaccggcgtgttcctgtgtgtcgatgtcgtgttctgtgcaattgtcaagaattgcagtttcaacattatggacatcgtggctcagatgagagagcaaagaagtgggatggtgcagaccaaagagcagtaccacttttgttacgacatagtgctggaagtgctgcgtaagctgctcactctcgactag

SEQ ID NO: 15445 - DNA, 1563 bp, Artificial Sequence
  Description of Artificial Sequence: Synthetic coding sequence
atgagttcccctcttgcctcactgtcaaaaacaagaaaagtgccccttccatcagagcccatgaacccaggccgacgcggcatccggatttacggggacgaagacgaggttgatatgttgagcgatgggtgcgggtctgaggaaaaaatctccgtaccaagctgttatgggggtatcggggcacctgtgtcaagacaggttcccgcaagtcacgatagcgagctgatggctttcatgactcgaaagctgtgggatctggagcagcaggtgaaagcccagactgatgaaatcctctcaaaagatcaaaagattgctgccttggaggaccttgtgcaaacgctgcgacctcacccagccgaggccacactgcagaggcaggaggaactggaaacaatgtgtgtgcagcttcaaagacaggtacgagaaatggaaaggtttttgtcagactacgggttgcagtgggtgggcgaaccgatggaccaggaggactcagaaagcaaaaccgtgagtgaacacggggagagggattggatgaccgctaagaaattttggaaacctggcgatagccttgcccctccggaagtggacttcgataggctgttagccagcctccaggatctgtctgaactcgtcgtcgagggtgatactcaagttaccccagttcctggaggcgcccggctgcgtactctggaacccattcctctaaaactgtaccggaacggaatcatgatgttcgacggcccattccagccgttttatgacccctctacgcagaggtgcctcagagatatactggatggctttttcccaagcgagctgcagcggctctaccccaacggggtgcccttcaaagtgtctgacctaagaaaccaagtatatctagaggatggcctggacccctttccaggagagggaagggtggtcggacgtcagctcatgcacaaggcattagacagggtggaagaacacccagggtcccggatgacagctgaaaagtttctcaacaggctgccaaagttcgtcatccgccagggtgaggtgattgatatccggggcccaatcagggacaccctccagaactgttgtccactgcctgcgcgcatccaggaaatcgtggtggaaaccccaacactcgcagcagaaagggagcggtctcaggagtcacctaacacccccgctcctcctctgtccatgctgcgcattaagagtgagaatggggaacaagcattcctcctcatgatgcagcccgacaacacaattggagacgttcgggccttgctcgcacaggcccgcgttatggatgcatctgccttcgaaattttctcaaccttcccaccgaccctataccaggacgatacactgacactgcaagcagctggactggtgccgaaagctgcactccttctgcgcgcaaggagggccccgaaatcctctctgaagttttcacccggcccatgtcccggacctgggccaggacctagccccggccccgggccaggcccatctccaggtcccggccctggtccatcgccctgcccaggtcccagtcccagccctcaatag

SEQ ID NO: 15446 - DNA, 1563 bp, Artificial Sequence
  Description of Artificial Sequence: Synthetic coding sequence
atgtccagccctttggcaagcctctctaaaaccagaaaagtccccttaccttcagagcccatgaaccctggcagacgcggaattcgaatatacggcgatgaggatgaggttgacatgctcagtgatgggtgtgggtccgaggaaaagatctcagtaccttcctgctatgggggcattggggcaccagtttcaagacaagtgccggcttctcacgattccgagctcatggccttcatgaccaggaagttatgggatcttgagcagcaggttaaagctcaaactgatgaaatactttccaaagatcagaagatcgccgctctggaagacctggttcagactctgcgaccccacccggcagaggcaaccctgcagcgccaggaggaattagaaactatgtgtgtgcaactgcagagacaggtcagagaaatggagcgctttctgtccgattacggcctccaatgggtcggcgaacctatggaccaggaagatagcgaatccaaaaccgtcagcgaacatggagaaagagattggatgacagcaaagaagttttggaaacccggcgattcgttggccccccctgaggtcgattttgacaggctgttggcatcattgcaggacttgagcgagttggtggttgaaggagatactcaggtcactccagtccccggaggtgccaggctcagaactctagagcctatcccccttaaactgtataggaacgggataatgatgttcgacgggccctttcaaccattctacgaccccagcactcagcgctgtctgcgcgatatcctcgatggcttctttccatccgagttgcagaggctttatcccaacggggtaccgttcaaggtgtccgaccttcgcaaccaggtgtacctggaggatggcctggacccgtttccaggagaagggagagtggttggtcgccagctcatgcacaaggcactggacagagttgaagagcaccctggcagtcggatgaccgctgagaagttcctgaaccgacttccaaaatttgtcatccgacagggcgaggtgattgatatccgcggacccatacgggacactttacagaattgttgtcctttgcccgctcgcatccaggagatcgtcgtagagacacccacgctggccgcagaaagagagcggtcccaagaatccccaaatacaccggcacctcccctgtccatgctacggataaagagcgagaatggagaacaggcatttctgctaatgatgcagccagataataccatcggggatgtgcgcgccctcctggcacaggcacgcgtgatggacgcttccgcgtttgagatcttctcaacatttccacctacactctaccaggacgatactctaaccctacaagctgctgggttggtaccaaaggcggccctcttgctccgggctcgaagagcaccaaaatcaagcctgaaattcagtcctggaccttgccctggcccgggccccggaccgagtcccggccccgggcccggcccttctcctgggccaggaccgggaccttctccctgtcccgggccatcgccatcaccccagtag

SEQ ID NO: 15447 - DNA, 834 bp, Artificial Sequence
  Description of Artificial Sequence: Synthetic coding sequence
atgttcgatgggccgtttcaacccttttatgacccctccactcagagatgtcttcgggacatccttgacggtttctttccctctgaattacagaggctgtatccaaatggcgtgcccttcaaggtctcagatttacgcaatcaagtgtacctggaggacggtctggacccctttcccggcgagggacgcgtggtgggtaggcagctcatgcacaaggcgctggaccgcgttgaggagcatccgggctccagaatgacagccgagaagtttctcaacagactgcccaaatttgtaatacgtcaaggggaggtgattgacattagagggccaatcagagacacgctgcaaaattgctgcccactgccggctcgcattcaagaaatcgtggtcgaaactcctacccttgcagccgaaagagaacgttcacaggagtcccccaatactccagcccctcctctgagcatgctgcggattaagtctgaaaacggggagcaggcgtttctgctcatgatgcagcccgacaataccattggcgacgtgagagcgctgctggcccaggcccgggttatggacgcatctgcattcgagatattttccacgttcccacccactctgtaccaagacgacacactgacactgcaagctgccggcctggtgcccaaagctgccctgttgttgagggcgagaagagcccctaaaagcagtctaaaatttagtcccggtccctgtccagggccaggccccggaccttctcctggacccggtcccgggccatccccgggcccaggacccggcccgtctccttgccctggcccctcgcccagtccacaatag

SEQ ID NO: 15448 - DNA, 1314 bp, Artificial Sequence
  Description of Artificial Sequence: Synthetic coding sequence
atggccggcgggccacctaaggcactccccagcaccggacctcactccctgcgggatatgccccatcctttggctggctccagcagcgaagaggccgtcggaggagattccacaccttctcccgacctcctcatggccagatcatttggagataaggaccttattctccctaatggagggacaccagcgggtacatccagcccagcatcctcttcttccctcctgaacagactgcaactcgacgatgacatcgatggggagacaagggacctcttcgtgatcgtggacgacccaaaaaaacacgtctgcaccatggagacgtatattacataccgaatcaccacaaagagcaccagggttgagtttgatttgcccgagtatagcgtccggaggagatatcaggattttgactggttgaggtctaaacttgaagagtcacagccaacacacctcatcccacctcttcctgaaaaattcgtggtgaaaggcgtggtagaccggtttagcgaagagtttgtcgaaacacgacgcaaagctctcgacaaattcctgaaacgaatcacggaccaccccgtcctgtccttcaacgaacactttaacatcttcttaaccgcaaaagacctcaacgcgtacaagaagcagggtatcgcactgttgacccgaatgggcgaaagcgttaaacatgtgacaggcggctacaaactgcggaccagaccactggagtttgccgcgatcggcgattatctggatactttcgcgctcaaacttggtactattgacaggatcgctcagcgaatcataaaggaggaaattgagtacctggttgagttgagggagtacggacctgtctatagcacatggagtgctttggagggtgaactggctgaaccccttgagggggtctccgcctgcatcgggaactgttcgactgcccttgaagagctgaccgacgatatgaccgaggactttctgcccgttctgagagagtacatcctctattcggactcaatgaaaagtgtgctcaaaaaaagagatcaggttcaagcagagtacgaggctaagctggaggccgttgctctcagaaaggaggaccgtccaaaagtgcctgcggacgtggaaaaatgtcaagaccggatggagtgtttcaatgcggaccttaaggccgacatggaaaggtggcagaacaataagcggcaggacttccggcagctgctgatgggcatggcagacaaaaatatccagtattacgagaagtgcctcatggcttgggaatctattattcccttattacaagagaaacaagaagccaagtag

SEQ ID NO: 15449 - DNA, 1263 bp, Artificial Sequence
  Description of Artificial Sequence: Synthetic coding sequence
atgtcttcacctcgtgattttcgagctgagcccgtcaatgattacgagggcaacgactccgaagccgaggatcttaattttcgggagacccttccgagtagctctcaggagaacacgcctaggagtaaagtctttgaaaataaggtcaattctgagaaggtcaagctaagcctaagaaatttcccccacaacgattacgaggacgtgtttgaggaaccatctgagagcggaagcgatcctagtatgtggactgcacgaggaccattcagaagagacaggtggtcaagcgaggatgaagaagccgcgggtcccagtcaggctttgtcgcctctgcttagcgacacccggaagatagtctccgagggagagttagaccagctagcacagatccgaccccttatcttcaacttccacgaacagaccgctattaaagattgcctgaagatcctcgaggagaagaccgctgcatatgatattatgcaggaatttatggctctcgagttgaagaatttacccggtgagtttaacagcggcaatcagcccagtaaccgcgaaaagaaccggtaccgggatatcctgccatacgatagcacaagagtaccattgggcaaaagcaaggattacatcaacgctagctatataaggatcgtgaattgcggcgaggagtatttttacatcgcaacacaggggccacttctctcaacgatcgacgatttctggcagatggttctcgaaaataattctaacgttatcgcaatgatcactcgcgagatcgagggtggcatcatcaagtgctaccactactggccaatttcgttgaaaaaaccattagaacttaagcactttcgcgtgtttctcgagaactatcaaatcctgcagtacttcatcatccgaatgtttcaggtggtagaaaagagcaccggcacatcacactctgtgaagcaacttcagttcacaaagtggccagatcacggtacacccgcttccgccgattcttttattaaatatattcgttacgcaaggaagtcgcacttgaccggcccaatggtagtgcattgttctgctggcattggcaggaccggcgtttttctctgtgttgatgttgttttctgtgcaattgtaaagaactgctcattcaatatcatggatattgtggctcagatgagggagcaacggtccggcatggtgcagactaaggagcagtatcacttctgctatgacattgtgctggaagtccttcggaaactcctgactttggattag

SEQ ID NO: 15450 - DNA, 837 bp, Artificial Sequence
  Description of Artificial Sequence: Synthetic coding sequence
atgtcgagcccccgagatttccgggctgagccagtgaatgactatgagggaaacgacagcgaggcagaggacttgaatttcagagagacgctgccctctagttcccaggaaaacacaccgcgcagtaaagtctttgagaataaggttaatagtgagaaagtcaagctgagcctcaggaatttcccccacaatgactatgaagacgtgtttgaagagccatccgaatctggtagtgatccatcaatgtggactgcaagaggcccctttcggcgcgaccgatggagttctgaagacgaagaggctgcaggaccaagccaagcgcttagtccattgttgtcagatacacgcaaaattgtgtccgaaggcgaactcgaccagctcgctcagattcggcccttaattttcaactttcacgaacagacagccatcaaggactgcctcaaaattctggaggaaaagaccgccgcttatgacattatgcaggaatttatgacaggaacttctcacagcgtgaagcaactgcagttcacaaaatggccagaccacggcacccccgcatcagcagactccttcatcaaatatatcagatatgctcgtaagtcccaccttactggtcccatggtggtccattgttccgcgggaataggccggactggcgtgttcctgtgtgtcgatgtggtgttttgcgccatcgtgaaaaattgttccttcaacattatggatattgtggcccagatgcgcgagcagaggagcggcatggtccagaccaaggagcagtaccacttctgctacgacattgtgctggaggtgctgcgtaagttgctgaccctagattag

SEQ ID NO: 15451 - DNA, 681 bp, Artificial Sequence
  Description of Artificial Sequence: Synthetic coding sequence
atgtctagcccccgagacttcagagccgagcccgtgaacgattatgagggcaacgattccgaagctgaagacctgaacttcagggagaccctgccaagttcaagccaggagaacacaccacgaagcaaggtgttcgagaataaggtcaacagcgagaaagttaaattaagtctccgtaattttcctcacaatgactatgaagacgtgtttgaagaaccctccgagtccggcagtgaccccagcatgtggaccgcaagaggcccctttaggagggacaggtggagtagtgaagacgaagaggccgccggcccctcacaagctctgtcaccactgcttagcgacaccaggaagatcgtcagtgaaggggaactggaccaactagcccaaattcgacctctcatcttcaattttcacgagcagaccgcaattaaagactgtcttaagatccttgaagagaaaactgccgcatacgacatcatgcaggaattcatggctctcgaacttaagaatctgcccggggaatttaacagcggcaaccagcctagcaatagggaaaaaaatcggtacagggacatcttacccttccagcatcatggttattctgggccaaatgaaagaactaccttctggcacggcagtaatgagggcgcggtgtcattgttgctcaggtattgcgcatag

SEQ ID NO: 15452 - DNA, 681 bp, Artificial Sequence
  Description of Artificial Sequence: Synthetic coding sequence
atgcatcagacctgcgtacgccttgaacgcgaagcatccgcgcgtccttccccagggcccgtgctccctccccgtccattaccatcacatacagagttgcagatacgcgaaggcccgaaaaggactattcgcgccgccgcagaaggtgctccttgcgtcgggcgcgttcgatgtgctccagggaaccgcgggggacgtgagggtgcaagtggtgtgcgcggaggggttgcccaggtgccccccaggctcccagcgcctccaataggccctgagcgagatgatctggcaggaggagcagggcgcaagccgctgccatccacagcggcggcttccagtcctggaagtgccgccgcagctaccgcagctttatgtcctcctgcccgactatctacaccaagcatgtctggattaagagtctacagtacatccgttaccggaagccgtgagatcaagagtcagcagtccgaggtgacccgtatacttgatgggaagcggatccaataccagctagtagatatctctcaggacaacgccctccgggacgaaatgcgggcccttgcaggtaatcccaaggcgacaccccctcagattgtgaatggcgatcaatactgcggagattatgagctatttgtcgaggcagtggagcaaaatacactgcaggagtttctgaagctggcttag

SEQ ID NO: 15453 - DNA, 1518 bp, Artificial Sequence
  Description of Artificial Sequence: Synthetic coding sequence
atggaccctggcaatgagaattctgctactgaggctgctgcaatcattgatctcgatcctgacttcgaaccccagagcagaccgcgctcctgtacatggcctctcccgcgtccagaaatagcaaatcagccaagcgagcccccggaagtggagcctgatctgggagagaaggtccacaccgaagggcgtagcgagcctatactgttaccctccagactgcctgagcccgctggggggccacaacccggaatcttaggggcagttacaggcccccgaaagggaggttcgcggcggaatgcttggggaaatcagtcttacgcggaactgatcagccaagcaattgagtccgcgccagaaaagaggctaacattggcgcagatctatgagtggatggtcagaacagtaccatactttaaggataagggggactctaattctagcgccgggtggaagaatagcataaggcacaatctttcactgcactccaagtttatcaaagtccataacgaggcaaccggaaaaagctcctggtggatgctgaaccccgaaggagggaagagcggtaaggcgccaaggagacgggccgcctccatggattccagctccaagcttctccggggcaggtccaaggcaccaaagaaaaaacccagcgtattgcctgcccctccagagggagcaaccccaaccagtcccgtcggccacttcgcgaaatggagcggatcaccttgctcacggaaccgagaggaagcggatatgtggaccacgtttcgcccgcgatcttcctctaatgcctcatctgtgtccactagactttctcccctgcgaccagaatctgaggtgctggcggaggaaattccagcatccgtctccagttatgctggaggcgtgccacctaccctcaacgaagggctcgagctgctggatggactcaatttgacaagcagccactcgctgttgtctaggtcaggcttgtcaggcttctctctgcagcaccccggagttacggggcccctgcatacttattcaagctctctctttagtcccgcggaaggtcctctgtccgccggagagggatgcttctctagcagtcaggccttggaggcactgctcacttctgacacccctcctccgcctgcagacgtgctcatgacccaggtagacccaatcctgtcacaggcgcctactctgctattgctgggtggcctccccagttcttccaaactcgctactggagtcggcctgtgtccaaagcctcttgaggcccctggccccagtagtcttgtacccactctgagcatgatcgctcctcctccagtgatggcatcagctcctattccgaaggcgctcggcacaccagtgcttacacccccaaccgaggctgcatcgcaggaccgaatgccacaggatcttgacctcgatatgtacatggagaacctggaatgtgacatggacaacatcatttccgatttgatggacgagggtgaaggactggatttcaactttgagcccgacccctag

SEQ ID NO: 15454 - DNA, 1062 bp, Artificial Sequence
  Description of Artificial Sequence: Synthetic coding sequence
atggactacaaaagttccctgatccaggacgggaatcctatggagaatctcgagaagcagctgatttgtcctatctgtctagagatgtttacaaagcctgtcgtgattctgccttgtcagcacaacttgtgtaggaaatgcgctaacgatatcttccaagcagcaaacccatattggacaagcaggggctccagcgtgtccatgtcgggcggaagatttcgctgcccaacatgtaggcacgaagtgattatggaccgccacggagtgtacggtttacagcggaatctcctcgtggagaacataatcgacatttataagcaggagtgctcctcaagacctctgcagaagggctctcacccgatgtgcaaagagcacgaggacgagaaaattaatatctactgcctgacctgtgaggtgcccacatgttccatgtgcaaggtttttggcattcataaggcttgcgaggtggcccctctccagagtgtgtttcaaggccagaagacggagctgaataattgcatctccatgcttgtagctgggaatgacagggtgcaaacaataatcactcagcttgaagacagtaggcgtgtcacgaaagaaaattcacaccaggtgaaggaggaactgtctcaaaagtttgatacactctatgccattcttgacgagaaaaagtcagagctgctccaacgcattacccaggagcaggagaagaaactgagcttcattgaagccctgattcagcaatatcaagaacagctggataagagtaccaagctcgtcgagacagccattcagtcacttgacgagccaggaggcgccaccttcttgctgacagccaaacagctgatcaagagcatagttgaggcttccaagggatgtcagttaggcaaaaccgagcagggatttgaaaatatggatttctttactttagacctagagcacatcgcagatgccctgcgggccatcgattttggcactgacgaggaggaagaggagttcatcgaggaggaagatcaggaggaggaagaaagcacggaggggaaggaggaggggcaccaatag

SEQ ID NO: 15455 - DNA, 1179 bp, Artificial Sequence
  Description of Artificial Sequence: Synthetic coding sequence
atgggggtgaaccaatccgttggattccccccagtgactggcccccatcttgttggatgcggagacgtcatggaaggccagaacttgcaggggtctttttttcgactgttttacccatgtcagaaagcggaggaaaccatggagcagcccttatggatccctcgctacgaatattgcaccggactggcggagtatctgcagtttaacaaaagatgcggcggattgctgttcaacctcgctgtggggagctgtcgcctcccagtgtcatggaatggtccctttaaaacaaaggatagcggatacccactgataatattttcacacggtctgggtgcctttcgtactctatattccgccttctgcatggagttggcgagcaggggcttcgtggtggcagtgcccgagcatcgcgaccgctccgccgctacaacctacttctgtaaacaggctcccgaggagaaccagcctactaatgagtcgctgcaggaggagtggataccatttcggagagtggaggagggcgaaaaagaattccatgttaggaacccccaggtgcatcagcgggtgagtgaatgcctacgagtgctcaagatattacaggaagtgacagcggggcagaccgtgttcaatatcctccccggaggcctggatcttatgacactaaaggggaatatcgacatgtcccgtgtggcagtaatggggcatagcttcggaggagctaccgccattctagctttagcaaaggagacccaatttcggtgcgcagtcgccctggatgcatggatgttccccttggagcgagacttttacccaaaggcacgcggccccgtttttttcattaacactgaaaaattccaaaccatggagagtgtgaacctgatgaagaagatctgtgcccagcacgaacagtctaggatcattacggtactggggtcagttcatcgctctcagactgacttcgccttcgttaccggaaatttgataggtaaattcttttccacagagaccagggggtctctggatccgtacgaggggcaagaggtgatggtcagagccatgctagccttcctccaaaaacacctagacttaaaggaggactacaaccagtggaataatctaatcgaaggcatcggacctagcctcactccgggtgcgccgcaccatctttctagcttgtag

SEQ ID NO: 15456 - DNA, 1179 bp, Artificial Sequence
  Description of Artificial Sequence: Synthetic coding sequence
atgggggtcaaccaatctgttgggtttccaccagtcacaggacctcatcttgtgggctgcggggatgtgatggaagggcaaaacctgcagggtagcttttttcggctcttttacccatgccagaaggcagaagagacgatggaacagcccctctggatccccaggtatgaatactgcacaggcctagccgagtatctgcagtttaacaagaggtgcggcgggctgctgttcaatctggcggtgggatcctgtagactgccagtttcttggaatggaccctttaagactaaggattcaggctacccgcttattattttttctcacgggcttggcgcctttcgtacgctgtattccgctttttgtatggagctagcttcccgcggatttgtcgtggctgttcccgagcatagggataggtctgccgctaccacatacttctgtaagcaggccccagaggaaaatcagccaaccaatgagagtctgcaggaggagtggattcctttccgaagagtcgaagagggcgagaaggagttccatgtgagaaacccccaagttcatcagcgcgtcagcgaatgtttaagggtgctgaagatattacaggaagtaactgccggccagactgtgtttaacatcctcccagggggactggacctcatgactctcaagggaaatattgacatgtctcgagtggccgtgatgggtcacagcttcgggggcgcgacagcgatacttgcattggccaaggagacccaatttcgctgcgccgtggcacttgatgcgtggatgttccccctcgaacgtgacttctatccaaaggcccggggtccggtattctttataaacacggaaaagttccagaccatggagtccgtcaacctcatgaaaaaaatctgcgcgcaacatgaacagagcaggataatcacagtgctcggatccgtgcacaggagccagacagactttgctttcgtcactggtaacctcatcggcaagtttttctccactgaaactcgaggaagcttggacccatatgaaggccaggaagtgatggtacgtgccatgctggcatttctgcaaaagcatttggacctgaaagaagactataatcagtggaataacctgattgaaggtattggaccaagcctgacacccggggcaccacatcacctcagttccctctag

SEQ ID NO: 15457 - DNA, 213 bp, Artificial Sequence
  Description of Artificial Sequence: Synthetic coding sequence
atggtgaggaccaaaacttggactctcaaaaaacactttgtggggtaccccactaattctgattttgagttaaagacagccgagttaccacccttgaagaacggtgaagtgcttttagaagcgctgttcttaactgtagatccctacatgcgtgtcgctgccaaaagattgaaggaaggggatacaatgatgggccaacaggtggcgaaatag

SEQ ID NO: 15458 - DNA, 213 bp, Artificial Sequence
  Description of Artificial Sequence: Synthetic coding sequence
atggtccgtaccaagacctggaccctcaaaaaacactttgtgggttaccccactaactccgacttcgaactgaagaccgccgagctgccgccactcaagaatggtgaggtactcctggaagcgctttttctcactgtcgacccatatatgcgagtcgcggctaagcgactgaaggaaggcgacaccatgatgggacaacaagtggccaagtag

SEQ ID NO: 15459 - DNA, 534 bp, Artificial Sequence
  Description of Artificial Sequence: Synthetic coding sequence
atgcccggccttacagcctactttggcctcctggagatctgcggcgtgaagggcggagaaactgtgatggtaaacgcagctgcgggcgcagtgggaagcgttgtgggccagattgcaaagctgaagggctgtaaggtggttggagcagtcgggagcgacgagaaagttgcttacctgcaaaaactcggcttcgacgtagtgtttaactataagacagtggagtcccttgaggaaacacttaagaaggcatccccggacggctatgactgctactttgataatgtcggtggcgagttctctaacacagtcattggacaaatgaagaagtttggcagaatcgctatatgtggtgccatctcgacctacaatcggacaggcccactgccgccagggcccccccctgagatcgtcatctaccaagagctccgtatggaagcctttgtggtctatcgctggcagggagacgcacgccaaaaggcactgaaggacctattgaagtgggtgctcgagctgccatacttcgtgattgactag

SEQ ID NO: 15460 - DNA, 1263 bp, Artificial Sequence
  Description of Artificial Sequence: Synthetic coding sequence
atgtcctcacctagagacttccgggctgagccagtgaacgattacgaaggcaacgactccgaggcagaagatctgaactttcgggaaaccctgccgtcttccagtcaggaaaacacaccccgaagcaaggtgttcgagaacaaagttaatagcgagaaggtcaagcttagcctcagaaatttcccccataacgattatgaggatgtgtttgaggaaccaagcgagtctggctccgacccgtcaatgtggacggcccggggccccttcaggcgcgacagatggtcgagcgaggatgaggaagccgcgggcccctcccaggcgctaagtccacttctgtctgacactcgtaagattgtttccgagggagagttagaccaattagcccagattagaccgcttatctttaatttccacgagcaaacagccattaaggattgccttaaaattctggaggaaaaaaccgctgcttatgacattatgcaggagttcatggccctggagctcaaaaatctgcctggcgaattcaatagcggaaaccaacctagcaaccgcgagaagaatcgctatcgcgacatcctaccatatgattcgactcgcgtccccctggggaaatctaaggactacattaatgcgagttatattcgaatcgtgaactgtggcgaggagtacttttatatagccacacagggccctcttctctccacaatagacgacttttggcagatggtcctggagaataacagcaacgtgatcgcaatgattacccgtgagatcgagggcggaatcatcaaatgctatcattactggcctatcagtctgaaaaaacctctggaactaaaacacttccgcgtcttcctcgagaattaccagattctgcaatactttatcattcgcatgttccaagtcgtggagaaaagcacaggaacctcccattcagtaaagcagctgcagttcaccaaatggccggaccacgggacccctgcgagtgccgactcatttataaaatacatccggtacgccaggaagtcccatctgactggacctatggttgtccactgcagcgccggaataggtcggacaggcgtgttcctgtgcgtagatgtagtgttctgtgcgatcgtcaagaactgcagttttaatataatggacatagttgcccaaatgagagagcagagatccggcatggtgcagaccaaggagcagtatcacttctgttacgatattgtgttggaggtactgcgcaagctgctgaccctggattag

SEQ ID NO: 15461 - DNA, 837 bp, Artificial Sequence
  Description of Artificial Sequence: Synthetic coding sequence
atgtcatccccgagagatttcagggccgaaccagtcaatgattatgaagggaatgacagcgaagcagaagacttgaatttccgggagacactaccatcttcctcacaggagaatacacctcggtctaaggtctttgagaacaaagtgaactcagagaaggttaagctgtcccttaggaactttccccacaacgattatgaagatgttttcgaagaaccgagcgagagcggtagcgatccatctatgtggactgccagagggccctttagaagagataggtggtcctccgaagatgaggaagcagccggtcccagccaggccttatcaccattgcttagtgacaccaggaagatcgtgtcggaaggcgaattggaccagctggctcagattaggcctttgatcttcaatttccatgagcagacagccattaaggattgtctgaagattctggaggagaagacagcggcatatgatatcatgcaggaattcatgacaggcaccagtcatagcgtgaagcaactacagtttaccaaatggcccgaccacggcacaccagcatccgcagacagttttatcaaatatatccgatatgcaaggaaaagccacctgacagggcccatggtggtgcattgtagcgctggcattgggcggaccggcgtattcctgtgtgtggacgtggtgttttgcgccatcgtgaaaaattgtagcttcaatattatggatatagtggcgcagatgcgcgaacagcgcagcggaatggtgcagactaaggagcagtatcacttctgctacgacatagtgcttgaggtattgagaaaactgttgaccttggattag

SEQ ID NO: 15462 - DNA, 681 bp, Artificial Sequence
  Description of Artificial Sequence: Synthetic coding sequence
atgagtagtcctcgcgatttcagagccgagccagtgaatgactatgaagggaatgactctgaggccgaagacctgaacttcagggagactctacccagtagttctcaggagaacactccccgttctaaggtcttcgaaaataaagtcaacagcgagaaagtaaaactctccctgcggaatttcccccataacgattatgaggacgttttcgaggaaccctccgagtcaggatctgatccatctatgtggacggcgcggggtccgtttcgaagggaccggtggtcttctgaggatgaagaggcagcaggccctagtcaagcactctcccctctactgtctgatactcggaagattgtgagcgaaggggagcttgatcagcttgcccaaatacggcctctcatctttaactttcacgagcagactgccattaaggattgtctcaaaatcttagaggagaaaacagcagcatatgacataatgcaagaatttatggcacttgagctgaaaaatctaccaggagagttcaactcaggaaaccagccaagtaatcgtgaaaaaaataggtatcgggacatacttccattccaacaccatgggtatagcggccccaatgaacgcacaactttttggcatggaagcaatgaaggtgctgtctccttgctcctgcgttattgtgcctag

SEQ ID NO: 15463 - DNA, 789 bp, Artificial Sequence
  Description of Artificial Sequence: Synthetic coding sequence
atgtcgcgttacctcaggcctccaaatacatctctgtttgtgcgcaacgtcgcagatgatactaggtcggaagacctcaggagggaatttggtcggtacggacctatagtggatgtctacgtaccattagacttttatacacgtcggccacggggtttcgcgtatgttcagttcgaagatgtgcgcgacgcagaagacgcgctacacaacctggatcgaaagtggatatgcggacggcagatagaaatccaatttgctcagggggatcgcaagacacctaaccagatgaaggctaaggaaggccgcaatgtctacagcagctctcggtacgacgattacgatcgctaccgccgttcccggagtaggtcctacgagaggcgacgatctagaagcagaagcttcgattataattaccgcagatcttatagtccccgtaattctcggcctaccggccgcccacgtaggtcaagatcgcactctgacaacgacaggtttaaacacaggaacaggagtttctctcgaagcaagtcaaattcccgctctaggtcaaagagccagcctaaaaaagaaatgaaggccaagagtaggtcacgcagcgccagccacaccaagactcggggaacaagcaaaacagactcaaaaacacactacaaaagtgggagtcgttatgagaaagagtcccggaaaaaagagcctccacgcagcaaatcccagtccaggagccagtcgagaagtcggtcaaagagccgctcgcgcagctggaccagtcctaagtccagcggacactag

SEQ ID NO: 15464 - DNA, 522 bp, Artificial Sequence
  Description of Artificial Sequence: Synthetic coding sequence
atgtcaagataccttcgacctcctaacacctccctctttgtgagaaatgtggccgacgacacccgctccgaagacctccgccgcgagttcggccgttacggcccaatcgtcgatgtctatgtgcctctagacttttacactaggcgcccccgagggttcgcatatgtccagttcgaggatgtgcgggacgcggaggatgccctgcacaatctggaccgcaaatggatttgcggaaggcagattgaaatccagtttgcccagggcgacagaaagacgccaaatcagatgaaagccaaggaaggtaggaacgtctatagtagctcgagatacgacgattacgatagatacaggcgttcacggtcaagatcttacgagcggagaagaagtcggtctcggtctttcgactataattacaggcgctcctacagtcctagaaacagtaggccaactggccggccgaggagaagcagaagtcactcggataatgacagccaggtctcgaaaaagaagaacgagaggtag

SEQ ID NO: 15465 - DNA, 669 bp, Artificial Sequence
  Description of Artificial Sequence: Synthetic coding sequence
atgtccgcctttggacacgacgaagcttggatggaggctggagggtttggcttggaagcagccgagcgtactgaatatcagtctctgtgtaaaagcaagcttctcttcctgggagaacagtcagtgggcaaaacaagcatcatttcccgttttatgtacaacagttttggttgtgcctgtcaggccactgtgggcattgatttcctctctaaaactatgtaccttgaagaccagatagtgcagcttcagctgtgggacacggctgggcaggaaaggtttcattcactcatcccttcatatattagagattcaacgatagccgtagtggtctacgatatcactaatatcaacagctttaaagagactgataaatgggtggaacacgtcagggccgagaggggcgacgatgtggtgattatgttattaggaaataaaattgatttggacaacaagaggcaagtcaccgcggagcaaggcgaggagaaatcacggaacttaaacgtcatgttcattgaaacctcggcaaaaacaggatacaacgtcaagaagctctttcgaagggttgcctctgcacttctttcaacccgcacttctcctcctcccaaggaaggaaccgtggagatcgagttggagagtttcgaggaaagtggcaacaggtcgtactgttag

SEQ ID NO: 15466 - DNA, 348 bp, Artificial Sequence
  Description of Artificial Sequence: Synthetic coding sequence
atggtgcagatcattaaggatacaaacgagttcaaaacatttctgaccgctgccggacataagcttgctgtagtgcagttcagttctaagaggtgcggcccatgcaagcgcatgttccccgtctttcacgccatgagtgtgaaataccagaacgtcttcttcgctaacgttgatgtgaataattctcccgaactggcggagacatgccatatcaaaaccatcccaacattccagatgttcaagaaatctcagaaagtcacccttttcagtcgaattaaacggatcatttgctgctataggtcaggatttatgtcgaacctgtgtctggcagacgacggcaacgaatag

SEQ ID NO: 15467 - DNA, 384 bp, Artificial Sequence
  Description of Artificial Sequence: Synthetic coding sequence
atggtgcaaattataaaagatacaaacgagttcaagacctttctgacagccgcagggcataaactcgcagtcgttcaattctcctctaaacggtgcggcccatgcaagcgcatgttccctgttttccacgctatgagcgtgaagtatcagaacgttttttttgccaacgtagatgtgaataacagtcccgagctggctgaaacatgtcacatcaagacaatacctacattccagatgttcaagaaaagtcagaaggtgactttgttttctaggataaagagaattatatgttgttaccgctcaggattcatgagcaatcttatatttgaattctgtggagccgacgcaaaaaagttagaagctaaaactcaggagctgatgtag

SEQ ID NO: 15468 - DNA, 1767 bp, Artificial Sequence
  Description of Artificial Sequence: Synthetic coding sequence
atgcacaggtcagccccttcgcagaccactaaaaggagccgaagtcccttcagtactacccgtagatcatgggatgatagtgaatcgtcaggcactaacctcaatatagataacgaagattactcccgatatcctcctcgggaatacagggccagcgggtctagaaggggcatggcttacggccacattgacagctatggcgccgacgacagcgaggaggagggggccggacccgtggaacgtccacctgtgaggggaaagaccggcaagtttaaggatgataagctgtacgacccagagaaaggggcccgcagtctggccggacctcctccccacttctcctcattcagccgcgacgtgagggaggaaagagacaaacttgatcccgtgccagcggccaggtgttctgctagcagagccgactttctgccccagtcttcggtggcctctcaatcatcatccgagggcaagctggccacaaagggggactcgtccgagcgcgagaggcgcgaacagaatcttcctgctcgcccctcaagagctcctgtctctatttgtggaggcggtgagaacacaagcaagtctgctgaggagcctgtggtgaggccaaaaatccggaatctcgcctctccaaactgtgtgaaacccaaaattttctttgacacagatgacgatgacgacatgccacattccaccagcaggtggagggacacggccaatgataatgaaggccattccgacggccttgctagaaggggccgtggtgaaagcagctctggatatccagagcctaagtatcctgaagataagcgcgaggctaggtctgatcaggtaaagcccgaaaaagtcccccggcggcggagaaccatggccgacccggatttttggacccattctgatgattactacaaatattgtgatgaagattctgattctgataaagagtggatcgccgccctgagacgaaagtataggtcccgggagcagacactatcaagcagcggggagtcctgggaaacccttcctggaaaagaagaacgagagccccctcaggcaaaggtctcagcctctacaggaacctcccccggaccaggagcgagtgcaagcgcaggagctggggctggcgcaagcgctgggtccaatggatcaaattacttggaagaggtgagagaaccctcactgcaagaagaacaggcaagcctggaggagggagaaattccgtggctgcagtaccacgaaaacgatagcagcagcgagggggacaacgacagcggacacgagctgatgcagccgggagtgtttatgctggacggcaataacaacttagaagatgattctagtgtttccgaagatttggaggtggactggtcactatttgatggtttcgctgacggtctcggggtggcagaagcgatatcctatgtggacccacaattcctgacctatatggccctggaggagcgccttgcccaggcgatggaaaccgccctggcgcaccttgaatcactagctgtcgacgtggaggttgccaatccgccagctagtaaggagtctatcgacgcactgccggaaatcttggtgaccgaagatcatggagcggtcggccaggagatgtgctgccctatatgctgttcagaatatgtgaaaggagaggtcgcaacggagcttccttgtcaccactattttcacaaaccttgtgtaagcatctggctgcagaagagtggcacatgcccggtgtgccgttgcatgttcccgccacctttatag

SEQ ID NO: 15469 - DNA, 612 bp, Artificial Sequence
  Description of Artificial Sequence: Synthetic coding sequence
atgcccgagcagttctcagtcgccgagtttctggctgtgacagcagaagatctgtctagccctgctggagcagctgcctttgcagctaagatgccaagataccgaggtgcggcgctagcacgggaagaaatcttggaaggcgatcaggctatcctgcagcgcataaaaaaggctgtgagagccatccactcttccggactcggacacgtggagaatgaagaacagtacagagaggcggtggagtcacttggcaactcgcatctgtcacagaatagccacgagctgtcgaccggattcctcaacctggctgttttcacccgggaagtggcggcactgtttaagaatctcattcaaaacttgaataacatcgttagcttcccactcgactccttaatgaaaggacagttaagggacggccgacaggatagcaaaaagcaattggagaaagcttggaaagactacgaggccaaaatggcaaagctggagaaggagcgggacagagcgcgggttaccggcgggatccctgcgtggaaccttgggatccccgctaagcctcacccgacacttaagagggcgtccgaaagcccacaggctccacctgaccccgcctag

SEQ ID NO: 15470 - DNA, 1932 bp, Artificial Sequence
  Description of Artificial Sequence: Synthetic coding sequence
atgggacaggaaagtagcaaacccgtgtggcccaatcctacgggcggctaccagtcgaatacaggtagacggtacgggcggcgccatgcctacgtgtcctttcgtccgcccaccagccaacgtgagcggattgcaagccaacgaaaaacaaacagtgaggttccaatgcaccggtccgccccaagtcaaactaccaaaaggagcagaagtccgttctctaccacccgaagatcctgggacgactccgaaagctcaggcaccaatctgaacatcgacaatgaggactattctaggtaccctcccagagaatacagggcctcaggttcgcggagagggatggcttacggacatattgacagctacggagccgacgactctgaggaggagggagccggtccggtagagaggcctccggtgagaggaaaaacaggaaagtttaaagacgataagctttacgatccagaaaagggagctagatcactggccgggcctcccccacacttttcctcattctcccgggacgtgagggaagagagggataaactggaccccgtcccagcagcaaggtgctccgcttcacgggcagatttcctgccccaatcttcagttgcctcgcaatcatcctcggagggcaaactggctactaaaggggactccagcgaacgggaacggcgggagcagaatctccctgcacggccctcccgggctcccgtgagcatctgcggtggtggagaaaacaccagtaaatctgccgaggaacctgtggtacggccaaagattaggaacctggcctccccgaactgcgtgaaacctaaaattttcttcgacactgatgacgatgatgacatgccccatagcacctccaggtggcgcgataccgcgaatgataatgaggggcactccgatgggcttgcaagaagaggaagaggggagtcctcctctggctaccccgagcccaagtatccagaggataagcgcgaagcgagaagcgaccaggtgaagccggagaaggttccacggagaagacgaaccatggcggaccctgatttctggactcattccgatgactactataagtactgcgacgaagacagtgacagcgacaaggaatggatagccgccttgaggcgcaagtataggagcagagaacagaccctgtccagctccggcgagtcgtgggaaaccttgcctggcaaggaagagcgggagccccctcaagcgaaagtctctgcttctaccggaacttctcctgggccgggggccagcgcctccgctggggccggcgccggagcgtccgcgggatccaatggctccaactatctggaggaggtgcgggaacctagcctgcaggaggaacaggcaagtctggaagagggggaaataccatggttgcagtaccatgagaacgactcttcgtccgagggggacaacgattcaggccacgaattaatgcagccaggggtgtttatgctcgatggaaataacaatctggaggatgattcctccgtgtctgaagacctcgaagtggattggtctctgttcgacggttttgccgacgggctcggcgtcgccgaagctatcagctacgtcgatcctcagttcctgacttatatggcccttgaagagcgtcttgctcaggctatggaaactgcactggcccacctggagtcactcgcagttgatgtagaggtcgcaaatccgccagcgagcaaagaaagtatcgatgcattgcctgaaatcctggttactgaagatcacggcgccgtgggccaggaaatgtgttgtccaatttgctgctccgaatatgttaagggagaagtggccaccgagttgccatgccatcactactttcacaagccctgtgtgtcaatctggctacaaaagagcggaacatgtccagtgtgtcggtgtatgttcccgccccctctctag

SEQ ID NO: 15471 - DNA, 1368 bp, Artificial Sequence
  Description of Artificial Sequence: Synthetic coding sequence
atgggccaggaaagtagcaagcccgtgtggccaaaccccactggcgggtatcaatccaataccgggaggcgctatgggcggaggcacgcttatgtttcgttcagaccacccacctctcagcgcgagcgaattgcgagtcagcgcaaaacaaattctgaggtgcccatgcatcgctcagcgccctctcagaccacgaagcgttcacgctcaccattctcaaccactagacgctcctgggacgattccgagtctagtggtactaacctgaatattgataacgaagactacagtagcaccagccgctggcgcgacacagccaacgacaacgaaggtcattccgacgggctcgcaagaagggggcggggagagtctagcagcggctatcccgagcccaagtaccccgaagataagcgggaggcacgcagcgaccaggtcaagcccgagaaagtaccacggcgcaggcgcacgatggcagatcctgatttttggacacactccgacgattattacaaatattgcgatgaagatagcgacagcgataaagagtggatcgcagccctgagacgcaaatatagaagcagagagcaaacgttaagttcctctggagaatcctgggaaacactgcccggcaaggaggaaagagaacccccccaggcaaaagtgtctgccagtacagggacatcacccgggccaggggcatccgcctccgcgggcgcgggcgcaggagccagtgccggatctaatgggtctaattatcttgaggaagtgcgcgagccttctctccaggaggagcaggccagtttggaggagggtgaaatcccatggctgcagtaccacgaaaatgactcatccagtgaaggggacaatgactccggtcacgagctgatgcagccaggggtgttcatgctcgacgggaataataacttagaggacgattccagtgtttctgaggatctcgaggtcgactggtcgctgttcgacgggtttgccgacggcctaggcgttgcagaggccattagctatgtcgatccccaattccttacttacatggcactggaagaaaggctcgctcaagcaatggaaaccgccctggctcatctagagagtctggcagtggatgtggaggtggccaacccacccgcttcgaaagaaagtatcgatgcattacccgagatcctggtaaccgaagaccacggcgcagtgggacaggaaatgtgttgtcccatttgttgctctgagtatgtcaagggagaagtcgctacagaacttccctgccaccactatttccacaagccatgcgtttcaatttggctccagaagtctgggacgtgtccggtgtgcagatgcatgtttccaccccctctgtag

SEQ ID NO: 15472 - DNA, 390 bp, Artificial Sequence
  Description of Artificial Sequence: Synthetic coding sequence
atggccgagctgattcagaagaagttgcagggtgaggtagagaagtatcagcagctgcagaaggatctcagtaagagcatgtcagggcgtcagaagcttgaagctcagcttacagagaataacatcgttaaagaggagctggctcttctcgacggctctaatgtcgtattcaagttgcttggccccgtgttggtcaagcaggagctgggcgaggcccgagcgaccgttggaaagaggctggactacattaccgcagaaatcaagcggtacgagtcgcagctgagggacctcgagagacagtccgaacagcagagagagacgctagctcagctgcagcaagagttccagagggcccaggccgccaaagccggagctcccggcaaggcctag

SEQ ID NO: 15473 - DNA, 390 bp, Artificial Sequence
  Description of Artificial Sequence: Synthetic coding sequence
atggcggaattaatccagaagaagttgcaaggtgaagtggagaaatatcagcagttgcagaaagatcttagcaaatcgatgagtgggcgtcagaaattggaagcacaattaaccgaaaacaacatcgtcaaggaggagctagcacttttagacggtagcaacgtagtgttcaagcttttgggcccggtcctggttaagcaagaactgggagaggcaagagccactgtcggaaaacgcctggactatattaccgcagagattaagcgatacgagagccagctgcgagaccttgaacggcaatctgagcagcagagagaaacactggcccagctacaacaggagtttcagcgggcacaagccgcaaaggctggggcgcctggaaaagcctag

SEQ ID NO: 15474 - DNA, 390 bp, Artificial Sequence
  Description of Artificial Sequence: Synthetic coding sequence
atggctgagttaattcaaaaaaagctgcagggggaggtggaaaagtaccaacagctgcagaaagacctgtcgaagtccatgagcgggcgacaaaagctggaggctcagctgaccgagaataatatcgtcaaggaggagctcgccctcctggatgggtcaaatgtagtgtttaaactcctggggccagttctagttaagcaagagctgggtgaggccagagcaactgtgggcaagcgactggactacataacagcggagatcaagcgctatgaaagccagctgagagacttagaacgccaatctgaacagcagagagaaactctggctcagctgcagcaagaattccagagggcccaggcagccaaggcaggggcacctggtaaagcatag

SEQ ID NO: 15475 - DNA, 1512 bp, Artificial Sequence
  Description of Artificial Sequence: Synthetic coding sequence
atgaagtgtgagcactgtactcggaaggaatgcagcaagaagaccaaaaccgatgaccaggaaaatgtcagtgccgatgctcctagccccgctcaggagaacggtgagaaaggagagttccataaactggcagacgccaagatcttcttaagcgactgtttggcttgcgacagttgcatgaccgcggaagagggtgtgcaactcagtcagcagaatgcaaaagacttttttagagtgctcaacttaaacaagaaatgcgacacttcaaagcataaggtgctagtggtatccgtgtgtccacagagcctgccgtattttgcggccaaattcaacctgagtgtgaccgatgcatcccgcagactctgcgggtttttgaagagccttggagtgcactacgtgtttgatacgactattgcagccgatttctctatattggaatcccagaaagaattcgtccgcaggtacagacagcactctgaggaggagcgtactctgcctatgctgacctccgcgtgtccaggctgggtacggtatgcagagagagtgctcggcagaccgatcacagcacacctttgcacagcgaaatctcctcagcaagtgatgggttcacttgtgaaggactacttcgctagacagcagaatctaagtccagagaaaatcttccatgtgatcgtggccccgtgttatgataagaaactggaagccctccaggagtcactgccgcccgcgctgcacggtagcagaggggcagattgcgtgctaacaagcggaaaggtgctcatctcttggtggtgcacgcccgtgatcaccgccacacaagaggctgcagcacgcgaatcattggagcccggtaggcaacggcttcagcgagataagatcgcacccctcgattccagcctgggcggaggtggtgagattgctcaaattatggaacagggcgacctgtctgtgcgcgacgctgcagtcgataccttatttggggatctcaaggaagacaaggtgaccagacacgatggggcttcaagtgacgggcacttagcccacatcttcaggcatgctgccaaggagttgtttaatgaagacgtggaggaagtcacctatcgagccttaaggaataaggatttccaagaggtgactttagaaaaaaatggtgaagtggtgctccgatttgccgccgcctacggctttcggaacatacaaaacatgattttgaagctgaaaaaggggaagtttccattccactttgtcgaggttctggcctgcgcaggcgggtgtctcaacggtcgtggtcaagcacaaacacccgacgggcacgccgataaggcactgctgagacagatggaaggcatttatgcagacatacctgttaggcgccccgaaagctctgcccatgtgcaagagctgtatcaggagtggctggagggcattaattctcccaaagcaagagaagtcttgcacaccacttaccagtcccaggagagagggactcactccttggatatcaagtggtag

SEQ ID NO: 15476 - DNA, 348 bp, Artificial Sequence
  Description of Artificial Sequence: Synthetic coding sequence
atggcaaccgagccagaggctgcggagcccgtggtcccgtctctggtcgaccgatactttacccgttggtataaaccggacgtgaagggcaaattttgtgaagaccattgcatcttgcagcactccaaccgaatttgcgtgatcaccctcgcagagagccacccagtgctacagtctggaaaaaccatcaaaagcattagttaccagatcagcactaattgctcacgcctgcagaataaggtgtctgggaaattcaaaaggaggattatctacctggaaaaggtggaggacgttatcaaacgtaagatgatgccgttatctctcggccttcatctgcctcacagctag

SEQ ID NO: 15477 - DNA, 1566 bp, Artificial Sequence
  Description of Artificial Sequence: Synthetic coding sequence
atgaacgtttcattatctcagaaaacagtgaaaatacaccgtctttttcctatgctggctttctcagagccctatgagtttgtttctctggaatggctgcagaaatggctggacgagtccacccctaccaaaccaatcgataatcatgcttgtctgtgtagccatgacaaactccacccggataaaattagcattatgaaaagaatctcggagtatgcagctgacatattctactctagatatgggggaggccctcgtctgactgttaaggctctctgcaaagagtgtgttgtcgaaagatgccggatcctgagactgaagaaccaactgaacgaagattataagacagtgaataatcttttaaaagcagccgtgaagggcgacgggttctgggtcggtaagtcctcactgcggtcttggcgccagctggcactggagcagctggatgagcaggatggtgacgccgagcagtctaatggcaaaatgaatgggtccactctcaataaggacgagtcgaaggaagagcgcaaagaagaagaggagcttaacttcaacgaagacatcctttgcccgcatggcgaactatgcatttcagagaacgaacggagactcgtttcgaaagaggcatggagtaagttacagcagtacttcccgaaggcgcccgaattccctagttacaaggagtgttgtagccagtgtaagatcctggagcgcgaaggcgaagaaaacgaagctcttcataaaatgattgcaaatgagcagaagacttcacttcccaatctgttccaagacaagaatcggccttgtctgtcaaactggccggaggacactgacgtgttatatatcgtttcacagttcttcgtagaggaatggagaaagtttgttcgaaaacccaccagatgcagccccgtaagcagtgtgggaaatagtgccctgctttgcccccacgggggcctcatgtttacctttgcctctatgacaaaggaagattcaaaactgattgcacttatttggccttctgaatggcagatgatccagaaattgttcgtggtcgaccacgtcatcaagattaccaggattgaagtgggggacgtgaatccaagcgaaacacagtacatttccgaaccgaaactgtgtcccgagtgccgagaggggttgttgtgtcaacaacagcgggacctgagggagtacacgcaggccaccatctacgtccataaggtagttgacaataaaaaagtcatgaaagactctgctcccgaattgaatgtgtctagctccgagactgaggaggataaggaagaagcaaagcctgatggggaaaaggatcccgattttaaccaaattatgcacgcctttagtgtggctccttttgatcaaaacctctcgatcgacggaaagatattgtctgatgactgcgccacgctgggaaccttgggcgtgattcccgagagcgttattctgcttaaggctgatgaacccatcgcagattacgctgccatggatgatgtgatgcaggtatgcatgccagaagagggcttcaagggcaccggattgctgggccactag

SEQ ID NO: 15478 - DNA, 984 bp, Artificial Sequence
  Description of Artificial Sequence: Synthetic coding sequence
atgactgctgtgggcgcggagagactgacgtcggtccgggcatggctgtcctgctgtggcgcctgcgtatgtgtattcctgttcttgtgtctgtgtgttttcccactgagggtgcacgtccatgtatggggaggcgaatgcagggtggatattgcagtctttgtgtccaagcacatgatcgtggcactgatgcacgtgaccggcgctgcgggcctgctaagactttgtgtcagggcatgcgtatgcatgcgggtgtgtgcgacagcccatatgtaccgcgtggacaagtcgtttacatcacgccgtagtgtgtggcggtcagatggccagaaccagcactttccccaggctctggatctatccagagtgaacctggtgccgagctacactccctcactgtatcctaagaacaccgatctgttcgaaatgatagagaagatgcagggctctaggatggatgagcagagatgttcctttccccccccactgaaaaccgaggaggactacataccttaccccagcgtgcacgaagtgctcgggcgggaaggtcccttccctctcatcctgctccctcagtttggaggctactggattgagggtaccaaccatgaaataactagcatacctgagaccgagcccctgcagtcgcctacaaccaaagttaagctggagtgtaatcccactgcaaggatttatcggaagcacttcctgggaaaggagcatttcaattattattcactggacgccgcgctcggccatctggtgttttcacttaaatacgacgtgattggagatcaagagcacctgagattgctcttgaggacaaaatgtaggacttaccatgacgtgatccctatatcctgtctaacagagttcccgaatgttgtccaaatggccaagctggtgtgtgaagatgtgaatgtagatagattctatccagtgctgtatcctaaagtgtggctagacttgggtaccgcacactag

SEQ ID NO: 15479 - DNA, 2079 bp, Artificial Sequence
  Description of Artificial Sequence: Synthetic coding sequence
atgattgaaaagatgcagggttcccggatggacgagcagcgatgcagcttcccacctcctttgaagactgaggaggactatataccttatcccagcgtgcatgaagtgcttgggagggaagggccatttcctctcatactcctgccccaatttggagggtactggatcgagggaaccaaccacgagatcacatccattcctgaaactgagcccctacagtccccaacaacgaaagtcaaactggaatgcaatcccaccgctagaatctatcgcaagcacttcctgggcaaggaacattttaactattattctctcgacgccgcactgggccatctcgtgtttagtctgaaatacgacgtgataggcgaccaagaacacctgcgattactgttgcgaactaagtgtagaacgtaccacgacgtgatcccgatctcttgcctgactgaattccccaacgttgttcagatggcaaaactagtgtgcgaagacgtgaatgtcgaccggttttacccagtgctctatccaaaggccagtaggctgatcgttacatttgatgagcacgtgatttcaaacaacttcaagtttggcgttatctaccagaaacttggtcaaactagcgaggaagaactgttcagtactaatgaggagagtcctgcttttgtggagtttctcgagtttctgggccagaaggtcaaactccaggattttaaggggttccggggcggcctggacgtgactcacggccagacaggcacagaaagtgtttattgtaacttccgaaataaagagataatgtttcatgtaagtacgaagctcccgtatactgagggggacgcccaacagctccagcgcaaaagacatattgggaacgatattgtggctgtggtattccaagatgagaatacccctttcgtccccgacatgatcgcgtctaatttccttcatgcttacgtggtggtacaagcagagggtggaggaccagatggtcccctgtacaaagtgagtgtaactgccagggatgacgtgcccttcttcgggccccctttgcccgatcctgctgtcttcaggaaaggtcctgagttccaggagtttctgctcacaaaattaatcaacgccgagtacgcctgttacaaggccgagaaattcgctaaactcgaggaaagaactcgagctgctcttctggaaactctgtatgaggagctccatatccacagccaatcaatgatgggtctgggtggtgatgaggataagatggagaatgggagcggagggggcggtttttttgaatcatttaaacgggtgattagaagccgctctcagtcaatggacgccatggggctatcgaacaagaaacccaacacagtctctacctctcatagcgggtcctttgccccgaacaatcccgatctggccaaagctgctggaatcagcctgctgatacccgggaaaagcgcttctcgcttcggcagacgagggtctgcgattggtattggcacagttgaggaggtggtggtgcgaggcgccgcaggctccggtggatgtctccatgcactgttttcagctcgctctcaagacggagggcacatcggagacgtcgctccattgcctcctggccaggccccaggacgggctggatggtctggagggagttctgatggcacgcaacatctgctgtggggcttgagtctgatcgtacccggcaagtcccctactcgcaagaaatcagggccatttgggtcccgaaggtcatctgctataggaatagagaacattcaggaagtccaagaaaagcgggaaagcccacctgctggacaaaagacacccgactcgggccacgtttctcaagaacctaagtcagagaatagttcaacacagtcatcccccgaaatgcccacgactaaaaatcgagccgagactgccgcccagcgcgccgaggcactgaagttaccattactcgtgcagtgccagcagctccggcagcggggaggcggggacggaggatgtggacgaagagggcatcgtcccggcgaaagggtgattctgagaaatacgccacaggccggactgctgcacctctag

SEQ ID NO: 15480 - DNA, 2085 bp, Artificial Sequence
  Description of Artificial Sequence: Synthetic coding sequence
atggcccaactaagaccagcagtgcccccaggtcgcccccgaaggggatccctccccgctggcgcttcatggcaaaatacagacctcttcgaaatgatagagaagatgcagggttctagaatggacgagcagcggtgttctttccccccaccattgaagaccgaggaagattacatcccctacccttctgtccacgaagtcctgggccgggaggggccatttccgcttatactgttaccccagttcggaggatactggatcgaggggaccaatcatgaaatcacttccatccctgagactgagcctctccagtcacctaccacgaaagttaagctggagtgtaatccaaccgctcgcatctaccgaaagcattttctgggtaaagagcactttaactattatagcctcgatgcagctttgggtcacctggtcttctccctaaagtacgatgtaattggtgaccaggaacatctgcgcctgctgctgcgtaccaagtgcaggacgtaccatgacgttattcccattagctgcctgacagaatttccgaatgtggtgcaaatggcaaaactggtgtgtgaggacgtgaatgtggatcgtttctacccggtactttacccaaaagctagccggttaattgtgaccttcgacgagcacgtgatcagcaataattttaaattcggcgtcatttatcagaaactgggccagaccagcgaagaagagctattctcaacaaacgaggaaagtcccgcttttgtagagtttctcgaatttttaggacagaaggtcaaactccaggattttaagggattccgcgggggattggacgtaactcatggtcagactggaaccgaatccgtatactgtaacttcagaaacaaagagatcatgttccacgtgtcaacaaaacttccctacacagagggtgatgcacagcagctgcagagaaagcgccatattggcaacgacattgtggcagtcgttttccaagatgagaacactccatttgtacccgacatgatagctagcaacttcctgcatgcttatgttgtagtccaagccgagggaggcggccctgatggcccgctgtacaaggttagtgttaccgcccgggacgatgtgcccttttttggtccacccctgccagatccagctgtcttccgtaagggccctgaatttcaggagttcctcttgacgaagctcataaatgccgagtacgcctgctacaaggctgagaagttcgccaagctggaggaacgaacccgggcagccctgctggagactctttacgaggaactgcatattcactcccaatcaatgatgggtctcggcggggacgaagacaaaatggagaatggctcagggggcgggggattctttgaaagtttcaagagagtcatccgatctagatcccagtctatggacgccatgggcctatctaataagaagcctaacacagtctccacatcgcattcaggcagcttcgcacccaataatcctgatctggccaaggccgccggcatctcgctgattgtgcccggcaagagccctacacgtaagaagtctgggccatttggtagccggcggtcaagtgccatcggaatcgagaacattcaggaggtgcaggaaaagcgcgaatctcctcctgcgggtcagaaaacaccggactctggacacgtgtcacaagaaccgaagagtgaaaacagtagcacccagtcatcccctgaaatgcctactactaaaaacagggcagaaacggctgcccagagagctgaagcgttaaaagatttcagccggagctcttctagtgccagttcttttgccagcgtcgttgaagagacagagggtgtggacggcgaagacacaggtctggaatcggtctcatcctccggcaccccccacaagcgggacagcttcatttattccacgtggctagaggattcagtttctacaaccagcggggggtccagtcccggcccgagccgaagcccacatccagatgcaggcaagcttggcgaccctgcttgccctgagataaaaattcagttagaggcgagcgaacagcatatgccccagctagggtgttag

SEQ ID NO: 15481 - DNA, 2082 bp, Artificial Sequence
  Description of Artificial Sequence: Synthetic coding sequence
atggcccagctcagacccgcagtacccccaggcagaccaagacggggctcgctgccagctggcgcatcgtggcagaacaccgacttatttgagatgattgagaagatgcagggttcccgcatggacgaacagcggtgtagtttccctcccccattaaaaactgaggaggattacatcccctacccgagcgtccacgaggttctgggtcgcgaaggcccttttccacttatcctgctcccacagttcggcggctactggattgaaggtacaaatcatgagatcacctctatccctgagactgaacccctgcagtctcctacaactaaagtgaaacttgagtgtaatccaacagcccgaatctatagaaagcacttcctcgggaaggaacacttcaactactatagtctggatgcagccctgggtcatcttgtcttcagcctgaagtatgacgtgattggcgatcaggaacatctgaggctgctgctaaggaccaagtgtagaacataccacgacgtgatcccaatcagctgcctgaccgagtttccaaacgtggttcaaatggctaagctcgtgtgtgaagatgtgaacgtggataggttctacccagtgctgtacccaaaagcctcccggctaatagtgacattcgacgagcacgtgatcagtaacaacttcaagttcggcgtgatctaccagaagttggggcaaacctctgaggaggagttgtttagcactaatgaggaatcacccgcttttgtggagttcctcgagttcctgggacaaaaagtgaagctgcaggactttaagggtttccgggggggcctcgacgtgacccacggccagaccgggaccgaaagcgtctactgtaatttccggaacaaggaaattatgtttcacgtgtccaccaagctgccttacaccgaaggcgatgcacagcttcaacggaagcggcacattggcaatgacatcgtcgccgtggtgttccaggacgagaatacaccctttgtgcccgatatgatagccagtaacttcctccacgcctatgtggtcgttcaggccgaaggggggggccccgacggcccattgtacaaagtgagcgtgaccgctcgcgacgacgttccttttttcggcccccccctgccggacccagctgtattccgcaaagggcctgagtttcaagagtttctgcttactaaactgatcaatgcagagtatgcgtgctacaaggcagaaaaatttgcaaagcttgaagagagaaccagagccgccttgcttgagacattgtacgaagaactgcacattcactcccagagtatgatgggacttgggggtgatgaggataaaatggaaaacggaagcggtggtgggggatttttcgagagttttaaaagggtgattcgatcgcgctcccagtctatggacgctatggggctgagcaataagaaacccaacacagtgtcaactagccactccggaagtttcgctccgaacaaccctgatctcgccaaggccgccggaattagtcttattgtccctggcaagtctcccacccgcaaaaagagtggaccattcggcagccgccggagcagtgccattggcatagagaacatccaggaggtgcaggagaagcgtgaatctccccccgctggccagaagacacctgattcaggccacgttagccaggaacccaaaagcgagaacagcagtacacagagcagcccagagatgccgaccacaaagaaccgcgctgaaactgctgcccagagggcggaggctctgaaggatttcagccgcagctctagcagcgcaagtagctttgccagcgtcgtggaagaaactgagggagtggatggcgaggatacaggcctggagtccgtcagcagctctggaaccccccataagcgggattcgttcatctattcaacctggctggaggacagtgtgagtaccacgtccggcggctcatctcctggtcccagccgcagtccacatcccgatgccggtaagcttggtgaccctgcatgtccggagattaagattcagcttgaggcttctgaacaacacatgccacagttaggctgctag

SEQ ID NO: 15482 - DNA, 1992 bp, Artificial Sequence
  Description of Artificial Sequence: Synthetic coding sequence
atgattgagaaaatgcaggggagccgaatggatgaacaaaggtgttcattcccaccacccctgaagaccgaggaggattatattccttatcctagtgttcacgaagtcctcggccgtgagggccccttccctctcattttgttgccacaattcgggggctactggatcgagggaacgaatcacgaaatcacctcaattcccgaaaccgagccgcttcagagccccacgactaaggtgaagctcgaatgcaatcctaccgcccgtatttatcgcaagcactttctgggcaaagaacattttaactactattcattggatgccgcccttggccacttggtattctcacttaaatatgacgtgatcggtgatcaggaacacctccgattgttactccgcacgaagtgtaggacataccatgatgtgattcctatctcttgcttgacagaattccctaacgtggtccagatggccaaactggtgtgtgaggatgttaacgtagaccgcttctaccctgttttgtatccaaaggcatcacggctcatcgtcacgttcgacgagcacgtaatttcaaataatttcaaattcggtgttatttaccagaagttgggacagacatccgaagaggaactctttagtaccaatgaggagagtccggctttcgtggagttcctggaatttcttggccaaaaggtgaaactccaggatttcaagggatttcgcggcgggctggacgtcacacacggtcagaccggcacagaatcagtgtactgcaactttcgtaacaaggagatcatgtttcacgtttcaactaaactcccctacacggagggtgatgcgcagcagctccagcggaaacgccatattggcaacgacatcgtggcagtggtgtttcaagacgagaatacaccatttgtgccggatatgatcgcaagcaatttcctgcatgcctacgtggtcgtgcaagccgaggggggtggtccggacgggcctttgtacaaggtttccgtcactgccagagatgacgttcccttttttggccctccgctccctgatcccgccgtgttccgcaagggacccgaatttcaggagtttcttctgaccaagctgattaatgcagagtatgcatgttacaaggctgagaagttcgcaaaattagaggagaggacgcgagcagccctgctggagaccctgtacgaagagttacacatccatagtcagagcatgatggggctgggcggagacgaagacaagatggagaacggtagtggaggcggggggtttttcgagtccttcaagcgagtcattcggtctagatctcagtctatggatgccatgggcctttctaacaagaaacctaatactgtcagcacgtctcactccggaagctttgctcccaataaccctgatctagctaaggcagctggaatctcactgatcgtacctggaaagtccccaactcgcaaaaagtccggccctttcggctcacggagaagcagcgctataggaatcgagaatatacaggaagtgcaggagaagcgcgagtctccccccgctggacagaagacacccgatagcgggcatgtgagccaggagcccaagtccgagaacagttcaacacagtcctcacccgagatgcccacgacaaaaaaccgggccgaaaccgctgcgcagagggcagaggccttgaaagatttctcacgaagctcatcaagtgcatcttcatttgcgagtgtcgttgaggaaaccgaaggagttgatggagaggacaccggtcttgagagcgttagcagcagcgggaccccacataaacgtgactcatttatttattctacctggctagaggatagcgtgtcgacaacatccggcggatccagccccggtccttctaggagcccgcaccctgacgccggaaaactcggggacccggcgtgtcctgaaattaagatacagctggaggctagcgagcaacacatgccgcagctgggttgctag

SEQ ID NO: 15483 - DNA, 744 bp, Artificial Sequence
  Description of Artificial Sequence: Synthetic coding sequence
atgctcgtcctcagatctgctctgactcgcgctctggcctctaggaccctcgcaccacaaatgtgctcctcctttgctactggacccaggcaatatgatggtattttttacgaattccgatcctactatctgaagccgtcaaagatgaacgagttcctcgagaacttcgaaaaaaatgcgcatcttcgtacagctcattctgaattggtgggttactggtccgtggaattcgggggtcggatgaacaccgtgtttcatatttggaaatatgataacttcgcccaccggaccgaggtcaggaaagccctggccaaggacaaagaatggcaggaacagttcttgattccaaatctggccctgattgataagcaggaatctgagattacttacctagttccatggtgtaagctggagaagccacctaaggaaggcgtgtatgagctggcgaccttccagatgaagcctggtggcccggccctgtggggagatgcgtttaagcgggcagtgcacgcccacgttaacctcggctacacaaaactcgtgggggtcttccatactgagtacggagctctgaaccgggtccacgtgttgtggtggaacgagagcgctgatagccgggcagccggtcgccacaagtcccacgaggaccctcgggtagttgctgctgtgcgggagagcgtaaactatctggtctcccaacagaatatgctcctcattccaacctcttttagtcctctgaagtag

SEQ ID NO: 15484 - DNA, 3594 bp, Artificial Sequence
  Description of Artificial Sequence: Synthetic coding sequence
atgcacataaagagtataatacttgaggggttcaaatcctatgctcagcgcacagaggtgaatggtttcgaccctctgtttaacgcaattactgggctaaatggaagtggaaaaagcaacatactggacagtatatgttttctgctgggcatctccaacctatcacaggtcagagcttccaatctccaggacctggtgtataagaatggccaggcgggcattacaaaggcatccgtcagcatcacattcgataactctgataagaagcaaagtccccttggatttgaggtgcacgacgagattaccgtgacccggcaggtggtaataggcggacgaaataagtacctcatcaacggcgtgaacgccaacaatactcgagtgcaggacctgttctgctcggtagggcttaacgtaaataaccctcactttctcataatgcagggaagaattacaaaggtgctgaatatgaagcctccggagattctgtctatgattgaagaagccgccggcacccggatgtatgaatacaaaaagatcgcagctcaaaagacgattgaaaaaaaagaggctaaattgaaggaaatcaagaccatactcgaggaggagatcactccaaccatccagaagctgaaagaagaacggagcagttacttggaatatcagaaggtgatgagagagattgagcatctgtccagactgtacatcgcatatcagttcctcttggcagaggatactaaagtgcgctctgctgaagaactcaaagagatgcaggataaggtgataaaactacaggaggagctcagcgagaacgataaaaaaatcaaggcactcaatcatgagatagaggagctggagaagagaaaagacaaggagaccggaggcattttgcgttccctagaggacgctttggccgaagcccagagagtgaacacgaagagccagagcgccttcgatctaaagaagaaaaacttagcttgcgaggaatctaaacgcaaggagcttgagaagaacatggttgaagatagtaagacactcgcggctaaggagaaggaagtgaaaaaaataactgacgggctccacgcactgcaggaagcctccaacaaggacgccgaggccctcgcggccgcccaacagcactttaatgcggtctcagccggcctgagcagtaatgaggatggcgccgaggccacactggcaggtcaaatgatggcctgcaaaaatgatatctctaaagcccagaccgaagctaagcaggcccaaatgaagctgaagcacgcccagcaggagctgaaaaataagcaggctgaggtcaagaagatggactcagggtacagaaaggatcaggaggctctagaggccgtgaagagactgaaagagaagctggaggccgagatgaaaaaactcaactatgaggagaacaaggaggagagtttgctggagaaaagacgtcagctgtcgagggatatcggccggttgaaagaaacgtacgaggctctgcttgccagatttcccaacttacgcttcgcttacaaagatcccgagaaaaactggaatcgaaactgcgtcaaaggcctcgtcgccagcctgatctctgtgaaggacacgagtgccaccaccgcactggagctcgtagccggcgagaggctctacaacgtcgtggtcgatactgaggtgacaggtaagaaactgcttgagaggggtgaactcaagcgccgttacacaatcattccactcaacaaaatctctgcgcggtgtatagctcccgagacgttacgcgtggcgcagaacctggtgggcccagacaatgtacatgtagccttatcactggtggaatacaagcctgagctgcaaaaggccatggagttcgtgtttggtacaaccttcgtgtgcgacaatatggataacgccaaaaaagtcgcattcgacaaacggatcatgaccagaaccgttacgctcggcggagacgtttttgacccacacgggaccctgtccggaggcgcccggtcccaggcggcctcaatactgaccaagttccaggagcttaaagacgtacaggatgagttgcgaataaaagagaacgaactgagagccctggaggaggaactcgctggcctgaagaacacagcagaaaaatacaggcagctaaaacaacaatgggagatgaagacggaggaagccgacctgctccagaccaaactccagcaatcttcttaccacaagcaacaggaggagttggatgccctgaaaaagactattgaagaatctgaggagacactgaagaataccaaagagatccagcggaaagcagaggagaagtatgaggtcttggaaaataaaatgaaaaatgcagaggccgaaagagagagggagctgaaagacgctcagaaaaaactggattgtgccaaaaccaaagctgatgcatctagtaagaagatgaaagaaaagcaacaagaggtagaggctatcacgctggaacttgaggagctgaagcgcgaacacacctcttacaaacagcaacttgaagcagtcaatgaggccattaagtcttacgaatcccagatcgaggtcatggcagccgaggttgcgaaaaataaagagtccgtgaacaaggcacaggaggaagtcacaaaacaaaaggaagtgataaccgcccaggacacagtgataaaggccaagtatgcggaggtcgcgaagcacaaggagcagaataacgattcacagctcaagattaaagaactcgaccacaatatctccaagcacaaaagggaggccgaagacggtgcggcaaaagtgagtaaaatgctgaaagactatgactggattaacgccgagcgccacttgttcggccagccaaactcggcatatgactttaagacaaacaatcccaaagaggctggccaacgcctgcaaaagctgcaggagatgaaggagaaactgggtcgtaatgtcaatatgcgagccatgaatgtgctgacagaagcagaggagcgctacaatgacctgatgaaaaagaaaagaattgtggaaaatgataaatctaagatccttactacaatcgaggacctcgaccagaagaaaaaccaggccctgaacatcgcgtggcagaaggtcaacaaggactttggatccatcttttctactctgttacccggggcgaacgctatgctggccccccctgagggccagacggtgctggatggactcgaatttaaagtggcgttgggtaatacttggaaagaaaatctgacggagctgtccggtggtcaacgctcactcgtggccctttccctgatcctatctatgctcctgtttaaaccagctcctatctacatcctcgacgaggtggacgcagcgttagatctgagtcacacacagaacattggacaaatgctccgcacccacttcacccacagtcaattcatcgtggtatctttgaaggaaggtatgtttaacaatgctaatgtgctttttaagactaaatttgtagacggagtaagcactgtggccaggttcacacagtgccagaatgggaagatttctaaagaagccaaatcaaaggccaagccgcctaagggggcccatgtcgaggtttag

SEQ ID NO: 15485 - DNA, 3594 bp, Artificial Sequence
  Description of Artificial Sequence: Synthetic coding sequence
atgcacattaagtccatcatcctagagggatttaaatcttacgcgcaacgaaccgaggttaacggctttgaccctttattcaatgccattacagggctgaatggcagcggcaaatccaacattctcgactcaatctgttttctgctgggcatttctaatctgagccaagtaagagcctcaaacctgcaagacctagtgtacaagaatggccaggctggcattacaaaagcctcagttagcatcacctttgacaactccgataaaaaacaatcacccctagggttcgaggtgcacgacgagattactgttaccagacaggtggtcataggaggtcgaaataaatacctgatcaatggggtgaacgccaacaacacacgggtgcaagacctgttctgcagcgttggactgaacgttaacaatccacacttcctgattatgcagggtcgaataactaaagttttgaacatgaaaccccccgagattttgtctatgatcgaagaggcagcagggactcgcatgtatgaatataaaaagattgctgctcaaaaaaccattgagaaaaaggaggctaagctgaaagagattaagaccatcttggaggaggagattaccccaactattcaaaagcttaaggaggaacgtagctcatatcttgagtaccagaaagtaatgagggaaatcgaacaccttagtcggttgtatattgcctaccaatttttactggctgaggatactaaggtgcgctccgctgaagagttgaaggaaatgcaagacaaggttatcaagcttcaagaagagctgagtgagaacgataagaaaatcaaggctctaaatcacgaaatcgaggagctagagaagagaaaggataaggagacaggtggaatcctgaggtcattggaagatgcgttggccgaagcgcagagagttaatacgaaatcgcaaagtgcatttgacttaaagaagaagaatcttgcatgtgaagagagcaagagaaaagaactggaaaagaatatggtcgaagattctaaaacacttgcagccaaggaaaaggaggtgaaaaagatcaccgacgggttgcacgccctgcaggaggctagcaacaaagacgctgaggcattggccgctgcccaacagcatttcaatgcagtgagtgctggactttcctcgaatgaagatggcgctgaggccactctggccggacagatgatggcatgtaaaaacgatatatctaaagcccaaacagaagctaaacaggcacaaatgaaactgaaacacgcgcagcaagaactgaagaacaagcaggcagaagtgaaaaagatggatagcggttacagaaaggatcaagaggctttggaggcggtaaagcgactgaaggagaaactcgaggcagagatgaaaaagctcaattacgaggaaaacaaagaagagtccctactggagaagaggcgtcagttatcccgagacatcggcagactgaaagagacgtatgaagcccttctcgcgcgatttccaaacttaagatttgcctacaaggacccagaaaagaattggaaccgcaattgtgtcaaaggtctcgttgcttctctcatctctgtcaaggatacatctgccacaaccgcccttgaactagtggcaggcgagcgcctgtataacgtcgtcgtagatactgaagtaactggaaagaagctcctggagcgcggggaactgaagcggaggtatactataatccccctcaataaaatctcggcgcggtgcatagcccctgaaactctgcgggtcgcacagaatctcgtaggtcctgacaatgtgcacgtggccttgtcacttgtggagtataagccggagttgcaaaaagctatggaattcgtatttggtacaacttttgtgtgcgacaacatggacaatgccaagaaggtggccttcgataagaggattatgaccaggacagtgacattggggggcgacgtattcgacccccatggcactctctcaggaggcgctcggtcccaggcagcctctattctcaccaaatttcaagaactaaaagatgtgcaggacgaactgcgcattaaggagaacgaactcagagctctcgaggaggaactggccggtcttaagaacacagccgagaaatacaggcagctgaagcagcaatgggagatgaaaacagaggaggccgatttgctgcagacgaagttgcaacaatcaagctaccacaaacagcaggaggaactcgatgccctgaaaaaaaccatcgaggaaagcgaggagactctgaagaacactaaggagatccagagaaaggcggaggagaaatacgaagtcctcgagaacaagatgaagaatgccgaggccgagagagaaagggagttgaaggacgcccagaaaaagctggattgcgctaaaactaaagctgatgcctcatccaagaagatgaaagagaagcaacaggaagtggaggctatcactctagaacttgaggagctcaaacgcgaacacacctcatataaacagcagttggaagcagtaaacgaggccatcaaaagctacgaatctcagattgaagtcatggccgcagaagtcgctaagaataaagaatccgtgaacaaggcccaagaggaggttacaaaacagaaagaggttattaccgctcaagacacagtcatcaaagccaagtacgcagaagtggcgaagcacaaagagcagaataatgacagccagttaaagatcaaggaattagaccacaacataagcaaacataagagggaagctgaggacggtgcagcaaaggtgagtaagatgctgaaggattacgactggattaacgctgagcgccatctgttcgggcagcctaactctgcttacgactttaagacgaataacccaaaggaggccggccagaggctgcaaaagctacaagagatgaaagagaaactcggccggaacgtgaatatgagagcgatgaacgtcttgaccgaagccgaggaacgatataatgatctcatgaaaaaaaaacggatcgtcgagaacgacaagtcgaagattctgaccaccatcgaagatcttgatcagaagaaaaatcaggcccttaacatcgcttggcagaaagttaataaagatttcggatcaatcttctccactcttctgcccggagccaacgctatgctggcccctccggaaggacaaactgtgctcgacggcctggagtttaaagtggcactcggcaacacatggaaggagaacctaaccgagttgtctgggggacaacgcagtctggtggctttgtcactcatactgtcgatgctcctgttcaagcctgcccctatttacattctggacgaggtcgatgccgctttggatttgagccacacacagaacatcgggcaaatgctacgcacccacttcacccactcccagtttatcgtggtgagccttaaggaggggatgtttaataacgctaatgtgcttttcaagactaaattcgttgatggtgtaagcactgttgcaaggttcactcagtgccaaaacgggaaaatcagcaaagaggcaaagtccaaggccaagcctccaaagggggcccacgtcgaggtctag

SEQ ID NO: 15486 - DNA, 1047 bp, Artificial Sequence
  Description of Artificial Sequence: Synthetic coding sequence
atgtcgctgcctaggttccagcgggtaaatttcgggccctatgacaactatattcctgtatccgaactttccaagaaaagttggaatcaacagcatttcgccctgctgttccccaaaccacagcgccccggcacaaaaagaaggagcaaacccagtcagattagggacaatacagtctccatcatagatgaagagcaactgcggggcgaccggcgtcagcccctctggatgtacaggtccctgatgcggattagtgagcgcccatctgtgtatctcgccgcacgccggcagcctctcaaaccgacacggaccgtcgaggtggactctaaagccgcagaaattggaaagaagggcgaagataagacaacacagaaagatacgaccgacagcgagtccgaacttaaacagggtaaaaaggattccaagaaaggaaaggacattgagaaggggaaggaagagaagttagacgccaagaaggattctaaaaaggggaaaaaggacgcggagaagggcaaggacagcgccactgaatcagaggatgagaagggcggcgcaaagaaggacaataaaaaggataaaaaagatagcaacaaaggcaaagatagcgccactgaatcggaaggagagaaaggtggcacagaaaaagattcaaagaaaggaaaaaaggactctaagaaggggaaagactcggcaatcgaattacaggccgtcaaagctgatgaaaagaaagatgaggatgggaaaaaggacgcgaataagggggatgaatccaaggatgcaaagaaggacgccaaagagattaaaaaggggaagaaagacaagaaaaagccaagctcaacggattctgactccaaggatgacgtgaagaaggaaagtaagaaagatgctaccaaagacgccaaaaaagtggccaagaaagacaccgagaaggagtctgccgacagcaaaaaggatgctaagaagaatgcaaaaaaagatgccaagaaagacgcaaaaaaaaatgccaaaaaggacgaaaaaaaggatgctaaaaagaagggcaagtag

SEQ ID NO: 15487 - DNA, 1515 bp, Artificial Sequence
  Description of Artificial Sequence: Synthetic coding sequence
atgaacagccaacctcagactcgttctccattcttccagaggccccagatccaacctccacgggctactatccccaattcttctccatcaatcaggcccggagcgcagacgcccactgccgtgtaccaggcaaaccagcatatcatgatggtgaatcatttgccaatgccataccccgtccctcagggcccacagtactgcattcctcagtatcgccacagtgggcctccttatgtgggtcctccccagcagtacccggtgcagccccctggacctgggcccttttatccaggaccaggaccaggggactttcccaatgcgtacggcactccattttacccatcacagccagtttatcagagcgcccccattatagtgcccacgcagcagcagcccccacccgctaagcgcgaaaaaaaaaccatcagaattagagaccctaatcagggcggtaaagatataactgaagaaatcatgtcaggaggtggaagccgcaaccccacgccacctatcggtagacctacaagcacaccgacccccccacagcagctgccaagccaagtccctgagcactccccagtggtctatggaacagtggaatcagcccatctggcagcttccacgcctgtaacagccgcctctgaccagaagcaagaggaaaagcctaagccggaccccgtgctgaaaagccctagcccagtcctgcgactggtcctctccggtgagaaaaaggaacaggaaggtcagacctctgaaaccaccgcaatagtgtccatcgctgagctccctctccccccatctccaactacagtgagcagtgttgcacggtccactatagccgccccaacatcgtctgcgctgtcatcacaaccgattttcacaacagccatcgacgatagatgtgaactgtccagtccgcgcgaggataccatcccgattccatctttgacatcctgcactgagacatctgaccctctgcctaccaatgaaaacgatgacgatatctgcaaaaagccatgctctgtcgctcctaatgatataccactcgtctcaagcacaaacctgattaacgagattaatggggtgagcgagaagttatctgcaactgaaagtattgtggaaatcgtcaagcaggaagtgttgccactcactctggagcttgagatactggaaaatcccccagaggagatgaagctcgagtgtattccagctcccatcacaccaagtaccgtcccttcgttccctcctacaccccctactccgccagctagccccccgcatacaccagtcattgttcccgcagcggccacaaccgtttcatctccaagtgcggccatcaccgtacagagggtgctggaagaagatgagtctattagaacttgcctgagcgaggatgctaaggaaattcagaataagatagaggtggaggcggacggacaaacagaggagatcctggattcccagaacctgaatagccggcggagcccagtacccgagacgtcaaacgagtgttag

SEQ ID NO: 15488 - DNA, 744 bp, Artificial Sequence
  Description of Artificial Sequence: Synthetic coding sequence
atgctgaaattccttgtatggttcttacaatggtgtgtgtgtgttctggtccagcctgccaaggaactgctgcactgtctgaaaatgcagatgcgaatatcaaagtacacaaagtgtttgcaagctcagattgccatcaccgtgccaaagacctggaaaaaacccaaggaccgaactaggactaccgaagagatgctcgaagccgagctggagctgaaagcggaggaagaactgagtattgacaaggtgctggaatcagagcaggacaaaatgtctcaggggttccacccagaacgcgatccctcagacctcaagaaggtgaaagctgtggaggagaatggcgaagaggccgagcccgtgaggaacggcgcagaatctgtctcggaaggggaaggtatcgatgctaacagcgggagcaccgattcatccggcgacggtgtcaccttcccttttaagcctgaatcttggaagcctaccgatactgagggtaagaaacagtatgacagggagtttctgctggattttcagtttatgcccgcctgtattcaaaaacccgaaggacttcctccgattagcgatgtggtactggacaagatcaaccagcctaagctgcccatgcgcaccctggacccacgaatactcccgcgtggacctgactttactcctgcctttgctgactttggccgccagacgcccggtggaaggggggtgccggtctctgccagttccctgcaactgacctag

SEQ ID NO: 15489 - DNA, 3918 bp, Artificial Sequence
  Description of Artificial Sequence: Synthetic coding sequence
atgaattcacaaccacagactcggagcccattctttcaacggccacagatccagcctcctcgcgccaccatcccgaattcatcaccctccatacggccaggtgcacagaccccaaccgctgtctaccaagccaaccagcatataatgatggtaaaccatctgcccatgccgtatcccgtaccccaaggtccgcagtactgcatccctcagtaccgccattcaggcccaccctacgtcggaccaccacagcagtatcctgtgcagcctcccggtcccggacccttctaccctggaccaggacctggggattttccaaatgcgtacgggacgcctttctaccctagccagcccgtgtaccaaagtgcacccatcatcgtgccgacacagcagcagccccccccggctaaacgagagaagaagaccatcaggattcgtgaccctaatcagggcgggaaggatattaccgaggagattatgagtgggggggggtctcgcaatccaaccccccccatcggcagacccacaagtactcccactcccccccagcaacttcccagccaggtgcctgagcactcacccgtagtttatggcactgtagagtccgctcacctcgcagctagtacacctgtgaccgcggcgtcagatcagaagcaagcccagattgctataacagtgccaaaaacctggaaaaagcccaaagataggacccggacaactgaagagatgctggaggctgaactcgaactaaaggcagaggaagaattatcaattgacaaagtgctggaatcggaacaggacaagatgtcccaaggtttccatcccgagcgcgatccgtctgatttgaagaaggtcaaggcggtcgaagagaacggagaagaggcagagccagtgcggaatggagccgaatccgtctccgagggtgaggggattgatgcgaacagcggatcaacagattcctcaggggacggtgtgaccttcccattcaaacccgaaagctggaagccaacagacaccgaaggaaagaaacagtacgatcgcgagttcctgctagatttccagttcatgcccgcgtgtatccaaaagcctgagggtcttccgcccatttcagacgtcgtcctcgataagattaaccagcctaagcttcccatgaggactctagaccctcggatactcccccggggacccgactttacacctgcattcgccgatttcggacggcagacccctggagggcgaggggtgcccctcctcaatgtgggctctcggcgttctcagcctggccaaagaagggagccacgcaagatcataacagtaagcgtaaaggaagacgtacatctgaagaaggccgagaacgcttggaagccctctcaaaaacgagattcccaggccgacgaccctgaaaacatcaaaacacaagagctgttccggaaggtgaggagcatactaaataaactcaccccccagatgttcaaccaattaatgaagcaagtctctggtctgacagtggacactgaagaacgactaaaaggtgttatagatctggtatttgagaaagctatagatgaacccagtttctctgtggcctatgccaatatgtgccgctgccttgtcacattgaaagtgcctatggccgataagccagggaataccgtgaacttccggaagcttttacttaatcgatgccagaaggaatttgagaaggacaaagccgacgacgatgtcttcgagaaaaagcaaaaggaactggaggcggctagtgcgcccgaagagcgtacccgcctgcacgatgagctcgaggaagcaaaggacaaggccaggcgtcggtcaatcggcaacattaagtttattggcgagctcttcaagttgaaaatgctgactgaggcaattatgcacgactgtgtcgtaaagctgctcaaaaaccacgatgaagaatccctcgaatgcctgtgccgactccttaccacaatcgggaaagaccttgacttcgagaaggccaaacccagaatggaccaatactttaatcagatggagaaaatcgtcaaagagcgtaagacctcctccagaataagattcatgcttcaggatgtcatcgaccttcgactatgcaattgggtgagcaggagggcagatcaggggcccaagactatcgaacaaatccataaggaggctaagattgaggagcaggaagaacagcgcaaggttcagcagctcatgactaaggagaaaagacgtccaggggtgcagcgggtggatgagggagggtggaatacagtacaaggagctaagaattcccgggtcttggacccttcaaagttccttaagataacaaaacctactattgatgaaaaaatccagctggtccccaaagctcagctaggcagctggggcaagggctcgtcaggcggggctaaggcctccgaaacagacgcccttaggagtagcgcctctagtttgaataggttctccgcgctgcagcctcccgccccatctggaagcacaccttccacacccgtcgaattcgactctcgaaggaccctgacatcaaggggctcaatgggccgggagaagaacgataaaccactgccatcagccacagctagacctaacacattcatgcgtggcggctccagtaaagacctcctggacaaccagtcccaggaagagcaacggagagaaatgcttgagactgtcaaacagctcaccggtggagtcgatgtagaaaggaatagtaccgaggctgagagaaataagacccgcgaaagcgccaagcccgaaatcagcgcaatgtccgcacacgataaagccgcactctcagaagaggagctcgaaagaaagtcaaagtccattatcgacgaattcctgcacatcaacgacttcaaggaagcgatgcagtgcgtggaagaacttaacgcccagggactgctgcacgtctttgtgcgtgtgggggtggagagcactctggagagatcacagattacccgggaccacatggggcagctgctgtaccaactggtgcaatctgagaaactctccaagcaagattttttcaaggggttttctgaaacgttagagctcgcggacgacatggccattgacattcctcatatttggctgtacctggccgaactcgtgaccccgatgttaaaagagggtggcatctctatgcgggaattgaccatcgagttttctaaacccctgctgccagtggggcgggctggcgttctgctctcagagatactgcacctgttgtgcaagcagatgtcccacaagaaagttggtgcactgtggcgggaggccgacttgtcttggaaagatttcttgcctgaaggagaggacgtgcacaattttttgctggaacagaagctggacttcatcgagtcggacagcccctgtagcagcgaggcactgtctaaaaaagaactgtcagcagaggagctgtataaacggctcgagaagttaatcatcgaagacaaggctaatgatgaacaaatcttcgattgggtcgaggccaacctagatgagattcaaatgagcagtccaaccttcttgcgcgcgctgatgaccgctgtatgcaaggctgccatcatagctgacagctctacgttccgcgtcgacactgcggtcatcaagcagagggtgccaatcttgctgaagtacctcgactctgataccgagaaggagcttcaggccctttacgctcttcaagcaagtatcgttaagctggaccagcccgcaaacctcttaagaatgttttttgactgtttgtacgatgaagaggtcataagcgaggatgcattctataagtgggagtcatccaaggaccctgcagaacagaatggtaaaggcgtggcactgaaatcagtcactgccttcttcacctggctccgcgaagctgaggaggaatcagaagataattag

SEQ ID NO: 15490 - DNA, 4776 bp, Artificial Sequence
  Description of Artificial Sequence: Synthetic coding sequence
atgaactcccaaccccagacccgttctcctggcggcttccgcccaatccagtttttccagcgacctcagatccagcctcctcgggcaactatccctaattccagccccagcattagaccgggggcccaaacacctaccgctgtgtaccaggccaaccagcacatcatgatggtaaaccatctgcctatgccatacccagtgccccaggggccccagtactgcatcccacaatatagacatagcgggccgccttatgtcggcccccctcagcaatatccggtgcaaccccccggcccgggtcctttttacccagggcctggccccggagacttcccgaatgcgtacgggacccccttctacccatcccagcccgtgtaccagtccgcccccattattgttccaacacagcagcagccaccacccgctaagcgagagaaaaagacaattcggatccgggacccaaatcagggcggcaaggacattacagaggaaatcatgagcgggggaggatccagaaatcccacaccaccaattgggaggcccacatcaacgcctactcccccccagttgccatcccaggttccagagcattctcccgtcgtctacggcacagtagagtccgctcatctggccgcctccacacctgtgacggctgcatcagatcagaagcaggaggagaaaccaaagcctgatcctgtcctcaaaagtccatcccctgtgcttagattggttctgtctggggagaaaaaagagcaagagggccagacaagtgagacaaccgctatcgttagcatcgctgagcttcctcttccacccagccccacgacagtctcttctgtggcgagatccaccattgctgcccctacgagctcagccctgtcaagccagccaatctttaccactgcaattgatgatagatgcgagctgtcctctcctcgcgaagatacgatccccatcccctcgctgacaagttgcacagaaacttcagaccccttgcctacaaacgagaatgacgatgacatctgcaagaagccctgcagcgtcgcaccaaatgatatccccctggtgtcgagtacaaatctgataaacgagatcaatggcgtttcagagaaactgtcggcgaccgagtctatcgtggagattgtcaagcaggaggtgcttcccctgacgttggaactcgaaatcctggagaatcccccagaggagatgaaactcgagtgtatacccgcgccaattaccccaagcaccgtcccctcctttcccccaacaccgcctacccctccagcttcccctcctcatactcctgtcatcgttcccgcagccgcaaccacggtaagctctccctccgcagccattacggttcaaagagtgctggaagaggacgaatcaatcagaacctgtctgtcagaggatgctaaagagatccagaataaaatcgaggtggaggctgacggacagactgaggaaatcctggacagccagaatttgaactccagacgtagtcctgtcccagcgcagattgccattacggttcccaagacctggaagaaacctaaagacagaacccgtaccactgaagagatgctggaggccgagctcgagctgaaagcggaggaggagctctccattgataaagtactggagagcgaacaggacaagatgagtcagggattccaccccgagcgtgatccaagcgacctaaagaaagtaaaagccgtcgaagaaaatggagaggaggcagaacccgtgagaaacggtgcagagtctgtcagtgagggagaagggatcgacgctaacagcggttccacggatagctcaggggacggcgtgacttttcctttcaaacccgaatcttggaagccaaccgatacagaaggcaagaagcagtacgaccgggagtttctgctggacttccagtttatgccggcatgcatacagaagcccgaaggactgccccccatcagcgatgtggtgcttgacaagatcaatcagcctaagctgccaatgcgcactctggacccacggatcctcccccggggacccgactttacgcccgccttcgccgacttcggccggcagaccccaggtggtcgaggagtgcccctgctcaacgtcggatcccgacggtcccaacccggacagcgtcgagaaccacgaaagatcattacagtatctgtgaaagaggatgtgcacttgaagaaggcagagaacgcttggaaaccatcacagaagagggattcccaagcagatgaccccgagaatatcaaaactcaggaattattcagaaaggtgagatcaattctgaataaactcacacctcaaatgttcaatcaactgatgaagcaggttagtggattgactgttgacacagaggagcgccttaaaggcgtgatcgacttagttttcgagaaagccattgacgagcccagcttctcagtcgcttatgccaacatgtgtcggtgtttagtgacccttaaagtgcccatggcagataaacctggcaataccgtgaactttcgcaagttgttactcaaccgatgtcagaaggaatttgaaaaagataaggctgatgacgacgtgtttgagaaaaaacagaaagagttagaggctgcttctgctcctgaggagcgaacgcgtctgcacgacgaactggaagaggctaaggacaaggcccgcagacgaagtatcgggaatattaagttcatcggagaactgttcaaactgaaaatgttgaccgaggctattatgcacgactgtgtggttaaattgctgaaaaatcacgacgaggagtcgctggaatgtctttgtaggctgctcacaaccataggtaaggatctggattttgagaaggccaaacctaggatggaccaatacttcaatcagatggaaaaaatcgtcaaagaacgcaaaaccagctcccgcatcaggttcatgttgcaggacgtgattgatctcaggctctgtaactgggtttcccgcagggctgatcaagggcctaaaaccatcgagcagatccacaaggaggctaagatcgaagagcaggaagaacagcgtaaggttcaacagcttatgactaaggagaaacggcgccccggggttcagcgagtcgacgaaggcggatggaacactgtgcagggtgccaaaaattcccgggtgctcgatccttccaaattcctgaaaattacgaagccaaccattgacgaaaaaatccagttagtgccaaaagcccagttaggaagctgggggaaagggagcagcggcggagccaaagcaagcgaaactgacgctctgcggtccagcgcaagctccctgaaccgctttagtgccctccaaccacccgccccctctggttccacacccagcacccctgttgagtttgatagtcgccgcaccttgacgtcccgtggctcaatggggcgtgagaaaaatgacaaaccccttccaagtgccacggctaggcctaatactttcatgcggggcgggagttctaaggatctgctggataatcaatcccaggaggaacagcgcagagagatgctggaaactgttaagcagctgacgggaggcgtggacgtggagcggaattctactgaagcagaacgcaacaagaccagagagtctgctaagccagagataagtgccatgtccgcccacgataaagctgcactctcggaggaagagttggagaggaaatccaagtccatcatcgacgaatttctccatattaatgatttcaaggaagcaatgcaatgcgtcgaagaactgaacgcccagggcctactccacgtttttgtgagagtgggagttgagagcacactggaaagaagtcagatcactcgcgatcacatgggacagctgctgtatcagcttgtgcaaagcgaaaagctctcaaaacaggacttcttcaagggcttctcagagacacttgaacttgccgacgacatggccatcgacataccccacatctggctgtatcttgcggaactggtcacacctatgctgaaggaaggcggcatctcaatgcgggagctcactattgagtttagtaagcccttgctccctgtgggcagggcaggtgtcttgctgagcgaaatactacatctcctgtgcaagcagatgtctcacaagaaagtgggagcactctggcgggaggcagacctgtcatggaaggatttcctgcctgaaggagaggacgtgcataatttcctgcttgagcagaaactggactttattgaatcggacagcccatgttcttctgaggcgctgagtaagaaagaactatcagcagaagagttgtacaagagacttgagaaactgatcattgaggataaagcaaatgatgaacagatttttgactgggttgaggccaatctcgacgagatccagatgtcttccccaacttttctgcgggccttaatgacagcggtgtgtaaagcagcaatcatcgcagattcatccacctttcgcgttgataccgcagtcatcaaacagcgggttcccatactgttgaagtacctagatagcgatacagaaaaggaactgcaggctctttacgcgcttcaagcgagcatcgttaagctagaccagcccgcaaatttgctccggatgttctttgattgtctgtacgatgaggaggtgatttctgaggatgccttttacaaatgggagagttctaaagacccagctgaacaaaacggcaagggcgtggctttgaaaagtgtcaccgcttttttcacttggctgagagaggcagaggaggagagcgaggacaactag

SEQ ID NO: 15491 - DNA, 1002 bp, Artificial Sequence
  Description of Artificial Sequence: Synthetic coding sequence
atgagcggggatgagatgatctttgaccctactatgagtaagaagaaaaagaagaaaaagaagcccttcatgcttgatgaagaaggcgacactcaaaccgaggaaacccagccatccgagactaaggaagtcgagcccgaacctacagaggataaggacttggaagcagatgaggaagacactcggaagaaggatgcgtcagacgaccttgacgatcttaacttctttaatcagaaaaagaagaaaaaaaaaaccaaaaagatcttcgacatcgacgaggctgaggagggggtcaaggatctaaaaatcgaatccgacgtgcaggagccaactgaacccgaagatgacttggacatcatgctaggcaataaaaagaagaaaaagaaaaacgttaaattccctgacgaggacgagatcctggagaaggatgaggccctggaggacgaggacaacaaaaaggacgacgggatatccttctcaaaccagacaggaccagcctgggctggcagtgaacgcgactacacgtacgaggagctgctgaaccgcgttttcaacatcatgagagaaaaaaatcctgatatggtcgctggggaaaagcggaaatttgtaatgaagccgccacaagtggtgcgcgtaggaactaagaagacctctttcgtgaattttacggatatatgcaaactgctgcatcgccaacctaagcaccttctggctttcctcttagcggaactgggcactagcggatcaatcgatgggaataaccagctcgtgataaagggcagatttcagcagaagcaaattgagaacgtcctgcgaagatatattaaggagtacgtcacatgccacacatgtagatccccggacactatcctccaaaaggatactcgactgtactttctccagtgtgagacctgtcattctagatgttcggttgcgtcaatcaagacagggtttcaagccgtgactggaaagagggcccagctcagagccaaggctaattag

SEQ ID NO: 15492 - DNA, 2619 bp, Artificial Sequence
  Description of Artificial Sequence: Synthetic coding sequence
atgggcgagggagggctccccccagccttccaactcctgttgagagcatgcgatcagggcgacacagaaactgcccgccggttgctagaacctggggccgccgagcccgcagaaaggggggctgaaccagaggccggcgctgagccggccggcgccgaagtcgccggacctggggcggcagccgcaggcgctgtgggagctcctgtgcccgtggactgctctgacgaagctggcaatacggcactgcaatttgctgcagccggagggcacgaaccactggtgcgattcttgctgcgtagaggggcctctgtgaattctcggaaccattacggatggagtgccctcatgcaggccgcccgatttggccacgttagcgtcgcccatctgctgcttgatcatggtgcagacgtgaacgcccagaacaggttgggtgctagcgttctgacagtcgcatccagaggcgggcacctcggggttgtgaagctcctattggaggctggggcgttcgttgatcaccatcacccaagtggtgagcagctggggctgggcggttcgagagatgaaccattagacattaccgctctcatggctgccatccaacatgggcacgaggctgtggtgcgactgttgatggaatggggagcagatcctaaccacgctgcaaggacggtgggctggagccctcttatgctggctgcccttacaggacgactgggggtagctcagcagcttgtggagaaaggagcaaaccctgaccacctcagtgtgctagagaaaaccgccttcgaggtcgctctagattgcaaacaccgggatttagttgattacctggatcctctgacgacagtgaggcctaaaaccgatgaggaaaagaggagaccagatatcttccatgctctgaaaatgggaaattttcagttggttaaggaaatcgccgatgaagatccgagccacgtcaatctggtgaatggcgacggtgccacccctctcatgcttgcagctgtgacaggacagctggcactagtgcagctgttagtcgagcggcatgccgacgtcgacaagcaggacagtgtccacggctggaccgccctgatgcaggccacttaccacggaaataaagagatagtgaaatatttactgaaccaaggggccgacgtcacactgagagccaagaacggttataccgcatttgacctggttatgttactgaatgacccggacaccgagctggtgcgtctgcttgcctctgtctgtatgcaggtcaacaaggataagggccgtcccagccaccagcctccactcccccattccaaggtaagacagccctggagcatccccgttctccccgatgataagggaggcctaaagtcttggtggaacaggatgtccaacagatttcgcaaactgaaattgatgcaaaccctgccccgtggcctgtccagcaatcagcctttacctttcagcgacgagcccgagccagctctggatagcaccatgcgggccgcccctcaagacaaaacatcccgtagtgctttacccgacgccgcacctgtgacgaaggacaatggtccaggatctacccgcggcgagaaagaggatactctgctgacaaccatgctgcggaacggcgcaccactgacacgactacctagcgacaaattgaaagctgtgataccccccttcttgcccccgtcgagcttcgaactgtggtcatccgacaggtctcgcacacgtcataacgggaaagccgacccaatgaagaccgcattaccgcaaagagccagccgtggccacccagttgggggcggaggaaccgacactacccctgtccggcctgtgaagttccccagcctgccacggtctcctgcatcgtccgccaactccggcaactttaaccacagtccacactcgtcagggggctcctcaggtgtgggcgtgagtcggcatggcggggagctcttgaaccgctcagggggaagcatcgataatgtgttgtctcagatcgccgcccagcgcaaaaaagcagcaggtttgctagaacaaaagccgtcccatagaagtagtcccgtgggcccagctcctggatcctctccctcagagctacctgcatctccggctggcggtagcgcccctgtcggtaagcagaagttggaaacatctaagcggcctccctccggcacttctacaaccagcaaatctacctctcccacactcacaccctccccttcgccaaaaggacacactgcagagtcttccgtgagcagctcatcatcccatcgccagagcaaaagcagcggcgggtcatcttccggcacgatcactgacgaggacgagcttactgggattttgaagaagctgtctttggaaaagtaccagcccatattcgaagaacaggaggtcgacatggaagcctttctgaccctgactgatggggacttaaaggaactcgggatcaagacggacgggagtcgccagcaaatccttgccgcaatctcggagctgaatgccggcaaggggagggaaagacaaatccttcaagaaacaatccataacttccactccagctttgaaagtagcgcatctaacacccgcgcaccagggaattctccctgcgcctag

SEQ ID NO: 15493 - DNA, 483 bp, Artificial Sequence
  Description of Artificial Sequence: Synthetic coding sequence
atggaggctgagcggcctcaggaggaggaggatggcgaacagggcccaccgcaggatgaggagggatggcccccccccaactccaccacgcggccctggagaagcgcaccaccttcgccccctccaccgggtaccagacacaccgcactcgggcctaggtccgccagccttctgagtttacagaccgagttgctactggacctggtcgccgaggctcaatctcgccgcctggaagaacagcgggctacattctacaccccccagaacccctctagcctggcccctgcaccactaaggccccttgaagatagggagcagctgtactccacaatcctgtcccaccagtgccagaggatggaagctcagcggtctgaaccccctcttccccctggaggccaggaactcctggagttgctgctccgagttcagggtggcgggaggatggaggagcaaaggtcaagaccaccaacacatacttgttag

SEQ ID NO: 15494 - DNA, 483 bp, Artificial Sequence
  Description of Artificial Sequence: Synthetic coding sequence
atggaagccgagagacctcaagaagaggaggatggcgaacaggggcccccgcaagacgaggaggggtggccaccacctaattccactactagaccgtggcggtcagcacccccctctcccccacctcccggcaccagacacactgcactaggtcccagaagcgcttctcttctgtctctccagacggagttattgctagatctcgtggccgaagcccagtctcgccgactcgaagaacaaagagcaaccttttataccccacagaatccctcgagcctcgccccagctcccctccggccactggaagatcgggagcagttgtatagcacaatactttcccatcaatgccaacggatggaagctcaaaggtctgagcctccgctgccccctggcggacaagagctactggaactcctcctgcgagtacaaggcggaggcaggatggaagaacaacgctcacgccctcctacccacacatgctag

SEQ ID NO: 15495 - DNA, 2790 bp, Artificial Sequence
  Description of Artificial Sequence: Synthetic coding sequence
atgcaaggactgcccgatccacccagccagagaggcattatcccaagagcctttgagcacgtgtttgagtccgtccagtgtgcggagaacaccaaatttcttgttcgggcgtcgtacctggagatctacaacgaagatgtccgcgatctgttaggcgccgacaccaaacagaagttggaactcaaggagcaccctgagaaaggcgtgtacgtgaaaggactgagcatgcatacagttcattcagttgctcagtgtgaacacatcatggaaaccggctggaaaaatagatccgtgggatataccctcatgaataaagacagtagccgatcccactctatctttactatctcaatcgaaatgtctgccgttgacgaaagagggaaagaccatctgcgcgctggaaagctgaatttggtggacttggccggctctgagaggcagtctaaaactggcgccacaggcgaacgcctgaaagaagccaccaagattaacctatccctatcagcactggggaacgtaatctcagcgctggtggatgggaggtgtaaacacgtcccttatagagacagcaagctaaccagactgcttcaagactccttaggcggcaacaccaaaaccctgatggtggcctgcctcagtccagccgataataactatgatgaaacgctgagcacactccggtacgcaaacagagccaaaaatattaggaataagccacgtataaacgaagaccccaaggatgcactgttaagggagtaccaggaggaaattaagaaactcaaggcaattctcacacagcagatgtctccctcatccttgtctgctctgctgagtcggcaggtccctcccgaccctgtgcaggtggaagaaaaactcttgccacagcctgtaattcagcacgacgtggaggctgaaaaacagctcattagggaggagtacgaggaacggctggctcgactcaaggccgattataaggctgagcaagagtcacgcgctaggctggaagaagatatcacagctatgcggaattcctacgacgttcgccttagcactctcgaagagaatctgcgcaaagagaccgaagctgtgttgcaagtcggagtactgtacaaagcagaggtgatgtctcgagctgaattcgcctcctcagccgaatatccgcctgccttccagtatgaaaccgtagtgaagccaaaggtgttctccaccactgacacgctgccatctgatgatgtatcaaaaacccaagtttcctcaaggttcgctgaattgcccaaggtagagccatccaaatcagaaatcagcttgggcagcagcgaatcttctagcctggaggaaacaagcgtatctgaggccttcccaggacctgaagagccaagcaacgtggaggtatcgatgcccacagaggaaagccggagccggtactttctcgacgagtgcctgggacaagaggcagcgggtcacttgttaggggaacagaattacctcccccaagaggaacctcaggaggtgcctctgcaggggttactgggcctgcaggacccattcgccgaggtcgaagccaaactagcaaggctgagttctaccgtggccaggacagatgccccacaggccgacgtaccaaaggtacccgtccaggtgccagcacccactgatcttttggaaccaagcgacgcacgccccgaggcagaggccgcggacgatttccctcccaggccggaggttgacctagcgtctgaagtggctctggaggtagttcgcacagcggagccaggggtttggctcgaggcccaagcgccggttgccctggtcgcacagccagagccattacccgcaaccgccggcgtgaaaagggagtcagttgggatggaagtagcggttcttaccgacgatccattacctgtggtcgatcaacagcaggtgctggctcgactgcagctgttagagcagcaggttgtggggggagagcaggctaaaaataaagatttgaaggagaaacataagcgccggaaacgctacgccgacgaacgacgaaagcagctggtcgctgctcttcagaacagtgacgaggactcgggggactgggttcttttgaatgtgtatgactccatccaagaggaagtacgggctaagtcaaagctgttggagaagatgcagcgcaaactgcgggcagccgaggtggaaatcaaggacctgcagtcagagttccaattggagaagattgactacctcgccactataagacgacaagagcgcgatagcatgctgctgcagcagctattagagcaagttcagcctcttatccgcagggattgcaactattccaacctggagaaaattctgcgcgagtcctgctgggacgaggataacggcttctggaagatcccgcaccccgtcatcacaaagacatctctgcccgtagcagtgagtaccggccctcagaacaaaccggccagaaaaacgagcgctgctgataatggcgagccaaacatggaggatgaccggtatcggctgatgctaagccgtagcaactccgagaatatcgcctctaactacttccggtccaagcgggcatctcagatattaagcaccgatgctaggaaatctctgactcatcataattcccccccgggcctgagctgccccctgtccaacaactccgccataccgccaacccaggcgcccgaaatgccacaaccccggcctttccgcttggaatccctggatattccgttcacaaaggctaaacgaaaaaagtctaaatctaatttcggctctgagccgctctag

SEQ ID NO: 15496 - DNA, 426 bp, Artificial Sequence
  Description of Artificial Sequence: Synthetic coding sequence
atgaacaagcacgtactaaagatacagaaggaactggaagaagccaaggagaagctggcccgccaacacaaacgcagatcagacgacgatgataggagtagtgataggaaagacggagtcctggaggagcaaattgagcgactacaggaaaaagttgaaagcgcacaatcagaacagaagaatttgtttttggtaatcttccagcggttcatcatgatattaacagagcacttagtccggtgtgagactgatgggacaagtgtgctgaccccctggtacaagaattgcatcgagcggctgcagcagatcttccttcaggtgtgcggtgaacttcgcctcggaaacaacaccatcttgtctcacaaggactttagcctgaaaaagattctggtgaagtttgtgcgacgcctttattctacatgttag

SEQ ID NO: 15497 - DNA, 2373 bp, Artificial Sequence
  Description of Artificial Sequence: Synthetic coding sequence
atgagtagacggagacacagcgacgagaatgacggcggacaacctcataagagaaggaagacatctgatgcaaacgaaactgaagaccacctggagagtttaatctgcaaggtgggagagaagtccgcctgtagcctggagagtaatctggagggattagctggggtgctcgaagctgatctgcccaattacaaatctaaaatcctgcgcctcctgtgtaccgtcgctcgcctgttgcccgagaaactcaccatctataccactctggtgggcctcctgaacgcccgaaattataacttcggtggtgagttcgtggaagcaatgattcgacaactcaaggagtctcttaaagcaaataattacaacgaagctgtttacctggttagatttctgagcgacttggtgaattgtcacgtgatcgccgctcctagtatggtcgctatgtttgagaatttcgtgtctgtcacccaggaagaggacgtgccacaggtcaggagagactggtacgtctacgcttttctgagctctttgccatgggtcggcaaagagctgtacgagaagaaagacgccgagatggaccgcatcttcgccaataccgagagctacctcaaacgtcgccagaagacccatgtcccaatgctccaagtgtggaccgccgataagccccacccacaagaggagtacctcgattgcctgtgggcccaaattcagaagctgaagaaggatcgttggcaggaacgtcacattctgcgaccatatctggcttttgattctattttgtgcgaggccttacagcacaacttgccgccctttacacctcccccacataccgaagactcagtctatcctatgcctagggtcatcttccgaatgttcgactacacagatgaccctgaaggacccgtcatgcccggttctcactccgttgaacgattcgtgatcgaggaaaatctacactgtatcattaagtcgcattggaaggaacggaaaacatgtgccgcccagctagtctcatatcccgggaagaacaaaatccctctgaattaccacatcgtcgaagttattttcgccgagctttttcaactccctgcgcctcctcacatcgatgtcatgtacacaactcttctgatagagttgtgtaaactccagcccggtagccttccacaggtgctggctcaggccaccgaaatgctctacatgagactggacactatgaacactacatgcgttgatcggtttattaattggttctcacaccatctgtctaatttccagttcagatggtcctgggaggattggtcggactgcctcagccaggaccctgagtcccctaaacccaaattcgttcgggaagtgctggaaaagtgtatgcgcctgtcatatcaccagagaatcctggacatcgtaccacctactttttcggccctgtgtccggccaaccccacatgtatttacaagtatggagatgaatcaagcaactcccttccagggcacagtgtggcgctgtgcctggccgtggcctttaagtctaaggctacaaatgacgaaatatttagcatcttgaaggacgtaccgaatcccaaccaggatgatgacgatgacgagggattttccttcaatcctctgaagattgaagtctttgtccagacgctgctgcatttagccgctaagagcttttctcattccttctccgcactcgctaagttccatgaagtgttcaagactttagcagaatctgacgaggggaaactccacgtgctgagagtgatgttcgaagtctggaggaatcacccccaaatgatcgctgtccttgttgataagatgataagaacgcaaatcgtagactgcgctgctgtggctaattggatcttctcttcagagttgagcagggatttcactagactttttgtgtgggagattctgcacagcaccatcaggaagatgaataagcacgttctcaaaattcagaaagagctggaagaagctaaagagaagctggccagacaacataagagaagatctgatgacgacgaccgcagcagtgacagaaaagatggcgtgctggaggagcagatagagagactccaggagaaggtggagtctgcacagagtgagcagaagaacctgttcttggtgattttccagaggttcatcatgatactgacagagcacctggtcagatgcgagaccgacggaacatccgttctgactccctggtataagaattgtatcgagcgactgcagcagatcttcctgcagcaccaccagataattcagcagtacatggtcacgctggagaacctcttgttcaccgccgaactggacccacacatcttggcagtgtttcagcagttctgtgccctccaggcatag

SEQ ID NO: 15498 - DNA, 699 bp, Artificial Sequence
  Description of Artificial Sequence: Synthetic coding sequence
atgtcacaggttctgtctatcctcggaatgcacacactgatgtcaaatcagcagtattaccaggcgctgtccagtagcagtattatgaacaaggagggactcaacagcgttataaaacctactcaatataaacccgtcccggatgaagagccaaactctacagacgtggaggagaccttggaacgcattaaaaacaatgaccccaagcttgaagaggtcaatctgaataatattaggaatatccccattcctacacttaaggcctacgcagaagcgctgaaggagaatagttatgtgaaaaagtttagtattgtcggtacccgcagcaatgaccccgttgcctatgcccttgcagaaatgttaaaggagaataaagtcctcaaaaccctcaatgttgaatctaactttatcagcggagccggaattcttcgactcgtggaagcattgccctataacacctcgcttgtggagatgaagatcgataaccaatcccagcctctaggcaacaaagtggaaatggagatcgtgagtatgctcgagaagaacgctacactcctgaaattcggataccactttactcaacagggcccacgcctgcgcgcaagcaatgcgatgatgaacaacaacgacctagtgagaaagcgccgactggctgatttgaccggtcccatcattcccaagtgtcggtctggggtctag

SEQ ID NO: 15499 - DNA, 2403 bp, Artificial Sequence
  Description of Artificial Sequence: Synthetic coding sequence
atgtcctccctgggtgcgagttttgtacagatcaaatttgatgacctccagttcttcgagaattgtggaggaggaagctttgggtccgtgtatcgggccaagtggattagccaagacaaagaggtggccgtcaaaaagttgcttaaaatagagaaagaagccgagattcttagtgtgctgagccataggaacatcatacaattttacggggtaattctggagccgcctaattacggaatcgtgactgagtacgctagtctcggcagtctttatgactatatcaacagcaaccggtctgaggaaatggacatggatcatatcatgacatgggccacagacgttgccaaggggatgcattacttgcatatggaggccccagtaaaagtgatccaccgggacttaaagtcgagaaatgtggtgatcgccgccgacggcgtactcaagatttgcgatttcggcgcctctcgattccacaatcataccactcatatgagcctcgtggggaccttcccgtggatggccccagaggtgattcagtctctccccgtctccgaaacttgcgacacttactcatacggtgtcgtgctttgggagatgcttacccgcgaggtgcccttcaaggggctggagggattgcaggttgcctggctagtggttgaaaagaatgagagattaacgatcccaagcagctgccccaggagcttcgcagaactgctgcaccagtgctgggaggcggatgctaaaaaacgcccctctttcaaacagatcatatcgattctggaatccatgtctaatgatactagcctgcccgataagtgcaacagtttcctacacaataaagccgagtggaggtgcgagattgaggccacgcttgagcgtttgaaaaaactggagagggatctctcattcaaagaacaggagttaaaggagcgtgaacgcagactgaaaatgtgggagcaaaaactgacggagcagtccaacacccccttactgccctcattcgagatcggagcctggaccgaggatgacgtgtattgttgggtacagcagctggtgcgaaaaggggacagttccgctgagatgtccgtgtacgcatcgctttttaaagaaaacaatatcaccggtaagcgcctactgctgctcgaagaagaagatcttaaagatatgggtattgtgtcaaaaggccacatcatccattttaaaagcgcgattgagaagctgacccacgattacattaatctgtttcactttccaccgttgattaaggactctggaggcgaacccgaagagaatgaggagaaaatcgtcaatctggagctggtgttcgggttccatctgaagcctggcactggcccacaggattgtaagtggaaaatgtatatggagatggacggcgacgagatcgctatcacttatattaaagatgtgactttcaataccaatttgccagatgcagaaatattgaagatgactaaaccgcccttcgttatggagaaatggattgtcggcattgccaagagtcagaccgtggagtgcaccgtgacatatgagtccgacgtaagaacacccaaatcaaccaagcatgtgcattcaatacagtggagccggacaaaaccgcaagacgaggtcaaggccgtgcagttagcaattcagacacttttcaccaacagtgacggcaaccccggttcgcggtccgacagctctgccgactgccaatggttggatactctgaggatgcgccagatagcctcaaatactagcctccaaagatctcagagcaatccgatactaggctctcctttcttctcccactttgacggccaggatagctatgccgcggccgtgcgcaggccccaggtccctataaaatatcagcagattacaccagtcaatcagtccagaagttcatcgcccactcagtatggccttactaaaaattttagcagtttgcacttgaatagccgtgatagtggcttttcctccggcaacacggataccagcagcgagcgggggcgatactccgaccgttcaaggaataagtatggcagaggctccattagccttaacagctcgccaagaggcaggtactcggggaagtcacagcacagcactccgtcccgcggtcggtaccctgggaaattttatagggtgtctcagagcgctcttaacccgcaccagtcaccggactttaagagatcaccgcgcgatctgcatcaacccaataccatcccgggtatgccccttcacccagaaactgatagccgagcttccgaggaagattcaaaggtctctgagggcgggtggacgaaggtggagtacagaaagaagccacaccgcccttcccccgcgaaaacaaacaaggagagggctagaggcgatcatagaggttggagaaacttctag

SEQ ID NO: 15500 - DNA, 1071 bp, Artificial Sequence
  Description of Artificial Sequence: Synthetic coding sequence
atgagacgattccttcgacctggccacgatccagttagggagcgactgaagcgggacctgttccagttcaacaagaccgtggaacacggctttccacaccagccatcagcactcggctacagcccatccttgcggatcctcgccattgggacaaggtctggtgcgatcaagttatatggggctcccggcgtggagtttatggggctgcaccaggagaacaatgccgtgacccagatccacctcctcccggggcagtgtcagctagttactctgctggacgacaatagccttcatttgtggagcctaaaggtgaaagggggggcttccgaactgcaagaggatgagagttttaccctgcggggtccaccaggcgcggctcctagtgcaacacagattacagtggtcctcccccatagttcatgtgaattattgtatctcggaaccgagagcggcaacgtgttcgtggtccagctgccagctttccgggctttagaggataggacaattagtagtgatgccgtgctgcagaggctgccagaggaggctagacatcggcgagtttttgagatggtggaagccctacaagaacacccccgcgaccccaatcaaatactcatcggctatagcaggggccttgtagtcatatgggatttacagggtagccgtgttttgtaccacttcttgtcttcccagcaactggagaatatttggtggcaacgcgatggcaggctcctagtaagttgtcattctgatggatcctattgccagtggcccgtcagtagcgaggcccagcagcccgagcccctccggagtttggtgccatatggaccatttccttgtaaggcaataacacgcattctgtggctgacaacaagacagggtttgccatttactattttccagggtgggatgcctcgggccagctatggcgaccgtcattgcatctccgtgatccatgatgggcaacagactgcattcgatttcacatcccgggtgatcgggtttaccgtgttgactgaggccgaccccgctgcttcccgacgggccagcggagtaggagcgcagggctag

SEQ ID NO: 15501 - DNA, 2526 bp, Artificial Sequence
  Description of Artificial Sequence: Synthetic coding sequence
atgggcgctcgggctgctggcaccagctcaggcggcggtccccgtccctgcctcgcaagaggtctgagtgcctctccctttccagcaaagcaacaacacccccaggcaggagcatctccagcagaattgcaacaacgggcctactatagagcgaggcaggacgccgccagccaacccgggctcggcttcctgatcagcccctctagctgtagttcttggggcccgggatcgttcactcggagctgtggatatcccaccttatgctcctcatggatttctaagcgtgagccaggagaattaagcggcgtttggacgagtgcttggcgaacccatgctgcattcacagggagccaagacctttgtctttacaaaggtctcggcagcatctacgaggacaaaactgccctctctctgctgggcctgggggaagaaaccaatgaggaggatgaagaggagagcgataatcagtcggtccactcaagtagtgagcctcttagaaatctgcacctggatatcggcgctttagggggggatttcgaatacgaagagtctctcaggacttcacaaccagaagagaaaaaagatgtaagcctggatagtgatgcagccggtcctcccacaccatgtaagcccagctcgcccggggctgatagcagcctgagttctgccgtcggcaaaggacggcagggatcaggagctcggcccgggttgccagagaaagaggaaaacgagaaaagcgagcctaaaatttgcagaaaccttgtgactcctaaagccgatcctaccggatccgagccagctaaagcttccgaaaaagaggcccctgaggacaccgtggacgccggagaagagggatctcgaagagaggaggccgctaaagagccgaaaaagaaagcatcagccctcgaagaggggtcctctgatgcctcgcaagagctcgaaatctcagagcacatgaaggagcctcagctctccgattcaatagcttccgatcctaaatccttccatggtctggatttcggttttaggtccaggatatcagagcatctgctagatgtcgatgtcctaagccccgttctgggcggagcctgtagacaggctcagcagccgctgggcattgaggataaagatgattcccagtcctcccaagacgaactgcaatctaaacagagtaaagggttggaagagaggtaccatcgcctctctccccccttgccacatgaggagagggcgcagagcccaccaaggtccctagccacagaggaagaacccccacagggtccagaagggcagcctgagtggaaggaagcggaagagctcggcgaggactctgccgcatcattatcgctacaactgtccctgcaaaggagatccactgaaccggtggcaccacccgagcagttgagtgaggctgctctgaaggcaatggaggaggctgttgcccaggtccttgaacaggaccagagacatctcctggagagcaagcaggagaagatgcagcagcttagagaaaaattgtgtcaagaggaagaggaagagattctccgtctccatcagcagaaggaacaatcactgagttccctgagagaaagactacagaaggcaatagaagaagaggaggctaggatgagggaggaggaatctcaacgccttagctggctaagagcccaggtgcagtccagtacacaggctgacgaagaccaaattagagctgaacaggaggcttcactgcagaagctgcgcgaggagctggagagccagcagaaagccgagcgcgcttcccttgagcagaagaaccggcagatgttggagcagctgaaggaggagattgaggcatccgagaaatccgagcaggccgcattaaacgctgctaaagaaaaggccttacagcagctccgcgagcaattggagggcgaacgcaaagaagctgtggcgacactggaaaaagagcactctgcagagttggaaaggctgtgctcgtctctggaggcgaagcatcgcgaggttgtctcctctttgcagaagaagattcaggaggcacagcagaaagaagaggctcagctccagaagtgtctgggccaggtcgagcatcgcgtgcatcagaagtcataccacgttgccgggtatgagcacgagcttagttccctcctgcgggaaaaacgccaggaggttgagggtgagcacgagcgacgccttgataaaatgaaagaggaacaccagcaggtgatggccaaggcgcgcgagcagtatgaggcagaggaacgcaaacaacgcgcagagttactcggccacctcacgggggaactggaaagacttcagcgtgcacacgaacgagaactcgagaccgtgaggcaggaacagcacaaaagacttgaagatctaagacgcaggcatagagagcaagaacgcaaactgcaagacttggaattggacttggaaactcgagcaaaagacgtgaaagctcggttggccctactcgaagtccaggtgcgagatctccaggaatcgctgacatcggagtcttag

SEQ ID NO: 15502 - DNA, 1053 bp, Artificial Sequence
  Description of Artificial Sequence: Synthetic coding sequence
atgattcggggctttgaggccccgatggccgaaaacccacctccacctccacctcccgtgatcttttgccacgacagtcctaagagggttctggtgtcagtgatccgaaccactcccattaagccaacttgtgggggagggggagagcctgaaccaccccctccgttaatccctaccagtccagggttcagcgattttatggtttatccatggagatggggggagaatgcgcacaacgtgactctgtctccgggcgctgccggagcggctgcttcagctgctctgccggctgctgctgccgcggagcatagtgggttacgggggcgcggagcccccccgccggccgccagtgcgtccgctgcggcctccggaggcgaggatgaggaggaggccagctcacctgattctggccacctaaaagatgggatccgcaggggtaggccaagggccgacaccgtacgcgatcttattaacgagggagagcacagctcttcccggattaggtgtaacatctgcaacagagtgttcccaagggagaagtccctgcaggcccacaagaggacacacaccggcgagagaccctacctctgtgactacccggactgcggcaaggcttttgttcagtccggacagcttaaaactcatcagcggctgcataccggagaaaaaccattcgtttgttcagaaaatggatgcttatccagattcacccacgctaacaggcattgtcccaaacacccctatgccagactgaaacgcgaagagcctactgataccctgtcaaaacatcaggcggcagacaataaggcagcagccgagtggctggcaagatactgggagatgagagaacaaagaacccccacactgaagggaaagctagttcagaaagcagatcaagagcaacaggatcctctggagtacctgcagagcgatgaagaggacgatgaaaaacggggagcgcaacgcaggctgcaggaacagcgggaaagactccacggcgcgctcgctctgattgaactggctaacttgacgggcgccccgctcagacagtag

SEQ ID NO: 15503 - DNA, 1137 bp, Artificial Sequence
  Description of Artificial Sequence: Synthetic coding sequence
atgaacatgatctggcgaaactcaatcagctgtcttagactgggtaaagtgccgcatagataccagtcgggataccacccagtcgccccactgggatcaagaattctcactgatccagccaaggtattcgaacacaacatgtgggaccatatgcagtggtctaaagaggaggaggccgctgcaaggaagaaggttaaggagaacagtgccgtgagagtcctattggaggagcaagtaaaatatgagagggaagctagcaagtattgggacacattctacaaaatccacaaaaacaaattctttaaagaccgcaattggcttctgagagagtttcccgagatcctcccagtcgatcaaaagccggaagagaaagctagagagtcctcctgggatcatgtgaaaacatcagccaccaatcgattctcacggatgcactgtccaacagtgcccgatgagaagaaccattatgagaaatcgagcggttcctcagagggacagtctaagacagagtccgatttttctaaccttgattctgaaaaacacaagaagggacccatggagacgggtttgtttccaggaagcaacgccacgtttcgcattctggaggttggctgtggcgccggtaactctgtgtttcccatcctgaataccctggaaaattccccagagtcttttctctactgttgtgacttcgcaagcggtgctgttgagttggtaaagtctcattcatcttaccgggcaacccagtgtttcgccttcgtgcatgatgtttgtgatgacggcttaccttaccccttccctgacggcatcctggacgttattcttctggtctttgttctgtcaagcatacaccccgaccgtatgcagggcgtcgtgaacaggttgagcaagcttctgaaacctggtggcatgcttctgttccgggactacggccgctacgataaaacccagctgaggttcaaaaaggggcactgtttatcggagaatttctacgtgcgcggggacggaactagagcatacttttttacaaaaggagaagtgcactcaatgttctgtaaagcgagtttggatgagaaacaaaacctggtggaccgaagactccaggtgaatagaaagaaacaagttaaaatgcattag

SEQ ID NO: 15504 - DNA, 1797 bp, Artificial Sequence
  Description of Artificial Sequence: Synthetic coding sequence
atggggctacgggcctcaaggcctagtaagctgacatggaagaagtgggctacaaccgccgcatccaacagctgttccaggagcgtgtcctcctgtaggcgctgtactggaggccgtctgatgaaggagccctggcgcaggccttcctctagtatttgttacactagtcggtcttcaaccattaaattctcttctaataagtttaagactctttccgtcctcctgagtcatctgcatctcttcaggcttcacgtgaagatttctcagccatcattgcctattagctcccggggcgctgcctcttccagtcagttccaaggcctgcccagcaggagtgccattttccagcagcagcctgaaaattgtagctctcccccgaacgttgccctcacttgcttgggcatgcagcaacccgcgcagtctcaacaagtgaccatccaggttcaagaacctgttgacatgctgagtaatatgcctggcaccgccgctggtagctcaggtcgggggatttcaatctcccctagtgcaggccagatgcagatgcagcaccggaccaatctgatggccacgttgagttacggacaccgccccctctccaagcaactgtccgcagacagcgccgaggcacatagtgcgcaccaacaaccgccgcactacactactagtgcactgcagcaggccctgctttcaccaacaccgccggactacaccagacatcagcaggtcccacacatcctgcagggtttgctctctccaagacacagcctgacgggccattcggacatccgtttgccccctaccgagttcgcccaattgataaaaaggcagcagcagcagagacagcagcagcagcaacagcagcaacagcaggaataccaggagctgttcagacacatgaaccagggggacgccggctcactggccccttctttggggggccagtccatgaccgagcggcaggctctgtcataccaaaatgcagattcttaccaccaccatacatctccccaacatctgctgcagatcagagcgcaggaatgcgtgagccaggcgtccagtccgactccgccacacgggtatgcccaccagcctgctctcatgcatagcgagagcatggaagaagattgctcgtgtgagggtgccaaggacgggtttcaagactcaaaatcgtccagcaccctgacgaagggatgtcacgactcacctctcttgctgagcaccggcggaccaggtgaccctgaatccctgcttggcacggtgtctcacgcacaggagctgggaatccatccatatggtcaccagcctacggctgccttcagcaagaataaggtaccaagtagggagcccgttatcggaaattgcatggatcggtcctcccctggccaggccgtagagctgccagatcacaatggcctgggataccccgcacgcccatccgtccatgaacatcatcggcccagggctctccaaaggcatcataccattcagaactctgatgacgcctatgtacagctcgacaacctgcccggcatgtccttggtggccggcaaagcactctcatccgctcgaatgtccgacgctgtcctttcccagtcgagcctgatgggcagtcagcagtttcaagatggagagaatgaggaatgcggggcttccctaggagggcatgagcatccggacctctccgatggttcccagcatctgaactcaagttgttacccaagcacctgcatcaccgacatcctgctgtcatataaacaccccgaagtgtcattttccatggaacaggccggagtgtag

SEQ ID NO: 15505 - DNA, 3966 bp, Artificial Sequence
  Description of Artificial Sequence: Synthetic coding sequence
atggcagccgctgccgcctcaggtgccggcggagcggccggcgcaggtaccgggggagctggcccagcaggaagactgttgccaccgccagcccctggctctccagcagcccccgcggcagtgagcccagcggccggacagcctcgaccacctgctccagcctcaagaggccctatgcccgcaagaatcggctattacgagattgacagaaccatcggcaagggaaactttgcagttgtaaaacgcgcaacccatttggtgaccaaggcaaaagtcgctataaagattatcgacaagacgcaattagatgaggagaatcttaagaagatcttccgggaagttcagataatgaaaatgctctgtcacccacatatcatccgcttgtaccaggttatggaaaccgagcgtatgatctatttagtgaccgaatatgcaagtggaggagagatatttgatcacctagtcgcccacggaaggatggcggagaaggaggctcggagaaagttcaagcagatagttacagccgtttatttttgccattgcaggaacatcgtgcaccgcgacctgaaggcggagaacctcttacttgacgccaatttaaacattaaaattgccgattttgggttttctaacctttttaccccaggtcaattgttaaaaacgtggtgcggcagccctccctatgccgctccagaactattcgagggcaaagaatatgatggccccaaagtggatatttggagcctgggtgtcgtcctttatgtactcgtgtgtggagccctacctttcgatgggtccacactacagaacctgagagcccgcgtgctctccggcaagtttagaatccctttctttatgagcactgaatgcgaacaccttatacgacacatgcttgtcttggatcctaacaaaaggctgtctatggaacagatttgcaaacacaagtggatgaagttgggcgacgctgaccccaactttgacagactcattgcggaatgccagcaactgaaggaagagcgccaggtagaccccctaaatgaggatgttctcctggccatggaggatatggggttggataaagaacagacactgcagagcctcagaagcgacgcgtacgatcactattcggccatttactctctgttgtgcgatagacataaacgccacaagaccctgaggctgggagccctccctagcatgcccagagccctggcttttcaggcccccgtcaacatccaagcagaacaggcgggtactgcgatgaacataagcgtgcctcaggtccagctgataaaccctgagaaccaaattgttgagcctgacgggaccctgaatctggattctgacgaaggtgaagagccaagccctgaggcactggtccggtatctgagcatgagaagacacaccgtgggagtcgccgacccacggacagaagtgatggaggatctacagaagttactccccggcttccccggagtgaacccccaagcccccttcttgcaggttgcccccaatgtcaatttcatgcacaacctgttgccaatgcagaacttgcagcccacaggtcagctggaatacaaggagcagtcattgctgcagccaccgactcttcagcttcttaatggcatgggaccactggggcggcgggcctcggatggcggggcaaacatccagctccatgcacagcagctcctgaaaaggcctcgcggaccttctccactcgttaccatgactccggcggtgccagctgtgacacccgttgatgaggagtcatcagacggcgaacccgaccaggaggccgttcagtcctctacctataaggatagcaacactctgcatttgccgacggaacggttctccccagtgcgacgctttagcgacggggctgcttccatacaggccttcaaggcacacctggagaagatggggaacaactcatcaattaaacagctgcagcaagaatgtgagcagctgcagaagatgtacggtgggcaaatagacgaacgcactttggagaaaacacagcagcagcacatgttgtaccagcaggagcaacaccaccagatactccagcagcaaatccaggatagcatctgtcccccgcagccctctcctccactgcaggctgcctgtgagaaccagcctgccctgttgacgcatcagctccagcggctcagaatccagccatcttcccctccacccaaccaccccaataaccaccttttccgccagccaagcaactctcccccgcccatgagcagtgccatgatccagccacacggggccgcctcaagctcccaattccaaggactgccaagcaggtctgcaatcttccagcagcagcctgaaaactgctcctctcctcccaatgtggccttgacgtgcttgggtatgcagcaaccagcgcagagccagcaagtcactatccaagtacaagaacccgtggacatgttgtcaaatatgccgggaaccgccgccgggagtagtggccgcgggatctcaatttcaccctccgccggacagatgcaaatgcagcacagaaccaatcttatggcaacactttcctacggacatcggccccttagcaaacaactgagcgcagattccgccgaagctcattcactgaacgtaaacagattcagtcctgcaaactatgaccaggcacacctgcaccctcatctgttctctgaccagtcgagaggaagcccctcatcctactcccctagtacaggtgtcggtttcagccccacacaggccctcaaggtgcctcccctggaccaattccccactttcccacccagcgcacaccaacagcctccacactatactaccagtgctctgcagcaggccctcctcagcccgaccccaccagattataccaggcaccagcaagtcccacatattctgcagggacttctctccccacgccatagccttacaggacacagtgatattcgacttcccccaacagaatttgcccagctaatcaagcggcagcagcaacagcgccagcaacagcaacagcagcagcagcagcaggaataccaggaactgtttaggcatatgaaccagggcgacgccggctcactcgcgccatctctgggaggacagtcaatgactgagcggcaggcactctcctaccagaacgcggactcctaccaccatcataccagcccacagcacttgttgcagatccgtgcccaagagtgcgtgtcccaggcctcatctcccacacccccacacgggtatgctcatcagccagcgttaatgcactctgaatccatggaggaagactgcagctgtgaaggagccaaggatggattccaagacagcaagagctccagcacattaaccaagggttgtcacgactctcccctgcttttgagcaccggcgggccaggagatcctgagagccttctcggtacagtgtctcacgcacaggagcttggcatacacccctacggccatcagccaacggccgccttttctaagaacaaagtgccgagccgcgagccagtaatcgggaactgcatggacagaagttctccaggccaggctgtcgagctgcctgaccacaatggcctaggctacccagcaaggccttcagtgcatgagcatcataggcctcgagcactccagagacatcacaccatccaaaacagcgatgatgcgtacgtgcagctggataatctcccaggcatgtccctagtcgccgggaaagccctctctagcgctagaatgagcgatgctgttctgtcacaatcaagtctgatgggctcgcagcagttccaggacggcgaaaatgaggagtgcggcgccagcctgggtggacacgagcaccccgacctcagtgacgggtctcagcatctaaactcgagttgctatccgagcacatgcattaccgatattttacttagctacaagcacccagaagtaagcttctcaatggaacaagccggtgtttag

SEQ ID NO: 15506 - DNA, 1569 bp, Artificial Sequence
  Description of Artificial Sequence: Synthetic coding sequence
atgccgagaaagaaggcagcggctgccgcctgggaagagccatcctctgggaacggcaccgctagggcaggccccagaaagagagggggaccagccggccggaagagagagcggcctgagaggtgttcctcatcatcaggcggcgggtcgagcggtgatgaggacgggctggagcttgacggagcaccaggtggaggtaagcgggctgctcgccctgctaccgctgggaaggccgggggggccgcagtagtgattaccgagcctgaacatactaaagagagagtgaaattggaaggaagcaaatgtaagggccaactcctaatcttcggagcaacaaactgggacctcattggccggaaggaagtccccaagcaacaggctgcctatcggaacttgggccagaatctctgggggccgcaccggtacgggtgcttagcaggcgtaagagtgcgtactgtagtgagtggcagttgcgccgcgcattctcttctgataactacagaaggcaagttgtggagctggggtaggaacgaaaaaggccagctcggccatggagacaccaaacgagtggaggcccctcgcctaatagaagggctttcccatgaggtgatagtgagtgcagcttgcgggcgaaatcacacactggccctgacagagacggggagtgttttcgccttcggtgagaataagatgggacaactcggactaggaaaccagactgatgcagtgccaagtccagcccagatcatgtacaacggccagcctatcaccaagatggcttgcggagctgagtttagcatgatcatggactgtaagggcaatttgtactcattcgggtgccccgaatatggacagctcggccataattccgatggtaagttcatcgcacgcgcccagcgtattgagtatgactgcgaactcgtaccgaggcgtgtggccatctttatcgagaagacaaaggatggtcagatattaccagtcccaaacgtggtcgtccgggatgtcgcttgtggcgccaatcacaccttggtgctagacagccagaaacgggtattttcttgggggtttggcggttacgggcgccttgggcacgccgagcaaaaggacgagatggttccccgattggtaaaactattcgacttcccagggagaggagcgagccagatttatgctggctacacctgttcttttgccgtgtctgaggtcggaggcctatttttttggggggcaacaaatacatctagagaaagcaccatgtaccctaaagcagtgcaggatctgtgtggctggaggattaggtcactggcgtgcggtaagagtagcattattgtggccgccgacgagtcaaccatcagttgggggccaagccccacctttggtgagctgggctatggtgaccacaaacccaaatctagtactgctgctcaggaagtaaaaacccttgatggcatcttctcagagcaggtcgccatggggtattcccatagccttgttatcgccagagacgaaagtgaaacagagaaagagaaaattaaaaagcttcccgagtataatccacgcactttatag

SEQ ID NO: 15507 - DNA, 1569 bp, Artificial Sequence
  Description of Artificial Sequence: Synthetic coding sequence
atgcctcgaaagaaagccgcagccgccgcttgggaggagccctcctctggaaacgggacagcgcgcgctggtccgagaaagcggggtgggcccgcaggacgaaagcgcgagcgcccagaaagatgcagctcctcgagcggcggaggcagctctggagatgaagatggcttggaactggatggagcacccggtggcggaaagcgagccgcaagaccagccactgcaggcaaagccggcggcgccgctgttgtgattacagaaccagaacacaccaaggagcgtgtgaaattggaagggagcaaatgtaagggccaactgctcatctttggcgcaactaattgggacctaatagggagaaaggaggtgccaaagcagcaggccgcctacaggaaccttggacagaacctatggggcccccaccgctatggatgcctagccggcgtcagagtgaggactgtcgtgtcagggtcttgcgccgcccacagtctgctgatcacaaccgaaggcaagctgtggagctggggccgaaacgagaaagggcaactcggccatggggatacaaaaagggttgaggccccccggctgattgaggggttatctcatgaagtgattgtctcggccgcttgcggtcgaaaccacaccctggccttgaccgagaccgggtccgttttcgcttttggtgaaaacaagatgggccagctgggtctcgggaatcagacagatgcagtgccctctcccgctcaaataatgtataacggccagccaatcacgaaaatggcatgtggggccgaattttcaatgattatggactgtaagggcaacctctacagtttcgggtgccctgagtatggtcagttaggccataacagcgatggaaagtttatcgctcgagcccagaggatagaatatgactgtgagctggtcccccggcgtgtcgccatcttcattgagaaaaccaaagacgggcagattctgcccgtgccaaatgtagtggttcgcgacgtcgcttgcggcgccaaccacaccctcgtgcttgactcccaaaaaagggtgttctcctgggggttcggggggtatggccggctggggcatgcagagcagaaagatgagatggtgccacgactggtcaaactgttcgatttccccggcaggggagcatcccagatttacgccggatacacgtgcagtttcgccgtgtccgaggtcggtggcctcttcttttggggcgctacgaatacatcccgggaatcgacaatgtaccccaaggctgtacaggatctgtgcggctggaggatcagatcgctggcctgtgggaagtcatcaatcattgtcgctgctgacgagagcacgatatcgtgggggccatcgccaacttttggagaactgggatacggggaccacaagcccaaatctagtaccgccgcccaagaagtgaagaccttggatggtatcttctctgagcaggtagccatggggtacagtcatagtcttgtcatagctagggatgagtccgaaaccgaaaaagaaaaaatcaaaaaattgccagagtataatcctcgcacactctag

SEQ ID NO: 15508 - DNA, 552 bp, Artificial Sequence
  Description of Artificial Sequence: Synthetic coding sequence
atgacagatcagacctactgcgacagactcgtacaggacacccccttcctcactggtcatggacgcctaagcgagcaacaagtggatagaatcatccttcaactgaatagatactatcctcaaatcttaacgaataaggaggcggagaagtttcggaatcctaaggcaagtctcagagtccgactgtgcgaccttttgtcccacctgcaacgaagtggcgagagagactgccaagagttttatcgggctctgtacatccacgcccagcctctgcactcaaggctcccctcccggcacgcgttgcaaaactctgactgcactgaacttgattccggcagtcagagtggcgagttgtctaataggggacctatgtcatttcttgccggcctgggtctggctgtgggtcttgcattattgctttactgttaccctcccgaccctaaggggctccccggaacccggcgcgtactaggttttagcccagttattatcgacaggcacgtttcacggtatttactcgcgtttctcgccgacgatctgggcggcctgtag

SEQ ID NO: 15509 - DNA, 492 bp, Artificial Sequence
  Description of Artificial Sequence: Synthetic coding sequence
atgctggatctcctcgacatagagggactctaccctctgtacaatcgcgtggagaggtatcttgaagagttccctgaggagaggaaaaccctccagatcgatggaccttatgacgaagctttctatcaaaaacttctggacctgtccacggaagatgatgggacagttgcattcgctctgactaaagtccaacaatatcgggtggccatgactgcaaaagattgctctataatgatagcgctttcaccgtgccttcaggatgctagttcggaccagcgaccagtcgtgcccagttcgcgctcccgttttgccttttctgtgagcgtgctggacctagacctaaaaccctatgagagcatcccgcatcagtacaagctcgatggtaagattgtcaactactacagcaaaactgtgcgcgctaaggataacgctgtgatgtccacaaggtttaaagagtccgaagattgtactctggtcttacacaaggtttag

SEQ ID NO: 15510 - DNA, 777 bp, Artificial Sequence
  Description of Artificial Sequence: Synthetic coding sequence
atggcacgcccacctgttccaggatccgtcgtggttcctaattggcacgagtccgcagagggtaaagaatatttagcatgtatcctgcggaagaaccgacgacgggtgttcggcctcctcgagagaccggtgctgttgcctcccgtaagcatagacaccgccagttacaagatcttcgtgtcaggcaagtccggcgtaggaaagacggcattagtagccaaactggctggccttgaggtgcccgtggtgcatcacgagaccacagggatccagacaacagtcgtgttctggcctgcgaaactccaggcctccagtagggtggtgatgttccggttcgagttttgggattgcggggaaagcgcactaaagaagttcgatcacatgctccttgcatgcatggaaaacactgacgcctttctgtttctcttttcttttactgaccgggcgagtttcgaggacttgccaggacagctcgctaggattgctggtgaagctcccggtgtggtgaggatggtgatcgggagtaagtttgaccagtacatgcataccgacgtgcctgaacgggatctaacagctttccggcaagcgtgggaactacccctcctcagggtgaaatcagtcccgggacgcaggctggcggatggccggaccctggacggcagggctgggctcgcggatgtggcccacatcctcaacggcctggcagagcaattgtggcaccaggaccaggtggctgctggattactgcctaacccccctgaatcagcaccggagtag

SEQ ID NO: 15511 - DNA, 333 bp, Artificial Sequence
  Description of Artificial Sequence: Synthetic coding sequence
atggccgataaggtactgaaggagaaacgcaagcagttcatcaggtccgtgggcgaaggtactattaacgggctcctcggagaactgctggaaacacgggtcttatcccaagaagagatagagatcgtgaagtgcgagaacgcaacagtgatggataaggccagagcactgttggattcagtcatcagaaagggggctccggcttgccagatatgcattacatatatctgtgaggaagacagtcatctggcaggaactcttggactgtcagctggcccaacttcgggtaatcacctcacgacacaagacagccagatcgtcctgccttcctag

SEQ ID NO: 15512 - DNA, 924 bp, Artificial Sequence
  Description of Artificial Sequence: Synthetic coding sequence
atggagcccagctctctcgaactacccgccgacactgtccagcggattgccgccgagctcaaatgtcatcctactgacgagcgggtcgcccttcatcttgatgaggaggacaaactacgccactttagagaatgtttttatatcccgaagattcaggatcttcccccagtggacttgagtttggtcaataaagatgagaatgctatctattttctcggcaattcgctaggactgcagccaaagatggtgaagacctacctcgaggaagagttagacaagtgggcaaagattgccgcctacgggcacgaggttggaaaacgcccctggatcaccggagatgaatcaattgtggggctgatgaaggacattgtgggcgcaaatgaaaaagagatcgccctgatgaatgcccttacagtcaatctccacctgctgatgctgtcatttttcaagcccacgcccaaacgctataaaatccttctggaagctaaggccttcccgagtgaccactacgcaattgagtcccagctgcagctgcatggattgaatatcgaagaatctatgcggatgataaagcctcgagaaggagaggagacgcttcggattgaggacattctggaagtaatcgagaaggagggcgactccatcgcagtcatcttgttttcaggcgtccacttctacacaggacaacacttcaatattcctgctattactaaggcaggtcaagccaaaggatgctacgtcggttttgatctggcccacgctgtcggaaacgtggaactctacctccatgactggggagtggactttgcatgctggtgctcgtacaaatatttgaacgcaggtgctggaggaattgctggcgcttttatccacgaaaagcatgcccacaccatcaaaccggcccgctcagaatttttcaactag

SEQ ID NO: 15513 - DNA, 3060 bp, Artificial Sequence
  Description of Artificial Sequence: Synthetic coding sequence
atggaaccaggcgaagttaaagatagaattttggagaatatctcactctcggtgaagaagttgcagtcatacttcgctgcttgcgaggatgagatccctgctatcagaaaccatgataaagttctgcagcgcctgtgtgagcatctggaccatgctcttctatatggcctgcaggacctgtctagcggctactgggttctcgtcgtgcacttcacccgccgagaggcaatcaagcagattgaggtcctgcagcatgttgcaaccaatcttggccgtagtagggcctggctgtatctcgccctaaacgaaaattcactcgagtcctacttgcgcctttttcaggaaaacttgggactgctacacaagtattatgtaaagaacgccctggtgtgctcacatgaccatctcaccctgttcttgactctggtatccggattggaatttatccgctttgaactcgatctggacgctccgtatttagacctggccccttatatgcctgactattataaaccacaatacttgctcgattttgaggaccggttgcctagctccgtgcatgggagtgatagcttgtctctgaacagttttaatagcgtgacttccaccaatctcgagtgggatgacagtgccatcgctcctagctccgaggactacgatttcggcgatgtctttcctgctgtgccttctgtgccgtccaccgattgggaagatggtgaccttaccgatacagtttcgggtccaaggtccaccgctagcgatctgacttcctctaaggcatcaacccgctcacccacccagcgtcaaaatccgtttaacgaggagccggctgaaaccgtatcttcatccgatactacacccgtgcacaccacctctcaggagaaagaagaagcacaggcactggatccccctgacgcctgtaccgaactggaggttattcgggtgacaaaaaaaaagaagattggtaagaagaagaagagtagatctgatgaagaagcttctcctctccacccagcatgttcccaaaaaaagtgtgctaagcagggggatggggactctagaaacggctccccgtcccttggtagagactcacctgacacgatgctggcctcacctcaggaagaaggagaaggaccctctagcacgaccgagtccagtgaaagatccgaaccaggattgctcatccctgagatgaaggataccagtatggaaagacttggacagcctctgagcaaggtcattgaccagctaaacggtcagctggatcctagcacatggtgctcccgggcggagcctcccgaccaatcgtttagaacgggatcaccaggagacgctccggaaaggccgccactgtgcgatttttcagaggggctgagcgcccctatggacttctatagattcactgtagagtcccctagtaccgtgacaagcggcggaggccaccacgacccagccggactcggacagcccctgcatgtgccgagctcacctgaggccgcaggccaggaagaagaaggcggaggaggagagggccaaacaccgagaccgttggaggatacaacacgggaggctcaagagctggaggctcagctgagcctggtccgcgaagggccagtctccgaaccggagccaggtacacaggaggtcttatgtcaacttaaacgggatcagcctagtccatgcttgtcttcggccgaagattccggcgtggatgaaggacaaggaagtcctagtgaaatggttcactcctccgaatttcgcgtggataacaatcacttgttactgcttatgatccacgtgtttagagagaatgaagaacagttgttcaagatgatccgcatgtccacaggccacatggagggcaacctgcaactgctgtatgtgttactcaccgactgctatgtttaccttctgcggaaaggagctaccgagaagccttatttggtggaggaggcagtctcctacaatgaactggactacgtaagcgtgggcctcgatcagcagacagtaaaactggtgtgcacgaaccgcagaaagcaattcctcctggacaccgccgatgtagcactagccgaatttttcctggcctccctcaaatctgcaatgattaaggggtgcagagagccgccctacccatcgatactcacagacgccacgatggagaagttggccctggccaagtttgtggcccaagagtctaaatgcgaggctagcgcagtcacagtccgcttttatgggcttgtgcattgggaagatcccacggacgaatctttgggtcccactccctgtcactgctcccctccagagggcacaatcacaaaggaggggatgttacattacaaggcagggacttcatatcttgggaaggagcactggaaaacatgtttcgtagtgttgtctaacggaattctctatcagtatcctgatcgtacagatgtgatacccctgctcagcgtgaacatgggtggtgagcagtgtggcggctgccgccgagctaacacaactgaccgaccacatgcctttcaagtaatcttgagtgatcggccatgcctggaactttctgccgagtccgaggcggaaatggcggaatggatgcaacatctgtgccaggccgtgagtaagggcgtgatcccccagggcgttgctcccagcccatgtattccctgctgcttggttctgaccgacgatcgtttgtttacctgccacgaggactgtcaaaccagcttcttccggagcctcggtactgccaaactaggggacatcagcgcagtgtctacagaaccaggtaaggagtactgcgtgctcgagtttagtcaggactcccagcagctcctgcctccctgggtgatctacttgtcatgcacttcagagctggatagactgctgagcgcgttgaactccggctggaagacaatctatcaagtggacctgcctcatacggcgattcaagaagcctcaaacaagaaaaagtttgaggacgctctcagtctcattcatagcgcttggcagagatctgatagcctttgtaggggacgtgctagtagggacccttggtgctag

SEQ ID NO: 15514 - DNA, 318 bp, Artificial Sequence
  Description of Artificial Sequence: Synthetic coding sequence
atgaaaccttttgaggacgcactgaaaaaccaacccctggggccagtcctgtccaaagcagctagtgtggaatgcatctcacccgtgagcccaagagcccctgacgcgaaaatgctcgaagaactgcaggctgagacatggtatcagggagaaatgtcccgtaaggaggctgaaggcctgttggagaaggacggggactttctggtgcggaaatctacaacaaatcccgggagtttcgtgctcacaggaatgcacaatggccaggcgaaacatctcttgctagttgatcccgaggggaccaggtccaatagctattag

SEQ ID NO: 15515 - DNA, 318 bp, Artificial Sequence
  Description of Artificial Sequence: Synthetic coding sequence
atgaagccttttgaggatgccctgaagaaccagccattgggtcccgtgttgtctaaggccgctagcgtagaatgtattagtcctgtgtccccacgtgcaccggacgctaaaatgctcgaagagctgcaggccgaaacctggtatcaaggcgaaatgagtcggaaggaggctgagggcctactagagaaagatggcgacttccttgttaggaaatccaccactaatccagggagtttcgtcttaactggcatgcacaacggccaagccaaacacttgttgctggtcgatccagaaggcaccagatccaattcatattag

SEQ ID NO: 15516 - DNA, 1785 bp, Artificial Sequence
  Description of Artificial Sequence: Synthetic coding sequence
atgttacctcgaactaaatacaatcggttccggaacgattccgtgaccagtgtcgacgatctgctgcactcactctctgtgtccgggggcggtgggaaggtgtctgctgctagggctactcccgccgcagcaccttacttagtttccggggaggcactgaggaaggcccccgatgatggccctggctcactcgggcatctcctccacaaagtgtcacatctcaagctgtcttccagtggcttgagaggcctgtcttccgcggctcgggagagggctggtgctagactgtcaggttcctgctccgcccccagcctggctgctccagacgggagcgcacccagtgctcctcgcgctcctgctatgtcggccgctaggaagggcagacccggggacgagccactcccaaggcctccacggggtgcacctcacgcatccgaccaggttcttggtcccggcgtgacatatgtggtgaagtatctgggttgtatcgaagttctccggagcatgaggtctctcgatttctctactaggacccagattaccagagaagcgatctctcgcgtttgcgaggccgtgcccggtgccaagggcgcttttaagaaacgtaagccaccctccaagatgcttagctctatattaggtaagagcaacctccagtttgctgggatgagtattagtttaactatttccactgcttcacttaatttgcgcaccccggattctaagcaaatcattgcgaaccaccacatgagatccatcagttttgcaagcggtggcgatccagacaccacagactacgtcgcatatgtcgccaaagacccagtaaacaggcgggcctgtcacattttagaatgttgtgacggcttggcacaagacgtcatcggaagtatcggtcaagcctttgaactgaggttcaaacaatatcttcagtgccctactaagatcccagctttacacgacaggatgcagtccctcgatgaaccctggacagaggaggaaggagacggctctgaccacccatattacaactccatcccctctaagatgccccccccgggaggattcctggacacaaggcttaagccaagaccccacgcacctgatactgcgcagtttgcgggtaaagaacaaacctactaccagggacgccatctcggggatacctttggtgaggattggcagcagaccccgcttagacagggcagctccgatatctacagtactcccgaaggcaaattgcacgtcgcccccaccggtgaggcaccgacttacgtgaacacgcaacaaatacccccacaggcctggcctgcggccgtttcatctgctgagtcctcaccccgtaaggacctcttcgacatgaaaccatttgaagacgctctgaaaaaccagcccctggggcctgtgttaagcaaggctgcctctgtggaatgcatctcacctgtgtcccctcgagcccccgatgctaaaatgttggaagaacttcaagccgagacatggtaccaaggcgaaatgtcccggaaggaagcagagggcctgttggaaaaggacggcgacttcctggtaagaaaatccactactaaccccggatctttcgtactgacgggtatgcacaatggccaggcaaaacacttactgcttgtcgaccccgaggggaccatccggactaaagatagggtcttcgacagcatctcccatcttattaaccaccatctcgaatcaagtttacctattgtgagcgccggcagtgaactgtgtctccagcagccagtggaacgtaagcaatag

SEQ ID NO: 15517 - DNA, 693 bp, Artificial Sequence
  Description of Artificial Sequence: Synthetic coding sequence
atgaataccctgatggacgttcttcgccatcggcccggctgggttgaggtaaaggacgaaggtgaatgggacttttactggtgcgacgtgtcctggctccgcgagaacttcgatcacacctatatggatgagcatgtgcgaattagccactttagaaaccactatgagctgactcgcaaaaattacatggtgaaaaacctcaagcggtttaggaagcagctggagagggaggctggcaagctggaggcggccaaatgcgacttttttccaaagacatttgagatgccgtgcgagtaccacctctttgtggaggaattcagaaagaatccggggatcacctggataatgaaacctgacacaaggtcaagtgacgatcagaaagacgacataccagtcgagaactatgtagctcaaagatacatcgagaatccatatctcataggagggcggaaatttgacctgagagtatacgtgttggtgatgtcttatataccactgcgcgcctggctgtacagagacggcttcgctcggttctccaacacccgttttacattgaacagtatagatgatcagtatgtacatcttacaaacgtggcagttcagaaaacctcacccgactaccatccaaaaaaagtcgccccaggcggtcagtgcgtgccaattaccgatagccaacagccgggtcggctctag

SEQ ID NO: 15518 - DNA, 1068 bp, Artificial Sequence
  Description of Artificial Sequence: Synthetic coding sequence
atgaacacactcatggacgtattgcgacataggcccggatgggtcgaggtaaaagatgagggcgagtgggatttctattggtgcgacgtatcttggctgcgggagaattttgatcatacgtacatggacgaacatgtgcggatctcacatttccggaatcattatgaactcacccgcaaaaattacatggtgaaaaacctgaaaaggtttcggaagcagctggagagagaagccggcaagctcgaagcagcgaagtgcgacttcttccctaaaacttttgagatgccttgcgaatatcacctgttcgtcgaggaattccggaagaaccctgggattacctggataatgaagcccgataccagatcaagtgacgaccaaaaagacgacatcccggtggagaactacgtggctcaacgttacatcgaaaatccttacttaatcgggggcagaaagtttgatcttagggtttacgtgctagtgatgtcctacataccgttgcgcgcatggttatatagagacggtttcgcccgattcagtaacacccggtttaccctcaattcaatcgacgatcagtatgtgcacttaaccaatgtcgccgtgcaaaagacctccccagattaccaccctaagaaaggatgcaagtggacactgcagcgctttaggcagtatctcgcatcgaaacatggcccggaagccgttgaaaccctgttccgagacatcgacaatattttcgtcaaaagtctacagtccgtccagaaggtcattatatctgataagcactgcttcgagctgtatgggtatgacattctcattgaccaggaccttaaaccttggctacttgaggttaatgctagtccaagcctgacagcttcctctcaagaggattatgaactaaaaacctgcttgttggaagacaccttgcacgttgtggatatggaagcaaggcttcgacagagatccgaggagacaaccgaggcagccctgctgttgcctagttcatctgaggagagctttcagctgatcccctcctgtcaggaagaaatatccctttcccgtccgtgcgtttag

SEQ ID NO: 15519 - DNA, 840 bp, Artificial Sequence
  Description of Artificial Sequence: Synthetic coding sequence
atgtctcgtcctaagaaccagaattacaagggacatggtctatctaaagggaaagagcgcgagcagcgggccagtattaggttcaagacaacgcttatgaatactctgatggatgtgctgcgccacagacctggctgggttgaggtgaaggacgaaggggagtgggatttctattggtgcgacgtcagttggctgagggaaaactttgaccacacctatatggacgaacatgtcagaatctcccactttcgcaaccactatgaactgactcggaaaaactacatggttaagaacctcaaacggttccggaagcagttggagcgggaggctgggaagttagaggctgccaagtgtgatttcttccctaagacttttgagatgccttgtgagtaccatttgttcgtcgaggagtttagaaaaaatccagggatcacctggatcatgaaacctgtcgcccgttcgcagggtaagggaatctttctcttccgccgccttaaggatatcgtcgactggcgcaaagacacacggtcctccgatgatcaaaaggacgacattcctgtggagaactacgtagcccagaggtatattgaaaacccttacctgataggtggccgaaaatttgacctgagggtttatgtcctagtgatgtccatgttcacctcccctacctggttgtgcaagaaacatctcccaacaactacacaaaggcgggcggcctccggccggtgctcggctagtggcagtacctggcgtcctaacacaggacctcgacagtggcggcacagttctggcacgtcaacaacatcattaagcaaggcctgccgtgtgtgcaggaggtag

SEQ ID NO: 15520 - DNA, 1116 bp, Artificial Sequence
  Description of Artificial Sequence: Synthetic coding sequence
atgagcagaccaaagaatcagaactacaagggccacggtttatccaaagggaaggaaagggagcaacgggcctcaatccgctttaaaaccacgttaatgaatacactcatggacgtcctacggcaccgtcccggctgggtggaagttaaggacgagggcgagtgggacttttactggtgcgacgtaagctggctccgggaaaatcttgagagagaagctggaaagttggaggcagccaagtgtgacttcttccccaaaactttcgagatgccttgtgagtatcacctgttcgttgaagagtttcgcaagaatcctgggatcacgtggatcatgaaaccagtagccaggtcccaggggaagggcatcttcttattccgacgccttaaagatattgtggactggaggaaggacacccggagtagcgatgaccagaaggacgacattcctgttgagaattacgtggcccagcgctatattgagaatccctaccttatcggcggtagaaagtttgatctcagagtgtacgtgctggtgatgagctatatccctttgagagcgtggctgtaccgtgatggatttgctcgcttttcaaacacacggttcacccttaactctattgatgatcagtacgtccatctgactaatgtggccgttcagaagacgtcacccgattaccaccccaagaagttacatcccactgttggcccactttgtattcactcgccagaaaatggatcacttagtgtcacaccttggccatgggacgcccacatgggctgcaagtggacgctgcaaagattcagacagtatttagcgagcaagcatggtcccgaggcagttgaaacactttttagagacatcgataatatattcgtgaagagccttcagtccgtacaaaaggtgataatttcagataagcactgtttcgaactgtacggttacgacattctaatagaccaggacttaaaaccctggctgctggaggtgaatgcaagcccaagcctcacagcctctagtcaggaggattatgaactgaaaacctgcctactggaggatacactccatgtggtagatatggaggctagcttctctcccatcatccccgcggaagtgtag

SEQ ID NO: 15521 - DNA, 1320 bp, Artificial Sequence
  Description of Artificial Sequence: Synthetic coding sequence
atggtcccttcccgagaagccctcttgggacccggtaccacggctatccggtgtccgaagaaactccaaaatcaaaactacaaggggcacggactgagcaagggtaaggagagggagcagcgggcctctatccggttcaaaacaaccctaatgaacaccctcatggacgtgctcagacatagaccaggctgggttgaggttaaggatgaaggcgagtgggacttttattggtgcgacgtgagttggttaagagagaacttcgaccatacttacatggatgagcacgtgaggattagccattttcgcaaccattatgagcttacgcgcaagaattacatggtgaaaaacctgaaacggtttcggaaacagttggaacgcgaagccggaaagctcgaggctgctaagtgcgattttttcccaaaaacattcgaaatgccatgcgagtaccacctgttcgtggaggaattccggaaaaatcctggcattacatggataatgaaacccgttgcacgttctcaagggaaaggtatctttttgttcaggcggttaaaggacatagttgattggcgcaaggatacccggtctagcgatgatcagaaagatgacataccggtcgaaaactacgtagcacaaaggtatattgaaaatccttatctgattggggggcgtaagttcgacctgcgggtctatgtgctggtcatgtcagtgttcgccgagtgtctcctgtggtccggacaccggcgacaggacgtgcacctcacaaatgtggcggtacagaagacttcacctgattatcaccctaagaagggatgcaaatggactctgcagcggtttcgccaatatctggcttctaaacacggacccgaggcagtcgaaaccctctttagagacatcgacaacattttcgtgaaatcccttcagtccgtgcaaaaagtcattatcagcgacaaacattgtttcgaactgtacgggtacgatattctgatcgaccaggatttaaagccatggttgctggaagtgaacgcttcaccaagcttgactgcctcatcacaggaggactacgaactgaagacttgtttgttagaagatactctccatgtggtggatatggaggcccggttgaccggacgggaaaagagagtgggagggttcgacttgatgtggaatgatggccccgtgtccagggaagagggcgctcctgatttgagcggcatgggtaattttgtgacaaacacacatctgggatgtgttaatgaccggaagaagcagttgcgacaactgttctgcagtctgcaggtgcagaaaaaagcgtctagttag

SEQ ID NO: 15522 - DNA, 501 bp, Artificial Sequence
  Description of Artificial Sequence: Synthetic coding sequence
atgaaagagatgttagctaaagatcttgaggaaagccagggtggcaagagcagtgaggtgctgtccgctacagaactgcgcgtgcagctggcacagaaagagcaggaattggctcgggccaaagaggcgctgcaggcaatgaaggcggaccggaaacggttgaaaggggaaaaaacggatctcgtcagccagatgcagcagctttacgccacccttgaatcccgcgaagagcagctacgcgatttcatcaggaactacgaacaacacagaaaggagtctgaggacgcagttaaagccctggcaaaagagaaagatctactggagcgggaaaagtgggaactgcggcggcaggcaaaggaggccaccgaccacgccacagcccttcgttctcagttggacctcaaggacaaccggatgaaggaactggaagcggaactggcgatggctaagcagtctttagctactcttactaaggacgtgccgaaacggcattccctctag

SEQ ID NO: 15523 - DNA, 2328 bp, Artificial Sequence
  Description of Artificial Sequence: Synthetic coding sequence
atgatggaggataataagcagctcgcactcagaattgatggagccgtgcaatctgcctctcaggaggtgaccaatctgagggcagagctgacagccactaatcggaggttagccgaattgtctggcggaggcggtccaggacccggaccaggtgccgccgccagtgcctccgctgccggggactctgcggccactaatatggaaaatccacagttgggagctcaggtccttctgcgcgaagaggtgagtagactgcaggaggaggtgcacttattaaggcagatgaaggagatgctggctaaagatctggaagagagtcagggtggaaagtcctccgaagtgctcagcgctactgagctgagagtccagctcgcccagaaagagcaggaacttgcacgagcgaaagaagccctccaagctatgaaagctgatcgaaaaagactgaagggcgagaagacagatctggtctctcagatgcaacaactgtatgccacactggagtcccgcgaagaacaactaagagatttcatcagaaattatgagcagcaccgcaaggagtccgaagatgccgtaaaagcattagccaaggagaaagacctgctggagcgtgagaagtgggagctccgcaggcaggccaaagaggctacagaccatgcaacagcacttcgctctcaactggacctgaaggataacaggatgaaggagcttgaggctgaattggctatggcaaaacagagtctggcgaccctcactaaggacgtgcctaaaagacatagtctagcaatgcctggcgaaacggtgctgaatggtaaccaggaatgggtggttcaggccgacctacctctgactgcggccatccggcagtcacaacagacgttataccacagccatcctccacatccagccgacagacaagcggtcagagtgtctccttgccacagccggcaaccctctgtgataagcgatgctagcgccgccgagggggatagaagctccactccatctgacatcaattctcctaggcacaggacacactccctttgtaacggtgacagccctggtcccgtgcagaaaaatctgcataatcccatcgtgcagagcctggaagacctcgaggaccagaaacgtaagaaaaaaaaggaaaagatgggcttcgggtctataagccgggtttttgctcgaggcaaacagcggaagtcactggaccccggcctctttgatgatagcgactctcagtgtagtcctactcggcaatccctctctctgagtgagggcgaggagcagatggatcgcctccagcaggtggaactcgtgagaacaactcccatgagtcattggaaggcgggcaccgttcaggcatggctcgaagtcgtcatggcaatgcccatgtatgtgaaagcatgtactgaaaatgtgaagtctggtaaggtcttgctttcactatccgacgaggacctgcagttaggcctgggcgtgtgctccagcttgcatcggaggaaattaaggctggcaatcgaagattaccgggatgcagaagctgggcggagcctgagtaaagccgcggaactggaccatcactgggtggctaaggcttggctgaatgacattggcctgagtcagtactcccaagctttccaaaaccacctggtggatggaaggatgctcaatagcttaatgaagagagatctcgaaaaacacttgaatgtgagcaagaagtttcaccaggtctccatcctcctggggattgaactactgtaccaggtaaatttcagccgtgaggccctgcaggaaagacgggccaggtgcgagacacaaaatattgatcctgtcgtttggacaaatcaaagagtattgaaatgggtccgggacattgacctgaaagagtacgccgacaatttgacaaattctggcgtccacggtgccgtccttgtgcttgagccgacctttaacgccgaagccatggctaccgcattgggtattccatccggcaaacatatcctgcggcgacacttggctgaggaaatgagtgccgtcttccacccagccaactcaaccggcataagggaggccgaacgcttcggtacgcctccggggcgcgcctctagcgtaacccgagctgggaaggaagaaaattcttctggcttgaaatataaggctgggcgtttgccacttggaaaaattggtcggggattttccagcaaagacccagacttccacgatgattacggttccttacagaatgaggactgcggggatgatgatccacagtcacggctggagcagtgccgcctggaaggctataactcactggaagtcactaacgtgtag

SEQ ID NO: 15524 - DNA, 861 bp, Artificial Sequence
  Description of Artificial Sequence: Synthetic coding sequence
atgtactctcttgataggattttcgctggctttaggacacgctcccagatgcttctcgggcacatagaagagcaagacaaagtgctccactgtcaattcagcgataactcagatgatgaggagtccgagggccaggagaagtctggcacacgatgtaggtcacgcagttggatccagaagcctgactcagtgtgctcactagtagaactgagtgacacccaggacgagacccaaaaatcagacctggaaaacgaagacctgaaaatcgactgcttgcaagagtcgcaggagctgaatctccaaaaactgaaaaattcggaaagaatcctgacggaagcaaaacagaagatgcgcgagttgacgataaacatcaagatgaaggaggatttgatcaaggaattaatcaagactggaaatgatgctaaaagcgtctctaaacagtactcacttaaggtgacaaaactggagcatgacgcagaacaggcaaaagtagagctcatagaaactcaaaagcagctgcaagagctcgagaacaaggatctttcagatgtggcgatgaaggtgaagctgcagaaagagttccgcaagaagatggacgcagctaaactgagggttcaggttctgcagaaaaagcagcaagattccaagaagttggctagcctgagcatccagaatgaaaaaagggcaaacgagttagaacagtccgtagatcacatgaagtaccaaaaaattcagctccagcgcaagctgcgcgaggagaatgaaaaaagaaagcagctcgatgctgtgatcaagcgtgaccagcagaagattaaggttatcctcagctatatcccggctaaatacaatatgaaatgttag

SEQ ID NO: 15525 - DNA, 1662 bp, Artificial Sequence
  Description of Artificial Sequence: Synthetic coding sequence
atgaacaagaacacctctaccgtggtttctcctagtctcctcgagaaagatcctgctttccagatgattacgatcgctaaggagacaggcttaggactgaaagtgttaggtggaatcaacagaaatgaagggcctctggtatatatccaggagattatccctggtggcgattgctacaaagatggcaggctcaaaccaggcgaccagctggtctcagtcaataaggagagcatgattggcgtcagctttgaagaggccaagagtataattaccggagcaaagcttcgactcgaaagcgcatgggaaattgcctttattagacagaagtccgataacatccaacccgagaacctgagttgtacatcactgattgaggcaagcggagaatacggtcctcaggcttccaccctctccctcttctcttcaccgccagaaattctgatccccaagacgtcttctacccctaagaccaacaatgatatccttagcagctgcgagatcaagacaggctataacaagacagttcaaataccaatcactagtgagaatagcactgtaggactcagcaatacagatgtcgcctcagcttggaccgagaactatggattgcaggagaagattagtctgaaccccagcgttaggttcaaagctgagaagctggagatggctctgaactacctgggcattcagccgacaaaggagcagcaccaggccctccgccagcaggtgcaagcagacagcaagggaactgtcagtttcggggatttcgtgcaggttgcccgtaatctgttttgtctgcaactggatgaagtgaatgtcggggcgcacgagatttccaatattttggatagtcaactcttgccatgcgattcaagcgaggctgacgagatggagcgtctcaagtgcgaaagagacgatgccctgaaggaggtaaacaccctgaaagagaagctgttagagagcgacaaacagcgcaagcaactgactgaagagttacagaatgtcaaacaggaagccaaagcggtcgtagaggagaccagggctctcagaagtaggatccaccttgcagaggccgcccaaaggcaggcccatggaatggagatggactatgaggaagtcatccgacttctcgaagccaagataaccgagctcaaggcgcagctggcagactactctgaccaaaataaagaatcagtccaggacctcaaaaaacgcataatggtgttggactgccagctgagaaagagcgagatggctcgcaagaccttcgaggcttctacggagaaactgctgcattttgtggaagccattcaagaggtattcagcgataattcgacccctttgtccaatttgtccgagcgaagggcggtgttagcctctcaaacctcgctgactccactgggtcggaatggcaggtcaatccctgctacgcttgccctggaatcgaaggaattggtcaaatcagtccgtgcattattggatatggattgtcttccttatgggtgggaggaagcctataccgcagatggcatcaaatactttataaatcacgtgacacagactacctcgtggattcatccagtcatgtctgttcttaacctgagtcgatcagaggagaatgaagaagattgttcccgcgaactcccaaaccaaaagtcatag

SEQ ID NO: 15526 - DNA, 564 bp, Artificial Sequence
  Description of Artificial Sequence: Synthetic coding sequence
atggctgccccgggagctctgctcgtcatgggtgtcagtgggtctggaaagagcacagtgggtgctctcctagcttcagaactcggctggaagttttacgacgccgatgattaccacccggaagagaatcgccgtaaaatggggaagggaatcccgttgaatgaccaagaccgaattccatggctgtgcaatctgcacgacatactcctaagggatgtggcgtctggacagagggtggtcctagcgtgtagcgcgctgaaaaagacctaccgagatatactaactcagggcaaggatggcgtggctctcaagtgtgaggaaagtggaaaagaggctaaacaagccgagatgcaacttctggtggtgcacctgtctgggtcctttgaagtgatatctggccgcttgctgaagcgtgagggacactttatgcctcctgaactcctgcaaagtcagttcgaaacattggaacccccagcagcaccggagaatttcattcagatcagtgttgacaagaacgtcagcgagatcatcgctaccataatggaaaccctgaagatgaagtag

SEQ ID NO: 15527 - DNA, 1134 bp, Artificial Sequence
  Description of Artificial Sequence: Synthetic coding sequence
atggcaactattcccgactggaaactgcagctgctcgcccggcgccgccaggaggaagccagtgtccgtgggcgggagaaagcggaacgcgagagattgtcgcagatgcccgcttggaagcgcggcctcctggaaaggcgtcgcgctaagctagggctctctccgggggaaccttctccagtacttgggactgttgaggccggcccaccagatcccgacgagagcgccgtcctgctggaggccattgggcccgttcatcagaacaggttcatccgacaggaacggcagcagcagcagcagcagcagcaaagaagtgaggagctgcttgcagagcgaaaaccggggcctcttgaagcgagggagcgacggccaagtccaggcgagatgcgggatcaatccccaaagggtcgagagtcgcgcgaagagcgcctttctccccgcgaaacaagagaacggaggttggggatcggcggcgcccaagaattgtctctaagacccctcgaggctcgagactggcgtcagtcccctggcgaggttggcgaccgatcatcgcgcctgtccgaagcctggaaatggaggctttcgccaggcgagacgccagagcggagcttacggctagctgagtcacgtgaacagtccccacggcgcaaagaggtagagtctcgactttctcctggggaaagtgcctatcaaaaactcggtttaacagaagcacataaatggcgccctgacagccgcgagtcacaggagcagtccctggttcagttggaggccactgagtggcgactgcgctcaggggaggagaggcaggattattccgaggagtgcggacgcaaggaagagtggcctgtgcccggggttgctccaaaagaaaccgcggagctctctgagacccttaccagggaggcacagggcaatagctcagcgggagtggaggcagccgaacagcggcctgtagaggatggcgagcgggggatgaaaccgactgagggatggaaatggacactaatcatgagtctggccggaaaggggaaccagcatttggtgacttgcttcccgcatcctgtctccggtggacgggctaactgccccatctccacgttaatacagagcccttggtgtggatggggatag

SEQ ID NO: 15528 - DNA, 2223 bp, Artificial Sequence
  Description of Artificial Sequence: Synthetic coding sequence
atggaggcagacggagacggggaggaattggcacgtctccgctcagtgtttgcagcctgcgatgccaacaggagtggacggctggaacgcgaagaatttcgtgccctttgtacggaactgagggttcgccccgctgatgctgaggctgttttccaaagactggacgccgacagggacggcgctatcaccttccaggaatttgcaagaggctttctgggtagcctacgaggcggtcgcagacgggactggggccccctggaccctgcacccgccgtgtccgaggccgggcctgagacccacgacagcgaagaggatgagggtgatgaagacgccgcggccgcactggcgacatcctgtggtcccgccagccctggccgtgcgtggcaggactttcaggcaaggctcggcgacgaagccaagttcattcccagagaagagcaggtgagtacactctaccagaatatcaatttggtcgagcctcgtttaattcaaccttatgagcacgtgattaaaaatttcattagggagatccgactccagtcgacggagatggaaaacttggccattgccgtcaagcgtgcccaggacaaagccgccatgcagcttagtgagctcgaagaggagatggaccagcgcatccaagcggcggagcataagacgcgaaaagatgaaaagcgcaaagccgaagaggcactgtctgacttacgccgacagtatgagaccgaggtgggagacttgcaggtcactattaaaaaactgcgaaaactggaggaacagtcgaagcgggtgtcccagaaagaggacgtggctgctcttaagaagcagatttatgacttgtcgatggaaaaccaaaaagtgaagaaggatcttttagaagcccaaaccaacatcgccttcttgcagagcgaattagatgcactgaagagcgactatgccgaccagtccctgaacaccgagcgtgatctcgaaatcatccgggcttataccgaagatagaaacagcttggaaaggcagatcgaaattcttcagactgccaatagaaaactgcacgattctaatgacggcttaagaagcgctctagagaattcatattctaaattcaaccggtccctccacatcaacaacattagcccaggtaacacgatctcaaggagcagtcctaaattcatcggacatagtccacagccattaggctatgaccggtcatccaggagtagttacgtcgatgaggactgcgattccctcgcattgtgcgaccctttgcagcgcacgaactgtgaggtggattctctgcccgagagctgttttgatagtgggctatcaaccctcagggatcccaatgagtacgattcggaggtcgagtataagcatcagagaggttttcaacggagtcacggcgttcaagaatccttcggtggagatgcatccgataccgacgtccctgatatccgggatgaagagacttttgggttggaagacgtcgcctctgtcctggactggaaacctcagggtagcgtttcagaagggagcattgtgtcatcctcgcggaaacccatatcagccctatctccgcaaactgaccttgtggacgataacgcaaagagcttttcctcccaaaaggcctacaagatcgttttagcaggcgacgccgccgtggggaagtcatcattcctcatgcggctttgtaaaaatgagtttagggagaatatcagcgcgaccttaggggtggattttcagatgaaaaccttgattgtggatggagagaggacagtgctccaactttgggacacagccggccaagagcggttccggtcaattgccaaaagttatttccggaaggcagacggagtgctgctgctctacgacgtgacttgtgagaagtccttccttaacattcgggaatgggttgatatgatcgaagacgcagcccatgaaactgtgcctatcatgttggttggaaacaaagctgatatccgggacaccgccgcaacagagggacaaaagtgtgtccctggccacttcggtgaaaagctagctatgacatacggcgcactgttttgcgaaaccagcgcgaaggatgggagcaacatagtcgaggctgtgctgcatctggcgagggaagtcaaaaaacggacagacaaggacgattcgaggtccattactaacctgacgggcactaattcaaaaaagtcacctcagatgaaaaattgttgtaatggctag

SEQ ID NO: 15529 - DNA, 4125 bp, Artificial Sequence
  Description of Artificial Sequence: Synthetic coding sequence
atggaagagaatgagtctcagaagtgcgagccctgtctgccctactctgccgaccgccgacagatgcaggagcagggcaagggaaatctccatgttacatctcctgaagacgctgaatgcaggcgcactaaggagcgtctgtctaacggaaatagcagagggagtgtaagtaaatcatccaggaacattccacggcggcataccctgggtggtcccagatccagcaaggaaatcctggggatgcagacatcggagatggaccggaaacgcgaggcatttctcgagcatctcaagcagaaataccctcaccatgcgagtgctataatgggccaccaggagcgcctgcgggaccaaacccgcagccccaaactgagtcactcacctcaaccacctagcttgggggaccccgtggaacacctttcagagacttctgccgactcactagaggccatgagcgaaggggacgcccctaccccgttttcccgcggctcacgtactcgcgcttccctgcctgtggtgaggagcactaatcaaaccaaagaacgcagcttaggagtactgtacctgcagtacggggatgagacaaagcaattgcgcatgcctaatgagataacatcagctgacaccatcagagccctgttcgtctcagcctttccacagcaactgacaatgaaaatgcttgaaagcccatccgtggctatatacattaaagacgagtctcgcaatgtatactacgagctaaatgacgtgcggaacattcaggacaggtcactccttaaggtgtacaataaggatccagcgcatgcatttaaccacacaccgaagacaatgaacggcgacatgcgcatgcagagagagttagtctacgctagaggcgatggacctggcgctcctcggcctggctcaactgctcaccccccccacgccattcctaactcaccaccctctaccccagttccccactctatgcccccgtctcccagcaggattccttatggcggtacccggtccatggtggtgccaggcaatgctactattccacgggatagaatttcctccctgcccgtttctcggcctatttctccatctccctccgccatcttggaacgcagggacgtaaaaccggatgaggatatgagcggcaagaatatcgcaatgtaccgcaacgaaggcttctacgccgacccctacttgtaccatgagggccgcatgtccatagcctcttcccacggggggcacccgctagacgtcccggatcatataatcgcctatcatcggaccgctatcaggtccgcctcagcgtactgcaacccgtccatgcaggcggagatgcatatggagcaatccctgtaccgtcagaaaagtcggaaataccctgatagtcatctcccaactctgggttccaagacaccaccggccagtcctcatcgtgtcagtgaccttaggatgatagatatgcatgctcattataacgcccatggacctccccacacaatgcagccagacagagcttctccctcaaggcaagccttcaagaaggagcctggaacactggtgtatattgagaagccccggagtgctgcagggctgtcttctctggtggacctgggcccacccttgatggagaagcaagtgttcgcttattcgaccgccacaatccccaaggaccgagagaccagcgaaaagatgatgaagactaccgccaaccgcaatcacactgactccgccggtactcctcatgtgtctggcggaaagatgttgagcgcactcgagtcgacggtgccaccaagccagccacccccggtggggaccagtgctatccacatgtccctattggaaatgaggcggagtgttgctgagctcagattacaattgcaacagatgagacaactgcagcttcagaatcaggagctgctacgggccatgatgaaaaaagccgaattagaaatctccggtaaagtcatggaaacgatgaaacgattggaggatcctgttcagcgacagcgagtgcttgtggaacaggagagacagaaatacctacatgaggaggaaaaaattgtgaagaagctctgcgaactggaagacttcgtggaggatctcaaaaaggactccaccgcggcctctcggctcgttacgctgaaggatgtcgaagatggcgcatttttattacgccaggtgggagaggctgtagcaacactgaagggggagtttcccacacttcagaataaaatgcgggccattttgagaattgaggttgaagctgttaggtttttgaaggaagaaccccataaactggacagcttgctcaaaagggttcggagcatgactgacgttctgaccatgctgagacgccacgtcaccgatgggttgctcaagggtaccgacgcggctcaggccgcacaatacatggccatggagaaagcaaccgccgctgaggtgctgaaatcgcaggaagaggcagcacatacatccggacagccttttcattctactggtgctcccggtgacgcaaaaagcgaggtggtgccgctcagcggcatgatggtacggcacgctcagagctctcctgttgtgatccagcctagtcagcactcagttgcgcttttgaatcctgcacaaaatctccctcatgtggcaagttcaccagcagtccctcaggaggccaccagcaccctccagatgtcccaggcaccacagtctccacagattcctatgaacggctccgccatgcagtcattatttatcgaggaaattcattctgtgagtgctaaaaatagagccgtatccattgagaaggccgagaagaaatgggaagagaagcggcaaaacctcgaccattacaacggcaaggaattcgaaaagttactcgaagaggcacaggccaacattatgaaatcaatcccaaacctagagatgccgcccgccacgggccctctccctcgcggcgacgctccagtggacaaggttgagctgagtgacagccctaattcagagcaagacttggaaaaactaggcggcaagtcaccaccacctccacccccacctccaagaaggtcatacctccccgggagtgggctcacaaccacacgttccggcgacgtggtctacactggacgcaaagaaaacattaccgccaaagcttcatccgaagacgcaggccctagcccccagacccgagcaaccaaataccctgctgaggagcccgcttcggcttggaccccaagtccccctcccgtgactacctcatctagtaaggacgaagaggaggaagaagaggagggcgataagataatggccgaactacaggcattccagaagtgttcttttatggatgtgaactccaactcacacgctgagccctccagagccgatagccatgtgaaggacactcgatctggcgcgaccgtcccgcccaaagaaaagaagaatttggagttcttccacgaggacgtccgcaaaagcgatgttgaatatgagaacggcccccagatggaatttcagaaggggtcttctggcgcccctcaaacatcccgtatgcccgtccccatgagtgcaaagaaccgacctggaacactggacaagcccgggaagcagtccaagttgcaggatccacgacagtacaggcaagccaatggctcagctaaaaaatccggcggtgatttcaaacctaccagccctagtctgcctgcttccaagatccctgctttaagcccttcttcgggtaaatcatccagcttgccctccagctctggtgacagtagcaacctgcccaaccctcccgccaccaaaccttctattgcatccaatcctctgtccccccagactgggccacccgcccactctgccagtctgatcccttccgtctcaaatggtagcctcaaattccaaagcctcactcacacaggcaagggccaccacctctcttttagtccccaatctcagaacggccgcgctccacccccactgtcgtttagctcctcaccgccatctcccgcctctagcgtgagccttaatcagggtgccaaagggacaaggacaatacacacaccttcccttaccagctataaggcccagaatgggagctcatctaaagcaacacctagcactgcaaaagaaacatcctag

SEQ ID NO: 15530 - DNA, 5832 bp, Artificial Sequence
  Description of Artificial Sequence: Synthetic coding sequence
atggaagaaaacgagtctcaaaaatgcgaaccctgcctgccctactcagctgacaggcggcagatgcaagaacagggcaagggtaacttgcacgtaactagtccggaggacgcagagtgccgccgtactaaggagcgactcagtaatgggaacagccgaggaagtgtctctaaatcctctcgcaacattcctaggcggcacaccctcggtgggccaagatcgtcaaaagagattttagggatgcagactagtgaaatggaccgcaaaagagaagctttcctcgagcacctgaaacagaaatatccccatcatgctagtgcaatcatgggccatcaggagaggctccgagatcagacaaggtccccaaagcttagccacagccctcagcctcctagtctcggcgatccagttgagcatttatccgagacttctgccgattcattggaggccatgagcgaaggggacgcccccactcctttctctcgcgggtccaggacaagagcttcattgcccgtcgtgcgcagcacaaatcaaaccaaagagaggtccctgggagttctgtacctgcagtatggagacgagaccaaacagctgcgcatgcccaatgagattacatccgccgataccataagggccctatttgtgtctgcctttcctcagcagctgacgatgaaaatgcttgaatccccttctgtggcaatttatattaaagatgaatcgagaaatgtctattacgaactgaatgatgttaggaacatccaggatagatcactactcaaagtctacaacaaagatcctgcccatgccttcaatcatacacccaaaactatgaacggcgacatgagaatgcaaagggagctggtgtacgccaggggtgatgggcccggagctccccgcccaggtagcaccgcgcatcccccacatgcaatccctaatagccctccgtctacacccgtgccacacagcatgccaccttcaccctccaggatcccatacggcggaacccgtagcatggtcgtaccaggcaacgccactataccacgcgatcgtatatcttccctgcccgtctctcggccaatctccccaagcccgtccgctatcctggagcggagggatgttaagcctgatgaggacatgtctgggaaaaatattgcaatgtaccgaaacgaaggtttttacgctgatccttatctctaccacgaaggacggatgagtatcgcttcctcccacgggggccatcccttggatgtgccagaccacatcatcgcctatcataggactgcaatacggagcgcctcagcttattgcaacccttccatgcaagctgagatgcacatggagcagtcattatatcggcagaaaagtaggaagtaccctgactcgcacctgcccacactcggctctaaaactcctcctgcctcaccacaccgggtgagtgatcttaggatgattgacatgcacgcacactataacgctcatggcccacctcacacgatgcagccagatagagccagcccgagcaggcaggcctttaagaaggaacctggtacgcttgtatacatcgagaaaccccggagcgccgccgggttatcgtcacttgtggatctgggcccaccacttatggagaagcaggtgtttgcttacagcacggctacaatccctaaggatcgagaaactagagaaagaatgcaggccatggaaaaacaaatcgcatctcttaccggtctggtgcaatccgccttgtttaagggtccaatcacaagttacagtaaggacgcctcttctgaaaaaatgatgaagacgaccgctaatcgtaaccacacggactcagctggcacaccacatgtgtccgggggcaaaatgctttccgcattggagtcgactgttccacccagtcagccgcctcccgtggggacaagcgctatccatatgagtttgctcgaaatgcgaagatccgttgccgagcttcgtctgcaactgcagcaaatgcggcagctgcagctacaaaaccaagagctgctgcgcgccatgatgaagaaggcagagctcgagatatcaggaaaagtcatggaaaccatgaagcgtcttgaggatcctgtgcagcgccagcgcgtgctcgtcgagcaagagcgccagaagtatctgcatgaggaggagaaaattgtcaagaagctgtgcgagctggaggattttgtggaagatctgaagaaagatagcacagccgccagccgcttggttacgctgaaggacgtggaggacggagcatttttgctcaggcaggtcggcgaagcagtcgccacactcaagggcgagttccccaccttacagaacaaaatgcgagccattcttcgaatcgaagtggaagctgtccgctttctcaaggaggaaccccataagctggattccctattgaagcgggttcgtagcatgactgatgtcctgaccatgttgcgacggcacgtcactgatggcctgctgaagggaactgacgccgcccaagctgcccagtacatggcaatggaaaaagcgaccgcagccgaggtcctcaaatcccaggaagaagcagcccatacctccggacaaccttttcattcaacaggagcgcccggggatgctaagagcgaggtggtcccgctcagcggaatgatggtgagacatgctcagtcttctccagtcgtgatacagccgagccagcacagcgtcgctcttttgaatcccgcccagaatcttccacacgtggcttccagcccagctgtcccgcaggaggccacatccactctccagatgtcacaagctccccagagcccccagattcccatgaatggcagcgccatgcagtcgctgtttattgaggagatccacagcgtctcggcaaaaaaccgtgcagtgtctatcgagaaagccgaaaagaagtgggaagagaagaggcagaatctcgaccactacaacggtaaagaatttgaaaaattgctggaggaggcccaggctaacattatgaagagcatcccgaacctcgaaatgcctcccgcgaccgggccactgccaagaggtgatgctcccgtagacaaagtcgagctctccgaggattctcctaatagtgaacaggatctggagaagttaggtgggaaaagtcctccgccccctcctccaccacccaggcggtcttacttacccggcagcgggctgactacgacgcgctccggggacgtcgtgtatactggcagaaaagagaacattacagcaaaagctagctcggaggacgctgggccttctcctcaaacgcgagccaccaagtaccctgccgaagagccggccagcgcatggacacccagcccaccccccgtgacaacctcctcttccaaggatgaagaggaggaagaggaagagggagataagatcatggccgagctgcaggcttttcagaagtgctcttttatggatgtcaactcgaacagtcatgccgaaccatccagagctgactctcatgtgaaggacaccagaagcggtgctacggtgccccctaaagaaaagaaaaacctagagtttttccacgaggacgttcgaaagagcgacgtggaatatgagaacggtccacagatggaattccagaaggtgacaaccggcgcggttcggccttccgatccccctaagtgggagcggggcatggaaaatagcatcagtgatgctagccggaccagcgagtataagacagagattattatgaaggaaaatagcatatctaatatgagcctgttgcgggatagtaggaactattcccaggaaaccgtccccaaagcgagcttcggtttttctgggatttctccactggaagacgagatcaataagggcagtaagatcagtggattgcaatacagcattcccgacaccgagaatcagactctcaattacggtaagactaaagagatggaaaaacaaaataccgacaagtgtcacgtgtcatcacatacgcgactgacggagtcatcagttcacgacttcaagactgaagatcaggaggtgattacgacggattttggccaggtggttctgcgacccaaggaagcccggcacgcgaatgttaatcccaacgaagacggagagtcaagcagcagtagccccaccgaggagaatgctgccaccgataacatagcgttcatgattactgaaacaacggtgcaggtactgagctcgggggaagttcatgatattgtgagccaaaagggcgaggatatacaaaccgtcaacatcgacgcacgaaaagaaatgacaccaagacaggaggggacggataatgaagatcccgttgtatgtttggacaagaaaccagtcattatcatatttgatgagcccatggatattagaagcgcttataaaagactgagtacaattttcgaggagtgcgatgaggagttggagcgaatgatgatggaagaaaaaatcgaagaagaggaggaggaggagaatggtgacagtgtggtgcagaataacaacacttcgcagatgtcccataaaaaggtggcacctgggaacctaagaaccggacagcaggtcgaaactaagtcccagcctcacagcttggcaactgaaacgagaaaccctggcggccaggaaatgaacaggacagaacttaataagttttcccacgtggactccccaaattccgaatgcaaaggcgaggatgccaccgacgaccagtttgaaagcccaaagaaaaaatttaagtttaaattccccaagaagcagctggcagcccttactcaggccatcagaacgggcaccaagactggaaagaaaacactacaggtcgtcgtctatgaagaggaggaggaagatgggacactgaaacaacataaagaggctaagcgcttcgaaatagcaagatcgcagccagaggacaccccagaaaatactgtaaggcgacaagaacagcccagtatcgaatcgacttcaccaatttctaggaccgatgaaatacgcaagaacacttacagaaccttggatagtctagagcaaactatcaagcagctggaaaacacgatcagcgaaatgtctcctaaggccttggttgatacaagttgttcgagcaacagagatagtgtggcctcttcatctcatattgctcaggaagccagcccccgccctctgctggtgccagatgagggccccacagcactggagccacccacatccataccatcggcctcccggaagggaagctcaggtgctccgcagacgagcagaatgcctgtgcctatgagtgcaaaaaataggcccgggacattggataaacccggaaagcagagcaagttgcaagatcccaggcagtacagacaggcaaatgggtccgccaaaaagtcaggcggagacttcaagccaacttccccgtcattaccagctagcaagattcctgcgctgtccccatctagcgggaagagttcttccctgccttcatcttctggcgatagctcaaacctgcccaacccacccgccaccaaaccgtccattgccagtaaccctctctccccccagaccgggcctcccgctcactctgcctcactaatcccatctgtctcgaacggctccctgaaatttcaaagcctaacacatactggtaaaggccaccatctctcctttagtccccagagtcagaatggacgcgcacctccccccctatctttctcatctagtcctccgagcccggcttcctcagtgagtctcaatcagggggcaaaaggtaccaggacaatccacactccgtctctaacctcctataaagctcagaatggttcatcttcaaaagccacccccagcacagcgaaagagaccagctag

SEQ ID NO: 15531 - DNA, 3795 bp, Artificial Sequence
  Description of Artificial Sequence: Synthetic coding sequence
atgcagacatccgaaatggaccggaagcgtgaagcatttcttgaacacctcaagcagaagtatccacaccacgctagtgccataatgggccaccaagagagactgcgtgatcagacccgcagtccaaagctctcccatagtccccagcctccctcacttggggaccccgtcgagcatttgtcagaaacgtcggctgattccctggaggctatgagcgaaggcgacgcgcctacccctttcagtagaggctccaggacaagggcttcccttcctgtggtgcggagtaccaatcagaccaaggagcgttctctgggcgtgctgtacctgcaatacggtgacgagacaaagcagttaagaatgcccaacgagatcacgtctgcagatacaattagagcactgttcgtaagcgcattcccccagcagcttactatgaagatgctggaaagtccctcagttgcaatatatattaaagacgagagccgaaacgtgtactatgaacttaatgacgtcaggaatatccaggaccgctcattgttgaaggtttacaacaaggatcccgctcacgctttcaatcatacccctaaaacgatgaatggcgacatgcggatgcagcgcgagctggtgtatgcgcggggagacggcccaggcgcgcccagacctggatcaactgcccatcccccgcatgctattccaaacagcccaccttcaacaccagtgccccactctatgcccccgtcgccaagcaggattccatatggaggtacaagatctatggtggtcccggggaacgcgacaatacctcgggatagaatctccagtttgcccgtcagcaggccgatctcaccttccccctcagctatactagagcggagagatgtcaagcccgatgaggacatgtccggcaagaatattgccatgtataggaacgagggcttctacgccgacccctacctctaccacgagggaaggatgagtattgcaagtagccacggcgggcaccccctggacgtgccagatcacataatcgcctaccatagaacagctattagatctgcgagcgcatactgtaatccgtctatgcaggccgagatgcacatggagcagagcctgtatcgacagaaaagccgcaagtatccagactctcacttgcccactttaggcagcaagactccgcccgcctccccccatcgggtctcagaccttcgtatgatagacatgcacgcccactacaacgcccacggtcctcctcatacaatgcagccagatagagccagcccatctaggcaagccttcaaaaaggaacccgggactcttgtgtatatcgagaaaccccgtagcgctgcgggactatcttcgttggtagacctgggtcctccgctaatggagaagcaggtatttgcctactccaccgccaccatcccaaaggatcgtgagactagagagcggatgcaggccatggaaaagcaaatcgcttcgctgaccggcctggtgcaaagcgctctcttcaagggccccatcacatcctatagtaaagacgcttcatccgagaaaatgatgaagaccaccgccaatagaaaccacacagacagtgctggaacaccccacgttagcggagggaaaatgctgtctgctctcgagtccactgtgcctccctctcagccaccaccggtcggcacctcggcgattcacatgtcactgctcgagatgcggcgctctgtcgccgagctccggctccaactgcaacagatgaggcagctgcaattacaaaatcaggagctgctgcgggctatgatgaagaaagccgagcttgaaatcagcggtaaagtcatggaaacgatgaagcggctggaggacccagtccaacgccagcgagttctcgttgagcaggagagacagaagtaccttcacgaagaagagaagatcgtgaaaaagttgtgtgaactcgaagatttcgttgaggacctcaaaaaggattccactgccgccagccggttggtgactctcaaggatgttgaggatggcgccttccttttacgccaggtgggggaggcagtagccacactaaaaggggagtttcctaccctacagaataaaatgcgagcaattctccggatcgaagtcgaggccgtacggttcctgaaggaggaacctcacaaactggatagcctgctgaagagggtccgaagcatgacagatgtcctgactatgctgagacgtcacgtcaccgatggcctgctgaaaggaaccgatgccgcgcaggcagcccagtatatggccatggaaaaagccaccgctgctgaggtgctgaaatcccaggaagaggccgcccacactagcgggcagccatttcactcaacaggcgcccctggcgacgccaaatccgaggttgtcccgctcagcgggatgatggtgaggcacgcccagtcgtctccggttgtgattcagcccagccagcattctgttgccttgttgaatccagcccagaatctgcctcatgtggcctcttctccggccgtgcctcaggaggccacctcgacactgcagatgtctcaggccccacagtcaccacaaattccaatgaatggaagcgcgatgcaaagtcttttcattgaagaaatacatagtgtttccgctaaaaacagagccgtgagcatagaaaaggcagagaaaaaatgggaggagaagcgccaaaacctggaccattacaacggtaaggaattcgaaaaactgctagaggaggcccaggctaacataatgaaatctatccccaacctggaaatgccccctgctaccggacctctccccagaggcgatgcgccggtggataaagttgagctgagcgaagattcccctaacagcgaacaagacctggagaaacttggcggaaagtcccctccaccacctcctcctcctccaaggcgttcctatctgcccgggagcggccttaccaccacgaggtccggcgacgtagtttatacggggcgtaaagaaaatatcaccgcgaaagcaagtagtgaggatgcagggccctcgcctcagactagagcaacaaaatacccagctgaggagccggcctctgcgtggaccccttcacctcccccggtgacaacctctagttcaaaagatgaggaagaggaggaagaggagggagacaaaataatggcagagctgcaaggaagtagcggagccccacagactagccgaatgcctgtcccaatgagtgctaagaaccgaccagggacactggacaaacctggaaagcaaagtaaacttcaggaccctcgccagtacagacaggctaatgggagtgcaaaaaaatctggcggtgattttaagcccacctcacccagcttgcctgccagcaagattcctgctttatcaccttccagtggaaagagtagttccctgccatctagtagcggcgatagcagcaatctccctaatccccccgccactaaaccatctatcgcttctaacccgctgagcccccagaccggtcctcccgcccactccgcatcactgattccaagcgtttctaacggatcattaaagtttcagtcattaacacacacaggcaagggccatcacttatccttctctcctcagagccagaacggccgtgcaccacctcccttatctttttccagtagccctccaagtccggcctcttctgtgtccctgaatcaaggggcaaaagggacacgtactatccacactccctcattaacatcctataaggcacagaacgggtcaagctcaaaagcaactccttctacggctaaagaaaccagctag

SEQ ID NO: 15532 - DNA, 531 bp, Artificial Sequence
  Description of Artificial Sequence: Synthetic coding sequence
atgggctgttgcgggtgctccgggggttgtgggtccggatgcgggggatgcggatctggttctgggggatgtggctccggttgcggagggtgtggctcgagctgttgcgttcccatttgctgttgcaagccggtgtgttgttgtgtgcctgcatgtagctgctcatcttgtggatcatgtgggggttctaaaggaggctgcggatcctgcgggtcatctaaaggtggatgtgggagctgtggatgctcccagagcaactgctgtaaaccctgctgttcttccagcgggtgcgggtcattctgttgccagtcttcttgtagcaagccttgttgttgtcagtcatcttgctgccaatctagttgctgcaagccgtgttgctgccagtcctcttgttgccaatcaagctgtttcaagccatgctgttgccagagttcctgctgcgtgcccgtctgctgccaaagctcatgttgcaagccctgttgcagccaatcaagctgctgcgtgcctatctgctgccagtacaaaatctag

SEQ ID NO: 15533 - DNA, 513 bp, Artificial Sequence
  Description of Artificial Sequence: Synthetic coding sequence
atgggatgctgcggatgcagcgggggatgtggatctgggtgcgggggttgcggaagcggctgtggcggttgcggatccggctgcggggggtatggctccgggtgtgggggatgcggatcatcatgctgcgtacctgtgtgctgttgcaagcctgtgtgttgttgcgtgccagcatgctcctgtagcagttgcgggtcttgtggcgggtctaagggtgactgcgggtgtgggtcgtgcgggggtagcaaaggggggtgcggaagttgtggctgttcccaatgtaactgctgtaagccttgctgctgcagcagtgggtgtgggagctgttgccaatcctcctgctgtaacccttgttgttgccaatcctcttgctgtgtgccggtttgctgtcagagttcttgctgcaagccatgctgctgtcagtccagctgttgcgtacctagctcatgctgccggtcttgctgctctaaatcttcatgctgtgtgcccatctgctgccagtacaaaatttag

SEQ ID NO: 15534 - DNA, 2169 bp, Artificial Sequence
  Description of Artificial Sequence: Synthetic coding sequence
atgatcgattctgtcaagcttcgccgcgactcagcggccgacttcttttctcactatgagtacctgtgtgcattgcagaattccgtgcccctccctgccgttcgtgcctgcctgcgggagggcgtgttggactttaatgccgaccgccttcgcggggtggactgggctccactcctgtcaaccctcaaaatcaataaggacctcccattggtgagcatcaaaagtttcttccagccatggttaggggacactggaagcgacatgaacaaattctgcaggtcaagagtcccagccataaggtataaggacgtgacttttcagctttgtaaggctctcaaggggtgcctgagcattagctcagttcttaaaaacctggagctaaatggcctgatactgagggaacgcgatctgacaattctagcgaagggactcaacaagtcagcgagcctcgtgcacctatcgttggctaactgccctattggtgacggagggttggagattatctgtcaggggatcaaatccagtattaccttgaagacagtgaatttcaccggatgcaatctcacttggcaaggagccgaccacatggccaaaatactaaaataccagacaatgcgcagacacgaagagacctgggctgagtcgctgcggtaccgccggccggatctcgattgtatggccggcctaaggcggattacactcaattgtaacaccttgataggtgatctgggagcctgcgcctttgccgattcattatctgaggatctgtggctacgtgccctagacctccaacagtgcggcctgacgaatgagggcgccaaggccctgttagaggccctggaaaccaatactactctggtcgtactggatatccgcaagaatccactgatagatcactcaatgatgaaagctgtgatcaaaaaggtccttcagaatggcaggagtgccaagtcagaatatcagtggattacgtcccctagcgtgaaagagcccagcaagacagcgaagcagaagagacgcaccattatccttggatcaggccacaagggcaaggccacaattcgcattgtgggtctagcaaccaagaagccggtctcctccggacgcaagcatagtctgggtaaagagtattacgccccagccccactgccccccggcgttagcggattcttgccctggcggactgcggagcgcgccaagaggcaccgcggctttccactaattaagacccgcgacatctgcaaccagttgcagcagcccggattccccgtgacggttaccgtggaaagcccctctagcagtgaagtcgaggaggtagatgatagctctgagtcagtgcatgaagtaccagagaaaacaagcatagagcaggaagcccttcaggagaagctagaagagtgtctgaaacaactgaaagaggagagagtaatcagacttaaagtggacaagagggtgagcgaacttgaacatgaaaatgcccagctgcgtaacataaatttctcactgtctgaggccctgcatgctcagtcattgacgaacatgatcctggacgatgagggtgtgctaggcagcatcgaaaactcttttcagaaatttcacgcctttttggatctcctgaaggatgctggtctgggccaacttgccaccatggccggtatcgatcagagcgactttcagttgctgggccatcctcagatgactagtaccgtgagcaatccaccgaaagaagaaaaaaaggccctcgaagacgagaaacccgagccaaagcagaacgccctggggcagatgcagaacattcaggtgtccatctgtatgcagagcgcgtacaatgaaggtacattgatgaaatttcagaaaatcaccggggatgcaagaattccactgcccctcgactcctttcctgtacccgtctccaccccggaggggctcggaaccagtagcaataacctgggagtgcctgccactgagcagagacaggagtcgtttgaaggattcatagcccgtatgtgcagtccctctcccgatgctactagcggcacgggcagtcagcgcaaggaagaggagttgtcccgtaactcccgaagctccagcgagaagaagacaaaaacaggggaatacacaaaaaaacatagcgacaaacagcaccccggcaaggacttacacagctag

SEQ ID NO: 15535 - DNA, 1122 bp, Artificial Sequence
  Description of Artificial Sequence: Synthetic coding sequence
atggcactcaacgtggctcccgtgcgtgacactaagtggctgaccttagaagtctgtagacagtttcagcgaggaacttgtagcaggtcggacgaagaatgtaaattcgctcatccacccaaatcctgccaggtggaaaatgggagagtcatagcgtgtttcgattcgctcaaaggtcgttgtagtagagagaattgtaaatacttacaccctcccacgcacttgaagacacagttggaaattaacgggagaaataatctcatacaacaaaagactgcggcagccatgcttgctcagcagatgcagttcatgtttccaggaaccccattgcaccctgttccgacgttccccgttggcccagcaatcggcactaacactgctatctctttcgccccttacctcgcaccagtgacccccggcgttggcttggtgcctacagaaattctgcctaccactccagtgattgttccagggagtcctcccgtcactgtgcccggatctacagccacccaaaagctcctgaggaccgataaattggaggtgtgcagagaattccagcgcggcaattgtgcccgcggggaaactgactgcagattcgctcatcctgcagattccaccatgatcgatacctccgataacactgtgaccgtgtgcatggattacataaaaggccgatgtatgcgtgagaaatgcaagtattttcatccacccgctcacctgcaggcaaagataaaagctgcacagcatcaggctaaccaagcagccgtggctgcccaggctgcagctgccgctgctaccgttatggccttcccacccggcgccctacacccccttcctaagcggcaagcattggagaagtccaatggcaccagcgccgtttttaacccgtcagtgcttcactaccaacaagccttaacatctgcgcagctccagcagcatgctgcattcatccctacaggctcagttctctgtatgactccagctacctctatagacaactccgagattatctctaggaacggcatggagtgccaggaatccgcactcaggatcaccaaacactgttactgtacctattacccagtgtcttcgagcatcgagctaccccagaccgcgtgctag

SEQ ID NO: 15536 - DNA, 321 bp, Artificial Sequence
  Description of Artificial Sequence: Synthetic coding sequence
atgacccagtcaactgccaaggcaatgaagcgccctctagaagcgacagtggatctggcctttccccctggcgccctgcatccattacctaagcgtcaagctctggagaaatccaatgggacatctgctgtcttcaatccatccgtgcttcattaccagcaggccttaacctctgcacagctgcagcaacacgccgcattcatccccacagtgcccatgatgcattccgctacctctgcaaccgtaagcgccgccactacaccagcaacaagcgttcctttcgccgccactgctacagccaatcagttggtctactcgtag

SEQ ID NO: 15537 - DNA, 915 bp, Artificial Sequence
  Description of Artificial Sequence: Synthetic coding sequence
atggcgaagatcgaaaaaaacgcccccactatggagaaaaagccagaactgttcaatataatggaggtggacggagtccccacactgatcctatcaaaggaatggtgggaaaaggtgtgcaatttccaagccaaaccagacgatttgatcttagctacctaccccaagtccgggaccacttggatgcatgaaattctggacatgattctgaacgatggagacgttgagaaatgtaagagggctcagaccctggataggcacgcttttctcgagctgaaattccctcacaaggaaaaaccggatttagagtttgtgttggaaatgtcatcaccccaactcataaaaacgcatctgcccagccatctgattcccccttcaatctggaaggagaattgcaagatcgtctatgttgctcgcaatccaaaggactgcctggtctcttactaccacttccatcgaatggcctcatttatgcccgacccccagaatctggaggaattttacgaaaaattcatgtcgggcaaggtcgtgggcggatcctggttcgatcatgttaagggctggtgggccgcaaaggacatgcacaggatcctgtatttattttatgaggacatcaaaaagaacccaaaacatgagatccacaaggtgctagaatttctggagaagacctggtcgggcgacgtcataaataagattgtgcatcacacttcatttgacgtgatgaaggataaccccatggcaaaccatacagcggtacccgcccatattttcaaccattcaatttcaaagttcatgcgaaaaggcatgcctggggactggaagaatcactttaccgtcgctctgaatgagaatttcgacaagcactatgagaagaagatggctggatccacccttaacttctgcttggagatatag

SEQ ID NO: 15538 - DNA, 1188 bp, Artificial Sequence
  Description of Artificial Sequence: Synthetic coding sequence
atggcttccgccgcgagtgttacctctctggctgacgaagtaaattgccctatttgccagggcacgctcagggagccagttaccatagattgtggtcacaacttctgtcgcgcatgtctcacacgttattgcgaaattcccggtccagatctggaggagtccccaacgtgtccattatgcaaagagccgtttagaccaggcagctttaggccaaactggcagctggccaatgtcgttgagaacatagagaggctccagcttgtgtctacccttgggctgggagaagaggacgtttgtcaggagcacggagaaaagatctacttcttttgcgaagatgacgagatgcagctctgcgtagtctgtcgagaggccggcgaacacgcaacgcatactatgcggttcctggaagacgctgccgcaccttaccgagagcagattcacaaatgcttgaaatgcctgcgtaaagaacgcgaagaaattcaggaaatccagtcgcgggaaaataaacgcatgcaagtgttactgacacaggtgagtactaagcgccagcaggtcatctctgagttcgcccacttgcgcaagtttctggaggagcagcagtctatccttctggcccagctagagagccaggacggcgatattttaaggcagcgggacgaatttgaccttctggtagcaggagagatttgtcggttctccgccctgattgaggagctggaggagaaaaacgaaagaccggccagagagttgctgaccgacattcgcagtactctcatccgctgcgagacgagaaaatgtcggaaacccgtggccgtctcacctgaactggggcaacgcattagggactttccgcagcaggcgttgccccttcagagagaaatgaagatgtttctggagaagttgtgctttgaactcgattacgaacctgctcatatttctcttgacccacagacatcacatccgaagctgctgctgtctgaagatcatcagagagcacagttcagctacaagtggcagaactctccagacaaccctcagcgatttgatcgcgccacctgtgtgctggctcatacaggtattacaggggggcgacacacatgggtgtggatggctcgagttccaggggatagcggatgctgccagttctgcagcccaccgtctgttctaggtacggaggtcgctgcttag

SEQ ID NO: 15539 - DNA, 1446 bp, Artificial Sequence
  Description of Artificial Sequence: Synthetic coding sequence
atggcttctgctgcaagcgtaacctcactagccgacgaagtgaactgccctatctgtcaaggtactcttagagagcctgtgacaattgattgtggacacaacttttgtcgagcctgcctaacgcgatactgtgaaatcccaggccccgatttggaggagtccccgacatgccccctgtgcaaggaacctttccggccaggatcctttaggcctaactggcaacttgcaaatgttgtcgaaaatatagaaagacttcagcttgtatctaccctgggcctcggggaagaggatgtgtgtcaggaacacggagaaaagatctatttcttttgtgaggacgatgagatgcagctgtgtgttgtctgccgagaggccggggagcacgcaacacatacgatgaggttcctggaggacgctgccgccccctatagagagcagattcataaatgtcttaaatgcctgcggaaggaaagggaggaaattcaggaaatccaatctcgagagaataaacgaatgcaggtgctcttgacccaggtttctactaagcggcaacaagttatttcagagttcgcgcacctgcgcaagtttctggaagaacaacagtccattctccttgcccagctcgaatcacaggatggcgatatcttacgacaaagagacgagtttgacctactagtggccggcgagatatgcaggttctccgccttgatcgaggaactcgaggagaagaacgagcgtcccgcacgggagcttctcaccgatatcaggtccacattaatcaggtgtgagactagaaagtgtagaaagcccgtcgccgtaagcccagagctgggacaaaggattagagatttcccccagcaagccctgcccctccagagagagatgaaaatgtttcttgaaaacctccctaatcaccttgtgattcccactgctcacatatccttggaccctcaaactagccatcctaaactgttgctgtcagaggatcatcagcgcgcccagttcagctataagtggcagaactctccagataaccctcaaagattcgacagggccacatgtgtgttagcccacacaggaattaccggggggcggcatacatgggtcgtctctatcgacctcgcgcatggcggctcttgtactgtgggcgtggtaagtgaagacgtccagcgcaagggagagctgcgactgcgcccggaagagggtgtctgggctgtgcggctcgcctgggggttcgtgtcagctctgggttcttttcctaccagactaacactaaaagagcagccccggcaggtgcgcgtctcattggactacgaggtcggttgggtgacctttacaaatgctgtcactagagagccaatctacaccttcacggcaagttttaccagaaaggtaatccccttctttggtttgtggggccggggttcttctttcagtttgtcgagttag

SEQ ID NO: 15540 - DNA, 2604 bp, Artificial Sequence
  Description of Artificial Sequence: Synthetic coding sequence
atgcaggcagaggctgcggactggttctcctccatgccattccagaaacacgtgtactaccctttagctagcggaccagagggcccagatgtggccgttgccgccgccgccgctggggcagcctctatggcctgtgctccaccttctgctgctagcgggcctctgccgttcttccaattcagaccacggttagagagcgtcgattggcgcagattatcagccattgatgttgataaagtcgcgggagccgtggacgtgcttacactgcaggagaatatcatgaatattacattctgcaaactggaagatgagaagtgtccccactgtcagtccggagtggacccggtactgctgaaactaattaggctggcacagtttaccatcgaataccttctgcacagtcaagagttcctgacgtcccagctgcatacattggaagagaggctccgactgtcacactgcgacggagagcagagcaagaaattacttacaaagcaggctggagagattaagacattgaaggaagagtgcaaacggagaaaaaagatgatcagtacacagcagttgatgattgaagcaaaggccaactattatcaatgccacttctgcgataaggcttttatgaatcaggcgtttctgcagtctcacatccagcgccgacacacggaggaaaattctcacttcgagtatcagaaaaacgcccagattgaaaaactgagatccgagatcgtcgtcctgaaagaggagctgcagttaacacgctccgagcttgaagcagcccaccatgcaagcgctgtcagattttctaaggaatacgagatgcaaaaaacaaaggaggaggatttcctcaagctgttcgaccggtggaaggaagaagaaaaagagaaacttgtcgacgagatggagaaagtgaaagagatgttcatgaaggaattcaaggaactgacctctaaaaattccgccctggaataccagctgagtgagatccaaaagtcaaacatgcaaatcaaaagtaacatcggaaccctcaaagatgctcacgagttcaaagaggatcgctctccctacccccaggattttcacaatgtgatgcaactgctggacagccaggagtcgaaatggacagcccgcgtccaagctatacatcaggaacataaaaaagagaagggacgcctcctcagtcatatcgaaaagttaagaacttccatgatcgacgatctgaatgctagcaatgtattttataagaagcggatcgaagagttagggcaacgcctccaggaacagaacgagttgattatcacacagcgccagcagattaaggatttcacatgcaatccactcaactccatctccgagcctaagggaaacccacttgcgtggcaggcatttgaatcacagcccgccgctccggcagtacccatgaacgcacccgccttacacactctggagactaagtcctccctccccatggtccatgagcaagccttttcgagccatatcctggaaccaattgaggagttgtccgaggaggaaaaagggagggaaaacgagcagaagctgaataataataaaatgcatctgcgcaaggccctgaaatctaacagctctctaaccaaaggcttgaggactatggtggagcagaacctgatggagaaacttgagactctgggaatcaatgccgacatccgcgggatatcttctgaccagctgcaccgagtgcttaaaagcgtggaatctgaacgccacaagcaggaacgagagattccaaactttcatcagatacgggagttcctcgagcaccaggtctcgtgcaaaatagaggagaaagccctcttgtcgagcgaccagtgtagcgtgagtcagatggacaccctttcgaccggcgaggtgccaaaaatgattcagttgcctagcaaaaatcgacagcttattcgccagaaagctgtatccacagataggacctctgtacccaagatcaaaaaaaacgtgatggaagacccatttccacgaaagtcttctacgatcaccacgcctccattctccagtgaggaggaacaggaggatgatgatttaatcagagcctacgctagtcctggaccgctacctgtgccaccaccccaaaataaggggtctttcggaaagaacacagtgaagagcgatgccgacggaactgagggctccgaaattgaagataccgatgactcacccaagcccgctggcgtggctgtgaaaacccctacagagaaggtcgagaaaatgttcccacatcgcaagaacgtgaacaagcccgtcggcgggactaacgtaccagaaatgtttataaagaaggaagagttacaagagctgaagtgtgctgacgtagaggacgaggattgggacatcagctctctcgaggaagagataagtcttggtaaaaagtctggcaaggaacagaaggaacctccccccgccaaaaacgaaccacacttcgcccacgtcttgaatgcgtggggggcttttaatcccaaaggtcctaagggcgaggggcttcaggagaatgagtcctccacattgaaaagcagtcttgtcacagtcactgattggtccgatacaagcgatgtatag

SEQ ID NO: 15541 - DNA, 279 bp, Artificial Sequence
  Description of Artificial Sequence: Synthetic coding sequence
atggccacgcctccaaaacggcgcgctgtcgaagccaccggggagaaggttcttcgctacgaaacctttatctctgacgtcctgcagcgagacctacgaaaggtgttagaccaccgggacaaggtttacgagcagctggctaagtacctccagctgcggaacgtaatcgagcggctacaggtcaaaactatgggtctgggcacaatcttcctggtctgcgtagggaaaggaggcaaatgggaagagaggctccagactcagccttgccacttgacttag

SEQ ID NO: 15542 - DNA, 2532 bp, Artificial Sequence
  Description of Artificial Sequence: Synthetic coding sequence
atggccgtggaagactccaccctgcaagttgtcgtccgagtccgtccccctacacctcgtgagctggactcccagcggcgacctgtggtgcaagtcgtggatgagcgggtgctcgtgttcaatcccgaagagccagacggtgggttcccgggcctgaaatggggaggtacgcacgatggtcccaaaaaaaaaggtaaagacttaacttttgtgttcgaccgcgtgtttggcgaggccgcaacacaacaggacgtgtttcagcataccacccattccgtcctcgatagcttcctgcaggggtacaattgttccgtcttcgcctatggtgccactggcgcagggaaaacccacactatgcttggtcgggaaggcgaccccggcatcatgtacctaacaacagtggagctgtaccggcgactggaggcaagacagcaggagaagcactttgaggtcctgatcagttatcaagaagtttataatgagcagattcacgacctcctagagcctaaagggccactggctatacgggaagaccccgataagggcgtagtggtccagggcctaagcttccaccagcccgcctcagctgaacaactgctggaaatcttaactaggggtaatcgaaaccggacccagcacccaaccgatgctaacgccactagttccagatcccacgccatttttcaaatttttgtgaaacaacaggaccgggtacctggcctcacccaggccgtccaggttgccaaaatgtcactcatcgatctcgccggttctgagagagcaagttctacccacgccaagggggaacgtctacgagagggcgcaaacattaaccggagcttgttggcgctgataaatgtactaaacgccttggctgacgccaagggaagaaaaactcacgtgccctacagagactctaaactgaccagactgttaaaggactctctgggggggaactgtcgtaccgtcatgatcgcagctatcagcccttcatccctgacatacgaggatacctataatactctgaagtatgctgacagagcaaaggagattcgcctgtccctgaaaagtaacgtgactagcctggattgccatatatctcaatatgcgaccatatgtcagcagctacaagcggaagtagcggccctgcgaaaaaaattacaggtctacgagggcggcggtcaacctccaccccaggaccttccaggtagcccgaaatctggcccaccgccagaacatctcccgtcatctcctctgcccccccatccacccagtcagccatgcaccccagagctccccgcgggaccgagggccctgcaggaagaatccctcggaatggaggctcaggtggagcgggctatggagggaaactcgtccgatcaggagcagagccccgaagatgaagatgaggggcctgctgaagaagtccccacccagatgcccgagcagaatcccacccacgccctgccagaatctcccagacttacattgcagccaaaaccagtcgtgggacattttagcgcacgggagttagacggagatcgcagtaaacagttagcattgaaagttctctgtgtcgcacagcggcagtactccctgctccaggccgcaaacctgctgactccagacatgatcaccgaatttgaaactctacagcagctggtccaggaggaaaagattgagcctggcgccgaggccctaaggacaagcggactggcacgaggtgcccctctggcccaagagctttgcagtgagtctatacctgtgcccagccccctgtgccccgaaccacccggctacaccgggcccgtgacccggactatggctcgcaggctctcgggccccctgcatacactgggtatccctcctggcccaaattgcacaccggcccagggttcccgctggccaatggaaaagaaacggcgcaggccttccgcactggaggccgacagccccatggcgcccaagcgagggaccaaacgtcagcggcaatcattcctcccttgcttgaggagagggtccttacccgacacacaaccatcccaaggcccttccaccccaaagggcgagcgcgcaagtagcccctgtcattctccacgggtctgtcctgcgaccgttatcaagtcccgcgtgcctttagggccatctgcgatgcagaattgctctactcctctggccttgcctacacgagatctcaatgccacctttgacctgtccgaagagccccctagcaagccctcatttcacgaatgcatcgggtgggataagatacctcaggaactgagccgactcgatcagcctttcataccccgcgcgccggtaccactttttactatgaagggccccaagccaacatcgtcactgccgggcacatcagcctgcaagaagaagagggttgcttcttctagcgttagtcacggtcgatcgcgtattgccaggcttccatccagtacactgaaaaggccaggtcccctttatagccaagtaacgggcacacgcgatagagatagcctcggacacggggggagatag

SEQ ID NO: 15543 - DNA, 561 bp, Artificial Sequence
  Description of Artificial Sequence: Synthetic coding sequence
atggagcccccccgaggaccaccagctaacggagctgagccaagcagggctgtgggcactgtcaaggtctaccttcctaacaagcagcgaacggtagtgactgtgcgcgatggcatgagtgtctacgactcccttgacaaagctctcaaggtgcgagggctgaatcaggactgttgcgtcgtctatcgtctgattaaaggtcgcaagaccgtaacagcttgggatactgctatcgctccgttagatggtgaggaattgatagtggaggtgctggaggacgtgcccctaaccatgcacaatttcgtaagaaaaacctttttcagcttggcattctgcgatttttgcctaaagttcctgttccacgggtttaggtgccagacatgcggctataagtttcaccaacactgcagtagcaaagtgccaacagtgtgcgtggacatgagtacaaaccgacagcaattctaccattcagtacaagatctcagcggcggcagcaggcagcatgaagccccaagcaacaggcctttgaatgaactgctcacaccccagggtccacgttag

SEQ ID NO: 15544 - DNA, 1821 bp, Artificial Sequence
  Description of Artificial Sequence: Synthetic coding sequence
atggaacctccgcgcgggccacctgcgaacggcgctgagcccagccgcgcagtcgggaccgttaaagtgtatctgcctaacaaacaacggacagtggtgacagtacgtgatgggatgagcgtctacgacagtttggacaaggccctgaaagtgcggggcctgaatcaggactgttgcgtggtatacaggcttattaagggaagaaagacagtaactgcctgggatactgccatcgcaccactggacggcgaggagctcatcgtggaggttctggaggatgtacctcttactatgcacaacttcgtgagaaaaaccttcttctcactcgcgttctgcgacttctgccttaagttcttattccacggttttagatgccaaacgtgcggatataaatttcaccagcactgcagctctaaggtccctacagtgtgtgtggatatgtccacaaaccgacagcagttctatcactccgtgcaggatctgtcaggcggctctagacagcacgaggcaccttctaataggcccctaaatgagttgcttacaccacaggggccatcaccaaggacccagcactgtgaccccgagcatttccctttcccagcccccgctaatgcacccctgcagaggatccgcagtacaagtacgcccaacgtccatatggtctcaacaaccgcccccatggactccaacttgattcagctaacagggcagagtttctctactgacgcggcaggcagtcgcggcggcagtgacggaactccccggggcagccccagccctgcctccgtgagctcgggccggaaatccccgcactctaagtcacccgctgagcagagagaaaggaaatcactcgcagatgataagaagaaagtgaagaatctggggtacagggactccggatattactgggaggtccccccatctgaagtacagcttctgaagaggatcgggaccggctccttcggaacggtgttcaggggaaggtggcatggagatgtcgctgtgaaagtcttgaaggtgagtcagcccactgccgagcaggcccaagcctttaagaacgaaatgcaggtactacgaaagacgcggcacgtcaacatcctgctgtttatgggcttcatgacacgaccgggttttgccataatcacccagtggtgtgagggtagcagcttgtaccatcacctgcacgtggcagacactcggttcgacatggtgcagctgattgatgtggccaggcagactgcgcagggtatggactacctgcacgccaaaaatataatccatcgcgatctgaagagtaacaacatcttcctgcatgagggcctgacagtaaaaatcggtgacttcggtctcgccacggtgaaaacacggtggtctggcgcacagcctttggaacagccctctgggtccgtcctgtggatggccgccgaggttatcagaatgcaggacccaaacccttactcgttccagtccgatgtttatgcctacggtgtggtactgtatgaactaatgactggcagcttgccatactcacacattggttgtcgcgatcagattatttttatggtgggcagaggatacttaagccctgacctgtctaagatctcttctaactgcccaaaagcgatgcgaagactgctcagtgattgtcttaagtttcagcgggaggagagacccctgtttccccagattctagctaccatcgagctgctccagagatccctgccaaaaattgagcgcagcgcatctgagcccagcctccatagaactcaggccgatgaattgcctgcctgtctgctatctgccgcaaggctggtcccgtag

SEQ ID NO: 15545 - DNA, 3036 bp, Artificial Sequence
  Description of Artificial Sequence: Synthetic coding sequence
atggttagcagcgataggcccgtttccctcgaggatgaggtatcccacagcatgaaggagatgattggggggtgctgcgtttgttcagatgaaagaggctgggccgagaaccctcttgtgtattgcgatggccatggatgctccgtcgccgtccatcaggcctgttatggcatcgtacaagtgcccaccggcccgtggttttgccgcaaatgtgagtcccaggagcgcgcagcccgggtcaggtgtgagttgtgccctcacaaggatggagctctcaagaggacagataacgggggctgggcacatgttgtgtgtgcactctatatacctgaggttcagtttgcaaacgtcagtacaatggagccgatcgtgctgcagtctgttccacacgaccgctataacaagacttgctatatctgtgatgagcaggggagggagtccaaagcggcgaccggcgcttgcatgacctgtaataagcatggatgtcggcaggcttttcacgtcacgtgcgctcagttcgcaggccttctttgtgaagaagaaggcaatggggccgacaacgtgcagtactgtggttattgcaagtaccacttttctaagcttaaaaaaagcaaaagagggagcaataggagttacgaccagagcctgagtgattccagctcccatagccaggacaaacatcacgagaaagaaaaaaaaaaatacaaggagaaggacaaacacaagcaaaagcataagaaacagccagagccatccccagccctcgtgcccagcctgaccgtgacaaccgaaaagacctacacaagtacgagcaataacagcatttcaggatcactcaaacggcttgaagacaccaccgctcgctttaccaacgcaaacttccaggaagtgagtgcacacacttccagcggaaaggacgtgtccgaaacgagagggagcgaagggaaggggaagaagagttccgcccactcaagtgggcagagaggtagaaagcccggcggcgggcggaaccccggaactacagtaagtgccgcttctcctttcccccagggtagcttctcagggaccccgggcagtgtcaaatcaagctccgggagctctgtccagtccccccaggacttcctttctttcacagattctgaccttcgtaacgattcatactcgcacagtcagcagtcatcagcaacaaaagacgtccataaaggtgaaagcggtagccaagagggaggcgtaaactcttttagcaccctgattgggctgccttctacctccgctgtaaccagccagcctaaatcatttgaaaattctcccggtgatttaggcaacagcagtcttccaaccgcaggatataagagagctcagacctccggcatcgaggaggaaaccgtgaaggaaaaaaagagaaagggaaacaagcagtctaagcacgggcctggccggcctaaggggaataaaaatcaggagaacgtgtctcatctgtctgtgtcctctgcttctcccacctcaagcgtggcctccgctgcgggctctataacgtcttctagcctgcagaagagtccgactttgctgcgtaacgggagtctacagagcctgagcgttggcagcagcccagtgggatctgaaatatcaatgcagtaccggcatgatggcgcatgtcccaccactactttctcagagctgctgaacgccatccacaatgggatatataactcaaatgacgtagccgtgtccttccccaatgtggtttccggatccggtagctccacaccagttagttcctcacatctcccccagcagagttcaggccacctccaacaggttggggccctgagtccctccgccgtgtcttcggccgctccagcagtggccaccacacaagcaaacaccctctctggtagcagcttgtctcaggcaccaagccatatgtacgggaaccgcagtaattcaagtatggccgccttgattgcacagtccgaaaataatcagactgaccaggacttgggcgataacagccggaacctggtaggtcggggctcttcacctagaggcagcttgagtccacgctcaccggtctcttccctacagataaggtacgatcaaccaggcaactccagcttggaaaacctgccgcctgtcgctgccagcatcgagcagctgttggaaagacagtggagtgaagggcaacagttccttctggagcagggcactccttctgatattctgggaatgctcaaatccctgcaccagctgcaggtcgagaacaggcgcttggaggaacagatcaagaacctcacagcaaaaaaggagcgcctccagctgcttaatgctcagctctccgtcccattcccgaccataacggcaaacccctccccgtctcaccagatccatacatttagcgcacaaactgctccgacaaccgatagcctgaactctagtaagtcaccacacattggcaacagctttcttcccgacaacagcttgccggtgttgaatcaggacctcacctcctccggccagtcaacgtcctcaagctccgccttgtccacccccccccctgccggtcagagtcctgctcagcaggggagtggagtgagtggagtccaacaggtcaatggggtgacggtgggcgccttggccagcggcatgcagcccgtaactagtacgatccccgctgtgtccgctgtgggagggatcattggggcccttcccggcaaccagctggctattaacggtatcgtcggggccctcaatggagttatgcagacaccagtgaccatgagccagaatcccaccccactgacgcacactacagttcctcccaacgccacccaccctatgcccgccactctgactaattccgcctccggtctgggcctcctgagtgaccaacagagacagatactaatccaccagcagcagttccaacaactgctgaactcccagcagctcacacccgttcacaggcaccctcacttcacgcagctacccccaacacatttttccccctccatggaaatcatgcaggtgaggaagtag

SEQ ID NO: 15546 - DNA, 3084 bp, Artificial Sequence
  Description of Artificial Sequence: Synthetic coding sequence
atggtatcatcagatcggcccgtgtccctcgaggacgaggtgtcccacagcatgaaggagatgattgggggttgctgtgtctgtagcgatgagcgaggttgggccgagaacccgctggtttattgcgacggacatgggtgctccgtggccgtccaccaggcatgctacggcatcgtgcaagtccccaccggcccctggttttgccgtaagtgcgaatctcaggagcgtgcggctagagttaggtgtgagttgtgtcctcataaggacggggctctgaagcgcaccgacaacggcggatgggcccacgtggtctgcgctctgtatatccccgaggtccagttcgcgaatgtctctactatggagcctattgttcttcaatctgtccctcacgaccggtacaacaaaacctgttacatatgtgatgaacagggccgcgaaagcaaggctgcgactggggcttgtatgacctgtaacaaacacggctgtcggcaggcattccacgtgacttgcgcgcagtttgctggtttactctgcgaggaagagggcaatggtgccgataacgtacagtattgcggctactgtaagtaccactttagcaaactaaaaaagtccaagagaggaagcaatcgctcttatgaccagtctctctcagactcttcatcccattcgcaggataagcatcatgagaaggaaaaaaagaagtataaggagaaggataagcacaaacagaagcataagaagcagcccgaaccctccccggcactggtgccctccctcactgtgacaactgagaagacttacacctccacttctaataattctatcagcgggagcctgaaacggctggaagatactactgccagattcactaatgccaactttcaagaagtgtccgcccacaccagtagcggtaaggatgtttccgagactcgtggatctgaaggcaagggaaaaaaaagctctgctcacagctcagggcagcggggcaggaagcccggaggaggaagaaatcccggcactactgtgtccgctgcctcacctttccctcagggcagcttctcgggaacccccggctcagtgaaaagctccagcggatcctccgtccagagcccccaggattttttaagcttcaccgattctgatctccgcaacgattcctactcccactcccagcagtcctctgcaacgaaggacgtacataagggggagagtggatctcaggagggaggcgtcaacagctttagtactctgatcggcctgccctctacatccgccgtgacttcgcaacctaaatctttcgagaactcacccggcgacctcggcaacagctccctcccgaccgccggctacaagagagcacaaacctccggcatcgaagaggaaaccgtgaaagagaagaaacggaaaggtaataagcaatctaaacacgggccagggagaccaaagggtaacaaaaaccaggagaatgtcagccatctctccgtcagcagtgctagcccaacttcatctgtggccagcgcagctgggtccatcacatcgtccagcctgcagaaaagcccaacgctgctacgcaacgggtccctgcaatccctgtccgtgggcagttccccagttggatcagagatttccatgcaataccgccatgatggcgcctgcccaaccacgaccttctcagaactgcttaacgccatacacaatgaccgtggtgattcatcgacactgactaaacaggaactgaaatttatcggcatatataacagtaatgacgtcgccgtctcattcccaaatgtggtgtcgggcagtggctcctctacacctgtttcttccagtcatttgccacaacaatcgtccggacatctgcagcaggttggagcgctgtctccaagcgccgtaagcagcgcggctccagctgtcgctactacgcaggctaacacactgtcagggtcgtccctgtcccaggctcccagtcacatgtacggtaacaggtctaactctagtatggcagcgttgattgcccaaagcgagaataaccagacagatcaggacctgggcgataactcccggaatctggtgggcagaggtagtagcccccgcggctctttgagcccccgctcccccgtgtctagtctgcagatccggtatgatcaaccgggaaactcctcgcttgagaaccttccccccgtggctgcctctatagaacaactcctcgaacgccagtggtccgaggggcagcagttcctgctagaacagggaacaccctctgacattctgggcatgctgaaatctttgcatcagctccaggtggagaatagacggctggaggagcagattaaaaatctgactgccaaaaaagaacgcctccagttactgaatgcccaactgagtgtacccttcccaacaatcacagctaatccctctccttctcaccagatccacacattttctgcccagacggctcccactaccgatagtctaaacagcagtaaatcgccacacatcgggaatagctttctgcctgataacagcctgcctgttctgaatcaggacctgaccagcagtgggcagagcacgtcttcatcttctgctctttctactcccccgccagctggccaatcccccgctcaacagggcagtggcgtgtcaggagtacaacaggtgaacggcgtgacggttggtgccctggcttccggcatgcagccagttacttccacaatacccgctgtttctgcggtggggggcattattggtgccttacctggcaatcagctggccattaatggcatcgtgggcgcactcaatggagtgatgcagacccccgtgactatgtcacagaacccaacccctctgacccacactacagtgccaccaaacgccacacacccaatgccagctactctgaccaattctgcttctggtctgggtctgttaagcgaccaacagagacagatcctgatccatcagcagcagttccagcagttgctcaacagtcagcaactcacacctgtccatcgacatccccacttcacccagttaccccccacacacttctccccctccatggaaatcatgcaggtgcggaagtag

SEQ ID NO: 15547 - DNA, 567 bp, Artificial Sequence
  Description of Artificial Sequence: Synthetic coding sequence
atgactgcccctagttgcgcattcccagtgcagtttcgccagccaagtgtcagcggattgtcacagatcaccaaatcgctgtatatatccaacggcgtcgcagctaataacaaattgatgctgagctcgaatcagataactatggtgatcaacgtttcggtggaggtggtgaataccctgtatgaggacatccaatatatgcaggtgccagtggctgattcacctaacagcaggctctgtgatttcttcgatccaatcgctgatcacatccattccgtggaaatgaaacagggaaggaccctccttcactgtgctgccggcgtctctaggagtgccgcgctgtgcttggcttacttgatgaagtaccacgcaatgtctctcctggacgctcatacgtggacaaagagctgccgtccaataatcagaccaaattctgggttttgggagcagctgatccactatgaattccagctgttcggaaagaacaccgtccatatggtgtccagccctgtgggtatgattcctgatatctatgaaaaggaggtgcgcttgatgatccctttgtag

SEQ ID NO: 15548 - DNA, 381 bp, Artificial Sequence
  Description of Artificial Sequence: Synthetic coding sequence
atggtttcaagcgacagaccggtctccctcgaagacgaggtttcccattcgatgaaggaaatgattggaggttgctgtgtttgttcagacgaacgtggatgggccgagaatccactggtctactgtgacgggcacgggtgctctgtggccgtacaccaggcctgctatggtatcgtgcaggtccctaccgggccatggttttgtaggaaatgcgagtcccaggagcgggcagcacgagtcgccgagtcccgaagtgtagctcaggcaaaagtgcagtggtgtgacctgagcccattacagccgttgctgccaggctttaagaggttttcttgtctttcgctgcctaacggaatgcagtttctgctcgttagcctgatctag

SEQ ID NO: 15549 - DNA, 540 bp, Artificial Sequence
  Description of Artificial Sequence: Synthetic coding sequence
atggtgagcagtgaccgacctgtcagcctcgaggatgaagttagtcatagtatgaaagaaatgataggaggctgctgcgtgtgtagtgacgagcggggatgggcagagaacccccttgtatattgcgatgggcatggttgtagcgtggccgtccaccaggcttgttacgggatcgtgcaagtgcccacaggaccatggttctgccggaaatgtgagtcccaagaaagagccgcaagggttatggtctgcaacagttgctggttagcatcttctgagaatgtgacaccaggatatatcgaacaccactgtgcctgtgcatcccctcacccgaggtgcctagtcagcaacgtacccccagtgtccggcgctctgatgcattgtttctgggcctgtcttaccaccgcggcttttttcggtccccaatcttttaccacatgtcatatgagctttctggtgtccagagatatactattctacatatatgggttcatgcctttcatctccgttgtgatttggagattcaaaaaggaacggtggtag

SEQ ID NO: 15550 - DNA, 540 bp, Artificial Sequence
  Description of Artificial Sequence: Synthetic coding sequence
atgggactgatctttgctaagctctggtctctgttctgcaaccaagaacacaaggtgatcattgtcgggctggacaacgccgggaagacaacgatcctctatcagttccttatgaacgaagtggtgcacaccagcccgacaattggcagcaacgttgaagagatcgttgtcaaaaacacacattttctgatgtgggacatcgggggacaagaaagcctacggagttcctggaatacatattactcaaatactgagttcattatactggtggttgactcaattgatcgtgagaggctcgcaattactaaggaggagctctatcgcatgctcgcccacgaggacctgagaaaggccgccgtgctgatttttgctaacaagcaggacatgaaaggatgcatgaccgccgccgaaatctcaaagtacctcacattatccagcatcaaagaccacccatggcatattcagagttgctgcgcactcaccggggagggcctgtgccagggactagagtggatgaccagtcggatcggcgtgagatag

SEQ ID NO: 15551 - DNA, 3345 bp, Artificial Sequence
  Description of Artificial Sequence: Synthetic coding sequence
atgtctcagacgcaggattacgagtgtcgcagtcacaatgtggatctccccgaaagccggatcccaggcagcaacacacggctggaatgggtggagataatagaaccccgaacacgtgagaggatgtacgcgaaccttgttaccggcgagtgtgtttgggacccccccgccggagttcgcattaagcggacttctgaaaatcagtggtgggaactgttcgacccaaataccagtcgattttactactataacgcctccacccagcgcacagtgtggcatagaccgcagggctgcgatataattcctctggccaaactgcagaccctcaaacaaaataccgagtcccctcgagccagcgcagagagctctccaggccgcggttcctcagtgagccgggaaggtagcacatcctcaagcctggaaccagagccggacaccgagaaggcccaagagctgccagcgcgggccgggaggcccgcggccttcggtacagtcaaagaggactctggaagttctagtcctcccggagtcttcctggagaaggactacgagatctaccgagattattcagccgatggccagctgctgcattaccgcacatcttctttacgatggaatagcggagctaaggaacggatgctgataaaagtggcggaccgcgaaccgtccttcttggccgcacaaggcaatggctatgctcccgatgggcctcccggggtgcggtctagaaggcccagcggctcacagcacagcccttccctgcagacttttgcccccgaggcagatggtaccatatttttcccggaaagaaggccttccccgtttcttaagagagcggaactgcccgggtctagttctcctctccttgcccagccccggaagccctcaggcgatagtcaaccatcctcaccacgctacggatacgagccgccgttgtacgaggaaccgcccgtggaataccaagccccgatttacgatgaacctcctatggacgtgcagtttgaagcaggtggcgggtaccaggcagggtctccacagagatctcctggcagaaagcctcgcccctttctgcagcctaacaaacaagggccacccagcccttgtcagcagctcgtccttacaaaacaaaagtgtcctgagcgattcctgtccttggaatactcccccgctgggaaagaatatgttagacagttagtatacgtggagcaggcagggtcaagtcccaaactcagagcaggaccacgtcataagtatgcccccaacccagggggaggttcctatagcttacagccctctccgtgcctgttgcgcgatcaacgacttggggtgaagtccggcgactacagcacaatggaggggccagagctccgccattcccagccccccactccactgccccaggctcaagaagacgccatgtcatggagttctcagcaggataccctctcctccacaggttacagtccgggtacgcgtaaaagaaagagccgcaagcctagtctctgtcaggccactagcgcgactccaaccgaagggccaggtgatctcctcgtcgaacagcccctcgctgaagagcagcctccatgcggaacctcactggcccctgtgaagcgcgcagagggtgaggcagagggcgcaaggggtgcagctgagccgtttctggcacaggcccgtcttgcatgggaggctcaacaggcgcattttcatatgaagcaacggagtagctgggactcccagcaggacggttctggttacgagtcagatggtgcattgcctttgccaatgccgggaccagtggtccgtgcctttagtgaagacgaggctctggcccaacaggaaaataggcattggaggcggggaacgtttgagaaattgggttttcctcagattctgctggagaagtctgtgtctgtccagacaaacttagcttcccccgagccctatctgcatccgtcgcagtcagaggacttagcggcttgtgcccagttcgaatccagtagacaatctcgctccggggttccatcgagcagctgtgtgttccccacgttcacattaaggaagccttcatcagaaaccgatattgagaattgggctagcaaacactttaacaaacatacccaaggcctgttccgtcgtaaagtgtcaattgctaacatgctggcctggtccagcgagagcataaaaaagcccatgattgttacctctgatcggcacgttaaaaaggaagcctgcgaactgtttaaactgatacagatgtacatgggtgatcggcgggcaaaagctgaccccctgcatgtggcgcttgaagtcgctactaaagggtggtctgtgcagggccttagagacgaactgtacattcagctttgccgccaaacgaccgagaacttccggctggaaagcctcgctaggggctgggagctcatggcaatttgtctggccttcttcccacccacccccaaatttcactcatatttggaagggtacatttaccgacacatggaccctgtcaatgatacaaaagttactcaacacattaaagagcttcttgagcgaaatacgaaaaaaaagagtaagctgaggaaaaagcccaagccctacgtggaagagccggatggtgtggctatctctacctatgcaaaatactgttaccacaagttgcagaaggcagcgctgaccggggccaagaaaggcctaaaaaagccgaatgtagaggagatcaggcatgcaaaaaacgctgtattctctccttctatgtttggcagcgccctgcaggaagtcatggggatgcagcgcgaacgataccctgaacggcagctcccatgggtgcagaccaggctgtctgaggaggtcctggcactcaatggagaccaaactgagggtatttttagggtgcccggggacattgacgaggtcaacgcactgaagcttcaggtggaccagtggaaagtgccaacaggcctggaagatccacatgtgccagcatccctcctgaagctgtggtatagagagcttgaggagccactgattccccatgaattctacgagcagtgcattgcccattatgatagccccgaagccgccgtcgccgtagtgcacgctcttccgcggattaatagaatggtcctgtgttacctgatccggtttctgcaggtgttcgtgcagccagcgaacgtcgcagtgaccaagatggacgtttcaaacttggcgatggtaatggctccaaattgtctacgatgtcagagcgacgacccaagagttatttttgaaaacactagaaaggaaatgtcattcctgagagttctgattcagcaccttgacacctcattcatggagggagtattgtag

SEQ ID NO: 15552 - DNA, 822 bp, Artificial Sequence
  Description of Artificial Sequence: Synthetic coding sequence
atgggacaaaaggtaactggcggcataaagaccgtcgatatgcgggatcccacgtacaggccactcaagcaggagctccaaggactggattactgcaagcccacccgactggatctgctactggacatgccacccgtctcatatgatgtgcagcttttacattcttggaataacaatgataggtctttaaatgtgttcgttaaggaggacgataagcttatttttcaccgacacccagtcgctcagtcgaccgatgcgattcgcggaaaggtcggatacacacggggcttgcatgtctggcagatcacttgggcaatgagacagcgggggacccatgccgttgtgggtgttgcaacggcggatgctcctttacattcagtgggatacactacactagtggggaataaccacgaatcctggggctgggacctgggtcgcaatcgtctgtaccacgacggaaagaaccaaccctccaagacatacccagcctttcttgagccagatgagacgttcatcgttccagactccttccttgtcgccctggacatggacgacggaacattatccttcatcgtggacggccaatacatgggggttgcatttcggggcctaaaagggaaaaaactgtaccccgtagtgtccgctgtgtggggacactgcgagatacgaatgagatacctcaacggcttagaccctgagccactgccactgatggacctgtgccgtcggtcggtgaggttagcactcggaagagaaaggctaggggaaatccacacgctgccacttccagcctccctcaaggcttacctgctgtaccagtag

SEQ ID NO: 15553 - DNA, 3633 bp, Artificial Sequence
  Description of Artificial Sequence: Synthetic coding sequence
atgccaaggggtgaggcaccaggtccaggtagaaggggcgctaaagacgaagccctaggggaggagagtggtgaacgctggtctccagagttccatctgcagagaaagctggctgattcgagtcatagtgagcagcaggatcgcaacagggtgagcgaggagctcatcatggtggtgcaggagatgaaaaaatattttccctctgaaagaagaaataaaccgagtacccttgacgccttaaattatgctctccgatgtgttcattccgtgcaagctaatagcgaattcttccaaatcttgtcccagaatggagctccacaggcagacgtcagtatgtacagcctggaagagttggccactatcgcttcagagcacaccagcaagaacacagacaccttcgtcgccgtgttttcctttctgtctggacgattggtccacatatctgagcaggccgccctcatcttgaatcggaagaaagacgtactcgcaagttcccactttgtcgacctgctggcccctcaggacatgcgggtattttacgctcacaccgccagagcccagctgcctttctggaacaactggacgcagcgggctgccgctagatatgagtgtgcgcccgtgaaacctttcttttgcagaattagagggggcgaagatcgtaagcaggaaaagtgccatagtccgtttagaattattccatatcttatccacgtccaccaccccgctcaaccagaactcgagtcagagccatgttgcttaaccgtggtggaaaagatccactccggctacgaagctcctcggattcctgtgaataaacgaatcttcaccaccactcacactccaggatgtgtgtttctcgaagtggacgagaaggctgtccctttgcttggctacctcccccaggacctcatcggaacaagcattctgtcctatttacaccctgaggatcggtcactgatggtcgcaatccatcaaaaagtcttaaagtatgctgggcacccgccttttgagcatagtcctattaggttctgtacccagaacggtgattatatcatccttgactcatcctggagcagctttgtgaacccatggtccagaaaaatcagtttcatcattggtcgtcataaagtgaggacttcacccttaaacgaagacgtgtttgcgaccaagattaaaaagatgaatgacaacgataaagatatcaccgaactacaggagcagatatacaagctgcttcttcagcccgtgcacgtgagcgtgagttctgggtacggctcgctcggaagcagcggatcccaggagcaactcgtctccatagcttcctcttcagaggcctccggacacagagtagaggaaacaaaggcagagcagatgacactccagcaagtttacgccagtgtcaacaagatcaagaatctgggacagcagctctatatcgaaagcatgaccaaaagttcattcaaaccagttaccggaacacggaccgagccaaatggaggtggagagtccgctaatggtggtggcgagtgcaaaacgtttacaagcttccaccagacactgaagaataactccgtctacaccgagccttgcgaggatctccgaaatgacgaacattccccttcctaccagcagatcaactgcattgattccgtgatacgttatctcaagtcctataacatccccgcactgaaacggaaatgtatatcttgtactaatacaacttcttccagcagtgaggaggacaagcagaatcacaaggcagatgatgtgcaggcactgcaggccggcctgcagatacctgccatccctaagtcagagatgcctacaaacggccgcagcatcgacacaggcggtggagctccacagattctgtccaccgccatgctaagcctgggttccggaatatctcaatgtggttactcctccacaatcgtgcacgtgcctcctcctgagactgctagagacgctacactattctgcgagccatggaccctaaatatgcaacctgcccccctgacatcggaagagttcaagcatgtcggcttgacagccgcggtgctgtctgcccacacacagaaagaggaacaaaattatgtggacaaatttcgcgagaaaatcctctccagcccttattccagttacctgcagcaagagagtagatctaaggccaaatatagttacttccagggggattcaactagtaagcagacacggtccgctggctgccgcaagggtaaacataagcgcaaaaagcttcctgaaccacccgactctagtagtagcaacactgggtcaggacctaggcgcggagcccatcagaacgcccagccatgctgtccttccgctgcctcctccccgcatacctcctctccaactttccctcctgctgcaatggtgcctagccaagccccatatttggtgccggcgttccccttaccagccgccacaagtcctggccgagaatatgccgctcctgggaccgcccccgaaggtctgcacggcctgcccttatccgaaggacttcagccctatcccgcatttccgtttccatacctcgacacctttatgactgttttcttacccgacccacccgtctgccctcttctgtctccttctttccttccgtgtccttttctcggcgccaccgcctcatctgcgatttcacctagtatgtccagcgctatgtcccccacactggatccccctcccagcgtgactagccagcgacgcgaagaagagaaatgggaagcacagtcagagggccatccgttcatcacatcgcgaagttcttctcctttgcagctcaacctgcttcaggaagaaatgcctcgcccttcagagagcccagatcagatgagacggaatacatgtccccaaacagagtatcagtgcgtgactggaaataatggcagcgaatcgtcgcccgccactaccggtgccctcagtaccgggtctccccctagggagaacccttctcaccctaccgcctctgccctgtcgaccgggtcccctcccatgaagaacccctcgcaccccacagccagtgccctgagtacaggcagcccgcctatgaaaaacccatcccacccgaccgcgagcactttatcaatgggtctgcctcccagccgcacgccttcacacccaaccgccacagtccttagcaccgggtcccctccctctgagagcccctcaagaaccggctctgctgcaagcggtagctcagatagtagcatctaccttactagtagtgtgtactcgagcaagatcagccagaatggacaacagagccaggacgtccagaaaaaagagacctttcccaatgtcgccgaagaacctatctggaggatgatcagacagaccccggaacgcatcctgatgacctatcaggtgccagagcgcgtaaaagaagtggtgctgaaggaggacctagaaaagctggaatcgatgaggcaacagcagccgcagttcagtcacggacagaaggaggagttagctaaggtttataattggattcagagtcagaccgtaacgcaggagatcgatatccaggcctgcgtgacctgcgaaaacgaggattccgccgatggcgccgcgacctcgtgcgggcaagtgctcgtcgaggattcatgctag

SEQ ID NO: 15554 - DNA, 1137 bp, Artificial Sequence
  Description of Artificial Sequence: Synthetic coding sequence
atgccacgtggggaagcgccgggccctggacggcggggtgcaaaggacgaggcattgggcgaggaaagtggtgagagatggtctccagaattccaccttcagcgcaagctggccgattcgagccattccgagcagcaggataggaatcgagtgtctgaggaacttatcatggtggtgcaggaaatgaaaaaatactttcctagtgagcgcaggaataagccgagcactttggacgctctgaactatgctctgcgttgtgttcattctgtgcaggccaatagtgagttcttccagatattgtcacaaaacggggcgccacaggcggatgtaagtatgtattctctggaagaacttgcgaccatcgcctcggagcacacgagtaaaaacactgataccttcgtggcagtcttcagttttctttccggtaggctcgtacatattagtgagcaggccgccctgatactcaatagaaagaaggatgtcttggcttcatcgcacttcgttgatctgctggccccccaggatatgagagtcttctacgcgcacacagccagggctcaactaccattttggaataattggacccagcgagctgcacgttatgagtgcgcaccagtgaagccattcttctgcagaatcagaggtggagaagataggaagcaggaaaaatgccactccccatttcgaatcataccgtacttgatccatgtacatcaccctgctcaacctgaattagagtcagaaccatgctgcttaacagtcgtggagaagatccattctgggtacgaagctccgcgaatccccgttaataaacgcatattcactacaacacacacacccgggtgtgtgtttctggaggtggacgaaaaggctgtgccgttactaggctacctgccccaggacctgattggcacgtccatcttgagctacctccatccagaagacaggagcctgatggtggcgatccatcaaaaggttttaaagtacgcgggacatcctccatttgagcactccccgattcgcttttgtacccagaatggcgactacataatacttgattcctcttggtcctccttcgtcaacccttggtcacggaagatcagcttcatcatcgggcgacacaaagttagaacatag

SEQ ID NO: 15555 - DNA, 1794 bp, Artificial Sequence
  Description of Artificial Sequence: Synthetic coding sequence
atggagcggcccgccccgctggccgtcttaccattcagcgacccagcccatgctttgagcctcctccgcggactctcccagctccgagctgagaggaagttcctggacgtgacgttggaggctgccggaggtagggacttccctgcccaccgggctgtcctggctgcagccagcccttattttagagccatgttcgccggccagttacgggagagccgggcagaacgggtgagacttcacggggtacccccagatatgctgcaattactgctggatttctcatacactggacgcgtagccgtcagcggcgacaacgccgagcccctgttgagagctgcggatttattgcaattccccgcggtcaaggaagcttgcggcgcctttttacaacagcaactcgacctcgctaattgcctggacatgcaggactttgcagaggcctttagctgctccgggttagcaagcgcagcacagcgattcatcctcaggcatgtaggtgagttgggggccgaacaattagaacgccttccgctggccagactgttgaggtacctgcgcgacgacggactgtgcgttccaaaagaggaagccgcctatcagctggccttacgctgggttagagctgatcccccgagaagggccgcccactggccacaacttctcgaggcggtgcgcctacctttcgtcaggcggttttatctgctcgcgcacgttgaggccgagcccctggtggcaagatgccccccatgcttgagactgttacgtgaggcccgggatttccaggccgcgcgctatgacaggcacgatagaggcccttgcccaaggatgcgtcctaggccaagcactgggcttgcagagatcttggtgctcgttggggggtgcgaccaggactgtgacgagcttgtaactgtggactgctacaacccccaaacagggcagtggagatacctagcagagtttccggaccacctcggtggaggatacagcatcgtggctctgggtaatgacatttacgtgaccgggggcagtgatggtagcagactttacgattgcgtgtggcgctacaatagttcggtgaacgagtgggctgaagttgcccccatgttgaaagctagagagtaccacagtagcagtgtgttggacggcctcctgtatgtggtagcagccgactcgacagagcggtatgaccacaccactgattcatgggaggctctgcagcccatgacatacccgatggacaattgtagcaccactgcatgtcgcggcagactgtatgccattgggtctcttgcagggaaggaaactatggtgatgcaatgttacgatcctgataccgatctgtggagcctggtggactgcgggcaactcccgccctggtccttcgccccaaaaaccgctactctgaatggccttatgtactttgttcgagatgactcagccgaggtggacgtatacaaccctacccgaaacgaatgggacaagatcccctccatgaatcaggtccacgtaggtggctcactcgccgtgctgggaggcaagttgtatgtttccggcggttatgataataccttcgagctgtcagatgtcgtggaggcttacgatcctgagaccagggcatggtccgtggtgggaaggctgccagaaccaaccttctggcacggaagtgtgagcatattcaggcagtttatgccgcagactttttccggtgggcgcggattcgaattggattccggctcggacgacatggaccccggaagaccgcgccccccacgcgatcccgatgagttacactag

SEQ ID NO: 15556 - DNA, 1620 bp, Artificial Sequence
  Description of Artificial Sequence: Synthetic coding sequence
atggagcggccagctccattggcagtgcttcctttctcagacccagctcatgccctgagcctgctgagaggtctgtctcaactgagagccgagcggaagtttctggacgtgaccctggaggcagccggcgggcgcgatttccctgcccacagagctgttctggcagccgcatctccttacttcagagccatgttcgccgggcagctccgtgagtctcgagcagagcgggtgagactgcacggggtcccacctgatatgctccaattgctgctggacttcagctacacaggaagggtcgccgtgagtggggacaatgcggagccactgcttagagctgctgatttactccagtttcctgctgtgaaagaagcctgcggtgcttttctccaacagcagctggatttggccaactgcctcgatatgcaggacttcgccgaggcgttctcttgtagtggtcttgcctcggcagctcagagattcattcttcgacacgttggagaactcggagccgagcaactagagcggctccctcttgctaggctcctgcggtacctgagggacgacgggctgtgcgtgcccaaagaagaagcagcctatcagctcgccctcagatgggtgcgcgcagatcccccacgtagggcagcccattggccccaactcctcgaggcggtgaggttgccatttgtgagaagattctatctgctggcccacgtggaagccgagcccttggtagcgaggtgcccaccatgcctacgcctcctgagagaggccagagattttcaggctgctcggtatgataggcatgatagagggccctgtccaagaatgcgacctcgccccagcaccggcttagctgagatccttgtgctggttggaggatgtgaccaagattgtgatgagctggtgacagtcgattgttataacccccagacaggtcagtggaggtatcttgcagagtttcctgatcacctgggaggtggttactcaatcgttgccctaggcaacgacatatacgtaacaggtggatctgacggctcccgtctgtatgactgcgtatggcggtacaactcttccgtaaatgagtgggcagaagtggcgccaatgctgaaagctagagagtaccattctagcagcgtgctggacggccttctctatgtcgtcgctgcagattcaacagagaggtacgatcatacgacagattcttgggaggccctgcaacccatgacctaccccatggacaactgcagcacaaccgcctgtaggggacgactgtacgccatcggctctctcgccgggaaagagaccatggtcatgcaatgctatgatcctgatacggatctctggtcactcgtggactgcgggcagctaccaccgtggagttttgcaccgaagacggccaccctgaacggattgatgtatttcgttcgagacgatagtgcagaagttgatgtttacaacccaacaaggaacgagtgggacaaaattcctagcatgaaccaagtgaactttcaagcaggccagcactggaagcatcgactcgttctcatcctccagcccaagtgccaccgagacgagtgtctgggctctactgccatgatgggcggaagtcatcttaactag

SEQ ID NO: 15557 - DNA, 2067 bp, Artificial Sequence
  Description of Artificial Sequence: Synthetic coding sequence
atggacggtagtttcgtgcagcatagtgttcgagtgttgcaagagcttaacaagcagagggagaaaggccaatactgcgacgctacacttgacgtgggcggcctggtcttcaaggcccactggtctgtgctcgcctgctgctcacatttcttccaatcactatacggtgatggcagcggaggcagtgtcgtgctcccagccggatttgccgagattttcgggctgctcctggacttcttttacactgggcaccttgccctgacttcagggaaccgcgaccaggttctactcgctgccagggaactccgcgtgccagaagctgtggagttatgtcagtctttcaaacccaaaactagtgtgggacaggctgcaggcggccagagcggcttgggtccacccgcttcacaaaatgtgaactcacatgtcaaggaacctgcggggctagaggaggaggaggtgtcacgtacactcgggctcgttcccagggatcaggaacccagaggctcgcatagtccgcagcggcctcagctgcatagcccagcacaatctgaagggccctcaagtttgtgtggcaaactgaaacaggcgctgaaaccctgcccactcgaggataagaaacccgaggactgcaaggtgccacctaggccgctggaagccgagggagcccaattgcaggggggctccaacgaatgggaggtggtcgtgcaggtggaggatgatggagatggagactacatgagtgaacccgaggctgtcttaactagaagaaagagtaacgttatcagaaaaccttgtgccgccgaacccgcactctctgcaggctctctggctgccgaaccagcggaaaaccgaaaggggaccgcagtcccagttgagtgccccacatgtcataagaagtttctcagtaagtactacctgaaggttcacaataggaaacacactggagagaagccatttgagtgtcccaagtgtggaaagtgttacttccggaaggaaaatcttctggagcacgaagcgagaaattgtatgaaccggagcgaacaagtgtttacatgtagcgtgtgtcaggagacctttaggagaagaatggagctcagggttcacatggtgtcccatacaggggagatgccgtacaaatgctcttcttgcagccaacagttcatgcagaagaaggatctccagagccatatgattaagctgcacggagcacccaagccgcatgcatgtccaacttgcgctaaatgtttcctgtcaaggactgaactgcagctacatgaagccttcaaacacaggggagaaaagctgtttgtatgtgaggagtgcggtcaccgagcctcctctaggaacggcctacagatgcacattaaagctaagcacaggaatgaacgaccacatgtgtgcgagttctgttctcacgccttcacccagaaggcaaatttgaacatgcacttgagaacccatacaggcgaaaaaccattccagtgccacctgtgtggcaagacatttagaacacaggcctcattagataaacataacagaacccatactggggagagacccttctcgtgcgaattctgcgagcaaagattcacagagaagggccccctcttgcgacacgttgctagccgacatcaagaggggcggcctcatttctgtcaaatctgtggcaaaacatttaaggccgtggaacagcttagagtgcacgtgcgacggcacaaaggagtgcgtaagttcgagtgcaccgagtgcggatacaagtttacacggcaggcccacctgaggcgccacatggaaatccacgatagagtagaaaactacaatccccggcaacgtaagctgaggaatctcatcatagaagatgagaaaatggtcgtagtcgccctgcagccacccgcagaactggaggttggaagcgctgaggtcattgtcgagagcctagcccagggcggacttgccagtcagttgcctggtcaacggttgtgcgctgaggagtccttcaccgggcccggcgtgctggagcctagcctcatcatcaccgccgccgtgcccgaagattgcgacacgtag

SEQ ID NO: 15558 - DNA, 525 bp, Artificial Sequence
  Description of Artificial Sequence: Synthetic coding sequence
atgacacactgttgctccccttgctgtcaaccaacatgttgccggactacctgttgtagaacaacgtgctggaagccaacaacagttaccacctgctcaagtacaccctgttgccagccagcttgctgcgtcagtagctgctgtcagccttgttgtaggccaacctgttgccaaaatacctgttgtcggacaacctgctgtcagcctacgtgtgtcaccagctgttgtcagccttcttgttgctcaactccctgctgccagcccacctgctgtgggtcgtcttgctgtgggcagaccagctgtggatcctcatgtggacagagctcaagctgcgcaccggtgtattgtcgccgcacatgctactacccaacaactgtgtgcctccccggctgtcttaaccagagctgcggcagtaattgctgtcagccttgctgccggccggcatgttgcgagaccacttgttgtagaactacttgctttcagccaacctgtgtgtcgtcatgttgccagccctcatgttgctag

SEQ ID NO: 15559 - DNA, 597 bp, Artificial Sequence
  Description of Artificial Sequence: Synthetic coding sequence
atggtctcatcttgctgtggatcagtctgtagcgaccaaggctgtagccaggacctgtgtcaggagacatgttgtcgcccttcttgttgtcagaccacctgttgtaggacgacttgttaccgcccttcatgctgcgtgagcagctgttgtaggccccagtgttgtcagtccgtttgttgtcagccgacctgttgtaggccaccgaggtgctgtatcagctcatgctgcaggcctagctgctgtatgtcaagctgttgcaaaccccagtgctgtcagagcgtgtgctgccaacccacaactacctgctgccatcctaggtgctgtatctccagctgctgtcggccctcttgttgcgtgtcatcatgctgcaagccacagtgctgtcaatctgtgtgttgtcagccaaactgttgccgcccttcgtgttccatctccagctgttgccgtccaagctgttgcgaaagcagctgctgtcggccatgctgttgcgtgcggcccgtgtgcgggagagtgtcttgccacactacttgctatcggcctacctgtgtaatatcttcctgcccccgaccattgtgctgtgcatcaagctgctgttag

SEQ ID NO: 15560 - DNA, 1296 bp, Artificial Sequence
  Description of Artificial Sequence: Synthetic coding sequence
atgacgtcagactgctcctctactcactgctcacctgagtcatgcggcacagctagcgggtgtgccccagcttcctcttgctctgttgaaactgcatgcctacctggtacatgcgcaacctccaggtgtcaaacaccctcctttctctcccgctctagaggactgaccggatgtttgctaccctgctatttcaccggtagttgcaatagtccatgcctggtgggaaactgtgcttggtgtgaggacggcgtgttcacttccaatgagaaggaaactatgcagttcctcaacgacagattagcatcgtatctggaaaaggtgcgctctctggaagagactaacgccgaactcgaatcccggatccaggagcaatgcgagcaggatatcccgatggtgtgccctgactatcagaggtactttaacactatcgaagatctgcagcaaaagattctgtgcaccaaggccgaaaattcccggcttgcagttcagttggacaattgcaaactggcgaccgatgatttcaagtctaaatacgagtcagagttgagcttaaggcagttgttggaggccgatatctcgtccctgcacggcatcctggaggagctgactctgtgtaagtctgacctggaggcccatgtagaaagcctgaaagaagacctactttgcctgaaaaaaaaccacgaggaagaagtcaatctgctgagagaacagctcggggatagactgtcagtggagctggacacagcaccaacccttgatttgaatcgcgtgctcgacgagatgcgctgtcagtgtgagaccgtgctggcgaataaccgaagggaggctgaggagtggctggctgtgcagaccgaggaacttaaccagcaacagttgagctcggctgagcagctgcaaggctgccagatggagatcctagaactgaagagaacggcctctgcactggaaatagaactccaggcccagcagtctttgacagagagtttggaatgcactgtggcagagactgaggcacagtattcttctcaactcgcccagattcagtgccttattgataatctggagaaccagttagctgagattaggtgcgatctcgagcggcagaaccaggagtatcaggttctgttggatgttaaagcgcggctggagggcgaaattaacacttattggggcttactggactccgaggacagtcggttaagttgctccccttgcagtaccacctgtacttcaagcaacacatgtgagccgtgttccgcttacgtcatctgtaccgtggagaattgttgtctttag

SEQ ID NO: 15561 - DNA, 1047 bp, Artificial Sequence
  Description of Artificial Sequence: Synthetic coding sequence
atggctggatctctgcccccctgcgtggtcgattgcggcaccggctataccaagctgggttatgctggcaatacagagccacagtttatcatcccttcgtgcatcgccatcagggaaagtgcaaaagtggtagaccaggcccaaaggcgggtcctgaggggtgtggacgatctggatttctttatcggagacgaagcaatcgataaacctacttacgctactaagtggcctattcggcacggcattatcgaagattgggatctgatggagagattcatggagcaggtggtgtttaaatacctcagagctgaaccagaggaccattatttcttgatgacggagccacccctgaatacccctgaaaacagagaatatctcgctgaaatcatgtttgaatcattcaacgtccctggactgtacattgctgtccaggctgttcttgcgctcgcagcctcctggacgagcagacaggtgggagagagaacgttaaccggcatcgtgattgactctggcgatggggtgacacatgtcataccggtagctgagggctacgtcatcggatcatgtatcaagcacatccccatcgctgggagggacattacttactttatccagcagctcctgagggaaagagaggtgggtatacctcccgaacaatcgctggaaaccgccaaagcgattaaagagaaatattgttatatctgcccagacatcgtgaaagaattcgcaaagtacgacgtggacccgcgcaaatggattaagcaatacacaggaatcaacgcgatcaaccagaagaaatttgtgatcgacgtgggctatgagcgattcctgggtcccgagatcttctttcacccggagtttgccaacccggattttatggaatctatcagcgacgtggtggacgaagtgatccaaaattgccctattgacgtgcgtcgccctctgtacaagcccgagttctttcaggtgtgccatacgaaaaaagattatgaagaatatggtcccagcatttgccgccacaacccagtgttcggcgtgatgagttag

SEQ ID NO: 15562 - DNA, 273 bp, Artificial Sequence
  Description of Artificial Sequence: Synthetic coding sequence
atggacaatatgagtcctcgactgcgggcctttctgagcgagcccatcggcgaaaaggacgtgtgctgggtcgatggcatctcgcacgagttagccatcaatcttgtaacaaagggtattaacaaggcctacatcctcctaggccagtttctccttatgcataagaatgaggccgaatttcagagatggcttatatgctgcttcggggctacggaatgcgaggctcagcagacctcccactgcctgaaggaatggtgcgcttgcttcttatag

SEQ ID NO: 15563 - DNA, 249 bp, Artificial Sequence
  Description of Artificial Sequence: Synthetic coding sequence
atggcttcgtcttccggcgcaggggccgctgctgccgcagcggccgctaacctgaacgctgtccgtgagaccatggatgtccttctcgagattagcaggatcctgaatacaggactcgatatggagacactcagtatctgtgtgcgactgtgtgagcaagggataaatcccgaggccctttccagcgtcataaaggagctcaggaaggctacagaagccctaaaagcagccgaaaatatgacaagttag

SEQ ID NO: 15564 - DNA, 3732 bp, Artificial Sequence
  Description of Artificial Sequence: Synthetic coding sequence
atggaaaccagagctgcggagaataccgcgattttcatgtgcaaatgctgtaatctgttctccccgaaccagtccgaactgctcagccacgtgtcagagaaacacatggaggaaggagttaacgttgacgagatcataattccgctacgaccattgagtactccggaaccgccaaactcctccaaaacaggtgatgaatttctggtgatgaaaagaaaacggggacgccctaaggggtcaacaaagaagtccagcacggaggaagagctggccgaaaacattgtttcgcctaccgaggactctccgctggcacctgaggagggcaactccttgcctccaagttcgctggagtgttctaaatgctgcagaaaattctcaaacactcgtcaattaaggaagcatatctgtataatcgtgctgaacctgggtgaagaggaaggtgaagccggaaatgagtctgacctcgaactcgagaaaaaatgtaaggaggatgatcgcgagaaagcctctaagagacctcgcagtcagaagacggaaaaggtacagaagataagtgggaaagaagccagacagctgtccggcgctaagaagcccatcattagtgttgtcctgacagcccacgaggccattccgggcgccaccaagatagtcccagtggaagccgggcctcccgaaactggagcaaccaatagcgagaccacttccgccgacctggtgcccaggcgggggtatcaggaatacgccatacagcagaccccgtatgaacagccgatgaaatctagtcgactggggccaacgcagctcaagatttttacttgcgagtattgtaataaagtgttcaagttcaaacatagtctccaggctcatctccgtatccacacaaatgagaagccatacaagtgcccgcagtgctcgtacgcatcggccatcaaggccaatctgaacgtccatttgcgcaagcatacaggtgagaaattcgcatgcgactactgtagcttcacctgcttaagtaaaggacatctcaaagtgcatattgagcgcgtgcacaagaagatcaagcagcactgtagattctgcaaaaagaagtactccgacgtcaaaaatctgatcaaacatatccgcgacgcacatgatccgcaggacaagaaggtcaaggaagcccttgacgagttgtgcctaatgacacgcgaggggaaaagacaactcttgtacgattgtcacatttgcgagcggaaattcaagaatgaactcgatagagatcgccatatgttggtgcacggagacaagtggccgttcgcatgcgaactttgtggccacggggccactaaataccaagcgctggaactgcatgtgcgaaaacacccattcgtgtacgtgtgcgccgtctgccgcaagaaattcgtctccagcatccgcctaagaacccatatcaaggaagttcacggagcggcccaagaagccctcgtgttcacaagtagcatcaaccagagcttttgtctcttagaaccaggaggagacatccagcaggaagccttaggtgaccagctgcagctcgtcgaagaagagtttgctcttcagggagttaacgctctgaaggaggaggcctgcccaggtgacacacagctcgaagagggacgcaaagagcccgaggcaccaggcgagatgccagcacctgcagtgcacctggccagtccacaggccgagtctaccgcgcttccaccttgcgagctggaaaccacggtggtttcctcgtccgatctgcatagtcaagaagtagtttctgacgacttcctgttgaaaaatgacacctcttcggccgaggcccacgccgcaccagaaaagcctcccgacatgcagcacagatcatccgtacagactcaaggagaggtaataaccctcctcctttccaaggcccagtcagcggggtccgatcaggaatctcacggagcccagtcacctctgggggaggggcaaaatatggcagttctctctgccggagatcctgaccccagcaggtgcttaagatccaaccctgccgaggcatcagaccttctgcctcccgttgccggagggggagacacaattacccatcagccagattcttgtaaggctgcacccgaacaccgctcaggcataacagcctttatgaaggttctgaatagcctgcagaagaagcagatgaacacgagcctgtgtgagagaatacgtaaggtgtacggcgacttggaatgcgagtactgcggaaagctgttctggtaccaagtgcattttgacatgcacgtccgcacccacaccagagagcacctgtattattgttcacaatgccattacagtagcattacaaaaaactgtctgaaaaggcacgtgatccaaaagcattccaacattctgttaaaatgcccgactgacggttgcgactactctacaccagacaagtacaaattacaagcccacctaaaggtacacactgccctcgataagcgctcctatagttgccctgtgtgcgagaaatccttttctgaggatagactgatcaagagccatataaagacaaaccaccctgaggtgtcaatgtccaccataagcgaggtgctaggaaggcgggtccagctgaagggacttattggaaaacgagcaatgaagtgtccttattgcgacttctacttcatgaaaaatggaagtgatctgcagcgccacatctgggctcatgagggtgttaagcccttcaagtgctctttgtgtgaatacgccacgagaagtaaatctaatttgaaggctcacatgaacaggcatagcacagagaaaacccacctctgtgatatgtgcggaaagaagttcaagagcaagggcaccctaaagtcccataagctgctgcatacagcagatggaaaacagtttaagtgtactgtgtgcgattacaccgcggctcaaaagccccagttgctcagacatatggaacaacacgtgagctttaaacctttccggtgtgcccactgtcactatagctgcaacatttccggcagtctcaagagacattacaatcgtaagcacccaaacgaggaatatgcaaatgttggcaccggagagcttgcagctgaggtattaatccagcagggtggactgaaatgccccgtgtgctctttcgtttatggcacgaagtgggaattcaatcgccacctcaaaaacaagcacggacttaaggttgttgaaattgatggagaccccaagtgggagacagctactgaagcacccgaggagccatctacacaatatttgcatattacagaggcagaggaagatgtccaaggtacccaggccgccgtggctgctcttcaggaccttcgctacactagtgagagcggagatcggctagacccaacagcggttaacattctgcaacagatcattgaacttggggctgaaacacatgatgccacggctttggctagtgtggtcgctatggcccccggcaccgtgaccgtggtcaagcaggttacagaggaagaaccttcttcaaatcataccgtcatgatccaagaaaccgtccagcaggcgtccgtagaactggccgagcagcatcaccttgtggtgtcctcagacgacgtcgagggaatcgagacggtgacagtgtatacacagggcggggaagcatctgaatttatcgtctatgtgcaggaagcgatgcagccagtggaggagcaggccgtggaacaacccgcgcaggaactatag

SEQ ID NO: 15565 - DNA, 2274 bp, Artificial Sequence
  Description of Artificial Sequence: Synthetic coding sequence
atggcactgggcgaggagaaagccgaagctgaagcttcagaagatactaaggcacagagttacggacgtggatcctgcagggaaagagagcttgacatcccgggtccaatgagcggcgaacagccacctcgcctggaggcggaaggagggctcatttccccggtctggggagcagagggcatccccgccccaacttgctggatcggtaccgacccagggggcccctcgagagcccatcaaccccaggcctcagacgccaatcgcgaaccagtggcggagcggagcgagcccgccctgtccggcctgcctccggctactatgggctccggggacctgcttctttcgggcgaatcacaggtcgagaagactaaactgtccagttctgaagagttcccccagactttatcactacctaggactactaccatttgctctggccacgacgccgacaccgaagatgacccgtctctggcagaccttccccaagcgttggacctgagccaacaaccacatagctccggcctttcgtgtctttcccaatggaagtccgtgttgagtccgggctccgccgcccagccctcatcttgctctataagcgcctccagtactggatcctctctgcagggccatcaagagagagctgaaccccgagggggttccttagccaaagttagctcgtccctggaacctgtggtgcctcaggagccatcgagcgtcgtgggactaggccccaggccccagtggagtcctcagcccgtgttctctggcggggacgctagcggactgggccgaagaagactctccttccaggctgagtactgggcatgcgttctgcctgattccctacctcccagtcccgatcgccattcacccctgtggaacccgaataaggagtatgaggatcttttggattacacctacccgctgcgccctggaccccagctgcctaagcacctcgattcaagagtgccagctgacccagtgttacaggattccggcgtggatttggactcatttagcgtgtcccccgcaagtacactcaagtcaccaactaacgtgtctcctaactgcccgcctgccgaagccaccgcactgccattctctgggccgagggaaccctccctgaaacagtggcctagccgcgtcccccagaagcaaggagggatgggactcgcctcttggtcccagctagcctccacgccaagggcacctggttctcgtgacgctcggtgggagcgtcgtgagccagccctgaggggagcaaaggatcgactcaccatcggcaaacacctcgacatgggctcaccccagctgcgcactcgggaccggggttggcccagcccacgtcctgagagagagaaaagaacttctcagtcagcaaggcgaccaacgtgtaccgaatcacgatggaagtccgaggaggaggtcgaatctgatgacgaatatcttgcgttgcctgcacgactgacacaggtgtcctctctggtctcatacctgggctctatcagcacccttgtgactttaccaacaggagatattaagggccaaagcccactggaagtcagcgattccgacggacctgcttcatttccaagttcctccagccaatcccagttgcctcccggcgcagccttgcagggatccggcgaccccgagggtcagaacccctgtttcctgcgatcattcgtgcgtgcccacgactctgccggtgagggcagtctggggtcaagtcaagccttgggtgtatcctctgggctgctgaaaacacggccttctctgccagcccgcctggatagatggccctttagcgaccccgacgtcgaagggcagctgccaaggaaagggggtgagcagggcaaggaaagcctagttcagtgtgtcaagaccttctgctgccagctggaggagctgatctgttggctgtataacgttgccgacgtcacagatcacggaacagctgcacgctccaacctgaccagtctcaaatcctcccttcagttgtatcgacagttcaagaaagacatcgatgaacaccagtcactgaccgagagcgtcctgcaaaaaggagaaatattgctgcagtgtctcttagagaacacacccgtgttagaagacgtgcttgggaggatagccaaacaaagcggagagctggaatcgcacgcagaccggctgtacgactctatactcgcctccctggacatgttagcaggttgcaccctgattcctgataagaaaccgatggcggctatggagcacccatgtgagggcgtctag

SEQ ID NO: 15566 - DNA, 540 bp, Artificial Sequence
  Description of Artificial Sequence: Synthetic coding sequence
atgaatccgtctatgaagcagaagcaggaagaaattaaggagaacatcaaaaactcttccgtgccacgacgaacattgaagatgattcagccttctgcctcgggctctctcgtgggtcgcgagaatgaactgagcgccgggttgtctaagaggaaacacaggaacgatcatctcacctctaccacgtcttcccccggggtcattgtccccgagagctccgagaacaaaaacctgggtggagtgacacaggagtccttcgacttaatgataaaggagaatccaagtagccagtactggaaggaggtcgccgaaaaacggcggaaagctttgtatgaagccctcaaggaaaatgaaaagctgcataaggaaatcgaacagaaggacaacgaaatcgctagactgaaaaaagaaaataaggagctcgccgaggtcgccgagcacgtccagtacatggccgagctgattgagcgcctcaatggcgagccattggacaatttcgagtccctggataaccaggagttcgattccgaggaggagtag

SEQ ID NO: 15567 - DNA, 309 bp, Artificial Sequence
  Description of Artificial Sequence: Synthetic coding sequence
atgaatccttctatgaaacagaaacaggaggaaatcaaggagaatatcaaaaattcttccgtccccaggcgcactctcaagatgatccagccatccgcgagtggttcactggtagggagagaaaacgagcttagcgccggcctgtcaaagcggaagcacaggaatgatcatttgacatccacaactagcagtcccggcgtcatagtcccggaaagctctgagaacaagaatctggggggcgtgacccaggagagcttcgacttaatgattaaggagaatcccagcagccagtactggaaggaagtgtag

SEQ ID NO: 15568 - DNA, 2259 bp, Artificial Sequence
  Description of Artificial Sequence: Synthetic coding sequence
atggcagaacccgccagtgtgacggtcacgtttgacgatgtcgccctgtacttttccgaacaggagtgggaaattcttgagaaatggcagaaacagatgtacaaacaggagatgaaaacaaactatgagacgctggatagccttggctacgcattctcgaaaccggacctgatcacgtggatggaacaaggtcgaatgcttttaatttccgagcagggttgtctggataagaccagacggacaacctcgccgcctactgatgagcagctcaacatgaaaaatacgggcaaactcctctgctttgacgatgaaggcactccgcggacgaaagaggaagactgtagactgaatggtccgcagaagcaagatctttgtgccgcactgagggggaaagaaaggaaaatattgctcgctcaaactgccacctttcagtcgccttccctgagggaaaccgagatcttgaacaaaaaagtttccattacagcttacgaccctgacaagaaagatcttaggcacaaacccagagaaacccccggcaggctggagattcctaccggtccacgatgctacagttgctacgtttgcaggaaggtttttcaagtgcggagggatttgctgaagcataagcggagtcatagtaaatcccaattgtgtagatatcccaagtacaagaacagctctagggggaaatcagaattgcggagaacacagagacttctatgtcagaaaaagcggttccagtgtagcgaatgtgagaagagctacttccttaaggggtctctggtcacacaccaggtcgtacacaccggacaaagaccctatccctgcccggaatgtgacaaaacctttaggtaccgggctaacttaaagaagcatctgtgccttcataggggcgagcgtcccttttgttgcggcgaatgtgggagggctttcgtgcagcaatgtgagctaacagaacacctgaggttgcacagtggagaaaagccttttcagtgcccacagtgtgaccggtgttttcggcttaaacgaggcatgaaggtgcacttgacacagcatagtggcaagaggccatttcactgccctgagtgcggacgaagcttttctcgcaaagcagccctgaaaacacaccagaggacgcatagtgaggagaaaccctttagctgcggtgaatgtggccgcaaatttatatacaaaatcaaattggatgagcacattagggtgcacactggagagaagcccttcagctgccccgagtgtaataagtccttccgcctgaagaggtctcttaaggcacacggtttgcagcatattggcaagaggcctttccagtgtcctgagtgctcccggggctttttctggagaaacgccatgcgcgcccaccagaggctccactctgaacagaaacccttcccttgtgccgaatgcggcaaacggttcaccaggccttccaaactcgcctgccacactcgagtgcacgacagacagaaggagtttccctgcggagagtgcaaaaagactttttcgcagcaatcccgactcactcagcacttgaaggtgcacactaccgagaaaccattctcttgtgcggagtgcggtagaagcttccggcgccgcgcacacctgactgagcataccaggttgcactcaggtgaggaacccttccagtgccctgagtgcgataagagctttagctggaaggcctccatgaagttccaccagagaatgcatagagacgagaagcctttcgcctgtggtgagtgcgataaaacttacacccaccagagtcagctgactgaacatctccgactgcacagcggcgagaagccatatcagtgccccgagtgtgagaaaaccttccgtcttaaggggaatctgaagagccacctgctgcaacatagcggacagaaaccatttagctgcgtgatgtgtggaaagtcgttcacccaacagtaccgacttacagaacacatcagggtgcatagcggagagaaaccatttcaatgtccagaatgtgataagagttactgtatccgaggatcactgaaggtgcacttgtataaacatagcggggagaggccatttcagtgtccagagtgcgggaaggggttccttcaaaagcgcagcctgaaagcacatctgtgtcttcactcaggagagcgtccgttcagctgcgatgagtgcggaaggtcctttacgtacgtgggcgcgctcaagacacatattgccgtgcatgctaaagagaagcccagtagcctctag

SEQ ID NO: 15569 - DNA, 1935 bp, Artificial Sequence
  Description of Artificial Sequence: Synthetic coding sequence
atgttcctcacatatatggagacagttaccaaagaactcgttagctggatgagaggccatgagagtagcgtcttcagtatcagtgtccatgcctcgggtaagtatgctataaccaccagctctgatacagcccagctctgggacctcgacacctttcagaggaaacggaagttgaatatcagacaaagtgtgggtatccaaaaagtgttttttttgcccctttcgaatacaattctgagttgtttcaaggacaatagcatattcgcgtgggagtgcgacactctattctgcaaatatcagctccctgcacctccagaaagtagctccattctatacaaagtttttgctgtcacgcgcgatggcaggattctggcggcaggtggaaaatccaatcacctgcacctctggtgtctcgaggctaggcagttgttcaggataatccaaatgccaaccaaggtccgagcgattcggcatctggagttcttgcctgacagtttcgatgcgggcagcaatcaggtcctaggtgtactgtctcaggacggcattatgaggtttataaatatgcagacttgcaagctgcttttcgagatcggtagcctggatgagggaataagtagtagtgctataagtcctcatggtcgctacatagcctcaattatggaaaatggcagtctgaacatttatagtgtccaggcactcacacaggaaatcaataagcctccaccccccctggtaaaagtgatcgaagatctacccaaaaacaagctctccagcagcgacttgaaaatgaaagttacttccggcagggttcagcagccagcgaagtccagggagagcaaaatgcaaaccaggattttaaagcaggacctgactggggactttgagagtaagaagaacgagctcccagatgggctcaacaagaaacggttgcagatactcctgaaaggctatggcgaatatccaactaaataccgaatgtttatttggagatccctcctacagctgcctgaaaatcacaccgccttcagcacacttatagacaaaggcacccatgtggcattccttaatctccagaaaaagtatcccataaagagtcgtaaactactgcgcgtgctgcaacgaaccctgagcgccctggcccactggagtgtgatattttcggacaccccttatctgccactgttggcctttcccttcgtgaagctctttcaaaacaaccaactgatctgtttcgaagtcatcgctaccctaattatcaactggtgtcagcattggttcgaatactttcccaacccacccatcaacatcctgagcatgatagaaaacgttcttgctttccacgataaagagttgctgcagcacttcatagaccatgacataacgtcccagctctacgcctggccactcctagaaacagtgttctcagaagtgctcacacgagaggaatggctgaaacttttcgacaacatctttagcaaccacccttcattcctccttatgactgtagtggcctacaatatttgctcacgtactccgttactgtcctgtaatttaaaggatgattttgaattcttcttccatcaccggaacaacctggatatcaacgttgtcatacggcaggtataccatctgatggaaacgacacccactgatattcatcctgacagcatgctgaatgtgttcgtagctctcacaaagggacaataccccgtgttcaatcagtacccaaagttcatcgtggattatcagactcaggagcgggagagaattagaaatgacgagctggactatctccgggaacggcagctcaagatctgcaagcttaagagcacatctaaagagttaaaaatgaagctgggaactcgcaataggtcctgtttcgttaagttaaagaagcaggaagaaaagtgctcgtacaagagacgaaggaaatag

SEQ ID NO: 15570 - DNA, 735 bp, Artificial Sequence
  Description of Artificial Sequence: Synthetic coding sequence
atgccccataaaataggctttgtagtggttagttcatccgggcacgaagacggttttagtgcccgcgaactgatgattcatgcccccacagtgtccggatggaggagccctcggttctgccagtttccccaggagatagtgctacagatggtcgagaggtgccgaattagaaagctacagctgcttgcccatcagtacatgatctcttctaagattgagttctacatctcagagagcctgcctgagtacttcgcaccataccaggctgagcgcttcaggcgactggggtacgtgtcactgtgcgacaacgaaaagaccggctgcaaggctagagaattgaaatctgtttacgtagacgcagtgggacaatttctgaagctcatctttcatcaaaaccatgttaacaaatataatatctataatcaggtggcactcgtggccataaatattataggcgatcccgctgacttttctgacgagtcaaatactgcgtctcgcgaaaaactgatcgatcactatcttggacataattcagaggacccagctctggaggggacctatgccagtagcgtgcggaccgggggcgaatcaacatttggggagttaaagggtccggcagtgcccagcagcgttaccctgtctgtactggggacaagtctaggacagtggtttccttgccacctgcccgctgttgacgacaacgaagggacccctttccagcgatgcctggtgtag

SEQ ID NO: 15571 - DNA, 2778 bp, Artificial Sequence
  Description of Artificial Sequence: Synthetic coding sequence
atgccccataagattggattcgttgtagttagctcctcgggtcacgaagatggcttttctgcccgcgagcttatgatacacgccccaacagtgtccggatggcgatcccccaggttctgccaattccctcaggaaatcgtgcttcagatggttgagcggtgcagaattaggaagttacagcttcttgcccaccagtatatgattagcagcaaaatcgaattctatatttctgagtcccttccagaatacttcgctccctatcaagccgaaaggttcagacgactggggtacgtaagtctctgtgacaatgagaagacagggtgtaaggcgcgcgaactcaaatcagtctacgtcgatgctgtcggacaattcctgaagctgatattccaccagaaccatgtgaataagtataacatctacaaccaggtggcactggtggctatcaacatcatcggtgaccccgccgatttctctgatgagagcaacactgcttccagagagaagttgatcgaccactatcttggtcacaattccgaggatcccgctctggaaggcacctatgcgcgtaaaagcgattatatctccccgctggatgacttagcatttgacatgtatcaggatcccgaggtggctcaaatcatccggaagctggatgaacggaaacgcgaggccgtgcaaaaagagcggtacgattacgctaagaagctgaagcaagccatcgccgacctgcaaaaggtcggagaaagacttggacgctacgaggtggaaaagaggtgtgctgtcgaaaaggaagattacgacctggcaaaagagaagaagcagcagatggaacagtatcgcgccgaagtctatgagcagctggagcttcactctcttttagatgccgaattaatgaggcggcccttcgacctgcctttgcaacccctggcaagaagtggttcaccttgccatcagaagccaatgccgagtctcccccaactggaagagaggggaactgaaaatcaattcgcagaacccttcctccaggagaaaccgtcttcgtacagcttgaccatcagtcctcagcatagcgctgtggacccgttacttcccgcaaccgacccccatcctaagattaatgcagagtccctgccttatgacgagagacccttgccggcaatcagaaaacactacggtgaggccgtcgtggagcctgaaatgagcaatgccgatatctctgacgcacggcgaggaggcatgttgggagagcccgaaccacttacagagaaagccctgagggaggcaagctcagctatcgacgtgctgggcgagaccctcgtggccgaagcatactgcaagacttggtcgtatcgagaggatgcgctcctggctcttagcaagaagctgatggagatgcccgtgggcacccctaaggaagacctcaaaaatacgctacgcgcctcggtattcttggtgagacgggccataaaggatattgtgacatcagtctttcaagcctcacttaagttacttaagatgattatcacccagtacataccaaaacacaagctgtccaaactggaaactgcacactgcgttgagagaaccatacccgtgcttctgacaaggaccggggacagttccgcgcggcttagggtaacagctgcaaattttatccaggaaatggccttgtttaaggaggtgaaaagtctacagataatccctagctatctagtacagccactgaaagcaaattcatcggtgcatctggcgatgagtcagatgggtttactcgcaaggctcctgaaggatttaggcacaggcagctccggcttcaccatcgacaacgttatgaaattttcagtgagtgccctcgaacatcgtgtctatgaggtgagggaaaccgccgtaaggataattctggacatgtataggcagcatcaggccagcattctggaatatttgccaccagacgactcaaatacacgcaggaatattctgtacaaaactatcttcgaggggtttgccaaaattgatggacgggccacagatgctgaaatgcgggcccgacgtaaagctgccactgaagaagctgagaaacagaaaaaggaggaaattaaagcactacagggccagctggcagccctcaaagagatccaagccgaagttcaggaaaaagaatccgacgcggttaaaccaaaaaaccaggatattcagggcggtaaggccgctccagccgaggccttgggtatccccgatgaacactatctcgacaatttgtgtatattttgcggagaacggtccgaatcattcactgaagagggacttgatcttcattactggaagcattgcttaatgctgaccagatgtgaccactgcaaacaggtcgtagagatatccagtctcactgaacaccttctaactgaatgtgacaagaaggatggttttgggaagtgttacaggtgctcagaggccgtgttcaaggaggaactgcctcgacatattaagcacaaggactgcaaccccgccaagcctgaaaaactggctaatcgatgcccactgtgtcatgagaattttagtcccggcgaagaagcgtggaaggcccacctgatgggccccgcagggtgcaccatgaatttaagaaaaacccacatcctgcagaaagcccctgcattgcagcccgggaagtcttcagctgtggcagcatcaggacctctcggcagcaaggccgggagtaagattcctacacccaaggggggcctctccaagagctcttcacggacctacgcaaagagatag

SEQ ID NO: 15572 - DNA, 2145 bp, Artificial Sequence
  Description of Artificial Sequence: Synthetic coding sequence
atggcacgtgctgggtcatgtgggggcgcagccgccggagccggacgccccgaaccttgggagttgagccttgaagaggtcctcaaagcttatgagcagcctctcaacgaagagcaagcttgggccgtatgtttccaaggctgtagggggctgcgcggttcacctgggcggaggctgcgcgataccggggacctgcttcttcgcggtgacgggtctgtgggcgcgagagagcccgaggccgccgagcccgccaccatggtggtgccattggcctcctctgaagcgcagacggtgcagagcttagggttcgcaatataccgggctttagactggggcctggacgaatccgaggagcgagaactaagtccccagttggaacgacttatcgacttaatggctaataatgatagcgaagattccgggtgtggcgctgcagatgagggatacggagggcccgaagaggaggaagaggccgaaggggttccccgtagcgtccggacctttgcacaggctatgaggctctgcgccgctcgcctgactgatcctaggggcgcccaggcccattatcaggccgtttgtcgtgcgcttttcgttgaaacgctggagctacgggccttcctcgcgcgggttagagaggcaaaggagatgctgcaaaagctccgagaggacgagcctcatctggaaaccccacgcgccgaactggattccctgggacatactgattgggcgcgtctttgggttcaactgatgagggaactgcgacggggagtcaaactgaaaaaggtgcaagagcaggagttcaaccctctcccaacagaattccagttgacgccgtttgaaatgcttatgcaggatattagagctaggaattacaaactacggaaagtgatggttgacggggatattcccccacgcgtgaaaaaggacgctcatgaactgattttagactttattcgctcacgccccccactgaagcaggtgagtgagagaaggctgaggcccctgccgcccaaacagcgttctctgcatgaaaagatcctagaagaaattaaacaggaaaggcgcctcagacccgtgcgtggagagggctgggccgccaggggatttggatcgctgccttgcatactgaacgcctgctcaggcgatgctaagtctacatcctgtattaacttgtcagtgacagacgccggcggatcagcacagcgaccccggccgcgggtgctcctgaaggcccctactctggctgagatggaggagatgaacactagcgaggaagaggaatccccttgtggggaggtcacattgaagcgggaccggtctttctccgaacacgatctggctcagttaaggagtgaagtggcctctggcctgcaatctgcaacccatcccccaggaggcacggagccaccccggcctcgcgctggaagcgcacacgtctggagaccaggctcccgagaccagggcacatgccctgctagcgtctccgatcctagtcaccccctgttgtctaatcgtgggtcaagtggggaccggccagaagcttccatgaccccggatgccaagcacctatggctcgagttttcccacccggtggaatcacttgcactgaccgtggaagaggtaatggacgtgcgacgcgtgctggtgaaggcggaaatggagaagttcttgcagaataaagagctcttctcttctttaaagaagggcaagatatgctgttgttgcagagctaaatttccgctctttagctggccaccttcttgtctgttttgcaaaagagccgtttgcacttcttgcagcataaagatgaagatgccttccaaaaagtttggacacatcccagtgtatacattggggtttgagagtccacagagagtgagtgccgcaaagacagcccctatccagaggcgtgatatttttcaatccctccaggggccacagtggcagtctgtggaagaggcattccctcacatatacagccacggctgtgtattgaaggatgtctgctctgaatgcacgagcttcgtagccgacgtcgttagaagttcccgaaaaagcgtggatgttcttaataccacccctcgtaggagcagacaaacacagtctctatatatccctaatactagaaccttggactttaagtag

SEQ ID NO: 15573 - DNA, 1308 bp, Artificial Sequence
  Description of Artificial Sequence: Synthetic coding sequence
atgaacttctctgaggtgttcaaactgtctagtctcctttgcaagttctcaccagatggaaagtacttggcctcttgcgtacagtatagattggttgtcagagacgttaatacactgcagatcttgcagctttatacctgcctggaccagatccagcatattgaatggtccgctgattctctgtttattctgtgtgcaatgtacaaacgagggctggttcaggtatggagtctcgagcagcctgagtggcattgcaaaatcgacgagggttctgccggactcgtagcatcttgctggagccctgacggacggcacatcttgaatacaacggagtttcacctccggattaccgtctggtccctctgcacaaaaagcgtgagttatataaagtatcctaaggcctgccttcagggaatcacctttacacgcgacggtcgatacatggctctggccgagcgccgagactgcaaagattacgtgtccatcttcgtgtgttcggattggcagctccttaggcattttgacacagatactcaggacctgacaggcatcgagtgggcgcccaatggttgtgtgctggcggtttgggacacatgcctggagtacaagatcctgctttattccctggatggaagactgctttcaacctacagcgcctacgagtggtccttgggcattaaatccgtagcttggagcccctctagccagtttctggccgtcggtagctacgatggtaaggtgcggatactgaatcatgtcacctggaagatgatcaccgagtttggacaccctgcagcaattaatgaccccaaaatcgtggtctataaggaggccgagaagagccctcagcttgggctgggctgcttatccttccctccccccagagccggcgcaggcccactgccttctagcgagtctaaatacgaaatcgcatcagtgccagtcagtcttcagaccctgaaacccgtcacagaccgcgcaaatccaaaaattggcatcgggatgctcgccttttcaccagattcttacttcctcgccactcgcaatgataatatccccaacgccgtgtgggtgtgggacattcagaagctccgcctcttcgctgtcctggagcaattaagcccagttcgggcctttcagtgggatcctcagcagccccggctcgctatttgcaccggcggatcgcgtctgtatctgtggtccccagccggttgcatgtccgtacaggttccaggagagggtaaacacattcctgaggctactgacgtggcagccctcctctgtgccgtatggcaccataccgggtag

SEQ ID NO: 15574 - DNA, 819 bp, Artificial Sequence
  Description of Artificial Sequence: Synthetic coding sequence
atgctgcaactcagggatagtgtcgattcagccggaaccagcccaacggctgtgttggctgctggagaagaggtcggtgccgggggcggcccaggcgggggacggcctggtgctggaacccctttgcgacaaacactatggcccttgtccatccacgatcccacaaggcgggccagagttaaggagtacttcgttttcagacctggcagtattgaacaggctgttgaagagataagggtcgttgtgagacctgtggaggacggtgaaatccaaggggtctggttgctgacagaggtcgatcactggaacaatgaaaaagagcggctagtacttgtgacagagcagtccttgttgatttgtaagtatgactttatttctctccagtgccagcaggtggtcaggatagctctgaatgctgtggacaccattagctacggcgagtttcaattcccccctaagtccttgaacaaaagagaaggatttgggatccgtatacaatgggataaacagagtagaccttcatttattaacagatggaacccctggtccaccaatgtaccgtacgcaacatttacggagcatcccatggccggggccgatgaaaagacagccagcctgtgtcagctggagtcatttaaggccctgctcattcaggccgtgaaaaaagcgcagaaagaaagcccacttcccggccaggctaatggcgtgttgattctggagagaccactgttaatcgagacgtacgtgggcctgatgtcctttatcaataatgaggccaagcttggttactccatgacccgcggcaaaataggtttttag

SEQ ID NO: 15575 - DNA, 870 bp, Artificial Sequence
  Description of Artificial Sequence: Synthetic coding sequence
atgtggccatttccttcccggtctctgttcccacccccaacgcaggcctggctgcaaaccgtgtcgtcagatccagaggcgcagggatggggggcctggaatgaaaccaaggagattctgggcccagaagggggcgaggggaaggaagagaaggaagaagaggaggatgcagaggaagaccaggatggagatgcgggctttctactgtccctgctggaacaagaaaacctcgccgagtgcccactgcccgaccaagagctggaagccattaagatgaaagtgtgtgccatggaacaggccgaaggaactccaagacctcctggggtgcagcagcaggctgaagaagaggagggcaccgcggctgggcaactgctcagtccagaaactgtggggtgcccactgtctggcacaccagaggaaaaggtggaagctgaccacaggagtgtttacgtgggaaacgttgactacggcgggagtgcagaggaactagaagcccatttctcgcgatgtggcgaggtccacagagtgactatcctgtgcgataagttcagcggccacccgaagggatatgcatatattgagttcgcaactaagggatctgtccaggcagccgtggagctggatcaatccctttttaggggccgggtgatcaaagtgttgcccaagcgcactaatttccctgggatctccagcacagatcgtgggggactgagggggcacccgggtagtcgcggcgcacccttcccccacagtggactgcagggcagaccaagattgcgaccacaggggcagaacagaacccccgcagcgctgactccactgtgggcaagaccactaccctgggtggtagtctcacatgtgataaagtag

SEQ ID NO: 15576 - DNA, 1266 bp, Artificial Sequence
  Description of Artificial Sequence: Synthetic coding sequence
atgttcgagattttgactagtgaattttcctatcagcactcgctttctatcttagtggaagaatttttacagagtaaagagctgagagccaccgtgacgcaaatggaacaccaccacctgttcagcaacatcttagacgtattaggcgccagccagcgctttttcgaggatctcgagcaaaggcacaaagctcaagtcctggttgaagatatcagcgatattctggaggagcatgcggagaagcacttccacccctacatagcatactgtagcaacgaggtgtaccagcaacggacgctccagaagctcatttctagtaatgccgccttccgggaagcgctccgcgaaattgaacggagacccgcatgtggcggtttacccatgttgagtttcctcatcctgcccatgcaacgggtcacacgactgcccctgcttatggacaccttatgtttgaaaacacagggacactccgaaaggtataaggctgcatcaagggcgctgaaggctatctccaaactggtgcgccagtgcaatgagggggctcatagaatggaaagaatggaacagatgtataccctccatacccagctggactttagcaaggttaaatctctcccacttatctctgccagtcgctggctgctgaaacgaggagaactgtttttagtggaagagaccggcctatttaggaagatcgccagtcggcctacttgttacctttttctattcaacgacgtcctggtggtgactaagaaaaagagtgaggaatcctatatggtgcaagactatgcccaaatgaatcacattcaggtggaaaaaatcgagccgagtgagctccccctccccgggggtggaaatcgttcctcttcagtgccacacccattccaggtgaccctgctgcgaaattccgagggcagacaggagcaacttctgctcagttcagacagtgcttcggatcgcgctagatggatcgtcgcgttaacccattccgagcgtcagtggcagggactcagcagcaagggagacttgccccaagtcgaaattaccaaggcatttttcgccaaacaagcagacgaggtgacactgcaacaggctgacgtggtgcttgtgctgcagcaagaagatggttggctttacggtgagcgcctgcgcgacggagagaccgggtggtttcccgaggatttcgctcgctttataacttcccgagttgcagtggagggaaacgtgaggcgcatggagaggctcagagtcgaaacagacgtgtag

SEQ ID NO: 15577 - DNA, 1266 bp, Artificial Sequence
  Description of Artificial Sequence: Synthetic coding sequence
atgttcgagattctgacttcagaattttcgtatcaacacagtcttagtatcctggtagaggagtttttgcagagtaaggagctccgagcaaccgttacccagatggaacaccaccacctgtttagcaacattctggatgtgcttggcgctagccagcgcttcttcgaggacttagaacagcggcacaaagcccaggtgctggtggaagatatttcagacatcctcgaggagcacgccgagaaacactttcacccatacattgcatattgttctaacgaagtgtaccagcagcggacgctgcagaaactcatttccagcaacgctgcttttagagaggcgctgagggaaatcgagagacgacctgcctgtggcgggctgcccatgttgtcatttctgatcctcccgatgcaacgggtcacccgcctgccgttactgatggacacattatgtttaaaaacccaaggccacagtgagcggtacaaggccgcttcacgggccctgaaagcaattagtaaattggtgaggcagtgtaatgagggcgcacacagaatggagaggatggagcagatgtatactctgcacacccagctagatttctctaaggtcaaatctcttccgttgatctccgctagccgttggctgctgaaaaggggggagctgttcctggtggaagaaaccggcctattccgcaagattgcaagtcgccctacatgctaccttttcctgttcaacgatgtgttggtcgtgacaaagaaaaaaagcgaggagtcctacatggttcaggactacgcccaaatgaaccatatccaggtggagaaaatcgagccgagtgagttaccactgccaggaggcgggaatcgttcctcttctgtccctcacccctttcaggtcacactcctcagaaatagcgaggggcggcaggagcagctgctgctgtccagcgattccgcctccgaccgggctcgatggatcgttgccttaactcattccgagagacagtggcagggcctcagtagcaagggggacctgccacaggttgagattactaaagccttctttgctaaacaggcagacgaagtgaccttgcaacaggcagatgtggttctcgtcctgcagcaggaggatggctggctgtatggggagcggctaagagacggggaaaccggttggttcccggaagacttcgctagattcatcacaagtagggtggccgtggaaggcaacgtgaggagaatggagcgcctgcgggtggagaccgacgtgtag

SEQ ID NO: 15578 - DNA, 2130 bp, Artificial Sequence
  Description of Artificial Sequence: Synthetic coding sequence
atggcccaaaggcattcagactcttccctagaagagaaactcctgggacacaggttccactccgaactgcggctggatgcaggtgggaaccccgccagcggtctcccaatggttcgaggatcaccccgggtgagagacgatgccgcgtttcagcctcaggttcctgcccccccccagccaaggcctcctggccacgaggaaccctggcctatagtactctcaactgaatctccggcagccctaaagctaggcacacagcagttaatccctaaatcacttgctgtcgcgagcaaagccaaaacaccagctaggcatcagtcctttggcgcggccgtgctgtctcgcgaggctgccaggcgtgatcccaagctgctcccagcaccatccttttctctcgatgacatggatgtggataaggatcctggcggaatgctcagaaggaacctccggaaccagagctatcgcgccgctatgaagggactcgggaagccaggggggcagggcgatgctattcagttgagccctaagctacaagcgctggctgaggagccatctcaaccacatacaagaagtcccgccaagaacaagaaaactcttgggcgcaaaagagggcacaaaggctcgttcaaggacgatccccaactttaccaggaaattcaagaacggggcctcaataccagccaggagtccgacgacgacatcctggacgagtcctcctcacccgagggcactcagaaggttgatgccacaattgttgtgaagtcttaccggcccgcccaggttacttggtcacagctccccgaggttgtggagcttggcattctggaccagctctctactgaagagcggaagcggcaggaggctatgtttgaaattcttaccagtgagttttcatatcagcattcgctgagcattctggttgaggaatttctgcaatcaaaggagcttagagccacagtaacgcagatggagcaccaccatctgttcagcaacatcctagatgtgctgggtgcatctcagcggttctttgaagacctcgaacagcgacacaaggcccaggttcttgtggaggatattagcgatattcttgaagagcatgccgaaaagcacttccatccctacattgcttattgctccaatgaagtttaccaacagcggacgctgcagaagcttattagctctaacgccgcttttcgtgaggcactgcgggaaattgagcgccggccagcatgtggaggtctaccaatgctcagctttctgatcctcccaatgcagcgcgtgacacggcttccacttctgatggacactctgtgtcttaagactcagggccactccgagaggtataaagctgcgagtcgcgccctaaaggctatctctaagttggtgcgccaatgcaacgaaggcgcccaccggatggagcgaatggagcagatgtataccctgcacactcaactagattttagcaaagtgaagtcgttgcctctgatttccgcatctcgctggctgctcaagaggggtgagctctttctagtggaggaaaccgggcttttccggaaaatcgcctcacgaccaacgtgttacctgtttctgttcaacgacgtgctggtggttacaaagaaaaagtctgaagaatcatacatggtccaggactatgcgcaaatgaaccatatccaggtggagaaaattgagccatcagagctccctctacccggcgggggcaatagaagctccagtgtgcctcatccctttcaggttacactgctgcggaacagcgaaggccggcaggaacagttgcttctctcctctgactcagcgagtgatagggccaggtggatcgttgccctgacacatagcgagcgccagtggcagggcttatctagtaaaggagacctgccgcaggtagaaattacaaaagccttttttgctaaacaagccgacgaggtgacacttcagcaagccgatgtggttctggtgcttcagcaggaggacggctggctttacggggagaggctgagagacggtgaaacagggtggtttcctgaggacttcgctcgcttcattacgtctcgggtggccgtggaggggaatgttcgaaggatggaacgcttacgggttgagactgatgtgtag

SEQ ID NO: 15579 - DNA, 1287 bp, Artificial Sequence
  Description of Artificial Sequence: Synthetic coding sequence
atggtctggcaagtcctcgagggcttgtcccaggacagtgctaagcggctgcggtttgttgctggagtcatcttcgtagatgagggagccgcgtgcggacagtcactggaagagcgatctaagactctggcagaagtgaaaccaattctccaggccaccggcttcccctggcacgtggtggcactcgaagaagtattcagtctgcctccatcagtgctctggtgtagcgcccaagaactggtagggtccgagggagcatataaggcagcggtcgatagcttccttcagcaacagcacgtgctgggggcaggcggtggacctgggcccacccagggagaagagcaacctcctcagcctcctctcgatccacaaaaccttgcaagaccccccgctccggcccaaactgaagcgctgagccagctgttctgcagcgtccgcactttgaccgcaaaagaggagcttcttcagacacttcgaactcacctcatcttacacatggctcgcgcacatggatactctaaggtcatgactggggattcctgtaccagactggctattaagctgatgacaaatctggccctggggcggggggctttcctcgcctgggatacagggttctcggacgagaggcacggggacgttgtggtggtacgccctatgcgagaccataccctgaaagaggtagctttctataaccgcttgttttctgtgccctctgtgtttacccccgccgtagatacgaaggctccggaaaaggccagtatccaccggctgatggaagccttcatcctccggcttcagacccagttcccctctactgttagtactgtgtacagaactagcgagaaacttgtgaagggacccagagatggccccgcagctggagattctggaccgagatgcctgctttgtatgtgcgccctcgacgtggacgccgctgacagtgcgacagcctttggtgcccaaacatcctccagattatcacaaatgcagtcccccattccactcacggagacaaggactccacctggtccatgctgcagcccaggtgtcgggtgggcccagaggtgcgggcagggcgcatgccgcagagaggatccccaggcctgcatcgaagagcagctgtgttactcttgtagagttaatatgaaggatctgccatctctggacccccttcctccttacattctagccgaggctcagctgcggacgcagcgagcatgggggttgcaagagattcgcgactgtctaatcgaggattcagacgacgaggcggggcaatcttag

SEQ ID NO: 15580 - DNA, 417 bp, Artificial Sequence
  Description of Artificial Sequence: Synthetic coding sequence
atgggtgaacaggctgacggcaaggattcaatcgccaggcaggtggcacctgagtcccactggccagagcttcgggtccttatactcgtcgtgtctgctgagaagaaattgaccggcagcacagtggggatgagagcgtcagttgagacgtcccccctgttgaggtttcgggcagagtctgtggtgccggcacatgggggggacgggcctttgcaccccggagcccgtttgccacaactgcgccccgcagatcatgaggggcagcagccggtgccccgacacctaccccggcatcttccaccctcactgacttccatgccctcaccaggcgcatccagtacttggtgcaccgcatccacacctacgacagggacccccagatggcggactcctctgactcgcgcacccatgccttag

SEQ ID NO: 15581 - DNA, 597 bp, Artificial Sequence
  Description of Artificial Sequence: Synthetic coding sequence
atgagtaccgtagatctcgcacgtgtcggtgcatgtattttgaagcacgccgtgacaggagaggccgtggaattgaggtccttgtggcgggaacatgcctgtgtggtggcaggccttcggagatttggctgtgttgtttgtcgttggattgctcaggatttatcgagcctcgcaggactcctcgatcaacacggagttcgtctcgtgggagtgggaccagaagctctgggtctgcaggagtttttagacggggattacttcgctggggagctgtacctggacgaatccaagcagctttacaaggagctcggctttaagaggtacaactcgttgtcaattctcccggctgccctaggcaaacccgtgagggatgtggccgccaaagcaaaggccgttggtattcagggcaacctgagtggtgacctgctgcaaagcggaggactcctggtcgtcagcaaggggggcgacaaagtgctgttacacttcgtgcagaaatcgccaggggattacgtccccaaagagcatatactgcaggttctcggcatcagcgcggaggtgtgtgcctctgatccaccacagtgcgaccgggaggtgtag

SEQ ID NO: 15582 - DNA, 642 bp, Artificial Sequence
  Description of Artificial Sequence: Synthetic coding sequence
tagtcccgagagagaggtagcagaagtgaggaacctggggccggcaacagggaaagtggctcgcgtgaacctggcctggccgcagccgccatgagcacagtggatctggcgagggtgggagcctgcatcttaaagcacgctgttaccggcgaagccgtggagctgcgcagcctgtggcgggagcacgcatgcgtggttgccggccttcgtaggtttgggtgtgtcgtttgcaggtggatcgcccaggatctctcatcattggcaggtcttctggatcaacatggagtgaggttggtaggcgtaggtcctgaagctctgggcctccaggaatttctggacggcgattactttgccggggaattgtacctggacgagtcaaaacagctttacaaagagctgggttttaaaaggtataattccctctcgattcttccagccgctctggggaagcccgtgagggatgtagctgccaaggccaaagccgtcggcatccagggaaacctcagcggcgacttacttcagagtggagggcttctggttgttagcaaggaagtacctcggaggctcagaccccaaggagcccatcctgcgggaccagggcatctctgcggaggactgtgtcagcggcctgccagtgtgtag

SEQ ID NO: 15583 - DNA, 2553 bp, Artificial Sequence
  Description of Artificial Sequence: Synthetic coding sequence
atggccgaagtggaggccgtccagctcaaggaggagggaaatagacacttccagttacaggattataaagcagccaccaacagctattcacaggccctgaaattaaccaaagataaagctttgctcgctaccctgtatcggaatagagcagcttgcgggctgaaaaccgaatcctacgtgcaggccgcgtccgacgctagcagggcaatcgatattaatagctctgatattaaggctttgtacaggcgatgtcaggcgcttgaacatctgggaaaactggatcaagcttttaaggacgtgcagaggtgtgcgacattggagcctcggaaccaaaatttccaggagatgctcagaaggcttaataccagcatccaagagaaactgcgcgtgcaattcagtaccgattctagagttcagaagatgtttgagatcttgctggacgagaatagcgaggccgataagcgagagaaggctgccaacaacctgatcgtgttaggacgggaggaagcaggtgcggagaagatattccagaataacggtgtggcactgctcttgcagctgctggacacgaagaagccggagttagtgcttgcagcggtcagaacgctctctggaatgtgcagtgggcaccaagctcgggccaccgtaatcctgcacgccgtgcggatcgacaggatatgttccctaatggctgttgaaaacgaagagatgtcactggccgtttgcaatctgctgcaagctattatcgactccttaagcggcgaggacaagagggaacacagagggaaagaagaggctctggttctagacactaagaaagacctcaaacagataacctcccatctgttagatatgttggtgagcaagaaggttagcggccagggacgggaccaggccctgaacctcctgaacaagaatgtgccgcgaaaggacctcgccattcatgacaactctaggacaatctatgtggtcgataacggcttacgaaaaatcttgaaggtcgtgggccaggtgccggacctaccatcttgtctcccacttaccgacaacacccgcatgctcgcctctatcctgataaacaaattatatgatgatctccgctgcgaccctgagcgggatcactttcggaagatttgcgaagaatacattacagggaaattcgaccctcaggacatggataagaacctgaatgccatccagacagtgtctggaatcttgcaagggcctttcgacctgggcaaccagctcttgggactgaagggcgttatggaaatgatggtcgcactgtgcggatctgaaagagagaccgaccaactggtcgctgtagaagccttaatccatgcctccactaagctgagtagggcgactttcatcattaccaatggggtctccctgctcaaacagatctacaaaacgaccaagaatgagaagatcaaaatcagaacactcgtcacttcagacaagacaattctctactcggtggctaccactctggtgaattgcaccaatagttacgacgttaaagaggttattcctgaactcgtccagttggccaaattctcaaagcagcacgtcccggaagaacaccccaaggataaaaaggattttatcgacatgagggtgaagcgtctattgaaggcaggcgtgatatcggccctggcctgtatggtgaaagctgacagtgccattctgaccgatcagacgaaagagctccttgcacgcgtgtttctagctctatgtgataatccaaaagaccgcggaactattgtcgcacagggcggagggaaggctcttatcccacttgctttggagggcacagacgttggcaaggtaaaggctgctcacgcgctggcgaagattgccgcggttagcaaccctgacattgcatttccaggagagagagtatatgaggtggtgcgccctctcgtacgtttactggacacccagcgcgatggtctgcagaactacgaagcactactcgggctaactaatctgtcaggacgaagcgacaaactccgccagaagattttcaaagagcgggccttgcctgacattgagaattatatgttcgagaaccacgaccagctccgacaggccgcaactgaatgcatgtgcaacatggtgctgcataaggaagttcaggaaaggtttctagccgacgggaatgaccggctgaagctggtcgtgctcctatgcggcgaggacgacgacaaggtgcagaacgccgctgcgggggctttggcaatgctaacagccgcccataagaagttatgtttgaagatgacacaggtcactactcagtggctggaaatccttcagcggctgtgcctccacgaccagttatctgtgcaacatcgaggccttgtgatagcttacaatttattagcggccgatgccgagctggccaaaaagctggtcgagtccgaactcttagaaatccttacggttgtaggcaaacaggagcccgatgaaaaaaaagccgaggttgtccagactgcccgcgagtgcttgatcaaatgcatggattatggtttcattaaacccgtgtcctag

SEQ ID NO: 15584 - DNA, 552 bp, Artificial Sequence
  Description of Artificial Sequence: Synthetic coding sequence
atgatgcagatctgtgacacttacaatcagaaacactcgctcttcaacgcaatgaatagatttatcggagccgttaataacatggaccagaccgtcatggtaccgtctttgctcagagacgttcctcttgcagatcctggcttggataatgatgtcggcgttgaggtaggtggatcaggggggtgcctggaggagagaacgcctccagttccggacagcggctctgcaaacggatcattcttcgcaccaagccgcgatatgtatagccactacgtgttactgaaaagtattcgcaatgatattgagtggggagtgctacaccagccaccaccaccagctgggagcgaggaaggttcagcgtggaagagcaaggatattctcgtggatctgggccacctggaaggcgccgatgccggagaggaagatctggaacagcaattccactatcatcttagaggtttgcatacagtgttgagcaagctgactcgcaaagcaaacatcctgacaaaccgatataagcaggagataggctttggaaactggggccactag

SEQ ID NO: 15585 - DNA, 366 bp, Artificial Sequence
  Description of Artificial Sequence: Synthetic coding sequence
atgttcaacaagtgttcatttcactcttcaatctatcgtcctgccgcggataattctgctagtagcctctgcgcaatcatttgttttttgaaccttgtcattgaatgtgacctcgaaacaaactcggaaattaacaaactgattatatacctgttttcccagaataacaggattcggttcagtaagctgctgctgaaaattctcttctacatttcaatattcagttatccagaactcatgtgcgagcagtacgtgacatttatcaagccaggaatccactacggacaggttagtaagaagcatataatttatagcacattcctgtccaaaaactttaaattccagttgctcagggtctgttggtag

SEQ ID NO: 15586 - DNA, 972 bp, Artificial Sequence
  Description of Artificial Sequence: Synthetic coding sequence
atggaatcacgcgtagccgacgcaggcaccggcgagacagccagggctgctgggggctcacctgccgtgggatgcaccactcggggcccagtggtgtccgcaccactcggcgcagctcggtggaaattactgagacaagttctgaagcagaaacatttggatgactgcttaagacatgtctctgtgcggcgcttcgaatcttttaatctgttttccgtgacagagggtaaagagcgggagacagaggaggaggttggggcttgggtgcagtacacttctatcttctgtccggaatactcaatctcccttcgccataattcgggttctttgaatgtagaagacgtcctcacctcctttgataataccgggaatgtgtgtatttggccatcagaggaggtgcttgcgtactactgtctgaaacacaacaacatattcagagcactggccgtgtgcgagttaggcggtggcatgacctgcctggcaggcctgatggtggccatttctgccgacgtcaaagaagtgttgcttaccgatgggaacgagaaggcaattaggaacgttcaggatattataactcgaaatcagaaggccggggtgtttaaaacgcagaagatttcgtcttgtgtgctccgctgggacaatgagacagacgtctcccaactcgagggacattttgacattgtgatgtgtgccgactgtttatttctagatcagtacagagctagtcttgtggacgccattaagcgcctcctccaaccccggggaaaggctatggtgttcgcccccagacgtggcaacacactcaatcaattttgcaacttagctgagaaggctggcttctgcatacagcggcacgaaaattacgacgaacatataagcaatttccacagtaagctcaagaaagaaaatcctgacatctacgaagaaaacctccactacccgcttctattgattttaaccaagcatgggtag

SEQ ID NO: 15587 - DNA, 3120 bp, Artificial Sequence
  Description of Artificial Sequence: Synthetic coding sequence
atggcggtgcaattggtgccagactcagcgctgggcctgctcatgatgacagaaggtcggcgctgccaggtgcacttactggacgataggaaactggagctcctcgttcagcccaaactgctggctaaggagcttttagacttggtcgcatcgcactttaaccttaaggagaaagagtatttcggtatcgccttcaccgatgaaactggccatttgaattggctgcagctggatcgccgcgtgttggagcatgatttccccaaaaaatccggcccggtggtgttgtatttctgcgttagattctacattgagagtatctcttacctgaaagacaatgccacgatcgagctgttctttctgaatgctaagagctgcatctataaagaactgatcgacgtggactctgaagtggtttttgaactcgctagctatattctacaggaggccaagggagactttagtagcaatgaggtggtccgctctgatcttaagaaactcccagcattacctacacaggccttgaaggaacatccttcccttgcttactgtgaggacagagttatcgagcattacaagaagctgaatggccagacgcggggacaagcgatcgttaactacatgtcaattgtggagtcactacccacttacggcgtgcactattatgctgtgaaggacaaacagggcatcccttggtggctcggtctgtcatataaagggatcttccagtacgactatcacgataaggtcaagccacggaaaatttttcagtggagacagctggagaacttgtatttccgcgaaaagaagtttagcgtcgaggtgcatgacccccgaagggctagtgtcacccgacgaacctttggccacagcggcatcgccgttcatacatggtacgcttgccctgctctgatcaagagtatctgggcaatggccataagccagcatcagttttaccttgatcggaagcagtcaaagagcaagattcacgccgcgagatccttgagtgagatcgccatcgatctgactgagactggtacactgaaaacatcaaagctcgccaatatgggtagtaagggtaagattattagcggctcttctggcagcctgctgtctagcggctcacaagaaagtgatagctcccagtcagccaagaaggacatgctcgccgcccttaagagcagacaggaagccctggaagagacattgaggcaaagactagaagagctgaagaaattgtgcctcagagaagccgaactcacaggcaaacttccggttgagtaccccctggaccccggagaggaaccacctatcgtacgccggcggataggcacagcatttaaattggacgaacaaaagatcctgcccaaaggagaggaggccgagctggaaagacttgaaagggagtttgccattcagtcacagatcacggaggcagctcgccgcttggcctcagatcctaatgtctccaagaagttgaagaagcagaggaaaacttcctacttgaacgcattaaagaaactccaagaaattgaaaacgccattaacgagaatcgcatcaaatccgggaagaagcctacacagagggcctccctcattatcgatgacggaaatatcgcttctgaggacagctccctgagcgacgctctggttctggaggacgaggacagtcaggttacctcgacaatcagccccctacatagtcctcacaaaggtttacctcctaggccgcccagccataatcggccgccacctccacaatccttagagggcctccgccagatgcactatcatcgcaacgactatgacaagagccctatcaagcctaaaatgtggtcagagtcgagtctagacgagccttacgaaaaagtcaagaagcgcagtagtcattcccacagtagtagtcataaaaggttcccctcaacaggctcatgtgctgaggctgggggtggctcaaacagcctacagaacagccccattcgaggtcttccacactggaatagccagagttcaatgccatccacaccggacctgcgagtgaggagcccacactatgtccattcgaccaggtcagtagatatctcccccactcggctgcattctcttgcattacacttcaggcacaggtcatcctcccttgagagccaaggcaaactgctcggctccgagaacgatactggatcacccgacttttacaccccacggacaagaagtagcaatggaagcgacccgatggatgactgcagttcctgcacatcacattctagcagcgagcactattacccagcacaaatgaacgctaactacagcactctggctgaggattctccatctaaggccagacagcggcagaggcaacgtcagcgggcggctggcgccttgggctctgcttcgtctgggtctatgccaaatctggctgctcgtggcggggccggtggagcaggcggcgcaggcgggggcgtctacctgcactctcagtcccaacctagttcacagtatagaattaaggaatatcctctctatatagagggtggggcaacccctgtggtggtccgttccctggaaagtgaccaagagggccactatagcgtgaaggctcaatttaagacctcgaattcatacacagccggtggcctgtttaaagaatcatggcgggggggaggcggagacgagggagacaccggcagactgaccccaagcaggagtcaaatcttgcggacaccaagtctgggtcgcgagggcgctcatgataagggcgctggtagagccgccgtgagcgatgaacttcgacaatggtaccaaagatcgaccgctagccataaagagcactctaggctcagtcacactagctcaacgagttctgattcaggctctcagtacagtacaagcagtcagtcgacattcgtggctcattctagagttacgcggatgccccagatgtgtaaggccacttcggctgctctgccccaatcccagagatcaagcacccctagtagcgagattggagcaacaccaccttcttcaccgcatcatatcctcacctggcagactggtgaagcaaccgaaaattctcccatactggacggttccgaatctccgccccaccagtcaaccgacgaatag

SEQ ID NO: 15588 - DNA, 390 bp, Artificial Sequence
  Description of Artificial Sequence: Synthetic coding sequence
atgtacaggcagaggttcttatacagcctctacagacacactcactgggtgcggtgtgccaagttttccccggacggtcggctcatcgtgtcctgcagcgaggataaaacaattaagatttgggatactaccaacaaacagtgcgtgaacaacttttcagacagtgttggcgatctgtccctgctgtttcacttccaaaaggtagaatcttacctgcaccaagaggtgcagacccaccggagttattatggtggtttaactctgatgaattgtatcgtgaaggtgctgcctaaagagatttcaaaagactatatactgatccatcaccacatatttctgatttctacacaggaacaccatattcccatgcgtaagaaactacggctctag

SEQ ID NO: 15589 - DNA, 2178 bp, Artificial Sequence
  Description of Artificial Sequence: Synthetic coding sequence
atgcatcctgagcctagcgagcccgccaccggcggggccgccgaattggattgcgcacaagagcccggcgtggaagaaagtgcaggagatcatgggtcggccgggagggggggttgtaaggaagaaatcaacgaccccaaggagatatgtgtaggatcctccgatacatcctaccattcacaacaaaaacagagcggcgacaatggctccgggggtcattttgctcacccacgggaagatagagaagatcgagggcccagaatgacaaagtccagtctacagaagctatgcaagcagcacaaactgtatattacacctgccctgaacgacacactatatctgcacttcaaagggttcgaccgaatcgagaatttagaggagtatacggggctgcgctgtctgtggttgcagagcaacggcattcaaaaaattgagaatttggaagctcagactgagctgcggtgcctcttccttcagatgaatctgcttcgcaaaatcgaaaatctggagcccctccagaagctagacgccctgaatctgtcaaacaactatattaaaacgattgagaacctgagctgcttgcctgtgcttaacaccctgcagatggcacataaccatctggagaccgttgaagatatccagcatttgcaagaatgccttcgcctttgcgtgcttgatttatctcacaataaactgtcggatccagaaattctgagcatactagagtctatgcccgacttgagggtcctgaacctgatgggtaatcccgtaataagacaaatccccaattatcggaggacagtgaccgtgagacttaagcatctcacatacttggatgatcggcccgtcttccctaaagacagggcgtgcgcagaggcctgggctcggggagggtatgcagcagaaaaggaagagcgccagcagtgggaaagtcgagagcgcaagaaaattaccgattccatcgaggcactggccatgattaaacagagggccgaggaaagaaagcggcaacgtgagagccaggagagaggagagatgacaagctcagacgatggtgaaaacgttcccgcgtccgctgaaggaaaagaagagccccctggggatagggagacacgccagaagatggaactgtttgtcaaagaaagctttgaggctaaagacgaattgtgccctgaaaagccatccggggaagaaccaccagtggaggccaaaagggaagacggaggaccggagccagaaggaacactcccagctgagacactgttgttgtcctctccggtggaggtgaagggcgaggacggcgatggcgaacctgagggcactctaccagccgaggccccacccccaccgcctccagtcgaggtaaaaggcgaggatggcgatcaggagcccgaaggaaccctacccgccgagacattattgctgtctcctcccgttaaggttaaaggcgaggacggggaccgcgaacccgagggaacactgcccgccgaggccccgcctcctcctcctctgggagcagctagggaggagccaactcctcaagccgtggctacagagggcgtcttcgtgacagagctggacggaacaaggaccgaggacttagagaccatccggctagagaccaaagagaccttctgtatcgacgatctgcccgatctcgaagacgacgacgaaactggtaaatctcttgaggatcagaacatgtgttttccaaagatcgaggtaatcagttccttaagcgacgactctgaccccgaacttgattatacgtccctccccgtactggagaatctacccaccgacactctgtctaatatattcgccgtatccaaagatacctcaaaagcggctagggtcccttttacagatatcttcaaaaaggaggcaaaacgtgacctcgagatcaggaagcaggataccaagtccccccgccctcttatccaggagttatctgatgaggacccttccggccaactgctgatgccccctacttgtcagcgggatgccgccccgctcacctcctccggtgatcgggactctgacttcttggccgccagttctcctgtccccacagaaagcgccgcgactccccccgaaacctgtgttggggtggcccagccctcacaggctcttccgacttgggacctgactgcattcccagcccctaaggcgtcttag

SEQ ID NO: 15590 - DNA, 957 bp, Artificial Sequence
  Description of Artificial Sequence: Synthetic coding sequence
tagggaatcaatggcagcgagggcgacggagctgagattgcagaaaagtttgtgtttttcataggtagcaagaacggggggaaaactacaatcatcctgagatgcctggatcgcgacgagccaccgaaacccactctcgctttagagtacacatatggacgccgggcaaaaggacataatacaccaaaagacattgctcatttctgggagctcgggggcggtacatccctacttgacttgatttccatccccatcacaggcgacacactccggacgtttagtctggtgctggttttagacttgtcaaaacctaatgacctctggcccacaatggaaaacctgttacaggctacaaagagccacgttgacaaagtgatcatgaagctcgggaagactaatgcaaaggccgtctccgagatgcggcagaaaatttggaataatatgcctaaagaccaccccgatcacgagctcatcgacccctttccagtaccactcgtaataatcggcagcaaatatgacgtgttccaggacttcgagtcagagaagcggaaagtgatctgcaaaacactcagattcgtcgcacattactacggagcttcgctcatgttcacctcaaaaagtgaagctctgctactcaagattaggggcgtgattaatcagctcgccttcggcatagataagagcaaatccatttgcgtggatcagaacaagccactgtttattacagcagggcttgattccttcgggcaaattggcagtccgccagttccagaaaatgatattgggaagttacacgcacactcaccaatggagttgtggaaaaaagtgtacgagaaattgttcccgccaaaatcaataaatacattaaaagacattaaggatcccgccagggatcctcagtacgctgagaacgaagtcgatgagatgagaatccagaaggatctcgtgctaagctag

SEQ ID NO: 15591 - DNA, 2559 bp, Artificial Sequence
  Description of Artificial Sequence: Synthetic coding sequence
atggaggctcttggcccaggtggggatagggcctcccctgcgtcttctacctcatcactcgacctgtggcacctctccatgagggcagattctgcctattctagtttctcagccgcctccggcggccccgaacctcggacccagagccccggcaccgatctcctaccctatctggactgggactacgttcgggtcgtgtggggcggtccaggtcccgccccccctgacgcggctctctgtacttccccacgccccaggcctgcagtagcagcccgtagtggccctcaacccactgaggtccccggaacacccggcccactcaataggcaagccacccctttgctgtacgcactggccgccgaggctgaagccgccgcccaagcagcggaacctccttcgcctcccgcctcaagagctgcatacaggcagaggctccagggcgcgcagaggagagtgctgagagagacgtcgtttcagcgcaaggaactgagaatgtctctcccagccagactccgcccaacagtcccagcccggccaccagcaacacaccctaggagcgcgtccctttcacacccggggggcgagggcgagcctgcccgaagcagagcacctgcccccggcaccgcggggcgaggtccattagcaaatcagcagaggaagtggtgtttcagcgaacccggaaaactcgaccgcgtgggtagaggaggaggtccggccagggaatgcttaggagaggcatgttctagcagcggtttaccaggccctgagcctctggagtttcaacatcccgcgttagctaagtttgaggaccacgaagtgggctggctcccagaaacacagccgcaggggtccatgaatctggacagcggcagcctgaaactgggtgatgcttttcgcccagcctcaagaagtcggtccgcctccggcgaggtgctgggcagttggggagggagtggcgggactatacctatcgttcaagccgtacctcagggcgccgaaactccacggccactgttccagaccaagctgtcccggtttttgccccaaaaggaggccgcggtgatgtaccccgcggagctcccacagagcagcccagctgactctgaacagagagtgagtgagacatgtattgtgccggcctggctgccgtcactcccagatgaagtgttccttgaagaagcgcctcttgtgcggatgagatcacctcctgacccacacgcctcccagggaccccctgcttctgtgcacgccagcgaccagccttacggaactggactcgggcagaggaccggacaggtgaccgtcccaaccgagtaccccctccatgaatgccctggcacagcgggagccgatgattgttggcagggcgtcaacggctcggtgggaatttcccgtcctactagtcacacacctacaggcaccgcaaatgataacatccccaccatagatcccactggattgacaactaacccccccacagcagccgagtccgacctgctgaagccagtaccagctgacgcattgggactctcaggcaatgatactccaggccccagccataataccgccttagctcgtggaactggtcagccggggagtagaccgacgtggcctagtcagtgtctcgaagaacttgtccaggagttggcgagactggatcccagcctgtgtgaccctttggccagccagccaagtcctgagcctccattgggcctgctggatggcctgatccccctggccgaggttagggccgccatgcgtccggcctgtggcgaggccggcgaggaagccgcgtcaaccttcgaacccggcagttatcagttctcgttcacgcaattgctcccagcgcctagagaggaaactagactggagaacccagccacacacccagttttggaccaaccctgcgggcagggccttcctgcccctaacaattccattcagggaaagaaagttgaactcgcagcccggttacaaaagatgctgcaggatctgcataccgaacaagagcgcctgcagggtgaggcccaggcgtgggccagacggcaagccgcattggaagcagcagtgcgtcaagcctgcgcgccacaggagctggaacgatttagccgttttatggccgatctcgagcgggttctgggtctgcttctgcttctcggttcaagacttgccagggtcaggcgggcacttgcaagagccgcttccgatagtgatcccgatgagcaggcgagtctgctgcagcgactgagacttctgcagcggcaggaagaggatgccaaagagctgaaggaacacgttgctagacgcgagagagccgttcgggaagtactggtaagagccttgcctgtggaagaattacgggtctattgcgcgctccttgccggcaaagcagccgttcttgcacagcagaggaacttagatgaacgaatcagactcctgcaggaccagcttgatgccatacgggacgatctcggccatcatgccccgagccctagccccgccagaccaccaggcacgtgtcccccggtccagcctccttttcccctgttgctcacatag

SEQ ID NO: 15592 - DNA, 1776 bp, Artificial Sequence
  Description of Artificial Sequence: Synthetic coding sequence
atggctcaagggagtgtgtcctttaatgacgttaccgtggacttcacacaggaggagtggcaacatctcgaccacgcacagaaaaccctatacatggatgtcatgctcgagaactactgtcacctgatctcggtcggatgtcacatgacaaagcctgatgtcattctgaagctggaaagaggcgaggagccatggactagcttcgctggccatacctgtcttgaggaaaactggaaagccgaggacttcctagtgaagttcaaggaacatcaggagaaatattctcggtctgtggtgtctattaaccacaaaaagctggttaaggaaaagtccaagatttacgagaagacttttaccttgggcaagaaccctgtgaactcaaaaaacctgcctccagagtatgatacacacggcagaatccttaagaacgtgtccgaacttataatttctaacctcaatcccgcgagaaaacgcctgtccgaatataacggatacgggaagagcctgctgtccaccaaacaggagacaactcatcccgaggtaaagtctcataaccagagcgctagagccttttcacacaacgaagtcctgatgcagtatcagaagactgaaaccccagctcagtcattcggttataacgactgcgagaagtcatttctccagcgtggaggattaatcacacacagccggccctacaagggggagaatccctctgtgtataacaagaaaagaagggccactaacatcgagaagaaacatacatgcaatgaatgtggcaaatcattctgcaggaaatcagtgctcattctgcatcagggtatacatagtgaagagaagccataccaatgccaccagtgcggaaacgctttcaggcggaagtcctacctgatcgaccatcaaagaacccacacgggtgagaagccttacgagtgcaatgattgtggcaaaagcttccggcaaaagacaaccctgagcctgcatcaaagaattcacacaggggagaagccatacatttgtaaggaatgtgggaagtcattccatcagaaagccaacctgacagtgcaccagcgcacacatacaggcgaaaagccttacatctgtaatgagtgcggcaagtccttcagtcagaagaccactctggctctccacgagaagactcacaatgaggaaaagccatacatttgtagtgagtgcgggaagtctttcaggcagaaaaccaccctcgtcgctcaccagcggactcataccggagaaaagtcatatgagtgtcctcactgtggcaaggctttccgaatgaaaagttacctcattgatcaccacaggacgcatactggggaaaaaccttatgagtgcaatgagtgtggcaagtcgttttctcaaaagaccaatctcaacctgcaccagaggattcacaccggggaaaagccatatgtctgcaacgagtgtggaaaatcttttagacagaaagccaccttgacagtccaccagaaaatccatacaggtcagaagtcatacgaatgtccgcaatgtggcaaagccttcagccgcaagtcctacctcattcatcaccagagaacgcacactggagagaaaccttacaagtgttcagagtgtgggaaatgttttagacagaagactaacctcatagtacaccaacgaacacacaccggggagaaaccctacgtatgcaatgaatgtggcaagtctttctcatacaaacgtaatcttattgtccatcagcggacccataaaggagaaaacattgagatgcagtag

SEQ ID NO: 15593 - DNA, 2934 bp, Artificial Sequence
  Description of Artificial Sequence: Synthetic coding sequence
atgggctggaagccatccgaggctcggggccagagtcagtccttccaagcctcaggactgcagcccaggtctcttaaggccgccagacgggcaaccggacgccccgacagatccagagctgcacgcccgacgatggatccttctgcacacagatctcgcgccgcacccccgaacatggacccagacccccaagccggagttcaggtcgggatgagagttgtgcgtggggtagattggaaatggggacagcaggatgggggggagggaggggtgggaactgtggtcgaattgggcagacatggcagcccttcgacacctgacaggaccgtcgtagttcaatgggaccaaggcactagaactaactaccgagccggataccagggggcccatgatctactactctacgacaatgcacagatcggagtccgccaccccaacatcatatgcgactgctgtaaaaaacacggattgcgaggcatgaggtggaagtgtagagtttgcctcgactatgatctgtgcacacagtgttacatgcataacaagcacgaactggcccatgctttcgatagatatgagacagcgcacagtagaccagtgacgctgtctcctcgccaagggctgcctagaatccctcttcggggcatatttcagggcgccaaggtcgtgcgcggtccagactgggagtggggcagccaagacggcggggagggtaaacccggaagagtggtggatatcaggggctgggacgttgaaacggggcgcagtgtggcttccgtgacttgggctgacggcaccaccaacgtgtaccgcgtcgggcacaaaggtaaggtggaccttaagtgtgtgggtgaggccgcggggggcttctactacaaagaccatcttccgcggctggggaagccagcggaattgcaacgcagagtcagtgcggactcacaaccatttcagcatggggacaaggtgaaatgtttgcttgacacagatgtgctgcgggagatgcaggagggtcatgggggctggaaccctcgcatggctgagcaccactcattctgggtcggggacgtcgttagggtgatcggagacctcgataccgtcaaacggcttcaggccgggcacggcgagtggacggacgacatggccccagctctgggtagggttggcaaggtggtcaaagtctttggagatggtaacttgagagtggcagtcgctgggcagaggtggaccttttcccctagctgcctggtggcatacagaccagaagaggacgcaaaccttgacgtcgctgagagggcccgagagaacaagagtagcttgagcgtggccctcgataagctacgtgctcagaagtctgatcctgaacatcccggacggttggtagtggaggtggccttaggcaacgccgccagggccctcgacctactccggagaaggccagaacaagtcgatactaagaatcagggtcgcaccgctctgcaggtcgccgcatacctgggtcaagtagagttgattcgcctcctgctgcaggcgagggcaggggttgacttgcccgacgatgaaggcaataccgcgctgcactacgccgcactgggtaatcagcctgaagcaacccgagtcttgctgtccgccggatgtcgcgccgacgctattaactctacccagtcgaccgccttacacgtggccgtgcagcgaggctttttagaggttgtacgcgccctgtgcgagcgtggatgcgatgttaatttgcccgacgcacactcagatacaccactgcacagcgccatctcagctgggactggcgcgtctggcattgtcgaagtgctgaccgaggtgccgaacattgatgtgacagccacgaacagccaggggttcaccctgttgcatcacgccagtttaaagggacacgcactggctgtgcgcaagattctcgccagggctagacagctcgtggacgcgaaaaaggaagacggatttactgcgctccacctcgctgcactgaacaatcatcgggaagtcgcccaaattctgattcgggaagggcggtgtgacgtgaatgtaaggaaccgcaaactacagagtcctttacacctggccgtccagcaggctcacgttggcctggtccccctgttggtcgatgcaggatgttccgtgaatgccgaagatgaagagggagatacagcactacacgtagctctgcaacggcaccagcttctcccattggtggctgacggcgctgggggcgatccaggacctttgcagcttttgagccgattacaggctagtgggttacccgggagtgctgagctcaccgtcggagcagcagtggcttgctttctcgccctggagggggccgatgtgtcctacaccaaccaccgcggcaggagtccccttgacctcgctgcagaaggccgggtgcttaaagccttacaaggttgcgcccagcgcttccgtgagagacaagctggtggcggagccgcacctgggccacggcagacgctcggcacacctaatactgtcacgaacctacatgtgggcgcggcccctgggcccgaggccgctgagtgtctggtttgcagcgagctcgccctgttggtgctgttctcaccctgtcagcatagaacagtctgtgaggagtgcgccaggcgaatgaagaagtgtattaggtgccaggtagtggtgtctaagaaactgcgcccggatggcagtgaggtggcctctgcggctcctgcacctggaccaccccgtcagctagtggaggaacttcaatccaggtacagacagatggaggaaaggatcacgtgtcctatctgtatcgactcacatattcgtctggtgtttcaatgtggacatggcgcttgcgcgccatgcggatcagcactgtccgcatgcccaatctgcaggcagccaatccgggacagaatccagatattcgtgtag

SEQ ID NO: 15594 - DNA, 2262 bp, Artificial Sequence
  Description of Artificial Sequence: Synthetic coding sequence
atggatccagaccctcaggcaggggttcaggtcggaatgagagtcgtgaggggggtagattggaagtggggccaacaggatggcggagagggcggagtcggtactgtagtagaacttggacgtcacgggtcaccatccacaccagacagaacagtggttgtacagtgggaccagggcacaagaaccaattaccgcgccggataccagggggctcatgatctgcttttgtacgataacgcccaaattggcgtccgtcacccgaacatcatctgtgattgctgcaagaagcacggactgcgcggtatgcggtggaaatgcagggtctgcctggactacgatctttgtactcagtgctacatgcataataaacacgaacttgcccatgcattcgatagatatgaaacagcccactctcggcccgtaaccctgtcacccaggcaggggctcccccgtatccctcttcgcggcatcttccagggagccaaagtggtgaggggtccagattgggagtgggggagtcaggatggcaaacccgcggagcttcagcggagagtgtccgccgatagccagccctttcagcacggggataaggtcaagtgtctgctggacacagacgttctgcgtgagatgcaggagggccatggaggctggaatccgaggatggcggagttcatcggccagaccggaacagtccatcgcataacggacagaggtgacgtgagggtacagttcaatcacgaaacgaggtggaccttccatccaggtgcgctgactaaacaccactcattttgggtaggagatgtggtccgtgttatcggcgatcttgacacggttaagcggctgcaagctggtcacggtgaatggacggacgatatggcacccgcactgggacgggtgggaaaagtagtgaaggtattcggtgacggcaacctgcgggtggccgtcgccgggcagaggtggacattttcgcccagctgtctggtggcctatcgtcctgaggaggatgctaacctcgatgtggcagaacgcgcccgtgaaaacaaaagtagtctttcagtggctctggacaaactccgggctcagaaaagtgaccctgagcaccccggtcgcctggttgtggaggtagctctcgggaatgctgcaagggcattggacctacttcggaggcggcctgaacaggtcgacacaaagaaccagggccggactgcactccaggttgccgcctatctcggacaggtcgaattaattaggttgctgcttcaagctcgggctggagtagaccttcccgacgacgagggtaacacagctctgcactatgcggccctcggcaaccagccagaggcgacacgggttctattaagcgccggctgcagggccgatgcgatcaattctactcagagcacggctcttcatgtcgccgtccagcggggctttcttgaggtggtgcgtgccctgtgcgagaggggttgtgatgtgaatttgcctgacgcccactcagacactcccttacacagcgccatctccgcagggactggcgcctctggcatcgtagaagtgctcacagaggtgcccaacatagacgtcacagccactaactctcagggatttaccttactacaccatgcctcacttaagggacacgctcttgctgtacgtaaaatcctggctcgagcccgtcagctagtcgacgccaagaaagaggacggcttcaccgcactgcatctggccgccctgaacaaccaccgggaagtggcgcaaatcctgatcagggaggggcggtgcgacgtgaatgtcagaaacagaaagctccagtcgcctctgcatctggcggtccaacaggctcatgtaggactcgtgcccctgctggtagatgccggctgttctgtgaacgcagaggacgaggagggcgacactgccctgcatgtggccctacagcgccatcagctgttgccactcgtggctgatggggcaggaggcgaccctggacctcttcagctgctgtcccgattgcaagccagcggactgcccggcagcgccgagttgactgtgggggccgctgtcgcctgcttcctggccctcgaaggcgcggatgtgtcttacactaatcataggggacgctctcccctcgacttagcagcagaaggtagagttttgaaggcactgcaggggtgtgctcaaaggtttcgggtaagagcccaagacgaagaagtccatcaggtgcctggagggaggcagcaggagacagcaccacggcgcttatag

SEQ ID NO: 15595 - DNA, 1161 bp, Artificial Sequence
  Description of Artificial Sequence: Synthetic coding sequence
atggggaaagactactacaaaattctggggatccccagcggcgccaatgaagacgaaataaagaaagcctatcggaaaatggctcttaaatatcaccctgacaaaaacaaagaaccaaacgcagaggaaaaattcaaggaaatcgcagaagcctatgacgtcttgagtgatcccaagaaaaggggattatacgaccagtacggtgaagagggtctgaaaaccggaggcggaacttccgggggaagcagtggtagctttcattacactttccacggtgatccccacgctacctttgctagttttttcggaggaagcaaccccttcgatatcttttttgctagctctcgtagcaccagaccattctctggattcgacccagatgacatggacgtggacgaggatgaggatccctttggagcctttggaagattcgggttcaacggtctttcgagagggccacggcgcgcaccagaacccctataccctagacgcaaggtgcaggatccaccagtggttcacgaactccgtgtctcacttgaggagatctaccacggttcaactaagaggatgaagatcactcgccggaggttgaacccagatgggagaactgtgagaaccgaagacaaaatacttcacattgtgattaagcgaggctggaaggaagggaccaaaataacgtttccaaaggaaggagatgccactccagataatatccccgccgatatcgtattcgtgctaaaggataaaccccacgcccatttcagacgggacggcaccaacgtactgtacagcgccctgatatctctgaaggaagcactgtgtggctgtacggtcaatatccccacaatcgacggacgggtgatacccctgccttgcaacgacgtgattaagcctggcaccgtgaagaggctacgtggagaaggtctgcctttccccaaggtacccactcaacgcggagacctaatcgtcgagttcaaagtccgctttccggaccggcttacccctcagacccggcagatcctcaaacagcaatacccacaacatagcctgcacagcatgtgcacacagttagatgtccattggactctggccacattcagtaaaatgcagaagaaggcaaccgggtttcaggagaacgtgccagttcctgatccgttctag

SEQ ID NO: 15596 - DNA, 1008 bp, Artificial Sequence
  Description of Artificial Sequence: Synthetic coding sequence
atgctgggaagtggatttaaagctgagaggctgagggtaaaccttaggctggttatcaataggttgaaactgctcgaaaagaaaaaaaccgagttagcacagaaagcaagaaaggagattgccgactacttggcagctggcaaagacgaacgagcccgcatacgcgtagagcatatcatacgcgaagactatctggtcgaagccatggagatcctggagctctactgcgatctcttactagcacgtttcggtctcatacagtccatgaaagagttggattcgggcttggccgagtccgtgtccacgctcatttgggccgcgccgaggctgcaatctgaagtggccgagttaaaaattgtggcggaccagctgtgtgccaaatactcaaaagagtacggtaagttatgccgaactaatcagatcggaacagtgaacgatcgtctgatgcataaactgagcgtggaagcccccccaaaaatcctcgtcgagagatacctcattgagatcgccaagaactacaatgtcccatacgaacctgactcagtagtgatggcagaggcaccaccgggcgtggagacagacctaatcgatgtcggcttcacagacgacgtcaaaaaaggcggaccgggtagggggggctccggcggcttcaccgctcccgttggagggcccgacggcacagtaccgatgccaatgcctatgccaatgcccatgccctctgcaaatactcccttcagctaccccctgcctaaagggcctgttgacgatattaatgctgacaaaaacatctcttctgcccagatcgttggcccaggaccgaaacctgaggcgagtgccaagcttccaagtcgtcctgctgacaactatgataattttgtgctgccagagctcccttctgtgccggatacacttcctacagcctccgcaggtgcttccacgtccgcttctgaggacattgactttgatgacctgagcaggagatttgaagagttaaagaaaaagacgtag

SEQ ID NO: 15597 - DNA, 1101 bp, Artificial Sequence
  Description of Artificial Sequence: Synthetic coding sequence
atgctcggatccggcttcaaagcagaacgactgcgggtgaatcttaggttagtcatcaataggctgaagctcctcgagaagaagaagactgagctggcacaaaaagcccggaaggagatagccgactatctggccgctggaaaggacgagagagcccgaatcagggtcgagcacatcattcgtgaggactatctcgttgaagcgatggaaattctcgagttgtattgtgacttactcctggctagatttggacttatccagtctatgaaggagctcgatagcggtctggcagagagtgtgtcaacactgatctgggctgctccgaggctccagtcagaggtagcagaactgaaaatcgtggctgaccaactatgtgccaagtactcaaaagaatacggaaagctttgtcggacgaatcagattggtacagtgaatgatagacttatgcacaaattatctgtggaggccccccccaaaatcctcgttgagcggtatttaatagaaatcgccaagaactataatgtgccctacgagcccgattcggtcgtcatggcagaggcccccccaggcgtggagaccgacctgatcgacgtgggattcacagacgatgtgaagaaaggaggaccagggagaggcggatctggcggattcacagctccggtgggcggcccagacggaaccgtgccaatgccaatgcctatgccaatgcccatgccttccgctaacacccctttcagctacccactcccaaagggcccgtcagacttcaacggcctgcccatggggacgtaccaagctttccctaatattcacccccctcagatcccagcaaccccaccttcttatgaaagcgtggacgacattaacgctgacaaaaacattagctcagctcagatcgtgggcccaggaccaaaacccgaggcctcagccaaactcccaagtcggcccgccgacaattacgataattttgtgttacctgagctcccatcagtacccgacactctccctaccgcgtccgccggagcaagcacgtcagcatcagaggacattgatttcgatgatctgagccggcgtttcgaggaactgaagaagaaaacatag

SEQ ID NO: 15598 - DNA, 948 bp, Artificial Sequence
  Description of Artificial Sequence: Synthetic coding sequence
atggaaaaatacgagaagctggcaaagacaggagaggggagctatggggtggtgttcaagtgcagaaataagacttcgggtcaggtggttgcagtgaagaaatttgtcgagtccgaagatgacccggtagtgaagaaaattgcgttaagggagattcggatgctgaagcaactaaaacatccaaatcttgtgaatctgatcgaagtgttcagacggaaaagaaaaatgcacctcgtgttcgaatattgcgatcatactttgcttaatgaactcgaaaggaatcccaatggagtcgccgatggtgtcataaagagtgttctgtggcaaaccctgcaggcattgaatttttgtcatatccacaattgcatccaccgtgatatcaagccagagaatattctaattacaaagcaaggtatcatcaaaatttgcgactttggctttgcacagattctaatccccggtgatgcatataccgattacgtggccaccagatggtatcgagctcctgagctgctggtaggggatacccagtacggatcatctgtagatatctgggctattggttgcgtcttcgcagagctcctgacagggcaacccctgtggccaggtaagtctgacgtcgatcagctgtacttgatcatccgcacactcggtaaactcatccctcggcaccagagtatatttaaaagcaacggcttttttcatggaatctccataccggagccggaagacatggagactttagaggagaaattctccgacgtccatcccgttgctttgaactttatgaagggctgcctcaaaatgaacccggacgataggcttacctgttcacagctgctagaatcttcctactttgactccttccaagaggctcagatcaaaagaaaggcgagaaacgaagggcgaaatcgtcggcgccagcaggtgctgccactgaagagttag

SEQ ID NO: 15599 - DNA, 948 bp, Artificial Sequence
  Description of Artificial Sequence: Synthetic coding sequence
atggctaacgacccactcgaggggttccacgaagtcaacctggctagtcctacatcgccggatctgttgggggtttacgaatcggggacccaggagcagacaaccagcccatcagtgatctatcggccacacccctcagctttaagttcggtgcccatccaggccaatgccttggatgtcagtgagttaccaacccagcctgtgtactcttccccacgccggctgaattgtgccgaaattagttctatatcattccacgtgacagatccagccccttgttctactagcggcgtgaccgccggactgacaaagctcaccacccgcaaggacaactacaatgctgaaagagaatttctgcaaggagcaaccatcaccgaagcctgtgacgggtccgacgatatcttcggtttgtcaactgattccctttcacgtttgcgctctccatcggtcctggaggttcgtgagaaggggtatgagcggctcaaggaagagcttgcaaaagcccagagggagttgaaactgaaagatgaggaatgtgagcgtctcagcaaggtgcgagatcagttagggcaggagctggaggagttaaccgcatcgctgttcgaagaagctcataaaatggtgcgggaggctaatattaaacaagctacagctgagaaacagttgaaagaggcccaggggaagattgatgttctccaggcagaagtggccgctttgaaaacgctggtgctgagctcctcccccacgagcccaacacaggagcccctgcccggtggaaagactccattcaagaaggggcacactcgcaataagtctacatcttctgcaatgagcggcagtcaccaggatctgtcggtgatccaaccaatagtaaaagattgtaaggaggtgacccaccagggcctgtccccactgaccctgttaattctggtgagtagccatcattag

SEQ ID NO: 15600 - DNA, 1074 bp, Artificial Sequence
  Description of Artificial Sequence: Synthetic coding sequence
atggccagagagaacggtgagtccagtagcagttggaagaagcaagcggaggacatcaagaaaatcttcgaattcaaggaaactctagggactggcgcgttcagtgaggttgtgcttgcggaggaaaaggccacaggcaagttgttcgcggtcaaatgcatccccaaaaaagcgctaaagggcaaggagtcctctatagagaacgagattgccgttttgagaaagatcaagcatgagaatattgtggccttggaggatatctacgaaagccctaaccacctatacttagtaatgcagctggtcagcgggggggagctgttcgaccggattgtcgaaaaaggattctacacagagaaggacgcatctactctcatcaggcaggtgctcgacgctgtctattaccttcaccgcatgggcatcgtgcacagggatctgaagccagagaacctgctctattactcccaggacgaggagtccaaaattatgattagcgattttggtctatcgaagatggagggaaagggcgacgtcatgagtaccgcctgcggaactccaggatatgtggccccagaggtcctcgcgcagaaaccttacagcaaagccgtagattgttggtcaattggtgtgattgcttatatcctgctctgcgggtatcctcctttttacgatgagaatgacagcaagttgtttgagcagatccttaaggctgaatacgagttcgattctccctattgggacgatatttctgacagtgccaaggacttcattagaaatttgatggagaaggacccaaataagcgatacacttgcgaacaggcagcaagacacccttggatcgctggcgatacggctcttaacaagaacatccatgagagtgtatccgcccagattcgaaaaaattttgctaaatccaagtggcggcaagcatttaacgctacagcagtggtcagacacatgagaaagctccacctggggtcttctctcgacagctctaacgccagcgttagcagctccctgtccttggccagtcaaaaggactgcgcttatgtcgcgaagcccgagtctttgtcctag

SEQ ID NO: 15601 - DNA, 1158 bp, Artificial Sequence
  Description of Artificial Sequence: Synthetic coding sequence
atggcaagagagaacggagagtcatcctcctcctggaaaaaacaagcagaagatataaagaaaatcttcgaatttaaagagacactgggcaccggcgcatttagtgaagtggtactggctgaggaaaaggccaccggcaagcttttcgccgtgaaatgcatccctaagaaagcactgaaagggaaggagagctctatagagaacgaaattgccgtgttgcgcaagatcaagcatgagaacatcgtcgcgttggaggatatctacgaaagcccaaatcacctgtacttagtgatgcagctagttagcggcggcgagctgttcgatcggatcgtagaaaaggggttctacaccgaaaaagacgcctcaaccctgattaggcaggtgctggacgccgtttactacctgcacagaatgggaatcgtgcatcgggatctcaaacctgagaatctgctttattatagccaggacgaagagtccaagatcatgatttctgactttgggctgtccaagatggaaggaaagggtgacgtgatgtctactgcctgcggaacaccgggatatgtcgcaccagaagtgcttgctcagaaaccctacagcaaggctgtcgattgttggagtatcggagtgattgcctatatactgctgtgtggatatccacctttttatgacgagaacgacagtaagcttttcgagcagatcctgaaggccgagtacgaattcgactccccatattgggacgatatcagtgattcagctaaagattttatccgaaatttaatggagaaggatccgaataaacgatatacttgcgaacaggccgctcgtcatccatggattgccggtgatacagcacttaataagaatatccacgagtctgtcagcgcccagatccgcaagaactttgcaaaaagcaaatggcgccaggcgtttaatgccactgccgttgtccgacacatgaggaagctacatctgggttccagccttgactctagcaacgccagcgttagctccagcctgtctctggctagtcagaaggattgcctcgcaccctctactttatgtagtttcataagctcatcatctggtgtttctggagtgggggcagagcgtcgccctagacctacaacagtgaccgccgttcatagcgggagtaagtag

SEQ ID NO: 15602 - DNA, 888 bp, Artificial Sequence
  Description of Artificial Sequence: Synthetic coding sequence
atgaaaaaagagcatgtccttcactgccagttctcggcatggtacccattcttcagaggcgtgaccatcaagagcgttattctccccctgccccagaatgtgaaagactatctcctggacgacggaacactcgttgtttccggcagggacgaccctcccacacacagccagcctgatagcgacgacgaggccgaagaaatccaatggtcggacgacgaaaacacagccacgctcacggcccctgagttcccagagtttgcaacgaaggtccaagaagcaatcaattctcttggagggtcagtgtttccgaagcttaattggagcgcaccaagggatgcttactggatcgctatgaactcaagtctgaaatgtaagaccctctctgatatatttctcctctttaagtctagcgatttcatcacaagggacttcactcagcctttcatccactgcaccgatgattcccccgacccttgcattgaatatgagctggtcttacgaaaatggtgtgaactgataccaggagccgagtttcggtgttttgtgaaggagaacaaactcatagttgtattcgatatatatcgcgattcacgggggaaggtctggctgattgatttcaaccccttcggtgaggtcaccgactctctcctgtttacctgggaagaacttatttctgagaacaaccttaatggagactttagtgaggtggacgcacaggagcaagactctcctgcctttcgttgcacaaatagcgaggtcactgtgcagccatcaccatacctgtcatatagattgcctaaggacttcgtcgacctgagcaccggggaagacgcacacaagctcattgactttcttaaactcaaaagaaaccagcaggaagacgactag

SEQ ID NO: 15603 - DNA, 3273 bp, Artificial Sequence
  Description of Artificial Sequence: Synthetic coding sequence
atggagcagccaaaaggtgtagactggacagtcattattctgacttgccaatacaaggactccgtgcaagtgttccagagggagcttgaagtcaggcaaaaaagggagcagatacccgctggaacgcttctgctagctgtggaagaccccgaaaaacgggtgggatcaggcggagcaacactgaacgcacttttggtcgcagccgagcacttgtccgcgagagctggatttacatggatatgtgtaggagtcagtctctggattagaggctgtcaccctcccgggaggctgcccgaagcctctgttcaccgagcctttccactgcttcaagtggtcacctccgacgtgctgcactcggcctggattctgatcttgcatatgggtcgcgacttcccattcgacgactgcggccgcgcttttacatgccttccagttgaaaatcccgaagcaccagtcgaagcactcgtgtgtaaccttgactgcctcctcgacattatgacatacaggcttggtcctggcagcccccccggagtctgggtgtgcagtacagacatgctgttatctgtgccggcaaatccaggcatctcgtgggattcatttaggggtgcgagggtgatcgccctgcctggcagccccgcttatgcccagaatcacggcgtctacctgactgatccgcaggggcttgtattagacatttactatcagggtactgaggccgaaatacagcggtgtgtgcggcctgacgggagggtgcccttggtgtcaggcgttgttttctttagcgtggagacagcagaaaggctcctagctacacacgtgtccccgcccttggatgcatgtacctacttgggtctggacagtggcgctcgcccggtgcagctctcactgttcttcgacatattgcactgcatggctgaaaacgtgactcgcgaggatttcctagttggccgacccccggagctgggacagggagacgccgatgtcgccggatatctgcagtctgcccgtgcccaactgtggagggagctcagagatcagcccctgaccatggcttatgtgtccagtggcagttattcctacatgacgtctagcgcatccgagtttctgctcagccttacattgcccggggccccaggcgcccagatagtgcactctcaggtcgaagagcaacagctgctcgccgccggaagctcagtggtgtcttgtcttttagagggcccggtacagttgggtcccgggtctgtgcttcagcattgtcatctccagggccccattcacattggcgcggggtgtctggtaactggtcttgacaccgcccattctaaggcattgcacggcagggaactgcgggatttggtgctccagggtcatcacacaagactccacggttctcctggacacgctttcacactggtggggcggcttgatagctgggagcgtcagggcgcggggacctacctaaatgtcccctggtccgagtttttcaaaagaacaggcgtgagggcctgggatctttgggaccctgaaactttacctgctgagtactgtttgcctagtgctcggttatttcctgtcctacacccgagtagagaacttgggcctcaggacctgctctggatgttagatcaccaggaggacggcggtgaggccttacgcgcgtggcgagcctcctggaggttgtcttgggaacagttgcagccgtgcctggatagagcagccaccttagcctcccgcagagacctgttcttccggcaagcccttcacaaggctcggcatgtgttggaagctagacaagatcttagcctccgccccctcatttgggccgctgtgagggaaggatgtccgggtcccctgctagctacccttgatcaagtcgctgcgggtgctggcgaccctggagtcgccgcccgcgccttggcctgcgtcgccgacgtgctggggtgcatggcagaaggcaggggaggactgagaagcggcccggccgccaatcctgagtggatgcggcccttttcttatttggagtgcggggaccttgcagctggtgttgaggccttggcccaagaaagagacaagtggttgtctagaccagccctcctagtcagagctgctcgccactacgagggtgccggccagattttgatcaggcaggcggttatgagtgcacagcattttgtgtccaccgaacaggtcgagctccccgggccgggtcaatgggtggtcgcagaatgtcccgcaagagtggacttctctgggggatggagcgacactcctcctttggcctacgaattaggcggcgcagtgcttggtctcgctgttagagtggacggcaggaggcctatcggcgcaagagcccgacggatcccagaaccagagctgtggttagctgttggaccccggcaagacgaaatgacggtcaaaatcgtgtgccgctgcctagccgatctgcgagactactgccagccccacgctcctggtgccctgctgaaagccgctttcatatgcgccggcattgttcacgtgcattcagaactgcaactgtcaacatcctccatcttggctggtactgccctcgctgccctccagcgcgccgcaggaagagtggtcggaacagaagcgttgatccatgcggtcctgcacttagagcaggtgcttacaactggcgggggttggcaggaccaggtcggcgggcttatgccagggattaaggtgggccgatctagagcccagctgcccttgaaagtggaggttgaagaggtcacggttcctgaaggtttcgtacagaagttaaacgaccatctgttgctggtgtatactggaaagaccagactggcccgaaacctgcttcaggatgtcttgaggagttggtacgcaaggcttccagctgttgtgcagaacgcacattctcttgttaggcagactgaagagtgcgccgaaggctttaggcaagggagcttacccctcctaggccagtgcctgaccagttactgggagcagaagaagcttatggcgcccggctgtgagcctctgacagtccgaagaatgatggatgttctagccccgcatgttcacgggcagagtttggccggggccggaggcggaggatttctgtatctgctgacaaaagagccccagcagaaggaggccttggaggccgtcttagccaagactgaaggtctcgggaattactcaatccacctagttgaggtagatacacaaggacttagcttgaagctgctgggaacggaggcgtcaacttgctgtccttttccatag

SEQ ID NO: 15604 - DNA, 318 bp, Artificial Sequence
  Description of Artificial Sequence: Synthetic coding sequence
atgctggagctggcccaagaccgtttgcagtttgagaccgtggaggtgtccgagccatccatgctgcagaaaatcctcaccacccggcggcgcgagactggcggcaacgagcccttacctgtgcctacactgcagcatcatctggccccgcctgccgaggcaaggaaggttccgtctgcctcacaggtacaagctatcaagtgtttcttgtctaaatgttggagcctgaacatcagtaccaaggaatatgcttacttgaaaggtactgtcctcttcaacccgggaaagggaaaagagaacgactgtaaccaccactag

SEQ ID NO: 15605 - DNA, 1413 bp, Artificial Sequence
  Description of Artificial Sequence: Synthetic coding sequence
atggccggtgagaaccatcagtggcagggctctattctgtacaatatgctgatgtctgcgaaacagacgagggctgcccctgaggcccccgaaacccgtctcgtggaccagtgttggggatgtagctgtggagatgagccgggagtcggacgcgagggcttactgggtggacggaacgtggctctcctgtatcgatgttgcttctgtggcaaagaccacccgagacaagggtctatactgtatagcatgctcacttccgctaagcagacttacgctgctcccaaagcaccggaggccaccttgggaccttgctggggctgctcctgtgggtctgaccctggcgtcggaagagccggattacccgggggcagaccggttgcactactgtaccgctgctgtttttgcggcgaggaccacccaagacaggggagcatcctgtactctctccttacatcttcaaagcagactcatgtggctccagccgcccccgaagcaagacctggcggcgcctggtgggatagatcatatttcgctcagcgccctggtggaaaagaagctctcccaggcggccgggctactgcattattgtatagatgttgtttctgcggtgaggatcaccctcagcaaggttccactctgtattgcgttccaaccagcacaaatcaggcgcaggccgcacctgaggagagacctagggcgccctggtgggacacaagttccggggccctcagacctgtagccttaaaatcaccacaggtcgtctgtgaggcagcttcagccggactgctcaaaacccttagatttgtaaagtacctgccttgctttcaggtattaccgctggaccagcagctcgtattggtgcgcaattgctgggcttccttattgatgctggaattggctcaggatagactgcaatttgagacggttgaagtcagcgagccctccatgctgcagaagatcctcacaaccagacgtcgggagacaggcggaaacgagcccctccccgtccccaccttgcagcatcatctcgcccccccagccgaagctcgtaaggtccctagtgccagccaggttcaggcgattaagtgcttcctgagtaagtgttggagtctgaatatttctactaaagagtacgcttacctcaagggcacagtacttttcaatccagatgtccccggactgcaatgcgtgaagtacatccagggtcttcaatggggcacacaacaaattttgtctgaacataccaggatgactcaccagggcccccacgatcgcttcatcgagctgaactctacattatttttgcttcggtttattaatgctaacgtaatcgcggaattgttcttcagaccaattattggcacagtgtcaatggatgacatgatgctcgagatgctgtgcactaagatctag

SEQ ID NO: 15606 - DNA, 2028 bp, Artificial Sequence
  Description of Artificial Sequence: Synthetic coding sequence
atgttaagggccaccgcaccatgctggtttccgcccggttatccagaagccaagaaagtagccgaggaagccgcactggaggcctctcggcaccttgggggagaacaaagccaggctggtgcccccgagggcagtaagatgctcagggctactgcaccctgctggttccgcccgggatacccagaagccaagaaagtagccaaggaagctgccccagaagcctctcgccatctcggagccgagcagagccctgccggcgcacccgagggctccaaaatgctgagggccacagccccatgctggtttcctccgggttacccagaagccaagaaggttgccgaggaggcagcgctcgaggccccagagttcccccttccatcccaccaaccggcccagagcttcggtctttgggtcccccagatgcacaagcaggctagcgcattcgtagacatccaggcagaaccacaaaaccgcggcccggctgtccctccggcttggcccaagatggtgaccgagagctgttactttcccgcacagaggggctccgcctgtaggttgccagccgcccccagactgactgagaggccatccggagttagaattagtgccccccggaaacggaaaactatcgcccattcctccagcccgtgtttggtcactggctacacggatgccaagagaacccgcgtggccagttcctcccagcgctccagggggagcaaagtgggccgccagcctggcaagacgcggaatcggagcggtatggcctgtaaaacaacagctaccacatcatccaaaagaatcgtcagaagagcctccctcccaagcctgtctcttaaaaaacccatcatcctaaggtctagtggttgccaggttccaaccgtgctgaggagaggatatctgcagctcttcaccgaggagtgcctgaagttctgtgcctctaagcaggaagccgaagagaaagccctgaacgaagagaaggtggcatatgactgcagccccaataaaaataggtacctgaatgtcgtgttaaatactttgaagcgcctgaaaggactaaccccttcaagtatgcctgggttgagcagagctgccctgtacagtcgcctccaagaattcctgctaacacaggatcagttaaaggaaaatggttacccctttccacatcctgagagacccggaggtgcagtgctgttcacaggccaaggcaaaggtcctggagattcttcatgccgagtttgctgccgctgtggcactgaatacctcgtgagttcttctggtagatgcgtccgagaccaattgtgttactaccattggggtagggttagatcttcacaggtagccggtggaagagtcagccaatacacatgctgtgcggctgcaccaggatccgtagggtgccaagtagctaaacagcacgttcgcgacggccgaaaggagagcctcgacggcttcgtcgagaccttcaaaaaagaattgtcaagggacgcttaccctggtatatacgctctggactgcgagatgtgctacacaacacatggcctcgagttgacccgggtcaccgttgtggacgcagatatgcgtgtggtgtatgatacatttgtgaagcccgacaatgagatcgtggattataacacccggttctcaggggtaacagaagctgatgtcgctaagactagtatcactctgccccaagtccaggctattttactctcatttttttctgctcagaccatactcatcggccactcactagagtctgacttacttgccctgaagctgatccattcaaccgtggtggatacggcagtattgttccctcactatttggggtttccatacaagcgctccctcaggaacctggccgccgactatctggcacagattatccaggactcccaagatggacacaactccagtgaggatgccagtgcttgtttgcagctggttatgtggaaagtcaggcagagagcccagattcagccacgccaccggagcgccagcccagcagcgcttgcctgtccatag

SEQ ID NO: 15607 - DNA, 711 bp, Artificial Sequence
  Description of Artificial Sequence: Synthetic coding sequence
atgcatacaactcagaaagacaccacatacaccaagatcttcgtcggaggcttaccctaccatacaaccgatgcctccctgcgaaagtacttcgaagtcttcggcgaaatcgaagaggccgtggtgatcaccgacagacagacaggaaagagccggggttatggattcgttactatggccgatcgagccgcggccgagcgagcttgcaaggaccctaaccctatcatcgatgggaggaaggccaacgtaaacttggcctatctgggtgccaagccccggatcatgcaacccgggtttgcctttggcgttcagcaactgcacccggctctgatccagagaccctttggcattcccgcccattatgtctatccacaggctttcgtgcaaccaggcgtagtaatcccccatgtgcagccgaccgccgccgctgccagcacgacgccttacattgactatactggtgctgcctatgcccaatactcagccgctgccgccgcagcggctgctgccgctgcatacgatcaatatccctatgctgcttcacccgcagctgccggctacgttaccgccggaggctatgggtacgctgtgcaacagcctattaccgctgccgcgccaggtactgctgccgcagccgctgctgctgcagctgctgcagccgcattcggacagtaccagcctcagcagctgcagaccgatagaatgcagtag

SEQ ID NO: 15608 - DNA, 4389 bp, Artificial Sequence
  Description of Artificial Sequence: Synthetic coding sequence
atggcccctgtccatggtgacgatagcctgagcgattctggatcatttgtgtcatcccgcgcaagacgggagaaaaagagtaaaaaaggacggcaagaagcgttagaaaggcttaaaaaagctaaagccggcgaaaagtacaagtatgaggtggaggacttcaccggtgtctacgaagaagttgacgaggagcaatattcaaagttagtccaagcccggcaggacgatgactggatcgtcgacgacgacggaattggctatgtggaggatgggagggagatctttgatgatgacctggaagatgacgcactggacgccgatgaaaaagggaaagacggaaaagcgcgaaacaaagacaaacgcaacgtgaaaaaattggctgtgacgaaaccgaacaatattaaaagcatgtttatcgcgtgcgctggaaaaaagacagcagataaggccgtggacttgagcaaagatggtctgctcggagacattttgcaggacctgaacacagaaacaccacagatcacaccaccaccagtgatgatcctgaagaagaagaggagcatcggtgctagtcccaaccctttttccgttcataccgccactgctgttcccagcggcaagatcgcctcaccggtctcacggaaggagccgccgttgactccagtcccattaaagcgagccgaatttgcaggcgatgatgttcaagtggaatctaccgaagaagaacaggaatctggggctatggagttcgaagacggagattttgacgaacccatggaagtggaggaggttgacctcgagcccatggctgctaaagcctgggataaggaatctgaacctgcggaagaagttaagcaggaggccgatagcgggaagggcactgtgagctatttaggctcctttctgccagacgtcagctgctgggacatagaccaggagggagactcctcattttctgtgcaagaggtgcaagtagatagctcccacctcccgctcgtcaaaggggcagacgaggagcaggttttccatttctattggctggatgcttatgaagaccagtacaatcagccgggagtggtgttcctcttcgggaaggtgtggatagagtcagccgaaacgcacgtctcatgctgcgtcatggtcaaaaacatagaaagaacactgtatttcttgccgcgcgaaatgaaaatcgacctcaacacaggaaaggagacaggcactcctatcagtatgaaggacgtatatgaagagtttgacgaaaagatcgctacaaagtacaaaatcatgaaatttaagagcaaaccagtggagaaaaactacgcatttgaaattcctgatgttccagaaaaaagcgagtatctggaggtgaagtatagcgccgaaatgcctcagttgcctcaggatcttaaaggcgagacattcagccacgtcttcggcactaatacctcttctctggagctcttcctgatgaaccgaaaaatcaaaggaccctgttggctggaggttaaatctcctcagctgttgaatcagcctgtctcatggtgtaaagtggaagctatggctctgaaacccgatttggtcaatgtgatcaaggacgtcagcccccccccactggtggtaatggccttttccatgaaaactatgcagaatgctaaaaatcaccaaaacgaaatcatcgcgatggctgcattggtccaccactcatttgccttagataaggcagcccctaagcctccatttcagagtcacttctgtgtcgttagcaaaccaaaggactgtatctttccttatgcctttaaagaagtaattgaaaaaaagaatgttaaggtcgaggtggccgccactgaacgcactttgctagggtttttcttggcgaaggtgcataagatcgatccagacattattgtgggacataatatctatggcttcgaacttgaagtgcttctgcaaagaatcaatgtatgcaaggccccccactggtcaaagatcggccggctgaagaggtcaaacatgcccaaactcggcggccgctcaggttttggagagaggaacgcaacttgtggccgaatgatatgtgacgttgaaattagcgccaaagaattgatccgttgcaagtcttaccacttgtcagaactagtccagcagatcctgaagactgagcgagtagtcatccctatggagaatatccagaacatgtatagtgagagtagccagctgctctacctgctggagcacacctggaaggatgctaaattcatactgcagatcatgtgcgagctcaatgtgttgcccctcgcactgcagatcacaaatatagcagggaacatcatgtctcgcacgctcatgggcggccggtccgagaggaacgaatttctgctactgcacgccttctatgaaaataattatatagttcccgacaaacaaattttccgcaagccacagcaaaagctgggcgatgaggatgaggagatcgatggggatacgaacaagtacaaaaagggcaggaagaaagcggcgtatgccggaggcctggtcttggacccgaaggtgggcttttacgacaagttcatcctgctcctggacttcaattccctgtacccctccattatccaggagttcaatatatgcttcacgacagtgcagcgtgtcgcatctgaggcacagaaagtgaccgaggatggggaacaagagcagatccccgaactgccggatccttccttggagatgggcatcctgccccgggagattaggaaactcgttgagagacgtaaacaggtgaagcagctgatgaagcaacaggatctgaaccccgacctgatccttcaatatgacattcgtcagaaagcccttaagcttacagcgaacagcatgtacgggtgcttgggatttagttattccaggttctatgccaagccgctcgcagccctggtgacctacaagggacgggaaatccttatgcacacgaaagagatggtgcaaaagatgaacctagaggtgatctacggtgacaccgactccatcatgataaatacgaactccacaaatctcgaggaggtcttcaaactagggaacaaggttaagtcggaagtgaataagctgtacaagctgctggagattgacattgacggggtgtttaagtccctactgttgctcaagaaaaagaagtacgcagcactggtggtggaaccaaccagcgacggcaattatgtcaccaagcaagaactgaagggtctggatattgtgcgtagggattggtgtgacctggccaaggacaccgggaacttcgtgattggtcagatcctgtcagatcagtcccgggataccattgtagagaatatccagaagcgcctgatcgagattggcgaaaacgtccttaacggatcagtgcctgtctcacagttcgagattaataaggccctgacaaaggatccacaggactaccccgataaaaagtctctccctcacgtccacgtcgccttatggattaatagtcagggtggacggaaagtcaaagccggagatactgtatcttatgtgatctgccaggacggctctaacctgaccgctagtcagcgggcatacgcccctgaacagttacagaagcaggataaccttactatcgatacccagtattacctggcccagcagatacatccagtggtcgcccggatttgtgagcccatcgatggcattgatgcagtcctgatagctacatggctggggcttgaccctacgcagttcagagtacatcattatcacaaagacgaggagaatgacgctttactgggcggtcccgctcagctgactgacgaagaaaaataccgtgattgtgaaagatttaagtgcccctgtccaacgtgcgggactgagaacatctatgataacgtcttcgatgggtcagggactgacatggaaccatctctgtacaggtgctcgaacatcgactgtaaggcttctcctctcacttttacagttcagctgtccaataagttaatcatggacatacggcgtttcattaaaaagtactacgatggttggctgatttgcgaggaacctacatgtcgcaatcgcacgagacatttgccacttcagttttctagaactggacctttgtgtccagcttgcatgaaggcgacactgcagcccgagtactccgacaagtctctgtacacacagctctgcttctacaggtatatcttcgatgcggaatgcgctttggagaagctgacgaccgaccacgagaaagacaaacttaaaaaacagtttttcacacccaaggtgcttcaagattacagaaaacttaaaaacacggcagagcagtttctgtctcgcagcggatactcagaagtcaacctttcaaaactgttcgccggatgcgcagtgaaaagttag

SEQ ID NO: 15609 - DNA, 2673 bp, Artificial Sequence
  Description of Artificial Sequence: Synthetic coding sequence
atgtccgctaataactctccaccctccgcccagaagtctgtgctgcctaccgccatccccgccgtccttcctgccgctagcccttgttcttctcctaagactgggctgtctgcccgcctctctaatgggtccttttcagccccctctctcacaaactcccgcggctccgttcacaccgtcagctttctcctgcaaattggtctgactcgcgagtcggtgacgatcgaggcacaggagctgagcctcagcgcagtgaaagatcttgtttgttctatagtctaccagaaattccctgaatgtggttttttcggcatgtacgataaaatcctgctgttcaggcacgatatgaattccgaaaacatactgcagctgataacttcagctgacgaaatccacgagggagatctggttgaagttgttctcagtgcactggccactgtggaagatttccagattcggcctcatacactgtacgtgcatagctacaaggcccccaccttctgtgattattgcggcgagatgctgtggggcctagtgcgacaaggcttgaaatgcgagggctgtggcctgaactatcacaaacggtgcgccttcaaaattcctaataactgttcaggggtgaggaagcggaggttaagtaacgtgtccctgcctggccctggactgagcgtacctaggcccctgcagcctgaatacgtcgcgttgccatctgaggagagccacgtgcaccaggagccttcaaagagaattccaagctggtcaggacgcccaatctggatggagaaaatggtgatgtgtcgggttaaagtgccccatacctttgccgtgcattcatacacccgaccaaccatatgtcagtattgcaagcgactcctcaagggcctgttccggcaggggatgcagtgtaaggattgtaagtttaactgccataaaagatgtgcttctaaggttcctagggactgtctgggggaggtgacttttaacggtgagccatctagcctcggcaccgatactgatatccccatggatattgacaacaatgatattaactccgattctagccgaggcttggatgatactgaggagccgagcccacccgaggacaagatgttcttccttgatcctagcgacttagacgtggaacgagacgaggaagctgttaagacgatctctccctctactagtaataacattcccctgatgagggtggtgcaatcaattaagcacaccaagagaaaaagttctacaatggtaaaagaaggatggatggtgcactacacatctagagataacctgcgaaagcggcactactggcgtcttgactcaaagtgtctgacactcttccaaaatgaatcaggctctaagtactacaaggaaatccccttgagcgagatattgcgaataagttccccgagggacttcactaatatctctcaagggtctaatccacactgttttgagattattacagacaccatggtttactttgtcggggagaacaatggagactcatctcacaacccggtgctggcggccaccggggtcggactggatgtcgcacaatcctgggagaaagccatccggcaggccttgatgccagtgacccctcaggcttccgtttgcacttcccctggacagggcaaggatcacaaagacctgagcactagtatctcagtgtctaactgtcagatccaggagaacgtggatatctccactgtgtaccagatctttgctgacgaggtcctgggaagcgggcaattcggaattgtgtatgggggtaaacacagaaagaccgggagggatgtggctatcaaggtaatcgataagatgcggttcccaaccaagcaggagagtcagctaaggaatgaggtggccattctgcagaatctgcatcatcccgggattgtcaatctggaatgcatgttcgagaccccagagcgcgtattcgttgtcatggagaagctgcatggagatatgttagagatgatcctgagctctgaaaagagtaggctgccagagaggattacgaaattcatggtgacccagatcctggtggcgctgaggaatcttcatttcaaaaatatagtgcattgcgacctcaagccggagaacgtgctgctcgcaagcgccgaaccatttcctcaagtgaaactgtgcgacttcggatttgccaggattattggggagaagtcattccggcgctcggtggtcggaacgcctgcatacctggccccagaggtacttcgatctaaagggtacaatcggtctctcgatatgtggtcagtaggggtaattatatatgtttcattatccggtacctttccatttaacgaagacgaagatattaacgaccagatccagaatgccgcttttatgtaccctccgaacccatggagagagatctctggcgaagcgattgacttgattaataatttgctgcaagtcaaaatgagaaaaaggtacagtgtcgataagtctctatcccacccttggctccaggattaccagacgtggctcgatctcagggagttcgagacccgaatcggagaaagatacattacccacgaaagcgatgatgcaagatgggaaatccacgcgtacacccacaatctggtctatccaaagcattttatcatggctccgaatcctgacgatatggaagaagatccgtag

SEQ ID NO: 15610 - DNA, 4407 bp, Artificial Sequence
  Description of Artificial Sequence: Synthetic coding sequence
atggctccagtgcacggagatgattgcgaaattggggcatcggctctaagtgattcagggtctttcgtctcctcgagagcgcgaagagaaaaaaagtccaaaaaaggacgccaggaagcactggaacgtctgaaaaaggccaaggccggtgagaagtataaatatgaggtcgaggactttacgggcgtttatgaggaggtggatgaagaacagtattcaaaacttgtgcaggcgagacaagatgacgactggatcgtggacgacgacggaatcggctacgttgaggacggccgcgaaatcttcgatgatgatctggaggacgatgcactcgatgcagatgaaaagggtaaggatggcaaggctcggaataaggacaaacggaatgtgaagaagttagcggtgacaaaaccgaataacatcaagagtatgtttattgcctgtgctggcaagaagaccgccgataaagctgtcgatctatctaaggacgggctgctaggggacatcttacaggatttgaacaccgaaacgccccagataaccccgcctcccgtgatgattttgaagaagaagcgctccattggcgcatctcccaaccccttcagcgtacacacagctaccgctgtgccgtcagggaagatcgcaagtcccgtctccagaaaggagccaccactcacacccgtgccactcaagcgcgctgaattcgcaggcgacgacgtgcaagtagagagcaccgaagaggaacaagaatcaggggctatggaatttgaggacggggactttgacgagccaatggaagtggaagaggtcgatctggaaccaatggccgccaaagcctgggacaaggagtcagaacccgcagaagaggtaaagcaggaagcggattccggcaaagggacggtgagttacctaggcagttttctacccgatgtgtcctgctgggacattgatcaggagggggattcctctttctcagttcaagaggtgcaggtcgacagcagtcacctgccactcgtaaagggcgcagatgaggagcaagtgttccacttttactggctggacgcttacgaggatcagtacaaccagcctggggtggtctttctgtttggaaaggtgtggatagaatccgccgaaactcatgtatcctgttgcgtaatggtcaagaacattgagcgtactctgtatttcctgcctagggaaatgaagattgacctgaacactggcaaagagacaggaacgcccatttcaatgaaggacgtatacgaggagttcgacgaaaagatcgctactaaatacaagattatgaaatttaaaagtaagccagttgagaaaaactacgcgttcgagatacccgatgttcccgagaagtccgagtacctcgaggtgaaatattcagctgagatgccacagcttcctcaggacctgaaaggcgaaactttcagtcacgtattcggaaccaatacttcctccttagaactgtttctaatgaaccgtaaaatcaaggggccgtgttggctggaggtaaagagtccacagctgttgaatcagcctgtgagttggtgcaaagtcgaagccatggccctgaagcccgacctagttaacgtaataaaggatgtgtcgccgccacccctggtagtgatggcattctccatgaaaactatgcagaacgccaaaaatcatcagaatgagattattgctatggccgcactggtgcaccatagcttcgccctggataaggccgcacccaaacccccattccagtcacatttttgtgtcgtgtctaaacctaaagactgtatattcccatacgcctttaaagaggtgatcgagaaaaaaaatgtgaaggtggaggttgccgccacagagagaactcttctgggcttttttctggccaaggtacacaaaatcgaccctgatataattgtggggcataatatctacggatttgagctcgaagtgctactacagaggatcaacgtctgtaaggctcctcattggagtaaaatcgggagactcaagcggtctaacatgccaaagctggggggccgctccggctttggcgaaaggaatgccacctgtggtcgtatgatctgtgacgttgagatctcggcaaaagagctgattcggtgcaagagctatcacctgtccgagctggtccagcaaattcttaaaacagaacgtgttgttattcccatggagaacatacagaatatgtacagtgagagcagccagctcctctatctgttagagcacacctggaaggatgctaagttcattctacagattatgtgtgaactaaatgtgctgccactggctttgcagatcaccaacatcgctggtaacattatgtcacgtaccctgatggggggtcggtccgaaagaaacgaatttctcctgttgcacgccttttatgaaaataactatattgttcctgataagcagattttccggaagccacagcaaaagctaggggatgaggacgaggagatcgacggagataccaacaagtacaagaaaggtagaaaaaaggcagcctacgccggaggtttagtgctagatccaaaggtgggcttttatgataagtttattctgctccttgactttaatagtttatatccctccattattcaggaatttaacatctgtttcacaacagtgcaacgcgtcgcttctgaagcccaaaaggtgactgaggatggagaacaggaacagatccctgaacttccagatccatctcttgaaatgggcatcttacctcgcgaaatcagaaaactcgtggagcggcgtaagcaagtgaagcagctgatgaaacagcaggatctgaatcctgatctgatcctgcagtacgatattcggcagaaggctctgaaattaactgcaaacagcatgtacggctgtctgggctttagctatagtaggttttatgccaagcccttggcggccttggttacttataaggggagggagatccttatgcatactaaagagatggtccagaagatgaatctggaggtgatctacggcgacactgactcgatcatgataaacactaacagcaccaatctcgaggaggtgtttaaactgggaaacaaggtgaaaagcgaagtaaataaactgtataagttgctcgaaattgatatcgacggggttttcaaatcactgttgttgctgaaaaagaaaaaatacgccgccttggtcgtggagcccacctcagatgggaactacgtgaccaagcaagagctgaaggggctagatatcgtgcgtcgggactggtgcgatttggctaaggacacaggtaattttgtgattggacagattttatcagaccaaagtcgcgacactattgtggaaaacattcagaagcgcctcatcgaaatcggtgaaaacgtattaaatggctcagtcccagtttctcagtttgagatcaataaagctcttacaaaggatcctcaggactacccggataagaagtccctcccccacgtgcacgtggcactgtggataaatagccaggggggcaggaaggtgaaggcaggagatacagtatcgtatgtcatttgccaagacggttcaaacttgacagcctcccagcgcgcttacgctccagaacagctgcagaagcaggataacttaacgattgacacacagtattacctggcgcagcagatacaccctgtggttgcgcgaatctgcgagcccattgatggcatcgacgctgtgctcatcgctacgtggctgggactcgatccgacacagtttcgtgtgcatcattaccacaaagatgaagagaatgacgcgctgttgggtggcccagcacagctgactgatgaagaaaaatatagggattgtgaacggtttaagtgtccctgccccacttgtggcactgagaacatttacgacaacgtgtttgatggctcaggtactgacatggaaccctcattatacaggtgctcaaatatcgactgtaaggcatcgcccctgacatttactgttcagctgtctaacaagttgattatggacattcggcgatttatcaaaaaatattatgacggctggctgatctgcgaggaaccaacttgcaggaacagaaccagacatctcccgctgcagttttccaggacaggtccactgtgcccagcctgtatgaaggctacactccaaccggagtacagcgataagtcactgtatacgcagttatgtttttaccgctatatattcgacgcggagtgcgccctggagaagcttaccaccgaccacgaaaaagacaaactcaaaaagcaatttttcacacccaaagtgctgcaggattatcggaagcttaagaacactgccgagcagtttttaagccgctccgggtactctgaggtgaatctctctaagctgtttgccggctgcgccgttaaaagctag

SEQ ID NO: 15611 - DNA, 399 bp, Artificial Sequence
  Description of Artificial Sequence: Synthetic coding sequence
atggtagagcctttcctggggacttggaaacttgtttcatcggaaaatttcgaggattatatgaaggagctgggcgtcaatttcgccgcacgcaatatggcaggcctagtaaagccaaccgtgacgatctcggtagatgggaagatgatgacaattcgaactgagtctagcttccaggatactaaaatttccttcaagttgggggaagaatttgatgaaaccactgccgacaaccgaaaggtgaaatcaacgattactctcgagaatgggtctatgattcacgtccaaaagtggttgggcaaagaaactaccatcaagcgcaagatagtggatgagaaaatggtggtggagtgcaaaatgaacaatatagtgtccacaaggatctatgagaaagtgtag

SEQ ID NO: 15612 - DNA, 555 bp, Artificial Sequence
  Description of Artificial Sequence: Synthetic coding sequence
atggatcggggcgagcagggattgctccgcacagaccccgtccccgaggagggggaagacgtggctgccaccattagcgctaccgaaacgctctcagaggaagagcaagaagaactccggagggaacttgccaaggtcgaagaagagatccaaaccctaagccaagtgctcgcagccaaagagaaacatctcgctgagattaaacgtaagctggggattaatagcctccaggaactcaagcagaatatcgctaaggggtggcaggacgtcacagctacttctgcttataagaagacctctgagactctgagccaggcaggccagaaggcatcagccgccttctcctctgtaggcagcgttatcaccaagaaattggaggacgtgaaaaacagtcctacatttaagagtttcgaggaaaaggtcgagaacctgaagagtaaggtgggcggaaccaagcccgccggaggggattttggtgaagtgcttaactcggcagccaacgcctctgcaaccacaaccgaacctcttcccgagaagacccaggaatcactttag

SEQ ID NO: 15613 - DNA, 675 bp, Artificial Sequence
  Description of Artificial Sequence: Synthetic coding sequence
atggattgcagagaaatggacctatatgaggattatcaatcaccctttgatttcgacgccggtgtgaataaatcctacctttatttgtctccttctgggaattcaagtccccccggcagtcctacactgcagaagttcggactgctccgcaccgacccagtacctgaggagggggaagatgtggcagctaccatatcagccaccgagacactttcagaagaagagcaggaggaactgagaagagagctcgcgaaagtcgaggaggagatacagactctttcccaagtattggccgccaaagaaaagcacctcgctgaaatcaagcggaagctggggataaactccctgcaagagctcaaacagaatatcgccaagggctggcaagacgttacggcaaccagtgcttacaaaaagacaagtgagaccctcagccaagctgggcagaaggcctccgcagctttcagtagtgtgggatcagtaattacaaaaaaattagaggacgttaagaatagcccaacctttaaatcgtttgaagagaaagttgagaacctcaagagtaaagtcggcgggacaaagcccgctggcggcgacttcggtgaagtgctgaattccgccgccaacgcttccgctacaacaacagagcctctgcctgagaagactcaggaaagtttatag

SEQ ID NO: 15614 - DNA, 285 bp, Artificial Sequence
  Description of Artificial Sequence: Synthetic coding sequence
ccaagagccgcgagatcacgcggcccggcagtgagcagacctagggcacccaggccagagctgacaacagaagccggcgaacccgccaggcgttgcgtcccaccgtacgagcatcgccctggcatgcagtgcgcggttacaactccacccccttcgtactatccatatcccaatctccgctgggatacgagccacttcaagaagtccggcggtcctcagcgcaataattacgtgatccatcctgaattcgtgtccgagacctatccagactaccggtgttggtag

SEQ ID NO: 15615 - DNA, 1110 bp, Artificial Sequence
  Description of Artificial Sequence: Synthetic coding sequence
atgcccgtagtgactacagacgcagaatctgagaccgggatccctaaatctctgtccaacgaacctccttcggagactatggaagagatcgaacatacctgtccccagcctcgcctcacgctcactgcccccgcaccatttgctgacgagaccaattgtcaatgccaggctcctcacgaaaagcttacaatagcacaggcacgactcggcacacccgccgaccgtcctgtgagagtatacgccgacggcatcttcgatttatttcatagcggccatgcccgggcgttaatgcaggccaaaacgctgtttccaaactcctatttacttgtgggtgtatgttccgacgacctgactcataagtttaaaggattcaccgtcatgaacgaggcggaaaggtatgaagcccttagacactgtcgatatgtagatgaggtaattagagacgctccctggaccctaacgcccgagttcctggagaaacacaagatcgattttgtggcccacgatgacatcccctacagttctgccggcagtgacgacgtctacaagcacataaaggaggccggaatgtttgtacctacccagagaacggaggggatttccaccagcgatattatcaccaggattgttcgagattacgacgtgtacgcacggcgaaaccttcaacgcggctatacggccaaggaactgaacgtgtcctttataaacgagaagcgttacagatttcaaaaccaggttgacaaaatgaaggagaaggtaaaaaacgttgaagagcggagcaaagagttcgttaaccgggtcgaggagaaaagtcacgacttgattcagaagtgggaggagaagagccgggagttcatagggaattttctggagttatttggtcccgatggggcctggaagcaaatgtttcaggaacgaagctctcgcatgttacaggccctgagccccaagcagagtcccgtgtcctctcctactaggagcagatctccttccagatcgccctcgccaactttcagctggctccctctgaagaccagcccgccatcgagtcccaaagctgcctctgcttcaatttcctcaatgtccgagggagacgaagatgaaaagtag

SEQ ID NO: 15616 - DNA, 1056 bp, Artificial Sequence
  Description of Artificial Sequence: Synthetic coding sequence
atggtgggccaccaggagtgcattatggaggaggacaatcgggctcctcagctctggcggaaaactctgacagctcctgctccctttgcagacgaaacgaattgtcagtgccaagcaccgcacgagaagctgacgatcgcacaggctcgacttggtacaccagccgacaggcccgtgcgcgtttatgccgacggcattttcgacctctttcactcggggcacgcacgagctctgatgcaagccaagactctcttccccaatagctacctcctcgtcggggtgtgttccgatgatctgacgcacaaatttaaaggctttaccgtcatgaacgaagctgaacgatatgaagccctgcgccactgccggtacgttgacgaggtaattcgcgacgcgccttggactttaacccctgagttccttgaaaagcacaagatcgactttgtggcccacgatgacatcccttattcctcagccggctcagatgatgtctataaacatattaaggaagctgggatgttcgttccgacccagcgcactgagggcatctctacctcagacataatcacaaggatagttcgggactatgacgtgtacgcgcgtagaaatctgcagagggggtataccgctaaagagttaaacgtgtcattcattaacgagaaacgctaccggtttcagaaccaggtggataaaatgaaggagaaagttaagaatgttgaagaaagatctaaggaatttgtgaatcgtgttgaggagaagtctcatgacctgatccagaaatgggaagaaaagtcacgagagtttataggaaactttctcgagctgttcgggccagatggggcctggaaacagatgttccaagaacggtcttcccggatgctccaggccttatcccccaagcagtcaccagttagttcaccaacacgctctagatccccctctcggtcgcccagcccaacgttctcgtggttacctctcaagaccagtcccccatcatcacctaaggctgcatcggccagtataagcagcatgtccgaaggagacgaagatgaaaaatag

SEQ ID NO: 15617 - DNA, 600 bp, Artificial Sequence
  Description of Artificial Sequence: Synthetic coding sequence
atggccgataaatccaagtttatcgagtatatcgatgaggccctagaaaaaagtaaggagaccgcactttctcacctgttcttcacctaccaagggattccctacccaataacaatgtgtacaagtgagaccttccaggccttggacaccttcgaggcacggcacgacgatatagtcctcgcatcataccctaaatgtgggtctaactggattttgcatattgtctccgaactgatttatgcagtgtctaagaaaaaatacaagtatcctgagtttcccgtgctcgaatgcggagactctgaaaaataccagaatctggccgcaggcataaaacagatagctgagtttctggggtttttcctgaccggagaacagattcagaccatctccgttcaatccacgtttcaggctatgagagcaaagtctcaggacacgcatggagctgtggggccttttctgtttcgcaagggtgaagtcggcgattggaagaacctcttttcggagatccagaatcaggaaatggacgagaagtttaaggaatgtctggccggtacatctctcggcgccaaattgaagtatgaatcctattgtcagggatag

SEQ ID NO: 15618 - DNA, 1527 bp, Artificial Sequence
  Description of Artificial Sequence: Synthetic coding sequence
atgcgctgtcccaaaagtgccgttaccatgcgcaacgaagaattactactgagcaatggcacggccaataaaatgaatggggctttagaccactcagaccagcccgaccctgacgcaattaagatgtttgtcggacagattcccaggtcctggtcggaaaaagagctgaaagaactgttcgagccctacggagctgtttaccagattaacgtccttagagatcggtctcagaaccccccccagtctaagggatgttgcttcgtgactttctatacgcgtaaggcggccctggaggcccaaaatgcactgcacaatatcaaaactctgccagggatgcatcatcccatccagatgaaaccggccgactcggaaaaatccaacgccgtagaagataggaaactgttcataggcatggtctccaagaaatgcaacgaaaacgatatacgggttatgtttagcccattcgggcagattgaagagtgtaggatcctgcggggccctgatgggctgtccagaggttgtgcattcgtgactttcagtaccagggccatggcgcaaaacgctataaaggctatgcaccagagccaaaccatggagggatgctcctctccaatcgtggtcaagttcgccgatactcaaaaagacaaagagcagaggcgccttcagcaacaactggcacagcagatgcaacagctcaataccgccacatggggtaatctgaccggcctgggaggcttaacccctcagtacctggccctcctgcagcaggctaccagcagtagtaacctcggcgcatttagcggcatccaacagatggccgggatgaatgcacttcagttacagaatttggccacacttgcggctgccgcagctgctgcgcagaccagtgctacgtcgactaatgcaaatccactgagcaccactagctcagcactgggagctctgacctcaccagtagcagctagcactcctaactcaacagccggcgctgccatgaattcgttgacctccctgggcaccttgcaaggtctggctggtgctacagtgggcctgaataatataaatgctctggcaggcatggcagcgttaaacggcgggttgggagctacgggactgacaaacggcactgccggaaccatggacgccctgacccaagcctactcggggatccagcagtacgccgccgccgccctgcccacactctatagtcagtccttgctgcagcagcagtcggctgcaggatcccaaaaggaggggcccgagggcgccaacttatttatttatcacctaccccaggagttcggcgatcaggacatcctgcagatgttcatgccatttggtaatgttatctcggcaaaagtgtttattgataagcagaccaatttgtctaagtgctttggatttgtgagttacgacaaccccgtgtccgcgcaggcggctatacaggccatgaacgggtttcagataggaatgaagagactgaaggtccagttgaagcggagcaagaacgactcaaaaccttattag

SEQ ID NO: 15619 - DNA, 1215 bp, Artificial Sequence
  Description of Artificial Sequence: Synthetic coding sequence
atggggtcatcccaggaggagggactccggtgtcagccctcacagccggaccacgatgccgacggtcattgtggacccgatctggagggcgctgagcgagcctcagcaacgccaggtcctcccggcctgctgaactcccatcggccagccgattcagatgacacaaacgctgcagggccaagcgctgcattgcttgaaggactgttactgggcggtggaaagccatccccgcactcaacaaggcccggtccgttcttttatattggaggcagcaacggtgcaacgattataagcagctattgcaagagcaaagggtggcagcgtattcacgattctcgccgtgatgattacacattgaagtggtgtgaagtcaaatctagagattcctatggatctttccgggaaggcgagcaactgctgtatcaattacctaacaataaacttttgacaacaaagatcggtcttctgtcaactctgagaggccgggcgcgcgcgatgtcaaaggcgtctaaggttcccggcggggtacaggcccgcttggagaaggatgccgccgcccccgcactcgaggacctgccttggacctcccccggctaccttcgccctcagagggtgctaagaatggaggagttcttcccggagacatacaggctagatcttaaacacgaaagagaagctttctttacattgtttgatgaaacacagatctggatttgcaaacccaccgcctcaaaccagggtaaggggatttttctgttgaggaaccaggaggaagtggccgctttacaggccaagacgcgatccatggaggatgaccccattcaccacaagacccctttccgagggccccaggctcgtgtcgtccagaggtacattcaaaaccctctcctggtggatgggcgcaaattcgacgtccgcagctacctcctaattgcctgcaccacaccctacatgattttcttcgggcacggctacgctagactaaccctatctctgtatgatccacattctagcgacctgggtggccaccttaccaatcagtttatgcagaagaagagcccattatatatgctcctgaaagagcacactgtgtggtccatggagcacctgaatcgttacatttccgacactttctggaaggctcggggcttagcaaaagactgggttttcacaactctcaaggtcagacctttgtgcccaccagtgtgggaatag

SEQ ID NO: 15620 - DNA, 2022 bp, Artificial Sequence
  Description of Artificial Sequence: Synthetic coding sequence
atggaccactcatgcacccgctttatccatagaagaggtccaccgacgcgcacacgcgctggctttaagagaggcaaaagaccgagaattcagcagaggccacgggctagggtctctggcacaatccccgcctctcgattacatcccgcacccgctagccaaccagggccctgtccggcaccaggccattgtcccgtaggaccagctcatgaacgacctatggggagcagtcaggaggaagggctgagatgccagccctcgcaaccagatcacgacgctgatgggcattgcggtcccgacttggaaggagccgagcgcgcctcagcaacacccgggccccctgggctcttgaactcccacaggccagccgacagtgacgataccaatgcagccgggccatctgctgccttattagaaggactgctgctcggcggcggcaagcctagccctcacagcacaagaccaggacctttcttctacatcggaggtagcaacggcgcgactattatttcctcctattgcaagtcaaaagggtggcagagaattcatgactctcggagagatgactatactctgaaatggtgtgaagtgaagagcagggactcctatggaagctttcgagagggggaacagctgctgtatcagctcccaaataacaagttgctgaccacaaagataggcctactgtcaactctaagggggcgggctagggccatgtcaaaagccagcaaagtgccaggcggcgtgcaggcacggctggaaaaagatgccgccgccccagcacttgaagacttgccatggacctcgcctggttatctacgcccccagcgggtgctgcgaatggaggagttcttccccgaaacctaccggctggacctgaagcatgagcgagaagcctttttcactctctttgatgaaacacagatttggatttgcaaacccaccgcaagtaatcaagggaaaggaatctttctgctgcggaaccaggaggaagttgctgctttgcaagcaaagacacgcagcatggaggacgatcctatccaccataagactcccttccgcggcccacaggctcgggttgtgcagagatacatccaaaaccccttgcttgtagatggccgcaagtttgatgtcagaagctacctgttgatcgcctgcaccacgccctacatgatcttcttcggccacggctatgcaagattgaccttgtcgctgtacgatccacattcttcagatttgggtgggcacctgacgaatcagttcatgcaaaagaagagtcccctctacatgttactgaaagagcacacggtatggtcgatggagcatttgaatagatacatatcagacacattctggaaagccagagggcttgccaaagactgggttttcacgaccctcaagaagagaatgcagcaaatcatggctcattgcttcctcgcagccaaacctaagctcgactgtaagctcggctactttgatctcatcgggtgcgactttctgatagacgacaacttcaaggtctggctgcttgagatgaatagcaatcctgcgctgcatactaactgtgaggtcctgaaagaagtaatccctggagtcgtcatagaaacactcgatttagtcctggaaacattccgaaagtcactgcgcggacaaaaaatgttaccattacttagccagcgccgctttgtactcctgcataatggcgaagccgacccccgtccccatcttgggggctcctgtagcttgcggagatggccacccctacctacgcgccaggcgaaatcatctgggcccccgatgcctcacgctccagatcagcccggggcacgccggcccgcaccccctcccctggtgccacagcgcccccggccaccagggcctgacctcgatagcgctcacgatggagaacctcaggccccaggaactgaacaatcaggtacaggcaatagacatcctgcgcaggaacccagtcctggaaccgccaaggaggagcgggaagaaccagagaatgccagaccttag

SEQ ID NO: 15621 - DNA, 2022 bp, Artificial Sequence
  Description of Artificial Sequence: Synthetic coding sequence
atggatcattcatgcacacgctttatccatagacgtggcccccctacgagaacaagggccgggttcaagcgcggcaagcgaccacggattcagcaacgccctagggccagagtcagcgggaccatccccgcgtctagactccaccccgcccctgcatcccagcctggcccctgccctgcccccggccattgtccggtcggtccagctcacgaacgtcccatgggctcatcccaggaggaaggcttacggtgtcagccgtcccagcctgaccacgacgcagatggccattgtggacccgacctggagggcgccgagagagctagtgcaacccctgggccgcctggtctgttgaatagtcaccggcctgccgatagcgacgacaccaatgccgccggccctagcgctgccctcctggaggggctgctgttggggggaggaaagccgtccccccactccactaggccaggtccgtttttctatattggaggttcaaacggcgccaccatcatcagctcatattgtaaatctaagggatggcagcgtattcatgactctcgaagagacgattacaccctgaaatggtgcgaggttaagtccagggattcttacgggtctttcagagagggagagcagctcctataccaactaccgaacaataagctgctgacaaccaagatcggtctgctgagcaccctgcgtggacgcgcccgggcaatgagcaaggcgagcaaggttcctggaggtgttcaagccagactggaaaaagatgctgcagcacccgccctggaagatctcccttggacaagccccggctatctccgcccacaacgggtcctccggatggaagagttctttcccgagacctaccggctggacctgaagcatgagagagaggcattcttcacgcttttcgatgaaacacagatctggatctgcaagccaaccgcttctaaccaaggtaaggggattttcctattgcggaatcaggaggaggtggccgcactccaggccaagacacgaagcatggaagacgatcctattcaccacaagacgccgttcagagggcctcaggctcgcgtagttcagagatacatacaaaatcccctgttagtagacggccgaaagtttgatgtgcgtagttatctcctaatcgcctgcacaacaccttacatgattttttttggccacggatacgcccggttgaccctaagcttgtacgatccccactctagcgatctgggtggccatctcactaatcagttcatgcagaagaaatcccctctatatatgttactgaaggaacatacggtgtggtcaatggagcatctgaatcggtacatttcagacactttctggaaagcccgaggcttggccaaagattgggtgttcaccaccctgaagaaaaggatgcagcagataatggctcactgtttcctcgctgcgaaacccaagttggactgtaaacttggctatttcgacctgataggctgcgactttctcattgacgacaacttcaaggtctggcttctcgaaatgaacagtaatcctgcactgcacactaattgcgaggttctgaaagaggtcattccaggcgtcgtgatcgaaaccctggatctggtgcttgaaacatttcgtaaaagcctgcggggtcagaagatgctcccactgcttagtcaacgacggttcgtgcttctgcataatggggaagcggacccacgtccccacctgggaggaagctgcagcctcagaagatggccaccacttccaactagacaggcgaagtcctcaggccccccgatgccccatgcaccagaccaaccaggggcccgccggcccgccccaccacccttagtgccacaaagaccacgtcctccgggtcccgatctcgacagcgcccacgatggggagccccaggcccccggcacggagcaatccggaaccggaaaccgccacccggcccaggagccctctccaggcactgccaaggaggaacgtgaggagcccgaaaatgcgcggccttag

SEQ ID NO: 15622 - DNA, 393 bp, Artificial Sequence
  Description of Artificial Sequence: Synthetic coding sequence
atgaccgaggattcacagcgaaactttcgctcagtgtactatgaaaaggtagggtttagaggcgtggaagaaaaaaagagcttagaaatcctcctgaaggacgatcgcctcgacaccgagaagttgtgcacattttcacaacggttcccattgccctccatgtacagggccttggtttggaaggtgctgttaggaatcctgccacctcaccatgaatcacatgccaaggtgatgatgtatcgcaaagagcagtatcttgacgtgctgcacgctctaaaggttgtgaggtttgtttccgatgctacacctcaggccgaagtgtatctgagaatgtatcaattagaaagcgggaagcttccccggagtccgtcttttcccctcgagcctgactag

SEQ ID NO: 15623 - DNA, 882 bp, Artificial Sequence
  Description of Artificial Sequence: Synthetic coding sequence
atgacggaagattcgcaacgtaattttcggagcgtgtattacgaaaaggtaggatttagaggtgtcgaggagaagaaatctctagagattctgctcaaagacgataggctagatacagagaagctgtgtaccttttctcagcgcttcccgctgcccagtatgtacagggccctggtgtggaaggtgttgcttgggatactgccccctcaccacgaatctcatgccaaggtaatgatgtatagaaaggaacagtatttagatgtccttcacgctctaaaagtggtgcgctttgtaagcgatgccactccacaggcagaagtttacctgaggatgtaccagctcgagtcgggtaaattgcccagaagtccaagtttccctctggaacctgacgatgaggtattcctggccatcgcaaaagccatggaggaaatggtagaggatagcgttgattgttactggatcacacgacgtttcgtgaatcaactgaacacaaagtacagagactctctcccccagctaccaaaagcatttgagcagtaccttaacctagaggacggcaggctcttgactcacctgcggatgtgttcagctgcacctaagctgccctacgacttgtggttcaaacgatgcttcgcaggatgcctgcccgaatcttcattacaacgggtctgggataaggtcgtttcaggcagctgcaagatcttggtattcgtagctgtggagatactgttaactttcaaaataaaagtgatggccctgaattctgccgagaagatcacaaaatttctagaaaatataccccaggactcctctgacgctatcgttagcaaagcaattgacctctggcataaacactgcggaactcccgtccatagctcctag

SEQ ID NO: 15624 - DNA, 801 bp, Artificial Sequence
  Description of Artificial Sequence: Synthetic coding sequence
atgacagaagactcacagagaaattttcgctcagtgtactatgagaaagtcggattccggggcgttgaggaaaaaaagtccctcgagatactgttgaaagatgatcggttaggtatactgcccccacaccatgaaagccacgcaaaagttatgatgtacagaaaagagcaatatcttgacgtgctgcacgctttaaaggtagtgaggtttgtatccgacgccacacctcaagccgaagtgtacttgcgcatgtaccagctggagtccgggaaacttcctagatctccatccttcccgctggaacccgatgatgaagtatttcttgccattgctaaggccatggaagaaatggtggaagattctgtggattgttattggataacaagacggttcgtcaaccagctaaacacaaaataccgcgacagcttgcctcagcttccgaaggcgtttgaacagtacctgaatctagaggacgggaggctcctgactcatctaaggatgtgttccgcagccccaaaactgccatatgacctttggttcaaacgatgttttgccggatgcctgccagagtcatcacttcagcgggtttgggataaagtagtgtctgggagctgcaagatactggtcttcgtggccgtggaaattctgctaaccttcaaaattaaggtcatggctcttaattcagcagagaagattaccaaatttctcgagaatataccacaggactcgtctgatgccatcgtcagtaaagctatcgatctttggcacaagcattgtggcaccccagtccactcttcctag

SEQ ID NO: 15625 - DNA, 3672 bp, Artificial Sequence
  Description of Artificial Sequence: Synthetic coding sequence
atgatgtccctgtccgtcagaccccaaagacggttactgtcggccagggtgaatcgatcgcagtcctttgcgggagtcctgggatcccatgagaggggtcctagcctgtcttttaggtcctttccagtcttctccccaccgggcccccccagaaaaccccccgctttgagccgggtatcccggatgttttccgtagcacacccagcggcaaaagtgccacagcccgagaggctcgatctcgtgtataccgccctgaagagaggactgactgcttatctcgaggtgcaccaacaagaacaagaaaagttgcagggacaaattagggaatctaagcggaacagtcgtctcggcttcttatatgacctggataaacaagtgaagtccatcgagagatttttgcgcaggttggaatttcatgccagtaaaatcgatgaactttatgaggcatactgtgtccagcggaggctccgcgatggtgcttataatatggtaagggcctacacgactggctcccccggttcacgagaggcccgggatagccttgctgaggccacccgaggccatagggagtataccgaatctatgtgcctgctggagagcgaattggaagcccagctgggcgaattccacctcaggatgaaaggactggctgggttcgcacgactgtgcgtcggcgatcagtacgaaatttgcatgaagtacggcaggcagagatggaaactaaggggacggatagaggggtccgggaaacaggtttgggacagtgaggaaaccattttcctgcctcttctcactgagtttcttagtatcaaagtgaccgaactgaaaggtctggcaaaccatgttgtggtggggagtgttagttgtgagactaaagacctgttcgctgccttgccccaggtagtggcagtggacatcaacgacctcggaactatcaaactctcgctggaggttacatggtccccctttgataaggatgaccagccatcagccgcttccagcgttaacaaagcatcgactgtcactaagcggtttagcacatacagccagagcccacctgataccccctccctacgggaacaagccttctataacatgctccgcagacaggaggaactggagaatggtacagcttggtcattaagttccgaatcctccgatgattcatcttctccccagctgagtggtactgcaagacattcaccagcaccacggccgcttgtgcagcagcccgaacccctgcctatacaggtagcttttcggaggccagagaccccctctagtggccccctcgatgaagagggcgctgtggctccagtcctggctaacgggcatgcaccgtattcccgtaccttatctcatatttccgaggctagcgtggacgcagcgctcgcagaagcgagtgttgaggcggttggtcctgagtcactggcctggggcccgtccccccctacacatcctgcaccgacgcacggcgagcacccatccccagtccctccagcactcgaccctggccattccgccaccagcagtaccctgggcactactgggtcagttcctactagtactgatccagctccctcggcacatctggacagcgtgcataagtcaaccgactcaggtccgagtgagctgcccggtcctactcacactaccactgggagtacatattcagccatcaccacgactcactctgcgccctctccactgactcatacgacgacgggcagcacacataagcccatcatctccacactcactactaccgggccaacgttgaacatcatcggccctgtgcagaccacaacgagccctacgcatactatgccatcccctacccacaccacagcctcccctacccacacttcaaccagccctacacatacacccacgagccctacccacaaaaccagcatgagtccacctacaacaacatctcccaccccatctggcatgggtctagtccagactgccacatccccaacccatcctactacttcccctacccaccctacaaccagtcccatactaatcaatgtcagcccctccacctcccttgaattagccaccttatctagcccgagtaaacattcagatccaaccttgccaggaaccgactccctgccgtgcagtccacctgtgagcaatagctatacccaggcagatccaatggcgcccagaacaccacaccctagccccgcccattcatcccggaaaccgctgacttctcccgcccccgacccaagcgagtctactgtgcaaagtctgtcccctacaccaagtcctccaacaccagctccccagcactcagacctgtgccttgcaatggcagtgcagactcccgtgcctaccgcagcaggaggatccggcgaccggtcactcgaagaggcgcttggtgcactcatggctgccctggacgactatagagggcagttccccgagctgcagggcctagaacaagaggtaacccggttggaatctctccttatgcaaaggcagggacttactagatcaagagcaagttcattgagtatcacagtcgagcacgctttggaatctttcagttttcttaacgaggatgaggacgaagataacgatgttccaggggacaggccaccttctagccctgaggccggcgccgaggattccatagactcgccctcagccagacctctgtccacagggtgtccagccttggacgcagcactggttagacacctgtatcactgtagcagattgctgctaaagttgggaacattcggacctctgagatgtcaggaagcgtgggcacttgagcggctactgcgagaagcgagggtgttggaagcggtatgtgagtttagcagaaggtgggagatccccgcatcttccgctcaggaggtggttcagttttcagcgtctagacccgggtttttaacattttgggaccagtgcacagagaggcttagctgctttctctgccctgtggagagggttctgctcacattttgcaatcagtacggtgcccgcctctccctccggcagccagggttagcagaagccgtgtgcgtgaagttcctcgaagacgctctcggtcagaagctcccgcggagaccacaacctggcccaggggagcagctgactgtgtttcagttctggtctttcgtggagaccttagatagccctacaatggaagcctacgtgaccgagaccgctgaagaagtgctactggtgagaaacctcaattcggatgaccaagctgtcgtgctgaaggcgttgcgtctggcgccagagggccgcttgcggagagacggactacgggcgttgagcagcctgctcgttcacggcaataacaaggtgatggccgccgtgtcaacccagctacggagtctaagtctggggcctaccttccgggagcgggccctcctgtgcttccttgaccagctggaggatgaagacgtccagacgcgtgtggcggggtgtctggcactcggctgcataaaagctcccgaggggattgaacctctggtgtacctctgtcaaactgacacggaggctgtacgtgaggccgccaggcaaagcttgcagcaatgtggggaggagggccagtcagcccataggaggcttgaagaaagccttgacgctttgccccgcatattcggccctggatctatggcttcgacagctttttag

SEQ ID NO: 15626 - DNA, 123 bp, Artificial Sequence
  Description of Artificial Sequence: Synthetic coding sequence
atggccgacgaggagctcgaggctctgcgtcggcagagactcgccgagttacaagctaagcatggagacccaggcgatgctgctcagcaggaggcaaagcactcctcgacagaggagaaatag

SEQ ID NO: 15627 - DNA, 414 bp, Artificial Sequence
  Description of Artificial Sequence: Synthetic coding sequence
atgaagccacccgctgcccagggaagccccgcagctgcagcagctgcggcaccagcactggattccgctgccgctgaggatctgtcggatgcgctctgcgagttcgatgccgtgctggcagattttgctagccctttccatgagcgccactttcactacgaagagcacctcgaacgaatgaaaagacgcagtagcgcctcagtaagcgatagttccggcttttctgattctgaaagtgctgactctctgtatagaaacagtttcagcttttcagatgagaagctcaattcacctacagacagcacgcctgctctcctgtcggcgacagttacgccacagaaagccaaactgggcgatacaaaagagctggaggctttcatagccgacctggataaaactcttgctagtatgtag

SEQ ID NO: 15628 - DNA, 1593 bp, Artificial Sequence
  Description of Artificial Sequence: Synthetic coding sequence
atgcctaacgttctattgcccccgaaggagtccaacctgtttaagaggattctcaaatgctatgagcagaaacagtataaaaatggccttaagttctgcaagatgatcctttcaaatccaaagttcgccgagcacggagaaacgctcgcaatgaaaggactaacattaaactgcctcggcaaaaaagaagaagcgtacgagtttgtaagaaagggcctcagaaatgatgttaagtcccatgtctgttggcatgtctatggtctacttcagcggtccgataaaaagtacgatgaggcaataaagtgttaccggaatgcgcttaagttggacaaggataatcttcagatcttacgggatttaagtctcctgcaaatacagatgagagatcttgagggttaccgggagacaagataccaactactgcaactccgcccaacacagagggcgtcatggatcgggtacgccatcgcctaccacctgttgaaggattacgacatggccttgaagctactagaggagttccgccagacacaacaagtcccccctaataaaatagactacgagtatagcgaattgattctctatcagaaccaagtgatgcgtgaagccgacctcctacaggaaagtctggagcacatcgagatgtatgaaaagcagatttgcgacaagctgctggtcgaagagatcaagggcgaaatactcctgaagctggggcggttaaaggaagcttcagaggtctttaaaaatttaattgatcgaaatgccgagaactggtgctattacgagggactggagaaagccttacagatttcaactttagaggaacgcctacagatctacgaagagatctccaagcagcaccccaaggccattacaccacgaaggctgcctctaactttggtgccaggagaaagattccgagaattgatggacaagtttctgcgcgtgaattttagtaagggctgtccacctctgttcactactctgaaaagcttgtactataacacagaaaaggtcagtatcatccaagagctagtgacaaactatgaggcaagcctgaagacgtgtgacttcttcagtccctacgaaaatggtgaaaaagaaccaccaactaccttgctgtgggtgcagtattttcttgcacaacactttgacaagctcggacaatattcattagcactcgactacataaacgcggcaatcgcatctacgccgactctgatcgaacttttctacatgaaggctaaaatttataagcatatcggaaacctcaaagaggctgcaaagtggatggacgaggctcagagtctcgatactgcggaccggttcataaactcaaagtgtgctaaatacatgctgcgcgctaacatgattaaagaagccgaggagatgtgctcaaagtttacacgcgaagggacgtccgccatggagaatctcaacgagatgcagtgtatgtggtttcagaccgagtgtatctcagcttaccaaaggcttggtaggtacggcgacgctttgaagaaatgccatgaggtggaacgccactcaccatccacctggacaaccggcggaaaagagccgcagatgcacccatag

SEQ ID NO: 15629 - DNA, 2595 bp, Artificial Sequence
  Description of Artificial Sequence: Synthetic coding sequence
atgcccaatgtgctgctgcccccaaaggagtcgaatttgttcaagcgcatcttaaagtgttatgaacagaaacaatataagaacgggctgaagttctgtaagatgatcttatccaatcctaaatttgcggagcatggtgagacactggcgatgaaggggctcacattaaattgtttagggaaaaaagaggaggcctacgagttcgtgagaaaagggctccgcaacgatgtgaagtcacacgtgtgctggcacgtttatgggttgctccagcgctctgacaaaaagtacgatgaagccatcaagtgctacagaaatgccctgaaactggataaagataacctgcagattcttcgcgacctctcactcctccagatccagatgagagatcttgagggatacagagaaacaaggtaccagctgctccagctgaggcccacacagcgggcctcttggattggctacgccattgcttaccacctgctgaaggactacgacatggccctcaagctgctggaggagtttcgacagactcagcaggttccaccaaataaaatcgactacgagtattcagaacttatcctgtaccagaaccaggttatgcgagaagccgacctcctccaagaaagcctggagcacatcgaaatgtatgaaaaacagatttgcgacaaactgctcgtcgaagaaatcaaaggggagatcctgctgaagctcggcagacttaaggaggccagcgaagttttcaagaatttgattgacaggaacgctgagaactggtgttattacgagggcctggaaaaagcgcttcaaattagcaccctggaggaacgcttgcagatctacgaagagataagtaagcagcatcccaaagctatcacacccaggcgtcttcccctgactctggtcccaggtgagaggttccgcgaacttatggataaattccttagggttaacttctctaaaggatgcccccctctgttcactacactaaagagcttgtattacaataccgagaaggttagtattatccaggagctggttacgaactacgaggctagtctcaagacttgcgacttcttctccccatatgaaaacggagagaaggagcctcctactactttactctgggtgcaatattttttggcccagcacttcgataagctggggcaatatagcctcgcactggattacattaatgctgccatcgctagcacgcccacgctgatcgagttgttctacatgaaggcgaaaatttataagcatatcggtaacctcaaggaggctgccaagtggatggatgaagcgcaaagcttagacaccgccgatagatttattaattctaagtgcgcaaagtacatgctgagagccaacatgatcaaggaggctgaagagatgtgctccaagttcacgcgtgaaggaacctccgcgatggaaaatctgaacgaaatgcagtgtatgtggttccaaaccgaatgtatttcagcttaccagaggctgggcaggtacggtgacgccctgaaaaaatgccacgaagtggagagacactttttcgagattaccgatgaccagtttgacttccacacatactgtatgaggaaaatgaccctccgggcctacgtcgacctgctaaggctcgaggatatccttaggagacacgctttttacttcaaggcggccagatctgccattgagatttacctgaaattatacgacaatcccctgactaacgagtccaagcaacaggaaataaactctgaaaacctcagtgcaaaggagcttaaaaagatgttatcaaaacagagaagggcgcagaagaaagccaagctagaagaagaacgcaagcacgctgaaagggaacgtcagcagaaaaaccaaaaaaaaaagcgagacgaggaggaggaagaggcctccggcctgaaggaagaactgatccccgagaagttggagcgggttgagaatcctttggaggaggccgtaaaatttctgatccccctgaaaaacctggtagccgataacatcgacacccaccttctcgctttcgaaatctatttccgcaaagggaaattccttctgatgcttcaatcggtgaagcgggcattcgccatcaatagcaacaatccatggttacatgaatgtctcatccggtttagcaagagcgtgtctaatcacagcaatctacccgacatcgtgagtaaggtgctgtcacaggagatgcagaaaatatttgtcaagaaagacctggaaagcttcaatgaggactttctgaagaggaacgccacgagtctgcaacacctgctgagcggcgccaagatgatgtacttcttggacaagagcagacaggaaaaagcgattgcgatcgcaacacgtctggatgaaacaattaaggacaaagacgtcaaaacacttatcaaggtcagcgaggctctgctcgacggctcgttcgggaactgctccagccagtatgaggaatatcgcatggcgtgtcataatctgctaccgttcacctctgcatttctgcctgccgtgaatgaggtggacaatcccaacgtcgccctgaatcataccgccaactacgacgtgctggcaaatgagatttag

SEQ ID NO: 15630 - DNA, 1668 bp, Artificial Sequence
  Description of Artificial Sequence: Synthetic coding sequence
atgcagtcctgcgaaagctctggcgactctgccgatgatccgctgtctcgtggactgcgcagacgaggccagccccgagtagtcgtgattggggcagggctggcagggctcgctgcagccaaagccctcttggaacaagggttcacagatgtgacagttttggaagcaagcagtcatattggtggacgcgtgcaaagcgttaagttgggccacgccacttttgagctgggggcgacatggatccacggttcacatgggaacccaatctatcatctagctgaagccaacggcctcctggaggagactacagatggagaaaggtctgtaggacgcatctcgttgtatagcaaaaacggtgtggcatgttacttgactaaccacggccgcagaattcctaaggacgtcgtcgaagagtttagtgacttgtataatgaggtgtataatttgacccaggaattcttccgccacgacaaacccgtgaacgccgaaagccagaattcagtgggcgtgttcacacgcgaggaagtgcggaaccgaataaggaacgaccccgatgatccggaggcgaccaagaggcttaaactggctatgatccagcaatatctgaaagtggaaagttgtgagtctagctcccattctatggacgaggtgtcactgagcgcttttggggaatggactgaaatacctggagctcaccatataatccccagtggtttcatgagggtggtagagctacttgcagaggggatcccagctcacgtgattcagctgggaaagccagttcgctgtatccactgggaccaggcctcggcgcgacccagagggcccgaaatcgaaccacggggtgagggcgaccacaaccatgacactggcgagggcgggcagggcggggaagaaccaaggggcggaaggtgggacgaagatgagcagtggtcagtcgtggttgagtgtgaagattgcgagctgatccctgccgatcacgtgatcgtaacagtatctttgggagtcttgaagagacagtacacatccttctttaggccaggactgcccactgaaaaagtagcggccattcataggttgggcatagggaccacagataagattttccttgaatttgaggaaccgttttggggcccggaatgcaacagcctccagtttgtgtgggaggacgaggccgagtcccacaccctgacctatcccccagaactgtggtacaggaaaatctgtgggtttgacgtgttgtacccccctgagagatacgggcatgtgctctcaggttggatctgcggggaagaggcccttgtgatggaaaagtgcgacgatgaggcagttgctgaaatttgtaccgagatgttaaggcaattcaccgggaacccgaacattccaaaacctagacggatcctgagatcagcctgggggtcaaatccatactttagggggagttactcttacactcaagtcgggagctctggcgccgatgtagaaaagcttgccaaaccactgccatacacagagagttccaaaaccgcgcccatgcaagtgcttttttctggagaggccacccacagaaagtactattcaacaacccatggggcccttctcagcggccagagagaagcggccaggttaattgagatgtacagagacctcttccagcaaggcacttag

SEQ ID NO: 15631 - DNA, 630 bp, Artificial Sequence
  Description of Artificial Sequence: Synthetic coding sequence
atggccccggtcggcgtcgaaaagaagcttttgctcgggcctaatggaccagcagtggcagctgcaggagacttaacgagtgaagaggaggaggggcagagcttatggtcctcgatcctgagcgaggtatctacccgggctcggagcaagctcccatcaggcaaaaacattctggtgttcggcgaggacggcagcggcaagacgaccttaatgaccaagcttcagggtgcagaacatggcaagaagggcaggggcctcgaatatctgtatctctctgtgcacgacgaagatcgggatgatcatactagatgcaacgtgtggatactcgacggagacctctatcacaagggcttgctgaagttcgctgtgtccgctgagtcattacccgagacccttgtcatttttgtggccgatatgtcccgaccatggactgtgatggagagcctccagaaatgggcttcagttctgagggaacacatagataagatgaagatccctccggaaaaaatgcgcgagctcgaaaggaaattcgtgaaagactttcaagattacatggaaccagaagagggatgtcaggaagggcccttgagtaacagagttgagcagatgcggccccgaaaccattggtag

SEQ ID NO: 15632 - DNA, 858 bp, Artificial Sequence
  Description of Artificial Sequence: Synthetic coding sequence
aattggaatctggcgtcttggaatccttcaaaccccgagtgtctgttactcgtggtcaaggagctggtgcagcagtatcaccaatttcagtgttcgaggctgcgcgagagctcccgtctcatgttcgaataccaaacccttttagaggagcctcagtacggtgaaaacatggagatttacgcagggaagaagaacaattggactggggagtttagtgcgcggttcctgctcaaactaccagtagactttagcaacatcccaacatatctactgaaggatgtcaacgaggatcccggagaggatgtggcccttctgtcagtgagttttgaggataccgaagctacccaggtctatcctaagctgtacctgtcgccccgtattgagcatgcactcgggggcagtagtgcactgcacatcccggcctttcccgggggcggatgcttaatagattacgtgccccaggtttgtcatcttctaactaacaaagtgcagtatgtcatacagggttatcacaagcggcgggagtacatcgctgcattcttgagccatttcggtactggggtggtggaatatgacgcagaaggcttcactaagttaactctcctgttaatgtggaaggacttctgctttcttgtacacatcgatctcccccttttctttccgcgcgatcagccgaccttgacctttcagagtgtttaccacttcactaacagtggccagctttatagtcaggcccagaagaactacccctacagcccccggtgggacgggaatgagatggccaaacgagctaaggcctatttcaagacattcgtgcctcaattccaggaggcagccttcgcgaatggaaagctctag

SEQ ID NO: 15633 - DNA, 1152 bp, Artificial Sequence
  Description of Artificial Sequence: Synthetic coding sequence
atgtcccctgaagttgccttgaatcgcatctcgcctatgttatctccctttattagttccgtagtaagaaacggcaaggtaggacttgacgccacaaattgtttgaggatcactgatctgaagagtgggtgtacttctctgacccccggccctaattgcgacaggttcaagttacacataccgtacgctggcgaaactctgaaatgggatattattttcaatgcccagtatccagagctgcctcctgactttattttcggagaggacgctgaatttctgcccgatccctccgctcttcaaaatttggctagttggaacccaagcaaccccgagtgcttgctgttagttgtaaaggagctagtgcaacagtaccaccagtttcagtgttcccggctgagggagtcttcaaggctcatgttcgagtaccaaactcttctggaggagccccagtacggggagaacatggaaatttacgcaggcaagaagaataactggacaggggagttctccgcacggtttctgctcaaactgcctgtcgatttcagtaatataccaacttaccttcttaaggacgtgaacgaggacccgggcgaagatgtcgctttgctgtctgtgagctttgaggatactgaagctactcaggtgtatcccaagctttacctttcgccccgcatcgagcatgctctgggggggtctagtgccttgcatattccggcgttccctggagggggctgtctgattgactacgtcccccaggtctgtcatctgctgaccaataaagtgcagtacgtcatccaggggtaccataagaggagggaatacatcgcagcgtttctgtctcacttcgggaccggggttgtggaatatgacgctgaggggttcacaaagttaacactgctccttatgtggaaggatttctgtttcctcgttcacattgatcttccactattcttcccgagggatcagccaaccctgacttttcagagtgtttatcatttcactaactctgggcagctctactcacaagcccagaagaactacccttacagtccaagatgggacggtaacgagatggccaagcgggctaaggcatacttcaaaactttcgttccacagtttcaggaagccgccttcgcaaacgggaaactgtag

SEQ ID NO: 15634 - DNA, 1131 bp, Artificial Sequence
  Description of Artificial Sequence: Synthetic coding sequence
atgagccccgaggtggccctgaatcgcattagtcccatgctgtcaccgttcattagttctgtggtgcgcaatggtaaggtcgggctcgatgccactaattgcctgcgcatcaccgacctgaagtctgggtgtaccagtctgacccccggaccaaattgcgatcgcttcaagcttcatataccatatgctggggagactctcaagtgggacattatatttaacgctcagtatccagagctgccgcccgattttatcttcggcgaggatgccgaatttttgcctgacccttcagcactccaaaatttggcttcttggaatcccagtaaccccgagtgcctccttctagtagtcaaggagctagtgcagcaatatcaccagtttcaatgctcccgtctacgagaatcctcacgattgatgtttgagtatcagacgctcctggaggaaccccagtacggggagaacatggagatttacgccgggaagaagaacaactggacgggggagttctctgctcgttttcttctgaaactgccggtggacttttctaacatcccgacatacctgcttaaggacgtgaacgaggatcccggcgaagacgttgccctcctatcggtatcatttgaagacaccgaagcgacccaggtgtaccctaagctgtatctctcaccacggatcgaacacgctcttggtgggagtagtgctctccatatccccgctttccccggcggcgggtgcctgatagattacgtccctcaggtgtgtcacctactcactaataaggtgcagtatgtgattcagggttaccacaagcggagagaatacatagctgcatttctgtctcatttcggcactggggtcgttgaatatgatgccgaaggcttcacaaaactgacccttctcttgatgtggaaagatttttgcttcctcgtgcacatcgacctgccattattctttcctcgcgaccaaccgacactgacattccagagtgtctaccacttcacaaactccgggcagctttacagccaggcccaaaaaaactacccctacagtcctaggtgggacggaaatgaaatggcaaaaagagcaaaacgagaatccaatagagacggcgaagaatcaagctctgcctag

SEQ ID NO: 15635 - DNA, 312 bp, Artificial Sequence
  Description of Artificial Sequence: Synthetic coding sequence
atgatccgggctttcccaacaacaacccccaggtcactgcacctttttacatccagtacattcctcgctcgtgcacttcccggagccttccccaccggcgcctgcgaggagcgcctgagcgtaccagagtcgacgccctttacggctgtgctcaagttcgcagccgaagaattcaaggtgccggcagccacttctgcaattattacaaatgacggcataggcatcaatccagcacaaacagctgggaacgtgttccttaaacatggttcagagttgagaattattcctcgagatcgcgtgggcagttgctag

SEQ ID NO: 15636 - DNA, 1968 bp, Artificial Sequence
  Description of Artificial Sequence: Synthetic coding sequence
atggctactccagtggtgactaaaacagcgtggaagcttcaggaaattgtcgctcacgccagtaacgtatctagccttgtcctgggaaaagcctctggcaggctgttagcaacagggggagacgattgccgagtgaatctgtggtctattaacaagcccaattgtattatgagcctcacaggtcacacgtcgccggtggagtcggtacgcctgaacaccccagaagagctgatagtggctggtagccagtccggcagcatccgggtatgggaccttgaggccgccaaaattctgagaaccctgatggggcacaaggcaaatatatgctctctggatttccatccctacggggagttcgtcgcctccgggagccaggacaccaacattaagctgtgggatattcgccgcaagggctgcgtgtttcggtaccggggacactctcaggccgtgcgttgtcttcggtttagccccgacgggaagtggctggcatctgccgcagacgatcacacagtcaaactgtgggacttaaccgccggaaaaatgatgagtgaattcccggggcacacaggtccagttaatgtcgtagaattccaccccaacgagtaccttctggcgtcagggtcctccgacagaaccatcagattttgggatctcgagaaattccaggtagtgagttgcattgagggcgagccggggcctgtcaggtccgtgctttttaatcccgatggttgttgcctttacagcggctgtcaggattccctcagagtgtacggttgggaaccggagcggtgtttcgacgtcgttctggtcaactgggggaaagtggccgatttagccatctgtaatgatcagctcatcggagtggcattctcgcagagcaacgtctccagctacgtagtggaccttaccagagttacacggactggcacagtggcaagggacccggttcaggatcacaggcctctcgctcagccacttccgaacccctcagctccccttcgccggatctacgaacgcccatccaccacttgtagcaagccacagagggtcaaacaaaactcagagtccgagaggaggagcccaagttcggaggatgatcgggatgagcgggagagtcgagccgaaatccagaatgccgaagactacaatgaaatctttcagcccaaaaactcgatttccagaactccacctagacggtctgagcccttccctgcccctcctgaggacgacgctgctactgctaaggaggccgccaaaccgagtcccgccatggacgtgcaatttccagtgccaaatctggaggttctgccgaggcccccggtcgttgcttcgacaccagcgccgaaggcagaacctgccatcatcccggcaacaaggaacgagcctatagggctaaaggcatccgatttcctgccggctgtcaaaattccccagcaggcggagctggtcgacgaggatgccatgagccaaatccgtaagggacacgacacaatgtgtgttgttctaacttctcgtcataaaaatctggatacagtgagagctgtctggactatgggagatataaaaacctcagtggacagtgctgtggcgatcaatgacttaagtgttgtcgtggatctgctcaatattgtgaatcagaaggcctctctttggaaactcgacctgtgtacgacggtcctcccacagatagaaaagctcctgcagtctaagtacgagtcctatgtgcagacaggctgcacttccctcaaactgatcctccagaggtttctgccccttatcactgacatgctggctgcccctccttcagtcggggtcgacatatctagggaagagaggctgcacaaatgtcggctctgttacaagcagttgaagtcaatcagcggcctcgtaaagtccaagtccgggttaagtgggagacatggctctaccttccgggaactgcacctgttaatggcctcgcttgactag

SEQ ID NO: 15637 - DNA, 165 bp, Artificial Sequence
  Description of Artificial Sequence: Synthetic coding sequence
atgtttttgtctgcagtcttctttgccaagagcaagagcaacgagacaaagtcaccccttcgaggcaaagagaagaatacactgcccctcaacgggggactgaagatgaccctcatatataaagagaagacagaagggggggatacagacagtgaaatcctctag

SEQ ID NO: 15638 - DNA, 2457 bp, Artificial Sequence
  Description of Artificial Sequence: Synthetic coding sequence
atgaagaagcagttcaataggatgagacagttggcaaaccagaccgttggcagagctgaaaaaacagaggtgctttcagaagacctcctgcaggtggaaaagcgtctcgaattggtcaaacaggtaagtcactctacacataagaagttgaccgcctgcttacaaggacagcaaggagcagaggccgataagcgctctaagaaactgccattgacaacgctagctcaatgtctaatggaaggctctgcaatactgggcgacgatactcttttgggaaagatgcttaagctgtgtggcgagactgaggataaattggcacaggaactgatccatttcgagctccaggtggagcgggacgttattgaaccccttttcttgctagccgaagttgagattcctaacatccagaaacagcgcaaacatctggcaaagctcgtgctggacatggatagctcacgcactcgttggcagcaaacctctaagtcaagcgggttgtctagctcgctacagcctgcaggagccaaggccgacgcactccgtgaagagatggaagaggctgctaacagggtggagatttgtagagatcagctgtctgccgatatgtattctttcgtagccaaggagatagattacgcgaattacttccagaccctgatagaggtgcaggcagaataccaccgcaagagtctgaccctgctccaagccgtcctgcctcaaatcaaagcccaacaagaggcctgggtggaaaaaccatcctttggcaagccccttgaagaacacctgaccatctccgggagggagatcgcttttcccatcgaagcttgtgttacaatgctcctggagtgcgggatgcaagaggaagggctctttagagtcgctcccagtgcctctaaactgaaaaagctgaaggctgcccttgactgctgcgtcgtggacgtgcaggagtattctgcggatccccatgctatcgctggcgccctgaagtcttatctccgggagctgccagaacccctgatgacatttgagctttatgacgagtggatccaggccagcaacgttcaggaacaggacaagaagctgcaggcgctgtggaatgcctgtgaaaagcttcctaaagccaaccataacaatatcagatacctaatcaagttcctttctaaactcagtgagtaccaggacgtgaacaagatgactccctccaatatggctattgtcctgggtcccaatctgttgtggccacaggcagagggtaacatcaccgagatgatgacaacagtgtctttgcaaatcgtcggaatcatagagcccatcatccagcacgccgattggttttttccaggcgaaatcgaattcaacatcacaggcaattatggaagccccgtacacgtaaaccacaacgccaattactctagcatgccgtctcctgacatggatccagccgatcgaaggcagcctgagcaagctcgccggccgctgagcgtggctacagataatatgatgttagagttctataaaaaggatgggcttagaaagattcaatctatgggggtacgagtaatggataccaattgggtggccagacgtgggagcagcgcaggacgcaaagtttcctgcgcgcctccctcgatgcaaccgcccgcccctcccgccgaactagcggccccactcccgagccccctgcctgagcagcctctcgattctcctgccgcaccagcactgagtccatccggtctcgggctgcagcctggcccggagcgcacaagcactacgaagagcaaagagttatctccgggatccgcacagaaaggatcccccggctctagccaaggtacagcctgcgccggcacacagccaggcgctcaaccaggggcacaacccggcgccagcccatcaccctctcaacctcctgctgatcaatccccccacaccttgcgtaaggtgtccaaaaagttagccccaataccgcctaaagtgccattcggccagccaggggctatggccgaccagtcggccggccagcccagtcccgtgagtctaagcccgacacccccctctacaccatcaccatacggactgagctaccctcaagggtactcactggcgtccggccaactgagtcccgcagccgcgcctccactggcatcaccgagcgtcttcactagcacattgtctaagagtaggcccacgcccaagcctagacagcgtcctaccctgccgcctccccagccacccaccgtcaatctgtccgctagctctccccaaagcaccgaggctccaatgttggacggaatgtcccccggcgagtccatgtccaccgatctcgtgcatttcgacatccctagcatacacatcgaacttggcagcaccctgagattgagccctctggagcatatgcggaggcattcagtgacggataagagagatagtgaggaggaaagcgaaagcacggcactgtag

SEQ ID NO: 15639 - DNA, 1014 bp, Artificial Sequence
  Description of Artificial Sequence: Synthetic coding sequence
atgaccaacaatagtgggtctaaagcggaattggttgtcggaggcaagtacaagctcgtgcgtaagattggttcaggctccttcggcgatgtgtatctcggcataaccacaaccaacggcgaggacgtagctgtcaagcttgaaagccagaaggtgaaacatcctcagctattgtatgagtcgaagctctacaccattctgcaaggcggagtcggcattccccacatgcactggtatggtcaagagaaggataataatgtactagtcatggacttgctgggaccatcgctggaggacctgttcaatttctgctccagaagattcactatgaaaacagttctgatgctggccgaccagatgatttcgcgcatagagtatgtgcacacgaagaacttcctgcacagggatatcaagccagataattttctgatgggaaccggacggcactgcaataagctgttcttgatcgatttcggcctcgctaagaagtacagagataatcgcactcgccagcatattccttatagagaagacaaacatctcatcggaacggtgcgttacgctagcattaacgctcacctggggatcgagcagtctaggcgagatgacatggaaagcttaggttatgtgttcatgtactttaaccgcacatccttaccctggcaggggttgagagccatgacgaagaagcagaaatacgaaaagataagtgaaaaaaaaatgtcgacccctgtggaggtgctctgcaaggggttcccggcagaattcgcaatgtacctcaattattgccgtggtcttcgtttcgaggaggttcccgactatatgtatctcagacagctcttccggattcttttccggacactcaaccatcaatatgactatacatttgactggactatgctgaagcaaaaggccgcacaacaggctgcttcttccagcgggcaaggccagcaagcacagacacagacagggaaacagacagaaaaaaataaaaataacgtcaaggataattag

SEQ ID NO: 15640 - DNA, 1608 bp, Artificial Sequence
  Description of Artificial Sequence: Synthetic coding sequence
atgtcagaaggagagtcccagacggtgctatcttccggctctgaccccaaggtggagtccagctcatccgcccctggacttactagcgttagcccaccggtgacctccactacttcggccgccagtccagaggaagaagaggaatccgaggacgagtccgaaattctagaggaatccccatgtgggagatggcagaagcgcagagaagaagtgaaccaacggaacgtgccaggtatcgactcggcttacctagctatggatactgaggaaggcgtggaggttgtgtggaacgaagtccagtttagcgagaggaagaattataagttgcaagaggagaaggtgagagctgtcttcgacaacttaatacagctggagcaccttaatatcgtcaagtttcataagtattgggctgacataaaagagaacaaggccagagtgatattcatcacagaatacatgtcttcaggttccctgaaacagtttcttaagaagaccaagaagaaccataagaccatgaatgagaaagcatggaagcgatggtgcacacaaatcctctcggccctctcatacctccattcctgcgatccaccgatcattcacggtaatctaacttgtgacaccatttttatccagcacaatggcctgatcaaaattggatcagtggctcccgacaccatcaacaatcatgtgaaaacatgtagagaagaacagaagaatctgcacttctttgccccggagtacggagaggtcacaaatgtgaccaccgcagtcgatatttatagtttcggcatgtgtgccttggaaatggccgtcctggaaattcagggaaatggggagagcagctatgtgccacaagaagcgattagctccgcgatacagctgctggaggaccccttgcaaagggagttcatccagaagtgccttcagtctgagcctgcaagacgcccaaccgcccgtgaactactcttccacccagccctttttgaggtccctagcctaaaactgctggccgctcactgcattgttggtcaccaacatatgatccctgaaaacgcactggaagaaatcaccaaaaacatggacacatcggcagttctggcagaaatcccagcggggcctgggagggagcctgtgcagacactgtattcccagtcccctgcgctcgaacttgacaaattcctcgaggacgtcagaaacgggatctacccactgacagcctttggactcccccgccctcagcagccacaacaggaagaggtgacatccccagtggtcccacccagcgtgaagacacccacccccgaacccgccgaggttgaaacccgcaaagtcgtactgatgcagtgcaacatagagagtgttgaagagggcgtgaaacaccatctgacactgctgctaaagctcgaggacaaactgaatcgccatctgtcttgcgatctcatgccaaatgaaaacattccagaactcgccgcggagctggtccagctgggctttatctcggaggctgaccaatcacggcttacctctctgcttgaagaaactctcaacaaattcaactttgcccggaattcaaccctgaattctgctgcagtgactgtgtcctcttag

SEQ ID NO: 15641 - DNA, 2169 bp, Artificial Sequence
  Description of Artificial Sequence: Synthetic coding sequence
atggagacaagcgatatccagatcttttatcaggaggatccagaatgtcaaaacctgtccgagaactcgtgtcctcctagcgaggttagcgacaccaatctttacagccctttcaagccaagaaactaccagctggaattagcccttccagcgatgaaggggaagaatactattatttgcgcacctacgggttgcggcaaaacttttgtgtcgctgctcatctgcgaacaccaccttaaaaagttcccccagggccagaagggaaaggtcgtcttcttcgccaaccagatcccggtgtacgaacaacagaagtcagtgtttagtaaatattttgagcggcatgggtacagagtcactggaatctcaggtgccacggcggagaacgttcccgttgaacaaattgtggagaacaatgacataatcattctgacccctcagatcttagtcaataacctaaaaaagggaacaatcccatccttaagtatcttcactttgatgatattcgacgaatgccataatacgtcaaagcagcacccatataacatgatcatgttcaattatctcgatcagaagcttggggggagcagtggacctctgccacaggtaataggtctgactgcatctgtgggtgtgggggatgccaagaacacagacgaagccttggattacatctgcaaactctgtgcgtccctcgacgcgtctgtgatcgctacagtcaagcacaatctcgaagagctggagcaagtcgtgtacaagccccaaaaattcttcagaaaggtcgaatctagaatctctgacaaattcaaatatatcatcgcccagctgatgagggataccgagtccctagccaaaagaatatgcaaagacctggagaatctctcccagattcagaatcgagagttcggcacccaaaaatacgagcagtggattgtcacagtccagaaagcctgtatggtgtttcagatgccagataaggatgaggagtccagaatatgcaaagcactcttcctgtatacaagccacctccggaaatataacgatgccctgatcattagcgagcacgctcgaatgaaggacgcgctcgactacttgaaagacttttttagcaatgtccgagcagccggcttcgatgaaattgagcaggatctgacccagcggttcgaagagaagctgcaggaactggaatccgtaagtcgagacccaagcaacgagaaccccaagcttgaagacctgtgtttcatattacaggaagagtaccacctaaaccccgagacgatcacaatcctcttcgtgaaaaccagagccctcgtcgacgcacttaagaattggattgagggcaaccctaaactttcattcttaaaacctggcatcctgactggtagggggaagactaatcagaacaccggaatgaccctgccggcacagaagtgcatcctagacgctttcaaggcctcaggtgatcataacattcttatagctacgtcagtggctgacgagggaatcgatatcgcccagtgcaacctggttatcctgtatgagtacgtgggaaatgtgatcaaaatgatccagaccagaggccgggggagggctcgaggtagcaaatgtttccttctaacgtcaaacgccggagttatagaaaaagagcaaattaatatgtacaaggaaaaaatgatgaatgatagcatactgagactgcagacatgggatgaagcagttttccgcgaaaagatcctccacattcagacacacgagaaatttatcagggatagccaagaaaaacctaaaccagtgccggacaaggaaaataagaagctcttgtgccgcaaatgtaaggccctcgcctgttacaccgccgatgtgagagttatcgaggagtgtcactacactgtgttaggcgatgcatttaaagaatgctttgtcagtcggccacaccctaagcccaagcagttttcctccttcgagaagagggctaagattttctgtgctaggcagaactgctcacatgattggggaatccacgtgaagtacaagactttcgagattcctgtcatcaagatcgaatcgtttgtagtcgaggacattgctaccggggtgcagaccctgtattccaagtggaaagatttccactttgagaagatcccatttgatcctgcagagatgagcaagtag

SEQ ID NO: 15642 - DNA, 2643 bp, Artificial Sequence
  Description of Artificial Sequence: Synthetic coding sequence
atgaccacagagcaaagacgatctctgcaggcattccaggattatattcggaagaccctagatccaacatatatcctaagctacatggctccatggttccgtgaggggtactcaggcctttacgaagccatcgaatcttgggactttaagaaaatagagaagctggaggagtaccgattgctgctgaagcgtctgcagccagaattcaagaccagaatcatccctactgacatcatctctgatttaagcgagtgtctgattaatcaggagtgcgaggagattcttcagatctgttctactaaagggatgatggctggtgctgaaaagcttgttgagtgtctccttagaagtgacaaagagaattggcctaagaccctgaagttagcactagagaaggaacgaaacaaattctcggagttgtggatagtggaaaagggtatcaaagatgtggagacagaggacctggaagacaaaatggagacttctgacattcagatcttctaccaggaggaccctgaatgccagaatttgtcggaaaattcatgtccaccatccgaagtttctgacactaatctgtatagcccgttcaaaccccggaactatcagctcgagctcgcactcccagcaatgaagggaaagaacacaattatttgcgcacctaccggttgcgggaaaacatttgtcagtctgctgatttgtgagcaccacctcaagaagttcccccagggacaaaagggtaaggttgtgttcttcgctaaccagattcctgtgtacgagcagcagaagtcggtcttctcaaaatatttcgagcggcatggctatagggtcacaggcatctcaggcgccaccgctgaaaatgtgcctgtggagcagattgttgaaaacaatgacattattattcttaccccccagattctggtaaacaaccttaaaaagggaaccataccatcgctgagcatttttacattgatgatcttcgacgagtgccacaatacaagcaagcaacatccctacaatatgataatgtttaattatcttgaccagaagttgggaggaagcagcggcccactaccccaggtgatcgggctgaccgcgtccgtgggcgttggggatgccaagaataccgatgaggccttagactatatctgtaagctatgtgcttcattggatgcgagcgtgattgcaacagtcaagcataatctagaggagctggagcaagtcgtgtacaagccgcaaaaatttttccgtaaagtagagagcaggatttcagataagttcaaatatataattgcacagttgatgcgggacacggagagcctcgcgaagagaatctgcaaagacctggaaaatctgtctcagattcaaaaccgtgagtttggcacccagaagtacgagcagtggatcgtgaccgtgcagaaggcatgtatggtatttcaaatgccagataaggatgaagagtctcgtatctgtaaggctctgttcctctacacgtcacacctccgaaagtacaatgacgcccttataatatcagagcacgcaaggatgaaagacgcattagactatctgaaggattttttttcaaacgtgagagccgctgggtttgacgaaatcgagcaagacctaacacaacggtttgaagagaagctccaggaactggagtcggtttcaagggacccatcaaacgaaaatcccaaattagaagatttgtgcttcatcttacaggaggagtaccatcttaatccagagacaattacaatactgttcgtcaaaactagggccctcgtggatgcccttaagaactggattgagggaaaccctaagctcagcttcctcaagccaggaatattgactggtaggggtaaaacaaatcagaacacaggaatgacactccctgctcagaagtgtattttggacgcctttaaagccagtggagaccataacattctgatcgctacttccgtggccgatgagggtatcgatatagctcaatgtaatctcgtcattctgtatgaatacgtgggcaacgtgattaagatgatccaaacacgcggccgtggaagggcccgcgggtccaagtgtttccttctcacatccaatgccggcgtcattgaaaaggaacagataaatatgtacaaggagaaaatgatgaacgactctatcttaagactgcagacctgggatgaggccgttttccgcgagaaaattctccacatccagacccacgagaaatttataagagatagccaagagaaacctaagccggtccctgacaaggagaataaaaagctgctctgtcggaaatgtaaggcactcgcctgttacacagcagacgtccgggtcattgaagaatgccactatacggttctgggcgatgcctttaaggagtgtttcgtgtccaggccccatcctaagcccaaacagttttcatcctttgaaaaaagagcaaaaatcttttgtgcaaggcagaattgctctcatgactggggcatacacgtaaaatataagacttttgagattcccgtgataaagattgaatctttcgtggtggaagacattgctacgggggtccagactctttatagcaaatggaaagacttccattttgagaagattccttttgatccagcagagatgagcaagtag

SEQ ID NO: 15643 - DNA, 2778 bp, Artificial Sequence
  Description of Artificial Sequence: Synthetic coding sequence
atgaccaccgagcagagacggtcactgcaggcttttcaagattacattaggaagacgctcgatcctacttatattctgagttacatggctccttggtttagagaggaggaggtacaatacatccaagccgagaagaacaataaggggcccatggaggcagctacccttttcctcaaattcctgctggagttgcaggaggagggatggttccggggcttccttgacgctttggatcatgccggttattctgggctgtatgaagccattgagagctgggactttaagaagatcgaaaagctggaggagtatcgtctccttctaaagcgtctgcagccagagtttaaaacgcgaataatcccaacagatattatctcagacctatcagaatgcctgatcaaccaggagtgcgaagaaatcctgcagatttgttcaaccaagggaatgatggccggtgcagaaaaactggtcgaatgtttattgcgatcagataaagagaattggccaaagactctcaagctagccctcgagaaagagcggaataaattctcagaattgtggatcgtagaaaagggtatcaaggacgtagagacggaagacctggaggataagatggaaaccagtgacatccagatcttttaccaggaagaccctgagtgccagaacctgagcgagaatagctgccctcccagcgaagtttctgacacaaacctctactccccgtttaaaccccggaattaccagctggaactcgccctgccagcaatgaagggaaagaacacaattatctgtgcaccaaccggctgtggaaagacgttcgtcagcctcttgatctgtgaacaccatctaaagaagtttcctcaaggccagaagggcaaggtggtgtttttcgcaaaccaaatccccgtgtatgaacaacaaaaatcagtcttcagcaaatacttcgaacgccacggttatagagtcacaggaataagtggggctaccgcagagaatgttccagtcgaacagatcgtggagaataatgatatcattatcctgaccccccagattcttgtgaataacttgaagaagggtaccatccccagcctctccatcttcaccttgatgatttttgatgagtgtcataacacgagcaagcagcacccctataatatgataatgtttaactacttggatcagaaactggggggaagctcgggcccactgccacaagtcattggactgaccgcttccgtgggcgtaggcgatgctaaaaacactgatgaagctttggactacatatgtaaattatgtgcttctttagacgcgagtgtcatcgctacagtgaagcataatctggaggaacttgaacaagtcgtttataagccccagaagttttttcggaaggttgaatcccgcattagtgacaaatttaaatatataatcgcccagctcatgcgcgacacagagagtttagcgaaacggatctgtaaggatctggaaaatctctcacaaatacaaaatagggagtttgggactcaaaaatacgagcagtggatcgtgacagtccagaaggcttgcatggtgttccagatgcccgacaaggacgaggaatcgcgcatctgtaaagcattgtttctgtacacgtcacacttgaggaagtacaacgatgccctgattatctcagagcatgcccggatgaaggatgctctggactaccttaaagactttttctcaaatgtgcgcgcagcaggctttgatgaaatcgagcaggacttaacgcaacgctttgaggagaaactgcaggaacttgaaagcgtgagccgcgaccctagtaatgagaacccaaagctagaggatctctgctttattttgcaggaggaatatcacttgaaccccgagactattaccatcctgtttgtgaaaactcgcgccctcgttgacgccttaaagaattggatagaggggaaccccaaactgtccttcctgaagcctggcattctcactgggcgggggaagactaatcagaacactgggatgaccctgccggcccagaaatgtatcttggacgctttcaaagccagcggcgatcacaacatcttaatcgctactagtgtagcagacgagggcatcgacatagcacagtgcaacctggtcatcttatacgagtacgtcggtaacgttatcaaaatgattcagaccaggggccgtggccgggcaagaggctccaagtgttttctcttaactagtaatgccggggtgatagagaaagagcagataaacatgtataaagagaagatgatgaacgactcaatcttgcgccttcagacttgggacgaggcggtctttagggagaaaattttgcacatacaaacacacgagaagtttatacgagacagccaagaaaagcccaaacctgtgcctgacaaggaaaataagaagctgctgtgtaggaaatgtaaggcactggcttgctatactgccgatgtgagggtgatcgaggagtgccattacactgtcctaggcgatgccttcaaagaatgttttgtgtctcggccacacccaaagccaaagcaatttagctcttttgagaagcgggcaaagatattctgcgctcgtcaaaattgctctcacgattggggtatacacgtgaagtacaagaccttcgagattcctgtcataaagatagaatccttcgttgttgaagatattgccaccggggttcagaccctgtacagcaagtggaaagacttccacttcgaaaagatcccgtttgaccccgccgaaatgagtaaatag

SEQ ID NO: 15644 - DNA, 987 bp, Artificial Sequence
  Description of Artificial Sequence: Synthetic coding sequence
atggacggcgaggacatcccggacttcagctcgctgaaggaagagactgcatattggaaagagttgagcctgaagtataagcaaagcttccaggaagcaagagacgagctggtagagttccaggagggatctcgtgagctcgaggccgaactggaggcccagctggttcaggccgagcagcgaaaccgtgatctgcaggcagacaatcagagattgaagtacgaagtagaagctttaaaggaaaaactggagcatcagtatgcccagagctataagcaggtgtctgtactcgaagatgacctgagccaaacccgcgcgatcaaagagcagcttcacaagtatgtgcgggaactggaacaggccaacgatgacctcgagcgtgcaaaaagagccactattgtgtcattagaggatttcgaacaacgcctcaatcaagccatcgaacgaaatgcttttcttgaaagtgagctagatgaaaaggagtcactcctggttagtgtccagagattaaaggatgaggcccgagacctgcgtcaggagctggcagtcagagaaagacaacaagaggtgacccgcaaatctgctcccagcagcccaaccttagactgcgagaaaatggattcagctgtgcaggcatccctgtctctgcctgcgacacctgtcggcaaagggaccgaaaatacattcccttcccccaaggccatccccaatgggttcgggacaagcccactgacgccctctgcgcgcatctccgctctgaatatcgtgggagacctgctgcggaaagtgggtgctctggaatccaagctagctgcttgtcggaactttgccaaggatcaggcttccaggaagagctacattagcgggaacgtgaactgcggagtgctgaacggaaatggaacaaaattctcccggtccggacacacatcctttttcgataagggtcaggagaaagtgattttccccaccttgttcatgggacagtag

SEQ ID NO: 15645 - DNA, 2898 bp, Artificial Sequence
  Description of Artificial Sequence: Synthetic coding sequence
atggcgttactgtgcggactcggccaggtgaccctccggatttgggtatcactcccatcccaatctgagaatgggatcggcttcctcgcagccagagcgttccttcggtccggagggatggaagcgttgactacccagctcggacccggacgagagggatcctctagccctaacagcaaacaggagctgcaaccctacagtggttccagtgctcttaagcccaaccaggtgggtgaaacaagtttgtatggagttccaatagtctcactggtcattgacggacaggagagactctgcctggcccagataagtaacaccctgcttaagaactacagttacaatgaaatccataaccgacgggtggcactgggtattacatgtgttcaatgcacacctgtccagttggagatactgcgcagggctggcgccatgccgattagctcaagacgctgtggaatgattactaagagagaggccgaacggctttgtaagagcttcttgggagagcacaagccccccaaactgccagagaattttgcttttgacgttgttcacgagtgcgcttggggatcaaggggtagctttattcctgcaagatacaactcaagtagggccaagtgcataaaatgtggctactgtagtatgtatttttcccccaataagttcatatttcacagccacaggacacctgacgcaaaatatacacagcctgatgcagcgaatttcaacagttggcgccggcacttgaaactctccgacaaaagcgctactgatgagctctctcatgcatgggaggacgtcaaggccatgttcaatggcggcacacgaaaacgtactttttccttgcaggggggcggcgggggcggcgccaatggtggcagtggcggtcagggaaaaggcggcgctggcggcggcggggggggggggccagggtgcggggcagaaatggctccgggaccaccccctcacaaatctttgcgttgcggggaagacgaagctgcgggacctcctgggccacccccacctcaccctcagcggggccttgggctggccaccggagcttctggccccgctgggccaggcggccctggaggtggcgctggggttaggagttacccagtgatacccgttccctccaaaggatttggattgctgcagaagctgccacctccattgtttccccacccctacggattccctacagcctttggattatgcccgaagaaagacgaccctgtcctgggcgccggggagcccaagggtggacccggaaccgggtccggcggaggtggagcaggcacaggtggcggagctggggggcctggcgcctcccaccttccccctggcgccggcgcaggccccgggggaggtgctatgttctgggggcatcagccgagcggggccgcaaaagacgctgctgccgtagcagcagcagccgctgccgcaaccgtctacccaacttttccgatgttttggcctgctgctggatcactgcctgtcccttcctaccccgcagcccagagtcaggcaaaggcagtggccgcagcggtggcagccgctgcagctgccgcagctgctgccgcaggctctggggctcccgagccattagacggcgcagagcccgccaaggagtcaggcctaggtgctgaggagcgatgtcctagcgccctctcgcgcggcccactagatgaggacggcaccgacgaggcgttacccccccctcttgcccccctgcccccacccccgcctccaccggcacgaaaggggtcctacgtgagcgcctttcgccctgtagtaaaggataccgagtctattgcaaagctgtacggctccgcgcgcgaggcgtatggtgcagggccagcacggggacctgggcccggtgccggcagcgggggctatgtgagtcctgacttcttgtccgagggaagctcctcatataattcagcctcgccagacgtcgacacagccgacgagcctgaggtggacgttgagagcaacagattccccgacgacgaggacgctcaggaggagaccgaaccttctgctcccagcgccggcggcgggcccgatggtgagcaacctactggccccccgtcagctaccagttccggagcagatggacctgccaactcacctgacggggggtcccccaggcccagacggcggctcgggcctccccctgccggaagacccgctttcggcgacctcgctgctgaggacctcgttaggaggccagagagatcacctccatctgggggaggaggatatgagttgcgcgagccgtgtggtccgctcggtggtccagcccctgccaaggtgtttgcacctgaacgcgatgagcacgtcaaaagtgccgctgttgccttaggccccgctgcctcttacgtgtgtactccagaagctcacgagcctgacaaagaagataatcacagtcctgctgacgacctggaaacccggaagagttacccagaccagaggagtatctctcagccctccccagctaacaccgacaggggcgaagacggattaactcttgatgtcactggcactcatttggtggagaaagatattgaaaacttggctagagaagagctacaaaaactattactggagcaaatggaattgcggaagaaactcgagcgcgagtttcagagcctcaaagataacttccaagaccaaatgaagcgcgagctggcgtaccgcgaagagatggtgcagcagctccagatcgtgcgcgacacattatgcaatgagctggaccaggaaaggaaggcccgatacgccattcagcagaagctcaaagaagcacatgatgctttacatcacttcagttgtaaaatgttaactcccagacactgtacaggaaattgttccttcaagccgccattgctcccatag

SEQ ID NO: 15646 - DNA, 1803 bp, Artificial Sequence
  Description of Artificial Sequence: Synthetic coding sequence
atggccagcaatcataagagttctgcagctagacctgtgtctcggggaggcgtgggacttactggccgccctccaagcggtattcggccattgtccggaaatataagggtggcaaccgccatgccacccggaactgccaggccgggcagtcggggatgccccataggtacggggggcgtgctgtcctcacaaataaaagtagcccaccggccagttactcagcaaggattaactggaatgaagaccggcacaaaaggcccacagaggcagatcttagataagtcatactacctggggctactccggtcgaaaatcagtgaattaactacagaagttaacaagctccaaaaaggcatagaaatgtataaccaggaaaattcggtgtacctgtcctacgagaaacgcgccgaaacccttgccgtcgaaattaaggagctgcaaggccagctggcagattataacatgctagtggacaaacttaatacaaataccgaaatggaggaggtaatgaacgattataatatgttaaaggcccagaatgatagagaaacccagagccttgacgttatctttaccgaacggcaagccaaagaaaaacagattcgaagcgtggaggaggagatagagcaagaaaagcaggccactgatgatatcataaagaatatgtcattcgagaatcaagtcaaatacctggagatgaaaactaccaacgagaaactgcttcaggaattggacacccttcagcagcagttagactcccaaaatatgaagaaagagtcgctggaagctgaaattgcgcactcccaggttaagcaggaagccgttcttctccatgagaagctgtacgaactcgagagccacagggatcagatgatcgccgaagacaagagtattggcagccccatggaagaacgggagaagcttctcaaacagataaaggatgacaaccaggagatcgctagcatggagaggcagttaaccgacactaaagagaagatcaatcagttcatcgaggagatccgtcaactcgatatggacctggaagagcaccaaggtgaaatgaaccagaagtataaagaactgaaaaaaagggaggaacacatggacactttcattgagacattcgaagagacaaagaaccaagagcttaaacgaaaggcccagattgaagccaacatcgtggcgcttctggaacactgttcgagaaacattaataggatcgagcagattagcagcattacgaaccaggagctgaagatgatgcaggacgacctgaacttcaaatctacggaggttcagaagtcgcaatcgaccgcacagaacctcacctctgacattcagaggctccaactggacctgcagaagatggaactgctggagagcaagatgaccgaggaacagcatagcctgaagtcaaaaattaaacagatgacaaccgatctcgagatttacaacgatctgccagccctgaagagcagcggggaggaaaagattaagaagttgcaccaagagaggatgatattgtccacacatcggaatgcttttaagaagatcatggagaagcagaatattgagtacgaagctctcaagacccagctacaagagaacgagactcacagtcagctgaccaatctcgagcggaaatggcaacacctggaacaaaataacttcgcgatgaaagagttcatcgccactaagtctcaggaatctgattaccagcccatcaagaaaaacgtgacaaagcagatcgcagaatacaataagaccattgtggatgccttacactctacaagcggaaactag

SEQ ID NO: 15647 - DNA, 582 bp, Artificial Sequence
  Description of Artificial Sequence: Synthetic coding sequence
atgctagtggcaggtaacgatagggtgcaggctgtaatcactcagatggaagaagtgtgtcagacaattgaggataattcaaggaggcagaagcagctgttaaaccagcggttcgagagcctctgcgccgtactcgaagaaagaaagggcgagctgctgcaggctcttgctagagaacaggaggaaaaattacagagggtccgcggcctcattcgacagtacggcgaccatctcgaagcttcctcaaagctcgtggaaagcgcaatacagtccatggaggagccccagatggctctgtatctgcaacaggctaaagaacttatcaataaagttggcgcaatgtctaaggtggaactcgccggcaggccagaacccggttatgaatccatggagcaatttaccgtgagagtggaacacgtggccgagatgttacggaccattgattttcagcccggggcgagtggcgaagaagaggaggtggcccccgatggtgaggaagggtctgcagggccggaggaggagcggcctgatggtccactcggcccatattccgcttacgtttccctgtgcggagcgccgtag

SEQ ID NO: 15648 - DNA, 1077 bp, Artificial Sequence
  Description of Artificial Sequence: Synthetic coding sequence
atgaatttcaccgtgggcttcaaaccactcctgggcgacgcacactcgatggacaatttagagaagcagctgatatgccccatctgtcttgaaatgttctctaaacctgtcgttatcctcccatgtcagcacaatctctgccgcaaatgtgcaaacgatgtcttccaggccagtaatcccttgtggcagagtagggggtcaaccacggtctcttcaggcggtagatttcgctgcccatcttgcaggcacgaggtcgtccttgatcggcatggcgtgtatggcctgcagaggaaccttttggtggagaacatcatagacatctacaagcaggaatcatccagacctcttcattccaaggccgaacagcacctgatgtgcgaggaacatgaagaggagaaaataaatatttattgcctgtcctgtgaggtccctacctgttcactctgtaaagttttcggggcccacaaagactgtgaggtggccccactgcccactatctacaaaaggcagaagtcggagctgtccgatggcatcgcgatgctcgtggccggcaacgacagagttcaggcagttatcactcagatggaggaagtctgtcagacaatagaggacaattccagacgacagaaacaactgttgaaccagcgcttcgagagcctgtgcgctgtcctggaggagcgaaaaggagagctcttgcaagcactggcaagggaacaggaggagaaacttcagcgcgtgagagggttaattaggcagtacggggaccacctggaagcaagctccaaactggtggaatccgccattcaatctatggaggagcctcagatggcattgtacctccagcaggccaaagagctgattaacaaagtgggcgccatgagtaaggttgaactggctggccgcccagaaccggggtacgaaagtatggagcaattcactgtcagggtggagcatgtggccgaaatgctgaggaccatcgattttcaaccaggggcttctggggaagaggaagaggtcgcacctgatggcgaggaagggagtgccggccccgaggaggagcggccagatgggccttag

SEQ ID NO: 15649 - DNA, 756 bp, Artificial Sequence
  Description of Artificial Sequence: Synthetic coding sequence
atggcagcctctaccatgtccatatgctcgtccgcctgcaccgattcatggcgcgtggtcgactgtcccgaatcgtgctgtgaaccctgctgttgtgcacctgcccctagcctcactctggtctgcacaccagttagttgcgtttcttcaccatgttgccagacggcttgtgagcccagtgcatgccaatcagggtataccagcagctgcacaaccccatgttaccagcagagcagttgccaacccgattgctgtactagctcgccatgccaacaggcgtgctgcgtcccggtttgctgtgtgcctgtgtgttgcgttcccgtctgtaacaagcccgtctgtttcgtcccaacctgttcagagtcgtcaccctcttgctgccaacagtcttcctgccagcctacctgctgcacgtcaagcccttgtcagcaagcctgttgtgtcccagtatgttcgaaaagtgtttgttatgtgccagtctgctccggtgctagtacaagctgctgtcagcagagctcctgccagcccgcgtgctgtacggcaagctgctgtcgcccctcgtcctccgtaagtctgctgtgccacccagtctgtaagtccacttgttgcgtccccgtcccatcttgtggagcttctgcgagtagttgtcagcctagctgttgtagaacagcgtcttgcgtgagtctgctctgccggccagtttgctccaggcccgcatgctactctctgtgcagcggacagaagagctcttgctag

SEQ ID NO: 15650 - DNA, 1128 bp, Artificial Sequence
  Description of Artificial Sequence: Synthetic coding sequence
atggcagcttccactatgagtgtctgctcatctgacttaagttacggctctcgggtatgtcttccaggctcctgcgattcatgtagtgactcctggcaggtcgatgattgcccagagagctgctgcgagcctccctgctgcgccccaagttgctgcgcccccgcgccttgtctcagtctggtgtgcacaccagtgtccagggtgtcttctccatgctgtcctgtgacctgcgaaccctcgccatgtcagtctggctgtacttctagctgtactccgtcttgctgtcagcagagctcatgtcaattggcttgttgcgcatcatcaccttgccaacaggcttgctgcatgccagtgtgctgtaaaaccgtttgctgtaaacccgtctactgtgtccctgtatgcagtggggactcatcatgttgccaacagtcctcttgccagtctgcttgttgtacttctagcccctgccagcaggcatgctgtgtcccgatctgttgtaaacctgtgtgttcgggaatttcctcatcttgttgtcagcagtcttcgtgtgtatcatgcgtatcaagcccttgctgtcaggccgtgtgtgaaccgtctccttgccaaagcggatgcatttcctcttgcacaccatcctgctgtcagcaatcctcatgtcaaccagcctgctgcacttctagtccttgccagcaagcttgctgcgtccctgtctgctgcaagccagtgtgctgcgtgccgacatgtagcgacgatagtggttcttgctgccagcctgcctgttgcacttcctcccaaagtcagcaggggtgctgtgtgcccgtgtgttgcaaaccggtgtgctgtgtgcccgtttgtagtggagccagctcaagctgctgccagcaatcgtcgtgccagccggcctgttgtactacctcttgttgccgtccaagcagcagtgtaagcttgctgtgccggcccgtgtgccggcctacctgctgcgtgcctgtaccaagctgttgtgcgccgacctcttcttgccaggcctcctgctgtaggccggcctcttgtgtgtcactgctgtgtcgacccgcttgctcgaggccggcctgctgcggcccaaccagcacacaaaaaagctcctgctag

SEQ ID NO: 15651 - DNA, 1587 bp, Artificial Sequence
  Description of Artificial Sequence: Synthetic coding sequence
atggctacccgggtcgaggaagctgcccggggacggggcgggggcgccgaggaggccacggaggccggacgtggtgggagaaggagaagcccccgccaaaagttcgagatcggaactatggaggaagccggaatttgcggtctgggtgtaaaagccgacatgctatgtaattcgcagtccaacgatattttgcaacatcagggtagtaattgcggaggaacttctaacaaacacagcttggaggaagacgaagggtcagacttcattaccgagaaccggaacctggtgagccccgcgtactgcacgcaggagagccgagaagaaatcccagggggtgaggcacgaactgatcccccagacggtcagcaggattctgaatgtaacagaaacaaggaaaaaacattgggaaaagaagtcctgctactgatgcaggcactgaacacgctgtccacacctgaggagaaactggcagctctgtgcaaaaagtacgccgacctgctggaggaaagcagatccgtacagaaacaaatgaagatcttgcagaagaaacaggcacagatcgtgaaagaaaaggtacatttacaatcagagcacagcaaagctatactggcccgctccaaactggaaagcctctgtcgcgaacttcagagacataataaaaccttaaaggaagaaaatatgcagcaggcaagagaggaggaggaacgacgtaaggaagccacggcccactttcagatcacgcttaacgaaattcaagcgcagctcgaacagcatgacatccacaacgcgaagctacgccaggagaacatcgagctgggagagaaactaaagaagctgattgaacagtacgctctccgggaggagcatatcgacaaggtctttaagcataaggagttacaacagcaactggtcgatgccaagctccaacaaaccacccagcttatcaaggaagctgatgagaaacatcagcgcgagcgtgagttcttgctcaaggaagctactgagtcacgccataaatacgagcagatgaagcaacaggaggtgcagttgaaacagcagttgtccctctacatggataaatttgaggaatttcagaccaccatggccaagtccaatgagctctttaccacatttcgacaggagatggagaagatgacaaaaaaaatcaagaagcttgagaaagaaactatcatctggcgcacgaagtgggaaaataacaataaagctcttctacagatggccgaggaaaaaacagtacgtgacaaggagtataaggcgctccagatcaagttggaacggcttgaaaagttgtgccgagctctgcagactgaaagaaatgagctcaatgagaaagtagaggttctcaaagagcaggtttccattaaagcggctatcaaagccgccaaccgggacctggctactcctgtgatgcaaccttgtactgctctcgactcccataaggaactgaacacctcaagtaagagagcactgggtgcccatctcgaagccgaacctaagtcgcagcggagcgctgtgcaaaaaccgcctagcactgggtcagcacctgccatagaatcagtcgactag

SEQ ID NO: 15652 - DNA, 399 bp, Artificial Sequence
  Description of Artificial Sequence: Synthetic coding sequence
atgagagcttcaccctgtatatcccagcccgcggcttcctggcatccgcgccccagtgccctgaggccgaccgcgggatccggacccgatacacgcacccccgggaccgtggaggacggctctgcaccctgtcccgctttcagatccccagccgtaagtccttgcggagaggagccttgttgctttcaaatcagcccagcggaagaaacccttgaactgggacgtctggtgagtcccggtaattgcgacacccttagtccccgagcggcgggcttttatgcctgtcatgtacggtccctcatcccttgtcgctccactaaaggccgctggccactgactgcatccgctgccggcttaagccgccatgcacagtgtgggcccagcctcggcctcggatag

SEQ ID NO: 15653 - DNA, 1944 bp, Artificial Sequence
  Description of Artificial Sequence: Synthetic coding sequence
atggccgagtttcgtgtccgcgtcagcacgggagaggcctttggggccggcacctgggataaagtgagcgtctctattgtcggaacgcgaggtgaatccccaccattgccactcgacaatcttgggaaagaattcaccgccggcgcggaggaggacttccaagtcaccctgccggaagacgtcgggagggtgctgttgctccgtgtgcataaagctccaccagtgcttccgttacttgggccccttgctcctgatgcctggttctgccgctggtttcagctgactccaccacgggggggacatctgctttttccgtgttatcagtggctggaaggcgctggaactctggtccttcaagagggaaccgccaaggtttcatgggctgatcaccatccggtgctgcagcagcagcgacaggaagagctccaggccaggcaggaaatgtatcaatggaaagcatacaacccaggatggccacattgtttagacgaaaagacggtagaggatcttgagttgaacatcaaatacagcaccgccaaaaatgccaatttctaccttcaagctgggagcgcctttgctgagatgaaaatcaaaggcctcttggatcggaagggcctgtggaggagcctcaacgagatgaaacgcatcttcaacttccgccgcaccccggctgccgagcatgcatttgaacactggcaggaggatgcctttttcgcctcacaattcttgaatggactgaaccccgttctgattcgtaggtgtcactacctccctaaaaactttccagttactgatgcaatggtggcaagcgttctcgggcctggtacctctctacaggcggagctcgaaaaaggatctctgttccttgtggatcatgggattctgagtggcatccaaacaaatgtgattaatggaaaaccccagttttccgccgcacccatgacactgttatatcagtcccccggttgtggaccgctgttgcctctggctatacaattgtcacagactcccggccctaacagccccatatttcttcccactgatgacaagtgggactggctgctggccaaaacttgggtacggaacgccgaattctcttttcacgaggccctgacccacctcctgcactcacatctcctgccggaggtgtttaccctggccaccctaaggcagttaccgcattgtcaccctctcttcaaatctaccgggatcgggattgaaggcttctccgagctgatccagagaaatatgaagcaactcaattactcactgctgtgcttgcctgaagatattaggacaaggggtgtcgaagacattccaggttactactatagggatgacgggatgcagatttggggcgcagtcgagaggtttgtgagcgagattatcgggatttattatccttccgacgagagcgtgcaagacgatcgggagttgcaagcctgggtgagggaaatttttagtaaaggcttcctgaaccaggaatcatccggaattccttccagcctcgaaacaagggaggctttagtgcagtacgtgacaatggtgatctttacctgtagtgccaagcacgccgccgtaagcgctggacagtttgactcctgcgcgtggatgccaaatctgcctccatccatgcagctgccccctccaacaagtaaggggttggctacatgcgagggcttcatcgcgactctgccacccgtaaacgccacatgtgacgtaattctcgccctttggcttctttctaaggagccgggggaccagaggcccctagggacatacccggatgagcacttcacagaagaggctccgcggcgaagcattgctacttttcagagtcggctggcacaaatctctcggggaattcaggagaggaatcaaggtctcgtgctcccttacacgtatctcgatcctcctttaatcgagaacagcgtgtcaatatag

SEQ ID NO: 15654 - DNA, 2031 bp, Artificial Sequence
  Description of Artificial Sequence: Synthetic coding sequence
atggctgagttcagagttcgcgtatcaacgggcgaggccttcggagccggcacttgggacaaagtgtctgtgtctatcgtcggcacaagaggggagtctccaccgttgcctctagataacctgggaaaggagttcaccgccggggccgaagaggatttccaagtgactctccctgaggatgtcggaagggtccttctcctccgagtacacaaagcacctcccgtactcccgctgctcggccctctggccccagacgcttggttttgtcgatggtttcagctgactcctcctaggggggggcacttgttgtttccatgctatcaatggttggagggtgcaggcaccctcgtcctgcaggagggcacagctaaagtaagttgggctgatcatcacccagtgttacagcagcagcggcaggaagaactacaggcacgccaagagatgtatcagtggaaagcctacaatcctggatggccccattgcctggacgagaagaccgtggaggaccttgaattaaatattaagtactctacggcaaagaacgcgaatttttacctacaggcgggatcagcctttgcagagatgaagattaaagggctgctcgataggaaaggactgtggaggtcgctgaacgagatgaagcggatattcaatttcaggaggacacctgcagctgagcatgctttcgagcattggcaagaggacgcattcttcgcaagccagttcttgaatggtcttaatccagtccttatacgacgatgtcactatctaccaaaaaatttccctgtgacagacgccatggtggctagcgtcctgggccctggtacatcccttcaggcggaactggagaagggaagcctctttttggtagatcacgggatcctgtccggaattcagacaaatgtaatcaacgggaaacctcagttcagcgctgctccaatgacactgctttatcagtcgcctggctgcggacccctgttaccgctggctatccagctctcccaaacgcccgggcccaatagccccatttttcttccaaccgacgacaagtgggattggctactggccaagacttgggtccgcaacgcagagttttcttttcatgaggcccttacgcacctgctacacagccatctcttgcccgaggtattcaccctggccactttgcggcagctgccgcattgtcatcccctgttcaaattgctgatcccacacactagatatactctgcatattaacaccctggctcgagaactactgatcgtcccaggtcaggtagtagaccgatccacaggcatcggtatcgaggggttctccgagctaatacagagaaacatgaagcagttgaattactctctgctctgcctacccgaggatattcggaccagaggggtcgaagatatcccaggctattattatcgcgatgatggtatgcaaatctggggcgccgtggaacgttttgtgtctgaaataatcggaatttactaccctagcgacgaatctgttcaggacgaccgagaactccaggcttgggttcgggagatttttagtaaaggatttctcaaccaagaatcctctgggatacctagttcactggagaccagggaggcattagttcaatatgtgacaatggtcatttttacgtgctccgccaagcacgccgctgtgtctgccggtcagttcgacagttgcgcctggatgcctaatttgccgcctagcatgcagttgccgccgccaacctccaagggcctggcaacttgcgagggcttcattgccacactcccacccgtaaatgcaacatgcgatgtgattctcgccttatggctgctgtctaaggaacctggggatcaacggcctctgggaacttaccccgatgagcatttcaccgaagaggccccacgaaggtccattgcgactttccaatcaagattggctcagataagcagaggcattcaggaacggaatcagggtctcgtcctgccttacacctacctggatccccccctaatagaaaattctgtatctatttag

SEQ ID NO: 15655 - DNA, 1665 bp, Artificial Sequence
  Description of Artificial Sequence: Synthetic coding sequence
atggccacttctgcagactccccctcttcccccctgggcgcagaagatcttctgagtgacagctccgagcctccaggactgaatcaggtcagcagcgaggttaccagccagctgtatgcctctctgcgtttgtctagacaggccgaagccacagcgcgggctcagttatatctgccttccacttcacccccacatgagggattagatgggttcgctcaggagctgagcagatctctgagcgtgggtctcgaaaaaaacctgaagaaaaaagatggctctaaacacatcttcgaaatggagtctgttagaggacagcttcagactatgctgcagaccagtagagataccgcgtacagagatccccttattcccggggccgggtccgagcggcgagaggaggactcctttgactccgactccacggctacactgctgaacaccaggcccctgcaggatctctccccgtcctcgagcgcccaggcactggaggagctcttcccccgttatacaagtttgcggccaggtcccccccttaaccctcccgatttccagggattaagggacgcactggacagcgaacacaccaggagaaaacactgcgagcgacacattcagtccctccagaccagggtccttgaactccagcagcagctggcagtcgcagtcgcagccgataggaaaaaggacaccatgatagagcagctggataaaaccctggctcgtgtggtggaaggctggaataggcatgaggcagaaagaactgaagtattgcgcggcctgcaagaagaacaccaagcagcagaactgacgaggtctaaacaacaagagacggtcacgagactggaacagtctttgtcagaggcgatggaagccctcaaccgggagcaggaatcagcgcggctccagcagcgtgagcgagagactctggaagaggaacgacaggctctgacattgaggctggaggcggagcaacagcggtgctgtgtgctgcaggaagaacgcgacgccgcaagagcagggcagctgtccgagcatagggagctcgagaccctccgcgctgcccttgaagaggaaagacaaacctgggcccagcaggagcatcaacttaaggagcactatcaggcactgcaggaagagagccaggcgcagctggaacgcgagaaggagaagagtcagcgggaagctcaagccgcctgggagacacagcaccagctcgctctggtccagtctgaagtgcgacggctggagggtgaactagacaccgctcggcgggaacgagatgctcttcaactggaaatgtcactagtgcaggcccgttacgagtcccaaagaatccagctagaatctgaattggccgtgcagctggagcagcgcgtgaccgagcggctggcccaagcccaggagagcagcctgcgccaggccgcttccctgagagagcaccatcgcaaacagcttcaggatctgtcaggccaacaccagcaagaactcgcttcccagctcgctcagtttaaggtcgagatggctgagcgtgaagaaagacagcagcaagtggccgaggattatgagctgcgtctgcttctgctggaccctccagctcccggactcaggtccccacgtaggcgtagaggtgggagcggcctgtgcctcccctggccctggccctag

SEQ ID NO: 15656 - DNA, 2778 bp, Artificial Sequence
  Description of Artificial Sequence: Synthetic coding sequence
atggctacctcagcagatagtccaagctccccgctcggggccgaagacctgctgtctgacagctccgagccaccaggcctgaaccaggttagctctgaagtcacctctcagctttacgcaagcctgcgtctgagtcgccaagctgaggccaccgctcgcgcacagttatatctgccctccaccagccctccacatgaggggctggacggcttcgcacaggaactttcgagatctttgagtgttggattagaaaagaacctaaaaaaaaaagacggttccaaacacatctttgagatggagagcgtgagagggcagctccagactatgctccagacaagccgggacacagcgtaccgcgaccctctcatccccggagcggggagcgagaggcgggaggaggactctttcgattccgattccacagccacgctcctcaacacgcgcccgctacaggaccttagtccgagttccagtgcgcaggctctagaagagttgtttcctagatatacatctctgaggcccggccctcccctgaatcctcctgactttcagggtctcagagatgccctagactcagagcatacccgccggaagcactgcgaaaggcacatacagtctttgcagacccgtgtcctggagttacagcagcaactggctgtggctgtagccgccgatagaaagaaagacactatgatcgagcaactcgataagaccctggcccgggtggtggaaggctggaatagacacgaggctgagcgcactgaggtgttgcgcggactgcaggaggagcatcaggctgctgagttgacgcggtctaagcagcaggagaccgtgactcgattggaacaatccttgtcagaagccatggaagccctgaaccgtgaacaggaaagtgctcgcctccaacagcgtgagcgggaaacgctggaagaagaacggcaggctttgactctgagacttgaagccgagcagcagaggtgttgtgtcctgcaggaagaaagagatgcagccagagcagggcaactgtctgaacacagagaactcgaaaccctgcgcgcagccctcgaggaggaacgacaaacttgggctcaacaagaacatcagctcaaggaacattaccaggccttgcaggaagagtcacaggctcagctggaaagagaaaaggagaaaagtcagcgggaggctcaggctgcttgggaaacacaacatcagctggctctggtgcagtctgaggttcgtcgcctggagggagagttggatacagccagacgcgagcgcgatgcactacagctcgagatgtctctggttcaggctaggtacgagtctcagcggatacaactcgaaagcgaactagccgtgcagctggaacagcgcgtgactgagcggttagcgcaggcgcaggaatcttccctacggcaggctgcctctctgagggagcaccaccggaagcaactgcaagacctgtcagggcagcatcagcaggagcttgcgagtcagttggcccaattcaaagtggaaatggccgaaagagaggagcggcagcagcaggtggctgaggattatgagctcaggcttgcaagggagcaagcacgagtttgtgaattgcagagcggcaatcagcaattggaagagcaaagggtggagctggttgagagacttcaggcgatgctacaagcccattgggatgaagccaaccagctgctctccacaacactccctcctccaaacccaccggcaccccccgcgggaccaagttccccaggcccacaggagccagaaaaggaggaacgaagagtctggaccatgccaccgatggcagtggcacttaagccagtgctccagcagagtcgcgaggctcgggatgagttaccaggtgccccccccgttctgtgctcatcgagctcagacctcagcctcttgctgggcccttctttccagagccagcattcattccagccacttgagcctaagcctgatttgacctcgagcaccgccggagctttttcagccctgggcgcattccaccccgaccaccgagcagagcgaccctttcctgaggaagaccctggacccgacggggagggtctcttgaagcaggggctccccccagcccaacttgagggcttgaagaatttccttcaccagctgcttgagaccgtgccccagaataatgaaaacccgtccgtggacctgctgccgccaaagtccggtcccctgacggttcccagttgggaggaagccccgcaggtgcctagaattcctcctcctgtgcataaaacaaaagtgccgttggcaatggcatcgagcctcttcagggtcccagaaccccccagctcacacagccagggtagtggtccatccagtggatcgccagagcgcggaggggacggactgacattccctaggcaattaatggaggtctcccagttgctcaggctctatcaggctcgaggatggggcgccttacctgctgaggatctgctgctgtacctgaaacgcctggagcatagcggatacaaacctgggagaaaggaggagggattcagcggttggaaactggattatggtgaatggtcagggaccgacgggcgtggagacaatgtaccgagacgcaatactgattcccgtctgggtgagatcccccggaaggagatcccgtcccaagctgtgcctcgcagactagcaacagccccaaaaaccgaaaagccgccagcacgcaaaaaatctgggcatcctgcgccgtcctcgatgcgcagcagggggggagtgtggcggtag

SEQ ID NO: 15657 - DNA, 2961 bp, Artificial Sequence
  Description of Artificial Sequence: Synthetic coding sequence
atgtatttctgttggggcgccgacagtagggaacttcagagaaggagaaccgccggatccccaggcgcagaactgttgcaggctgctagcggcgagagacacagtttgctgctcctcacaaatcaccgcgtgctaagctgcggcgacaactctcgaggtcagctcggccgccgtggtgctcaacgtggcgagctgccagagcctatacaggctctggagacactgattgtggatctagtttcttgcggaaaggagcacagcctagctgtttgccacaaggggagggtgtttgcctggggcgccggctctgagggccagttggggatcggggaattcaaggaaattagcttcacgccaaaaaagatcatgactctcaacgacattaaaattatccaggtaagctgcggtcactaccattcattggcattatcaaaggacagccaagtattttcgtggggcaaaaattctcacggccagctgggactcggaaaagagttcccaagtcaggcctctccacaacgggttcgctcactcgaaggtattccactggcgcaagtagctgcaggcggcgcccacagcttcgccctgagcctgtgtggaacgagcttcggatggggttctaattcagctggtcaattggcactgagcgggcgcaacgtacccgtacagagcaacaaacccctcagtgttggggccctgaagaacctgggggtggtctacatctcatgtggtgacgctcatacagcagtgctgacacaggatggtaaggtgttcacattcggcgataaccgctccggtcagttgggatatagcccgacccccgagaagagaggaccccagctggtggagagaattgacggtctcgtgagtcagattgactgcggttcttatcacacactggcctatgtgcataccactggccaggtggtgtcctttggccacggcccctcggacacgtccaagccaacccaccccgaggccctcacagagaatttcgatatcagttgcctaatcagtgcagaggacttcgtggatgtgcaagtgaaacacattttcgcaggcacgtacgccaattttgtgacaacacatcaggacacctcctccactagagcacctggaaagacccttccagaaatctcccgcattagccagagtatggctgagaagtggattgctgtgaagaggagatccacagagcatgaaatggccaaatcagagatacgtatgattttttccagcccagcttgcctgacagcctcctttttgaagaagcggggcaccggggagaccacaagtattgatgttgatctcgagatggccagggataccttcaaaaaacttaccaaaaaggagtggatctcctctatgatcaccacatgtctggaggatgacctactacgcgcccttccatgtcatagtccccaccaagaggctctgagcgtgtttctcctgctgcctgaatgccccgttatgcacgactcaaaaaactggaagaacttggttgttccatttgccaaagccgtgtgcgagatgtcaaaacagtctcttcaagtgctcaaaaagtgttgggcgtttcttcaagaatcctctctgaacccgctgatccagatgttgaaagcagcgataatttcccagctactgcatcagactaaaactgaacaagatcactgcaatgttaaggctttgctcggcatgatgaaagaactccacaaagttaacaaggcaaattgccgattgccggagaatacgtttaacattaatgagcttagcaacctcctcaatttttatattgaccggggtagacaactgttcagggataaccacttgatgtcagagaaaaaagcctacatgctgatgcacgaaacgatccttcaaaaaaaggacgagttcccacccagtccgcgcttcatcttgagagtgaggcggtctaggctggtgaaggacgccctccgccagctcagtcaggccgaggcaaccgatttctgtaaagtgctcgtggtcgagtttataaatgaaatttgccccgagtcaggcggggtgtcatcagaatttttccactgtatgtttgaagagatgacgaagcctgagtacggtatgtttatgtaccctgagatgggatcttgcatgtggtttccggctaagcccaaacccgaaaagaaacgctactttctgtttggcatgctctgtggtcttagcttatttaaccttaacgtggctaacctaccttttcctctggccctttacaaaaagcttctcgatcagaagccgagcttggaggaccttaaggagttgagtcctcgacttgggaagtctttacaggaagtgctcgacgatgctgccgatgatataggagatgccctgtgcatcagattctctatccattgggaccagaacgacgttgacttgattcccaatggtataagtatacccgttgatcagacaaacaaaagggattacgtcagtaaatatattgactatatttttaatgtttctgttaaagccgtttacgaggagtttcagagggggttttaccgggtgtgtgaaaaagagatcctgcgccacttttaccctgaggaactgatgacagcaattatcggcaatacagattacgattggaaacagtttgagcaaaacagtaagtatgagcaggggtaccaaaagtctcacccaacaattcagctgttctggaaggcctttcacaaactgactttggatgagaagaaaaagtttctgttcttcctcacaggtcgggaccgcctccatgcccgaggtatccaaaaaatggaaatcgtgttcaggtgtccagagaccttttccgaaagggaccatcccacatcaataacttgccacaatatcttatctctgcctaaatatagtactatggagcgcatggaagaggccttgcaagtcgccatcaataacaatagggggtttgttagtcccatgcttacccagagttag

SEQ ID NO: 15658 - DNA, 435 bp, Artificial Sequence
  Description of Artificial Sequence: Synthetic coding sequence
atgactactaggcaagcgactaaagacccgctgctgcgtggcgtgagccctactccttcaaaaattcccgttcgatcacagaagcggacacctttccccaccgtcacgtcctgtgcagtcgaccaggaaaaccaagacccacggagatgggttcagaagcctccgttaaacatccagcgacctctcgtggactcagccggacccagacctaaagcgcgccaccaggcagaaacgagtcagcgcctggttggaatcagccagcctagaaaccctcttgaggaacttcgtccttcccccagaggacaaaatgtcgggcccgggccccctgctcagaccgtcctggtgcctgccccaggaaaactctttgcactgcgcagatctccattcccccctgccaagtgccacctcgcccgatgtcacgggctctacctgtag

SEQ ID NO: 15659 - DNA, 327 bp, Artificial Sequence
  Description of Artificial Sequence: Synthetic coding sequence
atggccgatcccagggtacgccagataaagattaagacaggcgtcgtgaagagactggtgaaagagaaggtgatgtacgagaaggaggccaaacagcaggaagagaaaattgaaaagatgcgcgccgaggatggcgaaaactacgacattaagaagcaggccgaaattttgcaggaaagcaggatgatgatccctgattgtcagcgtaggcttgaggccgcttatctggatctccagaggatcctggagaatgagaaggacctcgaagaagcagaggaatataaggaagctagactggtccttgactcagttaagctcgaggcctag

SEQ ID NO: 15660 - DNA, 1341 bp, Artificial Sequence
  Description of Artificial Sequence: Synthetic coding sequence
atgcgggagtgtctcagcatccacataggccaggcgggaatccaaatcggcgacgcctgctgggaactatactgtttagaacatggtattcagccaaatggagtcgtcctggatacccagcaggaccagttggaaaacgcgaaaatggagcacacgaacgcgagctttgatacatttttttgtgagaccagggcaggaaaacacgtcccgagggccttattcgtagacctggaaccaacggttatcgatggtattcggacaggacaacatcgttcacttttccatccagagcagctcctttctggcaaggaggacgcagctaacaactatgcccggggacgatattctgtgggctctgaggtaatagatctggtgctggagcggacacgcaaactggctgaacagtgtggagggctgcagggcttcctgattttcaggtccttcggtggagggacaggatcaggattcaccagtctactcatggaacgtctgaccggggagtattcccgtaagacgaagttagaattctcggtgtatccagcacccaggataagtacggctgtcgtagagccttataactctgtgctcactacccacagtaccaccgagcacaccgactgcacattcatggtggacaacgaggcggtttatgatatctgtcaccgtaagcttggcgtcgaatgcccttcacatgcttctatcaacagactcgtagtacaggtcgtctcatccataacggcatctctgcgctttgaggggccactgaatgtggatttgattgagttccagacgaatctggtaccatatccacggatccactttccaatgaccgcattcgcccctattgtttccgctgataaagcctatcatgagcaattctctgtctccgatatcacaactgcttgtttcgaatcgagcaatcagttggtaaagtgcgaccccagactcggcaagtatatggcttgttgtctgctgtaccgcggcgacgtggtcccaaaggaagtcaacgctgcaattgccgccaccaagtcacgccacagcgttcagttcgtggactggtgcccaacaggcttcaaggtgggcataaataatcgacccccaaccgtgatgcccggaggtgatctagctaaggtacaccgcagtatctgtatgctgtccaacacgacagccattgtggaagcttgggccagattagaccacaagtttgatcttatgtacgccaaacgggccttcctgcactggtacctccgtgagggcatggaagaagcggagttcttggaagcacgggaagacctggccgcactggaaagggattacgaggaagttgctcaaagcttctag

SEQ ID NO: 15661 - DNA, 873 bp, Artificial Sequence
  Description of Artificial Sequence: Synthetic coding sequence
atgggcagtagcaagaaggtgacactctctgtgctgagccgggagcagtctgagggggttggggcccgggtaagaaggtcaatagggcggccggagttaaaaaaccttgatccctttctgctctttgatgaattcaagggcggtcgccccggtggcttcccagatcatccccaccgcggcttcgagaccgttagttacctgctggaagggggaagcatggctcacgaggatttttgtggtcacacaggcaagatgaacccaggggacttgcagtggatgactgctggtagaggtatcttgcacgctgaaatgccctgctccgaagaacccgctcacggattacagctctgggttaaccttcgatcctccgagaaaatggtcgaaccccagtaccaggagttgaaatccgaggagattcccaagccgtccaaagacggggtgacagtggcggtaatcagcggagaggccctggggattaaaagcaaggtgtatacaaggacccctacattgtacctcgactttaagctggacccgggagccaagcacagtcagcccatacccaaaggctggacatctttcatttatactattagcggggacgtgtatattgggccagacgatgctcaacagaaaatagagccccaccacaccgccgtgctaggagaaggtgatagcgtgcaagtggagaacaaagatcctaaacggtctcatttcgtactcatcgcaggcgagcccctgagagaacctgtgatccagcacggtcctttcgtgatgaatacgaacgaggaaataagtcaggccattctcgactttcgcaatgccaagaacgggttcgagagagccaagacgtggaagagtaagataggaaattag

SEQ ID NO: 15662 - DNA, 873 bp, Artificial Sequence
  Description of Artificial Sequence: Synthetic coding sequence
atggggtcatccaaaaaagtgacactgagcgtattgtctagagagcaatctgaaggagtaggggcaagagtgcggcggtctatcggaagacctgagttaaagaatctagatccatttttacttttcgacgagttcaaaggtgggcgcccaggaggttttcccgaccatcctcataggggcttcgaaactgtgtcatacttactggaggggggatccatggcccacgaagacttctgtggacatactggcaagatgaaccctggggacctgcagtggatgaccgcaggtcgcggcattcttcacgcggaaatgccttgttccgaagagccagcccacggattacaactgtgggttaacctgagatcctctgagaaaatggtggagcctcagtaccaggaactgaaaagcgaggagattccaaagcctagcaaagacggtgtgactgttgcagtgattagcggcgaggccctgggaatcaaatctaaagtctacactcgcactccaacgctctacctcgacttcaagctagaccccggcgctaaacacagtcagcctataccaaagggctggacctcgttcatttacactattagcggcgacgtgtatatcgggccggacgatgcccaacagaagatcgagccccatcacacagccgtgctgggggaaggggacagcgttcaggtagaaaataaggaccccaagagatcacattttgttctgatagcaggagagcctctacgcgagccagtgatccagcatggaccttttgtcatgaatactaacgaagagatcagtcaggccatactggacttccgcaacgccaaaaatggctttgagagagctaaaacatggaagtcaaagattggcaattag

SEQ ID NO: 15663 - DNA, 1200 bp, Artificial Sequence
  Description of Artificial Sequence: Synthetic coding sequence
atggacttctttagctcccatctccttgctgactcttcgagcccagccacaaattcaagccacacagacgctcacgaaatccttgtgtcagatttcctggtctctgacgaaaacttgcagaaaatggagaacgtgctcgacctctggagttccggcttgaagactaatattatctctgaactgtcaaagtggcggttaaatttcatagactggcataggatggagatgaggaaagagaaagagaaacacgctgctcacttgaaacaactctgtaaccagatcaatgagctgaaagagctgcagaagacattcgagatcagtatcggtagaaaggacgaagtgatctccagtctgtcacacgcaattggcaaacagaaggagaagattgagctaatgaggactttttttcactggcgtattggtcacgttagggcgaggcaggacgtgtatgagggtaagctcgcagaccagtactaccaacgaacgctgctgaagaaggtttggaaggtgtggaggtcagtcgtgcagaagcagtggaaggatgtggtggaacgtgcctgtcaggcaagagccgaggaggtctgcatccaaatttccaatgattatgaagcgaaagtggcaatgctgtctggtgctctggagaatgccaaggcagaaattcaacgtatgcagcatgaaaaagaacactttgaggactcaatgaaaaaagcattcatgcgcggagtgtgtgctctgaacctggaggctatgacgatattccagaaccggaatgatgccggtatcgattccaccaacaataagaaagaagagtatggaccaggcgtgcagggtaaagagcatagcgcccacctggacccatctgcaccaccaatgccactgcctgtgactagtcctctccttcccagcccaccagcagctgtggggggagccagcgccacagccgttccctctgcggcaagcatgaccagcacccgcgcagccagcgcttcctcagtgcatgtgcccgtgagcgcacttggggcaggatctgccgcaacggctgcatctgaagaaatgcagaccatcccccaggcgaccgctgccaagtatccaaggacaatccatcccgagagctctacttctgcttctcgcagcctgggcacccgtagcgctcacacacagtccctcacaagcgtccattccatcaaggtggtcgattag

SEQ ID NO: 15664 - DNA, 729 bp, Artificial Sequence
  Description of Artificial Sequence: Synthetic coding sequence
atggcagcggtgaaagcgagcacatcaaaggccaccaggccctggtattctcacccagtttatgcccgatactggcaacattaccaccaagccatggcttggatgcaatcacatcataatgcctaccggaaggctgtcgaatcttgttttaacctgccgtggtatctgccaagcgcactgctcccccagagtagctatgacaatgaagctgcttacccccagtccttctacgatcatcacgtggcttggcaagactatccatgctcctccagccacttcagacgctccggccaacatcctcgatactcttctcgtattcaggcctctactaaggaagaccaggcattgtccaaggaagaggaaatggagacggagtccgatgccgaagtagagtgtgacctatccaatatggagatcactgaagagttgcgccagtacttcgctgaaacagagcgccatcgtgaagaaagaaggcggcagcagcaacttgacgccgagaggctcgatagttacgtgaacgccgatcacgacctgtactgtaacacacggcgctctgttgaagcacccacagaacggcccggggagcggcgacaggcggagatgaagaggctgtacggtgacagcgccgccaaaatccaggccatggaagctgccgttcagctttcttttgacaagcattgcgataggaagcagcctaaatactggcctgtgatccccctgaaattttag

SEQ ID NO: 15665 - DNA, 1482 bp, Artificial Sequence
  Description of Artificial Sequence: Synthetic coding sequence
atggaacgaagccctgatgtttctcctggtccttcccggtcttttaaagaagagctgctgtgtgctgtgtgttatgaccctttccgcgatgctgtgaccctaagatgtgggcacaacttctgtaggggctgcgtcagtaggtgctgggaagttcaggtctcacctacttgtccagtgtgcaaagatcgggcttcccccgccgaccttcggacgaaccatacactgaataatctggtcgagaagttgttacgagaagaggcggagggcgctcggtggaccagctaccgcttcagtcgcgtctgccgcttgcaccggggacagctgagtctgttttgcctcgaggacaaggaactcttatgctgctcttgccaggccgacccaagacatcagggccatagagtccagccagttaaggacaccgcccacgattttagagttcggagcctcatagctgaggaacggcgcaatttcctgccaacacaccagtggatcgttacaaaaacccgcctgcagacatccagccccaatttgcagtccagaagacagggccaggtccaggagcacggcgcatgtaccgctggagaaggccaagggcttctgggccacgcggctctgctggacgccatggcggaggagacccgccaaaagcaactgttggcagatgagaaaatgaaacagctcaccgaggaaaccgaggtgttggcccatgagatcgaacgattgcagatggagatgaaggaagatgacgttagtttcctcatgaaacacaagtctaggaagaggagattattttgcacaatggaaccagagccagtccagcccggcatgctcatcgatgtctgtaaatatctggggtcactgcaatatagggtgtggaagaaaatgctcgctagcgttgaatctgtccctttcagcttcgaccccaatacggctgcgggttggctgagcgtgtctgacgacctcacctccgttaccaaccacggatatagagtacaggtggaaaaccccgagcgttttagctccgcgccctgtttactgggcagtcgggttttttcccagggctcccacgcatgggaagtggcactgggcgggctccaatcctggagagtaggcgtggtgcgagtccgccaggacagtggagcggaagggcattcacacagttgttatcacgacaccagatccggtttctggtatgtgtgcaggacacagggagtggagggagaccattgcgtcacctccgaccccgccaccagtccactggtgctggcaatccccaggaggctgcgcgttgaactggagtgcgaggaaggcgaattgtccttctatgacgccgaacgacattgtcacctctataccttccacgccagatttggggaggttcgaccgtacttctaccttggcggtgctcgcggggcaggccctccggaacctctgcgcatttgcccattgcatatttctgtcaaagaggagttagatggatag

SEQ ID NO: 15666 - DNA, 1473 bp, Artificial Sequence
  Description of Artificial Sequence: Synthetic coding sequence
atgaatttggcagagatctgcgataatgccaagaagggacgggaatacgctctgctaggcaactacgattcatcgatggtgtactatcaaggcgtgatgcagcagatacagaggcactgtcaatccgtgagagaccccgcaataaagggtaagtggcagcaggtgcgccaggagctgttggaagaatacgagcaggtgaagagcattgtctctaccctcgagtcattcaaaattgacaaaccgccagattttccagtttcttgtcaggatgagccattccgggaccccgccgtttggccaccccctgtgcccgccgagcaccgtgctcccccacagattaggagaccaaatagggaggtcaggccattaaggaaagaaatggcgggcgttggggccaggggcccggtcggaagagcccatcctatctccaagagtgagaagccatcaacctctcgggacaaagactatagagcacgcggaagagacgacaaaggcagaaagaacatgcaggatggagcttccgatggcgagatgcccaagttcgatggagcaggctatgacaaggacctggttgaagctctggagcgcgatatcgtttctcggaatccctctatccattgggatgacatagccgacttggaggaagctaagaagctattaagagaggccgtggtgttgcccatgtggatgcctgactttttcaagggaatcagaaggccctggaagggagtcctgatggtcggaccacctggaaccgggaagaccatgctggcaaaggccgtggctactgagtgtgggaccacctttttcaatgtcagctcttccactctaaccagtaagtacaggggcgagtctgaaaagcttgttagactgttgttcgaaatggcacggttttacgcacccaccacaatctttatagacgaaatcgacagcatctgctcaagacgggggaccagcgatgaacatgaggctagccgcagagtgaagtcagaactcctgatccagatggatggagttgggggcgctctcgagaatgatgaccccagcaagatggtgatggttctggctgcgacaaattttccatgggatatcgatgaggcacttcggcgtagacttgagaagcgcatatacatcccacttccaactgccaagggccgcgctgaactgctgaagattaacctgagagaggttgaactggaccctgacattcagctggaggacatcgctgagaaaattgaagggtactcgggagctgacatcacaaacgtgtgccgtgatgccagccttatggcaatgaggcgccgcattaacggtttgagtccagaagaaattagagctttgtcaaaagaggagctgcagatgccggtgaccaagggagactttgaactggccctgaaaaagattgccaagagtgtatccgccgccgatctcgagaagtacgagaaatggatggtggaatttggctcagcctag

SEQ ID NO: 15667 - DNA, 1473 bp, Artificial Sequence
  Description of Artificial Sequence: Synthetic coding sequence
atgaatctagcggaaatctgcgataatgcgaagaaaggtagggaatacgcactcctgggcaattacgactcttccatggtttattatcagggggtgatgcagcagattcagcggcattgtcaatcagtgcgtgacccagctatcaagggaaaatggcagcaggtacggcaggagctcttagaggaatacgagcaggtgaagagtatcgtcagcacactggagtcctttaagattgacaaaccccccgactttcccgtgagttgtcaggacgaaccctttcgcgaccctgccgtctggccccctccagtgccggccgagcatagagcgcccccacagattcgacgacctaacagagaggtgaggccactccggaaggaaatggcaggagtgggagcacgcgggcccgttggtcgtgcacaccccatttcaaaaagtgaaaagcccagcacaagtagagacaaggactacagggcccggggaagagatgacaagggccgaaaaaatatgcaggatggggcctctgatggagagatgccaaagtttgacggggcaggctatgacaaggacctggttgaagcccttgagcgcgatatagttagccggaatcccagcattcactgggacgacattgcagacctggaggaggccaagaagctgttacgggaggctgttgttctgccaatgtggatgcctgacttctttaaaggcatcagacgtccttggaaaggggtgcttatggttggaccccccggcaccggcaaaacaatgctggctaaggctgtcgctacagaatgtggaaccaccttctttaacgtgagttctagcaccttaacatccaagtaccgcggcgagtccgaaaaactggtaaggcttctgttcgagatggcccggttttatgcgccaaccacgatttttattgatgaaatcgacagcatttgttctcggcggggtaccagtgatgaacacgaggctagtcggcgagtaaagtcggagctcctcatccagatggacggcgttggaggtgctctcgagaatgacgatcccagcaagatggtgatggtcctggctgcaacaaacttcccgtgggacattgacgaggcacttaggcggaggctggagaaacgtatttacatcccgctccccaccgccaagggacgcgcagaactgttgaaaataaacctgcgggaagtggaattggatccagatattcagctggaagacatcgcggaaaagattgaaggatattcaggtgcagacataaccaacgtgtgccgcgatgccagtttgatggccatgcgccgcaggattaatggcctcagtccagaggagatccgcgccctgagtaaggaggagctgcagatgccagtgacaaaaggagactttgagttagctcttaaaaaaatagctaagagcgtaagcgccgccgacctggaaaagtacgagaaatggatggtcgaattcggttccgcctag

SEQ ID NO: 15668 - DNA, 1068 bp, Artificial Sequence
  Description of Artificial Sequence: Synthetic coding sequence
atggattttatctttcacgagaagcaagaggggttcttgtgtgcccaacactgccttaacaacctgctacagggagagtacttctccccagtcgagctggcctctatagcccaccagctggatgaggaggagcggatgcgaatggccgaggggggggtgacatcagaggagtatttggcctttctgcagcagccaagcgaaaacatggatgataccgggtttttttcgatacaggtgatatcgaatgccctgaagttttgggggctggaaatcattcatttcaacaatccagaataccagaaactgggaatagacccaattaacgagcgaagctttatttgtaattacaagcagcactggtttacaatcaggaagttcggcaagcattggttcaatcttaattccttgttggcagggccggagctgatctccgatacctgtctggctaatttcttagcccggcttcagcagcaggcttattccgtgttcgtggtaaaaggcgatctaccagactgcgaagctgatcagttgttgcagataatcagcgtcgaagagatggacaccccgaagttaaacggaaaaaagctggtgaaacagaaagagcatagggtgtacaaaaccgtgctggagaaagtttccgaggagtccgatgagtctgggacgtcggatcaagatgaagaagacttccagcgcgcattagaactgagccgccaggaaaccaaccgtgaggatgagcatcttagatctaccatcgaactgagcatgcaaggctcctctggaaatacaagccaagacctgcccaagacctcgtgtgtgacacccgccagtgaacagccaaagaaaatcaaagaagactacttcgaaaaacaccaacaggagcagaagcaacagcaacagcagtccgatctgcccgggcattcctcttatctgcatgagcggcctacaacgtcaagcagagccatcgagtcagacctatcagatgacataagtgagggtacagtgcaggctgccgtagacaccatcctggaaattatgaggaaaaatctgaaaattaaaggagagaagtag

SEQ ID NO: 15669 - DNA, 5910 bp, Artificial Sequence
  Description of Artificial Sequence: Synthetic coding sequence
atggcggcaagaagcgccccaagctgccatctccggctggaatgggtatatggctacaggggccaccagtgccggaataatctgtattacaccgcagcaaaggagatcgtgtattttgtcgctggcgtcggagtggtctattcccccagagagcaccgacagaaattttacagggggcacagcgacgatattatctccctagccctgcatccggagcgggtgcttgtggcgaccggccaagtgggtaaagagccttacatatgcatttgggacagttatacagtgcagaccatttcagtgctaaaagacgttcacacccacgggattgcctgcctagccttcgacctggacggccaacggcttgtgtcggtggggttagattccaagaacgcagtctgcgtctgggattggaagcgtggcaaaatgctgtcgatggcaccagggcacacagacaggatcttcgacataagttgggacttataccagcctaacaaacttgtgtcctgcggcgtcaagcacatcaagttttggagtctatgcggaaatgcattgactcccaaaaggggagtcttcggcaaaactggcgatctacagacaatcctgtgtctcgcatgtgcccgcgatgagttgacctacagcggtgctctgaatggagatatctatgtctggaaggggataaacctcatcaggaccatccaaggagcccatgctgccgggatcttcagtatgaacgcctgtgaggaaggttttgctaccggcggccgcgacggatgcatccggctgtgggatctcacgtttaagccaattacagtaatagacctcagggagaccgatcaggggtataagggcttgtccgtgagaagcgtgtgctggagaggcgatcacatattagtcgggactcaggacagcgagattttcgaaatcgttgtgcaagagcgtaacaagccgttcctcataatgcagggccattgtgaaggagagttatgggccctggctgtgcaccctacaaagcccctagcggtcactggttccgacgaccgcagcgtccgcatttggagcctcgtggaccatgcactgattgctaggtgcaacatggaggagcctattcgatgtgcagcagtgaacgcagatggaattcacttggcgttaggaatgaaggatggcagctttacagtattaagggtgcgagacatgaccgaggtggtgcacattaaggaccgtaaggaggcaatccacgaactgaagtacagtccagacgggacctatttggccgtgggctgtaatgactcatcagtggatatctacggagtggcacagcgctacaagaaagtcggcgagtgcctaggatctctgagctttatcacacaccttgactggagcagcgactctcgctacttgcagacaaacgacgggaacggcaaacggctgttttaccgcatgcctggcggcaaggaagttaccagcacagaagagattaagggggtccactgggcaagctggacttgcgtgtctgggctggaagttaacggaatctggcctaagtattccgatatcaacgacatcaatagtgttgacggaaactatatcggacaagttctggtcacggccgatgattacgggatcattaaactcttccgctatccatgtctaaggaaaggtgccaaattccggaagtacattggtcactccgctcacgtcacaaatgttcgatggtcccacgactaccagtgggtcatctctatcggaggagccgaccactctgtgtttcagtggaaattcattcccgagcgaaaactcaaggatgccgtgcacattgcaccacaggaatccttagctgacagccattctgacgagagcgactctgacttgtccgacgtgcccgagctcgatagtgaaatcgagcaggagactcagcttacctatagaagacaagtgtacaaggaagacctgccccagctgaaggagcaatgcaaagaaaagcagaagagtgctactagtaagcgccgagagcgggccccaggaaattctatccggctacattttgtccacggatatcgagggtacgattgtcgcagcaacttattttacactcagattggcgagattgtgtatcacgttgctgctgtgggggtcatctataaccggcagcagaatactcagagattctacctgggtcacgatgacgacattctctgtcttacaatccatcctttgaaagactacgtggccaccggccaggtcggccgcgatccttcaattcatatttgggatactgaaacaataaagccactaagtatcctgaagggacatcaccagtatggagtgtctgctgtcgacttctccgccgatggaaagcgcctcgcttctgtgggcatcgacgacagccatacggtagttttgtgggattggaaaaaaggagaaaaactaagtatcgcccgcggatctaaagacaaaatatttgtagtgaaaatgaatccctatgtgcccgacaagctgatcaccgcaggaattaagcatatgaaattctggagaaaggcaggaggcgggctgattgggcgaaagggatacattggcactttagggaagaacgatacaatgatgtgtgctgtttacggttggacagaggaaatggctttcagcgggacctctactggcgacgtttgcatctggagggatatttttcttgtgaagactgtcaaagcacacgatggtcctgttttttccatgcatgctctcgagaaggggttcgtcactggtgggaaggatggaatcgttgccctgtgggatgactcctttgaaaggtgcttgaagacctacgcgataaagagggcagcacttgctccggggagcaaagggctgttgctggaggacaatccaagcatcagggcgattagtcttgggcacggccatatcctggtcgggaccaaaaacggagagatcctcgaagtggacaaaagcggccctatcaccctgctggtgcaaggccatatggaaggagaggtctgggggctggcaacgcacccgtatttaccaatatgcgcgaccgtttccgacgacaagaccctgcgcatctgggatctctcaccttcgcattgtatgctggctgtccgcaaactaaagaaaggaggccgctgctgctgcttctcccctgacggcaaagcactggccgtcggccttaatgatgggagcttcctcatggctaatgccgacacgctagaggaccttgtcagttttcaccacaggaaagatatgattagtgatatcaggttctcacccggctccggcaagtaccttgctgtggcctctcacgactcgtttatcgatatttacaacgtaatgagcagtaaaagggtcggcatctgcaaaggggccaccagttacatcacccatattgactgggacatcagggggaaattactgcaggtgaacacgggtgctaaggaacaactcttctttgaagctcctagagggaagaagcagaccatcccaagcgtggaagtggagaagattgcttgggccagctggacatcagtcctcggactctgttgcgagggcatttggcccgtcataggggaagtgaccgatgttacagcaagttgccttacatctgataaaatggtcctcgcaaccggagacgatttaggctttgttaaactgttcagatatccgaccaagggcaaatttgggaagttcaaacggtacgtggctcatagcacgcacgtgacaaacgtgagatggacctacgatgattcgatgctggtaaccctcgggggtacagatatgtccctcatggtctggactaacgagatggagggatatcgggagaaacgtccttgtgactctgaagaaagcgatattgactccgaagaagacggggggtatgactccgatgtaacgagggaaaatgaaatcagttacaccattcgggcattgagcaccaacatcagacccatgctgggcatcaagccacacctccagcaaaaagaaccttccatagacgagcggcccccagttagccgagcccctccgcaacccgagaagttgcaaacgaataacgtcgggaagaagaaacggcctatcgaagatctggttctggaactgattttcggctaccgcggccgcgactgcaggaacaacgtgcattacttgaatgatggagacgatatcatctaccacacggccagtgtgggcattctacataatgttgctacaggttcgcaatccttctatcaagagcacaatgacgatattctctgtctgaccgttaatcaacacccgaaatttatcaacatcgtcgccacaggacaggttggggattccgcagatatgagtgctactgccccgtccatccatatctgggacgccatgaacaagcagacgctttccattctgcggtgctaccacagtaaaggagtctgctctgttagtttctcagccactgggaaactcctgttgtccgttggtttggaccctgagcatacgatcacaatatggagatggcaggagggggcaaaaattgcttcacgcgcaggtcataatcagaggatttttgttgccgaatttagacccgatagtgatacccaatttgtcagcgttggcgtcaagcacgtcaagttttggaccctagccggtcgggccttgctatccaaaaagggtctattatccaccctggaggacgcaagaatgcaaaccatgcttgccatagcttttggcgcaaacaaccttacattcacggggacaattagcggtgatgtgtgtgtctggaaagaccacattttgtgccggattgttgcgcgcgcacataacggcccagttttcgccatgtataccactttgcgggatggtctaatcgtaaccggaggaaaagagcgacccagtaaggaaggcggcgccgtgaaattgtgggaccaagagcttcgccggtgccgagcctttcgcctcgaaactgggcaggctactgattgcgtgcggtccgtgtgccgaggcaaaggaaagatcctggtggggactcgtaatgccgagatcattgaagtgggcgagaagaacgccgcctgcaacatcctggtgaacggccatgtggacggcccaatatggggcctggcaacacatccaagtcgcgatttcttcctcagcgcggccgaggatggtacggtgaggctctgggacattgcagataagaagatgctcaataaagtcaatttaggtcacgcggccaggactgtctgttacagccctgagggtgatatggtcgccattggcatgaaaaacggagaattcatcattctcctagtgtcatccttaaagatttggggcaagaagcgtgacagacggtgcgccatacacgatatacgcttttcgcctgattcccgctacctggcagttggatctagtgaaaactccgtagatttctacgacctgacactcggccctacactgaataggatctcttactgcaaagatattcctagttttgttatccagatggacttttctgctgatagtagctacctacaggtgagctcaggctgctataagagacacgtatatgaagtgcccagtggaaagcatctgatggaccatgctgccattgacaggataacatgggcgacttggacaagtattctcggagacgaagtgcttggaatctggtcacgacacgccgagaaggctgacgttaattgtgcgtgcgtgagccactccggaatctccctcgtcacaggcgacgatttcggcatggtgaaactgtttgatttcccatgcccggaaaagtttgctaagcacaaaagattcctcgggcacagtccccacgtcaccaatatccgattcacaagtggcgatagacatgtcgtgtcagcaggaggcgacgactgcagcctttttgtttggaagtgcgtccataccccccactag

SEQ ID NO: 15670 - DNA, 1146 bp, Artificial Sequence
  Description of Artificial Sequence: Synthetic coding sequence
atgccgctgcaggtgagtgattactcttggcagcagacaaaaacggctgtcttcctatcactgcctctgaaaggggtgtgcgtaagggacactgatgtattttgcaccgaaaactacttaaaggtgaactttccaccatttttgtttgaggcttttctgtacgcccctatcgacgacgaatcttctaaagctaagattggaaatgatactatcgtgtttacactgtataagaaagaagctgcaatgtgggagacactgtccgtgacaggcgtcgacaaggaaatgatgcagagaattcgggaaaagagcatcctgcaggcacaggagcgtgctaaagaagcaacagaagccaaagcagccgcaaagagggaagatcaaaagtacgccttgagtgtcatgatgaagattgaggaggaagaacgcaagaaaatcgaggatatgaaagaaaatgaaagaattaaggctaccaaagctctcgaggcctggaaggagtatcagaggaaggccgaagagcagaaaaagattcagcgcgaggaaaagttatgtcagaaagagaagcagatcaaagaggaaaggaaaaagattaagtacaagtccctgacccgaaacctcgcctccagaaatctggctccgaagggtcgcaatagcgagaatattttcacagaaaagctaaaggaagatagtatcccggcccctagaagtgttgggtccatcaagatcaacttcacacctcgggtattccctaccgctttgcgggagtctcaggtggccgaagaggaagagtggttacacaagcaagcagaggcccggcgagcaatgaatactgatattgccgaactatgtgatctaaaagaggaagagaagaatccagagtggctgaaagataagggaaataagctcttcgccactgaaaattacctggctgccatcaatgcctataaccttgctatcagactaaataacaagatgcccttgctgtacctgaaccgggctgcttgccatttgaagttgaaaaatctccataaggcaattgaggactcctccaaggaattctgttctttagaaggcatagaatgccaggcaagtgagccaaaactctctcaccacatcccaagtgatttgcacgtatatatacagatggcttag

SEQ ID NO: 15671 - DNA, 1344 bp, Artificial Sequence
  Description of Artificial Sequence: Synthetic coding sequence
atggccggcgccggaggggggaatgacattcagtggtgtttctctcaggtcaagggagccgttgatgatgacgtagctgaagcggatatcatctcaaccgtcgagttcaaccactccggcgaacttcttgccaccggtgataagggcggacgcgtggtcatattccagcaggagcaggagaataaaatccagagccacagccggggagagtataatgtatacagtacgttccagtcacatgagccagaattcgactatcttaagtcactcgagattgaagaaaaaatcaacaaaattcggtggttgccgcagaagaatgccgcccaattcctgctgtccacgaatgataaaactattaagctctggaaaatcagtgagagggataaacgccctgagggctataatttgaaggaggaggatggccggtatcgtgatccaactacagtgacgacactgcgagtgcctgtttttcggccaatggacttgatggtggaagctagccctaggaggatattcgctaatgcccatacctaccacattaactccatctccattaactcagactacgaaacatatttgtcggctgacgacctacgtattaacctctggcatcttgagattaccgatcggagctttaatattgttgacataaaacctgccaacatggaagagctgaccgaagtcattacggcagcagagtttcaccccaattcctgcaatacctttgtgtactcatcgtccaaggggaccattcgtttgtgcgatatgcgtgcaagcgcgctctgtgaccggcacagcaagctttttgaggagccagaagaccccagcaaccgtagttttttctcagaaatcatctcgtccatttctgatgtgaagttctcccactcaggtcgttacatgatgacccgtgactacttaagcgtgaaaatctgggacctgaatatggagaacaggcctgtggaaacgtaccaggtgcatgagtatctacggtccaaactctgctctttgtatgagaacgattgcatttttgataagttcgagtgctgttggaatgggagcgactccgttgttatgacgggctcgtataataactttttcaggatgttcgaccgaaatactaaaagggacattaccctggaagcctcccgagagaacaacaagccacgcactgtcctgaaacctcgcaaggtctgtgcctctggcaagcgaaagaaggacgaaatttctgtcgactctctggattttaataaaaaaatccttcacactgcctggcacccaaaggagaacataatcgccgtcgcaacaacgaacaatctctatatcttccaggataaagtcaattag

SEQ ID NO: 15672 - DNA, 1413 bp, Artificial Sequence
  Description of Artificial Sequence: Synthetic coding sequence
atggatcttcgagatcaggagctagtgaaaatcgtggggatcaggtatgaggtggggcccccaactctctgctgtctaaaactcgcttttatcgaccctgctacggggaagctcatggacaagtccttctccatacgataccacgatatgccggatgtgatcgacttcttggtgctaaggcagttctatgacgaggcccgccagcgaaattggcaaagctgtgaccgcttcaggagcattattgacgacgcctggtggttcggtactgtactgtcacaggagccataccagccccagtatcctgatagtcattttcagtgctacatagttagatgggacaacaccgaaattgagaagctaagcccttgggatatggaacctattccagacaacgtcgatcctcctgaagagctaggagctagcattagcgtcacaacagacgagttggagaagttactttacaaacctcaggccggagaatggggtcagaaatccagggatgaggaatgtgataggatcataagtggcatagatcagctcctgaatctcgatatagccgctgcgtttgccgggcctgtggatttgtgtacatacccaaagtactgcacggtggtggcctacccaacagacctgtacactattcggatgcgcctggtcaaccgcttttacaggaggctgagcgcgctggtatgggaagtgcgctatatagaacataatgctcgtacctttaatgagcctgaatcagtgattgccaggtctgccaaaaagatcactgatcaacttcttaaattcattaaaaaccagcactgtacaaacatctccgagctgtcgaacaccagcgaaaacgacgaacagaacgccgaggacctggatgactctgacctgcctaagacgtcttcaggacgaagacgggactatagggatatcatagacactcccatggacttcggaacagtgagagagaccttggatgcgggtaattatgacagtcccctggagttctgtaaagatattcggctgattttctctaatgctaaggcctacacaccgaataagcgctccaagatttattcaatgacactaagactctccgcacttttcgaggagaagatgaaaaaaatttcttccgacttcaaaattgggcagaaattcaacgagaaactcagacgatcacagcgctttaagcagagacagaattgcaaaggtgactcacagcctaacaagtccatcagaaatcttaagccgaagcgacttaaaagtcaaacgaaaatcatccccgaattggtgggctcacctacccagtctacctcgtcccgcacagcctaccttggcacgcacaaaacaagcgcagggatatccagcggggttacttccggtctgttcagattctcgagaatcatccgcaaagagtag

SEQ ID NO: 15673 - DNA, 516 bp, Artificial Sequence
  Description of Artificial Sequence: Synthetic coding sequence
atgtgtggtagggccccccccccagagatcactggccgcgaaccaggttaccatcttgtggaacagtcctgctggctgaagcctttacccaggaatctggggcattccctcttctggacagtgtggaagccaagacccgttagccagctggtagcccagcaagttacacagcagttcgtccccccaacccagagtaaaaaggagaagaaggacaaagtagaaaaagaaaaaagcgagaaggagaccaccagcaaaaagaatagccacaagaaaacccggcccagactaaaaaatgtagataggtcctcagcccaacacctcgaagttacggtgggcgatcttactgtgatcattactgattttaaagaaaaaactaaaagcccacctgctagctcagcagcgagtgctgaccaacactcacagagtggctcatcatcagacaacaccgagcgaggaatgtccaggtcgtccagcccgcgcggggaagcatcgtctctgaatggcgagagccactag

SEQ ID NO: 15674 - DNA, 417 bp, Artificial Sequence
  Description of Artificial Sequence: Synthetic coding sequence
atgggtgataaaaagtccccgaccaggaagcctcggcccgtctcccagctggttgcccagcaagtcacacagcagtttgtgcctccaactcagtctaagaaggaaaagaaggataaggtggagaaagagaagagcgaaaaggaaaccacctcaaagaaaaattctcacaaaaaaacacggccgcgccttaaaaatgtggaccggtcctccgcccaacacctggaggtcacagtgggcgacctgactgtcattatcacagattttaaggagaaaaccaagtctcctccggccagctccgctgcatctgccgaccagcacagccagtccggctcttcctccgacaacacagaacgagggatgtccagaagctctagcccacgtggcgaagcttccagcctgaacggcgagtcccattag

SEQ ID NO: 15675 - DNA, 1047 bp, Artificial Sequence
  Description of Artificial Sequence: Synthetic coding sequence
atgggacactgttgctgcaagccctataattgcctgcagtgtctcgacaagactaacgagtcagccctggtgaaggagaaggaactgtctatcgaactcgccaacattagagacgaggtcgcttttcatactgcaaaatgtgaaaagctgcagaaagaaaaagaggaattagaaaggaggttcgaggatgaggtcaagcgactggggtggcagcaacaggcagaattacaggaactcgaggagaggctgcagctgcagttcgaggccgagatggcgcgcctccaggaagagcacggagatcagcttctgtcaatcagatgccaacatcaggaacaggtagaagatttaacagcttctcatgacgctgctctgttggagatggaaaacaatcacacagtggccatcaccattttacaggacgaccacgatcataaggtccaagaactcatgagtacacatgaactcgagaaaaaggaactcgaggaaaatttcgaaaaacttaggctgtctcttcaggatcaggtggataccctaacttttcagagccaatctctgcgcgatagggccaggcgatttgaggaagccttaagaaagaatacagaggaacagctggaaatagcactggctccctaccagcacctggaggaggatatgaaatcattgaaacaagtgttggaaatgaagaaccagcagatccatgaacaggaaaagaagattttggaactcgagaaattggcggagaagaacatcatcctggaggagaagatccaagtgttgcaacaacagaacgaggaccttaaggccagaattgaccagaatacggtcgtaacccgtcagctctctgaggagaatgccaatcttcaggaatatgtggagaaagaaacccaggagaagaagcgactgtctcggacaaacgaagagctattgtggaagcttcaaaccggtgatcctacctctcctataaagctatcccctaccagccccgtttatcggggaagttcgagcggaccaagttcgccagccagggtgagcacaacacctagatag

SEQ ID NO: 15676 - DNA, 2664 bp, Artificial Sequence
  Description of Artificial Sequence: Synthetic coding sequence
atgaacagcggcggaggcctcccacctccttctgctgcagccagtccttccagctccagtttggctgccgccgttgccgtagtcgcgcccccaggggtgggaggagttccagggggcgccgctgtcggagtcaaacttaaatactgcagatactatgcgaaagataagacctgcttttatggcgaggaatgccaattcctgcatgaagatcccgcagctggagccgcccccggcctgggactgcattccaacagtgtcccgctcgccctggccggggcccctgtcgccgggttccctcctggcgccgtcgccggaggcggcgcaggccccccacccgggcctaaaaagccagatctgggcgacccaggaactggggcggcggcaggtgggggagggtcgtctggaggtttagacgggccacgacttgcaatccctggtatggacgggggggctttgaccgacaccagtcttacagacagctacttttccaccagctttattggcgtaaatgggtttggcagcccagtcgagaccaagtatcccctcatgcagaggatgactaacagcagctccagtcccagcctgcttaatgactctgcgaaaccttatagcgctcacgaccctctcacatccccagcttcgtccctgttcaatgattttggagctctgaatatctcccagaggcggaaacccagaaaatataggttaggcatgctggaggagaggttagtgcctatgggctctaaggctagaaaagctaagaaccccatcggctgcctcgcagaccggtgcaaatccggggtccccattaatatggtatggtggaacagggtaaccgagaataacctgcagacccccaatccaaccgcttctgagtttatcccaaaaggaggttctacctcccggctttcaaacgtctcacaatctaatatgtcggccttctcccaggtgttctcacatcccagcatgggttctccagccaccgcaggtctggcccctgggatgtctctgagcgccgggtctagcccacttcacagtccgaaaatcacacctcacacctctccggctcctcgccgtcggtctcataccccaaaccctgcctcttacatggtgcctagttctgcgagtacgagcgttaacaacccagtttctcagacaccgtctagtggccaggtcattcagaaggagacagttggggggaccacctatttttacaccgacacaactcccgcccccctgactggcatggtgttcccaaactaccacatttatcctcccactgcacctcacgtagcgtacatgcagccaaaagcaaatgcaccttccttcttcatggccgatgaactgagacaggaactgatcaacagacacttgatcacaatggcccaaatagaccaggcagacatgccagccgttccgaccgaagttgacagctatcattccttatttcccctagagcctctaccccccccgaaccgcatccagaaaagtagtaactttggctacattacttcctgctataaggccgtgaacagtaaagatgacttgccgtactgccttcggcggatccatgggtttagacttgttaatactaaatgtatggttctcgtggatatgtggaagaagatccagcactcaaacatcgttactttgagggaggtgttcactactaaagctttcgcggagcctagtctcgtcttcgcgtatgatttccatgcaggtggcgagacaatgatgagtcgtcatttcaacgaccccaacgccgacgcgtactttactaaacgaaaatggggtcagcacgagggaccgttgcccagacagcatgccggcctactccccgaatcgttaatctgggcctatatcgttcaattgtcttctgccctgaggacgattcacacagccgggctggcttgcagagtgatggatcctacaaaaattttgattactggcaaaaccaggttgagggttaactgtgtcggcgtgtttgatgtcctaacttttgacaatagccagaacaacaaccccctcgctctgatggcccagtaccagcaggctgacctcatctctcttggaaaagttgtgcttgcactggcttgtaactccctggcaggcatccaaagagaaaatctgcagaaggctatggagcttgtgactatcaactattcgtcagatcttaagaatctgatcctgtacttactaactgaccaaaaccgcatgaggtcagtgaacgacatcatgccaatgattggcgcaagattctacacacagttagacgccgctcagatgcgtaatgatgtgatcgaggaggacctcgctaaggaggtgcaaaacggacgcctgttcaggttacttgccaagctaggcaccatcaacgaacgccccgagttccaaaaagacccgacgtggagcgagaccggcgacaggtatctgctaaaactgtttagagaccacttatttcaccaggtaaccgaggcaggggccccctggatcgacctgtcccatataatatcgtgcctgaataagctggatgccggcgtgcctgaaaagattagcttaatttcccgggatgaaaaatcggtgctggtggttacctattccgatcttaagagatgcttcgagaacaccttccaggaactgatcgcggcagcaaacggccagctgtag

SEQ ID NO: 15677 - DNA, 1710 bp, Artificial Sequence
  Description of Artificial Sequence: Synthetic coding sequence
atggcaacactcgtggtcaacaagctgggagccggggtagactctggccggcagggaagcagggggacagccgtcgtgaaagtgctcgaatgcggcgtctgcgaagacgtgttcagcctgcaaggagacaaggttccgcgtcttttactttgcggacatactgtgtgtcacgattgtcttactcgcctcccccttcatgggcgggccataaggtgtccgttcgaccgtcaggtgaccgacctgggcgatagtggagtgtggggcttgaagaaaaattttgccttgttagaactgttggagcgacttcagaacggtccaattggccaatacggcgccgccgaagagtcaatcggtatcagcggggaaagtattattaggtgtgatgaggacgaagcgcatctggcatccgtgtactgtaccgtgtgtgcaacccacttgtgcagcgagtgcagccaggttactcattcaactaagacactggccaagcacaggagagtgcccctggcggataagcctcacgaaaaaaccatgtgctctcagcaccaagtgcacgcaatcgagtttgtgtgcctggaggagggctgccagactagcccccttatgtgttgcgtgtgcaaggaatacgggaagcaccaaggccataaacacagcgtactggaaccagaggccaaccagattagggccagcatcctcgacatggcacactgtattcgtacgtttacggaggaaatcagcgactatagtaggaagctggtgggaatcgtgcagcatattgagggcggtgagcagattgtagaagatggaatcggaatggctcacacagagcacgttcctggcaccgccgagaacgctagatcctgcattagggcctatttttacgacctgcacgagactctgtgccgtcaagaagaaatggccctgtccgtggtggacgcccacgtgcgagagaagctgatctggcttagacagcaacaggaagacatgacaatattactgtctgaggtcagcgctgcctgcctgcactgcgaaaagaccctgcagcaggacgactgtagggtggttttagcaaaacaggaaattacccggctccttgagacactacagaaacagcagcagcagttcacagaagtcgctgaccatatccagctcgacgcttccatccccgtgacgtttacgaaggacaacagggtgcacattggtcccaaaatggagataagggttgtgacactcggcctggacggcgcgggaaagacaacaattctgtttaagctgaagcaggacgaatttatgcagcctatccccaccatcggtttcaatgtcgagactgtggagtacaaaaacctcaaatttactatttgggacgtggggggcaagcataaattaagaccactttggaagcactactacttgaatacacaggcagttgtgtttgtcgtcgattctagccatagagataggatctccgaggcacatagcgagttggctaagctcctgactgaaaaagagctgagggatgcactgctattgatcttcgctaacaaacaagacgtggccggggctcttagcgtggaggagattaccgagcttctgagcttgcacaagctctgctgcggaaggagctggtacatacaagggtgtgatgcccggagtgtgttccagataatctgtgaccagtacaccggaaaggaagtggtgacagaaaaagggtag

SEQ ID NO: 15678 - DNA, 2061 bp, Artificial Sequence
  Description of Artificial Sequence: Synthetic coding sequence
atgggcaggattcatcaggcaatggtgaccagcctaaacgaagacaacgagagtgtaaccgtggagtggattgagaatggggacactaagggaaaggaaattgaccttgagtcgattttcagcttgaaccccgatcttgtcccggacgaggagatagaacctagccccgaaacaccccccccgccagcatcttcagctaaagtcaacaaaattgttaaaaaccggcgaaccgtggcctctatcaagaacgaccccccctctcgggataatagagtggtaggaagcgctcgagccaggccatcccagtttcctgaacaatctagcagtgcccaacagaatggtagcgtctccgacattagtccagtgcaagctgcgaagaaagaatttggcccccccagccgacgcaaaagtaattgcgtgaaagaggtcgagaaactccaagagaaacgggagaaacgccgattgcaacagcaagagctccgcgaaaagcgtgctcaggatgttgacgccacaaaccctaattacgaaatcatgtgcatgattagggatttccggggttcactggattacagacctctgactaccgccgaccccattgatgagcaccggatctgtgtctgcgtgaggaagcggccactaaataagaaagagacccagatgaaagacctggacgtcattactatcccttccaaagacgtggtgatggtccacgaacccaaacagaaagtggatctgacccggtatctggaaaaccagaccttcaggttcgactacgcatttgacgacagcgctccaaacgagatggtgtaccgatttactgcccgccctctggtcgagacaattttcgagagagggatggctacctgtttcgcctacggtcagacgggcagcggaaaaacccatactatgggtggtgatttcagcggaaagaaccaagattgtagcaaggggatctatgcccttgccgcacgggatgtctttttgatgctgaaaaaaccgaactataaaaaactggagctgcaggtttacgccaccttcttcgaaatttatagtgggaaggtgtttgacttactgaatcgtaagacaaaacttagggtgttggaggatggaaaacagcaggtccaagtcgtggggctccaggagcgggaggtgaagtgcgtagaagacgtactaaagttgattgatatcggaaacagttgccgaacgtctggacagacttcagcgaacgcacattcctcccggtcccacgccgtgtttcagattatccttaggaggaaaggaaagttgcacggcaagttcagcttgatcgacttggccggaaacgagaggggcgctgacacctcctccgccgacagacagaccagactggagggcgctgagattaataaatccctcctggcactcaaagaatgtatacgagccctgggacggaataagccacacaccccatttagggcttccaaactcactcaagtcctgagagactccttcatcggtgaaaatagtaggacttgcatgatcgccacaattagcccgggcatggcttcctgcgagaacacactgaataccctacgatatgccaaccgggtgaaggaactgaccgtggaccccaccgctgctggggacgtgcgccccatcatgcaccacccaccgaaccagatcgatgatttagagacgcagtggggagtaggatcatcaccacagagggacgacttgaagctgctctgtgagcaaaatgaagaagaggtctctccccaactctttacatttcacgaagcggtgagccagatggttgagatggaagagcaagttgttgaagaccacagggccgtttttcaggaaagtatcaggtggttggaagatgaaaaggcgctgctggagatgacggaggaggtcgactatgatgtagacagttatgcaacccagctagaagccatccttgaacagaagatagacatactcaccgaactacgtgacaaagtaaagagtttcagagcagccctgcaggaagaggagcaggcgagcaagcaaattaatcctaaaagaccaagagccctgtag

SEQ ID NO: 15679 - DNA, 618 bp, Artificial Sequence
  Description of Artificial Sequence: Synthetic coding sequence
atgtctgtggatcccatgacctacgaggcacagttctttggtttcacaccacagacttgcatgctcaggatctacattgcattccaagactatctttttgaagttatgcaagccgtggaacaagttatcttaaagaaactggacggcattcctgattgcgacattagccctgtacaaataagaaaatgcaccgagaaattcctttgctttatgaagggtcactttgacaatcttttctcgaaaatggagcaattgtttctccagctgatcctgcggattccaagcaacatccttctgcccgaggataaatgtaaagaaaccccatactccgaggaagatttccagcacttacagaaggaaattgaacagttacaggagaagtacaaaacagaactgtgcactaaacaggccctactagcagagctggaggagcagaagattgttcaggcaaaattgaagcagactctgacgttttttgacgagctgcacaatgttggtagagatcatggcacatcagacttcagggagagtctggtctccttagtacaaaattcccggaagttgcaaaatataagagataacgttgagaaggaaagtaaacgcctgaagatctcttag

SEQ ID NO: 15680 - DNA, 1866 bp, Artificial Sequence
  Description of Artificial Sequence: Synthetic coding sequence
atggtactgtgccccgttatcggaaagctgctgcacaaacgggtggtcctcgccagcgcatccccgagaaggcaggagatcctttccaatgcaggactgaggtttgaggtggtcccctcgaagtttaaagaaaaactcgacaaggcgagctttgccaccccctatgggtatgctatggaaaccgcgaagcaaaaggctttggaggtggccaataggctataccagaaggacctgcgcgcacccgacgttgtgatcggagccgacacaattgtaacggtcggagggctcatcctagagaagccagtggacaagcaggatgcatataggatgctctcaaggttatcaggacgtgagcactcagtgtttaccggggtcgccattgtccattgctccagcaaggaccaccagcttgataccagggtttctgagttctatgaagaaacaaaggttaaattctctgaacttagtgaggagctcctgtgggagtacgtacattccggcgaacctatggacaaagccggagggtacggcattcaggcactgggtggcatgcttgtcgaatcagtgcacggggacttcctgaacgtggtgggtttcccattaaatcacttctgcaagcaattagtgaaattgtattacccaccaagaccggaggatttacggagatccgtaaagcacgactccatacctgccgcggatacttttgaagacctttcagacgtggaaggcggcggctcggaacctacacaacgcgatgcaggcagtcgggacgagaaggcagaagctggggaggccgggcaggctactgctgaagccgagtgtcatcggaccagagagactctgcctccctttcctacaaggctgctcgaactgatcgagggatttatgctgtcaaaaggattgctcaccgcttgcaagctgaaggtgtttgatctcctgaaggatgaggccccgcagaaggcagcagatatcgcatctaaagttgatgcaagcgcatgcggcatggaaagactgctcgatatatgtgcagcaatgggattgcttgagaaaacagaacagggctatagcaacaccgaaacagccaacgtctatctcgcatcagacggcgagtattccttacatggatttattatgcataacaacgatctcacttggaatctgttcacatacttagagtttgctattcgggaggggacaaatcagcaccatagagccttgggcaaaaaggccgaggaccttttccaggacgcatactaccagtctcccgaaacacgtctgaggttcatgcgagccatgcatgggatgacaaaactgactgcctgtcaggtggcgaccgcctttaacctttctcgcttttcttccgcttgtgatgtgggggggtgtactggagccctggcgagagaacttgcccgagagtacccccgcatgcaggtcaccgtcttcgacctcccggacataatagagctcgccgcacatttccagccaccagggccccaggctgtgcagattcattttgccgctggggatttcttcagggatccactcccatctgccgagctatatgtactgtgtcggatcctccacgactggcctgacgataaggtgcacaagcttctgagccgggttgccgagtcatgtaaacccggggccggcctgttgcttgtggaaacacttctggatgaggaaaagagagtggctcagagggccctaatgcaatccctgaatatgctggttcaaaccgaaggcaaggaaagatcactgggggagtaccagtgcctgcttgagctgcatggattccaccaagtgcaggtcgtccacctcggcggcgtgctggacgccatactggccaccaaagtcgccccctag

SEQ ID NO: 15681 - DNA, 2541 bp, Artificial Sequence
  Description of Artificial Sequence: Synthetic coding sequence
atgttgtttactgtgtcgtgctccaagatgtccagcattgtggacagagacgattcttcgatatttgacgggctggtggaggaggacgataaagacaaagcgaaaagagtcagtcgcaataagtccgaaaagaaacgacgggaccagttcaatgtgttgatcaaggaactcgggtcaatgttacccggaaacgcacgaaagatggacaaatcaacggtgttgcagaagagcatcgatttcttgagaaagcacaaagagatcactgcgcagtcagacgcttccgagattaggcaggactggaaacctacattcctctctaacgaggagttcactcagctcatgctcgaggccctagatggattcttccttgcaatcatgactgatggtagcatcatctatgtcagcgaatctgtgacctccctgttggagcacctccccagcgatctcgtggatcagtcgatctttaacttcattcccgagggggagcatagcgaagtatacaagattctgtctacccatttactggaatctgactccttaactccagaatacctcaagtccaagaatcaattggaattttgttgtcacatgttgagaggaaccatcgatcctaaggagccatctacttatgagtacgtgaagttcatcgggaattttaagtcacttaatagcgtttcttccagcgctcacaacgggtttgaaggtaccatccagaggacgcatcgaccttcatatgaagacagggtctgtttcgtggcaacagttaggttggcaacaccccagttcatcaaagagatgtgcaccgtggaggaacccaatgaggaatttacaagtaggcatagtctggagtggaaattcctatttctggaccatcgggctccccctatcatcggctatttaccctttgaggtgctcggcacgtccgggtatgactactatcacgttgatgatctcgagaaccttgcgaagtgccatgaacaccttatgcagtatggaaagggaaaatcttgctattaccgcttcctgaccaaagggcagcagtggatctggctgcagactcattactacataacttatcatcagtggaatagccggcctgaattcatcgtgtgcacacacactgtggtttcctatgctgaagtgagagccgaacgacgcagagagctgggcattgaagagtccttgcccgagacagccgccgacaaatcccaagactccggtagcgataaccgaattaacaccgtgtccctcaaagaggcgctcgaacggttcgaccactcccctaccccgagtgctagcagccggagctcaagaaagagttctcatactgccgtttccgacccatcttccacacccactaagattcccacagacactagtactcctcccagacagcatctgcctgcccatgagaagatggtccagagaagaagcagcttttcttcccagtctataaacagccagagcgtcggctcttctctaacacagcccgtgatgtcacaggcaacgaacctgcctatccctcagggtatgagccagttccaattttccgcccagctgggtgccatgcaacacctgaaggaccagcttgagcagaggactcggatgattgaagctaacattcacaggcagcaggaagagcttcggaaaattcaggaacagctccaaatggtgcacggacagggactgcagatgttcctccagcagtccaatcctgggctgaattttggaagcgttcaactatcgagcggaaattccagcaacatccagcagttggctcccatcaacatgcaggggcaggtagttcccactaatcaaatccaatcaggcatgaacaccgggcacatcgggacaactcagcacatgatccaacagcaaacattgcagtcaacttctactcaaagtcaacagaatgttctcagcgggcactcccaacagacatccctgcccagccagacgcagtcgacattgacagctcccttatataacactatggttatttctcagcctgctgccggaagtatggtgcagattccctccagtatgccccagaactctacccagagtgctgctgtgaccacctttactcaggatagacaaataaggtttagccaggggcaacagctggttacaaaattggtcacagcccccgtggcatgcggagccgtcatggtgccctctactatgctcatggggcaagtcgtgacagcatacccgacattcgccactcagcaacaacagtcacagacgttgtctgtgacacaacaacagcagcagcaatctagtcaggagcaacagctgacctctgtccagcagccttctcaggctcaattaacgcaaccccctcagcaatttctgcagaccagccgactgttgcatggaaatccgtctactcaactgattctgtctgccgccttccccttacagcagtccacttttccgcagagccaccatcaacagcaccaaagccagcagcaacagcaactgtctcgtcaccggacagactcactccccgacccatccaaggtccaacctcagtag

SEQ ID NO: 15682 - DNA, 1818 bp, Artificial Sequence
  Description of Artificial Sequence: Synthetic coding sequence
atggttctttgccccgtgataggaaagctcctgcacaaacgggtggtgctagcgtctgcttcaccgcgaagacaggaaattctgagcaatgcaggactgcggttcgaagtggtgccatcgaaatttaaagagaagctagataaggcttcctttgccaccccatatggatatgctatggaaacagcaaagcagaaggcactagaggttgctaataggctgtatcagaccgttggcggcttaattctggaaaagcccgtggataaacaagatgcctacagaatgttgagtcggctttcaggacgagaacattccgtgtttaccggcgttgccatcgtgcactgcagtagtaaggaccatcaattagacaccagagtatcggaattctacgaagagacaaaagtaaagttcagcgaactctcagaagagctcctgtgggaatacgtgcatagtggcgagcccatggacaaggcaggcggctacgggatccaggcactgggcgggatgctagtggaaagtgtgcacggagactttctcaacgtggtaggatttcccttgaaccacttctgtaaacagctagttaagctctattacccgcctcggcccgaggatctgcgccgaagcgtgaagcacgactctattcccgccgcagatacttttgaggacctgagtgatgtcgagggtggaggttcagaacccacacagagagacgccggatcacgggacgaaaaggcggaggccggcgaagcaggccaggccacagcagaagccgaatgccatcgcacgagggagactctcccacccttccccaccagactcttggagctgatcgagggattcatgctctctaaagggctattgacagcatgtaaattaaaggtgtttgaccttctgaaggacgaggcccctcaaaaggccgccgacattgcctccaaggttgacgcttctgcttgcgggatggagcgcctcttagatatctgtgcagccatgggccttctggagaagacagagcagggatacagtaacaccgagacagctaatgtatacctcgcctccgacggagagtactctctgcatggttttattatgcacaacaatgacctgacatggaacctcttcacttatcttgaatttgcgatacgtgagggtactaaccagcaccacagggctctcggcaagaaagcagaggatctgttccaggacgcatattaccagagccctgagacccgacttaggttcatgcgagctatgcacggtatgaccaagctcaccgcatgccaggtggccacagcttttaacctcagtaggttttcctccgcctgcgatgtcggaggttgtactggagctctggctcgcgagctcgcccgagagtacccaagaatgcaggttacagtttttgacctcccggatattattgaactcgcagcccactttcagccgcccggtccccaggcagttcaaatccatttcgcggcaggcgatttctttcgtgaccctttgccctccgcagagctgtatgtactctgtcggatccttcacgattggcctgatgacaaagtgcacaagctgttgtctcgggttgccgaatcctgtaagccgggagccgggttgctcctggtggaaacactgctggatgaggaaaagcgggtcgcccagagggccctcatgcagagcctaaacatgctggtccaaactgagggcaaggagcgtagcctcggagaatatcaatgcctactggagcttcacggtttccaccaggtacaagtggtacacctgggaggcgtcctcgatgccatcctggctacgaaggtcgcgccctag

SEQ ID NO: 15683 - DNA, 696 bp, Artificial Sequence
  Description of Artificial Sequence: Synthetic coding sequence
atgacagtgggtaagtcgtctaagatgctgcagcacatcgactaccgcatgagatgtatcttacaagatgggagaatattcatcgggactttcaaggcattcgacaagcacatgaacctgattttgtgcgactgcgatgaatttcggaagattaaaccgaagaattccaaacaggctgaacgtgaggaaaaacgcgtgctcggccttgtgctgctgagaggagaaaatctggtttcaatgacagtggaggggccgccccctaaggatactggcatcgcccgtgtcccactggcgggcgccgctggaggacctgggatcgggagggcagctggccgtggcatcccagccggtgtgcccatgccacaggcccccgccggcctggccggccctgtcaggggagtcggaggcccttcccagcaagtgatgactcctcaggggcgcggaaccgtggcagccgcggctgccgctgctaccgcaagcatagcgggggccccaactcagtacccccctgggaggggggggcctcctccccccatgggaaggggggccccacctcctggcatgatggggccccctcccggaatgaggccccccatgggcccaccaatgggaatcccacctggcagagggacccccatggggatgccacctccaggaatgaggcctcctccgccaggaatgcgggggttactatag

SEQ ID NO: 15684 - DNA, 855 bp, Artificial Sequence
  Description of Artificial Sequence: Synthetic coding sequence
atgtggcgcgggctagccctggccagggctattgggtgtgccgcgcgcggtcggggtcaatgggctgtgcgcgcggcagattgtgcccagagcggacgacacccaggcccagccgtggtctgtggacgtcgcttgattagcgtgctggagcagataagacactttgtgatgatgcccgaaatcaacaccaaccacctggataaacagcaggtgcagctgttggccgaaatgtgcattttgattgatgagaacgacaataagattggtgcagagaccaagaagaactgccatttgaatgagaacattgagaaagggttactccaccgagccttcagcgtctttttattcaataccgagaacaagcttttgctgcagcaaaggtctgacgcaaagatcacattcccaggctgtttcaccaatacctgttgttcccatccactgtcaaaccctgccgaacttgaagagagcgatgctttgggagtaagacgggccgctcagaggaggctgaaggctgaattaggaatccctctggaggaagtcccaccagaggaaataaactaccttactaggatccattacaaggcgcaatccgacgggatatggggagagcacgagatcgattacatattgttagtacgaaagaacgtcaccctgaaccctgatccgaatgagatcaagtcatactgttatgtgtcgaaggaagagctgaaagagcttttgaaaaaggctgccagcggcgagatcaaaattaccccctggttcaaaatcatagccgcgactttcctgttcaaatggtgggacaacctcaaccacctgaatcagtttgtggaccatgagaaaatttatcgcatgtag

SEQ ID NO: 15685 - DNA, 180 bp, Artificial Sequence
  Description of Artificial Sequence: Synthetic coding sequence
atgaccaggggtaatcagcgcgaattagcccggcagaagaacatgaagaaacagtccgattccgtgaaaggcaaaaggcgcgatgatggtctgtctgcagcagcacgcaagcagagggattctgaaatcatgcagcagaaacagaagaaggccaatgagaagaaggaagaacccaaatag

SEQ ID NO: 15686 - DNA, 3039 bp, Artificial Sequence
  Description of Artificial Sequence: Synthetic coding sequence
atggaggaatacgagaagttctgcgagaaaagcctcgccaggatacaggaagcatccctgagtactgagtcatttctgccagcccagtctgagtccatcagcctaattagatttcacggcgtggctatcctatcaccgctgcttaatatagagaagaggaaggagatgcaacaggaaaagcaaaaggctctggatgtggaagcgagaaagcaagtcaaccgcaagaaggccctgttaactcgagtgcaagaaatcctggacaatgtgcaggtgcggaaagctcctaatgcaagcgactttgaccagtgggaaatggaaactgtctactctaatagcgaggtccggaacctgaacgtgcccgcaacctttccgaattccttcccatcccataccgagcactcaacagccgccaagctcgacaaaatcgccggcattttacctctggacaatgaggatcagtgtaagacagacggcatcgacctggcccgcgactcagaaggctttaactccccgaagcagtgcgactcatcaaatatttcccatgtggaaaacgaggcatttccgaaaacttcctctgctacaccacaggagactctcatttccgatggcccattcagtgtaaatgaacagcaagaccttcccctcttggcagaggtcatcccagatccctatgtgatgtctttacagaacttaatgaagaaatccaaggagtatatagaacgcgagcagagtcgccgctctctcaggggctcaatcaatcgcattgtcaacgagtctcacctggataaggagcacgatgctgtggaggtagccgattgcgtgaaagaaaaaggccagctcacaggtaagcactgcgtatctgtgattcctgacaagcctagcctgaacaagtccaacgtgctcctccagggggcttctacccaggcttcaagtatgtcaatgccagtgctggcctctttttctaaggtagacatccccatcaggaccgggcatcctactgttcttgagtccaattcagactttaaggtgatcccgacatttgtgaccgagaataacgttattaaaagcctgaccggaagttatgcaaaactgcccagccccgaaccttcgatgagccctaagatgcaccggcgcagatcaaggaccagctccgcctgccacatcctgatcaataaccccatcaacgcgtgtgaactgtcaccaaaggggaaagaacaggctatggatttaataatccaagatacggacgagaacaccaacgtccctgaaatcatgcccaagctgccaactgacctcgcaggcgtgtgtagctccaaagtgtacgttggcaaaaacacatccgaggtgaaagaggacgtggtcctcggtaagtcaaatcaggtgtgtcaaagctcaggtaatcacttggaaaacaaggtcactcatggcctggtgacagtagaggggcagctgacatccgatgagcgtggtgctcatattatgaatagtacttgtgctgccatgccaaagctgcatgagccttatgcgtcgtcacagtgtattgcctctccgaattttggcacggtgtctgggttaaagccagcctctatgctcgagaagaattgttcacttcaaacggagctaaacaaaagctatgatgtgaagaatccctctcctcttttgatgcagaatcagaatacccggcagcaaatggacacacctatggtcagctgcgggaatgagcagttcctggataacagcttcgagaaagtaaaacgccggttggacctggacatcgacgggcttcagaaggaaaactgcccttatgtgattaccagtggcatcacagagcaggaaaggcagcacctgcccgaaaagcgatacccgaagggctccggcttcgtgaacaagaataaaatgctaggcacctccagtaaagaatccgaggagctgctcaaatctaagatgctggctttcgaagagatgcggaaaagattagaggagcaacatgcacaacagttgtctctgctgatagctgaacaagaaagggaacaagaaagactgcagaaggaaatcgaagagcaggaaaagatgttgaaagagaagaaggcaatgaccgcagaggcttccgagctggatatcaataacgccgttgagctggagtggcgaaagatatcagactcatcacttttggagacaatgctgtcacaggccgactcactgcatacatccaatagcaactcaagcgggtttacaaatagcgcaatgcagtacagttttgtgagtgcaaatgaggctcctttttatttgtggggttcttctaccagcggtctaaccaagctgtctgtgacacgaccctttggacgcgccaaaacgagatggtcccaggttttttctttggagatccaagcaaaattcaataagatcacagccgtggccaaaggcttccttacaagacggctgatgcagaccgacaaactgaagcagctccggcagacagtcaaagatactatggagttcatcagatcgtttcagagcgaggcccccctcaagcgcggcattgtctccgctcaagatgccagtttacaagaaagggtcctggcccagctgcgagccgccctgtatgggatccatgatatcttttttgtgatggacgctgctgagcggatgagtattctgcaccacgatagagaggtgagaaaggagaaaatgctgcgccagatggataagatgaaatcacctagagtggcactttcagcggcaactcaaaaaagtctggatagaaagaaatatatgaaggcggctgagatgggtatgccgaataagaagtttctggtcaagcagaatccatccgagacgagggtgctgcagccaaaccaagggcagaatgcccctgtgcacaggctactaagccgccagggaacgccaaagaccagtgtgaagggtgtcgttcagaaccgtcagaaaccctcacagtcccgtgtcccaaatagagtgcctgttagcggcgtatatgcgggcaagatccagagaaaacgccctaatgtggcgacaatttag

SEQ ID NO: 15687 - DNA, 267 bp, Artificial Sequence
  Description of Artificial Sequence: Synthetic coding sequence
atggcgagtgcctctgcgcgaggtaaccaggataaggatgcacacttccccccccccagcaaacagtcactgcttttctgccctaagtcaaaactgcatatccaccgagctgagatctcaaagatcatgagggagtgccaggaagaatctttttggaagagggccctgcccttctccctggtaagtatgcttgttacgcaagggctggtgtatcagggctacttagccgccaattcccggttcggctcactccctaaagtggcctag

SEQ ID NO: 15688 - DNA, 738 bp, Artificial Sequence
  Description of Artificial Sequence: Synthetic coding sequence
atgaacggaagagcagactttcgagagcctaacgcggaggtgccacgcccgatcccccatatcgggcctgattatatcccgaccgaggaagagcggagggtattcgccgagtgcaacgacgagtccttttggttcaggtccgttcctctagcggctacttcgatgttaattacccagggacttatttccaaaggtatcctctccagccatcctaaatacggtagtatccctaaactgattctggcctgtataatgggctatttcgctgggaaactctcttatgtgaaaacctgccaggagaaattcaaaaaacttgagaattctcctttgggcgaggccctgagaagcgggcaagctcgtcgatcaagccctcccggacattattatcaaaaaagcaagtatgactcttctgtgtccggacagagcagctttgtgacaagtcctgcagcagataacatcgaaatgttaccacattacgagccaataccatttagctcttctatgaacgaaagtgctcccacaggaatcacagatcacatcgtgcagggaccagatcctaacttagaagagtcgccaaagagaaaaaacatcacttatgaagaactgcggaataaaaacagagagtcctacgaggtttcccttacgcagaaaaccgatcccagcgtccggcccatgcacgagcgagtaccaaaaaaagaagttaaggtaaacaagtatggcgatacctgggatgaatag

SEQ ID NO: 15689 - DNA, 1551 bp, Artificial Sequence
  Description of Artificial Sequence: Synthetic coding sequence
atgtcataccctgccgacgactacgaaagcgaggcagcatacgacccctatgcttatccttcagactatgacatgcacaccggagacccgaaacaggatcttgcctatgagcgccaatacgaacagcagacctatcaggtcatccctgaagtgattaaaaactttattcaatactttcacaagactgtgtccgatctaatcgaccagaaagtttatgaacttcaggcaagccgcgtgagttcagatgtgatcgaccaaaaggtttacgagattcaggatatttacgagaatagttggacaaagttgaccgagagattcttcaagaatacaccttggcctgaagccgaagccattgcgccccaggtgggtaacgacgctgtcttcctcatcctctacaaggaattgtactataggcatatttatgcaaaagtgtcgtttcagagtttctctcaataccgctgtaaaaccgccaaaaagagcgaggaggagatcgatttccttagatcaaacccaaagatctggaacgtgcattcagtcctcaacgtgctccatagcctcgtagataagtctaacatcaaccgtcagcttgaggtgtatacctctggcggtgaccccgaatcagtggctggtgaatacggcagacactccctctacaaaatgttaggctatttcagtctggtgggactgctacgccttcacagcctcctcggcgattactaccaagcgatcaaagtgctggagaatatcgaactcaataagaagagtatgtatagcagagttcccgagtgtcaagtgactacctactactatgtggggttcgcatatctgatgatgagacgctatcaagatgccataagagtcttcgctaacatattgctgtacatccagcggactaagtcaatgtttcaacggaccacctacaagtatgagatgattaataaacaaaatgagcagatgcacgcactactggcaatcgcactaaccatgtacccaatgcggattgatgagtcaatccatttgcagctcagggaaaaatacggtgacaagatgctcagaatgcagaagggcgatccacaggtgtacgaggaattattctcctacagctgtccaaaatttctcagtcccgtggtaccaaactacgacaacgttcatcctaactaccataaggaaccatttctgcagcagctgaaagttttttccgacgaagtgcagcaacaggctcagctcagcacaatccggtcatttcttaagctatatacaactatgcccgtggccaaactggctggtttcctggacctgaccgaacaagaatttagaatccaactcctggtcttcaagcataagatgaagaatctggtgtggacatcaggtatctctgccttagacggtgaatttcagtctgcatccgaggtggacttttatattgataaggacatgattcatatcgccgacaccaaagtggcccgaaggtacggcgatttcttcattagacagattcacaaattcgaggaactcaaccgtacattgaaaaagatgggtcaaagaccatag

SEQ ID NO: 15690 - DNA, 2502 bp, Artificial Sequence
  Description of Artificial Sequence: Synthetic coding sequence
ctttcacgacgtgtgccttgcgtgagaagaggatgtcggccccctcttccaccattacctggctcccaaagtagagcctggtctagagatcgggaggctccactggatccggggaggccggctcaaagcgggcgacgacccacaagcaggtcagtgtcacacgcttgcagctggaacggaggctctctggatccactggaagggacccctgctctcctgcgcagtgcggaacggctcatgcgcaaggttaagaagctgcggttggataaggaaaacaccggctcatggagatcttttagcttgaacagcgaaggggccgagagaatcacctcatacgatttccactccgaaagcgggctgttcctgttccaggcaagcaactctctatttcactgccgcgacgggggaaagaacggcttcatggtgtcaccaatgaaacccttggaaatcaagacacagtgctcagggcccagaatggatccaaaaatctgcccggccgatcccgcgttttttagtttcattaacaacagcgatttatgggtggctaacatagagactggagaggagagaaggctgactttttgccatcagggtctttccaatgtgttagatgaccccaaaagcgcaggggtggccacattcgtgatccaggaggagtttgaccgttttaccggatactggtggtgccctacagcctcgtgggagggctccgagggcctgaaaaccctgaggattctctatgaagaggtagacgagtccgaggtggaagtgatccacgtgccttccccagccttggaggagagaaagaccgactcataccggtaccctcgaaccgggagcaaaaatccgaaaatcgccctgaagctggccgaattccaaacagatagtcagggaaagatcgttagtacgcaggagaaggaactcgtacaacccttctcgtcgctgttccccaaggtcgaatacatcgccagggctggctggactagggacgggaagtacgcctgggcaatgtttctggatcggccacagcagtggctgcagctggtattactcccacctgccctcttcattccctcgacagaaaatgaagaacagcggctggcgtccgcccgggccgtgccaagaaacgtgcagccttacgtggtgtacgaggaagtgactaatgtttggatcaacgtgcatgacattttctatccatttcctcaaagcgagggagaagatgaactgtgttttttaagagcaaatgagtgcaaaacaggtttttgccatttgtacaaagttactgccgtgttgaagagccagggatacgactggagcgagcccttctcacccggcgaagacgaattcaagtgtccaatcaaagaggaaatcgccctaacctccggtgaatgggaggtgctggctaggcacgggagtaaaatctgggtgaacgaggagaccaagctcgtgtacttccagggaaccaaggacaccccccttgagcaccacctgtatgttgtgtcctatgaagccgcaggtgagatcgtgcggttgacaactcctggcttctcacatagctgtagcatgtcacagaattttgatatgttcgtgtcccactactccagcgtgtccactcccccctgcgtgcacgtgtataagctgtccgggccagatgacgatcccctgcacaaacaaccaaggttctgggcatctatgatggaggccgcctcttgccctcccgattacgtacccccagagatcttccactttcacactagaagtgacgtacggctttacggaatgatttataagcctcacgcactccaacccgggaaaaaacatcctactgtgctctttgtgtatggaggcccacaggttcagctcgtgaataattcatttaaaggaataaagtaccttcgcctgaataccttggcatccctcgggtatgcagtggtggtgatcgacggtcggggttcctgtcagagaggtcttaggtttgaaggagctctgaaaaatcaaatgggccaggtggagatcgaggaccaagtagagggactccagttcgtagcagagaagtacggcttcatagacctgagccgtgtggccatccacggatggagctatggagggttcctctccttgatggggctaatccataaaccacaggtgttcaaggtggcaatcgccggggcaccagttacagtctggatggcgtacgataccggttacactgaacgctacatggatgtacctgaaaacaaccagcacggatacgaagctggatccgtggccctccatgtggagaaactccccaatgagccgaacaggttgctgattctgcatggtttccttgatgagaacgtccacttctttcacaccaattttcttgtatctcaactgatccgggcagggaaaccgtaccagctacaaatctatcctaatgagcgacactccatacgctgccccgaatcaggggaacactacgaagtgacccttctgcatttcttgcaagaatacctttag

SEQ ID NO: 15691 - DNA, 5073 bp, Artificial Sequence
  Description of Artificial Sequence: Synthetic coding sequence
atggattgcctgctcgagctaagtgccactgacacaaagatcgaggaatctagctcccagtcctttgttgcaagcgaaaatcaggtcggcgcggcggagagcaagataatggaaaagaggcccgaggaggaaagcgaagacagcaaaatggacagttttttggacatgcagttgactgaggacctggactccttgatccaaaacgccttcgagaaactaaattcttcccctgacgaccaagtgtacagtttcctaccctcacaggatgtgaattcttttaacgactctagtgagtttatcaaccccgactcttccaacatgacacccatttttagcacacagaatatgaatctaaatggcgaaaatctcgagaattctggttcgaccctttcactcaatcctttgcccagccatagtgtattaaatgagtcgaagtgcttcattaaggataacaccctcgcactcgaatcaaactaccccgaagattccctgctcagctcatcattgaacgtggcaagtgacagcattgcaggttgcagctccttaaatcagaaacagaaagagctattggagagtgagtgtgtggaggcacaattttccgaggcacctgtggatcttgacgcttccgaaccacaggcttgtcttaacctacctggcctggacctgcccggcaccggcggcgaccaaaagagcacccgcgtcagcgacgtctttttaccatctgaaggattcaatttcaagccccacaaacaccctgaactacctactaagggtaaggatgtgtcatactgtcccgtgctggcccccttgcctctcctgctgccaccccccccaccacctcccatgtggaaccccatgatacccgctttcgatctgttccaaggaaatcacgggtttgtcgcccccgtggtgaccaccgccgctcattggagaagtgtgaactatacatttccccctagtgtaataagtcacacttcgcctaccaaggtgtggaggaataaagatggcacttcagcctaccaggtgcaggaaacaccagtgtcccaagtagtgcggaagaagacaagttatgtcgggctggtgttggtgttattgcgaggcttacctggctccgggaaatcatttctggcccggactctccaggaagataatcctagtggggtgattctgagcaccgacgattacttttacatcaatggacagtaccaattcgacgtgaagtacctaggagaggcccatgaatggaaccagaatagggccaaggaagcttttgagaaaaagattagtcctattattatcgataacacaaatctccaagcgtgggaaatgaaaccctacgtggccctaagccagaagcacaaatacaaggtgctgttccgagagcccgacacatggtggaaatttaagcccaaagagttagcccggcgcaacatccatggcgtgtctaaggagaaaatcactaggatgctcgaacactaccagagattcgttagtgtgccgatcatcatgagtagttccgtgcccgaaaaaatcgagcgcatcgagttatgcgcctatagctgtgaggacaggtctacatctccaagggatgacgaggacatcatatcagagaaagaggagaacatcctgtcactgtccctgaaacatttagagttcactgaagagaaaaacctggacgttaccaaggaaaccatgttaccagaaaacgtcgcttatctttccaacgccgacctgaataagcggcggaaggagattagtgacatgaaccctagtatccagtccgctctgatcctcgaaaccccccacatgtatttttcagattccgagagcaagttgcaggccaccgacaagtccgaaaacgaacagattgagatggttgccgtcaaggggtattccaaaaccgatactgattcctccatggagagggtttcaccaagcacatgctgttcggagaataatcaagaagactgtgatctggccaacagcggacccctgcagaacgaaaagtccagtcccggcgaaattgtcgaagaacgggcgaccgtgaccaagaaggccttcggtaaacagaagagtaagtcgaccctggagaaattccctagacatgagctaagtaactttgtgggagattggcccgttgacaagaccattgggcagcgcaccaagagaaatcgcaagacagaaaaaacttcaagcgtccagtctgataaaaagtacaactatccacagtcacacaagctggtcaactcggttagtgtgaatacagattgcgtccagcaaaggggctcgccccacgagtcagtggaggatggtcgaaagtcgcagtgcgatgatgcctccgaacccctgaactcctacaagtacgacgcgtataagaacatcgataaaaattctttcaacattatgggcgactggccctccagcgacagtctggctcaaagggagcacagatccaggatgcccaaaactggactgtccgagccaaatctcgaaataggcacgaatgacaagatgaacgaaatcagcctgagcacagcccatgaagcttgttgggggaccagttcacaaaagctcaaaaccttggggtcttccaacctggggtcctccgagatgctgctgagtgaaatgacctgcgagagccagacatgcctgagtaagaaatcacatggtcaacacacatctttaccacttactttcaccaattcagcaccgactgtatcaggtgttgtagagccccagaccttggccgagtgtcaggagcaaatgcctaaaagagacccaggaaaagaagttggcatgtgcactcagacagagccccaggactttgccctcctgtggaagattgaaaaaaataaaatttccatatcagacagtattaaagtgctgacgggacgcctggacggctttaaacccaaagtcttcaatataaacacaaagtccgatgtgcaggaggccataccgtatcgggtgatgtatgataagtcaactttcgtcgaagagagtgagctaacatcggccgatgaatccgagaacttgaacatcttatgcaaactcttcggctctttctccctggaagcactcaaagatctgtacgaacgctgtaacaaggatatcatctgggctacatctctccttttggattctgaaacaaagctgtgcgaagacaccgaatttgagaatttccagaaaagctgcgacgggtcccagatcggacctttttcactgggcctcaatctcaaggagatcatctcccaacgaggaaccctcgaaaattccaacagccccgtaccggaattctcccacggcattggaatctctaatgcggactctcagtccacctgcgacgctgagagaggaaattccgaacaggcggagatgcgcgcagtcacccctgagaaccatgaatccatgacgtccatttttccgtccgcagctgtgggtctgaaaaataacaacgatattcttcctaacagccaagaggagttgctttatagcagcaaacagtctttcccaggcatccttaaggccaccactcccaaagatatgagcgagacggaaaaaaacctggtggttaccgaaacgggcgataacattcacagtccatctcacttttcagacatttttaactttgtgagctccacatccaacctcgagcttaacgaagaaatttattttactgattcacttgagatcaagagaaatgaaaactttcctaaggactacgtgaaattctccgacgaagaagaattcatgaatgaagatgagaaagagatgaaagagatcctgatggcagggtccagtctctctgctggcgtcagcggcgaggataagacagagatactgaacccaaccccggccatggctaagtctctcaccatagattgtctggagttggccttgcccccggagttggcattccagttaaatgaactgtttggaccagtggggatagattccggctccctgaccgtggaggactgtgtggtacatatcgatctgaatctcgccaaagtgatacatgagaagtggaaagaaagtgtaatggagcggcagcgtcaggaagaggtatcctgtggaaagtttatgcaggaccctagcttggtgggccacacaggcctggacaatccggagcagaagagctcacagcggactggaaagaaactgctcaaaactctgactgcatctgagatgttgcctctcttggatcactggaatactcagactaagaaagtgtccctgcgcgaaatcatgtccgaggaaattgcgctgcaggagaagcacaacctaaagcgtgaaacattaatgttcgagaaggactgcgccactaagctcaaggagaagcaactgtttaaaattttccccgcgattaatcaaaattttcttgtggatatttttaaggatcataattatagcctcgagcatactgtgcagttcttaaattgtgtattggaaggcgatccagtgaagactgtcgtggcccaagagtttgtgcaccagaatgaaaatgttacaagtcacacagggcagaaatcaaaggaaaaaaaacccaaaaaactcaaagagaccgaggagacaccatctgaactgagctttcaggacttcgagtaccctgactatgacgattatcgggctgaagcctttctgcaccagcagaagagaatggaatgctacagcaaagccaaagaggcctaccgaatcggtaaaaagaatgtggccacattctacgctcagcaggggactctgcacgagcagaaaatgaaagaggccaatcatctagctgccatcgagatcttcgaaaaggttaacgcctcactgcttccacaaaacgtccttgatctgcacggcctgcatgttgatgaggccctggagcacttaatgcgtgtcctcgagaaaaaaactgaggagtttaagcagaatgggggaaaaccatatctgagtgtgatcaccggacgaggtaaccactctcagggcggagtggcacgcatcaaacctgcagtgataaaatatctcatcagccactcttttaggttctctgaaattaagcctggctgtttaaaggttatgttgaagtag

SEQ ID NO: 15692 - DNA, 477 bp, Artificial Sequence
  Description of Artificial Sequence: Synthetic coding sequence
atgggctctggctcaagccgcagctccaggaccctgcggcgtcggcggtcacctgagtccttacccgctggacctggtgcagctgccttggagggcggtacccgtagacgcgtgcctgtggccgccgccgaagttcctggcgccgccgcagaagaggctcccggacgggatccctcacccgtagccccccctgacggtcgggatgaaacactgcgtctgctggacgaactcctggccgagtcagcggcatgggggccccctgagcctgcacccagacgacctgcaagattacggcccactgcggttgccggatccgctgtttgcgccgaacagtcaacagagggccatccgggtagcggtaacgtgtcagaggctccgggctctgggcgcaagaaaccagagcgaccggctgccattagctacgaccatagcgaggaaggcctcatggcttctatcgagcgcgagtactgcagatag

SEQ ID NO: 15693 - DNA, 738 bp, Artificial Sequence
  Description of Artificial Sequence: Synthetic coding sequence
atggagaagacagaattaatccagaaggctaagcttgccgagcaggccgagcgttacgacgacatggctacatgtatgaaagcagtgactgaacaaggcgctgagctgtcaaatgaagagcgcaatttgttgtctgttgcttataaaaatgtggtgggaggtcgccggtcagcatggagagttatttcctcgattgaacagaagaccgacaccagcgacaaaaagttgcaactgatcaaagactacagagagaaagtggaatcagaattaagatcgatttgcacaacggtgctggaactactggacaagtatcttattgccaacgccaccaacccagaaagtaaggtattctacttaaagatgaaaggcgactacttccgttacttggccgaagttgcctgtggcgacgacagaaagcagaccatcgataatagccagggcgcgtaccaggaagcgtttgatataagtaaaaaggagatgcaaccgacccaccccattagacttggtttggccttgaattttagtgtgttttattacgagatcctgaacaaccctgagctcgcgtgcaccttggctaagacggcctttgatgaggcgattgcggagctcgataccctcaacgaagacagctataaagactcaactctcatcatgcagctcctacgcgacaacctcaccttatggacatcggacagcgccggtgaggagtgtgatgcagccgaaggagccgaaaactag

SEQ ID NO: 15694 - DNA, 1014 bp, Artificial Sequence
  Description of Artificial Sequence: Synthetic coding sequence
atggagcagccctggccacctcctggtccttggagtctgccaagggcggagggtgaggcagaagaagaatcagactttgatgtgttcccctcatctccccggtgtccccagctgcccggcggcggcgcccaaatgtactcccacgggattgaactcgcttgtcagaaacaaaaagagtttgttaagagctccgtagcttgtaagtggaatctcgcagaggcccagcaaaagctggggagtttagctttgcataactctgagtctcttgaccaggagcatgctaaagcccagaccgctgtaagcgagctccgtcagcgagaagaagagtggaggcaaaaggaggaggcccttgtgcaaagggaaaaaatgtgcctctggtccacagatgctatttccaaggacgtttttaataaatcgttcatcaaccaggacaagaggaaggacactgaagacgaagacaagagtgaatcctttatgcaaaagtacgagcaaaaaattaggcattttggaatgctctcccggtgggatgactctcagaggtttctgtctgaccacccttatctcgtatgtgaagaaaccgctaaatatttaatattgtggtgtttccacttggaggcagagaaaaagggagcgctgatggagcagatcgcacaccaagccgttgtgatgcaatttataatggagatggcaaaaaactgcaacgtcgatccacgggggtgcttccgtctgttctttcagaaggcaaaggcggaggaagaaggctatttcgaggcctttaaaaacgaacttgaggctttcaagtcacgagtgaggctttacagccaatcccaatcctttcaaccgatgactgtgcagaatcacgtcccgcacagtggcgttgggagtatcgggctgttagagtctttgccccagaatcccgactacctccagtacagtattagcactgccctatgtagtctgaatagtgtagtgcataaggaggacgacgagccgaaaatgatggacaccgtgtag

SEQ ID NO: 15695 - DNA, 927 bp, Artificial Sequence
  Description of Artificial Sequence: Synthetic coding sequence
atggagcagccttggcccccaccaggtccttggagtctaccacgggccgaaggtgaggcagaagaagagtcggattttgatgtatttcctagctccccccggtgcccacagctgcccggcgggggggcccagatgtattcccacggaattgaactcgcatgccaaaaacagaaggaatttgtgaagtctagtgttgcatgcaagtggaatctagcagaggcccaacagaagctgggatccctcgctctccacaacagtgaatcacttgatcaggaacacgcaaaagcccaaactgcagtgtctgaacttcggcaacgggaagaggagtggcgccagaaagaggaggccctagtgcagagggagaaaatgtgcctgtggtctacggacgccatctccaaggacgtgtttaacaagagctttattaatcaggataaaagaaaggataccgaagatgaggataaatctgaatctttcatgcagaaatacgagcagaagatccgtcatttcggcatgcttagtcgttgggacgactcacagaggttcttaagcgatcatccctatttggtgtgcgaagagaccgccaagtacctgatcttgtggtgtttccacctggaggccgaaaaaaaaggggctctcatggaacagatcgcacatcaggccgttgtcatgcagttcataatggaaatggccaagaactgcaacgtggatccacggggttgtttcaggctcttcttccagaaggctaaagctgaggaggaagggtacttcgaagctttcaagaacgagctggaagctttcaaaagccgcgttaggttgtattcccagtctcagagcttccaacctatgaccgttcaaaatcatgtaccgcattcaggagtcggttccattggacttcttgaatctctgccccaggctcccagattttag

SEQ ID NO: 15696 - DNA, 4227 bp, Artificial Sequence
  Description of Artificial Sequence: Synthetic coding sequence
atgtggagcctgaccgcatctgagggagagtccaccacagctcacttctttctgggggctggcgacgagggtctcggcaccaggggaatcgggatgagaccagaggagtccgactccgagctacttgaagacgaagaagacgaggtaccccccgagccacagattatcgtaggtatttgcgccatgactaagaaaagtaagagcaaaccaatgactcagatccttgaacgcctttgtcggtttgactatctcactgtagtgatcctgggggaggacgtgatccttaatgaacccgtggaaaattggccatcatgccattgtctgatttcctttcacagtaagggtttccctcttgataaggccgtcgcgtactccaagctccggaatccctttctgatcaatgatctggcgatgcagtactatatacaggatagacgagaggtgtacagaatactccaggaggaaggcattgatctgcccagatatgctgtgttgaatagagaccctgcaagacccgaagagtgcaacctaatagagggagaggaccaggtggaggtgaacggagcagtctttccaaagccatttgttgaaaaacctgtttctgctgaggaccataacgtgtacatttattacccatcgtccgctggcggcggttctcagcgcctgttccggaaaattgggagtcggagctctgtgtacagtcctgagtcctctgtgaggaagaccggcagctatatatatgaagagttcatgcccacggatgggactgatgtgaaggtgtatacagtcggaccggattatgcccacgccgaggctcgtaagagtccagcactcgatggtaaggtcgagagagatagtgagggtaaggagatcagatatcctgtaatgctgacagcaatggagaagctcgtggcaaggaaggtgtgtgttgcatttaagcagaccgtttgcggatttgacctcctcagagccaatggccacagtttcgtgtgtgatgtgaatggctttagcttcgtcaagaattcaatgaaatactacgacgactgtgctaagatcctcgggaatactatcatgagagagctggctcctcagttccagatcccttggagcatcccaactgaagctgaagatattcccattgtccctaccactagtgggacaatgatggagttacgctgcgtaatcgccattataagacatggagacagaacgcctaagcagaaaatgaagatggaagtgaagcaccctaggttctttgccttattcgagaaacacggcggctataagacaggcaaattaaaacttaaaaggcctgaacaactgcaggaggtattggacattacgagactgttattagccgaactggagaaggagcccggcggcgaaattgaggagaaaacaggaaaactggagcagctgaagagcgtcttggaaatgtacggacatttctcaggcatcaaccggaaggtacagctgacctactatcctcacggagttaaagcgtccaacgaggggcaggacccgcagagggaaactctggcaccatctcttctgctggtgttaaagtggggcggagagctaacgcctgcgggaagggtccaagcggaggaactaggccgggcgtttcgctgtatgtatcctggggggcaaggcgattacgcggggtttcctggttgtggtctgttgcgactccacagtacattcagacacgatctaaagatttatgcttccgacgaggggcgggtccaaatgactgcagctgcttttgctaaggggctcctagccttggaaggggagctcactccaattcttgtgcaaatggttaaatcggctaacatgaatggtctcttggatagcgatggcgattcactatcctcctgtcagcatagagttaaagcacgactgcatcatattctccagcaagatgcaccttttggccccgaggactatgatcagctggcgccaacccggtccacatctcttttaaactccatgactattattcagaatcccgtgaaagtgtgcgatcaggttttcgcactcattgaaaatttgacacatcaaatccgtgaaaggatgcaggatcccaggtccgtggacctgcagttgtaccactcggagacactggaactcatgctacaaagatggtcaaaacttgaaagagatttcagacaaaaaagtggacggtacgatatctctaaaatacccgacatatatgactgcgtaaaatacgacgtacaacataatgggagtctgggcctgcagggcaccgcagaactgctgcgcctgagcaaggcgcttgcagatgtcgtcatcccacaggagtacggcatttcccgggaagaaaaactggagatcgcagtgggattttgcctccccctgcttcgcaagatcctcctggacctgcagagaacacacgaagatgaatcggttaacaagcttcacccactgtacagccggggagttctgtctccaggcagacacgtacgaactcgcttatatttcacgtcagagtcacacgtgcatagcttattatcggtcttcagatacgggggcctgctcgacgagacgcaagacgcacagtggcaacgtgctcttgattacttgtcagcgatttccgagcttaactacatgacacagatcgtgatcatgctgtacgaggataatacacaggatccactgagtgaggagagatttcatgtcgagctccatttctcaccgggggtgaaaggcgtcgaggaggagggcagcgctcctgcagggtgcggattcaggccagcatctagcgagaacgaggagatgaaaactaaccaggggagcatggaaaacctatgccctggtaaggcctccgatgagcccgacagagcacttcagactagcccccagcccccagagggacctggccttcctcgcaggagcccactgattcgcaatcgcaaagcaggatccatggaagtgctgtcagaaaccagttcctcgagaccaggaggatatcggctgttttcatcgtctagaccacccacagagatgaaacagtcaggcctaggatcccagtgcacgggcctgttctccaccacagtacttggagggagtagctccgcccctaacttacaggattatgcacggtcccacggaaaaaagcttccaccggcaagccttaaacaccgggacggcttcgagggatgctctatggtgcctactatttatccactcgagacccttcataatgcactgagtctgagacaagtttcagagtttctgtccagagtatgccagcgccacacagacgcccaagctcaggccagcgcggcgcttttcgactctatgcattcttcccaggccagcgataatccgttttctccacctcggaccctccattcccctcccctgcaacttcagcaacgcagtgagaaacctccttggtacagtagtggtcccagctccactgtctctagtgccggtccatccagtcctaccacagtggacggaaattctcaatttggttttagtgaccagcctagcctgaacagccacgtggccgaggaacaccagggcttgggcctgctgcaagagactccgggctctggtgctcaagagttaagtatcgagggcgagcaggagctttttgagccaaatcagtccccccaagtgcctcccatggaaacttctcagccatacgaagaggtgtcacagccatgtcaggaggtcccagatatttcccaaccttgccaggacattagtgaagccctgagtcaaccctgtcagaaggttccagatatttcccagcagtgccaggagaatcatgataatggaaatcacacgtgtcaggaagttccccatatctcacagccttgccagaagtcctcccagctgtgccagaaggtctccgaagaggtctgccaactctgtttggaaaactcagaagaagtgagccagccatgtcagggtgttagcgtggaggtggggaaactggtacacaaatttcacgttggagtgggctccctggtacaggagactctcgtggaggtggggtctccagccgaggagatacccgaggaagttatccagccctatcaagagttctcagtcgaagtcggtcgcttagcgcaggagacaagtgccatcaatctgttaagccagggtatcccagaaattgacaaaccaagccaggaatttcccgaggagatcgacctgcaggcacaggaggtgcctgaagagatcaattag

SEQ ID NO: 15697 - DNA, 528 bp, Artificial Sequence
  Description of Artificial Sequence: Synthetic coding sequence
atgattcttaacgtgttagaatacggcagtcaacaggtcgccgacttgaccctcaacttggacgattatatcgatgcagaacacctgggagattttcacaggacatataagaatagcgaagaactccggagccggatcgtcagtggcatcattaccccaatccacgaacaatgggagaaggcgaatgtcagctcaccccaccgcgagtttcccccagccactgcgcgggaagtggaccctttgcggatccccccccatcacccccacacatccaggcaaccaccatggtgcgatcctctcggaccttttgtcgtgggaggtgaggatttagacccgttcggtccgcgccgcggtggcatgatcgtggacccgcttcgtagtggatttcccagagctctgatcgacccttcctccggcttgcccaaccgactgccacctggcgccgttcccccaggcgctcgcttcgacccattcgggcctataggcacgagccccccgggcccacgccccgaccgaaggggacagtag

SEQ ID NO: 15698 - DNA, 552 bp, Artificial Sequence
  Description of Artificial Sequence: Synthetic coding sequence
atggcagggctggaagtcctcttcgcttcagcagctcctgctatcacctgccgccaagacgctctggtgtgttttctccactgggaggtggtgacacacgggtacttcggcctcggagtcggggaccagcccgggcccaacgataaaaagtccgaacttctgcctgccggatggaacaataataaagacttgtatgtgctaaggtatgaatataaggatggctcgcgaaagcttctcgttaaggccatcaccgtcgagtccagcatgatcctcaatgtgctcgaatacggcagtcagcaagtagccgatcttaccctgaatttggacgattacattgacgctgagcaccttggagacttccacagaacctataagaactccgaagaactccgctccagaatcgtcagcggaatcattacccctatccatgaacaatgggagaaagccaacgtcagctctccccaccgggagttcccacctgcaaccgcgagagaagttgaccccctccggatacctccccaccatccgcacacctctagacagccgccatag

SEQ ID NO: 15699 - DNA, 888 bp, Artificial Sequence
  Description of Artificial Sequence: Synthetic coding sequence
atgcctgtgcatactctgtctcccggggcgccgagcgctccagctctcccatgccgactgcgaacacgcgttccagggtatttgcttcgcgggcctgccgacggcggtgcaagaaagcccagcgctgtggaacgacttgaggccgacaaggcaaagtacgtgaagagtctgcatgtggccaataccaggcaagagcctgtgcaacctttgctctccaagcaacccctcttctcgccagagacccggagaactgttctcacacccagcagaagggcactccctgggccatgccgaagaccacagctggatctagatattctgagctctttgattgatctgtgcgattcccccgtcagcccggccgaagcctccagaacccccggtcgcgccgagggggcaggacgcccccctccagccaccccccctcggccgccaccgtcaacgtctgcggtccggagagtagacgtgcgacctctgcctgcttcacctgcaaggccttgtccatcccccggacctgcagcagcttcctccccggccagaccaccaggactacaacggtccaagtccgacctgtccgaacggtttagccgtgcggccgcagatctggagcgtttcttcaacttttgtgggctagacccagaggaggcccgcgggctgggagtggcacatctcgccagggcaagctccgacatcgtcagcctcgctggcccgagtgcaggtccaggctcttccgaaggaggctgctcgcgtaggtcaagcgtaacagtggaggaaagggctcgggaaagagtcccctacggggtttccgtggttgaacggaatgcgcgtgtgatcaagtggctttacggactgaggcaggcccgagagtctcccgccgcagagggttag

SEQ ID NO: 15700 - DNA, 888 bp, Artificial Sequence
  Description of Artificial Sequence: Synthetic coding sequence
atgcctgttcacaccctttcccctggggccccaagtgccccagcgctcccctgtcgattacggacacgcgtcccggggtatctcctgcgggggcctgctgacggaggggccagaaaaccctccgcagtggaacgtctcgaagctgacaaggccaagtatgtcaagtcacttcacgtggcaaacactcgacaggaacctgtgcaacccctattgtctaaacagcctctcttttccccggagacacggcggacagttcttactccttcccgcagggctttgcccgggccttgtaggcggccacagcttgatctggatatactcagctctttgattgatctttgcgattctcctgtgtcccccgccgaagccagccgtacacccgggagggcagagggagctggccgccccccccctgctactccacctcgcccaccgccttcaacttccgcagtcaggcgagttgacgtgcgtcccctacctgcaagtcccgctagaccctgcccatcccccgggcctgctgccgcatctagccctgcccggccgcctggcctacaacgcagcaagtcagatctgtctgagaggtttagcagggccgctgcagacctagagaggttttttaacttctgtgggctagatcctgaagaagctcgcgggttgggcgttgcccatctggcgagggcctctagcgacatcgtaagcttggcgggaccttctgccggcccaggcagcagtgaagggggctgcagccggagatcttctgtgacagtggaggagagagcccgggagcgtgtgccctatggagtttcagtcgtcgagcgcaacgctcgagtgatcaagtggctctacggtctgcgccaggccagggagtcccctgccgcggaagggtag

SEQ ID NO: 15701 - DNA, 414 bp, Artificial Sequence
  Description of Artificial Sequence: Synthetic coding sequence
atgggtctccgggctggaggtacccttggtagagctggtgccggccgcggcgctcccgagggtccaggcccctctggcggagcccagggtggatcaattcattctggtagaatcgccgcggtgcacaatgtcccactgtctgtgctcatccggcccctaccttccgtactggaccctgctaaggttcagtccttggtagacacgattagagaagaccctgacagtgtgccaccaatcgatgtgttgtggataaagggtgcccaaggtggagattacttctactcattcggtgggtgtcacaggtacgccgcctaccagcagctgcagagggagaccatcccagctaagcttgtccagtcgacgctcagcgatctgagagtgtaccttggagcctcaactcctgatttacaatag

SEQ ID NO: 15702 - DNA, 1731 bp, Artificial Sequence
  Description of Artificial Sequence: Synthetic coding sequence
atgaagtgtcactatgaagccctgggggttcgtagggacgcttccgaagaggagctgaaaaaagcctaccggaagctcgccttgaagtggcacccagataagaacttggataatgccgcagaggccgcggagcagttcaagctcatccaggccgcatacgacgtgttgtccgacccacaggagcgcgcctggtacgataaccatcgcgaagccctgctgaagggcgggttcgatggcgagtatcaggatgactctttggacttactcaggtattttaccgtcacctgctattctggttacggagacgatgagaaagggttctacacagtttaccggaacgtgtttgagatgatcgcaaaggaggagttggagtcagtgctcgaagaagaggtggatgattttccaacgttcggggactctcaatcggattatgacactgtggtgcatccattctacgcctactggcagtcattttgtacgcagaagaacttcgcgtggaaggaggaatacgacacgcggcaagcctccaatagatgggagaagcgcgccatggagaaggaaaataagaaaatacgcgacaaagctagaaaagagaaaaatgaacttgtgaggcagttggtggcctttattaggaagcgcgataagcgcgttcaagcccaccggaagctcgtcgaagagcagaatgccgaaaaagccaggaaagcagaggaaatgcgccggcagcagaaactgaaacaggccaagctggtggagcaatacagggaacaaagttggatgactatggccaacttggagaaagagctgcaggaaatggaggcccgatatgagaaagaattcggagatggttcggatgaaaatgaaatggaggagcacgagctgaaagatgaggaggatggtaaggatagcgacgaggcggaggacgcagagttatatgatgatctgtactgtccagcctgtgataagtccttcaagacggaaaaagcaatgaaaaaccacgaaaaatctaagaagcacagggaaatggtcgccctgcttaaacaacagttggaggaggaagaagaaaactttagccgcccacaaattgatgagaatcccctagacgataactctgaagaggaaatggaggatgcaccaaagcagaagctctctaagaagcagaagaagaagaaacagaagccggctcaggatgtcccggggaaggactcctatctgccggccgcgcacttccagatggcctggggtaagaaatgcgtgttaggggaaaggcgggatggtgagagcgagcataagtgcgcaaaaatgcttttagaaaatcgacagaactacgatgacaactttaatgttaacggacccggagagggcgtgaaagtcgacccagaagacaccaacctgaaccaagattccgccaaggagctcgaagactcacctcaagagaacgtgagtgttactgagattattaaaccttgcgacgaccctaagtctgaggccaaaagtgtgccaaaacccaaagggaagaagactaaggacatgaagaagccagtgcgagtgcccgcggagcctcagaccatgtctgtgcttatttcatgcacaacctgccactctgaatttccctctaggaataaacttttcgatcacttgaaagcgacgggacacgcacgcgccccttcctcaagcagcctgaatagcgctacatcctctcagagtaaaaaggaaaaacgcaagaatagatag

SEQ ID NO: 15703 - DNA, 798 bp, Artificial Sequence
  Description of Artificial Sequence: Synthetic coding sequence
atgcttgctttaacggttctggagacctgcgtgaaaaactgcggccatcggttccatgtattagttgcatctcaggatttcgtcgagagcgtgttagtgcgtacaatcctgcccaagaataatcctcccacgattgtccacgacaaagtgttgaatctaatccaatcttgggcagacgcctttcggagctctcctgacttgaccggagtagtgactatctatgaggatctcagacggaagggactggaattccctatgacagatttggatatgttgtcccccatccatactccacagcgaaccgtgttcaacagtgaaacccagtcaggccaggacagcgtaggaactgattcctcccagcaggaagacagcggccagcacgcagcaccgctgccagccccacccatcctctcaggagacactccaattgctccaaccccagagcagatcggaaaactgcggagtgaactcgagatggtctcgggcaacgtgcgtgtcatgagtgaaatgctcacggaactggtaccaacacaggcagagccagctgacttagagcttctgcaggaactcaacaggacttgtagagcgatgcagcagagggtccttgaacttattccccagattgccaacgaacagcttaccgaagagctgcttatcgtaaacgacaacctgaataacgtgtttttacgccatgagagggaccggggcctgacggtcttgccgcgcctggtgtccaattcctggcctcaggccgttctgcccccctggcctccaaaggcactggtcttgcaggcctag

SEQ ID NO: 15704 - DNA, 6273 bp, Artificial Sequence
  Description of Artificial Sequence: Synthetic coding sequence
atggacgaggtggagcaggaccagcatgaggcccgcctaaaggaactctttgattccttcgacactacaggcaccggatccctggggcaggaagagctaaccgatttgtgtcatatgctatctctggaggaagtggctccggtgctgcagcagaccctgttacaggataacctcctgggcagggtccatttcgaccagttcaaggaggctctgattttaattttgtctaggaccctgtccaatgaggagcactttcaggagcctgactgctcactcgaggcccaacctaaatatgtccggggagggaagcgatacggcaggagatcacttcccgagttccaagaaagtgtcgaagagtttcccgaggtaacggtcatcgagcctctggacgaagaggccaggccatcccatattcccgccggtgactgctctgaacattggaaaacccagcgctccgaggagtatgaagcagagggacagctgaggttttggaatcccgatgatctgaatgcaagccagagcgggtcttcacctccacaagactggatcgaggaaaagctgcaggaagtctgtgaggacctgggcattacccgggacggtcacctcaaccggaagaagctggtctccatttgtgagcagtatggattacaaaatgttgacggcgagatgctggaggaggtgttccacaacctcgatccggatggtacgatgtcagtggaggatttcttctacgggctgttcaagaatggcaaaagcctcactcctagcgcatcaaccccataccgccagctgaagcggcacctgtctatgcagagcttcgacgagtccggacgcaggacaactacttcttccgccatgaccagcactatcggattccgcgtgtttagctgcctcgacgatggaatggggcacgctagcgtggagaggattctggatacttggcaggaagagggcattgagaattcccaggagattctgaaggcactcgatttcagtctggatggcaatattaacctgacggagttgacgctcgccttagagaacgagctgctagttaccaagaattccatccaccaggctgcgcttgcctccttcaaggctgaaattcgtcatctgctcgagcgggtggaccaggtcgtgcgggagaaagagaaactgagaagcgacctggataaagctgaaaagctcaaaagcctgatggcatcagaggttgacgaccaccatgctgccattgagcgtcgaaacgagtacaatcttcgcaaactcgatgaggagtacaaggagcgaatcgctgctttaaaaaatgaactgaggaaggaacgcgaacagatcctccagcaagctgggaagcagaggctagagttggagcaggagatcgaaaaagcaaaaactgaagaaaactacattcgtgatcggctggctctttctcttaaagagaactctcgattagagaacgaactgctggagaatgctgagaagttggctgaatacgaaaatctcaccaataaattgcagagaaatctggagaacgtgctggctgaaaagttcggggatctggatccttcaagtgccgaatttttcctgcaggaggagagactaactcagatgagaaacgagtatgaaagacagtgtcgggtcctgcaggatcaggtggatgagttgcagtctgagctggaagaatacagagcccaggggcgcgtgctgcgccttcctctgaagaactcccccagtgaggaggtcgaggcaaattccgggggaattgagccagaacatggattaggctccgaagagtgtaatcctttaaacatgagtatcgaggccgaattggttatcgagcagatgaaggaacaacaccaccgggacatctgttgcttaaggctagaactggaggacaaagtgcggcactacgaaaagcagctggatgagaccgtggtctcttgcaaaaaggcgcaggagaatatgaaacagagacacgagaacgagacccacacattagaaaagcaaatcagcgacctcaagaacgaaattgctgagttgcagggccaagccgcagtattgaaagaagcccaccacgaggcgacttgccgacacgaggaggagaaaaaacagctgcaggtcaagctggaggaggagaaaacgcatctccaggaaaaacttaggctgcaacatgaaatggagctcaaggctagactgacacaagcccaagcctcattcgaaagggaacgtgagggcttacagtccagcgcttggacagaagaaaaggttcgcggcttaacccaggagctcgaacaatttcaccaagagcagctgacatctctggtggagaagcacaccctggaaaaagaggagctgcggaaagagctgttagaaaaacaccagagagaactgcaggaggggcgagagaagatggagacagagtgtaatcgccgcacatcacaaattgaagcccagttccagtccgattgccaaaaggttactgaaaggtgtgaaagcgccttacagagccttgaagggcgatacagacaggagctgaaggacctgcaagagcagcaaagggaggagaagagccagtgggagttcgagaaggacgagctgacacaggagtgcgccgaagcgcaagagcttttaaaggagacactcaagagggagaaaaccaccagcctggtcttgacccaggagagggaaatgttagaaaaaacctacaaggaacatctgaattccatggtcgtcgaaaggcaacaattgcttcaggacctcgaggacctccggaacgtatcagagacccagcagtccctgctttctgaccagattctagaattgaaaagctcccacaaacgggaactcagggaacgcgaagaagtcctctgccaggcaggggcctctgaacagttagcctcccagcggctggaacggctggagatggaacacgaccaagaaagacaggagatgatgtccaagctgctggctatggagaacatacataaagccacatgcgaaacagcagatcgcgaacgggccgagatgtcaacagagatctcaagactgcagagtaagattaaagagatgcagcaggcgacgtcgcccctgtcaatgctgcaatctggctgccaggtcataggcgaagaggaagtggagggtgacggcgcactgtctttgctccaacagggcgagcagttattggaggagaatggggacgtgttactgagtcttcagcgcgcgcacgagcaagccgtgaaggaaaatgtgaagatggccactgagatatccagacttcaacagcggttacagaaactggaacctggcctcgtgatgtcctcatgcctggacgagccagccactgagttctttgggaatacagctgagcaaacagagcaatttttgcagcagaaccgtactaaacaggtggaaggtgttacgagacggcatgtactctcagacttggaagacgacgaagtcagagatctgggcagcactggtacctcatcagtgcagcgtcaggaggttaaaattgaagagtcagaagctagtgtagaggggttctccgagctggaaaactctgaggaaacacgaacagaaagctgggagcttaaaaaccaaatttcacagctgcaagagcaactgatgatgctgtgcgcagactgcgatcgggcaagtgaaaaaaagcaggacctgctgtttgatgtctccgtgttaaaaaaaaagctgaaaatgctcgagcggatccccgaagctagcccaaaatacaagctgctgtacgaggatgtatcaagagagaacgattgtctccaggaggaacttaggatgatggagacaaggtatgatgaagcacttgagaataacaaggaattgactgccgaggtgttccggctccaggacgagctcaaaaaaatggaagaggtgacggagaccttcctctccctggagaaatcttacgacgaggtgaagatagagaatgaagggcttaacgtccttgtgcttagactccagggaaagattgaaaaactgcaggaatccgttgtccagaggtgtgactgctgcctttgggaggcctctcttgagaacctagaaatcgagcctgacggtaacattcttcagcttaatcagacacttgaagagtgtgttcctagagttcggtcagtacatcacgtgattgaagaatgtaagcaggagaatcagtatctcgaggggaatactcaactgctcgaaaaagttaaggcacatgagattgcatggctgcatggcactatccagacccaccaggaacgtcctcgtgtgcagaaccaggtcatcctggaggagaacacgaccctattggggtttcaagataaacactttcaacatcaggcgaccatcgctgagctggaactagagaaaactaagctccaggaactaactagaaaactgaaagaaagggtgactatactggttaaacagaaggatgttcttagccacggggaaaaagaggaagagctaaaagcaatgatgcacgacctgcagatcacctgttccgaaatgcagcaaaaggtggagttgctgcgatacgagagcgagaagctgcaacaggagaattctattttaagaaacgagatcacgacactgaacgaagaggattcaatctccaacctcaaattgggtactctcaacggcagccaagaagaaatgtggcagaaaaccgagaccgttaaacaggaaaatgctgccgtccagaagatggtggagaacctgaaaaagcagatcagtgaactgaaaattaaaaatcaacaactggatcttgagaatactgaactcagtcaaaagaatagtcaaaatcaggagaagttgcaggagctcaaccagcggctgactgagatgctttgccagaaagagaaggagcctggcaacagtgctctggaggagagggaacaggagaagtttaatctcaaagaagagcttgagagatgcaaggtacaaagctcaaccctggtttcctcactcgaggctgagctgtccgaggttaagatacagactcacatcgttcagcaagaaaaccatctcctcaaagatgagctggaaaaaatgaaacagctgcacagatgccctgatctatccgatttccagcaaaagatttcttctgttctgtcatataatgagaagcttctgaaggaaaaagaagcactctctgaagaactgaactcctgcgtggataaactggctaaaagcagccttttagaacacaggatagctacaatgaagcaggagcaaaaaagctgggagcaccagtcggcctccttgaaatctcagctcgtggcttctcaagagaaggttcagaacttggaggataccgtgcaaaacgtgaatcttcaaatgtcacgcatgaaatccgacttgcgggtcacccagcaggagaaggaagccttgaagcaggaagttatgtcacttcacaagcaactgcagaatgcaggcggcaagtcatgggctccggaaatcgccacacacccttctggactgcataaccagcagaagaggctttcatgggataagttggaccacctgatgaacgaagagcaacagcttctgtggcaagagaatgaaaggctacagacaatggtacagaacaccaaggccgagttgacgcattctagggaaaaggtcagacaattagaatccaatctgctgcctaaacaccaaaagcacctcaacccatcaggcacaatgaatcctacagagcaggagaaactctctctaaagagagaatgcgaccagttccagaaggaacagtcaccggcgaatcgcaaagtcagccagatgaatagcctcgagcaagagctcgaaaccatacatctggagaatgagggcctgaagaagaagcaggtgaaactcgacgagcagttgatggagatgcaacatctgagaagcacagctactccttctccaagcccccatgcatgggaccttcagctgcttcagcagcaagcttgcccaatggtgccccgggagcagttcctgcagctgcagcgacagctgctccaggcggaaagaatcaaccagcacttgcaggaggaattagagaatcgcaccagcgagactaacacccctcagggcaatcaagagcagcttgtcaccgtgatggaggaacgcatgattgaggtggagcaaaagctgaagttggtcaaacgtctactacaagagaaagtgaaccagctaaaggagcaggtgtcactgcctggacacctctgtagtcccacgtcccactcctcattcaactccagctttacctcactatactgccattag

SEQ ID NO: 15705 - DNA, 4134 bp, Artificial Sequence
  Description of Artificial Sequence: Synthetic coding sequence
atggatgaggtcgaacaggaccagcacgaggcacggcttaaagaactttttgatagctttgatacgaccggcacgggcagtctgggccaagaagagttgacggatctgtgccatatgctctccctggaagaggtggcacctgttctgcagcagacactgctacaggataatcttctgggacgagtgcactttgaccagttcaaggaagcccttattttgattctcagtcgaactttgtccaatgaggagcactttcaggaacccgactgcagcttggaagcccagcccaagtacgtacgaggcggaaagcgttacggccggcgcagcctcccggagtttcaggagtctgtagaggagttccccgaagtcaccgtgatagaacctctggacgaggaggcccggcctagtcatattcctgccggcgactgtagtgaacactggaaaacacagcgcagcgaggaatacgaggcagagggacaactgcggttttggaaccctgacgatttaaacgccagccaatccggctccagccctccccaggattggatcgaagagaagctgcaagaggtgtgtgaggacctcgggattacccgcgacgggcacctcaatcgtaagaagcttgtttctatatgtgaacagtatggactccagaatgtcgatggggaaatgttagaagaggtgtttcataacctggatccggatgggaccatgtcagtagaagattttttctacgggctgttcaaaaatggcaagagcctcacaccaagtgctagcacaccctataggcagctgaagagacatctgtctatgcaaagcttcgatgaatcaggcagaagaaccactaccagctctgccatgacgagtacgatcggcttccgtgtcttttcctgtctcgatgacggtatggggcacgcctcagtagaacgcattttggacacctggcaggaggaaggcatcgagaattcccaggagattctcaaagctctggacttctcgcttgatggaaatataaacttgacggagcttaccttggccctggagaatgagcttctggtgacgaagaacagcatccaccaagccgcattagcctcctttaaagctgaaattcgccatctgctagaacgcgtcgaccaggttgtgcgggagaaggagaagctccgctcagatcttgacaaggccgagaaactcaaaagcctcatggctagcgaggtggacgatcaccacgcagctatagaaaggagaaacgagtataacttgcgcaaactggatgaggaatataaagagcgcatcgccgccttgaaaaatgaactgcggaaagagagggagcaaatccttcagcaggcgggcaaacagcgcctggaattagaacaagagatcgaaaaagccaagacagaggaaaactacatccgcgacagattagcactgagcctgaaggagaacagtcggctggagaatgaattgctggagaatgctgagaagcttgctgaatacgagaacctgacaaacaaactgcaaaggaacctggaaaatgtgctggcagagaagtttggcgacttggacccctcaagtgccgagttcttcctacaggaggagagactaacgcagatgcgaaacgaatacgagcgccagtgtagagtgctgcaagaccaggttgacgagctgcagagtgagctcgaggaatacagggcacagggccgcgttttgcggcttcccttgaagaattccccaagcgaggaggtcgaggcaaacagcggagggatcgagcccgaacatggcctaggctcggaggagtgcaacccgctcaacatgagcattgaggccgaactggttatcgagcagatgaaggagcagcatcaccgtgatatttgttgcctgagacttgagctcgaagacaaggtgagacattacgaaaaacagttggatgaaaccgtggttagctgcaaaaaagctcaggagaacatgaagcagagacatgagaatgaaacacatactctcgagaagcagatatctgacctgaagaacgaaattgcggagctgcagggacaggccgcggtgttgaaggaggctcaccatgaggccacctgtagacatgaggaagagaaaaagcaactgcaggttaaattggaggaggaaaagacccatctccaagaaaaactacgactgcaacacgaaatggagctgaaggcacggctgacgcaggctcaagccagtttcgaacgcgaaagagaaggcttgcagtcctcagcctggacagaggaaaaggttcgagggcttacacaggaattagaacagttccatcaggagcaactgacttctttggtggaaaaacacactttggagaaagaagaactgaggaaagaactgttggaaaaacatcaacgggaactgcaggagggcaggtatgagtcagagaagctccagcaggagaacagcattctcagaaatgaaatcaccacactgaatgaagaggacagtatcagtaacttaaaactggggacgttaaatgggtcccaggaggaaatgtggcagaaaacagaaaccgtgaaacaagagaacgccgccgtgcaaaagatggtcgaaaatctcaagaagcagatctcagaactcaagataaagaaccagcaactggatctggagaatacagaactgtctcagaagaatagtcagaatcaggagaaacttcaagagctgaaccaaaggctcacagaaatgctgtgccagaaggaaaaggagccgggcaactctgcgcttgaagaacgcgaacaggagaaattcaatctaaaagaagaactggaaagatgcaaggtgcagtcaagcacccttgtgtcgagtctggaagctgaactgagcgaggtgaagattcagacccacatcgtacagcaggaaaatcacttgttgaaagatgagctcgaaaagatgaaacagctgcacaggtgccctgacctcagtgattttcagcagaagatcagcagcgtcctatcctacaatgagaaactccttaaggagaaggaggccctgtctgaggagttgaatagctgtgtggataaacttgccaagtccagcttgctcgaacaccgcattgctacaatgaagcaggagcagaaatcatgggagcaccagagtgcctctctgaagtcgcagctggtggccagccaggagaaggttcagaacctcgaggacacagtgcagaatgtcaatctgcaaatgtccagaatgaaaagtgatctgagagttacacaacaggagaaggaggccctaaaacaggaagtcatgagcttgcataagcaactacagaacgccggcgggaaaagctgggctcccgagattgctactcaccctagcggcttgcataaccagcagaagcgactctcctgggataagctggaccatctcatgaacgaggagcagcagctgctgtggcaggagaatgaacgactacagacgatggtgcagaataccaaagccgaactgactcacagcagggaaaaggtgcggcagctggaaagcaatctgctgccgaagcatcagaaacacttgaatccttcaggcacaatgaatcccacagagcaggagaaactatcactgaaaagagaatgtgaccagtttcaaaaagagcagtcccctgccaacaggaaggtatcacagatgaattccctcgaacaagagctggaaaccatacacctggagaacgagggtcttaagaagaagcaagtcaagctggatgagcagctgatggagatgcagcacctgcgatccaccgctacgccctctcccagcccccacgcatgggacttgcagttacttcaacagcaggcttgtccgatggttccaagggaacagtttttgcaactacagagacagctcctgcaggctgagaggataaatcaacatcttcaggaagaattagagaataggacctccgagaccaataccccccaaggcaaccaggaacaactggtgacagtgatggaggagagaatgattgaggttgaacagaaactgaagcttgtcaaaaggctgttacaggagaaggtgaaccaactgaaagagcaggtgagcttgccaggtcacctctgctccccaacatctcatagttcgttcaacagctccttcactagtttgtactgccattag

SEQ ID NO: 15706 - DNA, 3171 bp, Artificial Sequence
  Description of Artificial Sequence: Synthetic coding sequence
atggcaactgggaattacttcggatttacgcatagcggtgctgccgccgctgcagccgcagcccaatatagccagcaacccgcaagcggtgtggcctactcccacccaactactgttgccagctataccgttcaccaggccccagtggccgcccacacagtgacggccgcctacgcccccgctgcagcaacggttgctgtggcacgaccagcgcccgtggccgtggccgctgcagccacagctgctgcctacgggggataccccactgctcacacagcaaccgactacgggtacacccagcggcagcaggaggcaccaccacccccccctcctgccacaacccagaattatcaggattcttacagttacgtacggtccaccgcccctgccgtggcctacgactcaaaacagtattatcaacagcctacagccacggccgcggccgttgctgccgccgcccaacctcagccatcagtggctgaaacttattaccagactgcacccaaagcgggatactcccagggggctacccagtatacccaggcccagcagacgcgtcaggttacagcgattaagccagctacacccagcccagccacgacaactttctcaatctatccggtcagctctactgtgcaaccagtcgcagctgccgcgaccgtcgttccgagctacacacagagcgccacctacagcactacagcggtgacctatagtggaacgtcgtactcagggtacgaagcagcagtgtacagcgctgcatctagttattaccagcagcaacaacagcaacagaagcaggccgcagcagcagccgcagccgccgcagccacagcagcatggaccggcacgacgttcactaaaaaagccccgtttcagaacaaacagttaaaacccaagcaaccacccaagcctccccagattcactactgcgacgtgtgcaaaattagctgcgcgggaccacaaacgtataaagaacacttagaaggtcagaagcataaaaagaaggaagctgccctgaaagcatcccagaacacctcttctagcaactccagtaccaggggcacacagaaccagctccgctgcgaattgtgcgacgtgtcatgcaccggtgcagacgcttatgcagcccacataagaggggctaagcaccagaaggttgtcaagcttcacaccaagctcggaaagccgatacccagcacagagcccaacgtagtttctcaggccacatcctctacagctgtgagcgcctccaagccaactgcatcgccgtccagcattgcagcaaacaattgtactgtgaacacgtcttcagtcgccacatcctcaatgaagggactgacaacaactggcaattcctccctgaatagcacttccaacacgaaggtcagcgccgtgcccactaacatggcggccaaaaagacctccaccccaaagattaactttgtggggggaaataagctgcagagcacagggaacaaagctgaggatatcaaagggaccgagtgtgtgaagtcaacgcccgtaacctccgctgtccagataccagaagtcaagcaggacactgtgagcgagcccgtgacccctgcctctctggccgcccttcaatcagatgtgcagccagtaggacatgactatgttgaggaggtccggaacgatgaaggaaaggtcatcagattccattgtaagctgtgtgaatgctcctttaatgaccccaacgccaaggaaatgcacttgaaaggcaggaggcacagactgcagtacaaaaagaaagtgaatcctgacctgcaggtcgaagtaaaacccagtatacgagccagaaaaatccaagaagaaaaaatgcggaagcagatgcagaaggaagaatactggcggaggcgagaagaggaagagagatggcgtatggagatgcgccgctatgaggaggacatgtactggagacgtatggaggaggaacagcatcattgggacgacagacggcgtatgccagatggcggatacccccacggtcccccaggaccgctgggattgcttggtgtgagaccaggtatgcctccgcagccacagggacctgctcctctgagacgacccgattcatcggacgataggtacgtgatgacgaagcacgccacaatatacccaactgaggaggagttgcaagccgtccagaaaatcgtcagcattaccgagcgggcacttaaattagtatcagacagcctgtcagaacacgagaagaataagaataaagagggcgatgataagaaagagggaggaaaagatagggcgctcaaaggcgtcctgcgcgttggtgtgttagccaaggggctgctcctgagaggcgacagaaacgttaacctggtactgttatgttcagaaaaaccatccaagaccctcctctcgcgcatcgccgaaaacctcccgaagcagctggcggtgatctctccggagaagtacgacatcaaatgtgccgttagtgaggccgccattatcctcaactcatgtgtcgagcccaagatgcaggtgacaataacgctcaccagcccaataatccgagaagaaaatatgcgcgagggcgacgtgacgtccggaatggtgaaagatccccctgatgtcctggataggcagaaatgtttggacgctctggcggctctcagacacgcaaaatggttccaacaagctagagccaacggcttgcaatcctgcgtcattatcatccgaatcctcagagatctgtgtcagcgggtcccgacctggtctgattttccctcctgggccatggaactgctagtggaaaaagcaatttctagtgctagctctcctcaaagtccgggagatgccttgcgaagggttttcgagtgtattagttccgggatcatcctcaaggggtctcccggcctgttagacccctgcgaaaaagatccctttgatacccttgcaacaatgaccgaccagcagagagaagacatcacatcctcagcacagttcgctctgcggcttctggcatttcgccaaatccacaaagttctgggcatggatccgctcccgcaaatgagtcaaaggttcaacattcacaataaccggaaaagacgccgcgatagcgatgggatggacctgaagcttagaggaaagaaaacgaagaaaatcatgattacctttaagaagtgtctgtag

SEQ ID NO: 15707 - DNA, 390 bp, Artificial Sequence
  Description of Artificial Sequence: Synthetic coding sequence
atgggttgctgtggttgctcgggtggctgtgggtccggctgtggaggatgcgggagcggctgcgggggctgcgggtcttcctgctgcgtgccgatctgttgctgcaagccagtgtgctgctgcgtccctgcgtgcagctgtacctcctgcggctcctgtggaggctcaaagggctgttgtggctcgtgcgggggaagcaaggggggttgtggcagctgcggcggatctaagggcggatgtggttcttgcggctgttctcagtgttcttgttgtaaaccctgctattgctcctctggttgcgggagctcctgctgccagtccagttgttgtaagccatgttgttctcaagcctcatgttgcgtgcccatatgttgccagtgtaaaatctag

SEQ ID NO: 15708 - DNA, 1344 bp, Artificial Sequence
  Description of Artificial Sequence: Synthetic coding sequence
atgccaatgcccaccgaagggaccccccccccgctgtcaggtacacccatccccgttccggcttatttccggcacgctgagcccggcttttccctgaagcgcccaagggggctttctcgttcgcttcctcctcctcctcccgctaaaggtagtatacctatttctaggctcttcccaccacgtacacccgggtggcaccagctgcaaccaaggagggtgagctttcgaggggaggcctccgagaccctgcaatctccagggtacgacccttccagacccgagtctttcttccagcaatcgttccagcgcttgagcaggctgggtcatggaagttatggcgaggtgttcaaggtccggagcaaagaggatgggaggctctacgcagtgaagcgatctatgtctccttttcggggacctaaggaccgagcacggaaactggcagaggttgggtcacacgaaaaggtcggacagcatccatgctgtgtgcggctggaacaagcctgggaagagggggggatcttgtaccttcagacggaactgtgcggtccatcccttcagcaacattgtgaggcctggggtgcttctctgccagaggcccaggtttggggatacttaagggacactctgctggccctcgcgcacctccatagccagggcctggttcaccttgacgtgaaaccagccaacatcttcctgggccctcggggcagatgtaagctgggtgattttggtctcctggtggagctcggaactgcaggagctggagaagttcaggaaggagatccacggtatatggcacccgagctgttgcagggctcctatgggacagccgctgatgtgttctcactcggtcttactattctggaagttgcatgtaatatggagttgccacatgggggcgaaggttggcagcagctgcggcaaggttacttgcctccggagttcacagccggcctttcatcagagcttcgatctgtgctggtcatgatgctcgagcctgaccccaaactgcgagcaaccgccgaagcactattagcccttcccgtcctgcggcagccccgagcctggggggtgctttggtgcatggccgccgaagccctttctcgagggtgggctctgtggcaagccctcttagcattgctctgttggctttggcatgggctggctcatccagcctcttggcttcaaccactgggaccacctgcaaccccccccgggagccctccctgctcattactgcttgattcctctctgtcatctaactgggacgacgatagtctgggcccttgcgttcttaaacggaccgagggggccctcgagtgcagccagatggagggcctctag

SEQ ID NO: 15709 - DNA, 1005 bp, Artificial Sequence
  Description of Artificial Sequence: Synthetic coding sequence
atgtccgctgccaatcctgagacaccaaactctaccatttctagggaagcctccacacagtcctcgagcgccgccgcctctcaaggatgggtcctgccggaaggaaaaattgtgcctaatacggtattcgtaggtggaattgacgccagaatggatgaaaccgagattggcagctgcttcgggagatatgggtctgtcaaagaagtgaagattataactaatcgcactggggtctcaaagggttatggctttgtctccttcgtcaatgacgtggatgtgcaaaaaattgtgggaagccagatccactttcatggaaaaaagctgaagttaggaccagcaatccggaagcaaaagctgtgtgccaggcacgtgcagcccagacccctggtcgtgaaccccccccccccgccccagttccagaatgtgtggagaaaccctaacactgagacttacctgcagccccaaattacacccaaccccgtcactcagcatgttcaggcttattccgcctacccacattctcctggccaggtgatcacaggatgtcagctactggtttacaattaccaggagtaccctacataccctgattctgcattccaggtgactacggggtaccagctgccggtttataattatcagccatttccagcttacccacgatcccctttccaggttacagccgggtatcaactgcctgtctataattaccaggccttccctgcttacccgaattcaccctttcaggtagctacaggctaccagttccccgtctacaattatcaaccattcccagcttatcccagtagcccatttcaggtaaccgctgggtaccaactgccggtatacaactatcaagcattccccgcttaccccaatagccccttccaggtagccaccggctatcaattccctgtgtacaattaccaagcttttcccgcctacccgaactcacccgtgcaagtgactaccggctatcaactgcctgtatataactatcagtag

SEQ ID NO: 15710 - DNA, 1173 bp, Artificial Sequence
  Description of Artificial Sequence: Synthetic coding sequence
atgtcggccgctaaccctgagactccaaacagcaccatttcaagggaggcgtcaacacagtcctcctccgccgctgcaagccagggttgggtcctgccggaaggtaaaatagtgccgaacaccgtgtttgtaggcggtattgatgcccgtatggacgaaacggaaatcggatcctgcttcgggagatacgggagtgttaaggaagtcaaaattatcacaaaccgcaccggggtcagcaaaggctacgggttcgtgtcattcgtcaacgacgtggacgttcagaagatcgtgggctcacagatccatttccatggaaaaaagctaaaactcggtccagctattcgcaagcaaaaactgtgcgcacgacacgtccaacctcggccactggtggtaaacccccctccaccaccacagtttcagaatgtgtggagaaacccaaacactgaaacttatttacagccccagatcaccccaaaccctgtgacgcagcacgtgcaggcatactcagcgtatccccactctcctggccaagtgattactggctgccagctgttagtgtataattatcaggaatatccaacgtacccagattctgcctttcaagtgactacggggtatcagctccctgtgtataactatcagccattcccagcgtaccctagatccccttttcaggttactgcaggctatcagctgccggtctacaattaccaagcttttccggcttaccccaactcaccctttcaggtcgccactggatatcagtttccggtttacaattaccagccattccccgcctacccatcatcaccatttcaggtcacagcaggataccagcttccagtgtacaactatcaggcgttccccgcgtatcccaactcccctgtgcaggtgaccaccgggtatcagttacctgtctacaactaccaggcattccctgcttacccttccagtccgttccaggttacgaccgggtatcaacttcctgtgtataactaccaggcctttcctgcctaccctaacagtgccgtgcaagtcacgactgggtatcaattccatgtgtacaattaccaaatgcctcctcagtgccctgtgggcgaacagcgcagaaacctgtggaccgaggcctataaatggtggtatctggtatgcctaatccagaggagagactag

SEQ ID NO: 15711 - DNA, 1173 bp, Artificial Sequence
  Description of Artificial Sequence: Synthetic coding sequence
atgagtgccgccaaccctgagacccccaactctactatctctcgcgaagcttccacccagtctagctcagctgctgcaagccaggggtgggtgttgccagaagggaagatcgtgcccaatactgtatttgtaggaggcatcgacgcacgtatggacgaaacagaaattggatcgtgttttgggcggtacggcagcgtgaaagaagttaagatcataactaatcggacaggtgtgtctaaagggtacggttttgtctcattcgtgaacgacgtggacgtacagaaaatcgtcgggtctcagatccattttcatggcaaaaagttgaagctggggcccgccattagaaagcagaagctgtgcgcgaggcacgtgcagcctaggcccctggtcgtgaacccccccccccccccacagtttcagaatgtatggaggaaccccaacacggagacctacctgcaaccacagatcactcctaaccccgtaacccagcacgtccaggcttacagcgcctacccccatagccctggacaggtgataacaggatgccagctgctcgtttataactatcaggagtacccgacgtatccggatagcgcttttcaggtgacgacaggctatcagctcccggtgtacaattatcaacctttccctgcttacccaaggtctcccttccaagtcaccgccggataccagctgcctgtatacaactatcaggcgttcccagcgtacccaaacagcccctttcaagtcgccacaggttaccagttccctgtgtataactaccagccattccccgcatatccatccagtccattccaagttaccgccggctatcagcttcctgtttacaattaccaggcctttccggcttatcccaactcacccgtgcaagttaccaccggatatcagctcccagtatacaattaccaagcattccccgcatatccctcttcacccttccaggtcactacaggctaccaactacctgtttataactaccaggcattcccggcctacccaaacagcgccgttcaagtcaccaccgggtatcaattccatgtctataactaccagatgcctcctcaatgccccgtgggcgaacagcgccgcaatttgtggaccgaggcctacaaatggtggtatctggtttgcctcatacagaggcgggattag

SEQ ID NO: 15712 - DNA, 1101 bp, Artificial Sequence
  Description of Artificial Sequence: Synthetic coding sequence
atgagcgccgcaaacccagagactccgaattctactatatccagggaagcttccacacagtcaagttctgcagcagcctcgcagggctgggtcctccctgagggaaagattgtccctaacacggtgttcgtaggtggcattgacgctagaatggacgagaccgaaattggaagctgcttcggacgctacgggagcgtgaaagaggtgaagataatcactaaccgtacaggagtgagcaaggggtatggatttgtgagctttgtgaacgacgtcgatgtgcagaagattgtcggctcacagatccacttccatggaaagaaactcaagttgggcccggctatacgcaaacagaaactctgtgcacgtcacgttcaaccgagacccttggttgtgaaccccccgccacctccacaattccaaaatgtttggcggaatccgaatactgagacctatttacaaccacaaatcacaccaaatccagtgacccaacacgtccaggcttactctgcgtatccacactctccaggccaggtcataacaggttgtcaacttttggtgtataattatcaggaatatccaacctaccccgacagtgcctttcaggtgactacaggataccagttgcctgtttacaattatcaacctttccctgcatatcctcggagcccctttcaagtcaccgctggctaccagctgcctgtgtacaactaccaggcgttccctgcttatcctaacagccctttccaggtggcaaccggctatcaatttccggtgtacaactaccagccttttcctgcatatcctagtagtcctttccaggtgactgccgggtatcaactacctgtgtataactaccaagcattccctgcttatccaaatagccctgtgcaagtgaccaccggttaccagctgcctgtgtacaattaccaggcctttccagcataccccaactctgccgtgcaggtgacaacgggttaccagtttcatgtgtacaattaccagatgccccctcagtgtcccgtcggggagcaacgaagaaacctctggactgaggcgtacaaatggtggtatctggtatgtctcatccagaggagggactag

SEQ ID NO: 15713 - DNA, 1149 bp, Artificial Sequence
  Description of Artificial Sequence: Synthetic coding sequence
atgagcgcagcaaatcccgaaactccaaacagtactatatcaagggaggccagcactcagtccagcagtgccgctgcgtcccaagggtgggtactgcctgagggcaagatagtccccaataccgttttcgttgggggcatcgacgcacgaatggacgaaaccgagatagggagctgttttggacgctacggttcggtcaaagaagtcaaaataataactaaccgcaccggtgtgtctaagggttatggttttgtttcattcgtcaatgatgtggacgtccagaagatagtgggctctcagatccacttccacgggaagaaactaaagctgggccccgccatccgaaagcagaaattgtgcgcccggcatgtgcaaccacggccactcgtagtgaacccacccccgccgccccagtttcaaaatgtatggcgtaaccctaataccgagacctatttacaaccccagattacccctaaccccgtgacacagcacgtccaagcctattccgcctatccgcacagtcctggtcaagtgattacagggtgccagttgttggtgtacaactatcaagaatacccaacatacccagatagcgcgtttcaggtgacaaccgggtatcagctgccggtttacaattaccagccttttccagcttatcctaggtccccctttcaagtgactgccggttaccaactccccgtgtataactatcaggccttcccggcctacccaaattcccctttccaagtcgccaccggatatcagttcccggtgtacaattaccagccatttcccgcttacccctcgagcccttttcaggtaaccgcaggatatcaacttccggtgtataattaccaggctttccctgcataccctaactcgccattccaagtggctacgggatatcagttccccgtctataattaccaggccttccccgcttaccctaactctccagtgcaggtgactaccgggtaccagttgccggtgtacaactaccaggcctttcccgcctatcctaactccccattccaagtcgccactgggtaccagtttccggtgtataattatcaggcatttcccgcctatcccaacagccccgttcaggttactactgggtatcagttgccagtctacaactatcagtag

SEQ ID NO: 15714 - DNA, 1842 bp, Artificial Sequence
  Description of Artificial Sequence: Synthetic coding sequence
atgagtgccgcaaatcccgaaactcccaactcaacgatcagcagagaggctagcactcagagcagttctgccgccgcttcccaaggctgggtgctgcctgaaggcaaaatcgtgcccaataccgtgtttgtcggcggcatagatgcaagaatggacgaaacggagataggcagctgcttcggtcgttatggtagcgtgaaggaggtcaagatcatcaccaaccgaacaggcgtgtccaaaggatatgggtttgtgtcttttgttaacgatgtggatgtgcagaagatcgtgggcagccagattcatttccacggcaagaaactgaaactcggcccggcaattcgaaaacaaaagttgtgcgccaggcatgtgcagcctcgccccctagtggtcaacccacctccccctcctcagtttcagaacgtgtggaggaatcccaacactgagacctatttgcagccacaaatcacccctaaccctgtcactcagcacgtgcagtccgctgccaaccccgagactcctaactctactattagtagggaggcatcgactcaatcatcatccgcggctgccagccaaggctgggtgcttccagagggcaagatcgttccaaacacagtctttgttggtggtattgacgctaggatggacgaaaccgaaataggcagctgtttcggtagatacggctccgtgaaggaggtgaaaatcattaccaatcgcaccggcgtatcgaaggggtatggatttgtatcttttgtcaatgatgtggatgtccagaagattgtggggagccagatccattttcacggcaagaagctcaaactcggacccgcgatccgaaaacagaagttatgcgctaggcacgttcaaccaagaccacttgttgtcaacccgccccccccccctcagtttcagaacgtgtggagaaatccaaacactgagacatacctccagcctcagatcacccccaatcctgtgactcaacatgtacagtctgctgcgaaccctgagacgcctaactccacgatctctagagaggcaagcactcagtcttccagtgccgccgctagccaaggctgggtgctcccagaaggcaaaattgttccgaataccgtgtttgtcggggggatagacgcccgcatggatgagaccgaaatcggcagctgttttgggcgttacggaagtgtgaaggaggtcaagattattaccaataggaccggtgtgagcaaggggtatggatttgtatcttttgttaatgatgttgatgtccagaagattgtaggatcccagattcacttccacggcaagaaactcaagctgggacccgccataagaaagcagaagctctgcgcgcggcacgtccagccccgcccgctagtcgtaaaccctcctccgcctccgcagtttcagaacgtgtggcgcaacccgaataccgagacctatctacaaccacagatcactcccaacccggtgacccaacacgtccaggcatattccgcttacccccactcccccggccaggtcataaccggctgccagctgctcgtgtacaattatcaagagtacccgacgtaccccgattccgctttccaagtcacgacgggataccagctacccgtatataattaccagccatttcccgcatatccccgctccccctttcaagtaacagccggttatcagttgccagtttacaattaccaagcgtttccagcctatcctaattcacccttccaggtggccacagggtaccaatttcctgtctgtgagatttgtaagatcctggtactcaaaaacgctgctgctttcttatgtcactctaaggtcaacagatctatctag

SEQ ID NO: 15715 - DNA, 384 bp, Artificial Sequence
  Description of Artificial Sequence: Synthetic coding sequence
atgagacccctggacatcgtggagttggctgagcccgaggaggtcgaggtgctggagcccgaggaggattttgagcagttcctcctgcccgtcatcaatgagatgcgtgaggacatcgcaagcctcacgagagaacatggaagagcatatctgagaaaccggagcaagttgtgggagatggacaacatgctgattcaaatcaaaacacaggtggaggcgtcagaggagtcagccttgaatcacctgcaaaacccaggagatgctgccgaggggagggcagccaaacgatgtgaaaaggcagaggaaaaggctaaagagatcgcaaagatggcagagatgctggtcgagctcgtgcggcggattgaaaagtcggagtcgtcttag

SEQ ID NO: 15716 - DNA, 537 bp, Artificial Sequence
  Description of Artificial Sequence: Synthetic coding sequence
atgatgcgagctatgaagccccctggaggggagagtagtaatctgtttgggtcgcctgaggaagccacgccgtctagcaggcctaatcggatggcgtccaatatcttcggtcccaccgaggagcctcagaacatccccaaaaggacgaacccccccgggggcaaagggtctgggatctttgatgaatctacacctgtccagactagacagcatctaaaccctcctggggggaaaacctcagatattttcggcagcccagtgacagccacaagccgactggcacaccccaataagcccaaagaccacgtatttctctgcgagggggaggaacctaaatctgacctgaaagcagcccggagcatccccgcgggcgcagagcccggcgagaaaggtagcgcgcgcaaggcagggccagcgaaggaacaggaacccatgcctaccgtggactcccatgagcctcgcctgggccctaggccacgttcacataacaaggtactcaaccctcccggcggcaaatcgtctatttcgttctactag

SEQ ID NO: 15717 - DNA, 657 bp, Artificial Sequence
  Description of Artificial Sequence: Synthetic coding sequence
atgttccaggttccagatagcgaggggggaagggcggggagccgcaagtggcagctactcacaggaagcctggcatcaacttcgccaagcctgcttagcgggcaggggccctgggccccactgcagagagccatgaagcctccaggaggagaatctagtaatctattcggctcccctgaagaagccacacccagctcacggccaaaccggatggcttccaatatctttggtccaacagaggagccccagaacatccctaaacggacaaaccctcctgggggcaagggctccgggatcttcgatgagagtaccccggtccagaccaggcagcacttaaatccccccggcggtaaaaccagcgatattttcggatcaccagtgactgctacaagtagactcgcccaccccaataagcccaaagatcacgtgttcctgtgtgagggcgaggaacctaagtcagacctgaaagccgctcgctctatccctgcgggggcagaacccggtgaaaagggaagcgccaggaaggcgggccccgcaaaggaacaggagccaatgcccactgtggatagtcatgagcctcggctggggccacgaccaaggtcgcacaacaaggtgttgaatccccccgggggtaaaagtagcatctcattctattag

SEQ ID NO: 15718 - DNA, 4866 bp, Artificial Sequence
  Description of Artificial Sequence: Synthetic coding sequence
atggcaggcgggagaggagccccaggtagagggcgcgatgaacctccggagtcatacccgcagcgccaggatcatgaactgcaggcactggaagccatttatggggccgattttcaggacctgagacctgacgcttgcgggccagtgaaagagccgcccgagataaaccttgtcctataccctcagggcctcaccggcgaagaggtgtatgtcaaagtagatctgagagtaaagtgccctccaacctaccctgacgtcgttcctgaaatcgaactgaaaaatgctaaaggcctgtcaaacgaaagcgtgaacctcctgaaatccaggctcgaggaactggccaaaaagcactgtggcgaagtgatgatcttcgagctcgcctaccacgtgcaatctttccttagtgaacataacaagcctcctcctaagagtttccatgaagagatgttggaaagaagggctcaggaggagcagcagcgtctcctagaggcaaaacggaaggaggagcaggagcagcgagaaattctccatgaaatccagcgccgtaaggaggaaataaaagaggaaaaaaaacgaaaggagatggccaaacaggagaggttggagatcgcctctctgtccaaccaggatcacacttccaaaaaggacccaggcggtcacagaactgctgcaatcctgcacggcggcagtcctgatttcgttggcaatggtaaacatagggccaactccagtggaagaagtcggagagagcgacagtatagtgtgtgtaactctgaggacagccccggcagctgtgagatactatatttcaacatggggagccctgaccagctgatggtgcataaagggaagtgcattggcagtgatgagcagttggggaagctcgtctataacgccctggaaaccgctaccgggggctttgtgctgctatacgagtgggtcctgcagtggcagaaaaaaatgggcccatttttgaccagtcaggagaaggaaaaaattgacaaatgcaagaaacagatacagggaaccgaaacagagttcaactctctcgtgaagctgagtcaccctaatgtcgtccgctacttggccatgaatctgaaagagcaggacgacagcattgtggttgacattctggtggagcacatcagtggagtctcactggctgcgcacttgtcccactccggtccaatacctgtgcaccaattaaggcgctataccgcccagcttctgagtgggcttgattacctccacagcaatagcgtcgtccacaaagtcctgagcgcttccaatgtgctggtggatgcggaaggaaccgtgaagattactgattactctatcagcaagagattagccgatatctgcaaagaggacgtttttgaacagaccagagtccggttcagtgacaatgcactgccatacaaaactggcaagaaaggagacgtgtggcgacttgggctcttgctcctgagcctctcccagggacaagagtgcggcgaataccctgttaccattccgtcagatcttccagctgattttcaggactttctcaaaaagtgtgtttgcctagacgataaggagagatggagcccacaacagctgctgaaacatagcttcattaaccctcaaccaaaaatgccactcgtggagcagagtccggaggacagtgaaggtcaggactacgtggagactgtgatcccgtcaaacagactccccagcgccgctttcttctctgagacacagcgtcaattcagtcggtatttcattgaattcgaggaactccagctgttaggcaagggtgctttcggggccgttattaaggtccagaataagcttgatgggtgctgttacgctgtcaagagaattccgataaatcctgctagcaggcagttccgtcgcataaagggggaggttaccctgttgagtcgcttgcatcatgaaaacattgtacgctactacaatgcttggattgagcgccacgagaggccagccgggcccggaacgcctcccccagactcaggccctctagcgaaggatgacagggccgcccggggccagcctgccagcgatactgacggcttggacagcgtggaagcagctgctccgccaccaatcctctccagctccgtggagtggtccacctccggggagaggagcgcttccgctagattccctgctaccggaccagggtcgtctgatgatgaggatgatgatgaggatgagcatggcggggtgttcagtcagtcatttcttccagcctccgactccgagagcgatattatttttgacaacgaagacgaaaattccaagtcacagaaccagatggaatattgtgagaaaagtacactcagggataccatcgatcagggtctgtatagagataccgtcaggctatggcgcctctttagagagattcttgacggactcgcctatatacacgaaaagggcatgatacacagggaccttaagcccgtaaacatctttctggattctgacgatcacgtaaagatcggtgactttggcctcgcaaccgatcacttggccttctctgcagacagtaaacaagatgatcagaccggcgacctcattaaatctgacccatcaggacacctcacaggaatggtggggacagctctgtacgtatccccggaagtgcaggggagcacgaagtcggcctacaatcagaaggtcgaccttttttccctgggtattatctttttcgaaatgagctatcaccctatggtcacagcgagtgaaaggatttttgttctgaaccaactgcgagatcccacatcgcccaaattcccggaggattttgacgatggtgagcacgccaaacagaaatctgtcatctcgtggcttctgaaccacgacccagccaagcggccgacagctaccgagttgctcaaatcagaactactgccccctccacagatggaagagtccgagcttcatgaggttctgcaccataccctgaccaatgtagacggcaaagcctaccggactatgatggctcagatcttcagccagcgcatatcccctgccattgattacacatatgattctgatatcttaaaggggaacttcagtatacggacagccaaaatgcagcaacatgtgtgtgagaccattattaggatctttaaacgacacggcgccgttcaactatgtacccctcttctcctgccccgaaaccggcaaatatacgagcataatgaggcggcgctgtttatggaccattcgggcatgctggtgatgctcccttttgacctgcgtatcccttttgcaaggtatgtagcacggaataatattctgaaccttaaacgttactgtatcgagcgggtttttcgaccacggaaactagacaggttccatcccaaggaattgttggaatgcgctttcgatatcgtgacttcaactacgaacagtttcctgccaacggctgagatcatctacacaatctatgagattatccaggagtttccggcgctgcaggagcgcaattactctatctatttgaaccacaccatgttgctgaaggcgattctgcttcattgtggtattcctgaggacaagctatcacaagtatacattatactttacgatgccgtgaccgagaagctcacaaggcgggaggtggaagccaaattttgcaacctgagtctcagctctaattctctatgtcggctttacaagtttatcgagcagaagggtgatctgcaggacctgatgccgacaattaattccttaatcaaacaaaagaccggcatcgcacagctcgtgaagtacggtctgaaggacctggaggaagtcgttggtcttttgaagaaactcggaatcaaactgcaggtcctgatcaacctgggcctcgtctataaggtacagcagcacaatggaattatcttccagtttgtggcctttatcaaacgtcgccaaagggctgtcccggagatattggctgcgggcgggcgctacgatctgctaatccctcagttcaggggaccccaggcactgggtccagtgcccactgccattggtgtatctatcgctattgataaaatctctgccgccgtactgaatatggaagagagcgtaacaatctcctcatgtgacctgcttgtggtgagcgtgggacagatgtctatgtccagagctataaacctgactcagaaactctggacagccgggattacagcggagataatgtacgactggtcgcaatcacaggaggagctccaggagtactgtagacaccacgaaataacttacgtggcattagtgtctgacaaagaaggatcacatgtgaaggtcaagtctttcgagaaggaacgacagactgagaaaagggtgctggagaccgagctcgtagatcacgtattacaaaagctacgtaccaaagtgactgatgagcgtaatggacgggaggcctcagacaacctcgcagtacagaatctgaagggaagcttttccaacgcctccggcttgttcgaaatccacggagctactgtggtgccaattgtttcagtgcttgctcccgagaagctttcagccagtacacgccgtaggtatgaaacacaggtgcaaacacgtctgcagacgagcctagccaacttgcaccagaagtcatctgagattgagattttggccgtcgatctgcccaaggagactattctgcagttcttatccctcgaatgggatgctgacgagcaggcgttcaacaccactgtgaagcagctgctaagccggctaccaaagcagcgctacctgaagcttgtctgtgatgagatatataatatcaaagtggaaaagaaggtgtctgtgctctttttgtactcatatcgggacgactactaccgcatactcttttag

SEQ ID NO: 15719 - DNA, 2388 bp, Artificial Sequence
  Description of Artificial Sequence: Synthetic coding sequence
atgaaattcaccaacactaaggtgcagatgatgcagaacgtgcatctggcccccgaaaccgacgaagatgatctgtattcgggttacaacgattataaccctatctacgacatagaagagctggagaacgacgccgcctttcagcaagccgtcagaacctcccatgggagaagaccccccattactgccaagatatccagcactgctgttactagacccattgcgacaggatacggcagcaagacctcactggcttcttccatcggtaggcctatgacgggagccattcaggacggcgtgacacgacctatgaccgccgttcgtgctgccggctttactaaagcagccctcaggggctcggctttcgatcccctgagccaatctagagggcctgcctcaccgctggaagccaagaaaaaggacagtccagaagagaagattaagcagttggaaaaagaagtcaatgagctcgtggaggaatcctgtattgccaacagctgcggtgatctcaagctggccctggaaaaggccaaggacgccgggcggaaagaacgagtcttagtacggcagcgtgagcaggttaccacgcccgagaatataaacctagacctcacttactcagtcctgtttaatctggcatctcagtatagcgtgaatgagatgtatgcagaggctttaaacacgtatcaggttatagtgaaaaacaagatgttctccaacgctggtatcctcaagatgaatatgggcaatatttatctgaagcagagaaactactcaaaggccattaagttctaccgaatggctctagaccaagtccccagcgtaaacaagcagatgcgtattaaaattatgcagaacattggagttacctttatacaggcgggccagtacagtgatgcaattaactcctatgagcacatcatgtcaatggctcccaacctgaaagccgggtacaacctcaccatttgttatttcgcgataggagaccgggagaagatgaagaaagccttccaaaaattgatcaccgtgcctctcgagatcgatgaagacaagtatattagtccttcagatgacccgcataccaatttagtgaccgaggccatcaaaaatgatcatcttcgccagatggagcgggagcggaaagctatggctgaaaagtatataatgacttccgccaagctgatcgctcctgttattgagacctccttcgccgccggctatgattggtgcgtggaggtggtaaaggcctctcaatatgttgaactggctaacgacttggaaattaacaaggctgtgacctatctgcgccaaaaggactacaatcaggcggtagaaatcctgaaggtgttggagaaaaaggactctcgggtcaagtcagcggcagcgaccaacctctccgcactctattacatggggaaagattttgcacaggcatcttcatacgccgacatagcagtgaatagcgaccgttacaatccagctgcattgactaataaggggaacaccgtgttcgcgaacggggactacgagaaagccgctgagttctacaaggaagcactgaggaatgattccagttgtacagaggccttgtacaatattgggctaacatatgagaaattgaataggttagatgaagccctggactgctttctcaagctgcacgcgatcttgagaaactcagccgaagtgttgtatcagattgccaacatttacgagctgatggaaaatccctcccaggctattgagtggcttatgcaagttgtgagtgttattccaacggacccacaggtgcttagcaagctaggggaattgtatgatagggagggtgacaaatctcaggcattccagtactattacgagagctacagatacttcccttgcaatatagaagtgatcgagtggctcggggcttactacatcgatacacaattctgggagaaggccattcagtatttcgaacgagctagtttaatacagcccacgcaggtgaagtggcagctgatggttgctagctgcttccgacggtccggtaactaccaaaaagcccttgatacttacaaagacacccatagaaagttcccggagaatgttgaatgtagcggaagcgtcaggacaggacacatggagagagatcccctcaatcttctgccccgcaagagcgtccttccagggcctgagatcgcaaagtgcaattacttctccggcgaaaaatactacttatctgcatttctgtcctcatctttgcaccggtcttggataaagcggtgttcgcgcatctgtcagaagaccgaggaggtaggcaaaaatgagagaaataaagggactgcacataaggtgcggcagcggtggcagtgggggcttccttggcagaagcgtcgaaaatgttag

SEQ ID NO: 15720 - DNA, 192 bp, Artificial Sequence
  Description of Artificial Sequence: Synthetic coding sequence
atgagctattatcgttcatattacggcggactaggttatgggtacggggggtttgggggctgggggtatgggtatgggtgcggatacggctcttttcgccggctgggctatggttgcggatatggaggttacggcttcagctgctgtcgcccgctgtactacggtggctatgggtttagcgcgttctactag

SEQ ID NO: 15721 - DNA, 135 bp, Artificial Sequence
  Description of Artificial Sequence: Synthetic coding sequence
atgtcctactacgggaactactacggagggttggggtacgggtacgactgtaaatattcatacacttctgggtttggggcctttaggatcctggattgcggttatcggtgcgggtgtggaggcgtctggatttag

SEQ ID NO: 15722 - DNA, 135 bp, Artificial Sequence
  Description of Artificial Sequence: Synthetic coding sequence
atgtcatattatagccatctgtcagggggactgggctgtggcctggccgtggccgtgaccatgggtcgaactgtcgctgttgcggagtatggtagatgtcgacatggttgccatagctcgtactctgctcgctag

SEQ ID NO: 15723 - DNA, 138 bp, Artificial Sequence
  Description of Artificial Sequence: Synthetic coding sequence
atgtgttactatcacaactactatggctcactggactatggctgcagctatgggtccgaatatggtaatagcggatacgcatgcaatttcccttgctcgtacgggcgcttcctgctggccccccggaaaaagttttag

SEQ ID NO: 15724 - DNA, 624 bp, Artificial Sequence
  Description of Artificial Sequence: Synthetic coding sequence
atgccccactcacactgccactcactgcgatcttttcacaatgctccacctctgagcgctataacccatggcactaaccccataacattcgaggataggctatgcctgccgtcctcattccattcccggacctgtttccttgacaattttcaggaaacttgtaacgaaacaacctcctgccagatgaccaattgtgagcaggacttattcaccgatgactcttgcgttcaaagtaattgcttccccggcgttgtccaaaccacctatagcaatagccggccgtgtgagaggacggcctgccaatctgagagcagctcagccgggttagcctgtgtgtcccagccttgtcaatcagagagtacacaacagatgggtttcgtggctcagtcatgtcagcctgctagcctgaaaggcaattcctgtccacctaagacgtcaaaatcgaagaatttcgagacacttgagagggcctccagccagtgtcaatgtcaaagccagaacccggaatcttccagttgccgcccactggtcaatgtggctccggaacctcagctgctggagtccagcccaggagtggagcctacgtgttgcgtcactggtgggtctcagctgccgagtaagtag

SEQ ID NO: 15725 - DNA, 645 bp, Artificial Sequence
  Description of Artificial Sequence: Synthetic coding sequence
atggcccatgtgtcttcggaaacgcaagacgtgtctccaaaggacgaactgacagcttcagaagcaagcacccgatcccctctgtgtgagcatactttccctggagatagtgaccttcgctcaatgattgaagagcatgcgtttcaggtgttgtctcagggctccctgctcgagtcaccttcctacacagtgtgtgtatctgaacctgataaggatgatgactttctgagtctgaacttccccaggaagctttggaaaattgtggaatccgaccaatttaagtccatttcctgggatgagaatggcacgtgcatcgtgattaacgaagaactgttcaagaaggagatcctcgaaaccaaagctccttaccgcatcttccagaccgacgccataaagagcttcgtgagacagctgaacttgtacggtttttcaaagatacagcagaactttcagaggtcagccttcttagctacctttctgtctgaggaaaaggaatctagcgtgctaagtaaattgcatgtgttcgtcttccaccacagcttgttcggcgccacattcggcgagcaccactttcaaccatgtcccctaccatcaggcaacaaagcccctatctctacttggtccggcgatagctggctcttgtag

SEQ ID NO: 15726 - DNA, 645 bp, Artificial Sequence
  Description of Artificial Sequence: Synthetic coding sequence
atggcccatgtaagctccgagacccaggacgtaagcccaaaggacgagctcactgctagcgaggcaagcacacggtcaccactgtgtgaacataccttccctggtgacagcgatctgagatcaatgatagaggaacatgcctttcaggtgctgagccagggtagtctcctggagtcacccagctacactgtctgcgttagtgaacctgacaaagacgacgacttccttagtctgaattttcctcggaagctttggaaaatcgttgagagtgaccagtttaaatctatttcctgggacgagaatgggacatgtatcgtaatcaacgaggagctctttaagaaagagatactggaaactaaggctccctacagaatattccagacagacgcgataaaaagtttcgtccggcagctgaacctgtatgggttttcaaaaatccagcagaactttcagagatccgcatttctggccaccttcttaagcgaagaaaaagaatctagtgtgttgtctaagctgcatgtgttcgtgtttcatcattcgttgttcggcgctactttcggcgagcaccactttcagccatgccccctgcctagcggaaacaaggcccctataagtacctggtccggggacagttggctcctgtag

SEQ ID NO: 15727 - DNA, 1437 bp, Artificial Sequence
  Description of Artificial Sequence: Synthetic coding sequence
atggccgctgccctgaagtgtcttctgacactcgggagatggtgccccggattaggcgtagcccctcaagcccgagctttagccgccttagtgccaggtgtgactcaggttgataacaaatctggctttctgcagaagagaccacatcgtcagcaccctggcatcttgaaactcccacatgtgagactgccacaggccctcgccaatggagcccagctcttgttgctgggttcagctgggccgactatggaaaaccaagttcagacattgacgagctacttgtggtcacgccatctgcccgtggagccggaggaattacagcgccgagctaggcacctggagaaaaaatttctggagaatccagatctgtcacagactgaggaaaaattgcgcggagccgtgctgcacgctctacgaaaaaccacctatcactggcaggagctgtcttacactgaagggctgagcttggtctatatggctgcccgcctggatgggggattcgccgccgtctccagggcattccatgaaataagggcaagaaaccctgcctttcagcctcagaccctcatggatttcggcagtggaacaggatctgtgacctgggctgcacactctatttgggggcagagcctcagagagtacatgtgtgtagaccgctccgccgctatgttagttctggcggagaagttgctgaagggagggagcgagagcggggaaccttacattcctggggtgttctttaggcagttcttacctgtgtcaccaaaggtgcagttcgacgtcgtggtttcagctttcagcctgagtgagctgccctccaaggctgatcgcacagaggtagttcagactctctggcggaaaaccgggcactttctcgtgttggtggaaaatggcaccaaggccggacactccctgttgatggacgctcgtgacctcgtcctgaagggcaaggagaaatctcccctcgatccgaggcctggttttgtgtttgctccgtgcccacacgaactgccatgcccccaattaactaacctcgcttgctctttctcccaggcttaccatccaatccctttctcatggaacaagaagcccaaagaagagaagttcagtatggtcattctggcacgggggtcccccgaagaggcccacagatggccaaggataacccaacccgtcctaaagcgcccgcgccacgtccactgccatctgtgttgccccgacggccacatgcagcatgccgtgctgaccgctaggcgccacggaaggtatgggggctgcgatcagaatcagtgggacgtcgccggctcgtgctcaccaaggcagcacctcttcccccaggggtttgtgtccctttgtccgtgtcagttattgggtaggtcctttacttgcgcatactccgtgtgcgtatcctccatttacggttccggatctctctag

SEQ ID NO: 15728 - DNA, 774 bp, Artificial Sequence
  Description of Artificial Sequence: Synthetic coding sequence
atggaagaggaagcctctagccccggactgggttgcagtaaacctcacttagaaaagctcaccctgggaattaccaggatcctggagtcctcccccggagtgaccgaggtcacaatcattgagaaacccccagccgagcggcatatgatcagcagctgggagcagaaaaataactgtgtaatgcccgaggacgtgaaaaatttttacttgatgaccaacggctttcatatgacctggtccgtgaaactggacgctagcgacgatcagcccgaaaagccacacttcgattccagaagcgtgatcttcgagctcgactcatgcaatggatccggcaaagtatgcttggtttataagtccggaaagcctgcccttgcagaggatacagagatctggttcctagatagagccctctactggcactttctgaccgatacttttacagcttactacagactgttgataactcatctcggtctccctcagtggcagtacgcatttaccagctacggaattagtccgcaggctaagcagtggtttagtatgtataaaccaataacctacaacactaaccttctaactgaggagacagattcctttgtcaacaagctggatccttctaaagttttcaagagcaaaaacaaaatcgtcatccctaagaaaaaaggacctgttcagcccgctgggggacagaagggcccctctggcccctccgggcctagtacctcaagcacaagtaagagttcctccggcagcggaaacccaaccagaaaatag

SEQ ID NO: 15729 - DNA, 792 bp, Artificial Sequence
  Description of Artificial Sequence: Synthetic coding sequence
atgctctcctctaaaggcctcaccgtcgttgatgtctaccaaggatggtgtgggccttgtaagccagtggtgagtttatttcaaaagatgagaattgaggtgggtttggatcttttgcatttcgcactggccgaggctgatagactggatgtcctcgagaaatatcggggaaagtgtgaacccactttccttttctatgccattaaggacgaggccctgagtgatgaagatgaatgcgtctctcacggcaagaataacggggaggatgaagatatggtgagcagtgagaggacatgcacgctggcaattattaaacctgatgcggttgcacacggaaaaactgacgagattatcatgaaaattcaggaagccgggttcgaaatattaactaacgaggaaagaacgatgacagaggcagaggtgcgcctcttttaccagcacaaagctggggaggaggccttcgagaagttagtgcaccacatgtgctccggaccatcccatcttctgattttgacccggacggagggattcgaagatgtggtaactacctggcgtaccgtgatgggtccaagagatcctaacgtagccagacgggagcagccagagtctttgcgcgcccagtatggcactgaaatgcccttcaatgctgtgcacggctcacgagatcgagaggatgctgaccgcgagttagctctgttgttccctagtctgaaattttcagataaggacacagaagcaccacaaggcgagagttctactcagccaagactcaaaatcacggatctggattag

SEQ ID NO: 15730 - DNA, 390 bp, Artificial Sequence
  Description of Artificial Sequence: Synthetic coding sequence
atggccgaactgatccaaaagaagctccagggggaggtggagaagtatcagcagctgcagaaggacctgtccaagagcatgtctggcaggcagaaactggaagcgcaacttaccgaaaataatatagtaaaagaggagctagctctcctggacgggtccaatgtggtattcaagctgcttggaccagtactcgtgaaacaggagcttggtgaggccagggcaaccgtcggtaagaggctagactatattaccgccgagattaagagatacgaatcccaactgcgggacttagagcggcagagcgaacaacagcgagagacacttgcccagcttcagcaagaattccagcgcgcccaggccgctaaggccggagcacctggaaaggcctag

SEQ ID NO: 15731 - DNA, 1626 bp, Artificial Sequence
  Description of Artificial Sequence: Synthetic coding sequence
atggaagcactgctggaaggtatccagaatagaggtcatggtggggggttcctgacatcgtgcgaggcggaactgcaggagttgatgaagcagattgatataatggttgcacacaaaaaatctgaatgggagggtcgtacccatgccctcgaaacctgcctcaaaattagggaacaggagctgaagagtctgcggagtcagctcgatgtgacacataaggaggttggcatgctgcatcaacaggtcgaagagcacgagaagataaaacaggaaatgacaatggagtacaaacaggagctgaagaagctgcacgaagaactttgtatcctcaaacggtcctatgagaaactgcagaagaaacagatgcgcgaatttagaggcaatacgaaaaatcacagagaggaccgtagcgagattgagcggctcacagctaagattgaggagttccggcagaagtcattagactgggaaaagcagcgtctcatttaccagcagcaggtcagttcgttggaagctcagagaaaggccctcgctgaacagagcgaaatcatccaggcccagctcgtcaacagaaaacagaaactggaatcggtagaactgtcctctcagtcagagatccagcatctgagctctaagctggaaagggccaatgacaccatttgcgccaacgaactggagatagagagactgactatgagagttaacgatttagtgggcaccagcatgaccgtactacaagagcagcagcagaaagaggagaagctaagggagtcggaaaagctgctggaagccttgcaggaagagaagagggaactaaaagcagccctgcaaagtcaagaaaatctcattcacgaagcaagaattcaaaaggaaaagctccaggagaaagtaaaggccactaacacccagcatgcagtggaggccattaggccaagggaagagtccctggccgagaagaaatacaccagtcagggacagggtgacctggactccgtgctgtctcaactgaacttcacacataccagcgaggacctcctgcaggctgaggttacttgtttggagggatcattggagtctgtaagtgccacctgcaagcagctttcccaggaactgatggagaagtacgaagaattgaagaggatggaagctcataacaacgagtataaggccgaaattaaaaagttgaaggagcaaattctgcagggagaacagtcctattcatctgctttagagggcatgaagatggagattagtcatttgacccaggagctccaccagcgggatattactatcgctagtaccaaaggcagctcctctgatatggagaagcggctgcgtgccgaaatgcagaaggcagaggataaggctgttgagcataaagagattcttgaccagttggagagcctcaagttagagaatagacatttatctgaaatggtgatgaagctcgaactggggttgcatgagtgttcccttccagtgagtcccttagggtccatagctacccgcttcctggaggaggaggaactacgaagccaccacattttagaacgtctggacgcccacatcgaagagctcaagagggagagcgagaagacagtccgacagttcacggctcttaaatag

SEQ ID NO: 15732 - DNA, 483 bp, Artificial Sequence
  Description of Artificial Sequence: Synthetic coding sequence
atggaagccgaacgccctcaggaggaggaagacggcgaacagggacctccccaagatgaggagggctggccaccccctaacagcaccactagaccttggcgaagtgcaccaccgtctcctcccccaccgggcacacgacatactgcgttgggcccgcgatccgcttccctgttgtcattgcagacagagcttcttctggacctcgttgccgaagctcagtcccgaaggctggaagaacagcgtgctacgttttacacaccgcaaaacccttcatccttagcgccagctccactccgccccctggaagatagagaacaactgtatagcactatcctgtcgcaccagtgccaaaggatggaggcccagcggtcagagccccctttgcccccaggggggcaggagcttctagaactgttgctgcgagttcaggggggcgggaggatggaggagcagagatctcgtccccctacccatacttgttag

SEQ ID NO: 15733 - DNA, 483 bp, Artificial Sequence
  Description of Artificial Sequence: Synthetic coding sequence
atggaagctgagcggccacaggaagaggaggacggcgaacaaggcccaccccaggatgaagagggttggcctccaccaaattccacaacacgtccttggcgaagcgctcccccatccccccctcctccaggaaccaggcacacagccctgggaccccgatctgcttctcttctctccctgcaaacggagttgctgctagatttggttgccgaagctcaatcacggaggctggaagagcagcgagcaactttttacacgcctcagaacccaagcagcctggcccccgcccccctgcgaccactcgaggaccgggagcagttgtacagcaccatcctcagccatcagtgccagcgcatggaggctcagcgtagtgagcctccactaccgccaggtggccaggagctcctagagttgctgcttagagtgcaggggggcggtcgaatggaggagcaaaggagccggccgccgacgcacacttgctag

SEQ ID NO: 15734 - DNA, 3192 bp, Artificial Sequence
  Description of Artificial Sequence: Synthetic coding sequence
atgccgcacctgccactcgcctcctttcggcctcccttttggggtttgcggcattccagaggtttgccccgatttcattccgtgtccacgcaatctgagccccacggatctcctattagtcggagaaaccgcgaggcaaaacaaaagcggttgagagaaaagcaggcaaccttggaagctgaaatagccggagagagcaagtctccagccgagtccattaaggcctggcggccaaaagaattggttctgtatgagatccccacaaagcctggcgagaaaaaggacgttagcggtcccctgcccccggcatattcaccaagatatgtggaggcggcttggtatccttggtgggtcagagagggcttcttcaagccagaatatcaggctcggttgccccaggctaccggtgagacctttagtatgtgtattcccccccccaatgtgacaggttccctgcatatcgggcacgctctgaccgttgccatccaggacgccctagtgaggtggcacagaatgaggggcgaccaggtgctttgggtgcctggttcagatcatgccggtatagccacacaggctgtagtggaaaagcagttgtggaaagagcggggcgtccggcgccatgaactgtctcgagaggcctttctgcgcgaagtgtggcagtggaaggaagctaaggggggcgaaatatgcgagcagctccgagcactgggggcctctttggactgggatcgcgagtgttttactatggatgtaggatcctccgtcgccgtgacagaagcattcgttagactgtacaaggcgggactcctgtatcggaaccatcagttggtcaattggtcttgtgcattgcgttctgcaatctccgacatcgaagttgagaatcgcccgctccctggtcacacccagctcaggctgcctggctgccctacgcctgtaagtttcggtttgctgttctctgtcgctttccctgtcgacggcgaaccagatgctgaagtggtggtggggactacacgaccagagaccctcccaggggacgttgccgttgcggtccaccctgacgacagccggtacacccacttgcatggccggcagctccgtcaccctttgatgggccagcctctgccactgataacggattatgccgttcaaccccacgtcgggaccggagccgtgaaggtgacaccagcgcactctcctgccgatgccgagatgggtgcccggcacgggctgagccccctgaacgtaattgccgaggatggtacgatgactagcctttgcggggactggcttcagggactgcacaggttcgtggctcgagaaaaaattatgtctgtgctgtcggagagagggctcttccgtggactccaaaatcatccaatggtgctgcccatatgtagccgttctggcgacgtgatcgagtatctcctgaagaaccagtggttcgtgaggtgtcaggaaatgggagcccgggcagccaaagcagtggaaagcggggccttggagttgagccccagcttccaccaaaagaactggcagcactggttctctcacataggtgactggtgtgtgtcccggcagctatggtgggggcatcagatccccgcttatctggtggttgaagaccacgcgcagggcgaggaggactgttgggtcgtgggtcggtctgaggctgaggccagggaagtcgccgcagagctcactggtagacccggagccgaactcacactcgagagggatcccgacgtactggacacttggtttagttctgccctgttccctttttcggcgcttgggtggccccaagaaacaccagatctggctcggttctaccctctttcgctgctcgaaacgggtagcgacctgcttctattctgggtaggtaggatggtcatgttgggcacccagctgaccggacagctgcctttttctaaggtgctgctgcatcccatggtgagagataggcaggggcggaagatgagtaagtccctcggaaatgttctcgacccccgggacatcatctctggggttgagatgcagctcctccaggaaaagctccggtccgggaatctggaccccgcagaactggccatcgttgccgcagcacagaaaaaagattttccccatggcatcccggagtgcggtacagatgccctgcgtttcaccttgtgctctcacggtgtccaagccggcgacctgcatctgagcgtcagcgaagtgcagtcctgcaggcacttctgcaacaaaatctggaatgcattgagatttatcctcaacgccctgggagaaaagttcgtaccgcagcccgctgaggagctgtctccctctagcccgatggacgcatggatcttgtccagattggccctggccgcacaagaatgcgaaagaggatttctgaccagagaactgagcctcgttacccacgctttgcaccacttttggctccacaatctctgtgatgtgtacctggaggcagttaagcctgtcctctggcacagccctaggcctctgggtcctcctcaagttctcttctcttgtgcagacctgggactccgtctcctggcgccattgatgccattcctggcagaggagctatggcaacgcctgcccccacgccccggctgcccaccagcaccctcaatctctgtggcgccttacccatcagcttgtagccttgagcactggcgccagccagagttagaacgccgattttctcgggtgcaggaggtggtgcaggttcttagagccctccgggccacctatcagttgaccaaggcccgcccaagagtgttacttcagagttctgagcctggggaccaggggctgttcgaggcgttcctggaaccccttggcacgttggggtattgcggggctgtgggtctgctgcctcccggcacagccgctcccagcgggtgggcccaggcgcccctgtctgataccgcgcaagtgtatatggaactgcaggggttggtcgaccctcagatacagctccctctcctggctgctcgccgctataaactccagaagcagctagattcattaaccgcccgaactccatctgaaggcgaagccgggacccagaggcagcaaaaactgtcaagcctgcaattggaattatcaaaacttgataaggcggcaagtcacttaagacagttgatggatgaacctcccgcaccggggagtcctgaactttag

SEQ ID NO: 15735 - DNA, 1620 bp, Artificial Sequence
  Description of Artificial Sequence: Synthetic coding sequence
atggccactagcgctccgttgagatccctggaagaagaggtgacgtgttcaatttgtctggactatctacgtgatccagtcacgattgactgtgggcacgttttctgcaggtcctgtacgactgacgtccgtcccatcagtggcagccgtccggtttgtcctctgtgtaagaagcccttcaagaaggagaatatcaggcctgtgtggcagcttgccagcttggtcgaaaacattgagcgcttgaaggtcgataaaggaagacaacctggggaggtgacacgggaacaacaagacgccaaactgtgtgaaagacatcgggagaagcttcactactattgcgaggacgacgggaagctgctgtgtgttatgtgtagggagtctcgcgaacatcgcccgcatacagctgtgctgatggagaaggcagctcagccgcaccgggagaaaatcctgaaccacctgagtactctccgtagagatagagataagatccagggattccaagctaagggtgaagccgatatcttggccgctcttaaaaaacttcaggaccaacggcagtacattgtagccgaattcgaacagggtcatcaattcctgcgagaacgggaagaacacttactagagcaacttgcaaaacttgagcaggagcttacggaaggaagagagaagttcaaatctagaggagtcggagagttggccaggctggcgctggtcatcagcgagctcgaaggcaaggcccagcaaccagctgctgaactcatgcaggatacccgggacttcctgaacaggtaccctaggaagaagttctgggttggtaaacccattgcccgcgttgtcaaaaagaaaaccggtgagttttctgacaagctcctgagcttgcagagaggtctgagagagtttcagggaaagctgctccgggacttagagtataagacagtctccgtgactctggatccccaatctgcttctggatacctccagctgtccgaggattggaagtgcgtaacctatacctccctgtacaagtccgcatatctgcacccacagcaatttgactgtgaacccggagtactgggatcgaagggcttcacttgggggaaggtttactgggaggttgaggtcgagcgagagggctggtcggaggacgaagaggaaggggatgaagaagaggaaggcgaggaagaagaggaggaggaggaggccggttatggcgacgggtatgacgattgggaaactgatgaggacgaagagtccctgggcgatgaagaggaggaggaagaggaagaagaagaagaagtgctggagtcttgtatggttggcgtggcccgagattcggtgaagcgcaagggtgatctttccctgagacctgaagatggcgtatgggccctgagactcagttcttctgggatctgggccaatacatcccccgaggcagagctctttcccgccctgaggccgaggagagttggcattgctttagactatgaaggcggtaccgtgacatttacaaacgctgagtcccaggagctgatttacactttcacagccacgtttaccagaagactggttcccttcttatggttgaaatggccagggacgagattactacttcgtccttag

SEQ ID NO: 15736 - DNA, 678 bp, Artificial Sequence
  Description of Artificial Sequence: Synthetic coding sequence
atggctgcaggttctgaggcaacaacacccgtgattgtcgctgccggcgccgggggtgaggaaggtgaacacgtcaaaccgttcaagccagagaaagccaaagagattattatgtcgctccagcagccagccatattttgtaacatggtgttcgactggcctgccagacattggaacgcaaagtatctatcacaggtgctgcacggaaaacagatccggtttagaatgggtatgaagagcatgtctacggtaccccaattcgaaaccacatgtaattatgtcgaagctacattggaagagttcctcacctggaactgtgatcagtcaagcatctccggtccttttagagactatgaccattccaagttctgggcctacgcagattacaagtatttcgtgtccctgttcgaggacaagactgacttgtttcaggatgtgaaatggtctgactttggctttcccgggagaaatgggcaggaaagtaccctctggattggatccctgggggcgcacacgccatgtcacctggattcctacggttgcaatctggtcttccaggtgcagggacgcctggagtgtaacggaatgattattgcacctggtccccaggcaatcctcctgccacagcccctaaaatacctggggctccaagagacgatggcttccctgagttcctag

SEQ ID NO: 15737 - DNA, 2571 bp, Artificial Sequence
  Description of Artificial Sequence: Synthetic coding sequence
atggatatatctaagggtctcccgggtatgcagggtgggctgcacatctggatttctgagaataggaagatggtgcctgtccccgagggtgcatatggcaatttttttgaggaacactgttatgtcatcctccatgtgcctcagtctcccaaagcaacccagggcgcctcttccgatctccactattgggtcggcaagcaagctggagccgaagcccaaggcgctgctgaagcattccagcagcgcttgcaagatgaactcggtggacagacagtgctgcaccgcgaggcccagggccacgagagtgactgtttttgcagctacttcagaccaggtattatctaccgcaagggcgggcttgcttccgatctgaaacacgtggaaaccaatttgttcaacattcagaggctgctgcacatcaagggaagaaagcacgtgtccgcaacagaagtggaattgtcctggaacagtttcaacaagggcgatatattcctgctggacttgggaaagatgatgatccagtggaacggcccgaagacctccatatcagagaaagccaggggcttagcactgacgtattctttaagggaccgggagaggggcggcggtcgagcccagattggcgtggtcgacgatgaagccaaggcacccgacttaatgcagataatggaggcagttctgggccggagagtcggatcacttcgtgcagctacaccatctaaagacatcaaccagctccagaaagccaatgtccgcctgtaccatgtttacgagaaagggaaggatcttgtcgtgcttgagctggccaccccacccctgacacaggacctgcttcaggaggaagacttctacattctcgatcagggcgggttcaaaatttacgtgtggcagggccggatgtcttccttacaggagaggaaagcagcattcagccgagcagtgggcttcattcaagcaaaggggtatccaacctacaccaatgtggaagtcgtcaacgatggagcagaatctgcggcttttaaacagctgttcagaacatggtccgagaaacgtcggagaaatcagaaattggggggtcgggacaagtccatccatgtgaagctggatgtgggtaaactccatacccaacccaaactagcagcccagctgcgcatggtcgatgacggttcaggcaaggttgaagtctggtgcatccaggacctccacagacagcccgtggacccaaagagacatgggcaactctgcgccggaaactgttacttagtgttgtacacctaccagagattgggccgggtacaatacatcctgtacctgtggcaaggacatcaggccacagccgacgagatcgaagcattaaactccaacgcagaagaactggacgtaatgtacggcggtgtgctagtgcaagagcatgtaactatgggatccgagcccccacattttctcgccatatttcagggacagctggtgatttttcaggagagggcagggcatcatggaaaggggcagtccgccagcactaccaggctgtttcaggtgcagggaactgactcacacaatacgaggaccatggaggttccagctcgagcctccagcctgaatagcagtgatatcttcctcttagtgactgccagcgtttgttacctgtggtttggtaagggttgcaacggcgaccagcgtgagatggcaagggtggtggtaaccgtgatcagtcgcaaaaacgaggagactgtactggaggggcaggagccgccccatttctgggaggccctgggcggccgcgccccgtacccaagcaacaagcgccttccagaggaggtaccatcctttcagccacggctgtttgaatgctctagccacatgggctgtctggtcctcgcagaggtgggttttttctctcaagaagacctggacaagtatgatatcatgctgctcgatacttggcaggaaattttcctgtggctaggcgaggccgcgtccgaatggaaggaggctgttgcttggggtcaggaatacctgaaaacccaccctgcgggcaggtcgcccgctaccccgatcgttctggtcaagcagggtcacgaacccccaacctttatcggatggttctttacttgggacccgtacaagtggacaagccaccctagccacaaggaagtggtggatggatcccccgctgcggccagcacaatatccgagatcacggccgaagtcaacaacctgcggctcagccgatggcctggcaacggacgcgctggcgctgtggcactccaggctttaaagggcagtcaagactcctccgaaaacgatttagttcgaagcccaaagagcgccgggagcaggacatccagttctgtatcaagtacgtcggcaacgatcaatggtggtctgcggcgggagcagctgatgcaccaagcagtcgaagacctgcctgagggagtggaccccgctaggcgtgagttctacctgtcagacagcgattttcaggacatctttggaaaatccaaagaagaattctacagcatggctacttggagacagcggcaggaaaaaaagcagctcggcttcttctag

SEQ ID NO: 15738 - DNA, 2607 bp, Artificial Sequence
  Description of Artificial Sequence: Synthetic coding sequence
atggccagctttcccgagaccgacttccagatttgtctgctgtgcaaagaaatgtgtggctccccagctccactgtcttccaattcatctgcctctagttccagctcccagaccagcacctccagtggaggtggcggggggggccctggcgccgccgcaaggcgactccacgtcttgccatgtctgcatgcattctgtagaccttgcctggaggcccatcgcctaccggccgccggcgggggcgccgctggcgaaccgctaaagctgaggtgtcccgtgtgtgaccagaaggttgtcctggctgaagccgcaggcatggacgctcttcctagctccgcattcctgctaagcaatctgttggatgcggtggtagctaccgctgatgagccgcccccaaaaaatggtagagccggggcccctgccggcgcaggaggacacagcaaccaccgccatcatgcccaccatgctcatccacgagctagtgcctctgctcctccccttccccaggcacctcagccacccgcgccttcacggtcagcacctggggggccagctgcttctccgagcgcccttctactgcgcagacctcatggatgttctagttgtgacgagggtaacgcggcgtcttctcggtgtcttgattgtcaggaacatctctgcgacaattgcgtccgagcccatcagcgagtccggctgacgaaggaccactacattgagcgcgggcctcctggacccggtgctgccgctgctgcccaacagctcggtctcggacctccttttccaggacctccatttagcattctcagcgtttttccggagagactaggattctgccaacaccatgacgacgaggtactccacctatactgtgacacatgctctgtgcccatctgtagagagtgcaccatgggaaggcacggcggccattcattcatctacttgcaagaggccttgcaggacagtcgggctctgacgatccagctactcgccgatgcccagcagggacgccaggcaattcagctgagcattgagcaagctcagacagtcgcagagcaagtcgagatgaaggccaaggtcgtccagagcgaggtgaaggccgtgaccgcccgtcacaaaaaggcgcttgaggagcgcgagtgtgagctcctatggaaggtggagaaaatcagacaagtgaaagcaaagagcctatacctgcaggtagagaagctgcgccagaacctgaataagctggaaagcacaattagtgctgtgcaacaagtgttggaggaggggcgggccctcgacatacttcttgcacgagatcggatgctcgcccaggtgcaggaattaaagaccgtccggtccctcttacaaccccaggaagacgacagagtgatgttcacccctcccgaccaggctctgtacctcgccattaaaagcttcgggtttgtgtcgtccggcgctttcgccccgcttaccaaggctacaggcgatggcctgaaaagagccttgcaggggaaggtcgcttcctttacagtcattgggtacgatcacgacggcgagcctaggctgtcgggcggcgacctgatgtcagcagtagttctaggacccgatgggaatttgttcggcgctgaggtgagcgatcagcagaatggtacttatgtggtctcttaccggcctcagctggagggcgagcacctggtgtcggtcacactgtgtaaccaacatatagaaaactctccctttaaggtggtggtaaaaagcggccgcagttatgttggcatcggccttccagggctgagcttcggctcagagggtgactccgacggcaagctgtgtagaccctggggtgtaagcgtcgacaaggagggctatatcatagttgccgatagatctaacaaccgaatacaggtcttcaagccatgtggggctttccaccataagtttggcacattgggctcacgacctggccagtttgatcgacccgctggggtcgcttgtgacgctagccgtagaattgtggtggctgataaggataaccacaggatccaaattttcacctttgagggtcagttcttgttaaagttcggggagaaaggtactaaaaacggacagttcaattacccatgggatgtggcggttaactctgagggaaagatattggtgtccgatactaggaaccaccggattcagctgtttggccctgacggtgtctttctcaacaaatacgggtttgagggagcgctgtggaaacacttcgactctcctcgaggtgtggcgtttaatcacgaaggccacttagtggtgacggatttcaataatcatcgcctgctcgtaattcatccagactgtcaaagtgcacgattcctggggagtgaaggaactggcaatgggcagttcctgagaccgcagggcgtagccgttgaccaggaggggaggataattgtagcagactcacggaatcacagggtccaaatgttcgaatctaacggttcttttttatgtaagttcggagcacaggggagcggattcgggcaaatggaccgaccgagtggtattgcaatcacacctgacggcatgattgtggtcgtcgacttcgggaacaaccgaatccttgtgttttag

SEQ ID NO: 15739 - DNA, 1107 bp, Artificial Sequence
  Description of Artificial Sequence: Synthetic coding sequence
atgcgcgaaccagtcctgacatggtgcgtaccacttgagctgttgtgcagccatcccctgccattgagcgctttcctcaaatcacaggtgaagctctatacttatcgagcatgtgctggtaaagacgagatggggaagatggtatctgtgattaacacagtggacactagccacgaggacatgatccacgacgcgcagatggattattacggcaccagactggctacttgctctagcgacaggtctgtcaaaatctttgatgttagaaacggcggccaaatccttatcgctgatttacgtggtcatgaaggtcccgtgtggcaggtggcttgggcacatcccatgtacggcaacatcctcgcttcatgctcatacgatagaaaagtaataatctggcgggaagagaatgggacttgggagaaaagccatgaacatgcaggccacgacagctctgtgaacagcgtctgttgggctcctcatgactacggactcatactcgcctgcggctcatcagacggagctatctcacttctaacatatacaggggaagggcagtgggaggtgaagaagataaacaacgcacacactattggttgtaacgcggtctcttgggcccctgccgtagtgccaggtagtctcatagaccacccatcgggtcagaaacctaactatatcaagcgcttcgccagtggcggctgcgacaacctgatcaaactgtggaaagaagaagaggacggtcagtggaaagaggagcagaaactggaggcccatagtgactgggttagggatgttgcgtgggctccgagcataggtctcccaacaagtactatcgctagctgctcccaagacggccgagtttttatttggacatgtgatgatgcttctagtaacacctggtcacccaaactgctccataaatttaatgacgtggtgtggcatgttagctggagcattacagcaaatattctcgcagtatctggaggcgacaataaggtcacactgtggaaggaatctgtggatggccagtgggtgtgtatcagtgatgtgaataagggccaggggtcggtctccgcctctgtgacagagggtcagcagaatgagcagtag

SEQ ID NO: 15740 - DNA, 1059 bp, Artificial Sequence
  Description of Artificial Sequence: Synthetic coding sequence
atggatattgacaaggacttagaggccccgctgtacttgaccccagaaggctggagcctatttctgcagagatactatcaagtagtacacgagggggcagaattgaggcaccttgatacccaggtgcaaagatgtgaagacatattacagcagctgcaagccgtcgtgcctcaaatcgatatggagggagacaggaacatctggatcgttaagcccggagccaagagtagaggccgaggcatcatgtgtatggaccacttagaagagatgcttaaactggttaatggaaatcccgtggtaatgaaggatggcaagtgggtcgttcaaaaatatatagaacgcccgctcctaatatttgggacgaaattcgatctgcggcagtggttcctggtcaccgattggaatccgctgactgtttggttctacagagattcttatatccggttttccacacagcctttttccctgaagaacctggataacagcgtccacctgtgtaataacagtatccaaaaacatttggagaacagctgtcataggcaccccttactgccacctgacaatatgtggtcctcccaacgctttcaggcccatctgcaggaaatgggggcgcccaatgcctggtctactatcatcgtcccaggaatgaaagatgctgtcatccatgcccttcaaacttcccaggacaccgtccagtgcagaaaagcatcattcgagctgtacggagctgacttcgtattcggtgaggacttccagccatggcttattgagataaatgccagcccaaccatggcgccaagcaccgccgtcacagcccgactgtgcgcaggcgtacaggctgataccctccgcgttgttattgaccgtatgttagatcgtaactgcgacacaggggcctttgagctgatctacaaacagccagtgacaacctcacctgccagcacccccaggccatcttgcctgctacctatgtattcagatacaagggctcggagcagtgatgactcgactgcgtcatggtgggccctccggccttgtcggccccaagccaggccctag

SEQ ID NO: 15741 - DNA, 579 bp, Artificial Sequence
  Description of Artificial Sequence: Synthetic coding sequence
atgggcaaggggtgcaaggttgtggtctgtggactgctctccgtaggtaagactgccattttggagcagctgctctacggaaatcatacaatcgggatggaagactgtgagacaatggaggatgtctatatggcgagcgttgaaaccgacaggggcgttaaagaacagctgcacctatatgatactaggggcctgcaggagggcgtggagcttcctaagcactatttcagctttgctgacggcttcgtgctcgtgtactccgtcaacaacttggaatccttccaacgtgtggagttgctgaagaaagaaattgataagtttaaggataagaaggaagttgccattgtggttctgggcaacaagatcgacctgtctgagcaacgccaggtggatgctgaagtcgcacagcagtgggccaaaagcgagaaggtccgcctttgggaagtgaccgtcacggacaggaagacactgatcgagccatttaccctgcttgcttcaaaactctcacaaccccaatctaaaagctcctttccactccccggtcgcaagaataagggcaacagcaattctgagaactag

SEQ ID NO: 15742 - DNA, 1419 bp, Artificial Sequence
  Description of Artificial Sequence: Synthetic coding sequence
atgtcccggcgcgtggtgagacagtccaagttcagacatgtcttcggacaagcagctaaagctgaccaggcctacgaggacattcgggtatcaaaagttacctgggatagcagcttctgcgcagtcaatccgaagttccttgccataatagttgaggccgggggtggaggcgcctttattgtcttgccactggcaaagaccggccgcgtggacaagaattatcccttggtgactgggcatactgctcccgtgcttgacattgactggtgtcctcataatgacaatgtcatcgcctctgcctcagatgacacaacaatcatggtctggcaaattcctgactacactcctatgcggaatattactgaaccgataatcaccctagaggggcacagcaaaagggtggggatcctgtcctggcaccctaccgcccggaacgtgctgctctccgccggcggagataatgtgatcatcatttggaacgtcggcaccggagaagtgttgctgtcactcgatgatatgcaccccgatgtaatccacagtgtatgctggaacagtaatggctcacttctggcgactacgtgtaaggataaaactctgagaattattgaccctcgtaaggggcaagtggttgcagaacgctttgcagcacatgagggcatgaggcctatgagagccgtgttcactcgccaggggcatatttttacgactgggtttacccgtatgagccagcgggagctgggtctgtgggaccccaacaattttgaagaacctgtggctctacaagagatggatacatcgaacggggtgctactgcccttctacgatccagattcttccatagtgtacctgtgtggcaagggtgactcttctatcaggtatttcgaaatcactgacgagcccccttttgtccattacttgaatacttttagttctaaggaaccccaaagaggcatgggctttatgcctaagaggggtctggacgtctcaaaatgcgaaatcgcccgcttctacaagctgcacgaacgcaaatgcgaaccgattatcatgacggttccaaggaaaagtgatctgttccaggacgacctgtatccagatacccccgggcctgaaccagctctggaggcagatgaatggctgagcggacaagacgccgaacccgttctcatttcgctccgcgatggctatgtccctccaaagcatagagagctccgtgtaacaaaacggaacatcctggacgtgcggccaccgagcggtccacggaggagccagtccgcatcagatgcccccctgtcccagcagcacaccctggagacactcttggaagaaatcaaagctctgagggaaagagttcaggcacaggagcagcggataacagcattagaaaatatgctgtgcgagttggtggacggaacagactag

SEQ ID NO: 15743 - DNA, 2628 bp, Artificial Sequence
  Description of Artificial Sequence: Synthetic coding sequence
atgggtgacagcgacgatgagtatgatcgacggcgccgcgataaattcaggagagagaggtccgactacgatcgcagcagggaacgcgatgaacgccgccggggagacgactggaatgacagagagtgggacagaggacgtgaacggcgcagtaggggcgagtatcgggattacgaccgtaatcgcagggagcgatttagtccccctagacacgagctgtcacccccccagaagcgcatgcggcgggactgggacgaacactccagtgatccttaccacagtgggtacgagatgccatacgctggtggtggcggaggccccacgtacggtccaccccagccatggggccatcccgatgttcacattatgcagcaccacgtgttacctatccaagctcggttgggcagcatcgccgagatagacctgggggtcccgcctcccgtgatgaaaactttcaaagagttccttctaagcctggacgattccgtggacgagaccgaggccgtcaaacggtacaacgactacaaactcgattttagacggcagcagatgcaggacttttttcttgctcacaaagacgaggaatggtttcgcagtaaatatcaccctgatgaggtcggcaagagaaggcaggaggcacggggagcccttcagaatcgcctgcgggtgttcttgagtctgatggagactggctggtttgataatctgttactggacatcgataaggctgacgccatcgtaaagatgttagacgcagctgtaataaaaatggaaggaggtactgagaacgacctaagaattctggagcaggaagaggaggaagaacaggcgggcaagcccggtgaaccaagtaaaaaagaagagggtcgagccggcgcaggcctgggggacggtgagaggaaaaccaatgataaggacgaaaagaaggaagatggaaagcaagccgaaaacgactctagcaacgacgacaagacaaagaaatctgagggtgacggcgataaggaagagaagaaggaggatagtgagaaagaggccaagaagtcttcgaaaaagaggaatagaaaacactccggggacgacagcttcgacgagggaagcgtgtccgaatcagaatctgagagcgagagtggccaggcagaagaggagaaagaggaagctgaggccctcaaagagaaagagaaacccaaagaggaagaatgggagaaaccaaaagatgccgcgggcctcgaatgcaagccgaggcctcttcacaagacttgcagtctgtttatgcggaatatcgctcccaatatttcacgcgcggaaattatctccctgtgtaagcgctaccctggattcatgagggtggccctcagcgaacctcagcctgaacgccgtttctttcggcgcggttgggttacctttgacagatccgtgaacatcaaggaaatctgttggaatctgcagaatattcgcctgagggaatgcgagctctccccaggagtcaaccgggaccttactcggcgagtgcgcaatataaacggcatcacccagcacaagcagattgtacggaatgacattaagttagccgctaagctgattcacactctggacgatcgtacccagctgtgggcctcagaacccggcacaccccctctccctacatcattgccttcacagaaccctatcttgaagaatattactgattacctgatcgaagaggtgagcgctgaggaggaggagttactcgggagctcagggggcgcgccaccggaggaaccaccgaaggaaggcaacccagctgagatcaatgtcgagagagacgaaaagctcattaaagttctggataagctgttgttgtacctccggattgtgcacagtctggactactataatacatgcgaatatcccaacgaggatgagatgcctaacagatgtggaattattcatgtcagagggcccatgccccctaataggattagccatggtgaggtgctggaatggcagaaaacctttgaggaaaagctgacgccactgttgtcagttagggagagtctatctgaggaggaagcacagaagatgggccggaaagacccagaacaggaagtggaaaaatttgtgacctcaaatactcaggaactgggaaaggataagtggctgtgtcccttgagtggtaaaaagtttaagggcccagagttcgtccggaagcacatttttaacaaacacgcagaaaaaatcgaagaagtgaagaaggaggtggcctttttcaataatttcctgacagacgctaagagacctgccctcccagagatcaaacccgcgcagcctccaggcccggcccaaattctcccgcctggcttgactcctgggctcccatatccccaccagacaccccagggtttgatgccttacggccagcccagacctcctatcctggggtacggcgccggagcagtgcgccctgccgttccgaccgggggccctccgtacccccacgcaccctacggagctggccggggaaattatgacgcattccgaggtcagggaggataccctggcaagccccggaaccgtatggtgcggggtgacccacgtgccatcgtcgagtatcgcgacctagacgcaccagacgacgttgatttcttctag

SEQ ID NO: 15744 - DNA, 816 bp, Artificial Sequence
  Description of Artificial Sequence: Synthetic coding sequence
atggccgcagtggagaagaggcgccaggccgtcccacctcccgccggcttcaccgactctgggcggcagagcgtgtccagagccgcaggcgctgcagaaagcgaggaggactttcttcgccaagtaggcgtcaccgagatgcttcgcgctgcacttctgaaagtcctggaagcccgacccgaggaacccatagccttcttggctcattactttgaaaacatggggttgagatctcccgttaatggtggcgccggggaaccccctggccagttgctgcttcagcagcaacgcctgggacgggcgctctggcatctgcgcctggcccaccacagtcagcgcgccgccttcaacaacaatgtttccgtggcatacgagtgcttgagtgccggcggaaggcggaagcgaccaggactagacggtcgaacctactccgagctccttcgaagaatctgccgggacggtcaagcaccagaagaagtggtggcccccctgctccgtaaagtgcaatgtagagatcacgaagccgttccacttagcgtgtttagggccggaacactcacatgcttcgtactgctggagttcgtggcacgagctggagcccttttccagttgctcgaagatagcgcagccgccgtggcagatcgccgagttggtcaggccgtgttggacacactggagggtgcactacaggcctccgatgctgctgcccctgctaggttcctggaggcaggcagtcgcttggctcctatgaccagagaggaattcttggagcgcgccgccgcactctttatagcaaaggtgaagccggtcggatag

SEQ ID NO: 15745 - DNA, 1977 bp, Artificial Sequence
  Description of Artificial Sequence: Synthetic coding sequence
atgggagggcatttgagtccatggcctacctacacgagtggacagacaatcctgcagaaccgcaagccctgttctgacgactatcggaagagagtcggaagctgccaacaacatccctttcgcactgccaagccacagtacctagaagagcttgagaactatctacggaaagaactcctcctcctcgatcttggaacagactccacccaggagctgagattgcagccatacagagaaatttttgagttttttatcgaggacttcaaaacctataaacctctcctttcatcgatcaaaaatgcatatgagggcatgcttgcccaccagcgggaaaagatccgggcgctggaaccgttgaaagctaaactcgtgacagtcaatgaagattgtaatgaaaggatcttggctatgagagctgaagagaagtatgagatctctctgctgaagaaagagaaaatgaaccttctaaagttgatcgacaagaagaatgaagagaagataagtctccagtcagaagtaacaaagcttaggaagaacctcgccgaggaatacctgcattacctgagtgaaagagacgcctgtaagatccttatagctgacctaaacgagctgcggtaccagcgagaagatatgtccctggctcagagtcccggaatctggggcgaggatccagtgaagttaacattggcgctaaagatgacccggcaggatttaactcgcactcagatggaattaaataatatgaaagcgaatttcggcgacgtggtgcccaggagggactttgagatgcaggaaaagacaaataaagatctccaagagcaactggatacattacgcgccagctacgaggaggtacgcaaggagcatgagatcctcatgcagcttcatatgtccacgctgaaagaacgggaccagttcttcagcgaactgcaagaaatccagcggacttccacccctcgacccgattggacaaagtgcaaagacgttgtcgctggcgggccggagcgctggcagatgctcgcagaaggtaagaatagcgatcaactagtggacgtactgcttgaggaaatcggctcaggcctactcagggaaaaagattttttccccggcttaggatacggggaggccatacccgctttcttacggttcgatggactcgtcgagaacaaaaagccttccaaaaaagacgtggtcaacctgctcaaggatgcgtggaaggaacggctggctgaggagcagaaggagacatttcctgatttcttctttaattttctcgagcaccgattcggaccctccgatgcaatggcttgggcgtacaccatcttcgagaacattaaaatcttccactccaacgaagtcatgagtcagttctacgcggtgctaatgggtaaaagaagcgagaacgtatacgtcactcaaaaggagacggtagcccaactgttaaaggagatgactaacgctgattcacagaacgaagggctcttgactatggagcaattcaacaccgttttaaaatccacttttccattaaagacggaggaacagatccaggagttgatggaggccggaggttggcatccctcgtcctccaatgccgatctgttgaactatcggtcactctttatggaggacgaggagggccagagcgagccctttgtgcagaagctctgggaacagtacatggatgaaaaagacgagtatctgcagcagctgaaacaggagctggggatagaattacacgaggaggtcacattgcccaagctgcgcgggggattgatgacaatcgacccaagtttagacaagcagacagtcaatacttatatgtcccaagcgttccagctgcctgaatccgaaatgccagaggaaggcgatgagaaggaggaagcagtggttgagatactgcaaacggcattggaaagactccaggttatcgacattagaagggtcggacccagggaacccgagcccgcctcttag

SEQ ID NO: 15746 - DNA, 1287 bp, Artificial Sequence
  Description of Artificial Sequence: Synthetic coding sequence
atggagccactgaaggtcgagaagtttgctacagccaaaaggggaaacggactacgggcagtcactccattgcgacccggtgagctcttgttccggtctgatcccctcgcctataccgtctgtaagggatcccggggggtcgtgtgcgacaggtgccttctggggaaggaaaagttgatgcggtgcagtcagtgccgcgttgccaagtattgttctgccaaatgtcagaaaaaggcctggcctgaccacaagcgagaatgtaaatgtttgaagtcctgcaaaccccgctatccaccggactccgttcgactgctcggacgggtagtgttcaagctcatggatggcgccccttcagagagcgagaagctatattctttctacgaccttgagagcaacattaataaacttacagaggacaaaaaagagggccttcggcagctggtgatgacttttcagcactttatgcgcgaggagatccaagacgcctcccagttgccgcccgcgttcgatctattcgaagcgttcgcgaaagtaatctgtaacagcttcaccatttgcaatgcggagatgcaggaagtcggcgtgggactttatcccagtatttccctgttgaatcatagctgtgatcctaactgctctatcgtgtttaacggaccccatttactgctcagagcagttcgcgacatagaggtgggtgaggagctgactatctgttacctggatatgctaatgacctccgaggagaggcgcaaacagcttcgggatcaatattgcttcgaatgtgactgcttcagatgccaaactcaagacaaagatgccgacatgctcacaggggacgagcaggtctggaaggaagttcaggagagcctgaagaaaatcgaggaattgaaagcccactggaagtgggagcaggtgctcgcaatgtgccaggccatcatcagcagtaactctgaacgcttacctgacattaatatctaccaactcaaagttctggactgcgcgatggacgcatgcatcaaccttgggctgctcgaagaggcccttttctatgggaccagaaccatggagccctaccgcatattttttcctggttctcacccggtgagaggagtacaagtgatgaaggtgggaaaacttcaactccaccaaggtatgttcccgcaggcaatgaaaaatttgcgtctggctttcgacattatgcgtgtgacccatggcagagaacacagcctgatagaggatttgattttgctcttggaagaatgcgatgccaacatcagagcgagctag

SEQ ID NO: 15747 - DNA, 1122 bp, Artificial Sequence
  Description of Artificial Sequence: Synthetic coding sequence
atgtcaagcgggaactatcaacagtcggaggcactttcgaagcccactttctctgaggaacaggcatctgctttggtggaatccgtgtttggcctaaaagtgtcaaaggtgcgtccactgccttcctacgatgaccagaattttcacgtgtatgtgtcgaagacgaaggacggaccaactgaatatgtgctgaagatttcaaacaccaaggcctcaaaaaaccccgatctcattgaagtacagaaccacatcattatgttcctgaaagctgctgggttccccactgcaagcgtatgtcacaccaaaggagacaacacagctagcctggtcagcgtagattctggatccgaaataaagagttatcttgttcgactgctgacatacctgccaggtcgcccaatcgcagagcttcctgtttcaccgcagctactgtacgaaatcgggaagctggctgccaagttggataaaacgctccagcggttccatcaccctaagctgtccagcttgcaccgcgagaactttatttggaatctgaagaacgtcccccttcttgaaaagtatctgtacgcccttggccagaacaggaacagggaaatcgtagaacatgtcattcatctgtttaaggaagaagtgatgacaaaactttcccacttcagggagtgcatcaatcacggcgatctgaatgaccacaatattttgatcgaatcctcgaaaagtgcatcaggaaacgccgaatatcaagtttccggaatcttagatttcggggatatgtcctacggatactatgttttcgaagttgctatcacgatcatgtacatgatgattgaaagcaaaagtccaatccaggtcggtgggcatgtccttgctggctttgagtcgatcacaccccttactgccgtagaaaagggtgcccttttcctgctcgtctgtagcagattttgtcaaagcttggtgatggccgcctatagctgccagctgtacccggaaaacaaggattacctgatggtcactgcaaagacagggtggaagcacctccaacagatgtttgatatggggcagaaagccgtcgaggaaatttggttcgagactgcaaaatcctatgagagcggcataagcatgtag

SEQ ID NO: 15748 - DNA, 2766 bp, Artificial Sequence
  Description of Artificial Sequence: Synthetic coding sequence
atggcactgctgtgcggactggggcaggtgactctcaggatctgggtaagcttgccctctcagagcgagaacgggatcgggtccggtggaatggaggcattgaccacccagctcggccctggccgcgaagggtctagcagcccgaatagcaagcaggagcttcagccatatagcggctcttccgcgctgaagcctaaccaggtgggagagacctctttatatggagttcctattgtcagcttggtcatcgacggacaggaaaggctatgcctggctcaaattagcaacacgctgttgaaaaattatagctataatgagatccacaatagaagagtagcgctgggcattacatgcgtccaatgcaccccagtgcaactggaaatcctgaggagggctggagccatgccaatctcttctagacggtgcggcatgattacaaagagagaagccgagcggctctgcaagagctttctgggggaacacaaaccccccaagctgccggagaactttgcattcgacgtcgttcatgagtgtgcttggggaagtagagggtcattcattcccgctagatacaacagctcacgggcaaagtgtataaaatgcggttactgcagtatgtacttttctcctaataagtttatcttccacagtcatcggacgccagacgcaaaatacactcagccagatgctgctaatttcaacagctggcgcagacatttgaagttgtccgacaaaagcgctaccgacgagctgtcccatgcgtgggaggacgtcaaagctatgttcaatggaggaacgagatgcggagccgaaatggcccctggacctcccccccataaatcccttaggtgcggcgaggacgaagccgcaggaccccctggcccacctcctccccacccccagcggggtctgggcctggccactggcgcctctggaccggccggcccaggtggtcctggaggcggggccggggtacggagctaccccgtgatacctgtaccaagcaaggggtttggactgctccagaaactgccaccacccctctttcctcacccgtacggtttcccaaccgccttcgggctatgccctaagaaagacgatcctgtccttggagccggcgagccaaaggggggcccaggaaccggcagcggtggaggaggggctggtacaggagggggtgcaggagggcccggggccagtcatctccctccaggcgccggggccggacctgggggaggtgcaatgttctggggacatcagcccagcggggccgccaaggacgccgcggccgtggcagccgccgcagctgctgccacagtgtaccctacttttccaatgttctggccagcagctgggtccctgccagtgccatcctaccccgcggctcagtctcaggcaaaagccgtggccgctgcagtggccgctgccgcggcggccgcggccgcagctgccggtagtggagcccccgaacccctggatggagctgagcctgcgaaggaatccggcctcggagctgaggaaagatgcccgagcgccctgagtcgtgggcctctggatgaggatggcactgatgaagctctgccccctcccctggcgcctctaccccccccgcctccccccccggcccgcaaaggcagttatgtcagcgcttttcggcccgtcgtgaaggacactgagtctatcgccaagctgtacggtagcgcacgcgaggcatacggggcgggccctgcaagagggcccgggcctggagctggctctgggggttacgtcagccccgatttcttaagtgaaggatcctcatcttacaactccgcttcgcccgatgtggacaccgctgacgaacctgaagtggatgttgagtcaaaccggttccccgatgatgaagacgcacaagaagagactgaaccctccgctccctcagccggggggggccccgacggcgagcaaccgactgggccaccctcagcaacctcatcgggagctgatggtccggccaacagtcctgacggcggtagtccccgccctagaaggaggttggggcccccacctgccggccgaccagcttttggggacctcgcagccgaggacctagtcaggcgccccgaaagatcccctccttcaggaggcggtgggtatgaacttagagaaccttgcggaccccttgggggaccagcccccgcgaaggtctttgcgcctgagcgcgacgaacacgtgaagagcgccgctgtggcgttgggaccagctgcaagctacgtctgtactcccgaggcccatgagcccgacaaggaagataatcactccccagccgatgatctggagactcgcaagtcatacccagatcaacgatcgatctctcagccttccccagccaatacagataggggtgaggatgggcttaccctcgatgtgaccggtacccacctggtagagaaggacatcgagaacctagcccgagaggaactacagaagctcctactggaacaaatggagttgcgcaaaaagctggaaagagaatttcagtcactgaaggataattttcaggatcaaatgaagcgcgagctggcctatagagaagagatggtgcagcagttgcagattgtaagagacaccttgtgtaatgaattagatcaagagcggaaagcaagatatgcgattcagcaaaagttaaaggaggcgcatgatgctctgcatcacttctcttgcaaaatgttgactcctaggcactgtacaggcaactgctctttcaagccaccgctgctgccgtag

SEQ ID NO: 15749 - DNA, 1395 bp, Artificial Sequence
  Description of Artificial Sequence: Synthetic coding sequence
atggcgatgacggcaggcacaacaacaacgtttccaatgagcaatcacacccgagagcgcgtgaccgttgctaaacttacactggaaaacttctactctaacctgatcttgcagcatgaggaaagggagacacggcagaagaagctggaggtagccatggaagaggaagggctcgctgacgaggagaagaaactgcgccgatcacagcacgctaggaaggagaccgagtttctcaggctgaagaggacccggttgggcctcgatgattttgaaagcctgaaagtaataggacgaggagcctttggtgaagttcgactggtccaaaaaaaagacaccggccatatttacgccatgaagattctgcgtaagtcagatatgttggagaaagagcaggtcgcacacatccgcgcagagcgtgatatcctggttgaggccgatggggcatgggtagtgaagatgttttattcctttcaggataagagaaacctctacctgatcatggaattcctcccgggaggcgacatgatgacattgcttatgaagaaggacactctcaccgaggaggaaacgcagttctatatcagcgagacagtgctggccatcgacgcgatccaccagctcggctttattcaccgagacataaaacctgataacttacttctcgacgctaagggtcacgttaagctgagcgatttcggactttgcaccgggctgaagaaggcccataggacggaattctatcggaatctgacacacaaccccccctccgatttctccttccagaacatgaactcaaagaggaaggccgagacctggaagaaaaaccgcaggcagcttgcttactcaacagtgggaactcccgactatatagcccccgaggttttcatgcagaccgggtacaataaattatgcgattggtggtcacttggagtgataatgtacgagatgttgattggctaccctccattctgcagtgaaacaccccaggagacatatagaaaggttatgaattggaaagaaactctggtgttccccccagaagtgcccatctctgaaaaggcgaaggacctgatcctcaggttttgcatagattctgaaaatcggatcgggaattccggtgtagaggaaatcaaaggacatccctttttcgaaggggtggattgggagcacattagggagaggccagcagctattcctattgagataaagtcaatagacgacacttccaacttcgacgatttccccgagtccgacatactgcaaccggtgcctaatacaaccgagcccgattataagagtaaggactgggtgttcctcaactatacgtataagcgctttgagggcttaacccagagagggtccattcccacatacatgaaagccggtaagctctag

SEQ ID NO: 15750 - DNA, 3951 bp, Artificial Sequence
  Description of Artificial Sequence: Synthetic coding sequence
atggcaagcaagggagccggcatgtctttctctagaaagtcctatcgacttacgtctgacgcagaaaaaagcagagtgacaggaattgttcaggaaaagttgctcaatgactatcttaacaggatcttctctagttctgaacatgcccctcctgcagccacttcgcgcaaacccctgaatttccaaaatttgccagaacatcttgatcaactgctccaggtcgataacgaagaagaagagagccagggacaggtggagggccgattaggtccttctactgtcgtacttgatcataccgggggatttgaggggcttctccttgtggatgacgatctgctgggtgtgatcggccatagtaacttcggcacaattaggagtactacttgcgtgtataaaggtaagtggctgtacgaggtgctcatctccagtcaagggctgatgcagattggctggtgcaccatctcctgtcggtttaatcaggaagagggagttggtgatactcacaattcttacgcatatgacggcaaccgcgtgcgcaagtggaacgtcacaacgaccaactatggtaaagcttgggctgcaggcgatatagtttcctgcctgatagacctagacgacggaactctttcgttctgcctcaacggggtgagcttggggactgcttttgagaacctaagcagagggctgggaatggcctacttccccgcaatctccctgtcatttaaagaatccgtggccttcaattttggctcacggccactccgatacccagtggcaggttaccggccgctgcaagaccccccaagtgccgacttagttagagcccagcgcttgctgggatgctttcgggctgttctgagcgtcgaactcgatccggttgagggccgcctgcttgacaaggagtcttctaaatggcgcttgaggggacaaccgacagtgctcctaaccctggcgcacatctttcaccattttgctcccttgctccgaaaggtatatctggtagaggccgttctgatgagcttcctactgggcatcgtagagaaggggacccccacacaggcccagagtgtcgttcaccaggtcctcgatctgctgtggctgtttatggaggactatgaagtgcaagactgtctcaaacagcttatgatgtcgctcctgagactttacagattttctcctatcgtgccagacctcggtctacagattcactaccttagacttacaatagctattttgcgacatgaaaagtctcggaagttcttgctatccaacgttctgttcgacgtgcttcggtctgtagtttttttctacatcaagagcccgttgcgagtagaagaagctggcttgcaggagttgattcccacaacctggtggccccattgtagcagcagggagggtaaggagtctacagagatgaaagaggagaccgccgaagagcgcttacgacggagggcatacgagcgcgggtgccagcgcctgcgcaagagaattgaagttgtcgaagaacttcaggtccagatcctgaagctgttgctggacaacaaggacgataatggcggcgaggcatcgagatacatctttttgactaagttccgcaagtttctgcaggagaacgcttccggacggggcaatatgcctatgttgtgcccccctgagtatatggtgtgttttctacatcggctaataagcgccttacggtattactgggatgagtataaagcaagcaatccgcatgcctccttttcagaggaggcgtatatccctccccaggttttttacaatggcaaggtggactactttgatctccagcgactcggggggctgctctcacatcttcgaaaaacactgaaagatgaccttgcatctaaagccaacatcgttattgacccactcgagctgcagtcaacggcaatggacgatctggatgaagacgaggaacccgcccctgccatggcacagcgcccgatgcaggccttggccgtgggcggcccactgcccttgcccagaccaggctggctgtcttctcccaccctgggacgggccaatcgctttttgtcgacggccgccgtgtctctgatgacacctaggaggcctctgtcaacttccgaaaaggttaaagtgcgaaccctgagcgtggaacagcgtaccagggaggacatagaagggagtcactggaacgaggggctgttgctcgggaggccacctgaggagccagagcagccgctgaccgaaaactccttacttgaagtgttggatggcgctgtgatgatgtacaatttatcggttcatcagcagctggggaagatggtgggggtgtccgatgatgtgaacgaatacgctatggcccttagagatactgaagataaattaagacgctgccctaagagacggaaggacattctagctgagctgactaagagtcagaaggtcttctctgagaaattggaccacctgtcgagaaggcttgcttgggttcatgccactgtctactcgcaagagaagatgttagacatttattggcttctgcgggtctgcctgcgcacgatagagcatggggacaggaccggcagtttgttcgctttcatgccggagttctacctgagcgtagccatcaactcttacagcgccctgaaaaattactttggccccgtgcactcaatggaggaactcccaggatacgaagagaccctgacacgcctggctgctatcctggctaagcattttgccgacgcgagaattgtggggacagacatccgcgacagtcttatgcaggcacttgctagctatgtctgctatccccactccctacgtgccgtcgaacggatcccagaggagcagcgcattgctatggtacgcaaccttctcgctccttatgaacagagaccgtgggcacaaacgaactggatactcgtgcgcctatggcggggctgtggtttcgggtacagatatacccggttaccccaccttttaaagaccaagcttgaggatgccaatttgccctccctgcagaagccctgtcccagtaccctgttacaacagcatatggctgaccttctgcaacaggggcccgatgtcgccccttccttcctgaactcggtcctcaatcaactgaattgggcgttttcagaatttattggcatgattcaggagattcagcaggcagccgaaagactcgaacgcaactttgtcgattcaaggcagttgaaggtctgtgccacctgtttcgatctatccgtgagcttgctccgggtgctcgaaatgaccatcactctagtgccagagattttcctggactggacacgccctacatcggagatgctgttacggcgtctggcccaactcctcaaccaggtgctgaatcgagtgacagcagagcgaaatctgtttgacagggtcgttactttgagacttcctggattggagagtgtggatcactaccccattctagtagctgtgacgggcatcctggtccaactgctggtgaggggacctgcctccgaaagggaacaggctacctccgtattgctggctgacccttgcttccagttaaggtccatttgctacctcctagggcagcctgagcctcccgcgccaggtaccgcgctgcccgctccagatcggaaacgatttagcctgcagtcttacgccgattacataagcgctgatgagctcgctcaggtggaacaaatgctagctcatttaacctcggcttcagcacaggctgccgcggcatcactgccaacctccgaagaagacctttgccccatctgctacgctcatcccatcagtgccgtctttcagccatgcgggcacaaaagttgtaaggcctgtatcaaccaacacctgatgaataataaggattgctttttttgcaaaaccaccacaagtaacctcctggcctgtttgtacccgcattggtgggaaccttctcacggccccaactgcgcttag

SEQ ID NO: 15751 - DNA, 2043 bp, Artificial Sequence
  Description of Artificial Sequence: Synthetic coding sequence
atgcccagtgtcagcaaggccgccgccgcagccctgagcggcagtcccccgcaaacagagaaacccactcattatcgctatctcaaggaatttagaactgaacagtgcccgttattctcccaacacaaatgtgcccaacaccggccctttacttgttttcattggcatttcctgaaccaaagaagaagaaggcccctgcgccggcgtgatggcaccttcaactactcacccgatgtgtactgctccaaatacaatgaagccaccggggtgtgtccggacggggatgaatgcccctacctacaccggaccaccggggatactgagcgcaagtaccacttgcgatactacaaaaccggtacctgcattcacgaaactgacgcacggggccattgcgtgaagaacggcctgcactgcgccttcgcccacggaccactggatctgcgccctcccgtgtgcgacgttagggagctccaggcccaagaagcactgcagaacggacagctgggggggggtgagggagtgcccgatctccagcccggggtgctcgccagtcaggccatgattgaaaagattctcagtgaggatccaagatggcaagatgcaaacttcgtgctgggctcctacaaaacagaacagtgcccgaagcccccacgtttatgcaggcaaggatacgcttgcccacattatcataatagtagagataggcgccgcaaccctcgaaggttccagtatcggtccactccgtgccctagtgtcaaacacggcgatgagtggggagaacctagccgatgcgatgggggcgacggctgccagtactgccactccaggaccgagcaacaattccatcctgaatctactaagtgtaatgatatgcgacagacaggatactgcccaaggggccccttttgcgcctttgcccacgtggagaaatcgctcgggatggtcaatgaatggggctgccatgacctgcatctgacatcaccttcatctactggatcaggacagccgggcaatgccaaacgtcgcgattctcccgcggaggggggccctcggggaagcgagcaggatagtaagcagaatcatctcgccgtattcgccgccgttcacccgccagccccctctgtctccagcagcgtggcatcttcacttgcatcgtctgcaggatctggatcctctagcccaaccgccctcccagccccgcccgctagggcactccctctggggcctgcgtcctccaccgtcgaggccgtcctcggttccgccttagatcttcacctctccaatgtgaacattgcctcattggagaaggatctggaggaacaggatgggcatgacctaggcgctgccggcccacgtagcctggctggcagtgctccagttgccataccaggctccctgccccgggccccctccctgcacagtccaagtagcgcctcaacctcgcccctaggcagtctgtctcagccccttcctggaccggttgggtccagcgcaatgacacccccacagcaaccccctccactccgcagcgagcctggcacactcggctccgccgcctcgtcctactctcctctggggttgaatggagtgccaggctcaatttgggactttgtgtccggctccttttctcccagtccttctcccatcctgagcgccggtccaccctcatctagctccgcttctccaaacggggcagagctagctcgggtgaggcgtcagctcgacgaggctaagagaaaaattaggcagtgggaggagtcctggcaacaagtaaaacaggtgtgcgatgcatggcagcgtgaagcccaggaggcaaaagaacgagctagggtcgctgacagcgaccgacagctggctctgcaaaagaaagaggaagtcgaagctcaggtgattttccagttgagagccaagcagtgcgtcgcctgccgagaaagggcccacggtgctgtcctgcggccgtgtcaacatcatatactttgtgagccttgtgccgcaaccgcccctgagtgtccttattgtaaaggacagccactgcagtggtag

SEQ ID NO: 15752 - DNA, 462 bp, Artificial Sequence
  Description of Artificial Sequence: Synthetic coding sequence
atgagctcgccccttgccagcctctccaagacccgcaaggtacccttgccaagcgagccaatgaacccaggaaggagaggtatacggatctacggggatgttccagcctcacacgattcagagctgatggcttttatgacaaggaagctgtgggacctcgagcagcaggtcaaggctcagaccgacgagatcctttccaaagaccagaaaatcgccgccctggaggatctcgtgcagaccctgagacctcaccctgctgaggcaactctgcaacgacaggaggaactggaaaccatgtgcgttcagctgcaaaggcaagtcagagaaatggaacgctttctgtctgactatggccttcagtgggtgggggaaccgatggatcaagaagacagtgaatctaagacagttagtgaacacggggaacgggactggatgaccgctaagaaattttggaaaccatag

SEQ ID NO: 15753 - DNA, 2382 bp, Artificial Sequence
  Description of Artificial Sequence: Synthetic coding sequence
atgggtcaatgctataacctggaggacgacgacttggagactgatgtcaacaaacttagctcaaagcccggcctcgacaggccagaagaggagctgatgcagtacgaagtcatgtgtttggagctgtcttactcgtttgaagaattgcagagtaagttaggcgacgacctaaacagcgagaagacacagtacgcaaatcatcaccatattcccgcggctgccagcagcaagcagcactgctatagcaaggaccaatcatcatgcggccaggagagggaatatgctgtccaaacaagtctgttatgcagggtgaagacgggaaggtccaccgtgcatctcggaagtaagaaaaatccaggagtgaatctttaccagaacgtgcagagcaactctctgcgaagagactcttcagaaagcgagattcccgacatccaggcaagcccaaaggcagatgcctgggatgtagatgcgatcttttgtccccgaatgagtgcaagttttagcaatagcactagaactagggaggtagttaaagtcatagacaaactgctgcagactcacctgaagcgagttcctttccatgacccctatctctacatggctaaggctcggaggacctcttcggttgtagacttcaagatgatggcattccccgatgtttggggacactgtcctccgccaaccacccagccaatgctggagaggaagtgcggagttcagaggatcaggatatttgaggatatcagaaggctcatccagcctagcgacgtaatcaacaaagtagtgttttcactcgacgagccctggcctctgcaggacaacgcctctaactgtttacggtttttctcaaagtttgaatcgggtaatctgcggaaagctatccaggtgcgcgaattcgaatatgacctactggtgaacgctgatgttaattcgacgcagcatcagcaatggttttactttaaggtttctgggatgcaagccgccattccctatcattttaatatcatcaactgcgaaaaacctaactcgcagttcaattatggaatgcagcctactctgtacagtgtgaaggaggccctgcttggcaaacctacctggatccggaccggccatgagatttgctactataagaaccactatcggcagagcacggcagtggcaggtggagcttccggcaagtgttactacacacttacattcgccgtgacatttcctcatagtgaagacgtctgctacctggcttaccactacccgtacacctatactgcattaatgacgcacttagacatactggagaaaagcgtgaacttgaaagaagtttacttccggcaagacgttctttgccagaccctcggggggaacccctgtccacttgtgacaataaccgcaatgcctgagagcaattccgatgaacatctggaacagttccgtcatcggccgtaccaagtcattacagcccgtgtgcatccaggagaatccaatgcgtcatgggttatgaagggaactttggagttcctggtttcaagcgatcctgttgcacgattgctccgcgaaaacttcatttttaagattatacccatgctgaacccagatggggtcatcaacggcaaccaccgatgctctttatcaggggaagacctgaacagacagtggttaagcccttctgctcaccttcagcccacaatttaccacgccaagggacttctgtaccacctctccagcatcggacgcagccctgtggtcttctgtgacttccacggccattcacagaagaaaaatgttttcttatacggctgcagtattaaggaaaccctgtggcaggctgcctgcacagtgggaacctccacaatattggaagaagtaaactacagaactctgcctaaaattctggataaactagccccggcattcaccatgtccagttgtagctttctggtcgagaagtctcgcgcctcgaccgcgcgggtggtggtctggcgcgaaatgggcgtgtcgcggtcatacacaatggaaagtagctattgtggctgcaaccagggcccttaccagtgcacacaaaggctattggagaggacaaaaaatgagcgggcccacccagtcgatgggctgcagggactgcagtttggcacgagggagttagaagagatgggagctatgttctgccttggactgctcatccttgagctgaaatctgcaagctgttctcaccagctcctggctcaagctgcaacactgctgagcgcggaggaagatgccctggatcagcaccttcaaagactgaagtcttccaatttcctgcctaagcatatttggtttgcttatcacttttttgcaatcactaactttttcaagatgaatctgctcttgcacgtgagtccatag

SEQ ID NO: 15754 - DNA, 153 bp, Artificial Sequence
  Description of Artificial Sequence: Synthetic coding sequence
atgatgcagaacgtccacctggcaccggagaccgacgaagacgatctttacagcggttacaatgattataatccaatttacgatattgaggaactggagaatgacgccgccttccagcaggccgtccgaacttcacacgggaggcgcccgtag

SEQ ID NO: 15755 - DNA, 1299 bp, Artificial Sequence
  Description of Artificial Sequence: Synthetic coding sequence
atgaccgcagtccgggcagcaggttttactaaggccgcactccgtggctctgcattcgatcctctttctcagtcacgaggcccggcttctcccctggaggcaaagaaaaaagatagtccagaggagaagataaaacagttggaaaaggaagttaacgagctcgtagaggaatcttgtatcgccaacagctgcggagaccttaagctggctcttgagaaagcaaaagacgctggcaggaaagaaagggttctcgtgaggcagcgagaacaggtcaccactccggagaatataaatctcgacctcacgtactctgtgcttttcaatttggcctcacagtattccgtgaacgagatgtacgccgaagcgcttaatacataccaagtgattgtgaagaataaaatgttttcaaatgctggcattctcaaaatgaacatggggaacatttaccttaaacagagaaattatagcaaggccattaagttttaccgaatggcgctagatcaggtgcccagcgtgaacaagcagatgcgcatcaagattatgcaaaacatcggtgttacattcattcaggccgatagggagaaaatgaagaaagctttccagaagctgattactgtccctttagagatagacgaggataagtacatatcccccagtgacgatccccatacaaatttagtaaccgaagctataaagaacgaccatctgagacagatggaaagagagagaaaagccatggcagagaagtacatcatgacctcagcgaaacttatagcccccgtgattgagacttcatttgccgcgggatatgactggtgcgtggaagtagtgaaggcctcccagtatgtggaactggccaatgacctggaaattaacaaagcagttacctacctccgtcagaaagattataatcaagcagtagagattttgaaggtgctggaaaaaaaggatagtcgcgtgaagagcgccgccgctactaatctcagcgctctctattacatggggaaggattttgcccaggctagttcatacgcagacatcgcagtgaattctgatcggtacaatccagccgccttgaccaataagggcaatacagtattcgcaaatggcgattacgagaaggctgcggagttttataaggaagccttgagaaatgattcatcctgcacagaggccctgtacaatatcgggctgacatacgagaaactgaatagacttgatgaagcgctagattgctttctgaaactgcatgccatcctgagaaacagtgcggaggtattatatcaaatagctaactag

SEQ ID NO: 15756 - DNA, 387 bp, Artificial Sequence
  Description of Artificial Sequence: Synthetic coding sequence
atggccgccgcagcagctgagcagcagcagttctatctgctcttgggaaatctcctaagtccggacaatgtagtgagaaaacaggctgaggcacgccaaatggccgctgttcttctacgcaggcttctgagttcggcatttgacgaggtgtaccccgccctgccatcggacgtgcagacggctattaagtccgagttgctgatgatcatccaaatggagactcagagcagcatgaggaagaaagtatgcgacattgcggccgagctcgcgcggaacctcatcgacgaggatgggaacaaccagtggccagagggtctgaaattcctttttgactcagtttcctctcaaaatgttgggttacgggaggccgcgctccacatcttctag

SEQ ID NO: 15757 - DNA, 2766 bp, Artificial Sequence
  Description of Artificial Sequence: Synthetic coding sequence
atgagacctgagggtgctggaatggaacttggcgggggggaggagaggctcccagaggagagtagacgggaacattggcaactgcttggaaacctaaagacaacagtagagggacttgtgtcgacaaactctcctaacgtttggtctaaatacggaggactggagcgcttgtgtcgtgatatgcaatctatcctatatcatgggttaattagggatcaagcatgcaggcgccagaccgattattggcagttcgtcaaggacattagatggctcagtccccacagtgcactccacgtggaaaagttcatttccgttcatgaaaatgaccagagctcagctgacggcgctagcgagcgggctgtggccgaactctggttacagcattcattgcagtaccactgtctcagcgcacagctgaggccccttctgggcgaccggcagtacatccgcaagttttataccgatgcggcatttctgttaagtgatgcccacgttactgctatgttacagtgcctggaagccgtggaacagaacaatcccagactccttgcccaaattgacgctagcatgttcgccaggaagcatgaaagccctctattagtgaccaaatcccagtccctgaccgctctcccaagttccacatatacgcctccaaatagctatgcccagcactcttattttggatcattcagctccctgcaccagtcagtacctaacaatggcagcgaacgcagatcaacctctttcccgttaagcggcccaccaaggaaaccccaggagtcacggggtcatgtctcacctgctgaagatcagacaatccaggcccctcctgtcagtgtgtctgctcttgcgagggactcaccactaacaccgaacgaaatgtcctcttcaacattgacctcacccatagaggcttcctgggtgtcgtcgcagaatgattcgcccggagatgcctcagaggggccagaatatctggctatcggtaatttggatcctcgcggtcgcacggcctcttgccaatctcattcatccaatgcggaatcttcctcttccaacctgttttccagttcttcatctcaaaagccggatagcgctgccagctctctgggggatcaggaaggtggaggggaaagccagttgtcctcagtgttaaggagatcttctttttctgaaggccagaccctcacagttacaagtggggccaagaagtcccacattagatctcattcagacacctcaatagcctctcgcggggcccctgagtcatgcaatgacaaggcaaaactgcgcggccccctgccatacagtggacaatccagcgaagttagcaccccctcgagtctttatatggagtacgagggaggacgctacttgtgctcaggcgagggcatgttccgaagaccttccgaaggacagtctctgattagctacctgagcgagcaggatttcggtagctgcgctgatctcgaaaaagagaatgctcatttctccatatccgaaagcctaattgctgctatcgaactcatgaagtgcaatatgatgtcacagtgcttggaggaggaagaagttgaggaggaggatagcgatcgggagattcaagagctcaaacagaaaattaggctgcgtagacaacagatcaggaccaagaaccttctcccaatgtatcaggaggctgagcacggttccttccgtgtaacgtcctcgtcctcacagtttagttcaagagacagcgctcagctgtcggacagcggatcagccgacgaggtagacgagtttgagatccaggacggaagcgagggctcaaatttgacacacatctcaaaaaatggcttatcagtaagccttgccagcatgttttcagacgccgacatccgcaggaacactgcttcctcctccaaatctttcgtgtcgtcccagagcttttcacactgttttctgcatagcacttccgcagaggccgttgctatgggccttttgaaacagttcgaaggaatgcaactgcctgccgcttcagagctggaatggcttgttcctgagcacgacgcgccacagaaattgctgcctatccctgacagcctcccaatttcaccagacgacggtcaacacgcagatatctataagctgcgcatcagggtaagagggaacctggagtgggcaccgccaaggccgcaaatcatcttcaatgtgcatccagcgcccacacggaagattgccgtcgctaagcagaactatcggtgcgccgggtgcgggatccgaaccgatccggactacattaagagactgcgatattgtgagtacctgggtaagtacttttgccagtgttgtcacgagaatgctcagatggccataccctctagggtcttaagaaagtgggactttagcaaatattatgtgtcaaatttcagtaaggaccttctgatcaaaatatggaatgacccgttatttaacgtccaggacattaacagtgctctgtacagaaaagtgaagcttttaaaccaggtgcgcttgctgcgggtgcaactatgtcatatgaagaatatgtttaaaacatgtcgtcttgcaaaggaattgttggattctttcgatacagttcccggccacctcaccgaggacttgcacctctactctctgaacgaccttactgcaactcggaaaggagaacttgggccccgactcgccgagcttaccagggccggcgctacccacgtagagcggtgtatggtgcgcaaaagccactgctcgatgcaactttcgccgtgcttttag

SEQ ID NO: 15758 - DNA, 1644 bp, Artificial Sequence
  Description of Artificial Sequence: Synthetic coding sequence
atgagagccctgacagtgcagcgggtgaaatttgccatggacttaccactgctcaagcgcgccggacaggatctggctgagaaaaccaagaattttgttagccggtcactcgttatcggcgaggtactgtcaatggccgacatggctaccggcgtgaagtgcggcatcatctactggctattcggcggtgccatccgcaatcttggctcccccgaacacgtgaccaagtggttccaaccccttcaggaacagaaatatacggggatgtttgctatgaccgagcggggtcatggatccaacgcgcgcggtattcaaacagaggccacctttgatttgagcgcccaagagtttgtcatagatacaccctgtgagaacgccgagaaaatgtacatcggcaacgcgatgtacggaaactacgcggccgtctttgcccagctcataatcgatgggaggtctcagggaccccattgttttatcgtcccagtccgggatgaaaacgggtcactctaccccggtgtcacggccatcgacatgatgtataaggaaggtctgcatggagttgataacgggattctgatatttgacaaagttcgaattccacgcgaaaacctgctggataagtttgggagcgtggcccctgatggacagtaccactccccaatcaggaataagtctgcaaggtttaatgcaatgttggccgcactaacaccgagtaggcttgccgtggccttccaggctatgggggcaatgaagctcggcctgactattgctatcaggtacagccacagtcgcaggcaatttggcccaaagaccaaagaagaggtgaaaattattgaacatcaaacccaaaccctgcgtctgatgcctcatttagccaccgccctggcccttacctttgtgtcacgttacgcaggcgccttgctggacgaggatgtgttccagggaaaagaactggttaacagccggtctcttcaggcgcttgtggccggccttaaagcgtacagcacatgggagaacattcgctgtctacaggattgcagagagtgcaccggagggatgggctatatgatggagaacaggatcagtggccttaagtgtgataccgatgtctttgcaactttcgagggggatgatgtcgtgatgcttcaggttgttggaagggagctgctcgcacagtacaccaaacagtatgaggagaaaccattgttcgggctgctgcaaaattgggcggagagcgttggcgacaaactccgaacatcttttctggccttcaatatggataccgtagatgacctggccttcctcctgaaagccgttaagtttagggagagggtattacagagggggcttgtagccagaatctattataaagtgaaaaccaaaaaagaagatttcttccacgcttggaacagctgccttcaccatgtggccagtctgagtttggctcacacccacagggtaactctcgaacagtttagtttagcggtgaaatcttgcccagatcaagaagatcagacactcctgatgaagttttgtcttctctatggaactaaactggtgttccaggaacgcgcttggtatctcgaacacaagtacttaacccctatggcatcaacaaggatccgtaaccaggagagatgttag

SEQ ID NO: 15759 - DNA, 6087 bp, Artificial Sequence
  Description of Artificial Sequence: Synthetic coding sequence
atggatgtaaccgtgtccgaactcctggaactgttcctgcaatcccccttggttacatgggttaaaacctttggaccctttggcagtggtagccaggacaacctgacaatgtacatggacctggtggatggcatttttctgaatcagatcatgctgcagattgatcccaggcccacaaatcagcgaattaacaagcatgtgaataatgacgtcaacctgcgaattcaaaacttgaccatactggtaagaaacatcaaaacttactatcaggaagtgttgcagcagctcattgtgatgaacttgccaaacgtgctaatgatcgggcgagacccgttaagtggcaagtcaatggaagaaatcaaaaaggttttactgcttgtgttaggatgtgccgttcagtgtgaaaggaaagaggagttcattgaaagaattaaacaactggatatcgagacacaggcaggtatagttgctcacattcaggaagtcacccacaatcaggaaaatgttttcgatcttcagtggctggagctccctgatgtggccccagaggagctggaggccttgtcccggtccatggtgttgcacttaaggaggctaatagaccaaagagacgaatgtaccgagcttattgttgatttaacgcaggaaagggattatctgcaggctcaacatcctcctagcccaatcaaaagttcctccgccgactcaacaccgagccccacctctagcctgtcttcagaagataaacaacatcttgccgtagaactggcggacactaaagcccgcctgaggcgagttcggcaggagttagaggataagactgagcagctggtggacaccaggcatgaagtggaccagctggttctggagcttcagaaagtcaagcaggagaatatacagctcgccgctgacgctcgctctgccagagcttaccgggatgaactcgatagtctgagagagaaggctaaccgtgtggagcgactcgagctcgagctgacccgttgcaaggaaaagctccatgacgtggacttttataaagccaggatggaagagctgagagaggacaacatcattctgatcgagacaaaagcaatgctggaggaacaattgaccgccgccagggctcggggagataaggtccacgaattagagaaggagaacttgcaactcaaaagcaaactgcacgatctcgagctggaccgggatacggataagaagaggatcgaggaactcctggaagaaaacatggtcttagagatcgcccaaaaacagagtatgaatgagtctgcccatctggggtgggagctcgaacagctgtcaaagaatgctgatttgtctgacgcctcacgcaaaagtttcgtgttcgagttgaacgaatgtgccagttccagaattttaaaacttgaaaaagagaatcagagtctccaatccacaatacaaggactaagagacgcctctctggtgctggaagagtccggacttaaatgtggagaactcgaaaaagagaaccatcagttatccaaaaagatcgagaaattgcagacccaacttgaacgggagaaacagagtaatcaagacttggagaccttatccgaagagctgattagagagaaggaacagctccagtcagatatggagactctgaaggcagacaaggccaggcaaataaaggatctggagcaggagaaggatcacttgaatagagccatgtggagcctgcgcgagcgttcccaggtctcctcagaggctcggatgaaggatgtcgaaaaggaaaataaggctctgcaccaaaccgtaactgaggccaatgggaagttgagtcaactggaattcgagaagaggcagttacacagagaccttgaacaagcaaaggagaagggtgagagagccgagaaactcgagagggaattacaacgcctccaggaggagaatggtcgcctggctaggaaagtgacatccttggaaacagcaacagagaaagtggaggcccttgagcatgagtctcagggcctgcagttggagaataggacgctgaggaagagcctggacaccctccagaatgttagtctgcagctcgagggcctcgagagggataataagcagttagatgcagaaaacctcgaactgagaagactggttgagaccatgcgattcacgtccaccaaactggcccaaatggagcgggagaatcaacaactggagagggaaaaggaggagctaaggaaaaatgtagacctgctgaaagcccttggcaaaaagtccgagagattagaactctcctaccagtccgtgtcagcagagaacttgcgcctgcagcagtccctcgaatcttcaagtcacaagacacagacccttgagtccgagcttggagagctcgaggccgagcgacaggcgctccggcgggacctagaagcgctgcggctcgccaatgcacagctagaaggcgctgagaaggacaggaaggcccttgaacaggaagtggcccagttagaaaaggacaagaagctgctcgaaaaagaggcgaaaaggctgtggcagcaggttgagctgaaagatgcagtcctagatgattcaaccgccaaactgtccgctgtcgaaaaggagtccagggcattggataaggaacttgccaggtgcagagacgcagctgggaagctaaaagagctggagaaggataaccgagatttgaccaagcaggtcaccgttcacgcacgcacgctcaccaccctgcgcgaagatctcgtgcttgagaagctcaaatcccagcaactgagttccgaactagacaaacttagccaggagctcgaaaaggtaggcctcaatcgtgagctcttacttcaggaagatgactccggttccgatacaaaatacaaaatattggagggcagaaatgaatccgccctgaaaaccaccctggcgatgaaggaagagaagattgtgttgctggaggctcagatggaggaaaaggccagcttgaacagacagctggaatccgaactccagatgctgaaaaaggaatgcgaaaccctcaggcagaaccagggggagggccagcacttgcagaattcttttaagcatcctgcagggaagacagccgcaagtcaccaaggtaaagaggcatggggacccggacataaggaagctactatggagcttctgagggtaaaagacagagccatcgaattggaaagaaataacgccgccctccaggcagagaaacagctgctcaaagaacagttgcaacacctggagacccagaatgtcaccttctcatcgcaaatcctcacgctgcaaaaacagtccgccttcttacaggagcacaatacaaccctgcaaacacagacagccaagcttcaagtcgagaactcaactctgtccagccagagcgccgctctgacagcccagtacacactcctgcagaatcatcacacagctaaggagactgagaacgagagcctccaaaggcagcaggagcagctgacggccgcttatgaagcactgctccaggatcacgagcatctgggaaccttacatgaaaggcagtcagctgagtatgaggccctcattcgccagcatagctgtcttaagaccttacacaggaatcttgagttggaacataaggagctcggagaaaggcacggggatatgctcaaacgaaaggccgagctcgaggagagagagaaggtgctcaccaccgagcgcgaagcactccaacaggaacagagaacaaacgcactggccatgggggaaaaccagcgtctccgcggtgagttagatcgcgttaatttcctgcatcaccagttgaaaggcgaatacgaggagctgcatgctcacacaaaggaacttaaaactagcttaaacaacgctcaactcgagctaaacagatggcaggccagattcgatgagttgaaagagcagcaccagaccatggacatttccctgaccaaactcgacaaccactgcgagctattatcgcggttgaagggcaacctcgaggaagaaaaccaccatttgctgtcccaaatacagctgctttcacagcagaaccagatgctacttgagcagaacatggagaacaaggagcagtaccatgaggagcagaagcagtacatcgacaaactcaacgctttgcgcagacacaaagagaagcttgaggagaaaatcatggatcagtacaagttctatgatccaccacctaagaagaagaaccattggataggcgcgaaggccctggtgaagctgatcaaaccaaagaaggagggctcacgagaaagattgaagagcacagtagatagcccaccctggcaactggaatcttcggaccctgcatctcctgccgcctcacagcctctgcgctctcaggcagagaacccggacactcccgcccttggctctaattgcgcggaagagcgggatgcccacaatggatcagtcggcaaggggcccggcgacttgaaacctaagcggggttcccctcacagaggcagtctggatagaaccgatgcttccacagatctcgcaatgcgctcttggccttccgagctcggctcaaggacgtgtagtaccagtgccaccacaactgcaccgtcaaacagtaccccaattgccaggcacccaggtcgtactaaggggtacaattccgacgacaacttgtgtgaaccatctctggagtttgaggttccgaaccatcgccagtatgtatctaggcccagttcactggagtcttcacgcaacacttcatcgaattcaagcccgttgaacctgaaaggcagctcggagcaactccacggtaggagcgagtcattttcttctgaggatttgattcctagccgggatctggccaccctccccagagaggcaagcactcctggtcggaatgcactcgggaggcacgagtacccactgcccagaaatggccctctgccccaagagggcgctcagaaaaggggaacagccccgccttacgtcggcgtgcgcccatgctcagccagcccatcttcggaaatggttacattggaggagttcctggaagaatccaacagatcctcgccaacacatgacaccccctcatgtcgcgatgatctgttaagtgattattttcggaaagctagtgaccccccagcaatcggaggccagccaggacctcccgctaagaaggagggcgccaaaatgcctacaaatttcgtggctcccaccgtgaagatggcagctcctacaagtgaaggaagaccactaaaaccggggcagtatgtcaaaccgaatttcagactgacagaggccgaggccccacctagcgtggctcctcgacaagctcagcctccacagtcattgtcgctgggaaggccccgacaagcccccgtcccgccagcatcccatgctcccgcctccagaagcgcgagtctctcacgtgccttcagcctcgcaagcgcagacttgctgcgggctagcggacctgaggcatgcaaacaggaatcgcctcagaaactaggcgcacccgaggctctggggggacgggaaacaggatctcacaccctgcagagccccgcacctcccagttcccacagcctcgcccgagaaagaacccccttagtgggaaaagctgggtctagctgccagggtccgggcccgcggagtaggccactggacacacgacgcttcagtttagcgcccccaaaagaggaaaggctggcgcccctgcaccagagcgccacagcccctgcgattgcgactgcaggcgcaggtgcggccgctgcaggaagcggcagcaacagccagctgctccactttagtcccgctgctgccccagcggcaaggaccaaaccaaaagcaccaccccgatccggtgaggtggctaccataacccccgtccgcgcggggctgtccctaagtgaaggagatggcgtaccaggccaaggctgtagcgaaggcctgcctgcaaaatcacccggtaggtcacctgatcttgccccccacctcggaagagctctggaggactgttccagaggctctgtcagtaagtcaagccccgccagccccgagcctggcggcgatcctcaaaccgtctggtatgagtacggatgtgtatag

SEQ ID NO: 15760 - DNA, 3831 bp, Artificial Sequence
  Description of Artificial Sequence: Synthetic coding sequence
atggatgaagtcgagcaggaccagcacgaggccaggctgaaagagctgttcgactccttcgatacaaccggtacaggatctctcgggcaggaggagttgaccgatttatgccacatgctgagcctggaagaagttgctcccgtgctgcaacagactttgttgcaggataatctgctgggccgggtccacttcgatcagtttaaagaggccctcatactgattctgtctcgaactctatctaatgaagagcattttcaggagccagattgcagcctcgaagctcagcccaaatacgtgaggggaggtaagcgctacggacgccggagcctgcccgagtttcaggaatctgtcgaagaatttcctgaggtcactgtaattgagcccctggacgaggaggcccggcctagccacatcccagctggcgattgctctgaacactggaagacacagagaagcgaagagtacgaagccgaaggtcagctgaggttttggaacccagacgacctcaacgcctcccagtcgggatcctcccccccccaggactggatcgaggaaaaacttcaggaggtgtgtgaggatctcggcataaccagagatgggcacctgaatcggaaaaagctagtctctatctgcgagcagtatgggctccagaatgttgacggggaaatgctcgaggaggtcttccacaacctcgacccagatgggaccatgtccgtggaggattttttttacgggttgttcaagaacggtaagtccctgaccccgtccgcaagcacaccctaccgtcagctcaagcgccatctttcaatgcagtcctttgacgaatcagggcgacggacaacaacttccagcgctatgacaagcacaattgggtttcgggtgttctcatgcctggacgacggcatgggccatgcgagtgtagagcgcattcttgatacctggcaggaagagggaatcgaaaatagccaggagattctcaaagcattagacttctcactcgatggcaatattaacttaaccgagctgacacttgcattggagaacgaactgttagttacaaagaatagtatccaccaagcagctcttgccagctttaaggccgaaatcagacacttacttgagagggtggaccaggtggtaagggagaaggaaaagcttaggagcgatctagacaaggccgagaagctgaaatcactgatggcaagtgaagtggatgatcatcacgctgccattgagcgcaggaacgaatataatctacggaagctagatgaagaatacaaggaacggatcgccgctctgaagaacgagctccgcaaggaacgggagcagatattgcagcaggccggcaaacagaggctggagctggagcaggagattgagaaggctaagactgaggaaaattacattcgggatcgcctagcactgtctttaaaggaaaattcccgtctggagaacgaactccttgagaacgcggaaaagctcgcagagtacgagaacctgaccaacaagctgcagcgcaatctcgagaatgtgctggccgagaagtttggggacttagaccctagctcagctgagttcttcctgcaagaggagagactaactcagatgaggaatgagtatgaacggcagtgtagagtactgcaagatcaggtggacgaactgcagtcagagctggaagaataccgggctcaaggacgcgtattgagacttcccctcaaaaactccccatccgaggaagtagaggccaactctggtgggatcgagccagaacatggtcttgggtctgaggagtgtaacccgttaaacatgagcattgaagctgagctcgttatagaacagatgaaagagcagcaccaccgtgacatttgctgcctgaggctggagctagaagataaggtgaggcactatgagaaacagcttgacgagacagttgtgagctgtaagaaagctcaggaaaatatgaagcagcgccacgagaacgaaacacacaccctggagaaacagatctcagatctgaaaaatgaaatcgcagaactgcagggtcaggcagcagtcctgaaagaggcccaccatgaagctacatgccgccacgaggaggagaagaaacagctccaggtgaaactcgaagaagagaaaacccatctgcaggagaaactccggctgcagcacgaaatggagttaaaagcccgactcacgcaggcgcaagctagctttgagagggaacgagaagggcttcagtccagcgcatggaccgaggagaaggtacggggcctcacccaagaactggagcagtttcaccaggagcagctgacctctctggttgagaagcacaccttggagaaggaggaactcaggaaagaactgctggagaaacatcagagagaactgcaagagggacgatacgaaagcgagaaactgcaacaggagaattccatcttgcgaaacgagataaccactcttaatgaggaggacagtatctccaatctgaagctagggaccttgaacggttctcaggaagaaatgtggcaaaagacagagacagtgaaacaggagaacgcagcagtgcagaaaatggtggagaacctaaagaagcagatcagcgaactgaaaattaaaaatcagcaactcgacctggagaacaccgagttgtcacagaagaactcccaaaatcaggaaaagctacaggaactgaatcaacggctgacagagatgctttgccaaaaagagaaagaacccggcaatagcgcactcgaggagagggagcaggagaaattcaacttgaaggaggagcttgagcgatgcaaagtgcagagcagcacactggtttctagcctggaagcagaactgtctgaggtcaagatccaaacgcacatcgtgcaacaggagaatcatctcctgaaggacgaactggaaaagatgaaacagctgcacaggtgccctgacctgtccgattttcaacaaaaaatctccagtgtgctgagctataatgaaaagctgctcaaggagaaggaagctctctcagaagagctgaactcttgcgtggacaaactggccaagtcctcattgctcgaacatcggatcgcaaccatgaagcaggagcaaaaatcctgggaacatcagtctgcgagcctgaaatctcagctggttgcctcccaggagaaggtccaaaacctggaagataccgtacagaatgtgaacttgcagatgagcaggatgaaaagtgacttgagggtaacacagcaggaaaaggaggccctgaaacaagaggtcatgagtctgcacaagcaattacagaacgccggcggcaaaagttgggccccagagattgccacccatcccagtggacttcacaaccagcagaaaaggttaagttgggataagctggatcacctgatgaatgaagaacagcagctgctttggcaggaaaacgagagactgcagactatggtgcaaaatactaaagccgaactcacccacagccgggaaaaggtgagacagctggaatcgaatcttctgcccaaacaccagaagcacctcaacccgagcggaactatgaatcccacagagcaggagaagttaagtttgaaaagggagtgcgatcagtttcaaaaagagcagagtccagctaacaggaaagtcagccaaatgaactctctagagcaagagctcgaaaccattcacttggagaacgagggcctcaagaaaaagcaggtgaagctcgatgagcagttaatggaaaattctgttgtgggttccagcagagaaggctgcagtagtctgcccgagatcgtatgcgaggacgctgcccccgaggttcattgcgacgcctag

SEQ ID NO: 15761 - DNA, 2997 bp, Artificial Sequence
  Description of Artificial Sequence: Synthetic coding sequence
atgaaagacagcggagactctaaagatcagcagctcatggtcgccctaagggtccgacctatcagcgttgccgaacttgaggagggagccaccctgatcgcccataaggtggacgaacagatggtcgtcttaatggaccctatggaggaccccgatgacatcttacgtgctcatagatcaagagagaaatcatatctcttcgacgtggcctttgacttcaccgccacccaggaaatggtgtatcaggccacaaccaagagcctcatcgagggtgtgatctctggatacaatgccactgtgtttgcctacggacccactggatgtggaaagacctacacaatgctgggaaccgaccaggaacctgggatttacgtccaaactctgaacgatctctttcgagctatagaggaaacttccaacgatatggagtacgaggtatctatgagttacttggaaatttacaatgagatgataagagacctgctgaaccctagcctgggctatctggaactgcgggaagacagtaaaggagtgatccaagtggcggggatcaccgaagtgagcaccataaatgccaaggaaattatgcagctgctcatgaagggcaaccgccagaggacccaggaacccacagctgctaatcaaacatcctcacgcagccatgctgtgcttcaagtaactgtgcgccagagaagtagggtgaagaatatccttcaagaggtcaggcaaggtcgtttgttcatgattgatctggccggcagcgagcgggcctcccagacacagaaccgcggtcaacgtatgaaagaaggcgcacatatcaacaggtctctgcttgcgctcgggaactgcattaacgccctctcggacaagggctctaataagtatattaactatcgggattctaaattaacaaggttgttgaaagacagccttggcggaaattcgcgaacagtaatgatagcccatattagccctgcctcttctgccttcgaagagagccgaaatacactgacctacgcaggccgtgccaagaacataaagaccagagttaagcagaacctcctaaacgtgtcctaccacatcgcccagtacacgagcataatcgcagacctgcgaggggagattcaacgcctgaaaagaaaaatcgacgagcagacggggcgcgggcaagctcgggggcggcaggaccgcggcgatatccgccacatacaggctgaggtacagctgcactcaggtcaaggagagaaggctggaatgggacagctaagggaacaattggcttccgcttttcaggagcagatggacgtgagaaggcggctgctcgaattggagaaccgtgctatggaggtgcagatcgacacatcccggcacttgctaaccatagccggttggaagcacgaaaagtcccgaagagctctgaagtggagggaggagcagagaaaagagtgttatgccaaggacgacagcgagaaggacagcgacactggggacgaccagcctgatatattagagccgcctgaggtcgccgcggccagagaaagcatagccgctctggtggatgagcagaagcagttaaggaaacagaaattggcgctggagcaaagatgccgtgagctgagggcccgcggaaggcggctagaggaaacactgcccagacgcataggaagcgaggagcagcgagaggtgttatcgctcctctgccgtgtccacgagctcgaagtcgaaaacaccgagatgcagagccacgctttactaagagacggagctcttagacatcgtcacgaagcagtcaggcgactggaacaacatcggagcttgtgcgacgaaatcatccagggacagcggcaaattatcgatgactacaatctcgctgtgccacagaggctggaggagttgtacgaggtgtatctgcgagaactggaagaaggtagcctcgagcaggcgactattatggaccaggtggcctctcgggctttgcaagattctagcctgccaaagataacacccgctgggacaagcctcacgcccgattcagacctagagtccgtgaagacccttagctcagatgcccagcacttacagaactccgctctgcctccgctgagcacagagagtgagggacaccatgtgtttaaggctggtaccggggcctggcaggctaagtcctctagtgttcctacacctcctccaatccagctgggctctttggtaacacaagaggccccagctcaggacagcttaggctcgtggattaacagttcccctgatagtagcgagaacttaagtgagattcctctgtcacataaggagagaaaggagattctgacgggaacaaagtgtatatgggtcaaggccgccagaaggcgctccagggcgctgggaaccgaaggccggcatcttctggctccagcaacggaaaggtcctccctatctctgcactccttgtccgagggcgacgatgcccggcctcctggacccctggcctgcaagcgtcccccctccccgacactccagcacgctgcctcagaagacaatctgagcagctcaaccggtgaggccccatcacgagccgtaggccatcacggggatggacctcggccatggcttcgcggccaaaagaaaagcctagggaaaaagagagaggaatcgctggaggcgaagcgccgcaaaaggaggagtaggtcattcgaggtgaccggtcagggtctttctcatccgaagacccacctgttgggaccgcatcaggccgaaaggatatcggaccacaggatgcccgtgtgtaggcacccagcaccaggcattcggcacctcggaaaggttacacttccgttggccaaagtcaagctcccgccctcccagaatacagggcccggagactcctccccactggccgtcccaccaaaccctggaggcggcagcaggcgggctaccaggggtcccagacttccacatggaacatccacccatggaaaggatggctgctccaggcacaactag

SEQ ID NO: 15762 - DNA, 1194 bp, Artificial Sequence
  Description of Artificial Sequence: Synthetic coding sequence
atgaccgccgaagagggcgtacaactgtcccagcagaacgccaaagactttttccgtgttttgaatctgaacaagaaatgtgatacatctaagcataaggtcttagtcgtgtctgtctgcccccagagcctcccgtattttgctgccaagttcaatttatccgtcactgacgccagcagacggctgtgcggattccttaaatcccttggcgttcactacgtttttgacacaaccatcgctgctgatttcagcatccttgagagtcaaaaggaattcgtccggcggtatcgccagcattcagaggaagagcgcacactgcccatgctgacaagcgcttgtcctgggtgggtgagatatgctgagagagtcctgggcaggcccatcacagctcacctgtgcacagccaaatctccccagcaggtgatggggagtctcgtgaaggattatttcgccagacagcagaacctgtctccggaaaagatttttcacgtgatcgtggcaccctgctacgacaaaaaactggaggctctgcaggagtccctgccacccgccctgcatggttcacgtggtgccgattgtgtgctgacgtccggagagatagcccaaattatggagcaaggggatttatccgtgcgagatgccgccgtggataccctgtttggcgatcttaaggaggacaaagtgactagacacgacggcgccagcagtgatggccatctcgcgcacatattccgccacgccgcgaaagaattattcaacgaagacgtggaggaagtgacgtaccgggccctgcgcaacaaggacttccaggaagtgacgctcgagaaaaacggggaggtggtcctccggtttgccgccgcctatgggttcagaaatattcagaacatgattctgaagctcaaaaagggcaaatttccctttcattttgttgaggttttggcctgcgcaggtggatgtctgaacggacgcgggcaagctcaaacacctgacggacatgccgacaaggcactgttacgccagatggagggcatttatgccgatattccggtaaggcgcccagagtctagcgcccacgtgcaagagctgtaccaggaatggctggaaggcatcaactctcccaaggcgcgggaggtgctgcatacaacctaccaatcacaagagcgaggaactcatagtctggatataaagtggtag

SEQ ID NO: 15763 - DNA, 3603 bp, Artificial Sequence
  Description of Artificial Sequence: Synthetic coding sequence
atgaaggtcgcaggaggactggagcttggagcagccgccctattatcagccagtccccgcgcgctcgtaacactctccactggaccaacctgtagtatacttcctaagaaccccctttttcctcagaatctgtccagccagccctgtattaaaatggaaggtgacaaatctttaaccttttcttcttatggacttcagtggtgcttgtatgaactggacaaagaagagttccagacattcaaggaactgttgaaaaagaaaagttcggagtccacaacctgctcgatcccccagtttgagatagaaaatgccaacgtggaatgtctagcccttttgttgcatgagtattacggcgctagtcttgcatgggctactagcatcagcatcttcgagaatatgaacctcaggactttgtcagaaaaggcgagagatgatatgaaaaggcactcaccagaggatccagaagccactatgacagatcaaggcccatccaaggagaaggtgcccggcatttcacaagcagtccagcaggactccgctacagctgcagaaaccaaggagcaagaaatctcacaggccatggagcaggagggcgccaccgccgcagagacagaagaacaggaaatcagtcaggccatggaacaggagggagcaacggctgctgagacagaggagcagggccatggcggagatacatgggattacaaatcacatgtgatgaccaaatttgcagaggaagaggatgtgagacggtcattcgaaaacacagctgctgattggcctgaaatgcagacacttgcaggggcttttgatagcgaccgctggggatttagaccacggactgtcgtgttacatggaaagtctggcatcggcaagtccgctttagctcgtcgcattgtgctttgttgggcccagggagggctgtaccagggtatgttcagctatgtgttcttcctcccggtaagggagatgcagcggaaaaaggaatcaagcgtgactgaattcatttcccgcgaatggccggattctcaggccccagtaactgaaatcatgagcaggcccgagcgccttttattcattatagatggatttgatgacctcggaagcgtcctgaacaatgataccaagctttgcaaggactgggctgaaaaacagcccccattcactctcatcagaagcctattaaggaaggtgctgctgcccgagtcgttcctgattgtcacagtccgggacgtcgggacggaaaagctaaaaagtgaagtcgtctctccccggtatctgctggtacgcggcataagcggtgaacaaagaatccacctgctcctcgaaagggggatcggagaacaccaaaagacccagggcttacgtgctattatgaacaaccgtgaactgctggatcaatgtcaggtacctgccgttggctccctgatctgcgtggcactacagctacaggatgtggttggtgaatcagttgccccctttaaccagacactgaccggcttgcacgccgccttcgtttttcaccaactgacccccagaggcgtggtgcgtaggtgtctgaacctggaggagcgtgttgtgctcaaaagattctgtcgcatggcggttgaaggagtctggaacaggaaatcagtctttgatggcgacgacctgatggtgcagggactcggcgagtcagagctgcgcgcactgttccacatgaatatcctcttgcccgacagtcattgcgaagaatactacacgttttttcatctttcactacaagacttctgcgccgcactatattacgtgttggagggtctcgagatcgagcctgccctctgtccattgtatgttgaaaaaaccaagcgttctatggagttaaagcaggctggctttcacatccactccctatggatgaagcgtttcctatttggcctagtcagcgaggacgttagacgtcctctggaagtcttactcggctgtccagtcccgttgggtgtgaagcagaagctgcttcactgggtgagcctgctgggccagcagccaaacgccaccacccctggtgataccctggacgcatttcactgcctgttcgagactcaggacaaggagttcgtgagactggctcttaactccttccaagaggtgtggttgccaattaaccagaacttggacctgatcgcaagctccttctgcctgcagcattgtccatatcttaggaagatcagagtagatgtaaagggcattttcccgcgagacgaaagtgctgaggcttgtccagtagtgcccctgtggatgcgcgataaaactcttattgaggaacaatgggaggacttctgcagcatgctggggacacatccccacttgcgacagctcgatctgggttcatctatactgactgagagagcgatgaagacactgtgcgccaaactacgccacccaacgtgtaagatacaaactctcatgttcaggaatgctcagatcactcctggggtgcagcatctgtggagaatcgtcatggccaaccggaacttgcgttcactgaatctgggcgggactcatttgaaagaggaggacgtacgcatggcctgcgaggcgttgaaacacccgaagtgcctactggaaagtctgagacttgattgttgtggcttgacccatgcttgttatctgaagatcagccaaatattgacgacaagcccgagccttaagagcctatccttagcagggaataaggtaacagatcaaggtgtgatgcccctgtccgatgctttgagagtttcgcagtgtgccctccagaaactgattcttgaagactgcggcattaccgcaacgggctgccagagcctcgcttctgccctggttagcaataggagcctgacccacctatgtctaagtaataattcactgggtaatgagggggtgaatctcttgtgcagatccatgcgcctgcctcattgctctctgcaaaggcttatgctgaatcagtgccacctcgacactgctggttgcggttttctggcccttgctttgatgggtaactcctggctgacacatctgagcctgagcatgaatccagttgaagataacggggtcaaattgctctgcgaagttatgcgggagccaagctgtcatctgcaggatctggagttggtcaagtgccatcttacggctgcctgctgcgaatctctgtcttgcgtaatctcacgtagtcggcacttgaaaagtttggatctaaccgacaacgcgctcggagacggaggagttgccgcgctgtgcgagggcctgaaacaaaagaacagcgtgctggccaggctgggactgaaagcctgtggtctaacttccgactgttgtgaggcactcagcttggccctgagctgcaacagacacctgacaagcctcaaccttgtgcagaacaatttttcccctaaaggcatgatgaagctgtgtagcgcattcgcttgtcctacttctaatctccagatcataggcctgtggaaatggcaatacccggtgcagattaggaaactgctcgaggaggtgcagcttcttaaaccgcgtgttgttatagacggctcctggcacagcttcgatgaggacgataggtactggtggaaaaactag

SEQ ID NO: 15764 - DNA, 2787 bp, Artificial Sequence
  Description of Artificial Sequence: Synthetic coding sequence
atgaacgaggctatggccactgattcccccaggcgccctagcaggtgcaccgggggggtcgttgtgcgcccacaggctgtaaccgagcaatcatacatggaatctgtagtcaccttcttgcaggacgtggtgccccaggcatattctggtactcccctgacagaagagaaagaaaaaatcgtgtgggtgagatttgagaatgctgatctcaatgacaccagccggaacctagagttccacgagattcactcaaccggcaacgagccaccactactgattatgatcggctactcagatgggatgcaggtgtggagtattccaataagcggcgaggctcaagagcttttctctgtgcgccatggccctatcagagccgcccggatcctcccggcgccccagttcggagcacaaaaatgcgataattttgccgagaaacggccacttctgggcgtttgcaagagtattggcagctcgggtacctccccaccatactgctgtgttgatctctacagtctcaggaccggggagatggtcaagtctatccaatttaagacaccaatttatgatctccactgtaacaaacgtatattagtggttgtgttgcaggagaagatcgctgctttcgactcttgtacgtttacgaagaaattttttgtaacaagttgctatccatgccccggtcctaacatgaaccctattgccctggggtctaggtggctggcttatgcggagaataagttgatcaggtgccaccagtcccggggaggcgcttgtggcgacaatattcagagttatactgctacagtcatcagtgctgctaagactctcaagagcggtttaactatggttggaaaagtggtcacccagcttactggcaccctgccttcaggcgtcactgaggatgatgtagcaattcattcgaactcacgccggtcacccctcgtgcccggcattatcacggtgattgataccgagacggtaggtgaaggccaggtgctggtcagcgaggattccgacagtgatgggattgtcgcgcactttcccgcacatgaaaagccggtgtgctgcatggcttttaatacgtccgggatgctgctggtcactaccgacacattggggcacgacttccacgtgttccagatactgacacacccctggagctcctctcagtgcgcggtgcaccacctgtatacccttcatcgaggtgagacagaagccaaggttcaagacatctgcttcagccacgactgccgatgggtggtggtgtctacacttcgaggcacatcacacgtgtttcccattaatccctacggcggtcaaccttgtgtccgcacccatatgtcccctcgcgttgtcaaccgcatgtcgagatttcagaagagtgccggcctggaggagattgaacaggagctgacttctaagcaaggcggccgttgtagccccgttcccgggctttcaagctcaccaagtggttcaccgctgcacgggaaactgaactcccaggactcttataacaacttcaccaataacaatccaggaaatccccgccttagccccctaccttctctcatggtggtcatgccccttgctcagatcaaacagccaatgaccctgggcaccatcaccaagcgcacaggaccatacttatttggagcaggctgtttttccattaaagctccctgcaaagtaaaaccaccaccacagattagtccttctaaatccatgggtggcgagttttgtgtggctgctattttcgggaccagtcgaagctggtttgccaacaacgcaggactaaaacgtgaaaaggaccagtctaagcaggtggtggtcgagagtctctacatcattagttgttatggtactctggttgagcacatgatggaaccgcggcctctgagtacagctcccaagatttccgatgatacgcctttggaaatgatgacctcccctagagcgagttggaccctggtccggactccccagtggaacgagctacaaccgcccttcaacgccaatcacccgctgctcctcgccgctgacgccgtacagtactatcaattcctcttagcaggactagtccctcccggatccccaggccccatcacacgacacggctcatatgacagtctggcatctgaccacagtggacaggaggacgaagagtggctgtcacaggtcgaaatcgttactcacacaggtccgcacaggagactttggatggggccgcagttccagttcaaaaccattcacccgtccgggcagacgacagtgatctcctcgtcttcctccgttctgcagtcccatggcccttcagacacacctcagcctctcctggactttgacactgacgacctcgatttgaattcattgcggattcagcccgtccggagtgacccagtctcgatgcctgggtctagccggcccgtgagcgatcgtcggggtgtgagcactgtgattgatgcagcgtcgggcacatttgatcgctctgtgacactgcttgaggtttgcggaagctggccagaggggttcggtttgagacatatgtcttccatggaacatacagaggagggactcagagaacgcctcgcagacgctatggcagagagccccagcagagatgttgtcggttctggaacggaattacagcgggagggctctatagagactctcagcaatagcagtggttcaacctccggcagcataccacgaaacttcgacggttaccgtagccctctgccgaccaatgagtcccagcccttaagcctctttcccaccgggttcccttag

SEQ ID NO: 15765 - DNA, 501 bp, Artificial Sequence
  Description of Artificial Sequence: Synthetic coding sequence
atggtgaacagctgctgtggcagtgtgtgttctgatcagggatgtggactggaaaattgttgtagacctagctactgccagactacttgctgtcgtacgacgtgctgcagacccagctgctgcgtttcaagttgctgtaggccacagtgctgccaaactacctgttgccggacgacatgctgccacccatcatgctgcgtgtcaagctgttgtagaccgcagtgctgtcagtcggtgtgctgtcagccaacctgttgtcgtccccagtgttgccagaccacctgctgtcggactacttgttgtcggccttcttgttgtagaccccagtgctgtcaaagtgtgtgttgtcagcccacatgttgttgccctagttactgcgtgtcttcctgttgtcgacctcagtgctgtcagacaacatgctgccgaaccacatgttgccggccatcttgctgtgtgagcaggtgctacaggcctcactgcggacagtctctgtgttgctag

SEQ ID NO: 15766 - DNA, 1104 bp, Artificial Sequence
  Description of Artificial Sequence: Synthetic coding sequence
atggacgacgctgctgtgcttaagcgccggggatacttgttgggaattaacttgggcgagggcagttacgctaaagtgaaatccgcttacagtgaaagactaaaatttaacgttgcaatcaaaatcatagatcggaaaaaagccccggctgacttcctggagaagttcctccccagagagattgagattcttgcgatgctgaatcattgctctattataaaaacttacgagatctttgagacatcgcacggaaaggtgtacattgtcatggagctggccgttcagggcgatcttctggaactcatcaagaccaggggtgcactgcatgaggacgaggcccgtaagaagtttcaccagctgtctctggccatcaaatactgccacgaccttgatgtcgtgcaccgagatctgaagtgcgataacctcctgctcgacaaggatttcaatatcaagctttccgatttctccttcagcaaaaggtgcttgagggatgattcaggacgtatggcattatcaaagactttttgcgggagcccagcttatgcagcccccgaagtgttacagggcatcccctatcagccaaaagtctatgacatttggtcattaggcgttatactgtatatcatggtgtgtggatctatgccatacgacgactccaatatcaagaagatgttgcgcatccagaaagaacatcgggtgaacttcccacggagcaagcatcttactggggaatgcaaagatttgatttaccatatgctccagcctgacgttaatcgccggctccatatagatgaaatcctgtcccactgctggatgcaacccaaagcacgtgggtccccctccgtggcgattaataaggaaggagagagctcacgcggtactgagcctctgtggacacctgagcccggctccgataagaagagtgcaactaaactggagcctgagggggaagcacagccccaggctcagccagaaacaaaacccgaaggtacagctatgcaaatgtctcgccagtccgaaatcctaggattcccttcaaagccctctaccatggaaacagaggagggtccacctcagcagccaccagaaactagagcacagtag

SEQ ID NO: 15767 - DNA, 273 bp, Artificial Sequence
  Description of Artificial Sequence: Synthetic coding sequence
atgtcccattacggcagttactatgggggcttaggctacagctgcgggggcttcggagggctgggctacggttatggctgcggctgcggctctttctgcagaaggggcagcggttgtggctacgggggttacggatatgggtcaggctttggaagttacggctacggttccggctttgggggatacggatacggatcaggatttggcggttacgggtacggttgctgtcgtccctcctataacggcggctatggtttctcaggcttttattag

SEQ ID NO: 15768 - DNA, 519 bp, Artificial Sequence
  Description of Artificial Sequence: Synthetic coding sequence
atgtcttataactgctgttctagaaatttctcatcttgttcacatggaggttatttacattatcccggcagctcctgcggatcgtcctatcccagtaacctggtgtacagcacagatctctgcagtccgtcaacttgccagcttggatcctccctctacaggggctgccaggagacctgctggcgtcctaactcttgccagacactatgcgtggagagtagtccctgtcacacttcctgctactacccgagaacccacatgctctgtaacagttgcctcaccatgcatgtgggatcaagggggtttggaagcaactcttgctgtagtttatcatgcggttccaggagctgcagtagcctaggttgtggctccaacggcttccgttatcttaactatcgaatacatacctctccctctcagagctaccggagcagattctgtcatcccatttattttcctcctagaaggtggtttcattcatcctgctaccagccattctgccgcagcgggttttactag

SEQ ID NO: 15769 - DNA, 1554 bp, Artificial Sequence
  Description of Artificial Sequence: Synthetic coding sequence
atgagtggctcctgtagcagtcgtaagtgttttagcgtacccgctacgtccctctgcagcactgaagtgtcttgtggcgggcccatttgcctgcccagcagctgtcagagccaaacttggcaactggtgacttgtcaggactcttgcggctcctcctcatgcggaccccagtgtcgtcaacccagctgtccagtgtcgtcatgcgcccagcccctatgctgcgatcctgtaatttgcgagcctagctgcagtgtgagcagcggctgtcagcctgtctgttgtgaagccacaacctgcgaaccctcttgcagtgttagcaactgttaccagcccgtttgtttcgaggcgacgatatgtgaaccatcttgtagtgtgagcaactgttgtcagccggtgtgctttgaggccactgtgtgtgagccttcctgctcagtgagcagttgtgcccaacccgtttgttgcgaaccagccatatgtgaaccatcatgttccgtcagttcctgctgtcaacctgtcggcagcgaggccaccagttgtcagcccgtcctctgcgtaccaacttcctgtcagccagtactctgcaagtctagctgttgccagcctgttgtgtgcgaaccatcttgctgttctgccgtgtgtaccctgccatcatcatgccaaccggtggtgtgtgagcccagctgttgccagcctgtctgtcccacacccacttgtagcgtcacatcctcttgccaggcagtgtgctgtgacccatccccgtgcgaaccgagctgctccgaaagctccatctgccagccggccacttgcgttgccctggtgtgcgaacccgtgtgcttaagacccgtgtgttgcgtgcagtctagctgtgagcctccctcagtgccgtcaacttgtcaggagccgtcttgctgtgtgtcctctatttgccagccaatctgcagcgaaccaagcccctgctctcccgctgtgtgcgttagctccccttgccaacccacttgttacgttgtgaaaaggtgcccctcagtttgccccgagccggtttcctgccccagcacctcttgccgtcctttgtcttgctctcccggatcaagtgcgtctgcaatctgtcggcctacctgtcctaggactttttacattccctcctcaagcaaacgtccgtgctccgctaccatctcttatcggccagtatcaaggccaatctgtcggccaatatgctccggactattgacctatcggcagccttatatgacatccatttcataccgtcccgcctgttatcggccctgctactctatcctgaggcgacctgcttgcgttacaagttattcgtgtcgcccagtctatttccgaccctcatgtaccgaatcagactcctgcaaacgggactgtaaaaagagtaccagttcgcagctggattgtgtagacactacgccttgcaaggtggatgtgagcgaggaagccccttgccagcccactgaggcaaagccgatttcccccaccacacgagaggcggctgccgctcagcccgcagcctcaaaacccgccaattgttag

SEQ ID NO: 15770 - DNA, 1026 bp, Artificial Sequence
  Description of Artificial Sequence: Synthetic coding sequence
atggcagatggttgctgtcctgggaacaccaccgcaatccctgctgttcctactatcactacctatcctgtcaaaggaggcttcagacatgctctctgcctccctagttcctgccattcaaggatgtggcagcttgttacctgtcaggagagttgtcagccatcaataggagcccccagtgggtgcgacccagccagttgccagcccacgcgcctccctgccacatcctgtgtgggctttgtttgtcagcctatgtgttcacacgctgcctgttaccagtcaggaaccggccagtcgccttgccttgtttcctcctgtcagccatcctgctctgagtctacttgttgtcaagaaaaatgttgcgacgccagcccttgccaacaaagctcctgccaggagtcagtgtgtatgtctggaagttgtcaggccgcatgcggacaaagcgtgtgttgcgatgctggaagttgtcaaccaagttgttccgaagtgaccagttgccccgaaacctcatgcctgcccactatatgcaccgcctccccatgccagcccacttggtgtcagggaagcagttgtcaacctgtgagtggggaaggacaaccctgcaagtccacgtattatcagcccatctgctatatctttaagccatgccagtcagcactgtatatgcccgtgccctgtcaaccttccacctgtgtcttcagctcatgcaatacaacctgctgtgttccatctcactgccaacctccccactgtcaattggttccgagtacatgcttcatttatcaacccgtggctaattgtcaggcaccatgctctacaaagaattgttgtaaacctgcttcctgcgacactgtaatctccggccagccaacatgtgacggaccccctagctacaatcagagcggctgtaagtccgcatgctgcgtcacgggattgggcactagtccctcatccgggagcaactgtttgccaacctcctgccagccgtcatgtgagagttctttttgtaaggccaccctgtgttag

SEQ ID NO: 15771 - DNA, 588 bp, Artificial Sequence
  Description of Artificial Sequence: Synthetic coding sequence
atggtaagctcatgctgcgggtctgtatgttcggatcagagctgtggccagggcttgggccaggaatcctgctgtaggccttcatgttgccagactacatgctgtaggactacttgctgccggccttcttgttgtatatcctcatgctgcagaccaagttgttgcatcagttcctgttgcaaaccatcctgttgtcggactacatgctgccgcccaagctgctgcatttcatcttgctgccgcccatcctgttgtatttccagctgctgtaagccttcctgttgtagaactacgtgttgtagaccttcatgctgcatcagctcctgctgcaggccaagctgctgcataagtagttgctgcaaaccaagttgctgccaaacgacttgctgtaggccaagttgctgcatttcttcatgctatcgcccccaatgctgccaaccctcctgctgccggcccgcttgctgcataagctcgtgctgccacccgtcctgctgcgtcagcagttgtaggtgtcctttctcatgtcctactacttgttgcaggactacttgcttccaccccatttgctgcggatcctcgtgctgctag

SEQ ID NO: 15772 - DNA, 588 bp, Artificial Sequence
  Description of Artificial Sequence: Synthetic coding sequence
atggtgaactcctgttgcggttcagtctgcagtcaccagggatgcggacgggatctgtgccaggagacatgctgccgcccctcgtgttgcgagacaacttgttgtcgcacaacttattgtagaccctcttgctgtgtctcttcatgctgccgacctcagtgttgccaatcagtgtgttgtcagcccacctgttgcagacctcgttgttgcatctcatcatgttgccgcccaagctgctgcgtgtctagctgctgtaagccccagtgctgccagtcaatgtgctgtcagccgacatgttgccgccctagatgttgtataagcagctgctgtcggccatcttgctgcgtaagctcctgctgccgacctcagtgttgtcagtccgtgtgttgccagcctacctgctgccatccctcatgtagcatatcgtcgtgctgccgcccatcttgctgtgaatccagctgctgccggccctgctgctgcctgcggccagtgtgtggcagggtctcttgccacactacatgttatcgaccaacgtgtgtgatcagctcgtgtcctcgccctctctgctgtgcaagtagctgctgttag

SEQ ID NO: 15773 - DNA, 633 bp, Artificial Sequence
  Description of Artificial Sequence: Synthetic coding sequence
atggtctcttcttgttgtggcagcgtatgttctgatcaaggatgtgggcaagatctgtgccaggagacatgctgtcgtccatcatgctgtgagacgacatgttgccgcactacgtgctgccgcccttcctgttgcgtgagcagttgctgtagaccacagtgctgccagtcagtgtgttgccagccaacctgctcaagacctagttgttgccagacaacatgctgccgaaccacttgctacagaccctcctgttgtgtttcgtcttgttgtaggccacaatgttgtcagccagcatgttgccagcccacctgttgccggccctcctgctgtgagaccacatgttgtcacccgaggtgctgtatcagctcctgctgcaggcctagctgttgtgttagctcatgttgcaagccacagtgctgtcagtctgtctgctgccagccgaactgttgccggccaagctgcagcatctcgtcatgttgccggccatcatgctgtgaaagcagttgttgtaggccgtgctgttgtgttcggccggtgtgtggcagggtttcctgccacacgacatgctataggcccacctgtgtcatcagctcctgcccccggcctctgtgttgtgcaagctcctgctgctag

SEQ ID NO: 15774 - DNA, 387 bp, Artificial Sequence
  Description of Artificial Sequence: Synthetic coding sequence
atgacagggagttgttgtggttcaacactgagctcactttcatacggggggggctgctgtcagccatgttgttgcagagatccttgttgttgccggccagtgacttgccaaacgacagtgtgcagacctgtgacctgcgtcccacgatgcacccggcctatttgtgaaccatgtcgacgccctgtctgttgtgacccctgttccttacaggaaggatgctgcagaccaataacttgctgtccgtcctcatgcaccgccgttgtttgtcgtccctgttgctgggccaccacgtgttgccagcctgtttccgttcagagcccctgctgtcgtcctccctgcggacagcctaccccttgcagtacaacatgccggacatctagttgttag

SEQ ID NO: 15775 - DNA, 387 bp, Artificial Sequence
  Description of Artificial Sequence: Synthetic coding sequence
atgaccgggagctgctgtgggagcactttttcgtccctgagctacggaggcgggtgctgccagccatgttgctgcagggatccttgctgttgtcgcccagtgacctgccagaccactgtctgtcgccctgtgacatgtgttcctcgctgtacgagacccatctgcgaaccttgccggcggcctgtatgctgtgacccatgtagcctgcaggagggttgctgccgtccaattacatgctgtcctagtagctgcaccgccgtcgtctgccgcccatgttgctgggccacgacgtgttgccagccagtttccgtacaaagtccatgttgcagacctccatgcgggcagcccaccccctgctccacaacctgcaggacaagctcttgctag

SEQ ID NO: 15776 - DNA, 297 bp, Artificial Sequence
  Description of Artificial Sequence: Synthetic coding sequence
atggactgctgcgcctcccggggatgcagcgtacccacagggccggccacaaccatctgctcatcagacaagtcatgccggtgtggcgtctgcctgcctagcacatgtccccataccgtgtggctactcgagcccacctgttgcgacaattgtccaccaccatgccacatcccgcaaccatgcgtgccaacatgcttccttttgaacagttgtcagcccacacctggactagagactctcaatctgactacttttactcaaccctgttgcgaaccatgcttgcccagaggttgttag

SEQ ID NO: 15777 - DNA, 297 bp, Artificial Sequence
  Description of Artificial Sequence: Synthetic coding sequence
atggactgctgtgcgagtcggtcctgcagtgtgcccaccggacccgcaacgaccatctgttcaagcgacaaatcttgccgctgcggggtgtgtttgccctctacatgcccccatacagtttggctgcttgagccgatctgctgcgacaattgtcctccaccctgccacatcccacagccatgcgttccaacgtgttttttgctgaatagctgccagccaactcccgggctggagacactgaatctgaccactttcacacagccctgctgtgaaccctgccttcccagaggctgctag

SEQ ID NO: 15778 - DNA, 297 bp, Artificial Sequence
  Description of Artificial Sequence: Synthetic coding sequence
atgtactgttgcgccctgcggtcttgcagtgtacccacggggcctgcaaccaccttttgctcctttgataagagttgccgctgcggcgtatgcttgccttccacgtgtcctcatgaaatcagcctattgcagcctatttgctgcgacacttgtcctccaccgtgttgtaagcccgatacttatgtgccgacttgctggctgttgaataattgccaccctacacccggcctgtctggaataaatttgacaacatatgtgcagcccggttgtgagagtccctgtgaaccaagatgctag

SEQ ID NO: 15779 - DNA, 291 bp, Artificial Sequence
  Description of Artificial Sequence: Synthetic coding sequence
atgtgccacacttcttgctcttctgggtgccagcctgcctgctgcgcccctagcccatgtcaggcctcgtgctacatcccggtggggtgccagtcttcagtttgtgtacctgtgtcctttaagcccgccgtttgcgtgccagttaggtgccagagctccgtgtgtgtacctgtgtcatgtcgtccagtggtgtacgctgctccatcatgccagagttctggctgctgtcaacccagctgtacatcagtgctgtgtagacctatttcatgttctacacctagctgttgctag

SEQ ID NO: 15780 - DNA, 339 bp, Artificial Sequence
  Description of Artificial Sequence: Synthetic coding sequence
atgtgccacacctctcacagttctgggtgtccaatggcgtgccccggatccccatgctgcgtcccatctacatgctatccgcctgaggggtacggaacatcatgctgctgctcagctccgtgcgtcgcgttattgtgcaggcccctatgcggcgtctccacctgctgtcagccagcttgttgtgtcccatcgccatgccaggtggcatgctgcgtgccagtatcatgtaaacccgtgttgtgtgtggcatcattctgtcccacgagcggatgctgtcaaccgttctgccctaccctggtttatcgaccagtcacgtggagtacccccactgggtgctag

SEQ ID NO: 15781 - DNA, 666 bp, Artificial Sequence
  Description of Artificial Sequence: Synthetic coding sequence
atggcaacatccaccatgtccgtatgctcttcggcatattccgactcatggcaagttgatgcatgtcctgagagctgttgcgagcccccctgttgtgcaacgtcctgttgtgcacccgctccgtgcctgacgctcgtttgcaccccagtgtcatgcgttagcagtccatgctgccaggccgcatgtgaaccatcgccttgtcaatcgggctgcacaagctcttgtacccccagctgttgccagcagagcagctgtcagccggcatgctgtacatcatctccctgtcagcaggcttgttgcgttccggtgtgttgcaaacctgtgtgctgtgtacctgtctgctgcaagccggtctgttgtaaacccatctgttgcgtgcctgtttgttccggggcctcgagttcctgctgtcagcagagttctaggcagcccgcctgctgcaccacatcttgctgtcgcccatcctcttccgtgtctcttctctgtcgtccagtttgtcggtcgacttgttgcgttcccattccctcttgttgcgcgccagctagcacatgccaaccatcatgctgtcggcccgcttcttgcgtctcactcctttgtaggcccacttgcagccggctcagctctgcgtgctgtggcctgagttccggacagaaatcctcctgttag

SEQ ID NO: 15782 - DNA, 768 bp, Artificial Sequence
  Description of Artificial Sequence: Synthetic coding sequence
atggctgctagcacgatgagtatctgctcttctgcatgcactaactcctggcaagtggacgactgccccgaatcctgctgtgagctgccatgtgggacgccatcttgctgcgcccccgccccctgtttgacattggtgtgtacacctgtgtcatgtgtctccagcccttgttgtcaagccgcgtgtgaaccctcggcctgccagtccgggtgtaccagcagttgcactccgtcctgctgccaacagagcagttgtcaaccagcttgctgtacgtcatcgccttgtcaacaggcctgctgcgttcctgtctgttgtaaacccgtgtgttgtgtccccgtttgttgcggcgcaagttcttgttgccagcagtcttcctgtcaacccgcatgttgtgcctccagtagttgtcagcagagttgcagagttcctgtgtgttgcaaagcagtgtgttgtgtgcctacttgttctgaatctagtagctcctgctgtcaacagtcctcatgccaaccagcgtgttgcacctcttcaccatgtcagcagtcatgctgcgtttctgtctgctgcaaacccgtatgctgtaagagcatatgttgcgttccagtctgctctggtgcctcatccccttgctgccaacagagctcgtgccaacccgcatgttgtacttcctcttgctgtcgtccgagttcttctgtcagtctcctctgtcgtcccgtctgttctagaccagcaagctgctcattctcttccgggcagaagtcatcgtgttag

SEQ ID NO: 15783 - DNA, 312 bp, Artificial Sequence
  Description of Artificial Sequence: Synthetic coding sequence
atgtgtgggtcgtactaccgcaattacaatggagggcacggctacggttgttgtggctacgggggcctgggttgcggctacggcggttgtggttacggatgctgcgggtatggaggacttggcttcggctacgggggtttggactgtggatacggtggcctgggttgtggctacggtagtttctgtgggtgtggttatcggggactggattgcggatatgggtgcgggtacggatatgttagtcacagcttctgcggatgtggctacagatgcggatcgggatacggaagctcctttggctactactactag

SEQ ID NO: 15784 - DNA, 3117 bp, Artificial Sequence
  Description of Artificial Sequence: Synthetic coding sequence
atggttagctccgcccagatggggttcaatttacaggccctcctcgagcagctgagccaagatgagctgtcaaagtttaaatacctcataaccaccttctctctcgctcacgaactgcagaagatcccacataaagaggtggacaaggctgacggaaagcagcttgtcgagattctgaccacccattgcgactcctactgggtcgaaatggcgagtttacaggtgtttgaaaagatgcacaggatggacctgtcagaaagagcgaaggacgaggtccgagaggcagcattaaaatctttcaacaagcgcaagccactgtccctcgcattcaccgaaacaaaagggaacgtaatatgcttggggaaagaagtcttcaaggggaagaagccagacaaagacaataggtgccggtacatcttaaaaacaaaattccgagaaatgtggaagtcgtggcctggagacagcaaagaagtgcaggtgatggctgaacgctacaagatgctgatcccattttccaacccccgtgtgctgcccggacctttttcctatacggtcgttttgtatggccccgctgggttggggaagaccacactggcgcaaaagctcatgctggactgggcagaagataaccttattcacaaattcaaatacgctttctatctgagttgccgcgaactctcaaggttggggccgtgcagttttgctgagctggtgtttagggactggccagaactccaagatgatatccctcatattttggcccaggcccgcaagatcctctttgtgatcgacggttttgatgagcttggcgccgctccaggagccttgattgaggacatttgcggcgactgggagaagaagaaacctgtgccagtgctcctcggctcacttctcaatcgggtcatgctgccaaaagccgcccttcttgtaaccacgcgcccacgagccctgagggatcttcgaatcctcgcagaggaaccaatctatataagggtagagggatttctcgaggaggacagacgggcttatttcctccggcactttggagatgaggaccaggcaatgagggctttcgagttgatgaggtctaacgcggcacttttccagttagggtcagctcctgccgtgtgttggatcgtctgcactacactcaagctgcagatggagaagggagaggatcctgtgcctacctgtctgacccggaccggtctattcttgcgattcttatgttcaaggtttccacaaggggctcagttgcgaggggcgttgagaactctgtcgctcctcgcagcccagggactctgggctcagacaagcgtgttgcaccgcgaggatctcgaaagattgggcgtgcaggaatccgatcttaggctgtttttagatggtgacatcctgagacaggaccgggtgtcaaaaggttgctacagctttatccacctcagcttccaacagtttctgactgcactgttctacacgctcgaaaaagaagaggaggaggaccgagacgggcatacttgggacattggggatgtacaaaaactgttgagtggcgtggagaggctgcgaaaccccgatctgatacaagccggatactacagcttcggactcgctaatgagaagcgggcaaaagagctggaagcaacattcggctgtagaatgagcccggacataaaacaggaattgttgcgctgtgatataagctgtaaaggaggccactctacggtgactgatctccaggagctacttggttgtctgtatgagagccaggaggaagagttggtgaaagaggtgatggctcagtttaaagagatttcactgcatcttaatgctgtggatgtggtgccaagttctttttgtgtcaagcactgccgaaatctacagaaaatgtccctccaggtcatcaaggaaaatttgccagaaaacgtcaccgcttctgagagcgatgccgaggtcgagagaagccaggacgatcaacacatgcttccgttctggaccgacctctgtagtatttttggcagcaataaagatctgatgggcctagctattaacgactcattcctgtccgcttctcttgtccggattctgtgtgaacaaatcgctagcgacacttgtcaccttcagcgggtggtcttcaagaacatatcacccgccgacgcccatcgtaatctgtgccttgctttgaggggccataagactgtcacgtacttaactcttcaggggaatgaccaggacgacatgtttccagctctgtgtgaggtcttgaggcaccccgagtgtaacttacgttaccttggcctggtgagctgctccgcaacaacgcagcagtgggctgatttgtcgctcgccctggaggtgaaccagagcctgacgtgcgttaacctgtcagacaacgagctcctcgatgaaggagccaagctgctctataccacattgcgacatcctaagtgttttctacaaagactgtccctagaaaactgccacttaacggaagccaactgcaaagatctggctgccgtcctcgtggtttcccgcgaattgacgcacctttgtctggcaaagaaccccattggtaacacaggggtaaaattcctatgtgaagggctgaggtacccagagtgcaagctgcaaacgctggtcctgtggaactgcgacatcacctccgatggttgttgcgacctgactaagcttttacaagagaagagctccttactgtgtttagacctgggtctgaatcatattggcgtgaaagggatgaagtttttgtgcgaggctcttaggaaacccctctgtaatttgcgctgcctgtggctctggggctgttccatccccccatttagttgtgaggatttatgtagcgctttatcctgtaaccagtcacttgtgacattggatctggggcagaaccctctcgggtcttccggcgtaaaaatgttattcgaaacactgacctgtagtagcgggacgctgcgcacgctgaggctgaagatagatgactttaatgacgaattgaataagttactggaggagatcgaggagaagaatccgcaacttattattgacactgagaagcaccatccatgggccgaacgtccaagctctcatgacttcatgatttag

SEQ ID NO: 15785 - DNA, 762 bp, Artificial Sequence
  Description of Artificial Sequence: Synthetic coding sequence
atggagctggaacagcgcgaagggacaatggccgccgttgggtttgaggaatttagtgctcccccgggctctgaacttgctttgcccccactgttcggaggacacatcctggaatccgagctcgagacggaagttgagtttgtgtctggcggactgggcgggagtggacttagagagcgagatgaggaagaggaggctgcgcgcggcagaagacggagacaaagggagttgaaccggcggaagtaccaggccttagggcggcgctgtagggagatcgaacaggtgaatgagcgcgtgttgaatcggctgcatcaggtacagcggatcacacgaaggttgcagcaggaaaggaggttcctgatgcgagtgcttgacagctacggagacgactaccgagcaagtcagttcacgatcgttctggaggatgagggctcccagggcacggacgcaccgacgcccggcaatgccgagaatgagcccccagagaaggagaccctgagccctccccgccgcacgcctgcaccaccggaacctggcagtccagcacccggagagggaccatctggacgaaagcggaggagggtgccccgcgatggaaggcgggccggcaatgctttgaccccagagctcgcacccgttcagatcaaagtcgaggaagacttcggattcgaggccgacgaagcattggactcaagctgggtgagccgtggtccggacaaattattgccataccccacactggcttctcctgctagcgattag

SEQ ID NO: 15786 - DNA, 2679 bp, Artificial Sequence
  Description of Artificial Sequence: Synthetic coding sequence
atgctgcggactgccggccgcgacggactgtgtcgattgtccacttatctggaggagttggaagccgtcgagctgaagaagtttaagctctatcttggtactgctactgaacttggcgaagggaagattccgtggggaagcatggaaaaagccggccctctcgaaatggcacagctcctgatcactcacttcggccccgaagaggcatggcggttggcactgtctacatttgagaggattaaccgcaaggatctctgggagcgcggtcagcgagaggatctcgtccgggatacgccaccaggcggcccttcgtctttgggaaaccagagcacttgcctgctggaggtttctcttgtgacaccccgtaaagacccgcaggaaacctacagggactatgttaggagaaagttccggctaatggaggacagaaatgccaggttaggcgagtgcgtaaacctcagccatcgatacacccgactcctgctggtgaaggagcatagcaacccaatgcaggttcaacagcagctgctggataccggacgcggacacgccaggaccgtgggacaccaggcctccccaataaaaattgagactctcttcgagcccgatgaagagaggcctgagcctccaagaacagtggtcatgcaaggagccgcaggcatcggcaaaagcatgctcgcacataaggtcatgcttgattgggctgacggcaagttgttccagggccgcttcgattatttgttctatattaattgcagggagatgaatcagtctgcgaccgagtgtagtatgcaggatctcattttctcatgctggcccgagccctctgctcctctgcaggaactgatccgcgttcccgaaaggttactgttcattattgatggctttgatgagctgaaaccctccttccatgatccccagggcccatggtgtctgtgttgggaggaaaaaaggccaactgaacttctgctgaatagcctgatcaggaagaagctcctgcccgaactgtcactacttattactacacgacccacagcgctggagaagcttcacagacttctggaacatccacgccacgtcgagatcttagggttctctgaagcagagcggaaagagtacttttataagtatttccataatgccgagcaagccggccaggtgttcaattacgtgcgtgacaatgagccactatttactatgtgttttgttcctttggtctgctgggtggtttgtacttgcctccaacagcaactagaaggaggcggcttgctgaggcaaacgtctcgaaccactaccgccgtctacatgctgtacttattgagccttatgcagccaaagccgggtgcaccacgcctgcagcctccccctaaccaacggggactctgcagccttgccgctgacggtctgtggaatcagaagattctgtttgaagagcaagatctgagaaaacacggcttggatggtgaggatgtgtccgccttcttaaatatgaatatattccagaaagatatcaactgtgagagatattacagttttatccatctctcttttcaggaatttttcgcagcgatgtattacatattggatgagggcgagggcggagccggccccgatcaagacgtgacacgcctgctgactgagtacgccttttccgagcggtcttttcttgctttgacgtctagattcctattcggactgttaaacgaggagactaggtcacacctcgaaaaatcactgtgctggaaagtaagtccccacatcaagatggatcttctgcaatggatacaatctaaggctcagtctgacgggtccaccctgcagcaagggagtttggagtttttcagctgcctctacgagatccaggaagaggagttcatccagcaagcactgtctcatttccaggtgatcgttgtatcaaatattgccagcaaaatggaacatatggtgtcctctttctgtttgaaacgttgtcggtccgcacaggtgctgcacctctacggcgccacttactctgccgacggcgaggatcgcgcacgctgctcggccggggcccacaccttattggttcagctgagaccagagagaactgttctgctggatgcttactctgaacacctcgcagcggccctgtgtacaaatcctaacctgatcgaactcagcctgtacaggaacgctctcggctccagaggcgtgaaactactctgccaggggctgcgacatccgaattgcaaactgcagaacctgcgactgaagagatgtagaatttcatcaagtgcctgcgaagacctctctgcggcactcattgcaaataagaacctcacgaggatggatctcagcggcaatggagtggggtttcccggaatgatgctgctgtgtgaggggcttaggcaccctcagtgcaggctacagatgatccagctgaggaagtgtcaattggagtccggagcgtgtcaggaaatggcctccgtcttagggaccaaccctcacctcgtggagttagatctgactggtaatgcccttgaagacttgggattgagactgttgtgtcagggtctgcgccacccggtgtgccgcctgcggactctctggtggctgttcgggatggacttaaataaaatgacacactctcgacttgccgcgctccgggtcaccaagccatatctggatattggctgctag

SEQ ID NO: 15787 - DNA, 3189 bp, Artificial Sequence
  Description of Artificial Sequence: Synthetic coding sequence
atgttacgcacagctgggagggatggtctgtgtcgactgtccacctatctggaagaattagaagctgtggaattgaagaaattcaagctctacctgggtaccgccacagagctgggagaaggcaaaatcccctggggctctatggagaaagcaggccccctggaaatggcacaactattgatcactcatttcggccctgaggaagcgtggcggctcgcgctttcaactttcgagcgaatcaatcgcaaagacctgtgggaacgcgggcaaagggaggatttggtgagagataccccacctgggggccctagctcccttgggaaccaaagtacttgtctgcttgaggtatccctggttactccacgtaaggatcctcaggagacatacagagattatgttcgcaggaagttccgactaatggaggacaggaatgcgcggctaggagaatgcgtgaatctttcccataggtatacacgactgcttctcgttaaagaacatagcaaccccatgcaggttcagcagcagctgcttgacaccggtcggggtcatgcccgaacggtcgggcaccaggcctcacccattaaaattgaaacgctgtttgagccagacgaagaacggcctgagcctccaagaaccgtggtgatgcagggagcagccggaatcggcaaaagcatgctggctcacaaggtgatgctggactgggccgatggtaagttgttccagggtcgcttcgattatctcttttacatcaactgtcgagagatgaatcagagcgctacagaatgctctatgcaggacctcatcttcagttgttggcctgagccatcagcacctcttcaagaactgatccgcgtacctgagcgcctgctcttcatcattgatggcttcgacgagctcaaaccctcatttcacgacccccagggtccctggtgcctgtgctgggaggaaaaacgcccaactgagctcctactaaactcactgattagaaagaagctgctccccgagctctctttgctgatcacaacacggccaacagcccttgagaagctccacagactgctggagcatccgcgccatgttgagattctcggtttttcagaagctgaacggaaggagtatttctacaaatacttccacaacgcagaacaggctggacaggtgttcaactacgttcgggacaacgagcctctgtttaccatgtgtttcgtgccactggtgtgctgggtggtgtgcacatgcctccagcagcagcttgagggtggagggctgctgcgccaaacatcccgcaccactactgctgtatatatgttatatttgttatctttaatgcagccaaaacccggagcgcctcgcctgcagcctccacccaaccagcgcggcctgtgcagcctggcggcagatggtctgtggaaccagaaaatacttttcgaggagcaagatttgaggaaacatggcctcgacggggaagacgtgtctgctttcctcaatatgaatattttccagaaggacatcaattgtgaaaggtattatagttttatccatttatccttccaagaattcttcgctgcgatgtactacatattagatgagggcgagggtggcgccggtccggatcaagatgttaccagactgttgactgagtacgcgtttagcgagcgcagctttctggcgctgacctcccgcttcctgtttgggctactgaatgaggagactcggtcccatttggagaaatctctatgttggaaggtgagcccccatataaaaatggatctgctgcagtggatccagtcgaaagcacagagcgacggctctaccctgcaacaaggcagtctcgaattcttctcctgtctgtacgaaattcaggaagaagaattcattcagcaggccctgagccatttccaggtaattgtggtctcaaatatcgcaagtaaaatggaacacatggtgtcctctttctgcttaaagcggtgccggagcgcccaggtcctgcatctgtatggggccacgtatagtgccgatggggaagaccgagcccgatgttcagccggtgctcacactctgctggtgcagctgcgaccagagaggaccgttctcctggacgcctactccgaacatctggccgccgcactgtgtaccaaccctaatcttatcgaactttctctgtaccgcaacgccctcggatccaggggggtgaagttgctttgccagggtctgcgacacccgaattgtaaactccaaaaccttcgcctgaagagatgtagaatctcttcatcagcatgcgaggatctaagcgcggcacttatcgccaacaagaatctcacacggatggatttgagtggaaacggcgttggcttccctggcatgatgctgctttgcgagggcttgaggcacccgcagtgtcgtctccagatgatacagctcaggaagtgtcagcttgaatccggcgcgtgccaggaaatggcaagcgtgttgggaacgaatcctcaccttgtggagcttgacctgacaggaaacgccctggaggatctcgggctcagattgttgtgccaggggcttaggcatccggtgtgccgactcagaactctttggctcaaaatctgcaggttaactgcggcagcatgtgatgagctggcaagcactctgagcgtgaatcagtccttgcgcgagctcgatctgagtctcaatgagcttggtgatctgggggtacttctcttgtgcgaaggactgaggcacccaacgtgtaagctccagacactccggcttggcatctgccggctgggatctgccgcatgcgagggattgtctgttgtcttgcaggcaaaccacaacctgcgcgagcttgacttatcctttaatgaccttggagattggggactgtggttactagcagaaggcctacagcatcccgcatgcagacttcaaaagctgtggctggactcctgcggactaaccgcaaaagcctgcgagaacctctattttactctcgggattaaccagacactcacagacttgtatcttacaaacaatgctttgggtgacaccggcgtgagattattgtgtaaacgtctttctcatcccggctgtaaactgcgcgttctctggctgttcggcatggatttgaacaagatgacccacagccgactggccgccctgcgggtgactaagccctatcttgatatcggctgctag

SEQ ID NO: 15788 - DNA, 3015 bp, Artificial Sequence
  Description of Artificial Sequence: Synthetic coding sequence
atgctgcggaccgctggacgcgatggactatgtcggttatccacctacttagaagaactcgaagcagtcgagctgaagaaattcaaactgtatctgggtacggccaccgaattaggggaaggcaaaatcccctggggatcaatggagaaagccggccccttggagatggcccagctgttaatcacccattttggccccgaagaagcctggcggctggctctgtcgacctttgaacgcatcaacagaaaagacttgtgggagcgggggcagcgtgaggatctggtgcgcgatacaccccctggggggcctagtagtctcgggaaccagtccacctgtttactggaagtctctctcgtgaccccacgaaaagatccacaggaaacctacagggactacgttcggcgtaaatttaggctgatggaggatcgaaacgcccggctgggcgagtgcgtgaacttgtcccacagatataccaggcttctgctggttaaagaacactccaatccaatgcaagtccagcaacaactcttggatactggacgaggacacgcacggaccgtgggacatcaggccagccccatcaagatcgagacactgtttgaacctgatgaggaacgacccgaaccgcctagaacagtcgtgatgcagggcgccgcagggatcggcaagtcaatgctcgcccacaaggtgatgctggattgggccgacggtaagctgtttcaagggaggtttgattatctgttttatatcaactgccgcgaaatgaaccagtctgccactgaatgctcaatgcaggatctaatttttagctgttggccagaacctagcgccccgctccaggagctgatacgggtgcccgaacgtcttctgttcatcatagacggctttgacgaactaaaaccttcctttcatgatccacaggggccctggtgcctgtgctgggaggagaaacgccctaccgagcttctccttaattctctgatccgcaaaaaactcctgcctgagttatctctgcttatcaccacccggccaaccgccctggaaaagctgcaccgactactggagcatccccgtcatgtggagatccttggtttctccgaagccgagcgtaaggagtacttctacaagtatttccataatgctgagcaggcgggacaggttttcaattatgtccgcgacaacgagccattgtttacgatgtgttttgtgccactggtgtgctgggtagtgtgtacttgcttacaacagcagttggaaggcggaggcctgctgagacagacttctcggactaccaccgcggtttatatgctatatctactatctctcatgcagccgaagcccggagctcctcgcctgcagccaccaccaaaccaacggggactctgcagcctggccgctgacggcctctggaatcagaaaatccttttcgaagagcaggacttgcggaagcacggccttgatggcgaggacgtgtccgccttcctgaatatgaacatcttccagaaagatattaactgtgaacggtactacagcttcatccacctcagcttccaggagtttttcgcagcaatgtattacatcctcgacgagggcgagggcggcgcagggcccgaccaggacgtgacccgactgttaaccgagtatgccttctcagaacgttccttcctggccctgacatccaggttcctattcggtctcctgaatgaggagactaggtctcaccttgagaaaagtctatgctggaaagtgtctccacacatcaaaatggacctgctacagtggatccagtccaaggcacagagtgacgggtctacgttgcagcaggggtctctcgagttcttttcatgcctgtatgagatacaggaggaggagttcattcagcaggctctgagccactttcaagtgatcgttgtaagcaacatagccagtaaaatggagcacatggtttcaagcttttgcctaaagcgatgtcggtcagcccaagtgctccacctgtatggagccacctactccgcagatggcgaggatcgcgctaggtgtagtgcaggtgcccatacgcttctagtccagctgcctgagcgtacagttctgctggatgcttattccgaacacctcgctgcagctttatgtacgaacccgaacctgattgaactaagcctgtatcgcaatgcgctcggcagccgcggggttaagctgctatgtcaggggcttcggcaccctaactgtaagttgcagaatctccgattaaagaggtgccgcattagtagttccgcttgtgaggatctgagcgccgccttgatcgccaacaagaatctgactcgaatggacctatctggaaacggggtggggtttcccggcatgatgttgctgtgcgagggtctcaggcatccccaatgccgcctccagatgatccagctaaggaagtgtcagctcgagtcaggagcttgtcaggaaatggcaagtgtgctgggcacaaatcctcacctcgtggaactggatcttaccgggaacgccctggaggacttaggactgagactactatgtcaaggactcaggcacccagtgtgtcgcttacgaactctctggctgaaaatttgtcggctgactgctgcagcgtgtgatgagctggcttctaccctgtccgtgaatcagtcgctgagagaactggacctgtctctgaacgaactcggcgacctcggggtgctcctgctgtgcgaggggctaagacacccaacctgtaaactccaaactttgcgcctggactcatgcggcttgactgcgaaggcctgcgagaatctatactttacactgggaattaatcagactctgacagacttgtatctgaccaataatgctttaggtgataccggggttagactcctgtgcaagcgattaagtcatcccggttgtaagctgagagtcttgtggctgttcggcatggatctgaataaaatgactcattccaggctggccgcattgagggtgacaaaaccttacctggatatcgggtgctag

SEQ ID NO: 15789 - DNA, 327 bp, Artificial Sequence
  Description of Artificial Sequence: Synthetic coding sequence
atggcaagcggcaggccagaggagctctgggaggccgtggtcggggcggctgaacgattccgcgcccgtactgggaccgagttggttctgctgaccgctgcccctcctccaccaccaagacctgggccgtgcgcatacgccgctcacggtcgcggggcactcgctgaagcagccaggcgttgcttgcacgacatagccctcgcccaccgcgccgccaccgctgcgcgtccccctgcccccccacctgcccctcaaccgccaagtcccactccctcacccccgagaccaacgctcgcccgtgaagataatgaggaggatgaggactag

SEQ ID NO: 15790 - DNA, 771 bp, Artificial Sequence
  Description of Artificial Sequence: Synthetic coding sequence
atggcaagtggcaggccagaggagctgtgggaggcagttgtaggggccgccgaacggttcagggccaggaccggaacagaacttgtgctcttaactgctgcccctccaccgcctccacgaccaggcccgtgcgcttatgcggcccatggcaggggtgccctggccgaagccgctcgaaggtgcctgcatgatatcgccttggcacaccgtgctgccaccgctgcacgccccccagcacccccaccagcaccgcagccccctagcccaactccttctcccccgcggccaacactggcgcgcgaagataacgaggaagacgaggatgagcccacagaaaccgaaaccagtggggaacaactcggtatttctgacaacggaggcctgttcgtgatggacgaagatgctacactgcaggacctgccgccattctgtgagagcgatcctgaatccacggacgacggctcactctccgaagagactcccgcgggtccgccaacttgttctgtgccacctgcatccgcactgcctacccagcagtacgctaagtcattacctgtgagcgtacctgtttgggggttcaaggagaaacggacagaagcccggagcagcgatgaggaaaatgggccaccctctagtccggatttagaccggatcgcagcttctatgagggctctcgtcttgcgggaagccgaagatacacaggtcttcggagatctgccgcgcccacgacttaacacctccgatttccagaagctcaagcggaagtattag

SEQ ID NO: 15791 - DNA, 771 bp, Artificial Sequence
  Description of Artificial Sequence: Synthetic coding sequence
atggcaagtggtaggccggaggaactctgggaagctgtggttggcgccgcagaaaggttccgcgccaggactgggacggaattggtgctgcttacagcagccccccccccccctccccggcccggcccctgtgcctatgcagcccatggacgtggagctcttgctgaggcagctcgtaggtgcctacatgatatcgcgcttgcccaccgggctgccaccgccgctaggccccccgcccccccgcccgctcctcagccacctagtcctacaccaagccctccccgaccgacattggcccgagaagacaacgaagaagacgaagatgagcctacagagacagagacatcaggagaacagctggggatctcagacaacggaggattatttgtaatggacgaggacgctactcttcaggatcttcctccgttttgtgaatctgaccctgaatcaacagacgacggttccctttccgaggagaccccggccggcccacctacctgctccgtgcccccggccagcgccctgcccactcagcagtacgcaaagtcattgcccgtttcagtaccagtgtggggcttcaaagagaagaggactgaggcccggagcagcgacgaggaaaacggcccaccctcatcacctgatctcgaccggatagcggcatctatgcgcgccctggtgttgagggaggccgaagatacacaggtattcggggatctacctcggccccgacttaacacctctgactttcagaagctgaagcgcaaatactag

SEQ ID NO: 15792 - DNA, 771 bp, Artificial Sequence
  Description of Artificial Sequence: Synthetic coding sequence
atggcctctggcagaccagaagagctgtgggaggcagtggtcggggccgctgagcgttttagagcccggactggcaccgaactcgtgctgctgactgctgctccaccccctcccccgcgacctggcccatgcgcctacgcagcccacggccgcggcgccctagctgaggcagcccggaggtgtctgcacgacatcgcccttgcccaccgcgctgctaccgcagcccgccctcctgctcccccacctgcgccgcagcctccgtctcccacaccgagtccccccagacccacactcgccagggaagacaacgaagaagacgaagatgagcctactgagacagagacctcgggcgagcaactaggcatctctgataatggcggcctgttcgttatggacgaagatgcgacgctccaggatttgcccccgttctgtgagtcggatcccgagagcactgacgatgggtccctttccgaagagactcccgctggaccgccgacatgctccgtgccacccgcaagtgccttgccaacacagcaatacgctaagtccctccctgtctcagtccccgtctgggggttcaaggagaaacgtaccgaggcaaggtcatctgatgaggagaatggtcctccctccagccctgatttagaccgcatagccgcctccatgcgggccttggtactgcgcgaagctgaagatactcaggtgtttggtgatctaccgcgtcctagactgaatactagtgacttccagaagctgaaacgcaagtattag

SEQ ID NO: 15793 - DNA, 771 bp, Artificial Sequence
  Description of Artificial Sequence: Synthetic coding sequence
atggcttctggcaggccagaagagctatgggaggccgtagtcggagctgccgaaagatttcgagctaggactggcacagaattagtgttgcttacagccgcacccccaccccctccccgaccgggaccatgtgcttacgctgcccatgggcggggggctctcgccgaggccgcccggcgctgcctgcacgatatcgctctggcccatcgtgccgccactgccgcgcgtcccccagctccgcccccagccccacagcctccctccccgaccccaagtcccccacgaccaaccctggcccgcgaggacaatgaggaagatgaagacgaaccaacagagaccgaaacaagcggtgaacaactggggatttcagacaacggcggtctgttcgttatggatgaagatgctacactgcaagatctgcctccgttctgtgagagcgatccggaatctaccgacgacggaagcctgtcagaggagacgccagccggtcctccaacctgtagcgtgccgcctgcttcagctttgccaacccagcaatacgcaaaatccctgcctgttagcgtccccgtgtggggattcaaggagaagcgaactgaggcccggagcagtgacgaggaaaatggacctccaagtagtcctgacttggacaggattgccgcttctatgcgcgctctcgtgctgagggaggcagaggatacccaggtgtttggcgacctgccacgcccccgactgaatacctcagatttccaaaaactgaaaagaaagtactag

SEQ ID NO: 15794 - DNA, 831 bp, Artificial Sequence
  Description of Artificial Sequence: Synthetic coding sequence
atgagtttcgaaggaggtgacggggctgggcccgccatgcttgcgacaggcacagcccgcatggcttctgggcgccccgaggagttgtgggaagccgttgttggagcggccgagaggtttagggccagaactggaactgaattggtcctactcactgcggcgcccccaccgccaccccggccgggaccttgtgcatatgccgcccacggccgcggtgcgctggctgaggctgccagaaggtgtttgcacgatattgccctcgcccacagggctgctacagccgctcggccgcctgctccccctcctgcacctcaaccccccagcccaacaccaagtcctcctcgccccactctcgcccgagaggataacgaggaggacgaggacgagcccaccgaaactgagacgtcgggtgaacagctcggcataagtgacaacggaggtctgttcgtcatggatgaagacgctacccttcaggaccttcctcccttttgcgaaagcgaccctgaaagtacagatgacggctctctttcagaagagacccccgcgggccctccaacgtgctctgtgccgcctgccagtgccttgcctactcagcagtatgccaagtcccttcccgtgtcagttccagtctgggggtttaaagaaaagcggaccgaggcgaggtccagcgatgaagaaaacgggccgccgtcctcccctgatttagatcgcatcgcagcctctatgcgagctttagttctcagggaagccgaagacacacaggtgttcggggacctgcctagaccccggttgaacacctctgactttcagaagctgaagcggaagtattag

SEQ ID NO: 15795 - DNA, 906 bp, Artificial Sequence
  Description of Artificial Sequence: Synthetic coding sequence
atgacaaggcacggtaagaactgcacagcaggagccgtttatacatatcacgagaaaaaaaaagacacagcggcgtccggctatggcacacagaatattaggctgtcaagggacgccgtgaaggacttcgactgctgctgtttatccctgcaaccctgccacgatcctgtggtgacccctgacggctacctgtacgaaagagaagcgatcctggagtatattctgcaccagaaaaaagaaatcgcccgtcagatgaaagcatatgaaaaacagcgcgggactcgaagagaagagcaaaaagagctgcagagggctgcctcccaggaccatgtgagaggtttcttagaaaaagaatcagccatcgtaagcagacctcttaacccctttactgcgaaggcgctgtctgggactagccctgatgacgtgcagcccggtccttccgttgggccaccatccaaagacaaagataaagtcctcccatccttctggatcccatcactgaccccagaagccaaggcgactaaacttgagaaacctagccgcacggtcacctgccctatgagcggtaaacccctgcggatgagcgatctcacacccgtccattttacacctctagactcgtccgtggaccgagttggactgataacccggagtgaaagatatgtctgcgcagtgacgcgggacagcctaagtaacgcaacaccatgtgccgtgctgagacctagcggtgccgtggtaactctggaatgcgttgagaagctaatccgcaaggacatggtcgaccccgtcaccggcgataagcttactgaccgtgatatcattgtactgcagcgaggcgggaccggcttcgccgggtccggtgtgaagctgcaggcggagaaatctagaccagtaatgcaggcatag

SEQ ID NO: 15796 - DNA, 612 bp, Artificial Sequence
  Description of Artificial Sequence: Synthetic coding sequence
atggcggaagtccaggtacttgtgctcgatggccgtggtcacctgctaggccgcctggccgcgatcgtcgcaaagcaggtgctgctggggcgaaaggtcgttgtggtgcgctgtgaaggcataaatattagtggtaacttctatagaaacaaactgaagtacctggcctttctcagaaaacgcatgaataccaacccgtcaaggggaccttatcatttcagggccccatcacgtatcttttggagaaccgttaggggcatgctgccacacaagaccaaacgcggccaggcagccctggataggctgaaagtgttcgacgggattcctcccccatacgataaaaaaaagaggatggtggtgcctgccgccctgaaagtcgtccggctgaaacccactcgcaagttcgcttatttgggtcgcctggcacacgaagtagggtggaagtatcaagcggtgacagccacgctagaggagaagcggaaagaaaaagccaaaattcactaccggaagaagaagcaactgatgcgactgaggaaacaggccgagaaaaacgttgaaaagaaaatcgataagtataccgaggtgttgaaaacccacggtctcctggtctag

SEQ ID NO: 15797 - DNA, 690 bp, Artificial Sequence
  Description of Artificial Sequence: Synthetic coding sequence
atgacatgctgcagtcaggtgcctccccgcaggcggccttccctcgcactttcccctcggctggactgtaatggcctaaatggcgtgcccggatccatttgggacttcgtgtccggcagcttcagccccagtccaagcccgatcctatctgcgggcccccccagtagctccagcgctagccctaatggagctgagctcgcgagggtgagacgccagctcgacgaagcaaaacgtaagatccgccaatgggaggagtcatggcagcaggtaaaacaagtttgcgatgcttggcagcgcgaggctcaggaggcgaaagaacgggccagggtggctgacagcgataggcagctggccttgcagaagaaggaggaggttgaagctcaagtcaaacagctgcaggaggagcttgagggactgggggtggcctcgacccttccaggcctgcgcggctgtggcgatattggtacaatacccctgccaaagcttcacagcctgcagtcacaactgaggttggaccttgaggccgtggatggagtcatattccagctgagagccaagcagtgtgtagcctgtagagaacgtgcgcatggtgccgtattgagaccatgccaacaccacattctgtgcgaaccatgtgctgcaactgctccagagtgcccatattgcaagggccagcctctgcagtggtag

SEQ ID NO: 15798 - DNA, 2283 bp, Artificial Sequence
  Description of Artificial Sequence: Synthetic coding sequence
atgatggaagaacgcgcggccgccgccgtggccgcagctgccagcagttgcagaccgctaggcagcggcgccgggcctgggccaacgggggccgctcctgtgagcgcccccgccccgggcccaggaccagctgggaagggcgggggcggtggggggtcacctggcccaactgccggacctgagcctctgtccctgccagggatcctgcactttattcagcacgaatgggccaggtttgaagccgagaaggcccgatgggaggccgaacgcgctgagttgcaggcccaagttgccttcttgcagggggaacgcaaaggccaggagaacttaaaaaccgacctggtaaggcgcatcaagatgctggaatacgccttgaaacaagaaagagccaagtatcacaagctcaagttcggtaccgacctgaatcagggggagaaaaaagcagatgtgtctgagcaggtgtcaaacggccccgttgaatccgtcacgcttgagaattccccacttgtttggaaagaagggcgacagctgctcaggcagtacttggaggaggtagggtatactgacactatcttggatatgaggagtaaaagggtccgatctctcctgggaaggtccttggagctgaacggagccgtcgaaccgtccgagggcgccccacgggctccacccgggcccgccggtctctccgggggtgagtccttattagttaaacagatcgaggaacagattaaaaggaatgctgcagggaaagatgggaaagagcggcttggtgggtcggttctgggccagatccccttcctgcaaaattgcgaggacgaagatagtgacgaggacgatgagctggactccgtacaacacaagaaacagcgcgtgaaactcccaagtaaggctcttgttccggagatggaggatgaggacgaggaggatgattctgaggatgccatcaacgaattcgactttctggggtcaggagaggatggtgagggcgctccggatccacgccgctgcactgtggacgggtcccctcacgaactcgagagtcgccgggtcaagcttcaaggcatattggcggatctacgcgatgtagatggactgccccctaaagtgactggtcctcctcctgggacaccacagccccgcccacatgaaggctcttttggttttagtagcgacgtgtttataatggataccatcggtgggggagaggtatccttaggcgatctggccgatctcacagtaacgaatgacaatgacttaagttgcgacctgagcgacagcaaagatgccttcaagaaaacctggaacccaaaattcaccctcaggtctcattacgatgggatcaggtcccttgctttccaccattctcagagcgcccttctgacagcttccgaggacggtacgttgaaactgtggaacctccagaaggccgtcacagcaaaaaagaacgctgcattggatgtggaacctatacacgccttccgcgctcatcggggacccgtactagctgtagccatgggaagcaattctgagtactgttattcaggaggggctgacgcctgtatccacagctggaagatccctgatctgtccatggatccctatgacggctacgatccctcagtcctgtcccatgtgctggaaggccacggcgatgccgtgtggggattggcatttagtcccacatcccagcgcctggcatcttgttctgcggacggaactgtacgtatatgggacccgagctctagcagcccagcctgtctttgcacgttccctacagcatccgagcacggcgttcccactagcgtcgcctttacgagcaccgagcccgcccacatagtagcctccttcagaagcggagacaccgtgctatatgacatggaagtgggatccgccttattgacactggagtctcgaggcagcagcgggcccactcagataaaccaagtcgtttctcacccaaaccagcctctgacaatcacagcccacgacgacaggggaatacggtttctcgacaaccggactggaaagcctgttcacagtatggttgctcaccttgatgccgtaacctgcctcgccgtggatccaaatggtgcgttcctgatgtctggctctcacgactgcagcttgcggctttggtcactggacaataaaacctgtgtgcaagaaattacggctcatcgcaagaaacatgaagaagccattcatgcggtggcctgccacccctctaaggcactcattgcatctgctggcgccgacgcactagcaaaggtttttgtttag

SEQ ID NO: 15799 - DNA, 327 bp, Artificial Sequence
  Description of Artificial Sequence: Synthetic coding sequence
atgacccccgaggagctgcagaagcgggaggaagaggaatttaatacaggtcctctgtccgtcctgactcaatccgtcaagaacaacacccaggtgttgatcaattgccggaataacaagaagctgttaggaagggtgaaagctttcgatagacactgtaatatggtccttgaaaatgtaaaagagatgtggacagaggtgcctaagagcggcaaaggaaaaaagaagtcaaagcctgttaacaaagaccgttatatttcaaagatgtttctcaggggagactccgtaatcgtcgtgcttcgcaatcctttgatcgccggcaagtag

SEQ ID NO: 15800 - DNA, 1275 bp, Artificial Sequence
  Description of Artificial Sequence: Synthetic coding sequence
atggtccaaactttgtattattccgcagaccacaaacttctggatggcaacctgctcgacggccaagccgaggtctttggctccgacgacgatcatattcagttcgttcagaagaaacccccaagggaaaatggtcacaaacagatctcatctagcagtaccggatgtttgagctctcccaatgctacggtgcaaagccctaagcacgagtggaaaatcgtggcatcagagaagacttctaacaatacctatctctgcctggcagttttagacggcatcttttgtgttatctttctgcacggcaggaactctccacagagctccccaacaagcacaccaaaattaagtaagtccctttccttcgagatgcagcaggacgagctgatagaaaagcctatgagccctatgcagtatgcacgatcaggcctcggcacggccgagatgaatggcaaactgattgctgctggcggctacaatagggaggaatgcctcaggactgtggagtgctataacccccatactgatcactggagcttcttggcccccatgagaacaccaagagcccggttccaaatggccgtgctgatggggcaattgtatgtggttggtggatccaatggccattcagatgatttatcttgcggggagatgtacgactcgaatatcgacgactggatccctgttcccgagcttcgaactaatcgctgcaatgccggcgtctgcgctcttaacgggaagctttatattgtgggagggtccgacccatatggacagaagggcctcaagaactgtgatgtgtttgatcccgtgacaaaactgtggacgagttgcgcaccgctcaacatccgtagacatcaaagcgcagtctgtgagctgggcggctacctctacattatagggggcgccgaatcctggaactgtttaaacacagtcgaaagatataatccggagaacaatacctggaccctcatagcccctatgaatgtcgctcgcagaggcgctggggtagccgtgctcaacggtaagctattcgtatgcggcggattcgacggttcacatgcgataagttgcgttgagatgtatgatccgaccaggaacgagtggaagatgatgggaaacatgacctcgccccgaagtaatgcgggcatcgcaaccgtgggaaacacaatttacgcggtgggaggcttcgatggcaatgagtttctcaacaccgtggaagtgtacaacctggaatcaaacgagtggtccccttacactaaaatcttccagttttag

SEQ ID NO: 15801 - DNA, 483 bp, Artificial Sequence
  Description of Artificial Sequence: Synthetic coding sequence
atgaacaatgcaaggtacctgtggaaaagaattccccctgctatcaaaagtgcgaactcagagttaggggggatctggtctgtgggtcagcggatatggcaaagagactttcccggtatctacacgaccatcaacgcacatcagtggagcgaaaccgttcagcccattatggaggctcttagggacgctacacgtcgacgagccttcgccctggtgagccaggcctatacttccattatagccgatgatttcgcagcgttcgtggggctgcctgtcgaggaagctgttaagggcatcctggaacagggctggcaagccgactctactacacgcatggtgctcccaagaaagcccgtcgcaggtgccttggacgtgtccttcaacaaattcattcccctgtccgaacccgctccagttccccctatcccgaatgaacagcagttggcccggttgaccgactacgtggcattcctggaaaattag

SEQ ID NO: 15802 - DNA, 927 bp, Artificial Sequence
  Description of Artificial Sequence: Synthetic coding sequence
atgatggaagagatctccataatggtggcttacgacgcgcacgtattctctcaacttcacgacgaagacttcctgaccagcctagtggctatctccaaaccgcgctcaatggttcctacgaaaaagttgaagaagtacgaaaaggagtatcagactatgcgtgagtctcagcttcaacaagaagatcctatggatcggtataaaagggaaaaccgccggctccaggaagctagtatgagattagagcaggaaaacgacgatctggctcacgagctggtaacaagcaagatagccttacggaacgatcttgatcaagccgaggacaaagctgatgtgttaaacaaggagcttctgttgaccaagcagcgtcttgtggagaccgaggaggagaaaaggaagcaggaagaggagaccgcccaattaaaagaagtgttcagaaagcagctcgaaaaagctgagtacgagatcaagaagacaactgcgatcattgccgaatataaacaaatctgttcccagctgtctacccgcctagagaaacagcaagctgccagtaaagaggaattggaggtcgttaaggggaagatgatggcttgtaaacactgctctgatatttttagtaaggagggtgctctcaagctcgccgctacaggcagagaagatcaagggatagagacggatgatgaaaaagatagtttgaaaaaacagttgcgagaaatggaattagagttggcacagactaagcttcagttggtagaagccaagtgcaagatccaggagttggagcatcagcgcggcgcactcatgaatgaaatccaggcagcgaagaatagctggttttctaagactttgaatagcataaagaccgcaactggcacgcagcccttgcagcctgcccccgtaactcagccaccaaaagaaagtacctag

SEQ ID NO: 15803 - DNA, 3600 bp, Artificial Sequence
  Description of Artificial Sequence: Synthetic coding sequence
atggccagcgccggtactcagcattatagtatcggactccgacagaaaaattccttcaagcaaagcggacccagcggaaccgtcccagccaccccaccagaaaagccaagcgaaggccgggtgtggccccaggcgcatcaacaggttaagcctatttggaagctagaaaagaaacaagttgagacgctgtccgctgggctcggacccggcttattgggcgtccccccccagccagcttacttcttttgcccatccacgctgtgcagctccggtaccacagcggttatcgctggacatagttcttcctgttacctccattctctgcccgatctgttcaattcgacgctcttgtaccgtcgctcatcgtacaggcagaaaccatatcaacagctcgagagtttttgcctccggtcatccccaagtgagaaaagtccattctcgctccctcagaagtccctgcctgtgtctttaaccgcgaacaaggcaacatcctcaatggtcttctccatggcccaacccatggcgtcatctagtacggaaccatacctttgcctcgccgcggctggcgagaacccatcaggaaaatccctagcatcagccatcagtgggaagattcccagccctctaagttcatcctacaaacccatgctgaacaataactcttttatgtggcccaactcaacccctgtacctttgctgcagaccacccaagggttaaaaccagtgtccccaccaaagatccagcccgttagctggcaccattctggtggcaccggagactgtgcgccacagcctgtcgatcataaggtgcccaagagcatcggcacagttcccgccgatgccagtgcccatatcgcactgtcgaccgcttcctctcacgacacttccactacatctgtggcatcttcctggtataatcgcaacaacctcgctatgcgcgctgaacctctgagctgtgcgctggacgattcaagtgacagtcaggatcccactaaggagatacggttcacagaagccgtccgcaagctgaccgccagggggtttgagaaaatgcccaggcagggctgtcaactagagcagtcctcctttctgaaccctagtttccagtggaatgtgctgaaccgctccagaaggtggaagccgcccgcggtcaatcagcaattcccccaggaggacgcaggctccgttcggcgagtcttgccaggtgcttctgacactttgggactggacaacaccgtgttttgtacaaaaagaatttccattcacctgctggctagtcatgcgtcgggactgaaccataaccctgcgtgtgaatccgttatcgatagcagtgctttcggagagggcaaagccccagggccaccttttccacagacactaggaatagctaacgtggccaccaggctttcatccatccaacttggccagtccgaaaaagaacggcctgaagaggcacgcgagctggactccagtgacagagacatctcttcagccacagatttgcagcccgaccaggctgaaacagaggacactgaagaggagctggtggatggcttagaagactgttgttcgcgggacgaaaatgaggaggaggagggcgactctgaatgttctagtctgagcgctgtaagcccgtccgaaagtgtggctatgatctccagaagctgcatggaaattctgactaaaccattgtcgaatcacgagaaggtggtgagacctgctttgatctattcattgttcccaaatgttcctcccacaatttattttggaaccagagatgagcgggtagagaaattgccatgggagcagcggaaactgctccgctggaaaatgtccaccgtgacgcccaacatcgtaaagcagaccatcggccgatctcattttaagatcagcaaacgtaacgatgattggctgggttgctggggccatcacatgaagtctccctcgtttcgaagtatccgcgaacatcagaaattgaaccactttccaggatcttttcagattggacgaaaagatcgcttatggcgcaacctgtccagaatgcagagtcggttcggaaaaaaggagttttcattctttcctcagagttttatcctgccgcaggacgctaaactcctacgcaaagcatgggaatctagctctcggcagaagtggatagttaaacctccagcgagcgcccgcgggatcggaattcaagtcatccacaagtggagtcagttgcctaagaggaggccactcctggtgcaaagataccttcataagccatacctgatatcaggcagcaaatttgaccttaggatctatgtgtacgtgactagttacgatcctctcagaatctatctcttctcagacggcctcgtgaggtttgcatcttgcaaatattctccgtcaatgaagtcgttgggtaataaattcatgcacctgactaattattcagtcaacaagaagaacgccgaataccaggcaaacgcagatgagatggcctgtcagggccacaagtgggccctgaaagctttgtggaactatctgagccagaagggcgtcaatagcgatgccatctgggaaaagattaaagacgttgtagtgaagactatcatttcgagcgagccttatgtaacttctctcctgaagatgtatgtgcgaagaccgtactcctgccatgaactgttcggcttcgatatcatgctcgacgaaaatcttaaaccatgggtgttggaggtgaacatttctccttccctccattcttcttctccattggatatctcgattaaagggcagatgattcgcgatctccttaatcttgccgggtttgtattgcctaacgccgaagatatcatctcgtcccctagtagctgctccagttccacaacctctctacccacatccccaggagacaagtgtcgaatggccccagagcacgtgactgcccagaagatgaaaaaggcttactacttaacacagaaaattcctgatcaggatttctatgcaagcgtgctcgatgttctgacccccgacgatgtaaggatcctggtagagatggaggacgaattcagcaggagaggacagtttgagcggatcttcccgtcccacatttcctcccgatacctgcggtttttcgagcaacctagatattttaacatcctgacgactcagtgggagcagaaataccatggcaacaaacttaaaggggtcgacctgctgcgttcttggtgttacaaaggatttcatatgggagtagtcagcgattccgcccccgtatggtccctgcccacatcactactgacgatctcaaaagatgatgtgatcctgaacgctttctctaaaagtgaaacatcaaagcttggcaagcagtcctcttgcgaggtctcgctactgctgtctgaggacgggactacacccaagagtaagaaaacccaagccggactgtctccatatcctcaaaaaccatctagtagtaaggatagtgaggacacctctaaggagccttcgctgagcacccaaaccctgccagtgatcaaatgtagtggccaaaccagtaggctgtccgcctcttctaccttccagtccatctccgactcgctactggcggtgtctccttag

SEQ ID NO: 15804 - DNA, 2337 bp, Artificial Sequence
  Description of Artificial Sequence: Synthetic coding sequence
aggatccaagagcagctcgaatcatcttttactggactgacagacgaaaaggtcaaggcttacctatccctgcatccccaggttttagacgagtttgttagtgaatcagtgtctgcagagacagttgagaaatggttgaagaggaagaacaacaaaagtgaagatgaatctgcccccaaagaggtgtcgcgatatcaagatacaaacatgcagggcgtggtgtacgaacttaattcatatattgagcagcgactcgacactgggggtgacaatcagctgttgctttatgagctttcatccatcatcaagatcgcaactaaagcagatgggtttgcactgtacttcctgggcgagtgcaataacagtctctgcatatttaccccgcccggcattaaggaaggcaaacccaggctcattcctgccggacctatcacacaaggtacaactgtatctgcctacgtcgcaaaatcccggaagactctgctggtggaagatatcctgggcgacgagcgttttcccagaggcactggactggagtctggaacacgcatccagagcgttctgtgtctgccaattgtgactgcaataggggatctgataggtatcctcgaactatatcgacactgggggaaggaggctttttgcctaagccaccaggaagtggccacagcaaatctcgcgtgggccagtgtggctatacatcaggtccaggtatgcagagggctggcgaaacagaccgagttgaatgactttctcctagatgtttcaaagacctacttcgacaacattgtagctatcgacagcctactagagcacattatgatttacgccaagaatcttgtcaatgccgacaggtgcgctctcttccaggtcgaccacaaaaataaagaactatattcagatctgtttgacatcggggaggagaaggaggggaaacccgtctttaaaaaaactaaggaaataagatttagcattgaaaagggtatcgccgggcaggttgctagaaccggggaggtgcttaatatccccgatgcctatgcggatccccggtttaacagggaagtagacctgtacactgggtataccacccggaatatcctgtgtatgccaattgtttcaagaggaagtgtgatcggggtggtgcagatggtgaataagattagtggctccgccttcagcaagacagacgaaaacaattttaaaatgtttgctgtgttctgcgcactcgctctgcactgcgccaacatgtatcatcgaattcgccacagcgagtgtatctaccgtgtgacaatggagaaactcagctatcattcgatttgcacctccgaggaatggcagggcctgatgcagttcacccttccagtgcgcctttgtaaggagatcgagcttttccactttgatatcggacctttcgaaaacatgtggcctggtattttcgtctatatggtgcatcggtcttgcggaacctcatgttttgaattggaaaaactgtgtaggttcataatgagcgtcaagaaaaactatcggcgtgtcccctaccacaactggaagcacgctgttactgttgcgcattgcatgtacgctatccttcagaataaccacactctcttcaccgatctcgagcggaaaggcctcttaatcgcttgtctgtgtcatgacttggatcaccgagggttttccaattcttatctgcagaaattcgaccacccactggccgccctgtactctacttctacaatggagcaacaccacttcagccagaccgtgtctatcttacagctggagggacataacatctttagtactctgtcttccagtgaatacgagcaggttctggaaattatccgaaaggccattattgctactgacctggcgctctactttgggaacaggaagcaactggaggagatgtaccaaaccggtagtctgaacctcaacaatcagtcacatcgggacagggtgatcgggctgatgatgaccgcgtgcgatttgtgttcagtcacaaagttatggcctgtcaccaagttgacggctaacgacatctacgccgaattttgggctgagggagatgaaatgaaaaaactggggatccagcccatccctatgatggaccgcgacaaaaaagatgaggtcccccaaggccagctcgggttctataatgctgtggctattccttgctacacgactctgacacaaatccttccaccgaccgaacccctgcttaaggcatgtcgggacaacctctcccagtgggagaaagtgatccggggagaagagacggccacatggatctctagcccatcggtggcccaaaaggcggccgcctctgaagactag

SEQ ID NO: 15805 - DNA, 1281 bp, Artificial Sequence
  Description of Artificial Sequence: Synthetic coding sequence
atgtggccactgacagcactattgctcctcgtgccctctagcggccaggcggcaaccctggagaaaccaatactgagtctgcacccaccctggactacgatttttaagggggagagagtgaccctcaagtgcgacggataccatcccctgctccttgagttacaacctatatccactctatggtaccttggacatttgttgctgccatcccacaaaaaatctattgaggttcagacacctggagtataccggtgccagacccggggcgcccctgtgtctgaccccatacacctgagcgtgagtaacgactggctgatcttacaggtcccctatgcgcccgtctttgagggtgaaccactcgtgcttcgctgccggggttggtatgataaggttgtctataagctccactattatcacgacggccaagctgtccgctatttccactcatctgcgaactacacagtgctgcaggcgcgagccagcgattccggcaggtatcaatgctcaggcactatgcgaatcccagtggaaagcgccccaatgttctctgcaaaagttgcggttacggtgcaggagctctttcgcgcccccgtgctccgggtaatgggtcctagggaggctcgcggggccgcccttggcggagtggttctgcgttgtgacactcggttgcaccctcagaaacgtgacacaccactgcagtttgcattctacaaatattccagagcggtgaggaggttcgactggggagctgagtataccgtcccggagcccgaggtcgaggaattggaatcatattggtgtgaagcagccactgctaccagatccgtgagaaaacggtcaccttggctacaacttccgggcccaggctcaccacttgatccggcatcgacaactgcccctgcaccatgggctgctgcgctggcaccgggtaacaggccactgtctttccgtaagcctcctgtcagtcggagtgtcccgctcgttactagcgtgcgcaacactacaagtacaggattgcagttccccgcctccggggcacctacagccggccctcccgcgtgtgctcccccaacccccctcgagcagtcagctggggcgctgaaacccgatgtggacctcctgctacgggaaatgcagctgctcaagggcttattgagtcgggtcgtcctggagctgaaagagccgcaggctcttcgcgaattgagaggcactcccgaaacaccgacttctcatttcgcggtgtcacccgggactcccgaaacaactcctgtagaaagctag

SEQ ID NO: 15806 - DNA, 1779 bp, Artificial Sequence
  Description of Artificial Sequence: Synthetic coding sequence
atggacgtcatgctggaaaactattgtcacctgatctctgtgggctgtcacatgacaaagccagatgtgatcctgaaactcgagcgtggagaggagccctggacctcattcgccggccatacatgcttggaggaaaattggaaggctgaagatttcctcgttaaattcaaggagcatcaggagaaatacagcaggtcggtggtgtccattaatcacaagaagctggtgaaggaaaaatcaaagatttatgagaaaacgttcaccttgggcaagaacccggtgaattccaagaatctacctcccgagtacgacacacacggcaggatccttaagaacgtgtccgagcttattatctcaaacctgaaccctgccaggaagcggctgagcgagtacaacggctacgggaaatctctcttatctaccaagcaagaaactacccaccccgaggtgaaaagtcacaaccaatccgctcgtgccttcagtcataatgaggtgttgatgcagtaccaaaagaccgagaccccggctcagtctttcggttataacgattgcgaaaagtctttcttgcagcggggtgggctgatcacccacagtaggccctacaaaggcgagaaccctagcgtctacaacaagaaaaggcgggcaactaatatagagaaaaagcatacatgcaacgagtgcggaaagagcttctgtcggaagagtgtgctgatcctccaccagggaatacacagtgaggagaaaccttaccagtgtcaccaatgtggtaacgcatttcgccgcaagagctacctgattgaccatcagaggactcatacaggtgaaaaacctttcgtgtgtaacgagtgcgggaaatcattcaggttgaagacggcactcacagaccaccaacggactcacacgggcgagaaaagttatgagtgccttcaatgtcgcaacgcattccggctaaagtcccatctcattcggcaccagcgcacccacactggcgaaaagccctacgagtgtaacgattgcggtaagtcattccgccagaagaccacactgagtctgcatcagaggatccataccggcgagaaaccctatatctgtaaggaatgcggaaaaagttttcaccagaaggcaaatttaacagtccaccaaaggactcacacgggggaaaaaccctacatctgcaacgaatgtggcaagagtttctcgcagaaaaccaccctcgctctgcatgaaaaaacccacaatgaggaaaagccttatatctgttccgaatgcggtaagagttttaggcagaaaacgaccctggtcgcccatcaacggacccatacaggggagaagagttatgaatgccctcattgcgggaaagccttcaggatgaaaagttacttaatcgatcaccaccgcacacacacaggagaaaaaccgtacgaatgtaatgaatgtggtaagtcattttcccaaaaaacgaatctgaacctccaccaacggattcatacaggcgagaaaccgtatgtgtgtaatgaatgtggaaaatctttccgacagaaggctacactcactgtgcaccagaagatccatactggtcagaaatcctatgagtgtccccaatgcggcaaggcttttagtcggaagtcatacctcatccatcaccagcgcactcacactggggagaaaccatacaaatgcagtgagtgcggaaaatgcttcaggcagaagactaaccttatcgtacatcagagaacacacactggtggcgaggacggcctcacaggctgccttagttag

SEQ ID NO: 15807 - DNA, 645 bp, Artificial Sequence
  Description of Artificial Sequence: Synthetic coding sequence
atggaggtgactggggtatcagctcctactgtaaccgtgttcattagcagtagtctaaacacattccgcagcgagaagcggtattctagaagtctcactatagccgaatttaaatgtaaacttgagctgctggtgggctctcccgcttcctgcatggagctcgaactttatggggtggatgacaaattctatagcaaactcgaccaagaggatgcattgctcggatcatatcccgtggacgatgggtgccgcattcacgtgatcgatcactcaggagctcgtctcggtgagtacgaggacgtgtctagggttgagaaatacactatttcccaggaggcctatgatcagcgtcaagataccgtgaggtctttcctgaagcgaagcaagctgggcagatataatgaggaggaaagagcccaacaggaggccgaggccgcacagcgtctagcagaggaaaaggcacaagcttcgtctatacccgtcgggagcagatgcgaagttcgagccgcagggcagagcccacgccgcgggactgtcatgtacgttggcgcctggctcgccggacctgttccgggatcccgggctcctagaccgggtgggaacgtgggaggaacagtggagccacgccgcccgcggtccgcttag

SEQ ID NO: 15808 - DNA, 189 bp, Artificial Sequence
  Description of Artificial Sequence: Synthetic coding sequence
atgagcatccaatggaaaacccgacagctgcagtccaaactgcacgaagccgacattgtcgttctgggctcccctaagcccgaggagatacccctgacctggattcaacccggcacaactgtcctaaactgctcacacgactttctgtcagagagcctcatcatcattagacgaatggctatcttctag

SEQ ID NO: 15809 - DNA, 1269 bp, Artificial Sequence
  Description of Artificial Sequence: Synthetic coding sequence
atgtaccccaatcctctaatttactgtacctgttgggacccctggaacctcggtcctcgcaagctgatcaagactcctcagttgccacgtaaaaattctactggttcttctaaattgactcccctggttccagcccccaaaaatcacaactacctccaacccacgaaacctgtcgtatccccaaagatgaagattcattctgccaggcaggaggaaacaaataagtccttctatgaggttataaatgtgtccccagggtatcagctggtgaggaacagagagcaaatctccgtcacactcggggatgaaatgtttgatcgaaaaaaaaggtgggaaagcgagatccccgacaaagggaggttcagtaggactaatataattagtgatctggaggaacaaatctctgagctgactgccatcatcgagcagatgaatcgagaccaccagtcagcccagaaactgctcagctcagaaatggatctgcgatgcgctgaaatgaaacaaaacttcgaaaataagaatagggaactcaaggaggcccacgaagcagagttgagcgagctggaaaacaattacaaggccgcattaaaagcagagaaattggcagcccaggaaaaactggaggagatggggaaagagtacaagtacctaaagaatatgttcaggacctatcaagacagtatctatgacgagatggaagaaaaatggagcaagcagaaggctaagtggaagaaagacgagaagttcgaacgagagaacatcctgcttcagcagaaaaagaagatgacaaaaaagtttgagatggaaagcggggaggaggataagaaaataaacgaatcttgtagcgccgtttttgaaaatttcatacaggaaaaggaggaattgctgaaacagcaccaaagcgacacactgcaactggaagaactgcggaaaactaaggaagtgatgcaggaagagttgcacgcccaagccctgattttggaaagcctaaacaccaacctgtactatacgcagctggagctgcaaaaggagaaggccatcgtcggtaacctggaaaaaatgctccagacaaagttcgctgagactgaggagaagtataagcatactattcagatccttacagaagaaaatatccatctgaagcaaaagatcatctccaagaatgaagagatctgtgaaggttgtagtggccgacttgcttctatcaccgtcagcaaagatgactccgatacagtgcaggacggtagcaaaaagggacaggaatcctag

SEQ ID NO: 15810 - DNA, 1380 bp, Artificial Sequence
  Description of Artificial Sequence: Synthetic coding sequence
atggtcccttttggcccctttgctttcatgcccggcaaactggtccatacgaacgaggttaccgtcctccttggtgataattggttcgcaaaatgttcagccaaacaggccgtcggtctggtagaacatcgaaaggagcacgttagaaagaccatcgacgatttaaagaaggtgatgaagaattttgaaagtagagtcgaatttaccgaggacctccaaaagatgagcgatgctgccggtgatatcgtggatattcgtgaggagattaagtgcgattttgagttcaaggccaagcaccggattgctcacaaaccccattccaaaccaaagacgagtgacattttcgaggccgacattgcgaacgatgtgaagtctaaggatcttctggcagacaaagaattgtgggcacggctcgaggagctggagaggcaggaggaattgctgggagagctcgatagcaaaccggatacggtcattgccaatggcgaggacacaacaagttctgaagaagaaaaggaagatcggaatacgaacgtgaatgctatgcaccaggtaacagacagccacacaccgtgtcataaggatgtggcgtccagcgaacctttctcaggccaggtcaacagtcagttgaactgctcagtaaatggatcctcctcttatcattcagacgacgacgacgatgatgacgacgatgatgacgatgataatattgacgatgatgatggagacaacgatcacgaagcactaggggtgggggataattctataccgaccatctatttttcacatacagtggaacctaagagagtgcggattaacactggaaagaacaccaccctcaaattctccgagaagaaggaggaggccaaaaggaagaggaaaaacagcaccggttctggacactccgcacaggagctccccacaattagaacgcccgcagacatttaccgcgcgtttgttgatgtggtgaacggtgaatatgttcctcggaaaagcatcctaaaatcccgatcaagggagaacagcgtctgcagcgacacttcggagtcttccgccgccgagttcgacgataggaggggggttcttcgctctatcagttgtgaagaagctacctgctcggatacctccgagtccatattggaagaggagccccaagagaaccagaagaaacttttgccccttagcgtcactccagaagctttttctggcacagtgattgagaaagaattcgtcagccccagtctgaccccccctcccgccatcgcccatccagcactgcccacgattccagaacgcaaagaagtgctcttggaggcctctgaagaaaccggaaagcgggtgagtaagtttaaagccgcgagattacagcaaaaagactag

SEQ ID NO: 15811 - DNA, 1068 bp, Artificial Sequence
  Description of Artificial Sequence: Synthetic coding sequence
atgcgcgagatcgtccacatccaggctggccagtgtggcaatcagattggagcaaagttctgggaagtgataagtgacgaacatggaatcgaccccaccggctcataccatggagatagtgacctgcaactgttgacacatagtctgggcgggggcacaggaagtggaatgggaacgttgctgatttcaaaaatccgggaagagtacccggaccgcattatgaatactttttctgtgatgccttcccccaaagtgtccgatacggtggtggagccatataacgcgaccctgtccgtacaccaactggttgagaataccgacgagacatattcaatagataatgaagcactctacgacatttgttttagaaccctgaagctgaccactccgacatatggagacctcaaccacctagtgtcagctacaatgtctggcgttactacctgtctgagattcccggggcagctgaacgccgacttaagaaaattagccgttaacatggtaccctttccacgactccatttcttcatgcctggcttcgcacctctgacctcccgagggtcccagcagtatcgtgccctgacggttccagaactgacccagcagatgttcgattccaagaatatgatggcagcctgcgacccccgccatgggcgatacttgaccgtggccgcaatctttcgggggagaatgtcgatgaaagaagtggacgaacagatgctgaacgtgcagaacaagaatagttcctactttgtcgaatggattcccaacaacgtcaagaccgccgtgtgcgacatccctcccaggggcctcaaaatgagtgccacttttataggcaacagcacagctattcaggagctgttcaagcgcatatctgaacagtttactgcgatgtttagaagaaaggctttcctgcattggtataccggcgagggaatggatgaaatggagttcacggaggccgagtccaatatgaatgacctggtcagcgagtatcagcagtaccaagatgcaacggccgatgagcagggagagtttgaagaggaggagggcgaggacgaggcctag

SEQ ID NO: 15812 - DNA, 255 bp, Artificial Sequence
  Description of Artificial Sequence: Synthetic coding sequence
atgaaggtgaaaattaagtgctggaatggagtggccacctggctctgggtggccaacgacgagaactgtggtatttgtaggatggctttcaatggctgttgtccagattgcaaggtccccggcgatgattgcccattagtctggggacaatgtagtcactgtttccacatgcactgtatattgaaatggttgcatgcccagcaggtgcagcaacactgtccaatgtgtagacaggagtggaagtttaaagagtag

SEQ ID NO: 15813 - DNA, 1416 bp, Artificial Sequence
  Description of Artificial Sequence: Synthetic coding sequence
atgaagatgcaggtgttttgcaagagtattgaggatatgaccgtgaaggcggaacagagccaacaggaggccgccaagaaacatgaagaagagaagaaggaactggaaagaaagttgtctgatttggagaagaaaatggagaccagccacaatcagtgccaagagctcaaagcccgctacgaaagagcaacatctgagaccaaaacaaagcacgaggaaattctccagaatcttcagaagacactcctggacactgaagacaaacttaagggggccagggaagagaattcgggcctgctccaggagctggaggaactgaggaagcaagccgacaaagcgaaagcagcacaaaccgccgaggacgcgatgcagattatggaacagatgacaaaggagaagactgagaccctcgcctctttggaagacactaaacaaacgaacgccaaactccagaacgaattggacacactgaaggagaataacttaaaaaacgtcgaggaactgaataagtcaaaggagctccttactgttgagaatcagaaaatggaggaattccgcaaggagatagagacactcaagcaagccgcagcccaaaaatcacagcagttgtccgctttacaggaggaaaatgttaaattggcggaagaacttgggagatcaagagacgaggtgacgtcgcatcagaagctcgaagaggaaagatcagttttaaacaaccaactgctggaaatgaaaaagcgtgaaagcaaatttatcaaggatgccgacgaagagaaggctagtctccaaaagtcaatcagcatcacttccgctctgctgaccgaaaaagacgccgagttagagaagctgcgcaatgaggtgaccgtgctaagaggggagaacgctagtgccaagagcttacattccgtagtccaaaccttggagtccgacaaggtgaagttagaattgaaagttaaaaacttggagttgcagttgaaggaaaacaagcgccagctttcttcttcgtcaggaaacacggacacacaagccgacgaagacgaaagggctcaggagtctcaggtcatgattgactttctaaatagcgtcatcgtagatctccagcgcaagaatcaggatctcaagatgaaagttgagatgatgagcgaggctgcactgaatggcaatggtgacgacctcaataactatgactctgatgatcaagaaaaacagtcaaaaaagaaaccccggctgttttgcgacatttgcgattgcttcgatctgcacgacactgaagattgtccaacacaagcccagatgagcgaagacccaccacattccacccatcacggcagtcggggagaggagaggccttattgcgagatctgtgaaatgtttggacactgggctaccaactgcaacgatgacgagaccttttag

SEQ ID NO: 15814 - DNA, 1602 bp, Artificial Sequence
  Description of Artificial Sequence: Synthetic coding sequence
atgagcagctgtgtgtcctcccagcctagctccaatagggcagccccacaggacgagctcggaggaagggggagctctagcagcgagtcacaaaaaccatgcgaggccttaagagggctgtccagtttgagcatacatttagggatggaaagcttcatcgtggttacggaatgcgagcctgggtgcgcagtagatctcggtctggctagagatcgtcctctggaggccgacggtcaagaggttcccctggataccagcgggagtcaggccaggccacatttgtctggaagaaaactttctttgcaagagagatctcaagggggtcttgctgccggcggaagcctggacatgaatggtaggtgtatctgtcccagtctcccctatagccctgtgtcaagcccacagtccagtcctcgcctgccccgacggccgaccgtggagtcacatcacgtgtctatcacgggcatgcaggattgcgtgcagctgaatcagtacaccttgaaggatgagatcggaaagggaagctacggtgtagtcaagctggcttacaatgagaatgacaatacatactatgccatgaaagtgctgtcgaagaaaaaattaatccggcaagctggattcccacgcagacccccccctaggggtacacgaccagcacccggaggctgtatccagcctaggggcccaatcgagcaagtgtaccaggagatcgccatcctcaagaaacttgaccatcccaatgtcgtgaagctggtcgaagtcttggacgaccctaacgaggatcacctgtatatggtctttgaattagtgaaccagggccctgtcatggaagtaccgacactgaagcccctgtctgaagatcaagcccggttctactttcaggacctgattaaaggcatcgaatacctacattaccagaagattatccatcgcgatattaagccttccaacttgctcgtgggcgaggatggtcatatcaagatcgcagacttcggggtttccaatgagttcaagggttccgacgctcttctgtccaatacagtgggcacgcctgctttcatggcccccgaaagcctgagcgaaacacgtaagatctttagcggtaaagcattggacgtgtgggctatgggggtgacattatattgttttgtattcgggcagtgtcccttcatggacgaaagaattatgtgcttgcattccaaaatcaaatctcaggctctcgagttcccagatcaaccagacatcgcagaagatttgaaggacctgattacgcgcatgttggacaaaaatccagaatctcgcatagtggtgcccgaaatcaaactgcatccctgggtcactcgccatggcgccgagcctcttccgtcagaggacgagaattgcacattagtcgaggttacagaggaggaggtggaaaattctgttaaacacataccatcactggccactgttatccttgtgaaaacgatgatcagaaagagatcattcggaaatccatttgaaggctcacgaagagaggagcggagtttgtctgcacccgggaatctcttgacaaaaaaacccactcgggaatgcgagagtctcagtgaattaaagacttag

SEQ ID NO: 15815 - DNA, 1671 bp, Artificial Sequence
  Description of Artificial Sequence: Synthetic coding sequence
atgtcgtcatgcgtgtccagccagccctcaagtaatagagccgccccccaagatgaactgggtgggcgcgggtcgagcagctccgagtcacagaaaccctgtgaagcactccgtgggctaagtagcctgtctatccacttgggaatggaaagctttatagtcgtgacagagtgtgagcccggctgtgccgtggatttgggccttgcccgtgaccggcccttggaggctgatgggcaagaggttccactggacacgtccggttctcaggcacggcctcatctatccggacgaaagctttctctgcaggaaagaagccaagggggtctggccgctggaggcagtttagacatgaatgggagatgcatatgtccttcattaccctactcacctgtctccagtccccagtcttccccaagattgcctcgaaggcctactgttgagtcccaccatgtgagtattaccggcatgcaagactgcgtccagctgaatcagtatacgttaaaagatgaaatcggtaaggggagttacggggtggtaaagcttgcctacaacgaaaatgacaacacatactacgccatgaaggtcctgagcaagaagaaactgattcggcaagctggattccctagaaggcccccacctaggggcacccgcccggccccagggggttgtatacagccaaggggtcctattgagcaagtgtaccaggagattgccatcttgaagaagctagatcacccgaatgtcgtcaaactagtagaagtcctggacgacccaaatgaagaccacctgtacatggtgttcgaactggtgaatcaggggcccgttatggaagtgccaacgttaaagcccttgagtgaggatcaggcacgattctatttccaggacttgattaaggggatagagtatctacactaccagaaaatcatccaccgcgatattaaaccctctaacctgctggtgggagaagatggacacattaagatagccgattttggagtgtctaacgagttcaagggaagtgacgccctgttgagcaacaccgtcggcacacctgctttcatggctccagagagtctatccgagacaaggaagatcttctccggtaaggccttagacgtttgggcaatgggcgtaacattatattgtttcgtgtttggacaatgcccatttatggatgaaaggattatgtgccttcactcaaagatcaagtcacaggctctggaattcccagatcaaccagacattgctgaagatttaaaggacctcattaccaggatgctcgataagaatcccgagtcccgtatcgttgtccccgagattaaactgcacccatgggtgacccggcacggcgccgaacccctgccgtcagaggatgagaactgcactctagttgaagtgaccgaggaagaggtggaaaattcagtcaagcatattcctagtctcgccaccgtcattttggtcaagaccatgattagaaagcgctcattcggcaacccatttgaaggcagcaggcgcgaggagcgaagcctgtccgcccccggaaatctgcttacgaagaagcccactcgggagtgcgaatcactcagcgagttaaaaggtactaagaaaaaaaagggccttgattccatgacatccaccgtcgccgccgggtggctcgatcggagggtgtag

SEQ ID NO: 15816 - DNA, 309 bp, Artificial Sequence
  Description of Artificial Sequence: Synthetic coding sequence
atgctgagcgaggaagagaaagaggaattgaaggccgagctggttcagctagaggatgaaatcacaaccctgcgacaagtgctgagcgcgaaggagagacacctggttgagatcaagcagaagctgggtatgaacctgatgaatgaattgaagcagaatttctccaagagttggcacgacatgcagaccacaacagcatacaagaagacccacgaaactttgtcacacgcagggcagaaggcaacagctgcttttagcaacgttggaaccgcaatcagtaagaaatttggagacatgcggagaaaatag

SEQ ID NO: 15817 - DNA, 615 bp, Artificial Sequence
  Description of Artificial Sequence: Synthetic coding sequence
atggaagccgaacccaagggccttctggagacagagcccctacagggaactgacgaggacgcggtggcatccgccgatttttcttccatgcttagcgaggaagagaaagaagagctcaaggctgagctcgtccagctggaggatgagattacaaccctgagacaggttctgagcgccaaagaaagacatctagttgagatcaagcaaaagttgggtatgaatctgatgaacgagttgaagcagaatttctcaaagtcttggcacgacatgcagactaccactgcgtataaaaagacacatgaaacccttagtcacgcagggcagaaagcaactgcggcttttagcaatgttgggaccgcgatcagtaaaaagtttggcgacatgagctactctatcagacactcgattagcatgcccgcaatgcgcaactcgcccactttcaagagctttgaggaacgggtcgaaaccacagtgaccagtcttaagacgaaagtcggcggtacgaacccaaatggtggctcctttgaggaggtgctctcttcgacggctcacgcaagtgctcaaagcttagcaggaggatccagacgaaccaaagaggaggaacttcaatgttag

SEQ ID NO: 15818 - DNA, 369 bp, Artificial Sequence
  Description of Artificial Sequence: Synthetic coding sequence
tgatacctggtcgccctgggttgcatcaagccactgtgcgacctgctcaccgtaatggatagcaaaatcgtgcaggtcgccctgaacggcttggagaacattcttcgcctcggcgaacaagagtcgaagcagaacggcatcggtattaatccctactgcgccctgattgaagaggcctacgggttagacaagatcgaattccttcaatctcacgagaaccaggaaatataccaaaaagctttcgacctcattgagcactactttggagtggaagaagacgacccaagtattgtacctcaggtcgacgagaatcaacagcaatttattttccagcagcaagaggcccctatggacggttttcagctgtag

SEQ ID NO: 15819 - DNA, 1137 bp, Artificial Sequence
  Description of Artificial Sequence: Synthetic coding sequence
atggaggtcaagccaccacccgggagacctcaaccagactccgggcgacgcaggcgccgacgtggagaagagggtcatgatccaaaagaaccagagcagttgcgtaaactgttcatcgggggactgagtttcgagaccaccgatgactccctacgggaacattttgaaaagtgggggactctaactgattgtgtggttatgcgagacccgcagacgaagaggtcgagaggctttgggttcgtcacctacagctgtgtggaggaagttgacgccgccatgtgcgcacgaccccacaaggttgacggcagggtggtcgagccaaaacgagcggtgtctagagaggactccgttaaaccgggggcccaccttactgtaaaaaagatctttgttggaggcataaaggaagataccgaagagtataatctcagggattactttgaaaagtacggtaaaatcgaaacgattgaagtgatggaggatagacagagtggaaaaaagagagggttcgctttcgttacgttcgacgatcacgataccgtcgataaaattgtggttcagaagtaccacaccataaacggtcacaactgtgaggtaaagaaagccctgtccaagcaagaaatgcagtccgctggcagccaaagaggccgtgggggcggttccggtaatttcatgggaaggggcgggaatttcggaggcgggggcggaaactttggtagaggcgggaatttcggggggaggggcggctacggaggtggtgggggcgggagtagaggtagctacggagggggggacggcgggtacaatggctttggcggagacggaggcaactatggaggggggccgggctattctagcaggggcggttacggcggaggcggcccaggctacggtaatcaaggcgggggctacggcggcggggggggttacgatgggtacaacgagggcggcaattttggcggaggcaattacggaggcggcgggaactacaatgacttcggcaactactcaggccaacagcaatccaattacgggcctatgaaaggaggatcttttggcggtagaagttctgggagcccctacggggggggatatggaagtggtggaggttccggcgggtatggcagccggcgcttctag

SEQ ID NO: 15820 - DNA, 3063 bp, Artificial Sequence
  Description of Artificial Sequence: Synthetic coding sequence
atgaggagatttctgaggccaggtcatgaccctgttagagaaaggttaaaaagagacctgtttcaatttaataaaacggtcgaacatggcttcccgcatcagccgtcagcactgggatattcgcccagcttacgcatactggccataggcacacgcagtggggctatcaagttgtacggcgcaccaggggttgaatttatggggttgcaccaggagaacaatgcagtgactcagatacacttgctgcccggtcagtgtcagctggtgactctcctggatgacaactctctccacctgtggtcattgaaagttaagggcggcgcctctgaactgcaggaagacgagtcattcaccttgcgcggaccgccaggagccgcaccctctgcgacccagatcacagtggtgctgccccattcctcctgtgaactgctgtatctcggaaccgagtccggcaacgtgtttgtggtacagctgcccgctttcagagctctcgaggatcgcacaataagttctgacgctgtgctgcaaaggctgcccgaggaagcccgccacagacgagtctttgaaatggtggaagccttgcaagaacatccgcgcgaccccaaccaaatcctcattggttactcacggggtctcgtggtcatctgggatttgcagggcagtagagtgttgtaccacttcctttcctctcaacagctggaaaacatctggtggcagcgcgacggtaggctgttggtgagctgtcactcagatgggtcatattgccagtggcctgtctctagcgaagctcagcagccggagccactccgcagcttggtcccttatggcccctttccctgcaaagcaatcactagaatcttatggcttaccacccggcaagggctccctttcaccatatttcagggcggcatgccccgcgcctcatatggcgatcgccactgtatttcagtgattcatgatggccagcagacagccttcgactttaccagccgggtaatcgggtttacagtcctgacagaagctgatcctgcggcaacatttgatgacccttatgcactcgtcgtcttagctgaagaagagttggtggtcattgatctccagactgccggatggcctcccgtgcagttgccgtacctggcttccctccattgctctgccattacatgctcacaccatgtttccaacataccacttaagctctgggagaggatcattgcagcagggtcccggcagaatgcacattttagcacaatggagtggccgatcgacgggggaactagtctcacaccagccccgccccagcgtgatctgctgcttactggacatgaagacggtacagtcaggttctgggatgcctccggggtgtgtctgaggctgttgtataagctctctacagtgcgagtttttctgacagatacagacccaaacgagaactttagcgcccagggcgaagacgagtggccgccattgcgcaaggtcgggagcttcgatccttactctgatgacccgaggctcggaattcagaagattttcctatgtaagtattcgggctatctagcagtcgcgggaactgctggtcaggttttagtacttgaactcaacgatgaagcagcggagcaggctgtggagcaggtggaggctgacttgctgcaagaccaggagggttaccggtggaaaggacatgagcggctggccgcgcggtccggccctgtccgctttgaacccgggttccagccgtttgtcctggtgcagtgtcaacctccggcagtcgtgacgagtctggcactgcatagtgagtggcggctggtggcatttgggacatcccacggattcgggctttttgaccaccagcagcggaggcaagtattcgtcaaatgcactctgcatccatctgatcagcttgccctagagggccccctgtcccgggtgaagtcactcaaaaagtccctaaggcagtcctttcgccggatgaggaggagtcgggtgagctcacgcaaacgacacccagcaggacctcctggagaggcccaggaggggtcagccaaagccgagcgaccagggctgcagaatatggaactggcaccggttcagagaaaaattgaggcccgcagcgctgaggacagctttacgggttttgtgagaacactctattttgccgacacgtacctaaaggatagctcccggcactgtcctagtttgtgggctggaaccaacggcggcaccatttacgccttttctctgagagtaccccccgctgaacggcgaatggatgagccggtgcgggctgagcaggccaaggagattcaactcatgcaccgggcccccgttgtgggcatcctggtgcttgacgggcatagtgtgccgctgcccgagcctttggaagtggcccatgatctctccaaatcccctgatatgcagggatctcaccaactcctagtcgtatctgaggagcaatttaaggtgtttactcttcccaaggtatcagccaaactgaagttgaagctgacggcgttagagggctctcgcgttcggcgtgttagcgtggcacactttggctccagacgggctgaggactatggcgaacaccacctggctgtgctgaccaacctcggagacattcaggttgtgagtcttcccctcttgaagcctcaggtcagatacagctgcatccgccgggaggacgtatccgggatcgcgagttgtgtctttacaaagtatggccagggattttacctcatttcaccctctgaatttgagaggttttctctgagcacaaaatggctagtagagcctagatgcctagtggattccgcggaaactaagaatcacagaccgggcaacggagccgggcccaagaaggccccatccagggcacggaacagtggtactcaatctgacggggaggagaaacaacctggtctggttatggagcgcgcactgctcagtgacgaacgcgttctgaaggagatccaaagcacactcgaaggagaccgaggctctggaaactggcggagccacagagccgcagtcggctgttccctatccaacgggggagcagaatag

SEQ ID NO: 15821 - DNA, 1458 bp, Artificial Sequence
  Description of Artificial Sequence: Synthetic coding sequence
atggcggcagagctttacgcacctgcctcagccgcagcagcggatctggctaattctaacgccggtgccgccgtgggccgcaaagctggccctaggtcacccccttcagcccctgctcccgcgccccccccaccggctcctgctccccccaccctgggcaacaatcatcaagagtctcctgggtggcggtgctgcagacccaccctccgagaacgcaacgcactcatgttcaacaacgaactgatggccgacgtccactttgtggtgggaccgccaggtgcaacccgcaccgtgcctgcacataagtacgtgctggccgtcggatcttccgtcttttacgctatgttttatggtgatctggctgaagtgaagagtgagatccatatccccgacgtcgagcccgcggcgtttctgattctcctgaaatatatgtattccgatgagattgaccttgaagccgataccgtactggcgactctgtacgccgccaaaaaatacattgtgccagcattggctaaggcttgtgtgaacttcttggagacttccctggaggccaagaatgcctgcgtgttactgagccaaagccgcctgttcgaagaaccagagcttacgcagcgctgttgggaggttattgacgcccaagccgagatggccctcagatccgagggattttgtgagatcgacaggcaaactttagagatcattgtcacacgagaagcccttaatacgaaggaggccgtggtgtttgaagccgtgctaaattgggccgaggctgagtgcaaacgccaggggttaccgatcacaccacggaataagaggcacgtgttgggcagggccttgtacctggtccggattcctaccatgacattggaagagtttgccaatggagctgcacagagcgatattctaacgcttgaagaaactcacagcatctttttgtggtatacagcaacaaataagccccgactggatttccctctaaccaagaggaaggggctggccccccagcgttgccaccggttccagagctctgcttatcgctctaatcaatggcgctaccgtggaagatgcgactctattcagttcgccgtggatcgacgagtctttatcgctgggttgggtctgtacggcagcagttcgggtaaggcggagtacagtgtgaaaatcgaactcaagaggctgggagttgttctcgcacagaacttaacaaaattcatgagtgacggctcttccaatacctttcccgtctggttcgagcatccagtccaggtcgaacaggacaccttttataccgcctcggcagtattagacggctctgagctgtcctactttggtcaagagggtatgacggaagttcagtgcggaaaggttgccttccaatttcagtgctcatcagatagcactaatggcaccggagtccaggggggccagatcccagagctcatcttttatgcttag

SEQ ID NO: 15822 - DNA, 2883 bp, Artificial Sequence
  Description of Artificial Sequence: Synthetic coding sequence
atgtcacggctcattgtgaagaacctgcccaacggtatgaaggaagagagattcaggcagctcttcgccgcattcggtaccctcactgactgtagcctgaaattcacaaaagatggaaagttccgtaagttcggctttattggattcaagagcgaggaagaagctcagaaagctcagaaacactttaacaagagctttattgacacgtcacggatcacagtcgagttttgcaaatcctttggggaccccgcgaaaccaagggcttggtctaagcatgcccagaaaccatcccaacccaaacagcccccgaaggattcaacaacccccgagattaaaaaagatgagaagaagaagaaagtcgcggggcagctggaaaagctgaaagaggacacggagtttcaggagttcctctcggtgcatcagcggcgagcccaggccgccacttgggcaaatgatgggctcgatgccgaacccagcaagggtaaatctaaaccagctagcgactaccttaacttcgactccgactccggccaggaatcagaggaggagggtgcgggtgaagacctggaagaggaagctagtcttgaacctaaggccgccgtgcagaaggagttgagcgacatggactacttgaagtcaaaaatggtgaaggctggatcaagttcttcctcggaagaggaagagtctgaggatgaggctgtacactgcgatgaggggtctgaagcagaagaagaggactcaagcgcaacccccgtgctgcaggagagggacagtaagggtgcggggcaggaacaaggcatgccagccgggaaaaagcgtccaccagaggcccgggcggaaactgaaaaacccgccaatcaaaaagaaccaaccacatgtcataccgttaagcttcggggggcgccatttaatgtgaccgaaaagaacgttatggaattcctggcccctctaaagcctgttgccatccgcattgtgcgcaacgctcatgggaataagacaggctatatatttgtggacttcagcaacgaggaggaagtgaagcaggctctaaagtgcaaccgcgaatacatgggtggtagatatatagaggtgtttcgcgaaaagaacgttccgactactaaaggggcgcccaaaaatacaacaaagagttggcagggtcgaatcctgggcgagaatgaagaggaagaagaccttgctgagtcgggcagactgtttgtcaggaacttgccatacacctctacggaggaagatctggagaaactgttctccaagtatggccccctatccgaactgcattatcctattgattccctgactaaaaaacctaaaggattcgctttcattaccttcatgttccccgagcacgctgttaaagcctatagcgaagtagacggccaagtgtttcaggggaggatgcttcatgttcttccgtcgacgattaagaaggaagctagcgaggacgcctcagcactgggctcttcgtcctacaaaaagaaaaaagaagcacaagacaaagcaaacagtgcctcttcccacaactggaacacactatttatgggccctaacgcagtagccgatgcaattgcccaaaagtataacgccacgaaatctcaggtgtttgatcacgaaacaaaaggctctgtggccgtgcgcgtggccctcggagaaacccagcttgtacaggaggtaaggagattcctaatagataacggggtgtcactggactccttttcacaggccgctgcagagagaagcaaaacagtaatcctggtcaaaaacctcccagcaggaaccctggcggcccagcttcaagaaaccttcggccattttggtagtttgggcagggtgcttctgcctgagggaggtataactgctatcgtcgaattcctggagccattagaagcacgaaaagcattcaggcatctggcctactccaaattccaccacgttccactttacctcgagtgggcccccgtcggcgttttcagctcaacggccccacagaaaaaaaagctgcaggacaccccctcagagccgatggaaaaggatccagccgagcccgagactgtccccgacggggagacgcccgaggacgagaacccaaccgaggaaggagccgacaatagctccgctaagatggaagaagaagaagaagaggaggaggaggaagaggagtctttgccaggatgcacactcttcattaagaatctcaactttgacacaaccgaagagaaactcaaagaagtcttctcaaaagtgggcaccgtcaagtcctgttccatttccaagaaaaagaacaaggcaggcgtgttgctctctatgggattcggcttcgtggagtatcgaaagccagaacaggcccagaaggctctgaaacaattgcaaggacatgtcgtggatgggcataaacttgaagtcaggatcagcgagcgggcaaccaaacctgcagtaacacttgcaagaaaaaaacaagtgccacgaaaacagacaaccagcaagatcctggtgcgcaatatcccattccaggcccactctcgagaaatccgggagctgtttagtaccttcggcgagttgaagacagtgcgacttccgaagaagatgactggtactggaactcacaggggtttcggttttgttgattttttaactaagcaagatgcaaagcgcgctttcaacgctctctgccatagtacacacctgtatggacgccggctggtcctggaatgggcagactctgaggtgaccctgcaggccctccggcgcaagaccgcagcccacttccacgagccacctaagaaaaagagaagtgtggttctggacgagatcctagagcaactggagggcagtgattccgattctgaggagcaaaccctccagctctag

SEQ ID NO: 15823 - DNA, 669 bp, Artificial Sequence
  Description of Artificial Sequence: Synthetic coding sequence
atggaaaggatagagggagccagcgtcggccgctgcgcggctagcccctatttgcggccgctgacactacactatcgccagaacggcgcccagaaatcatgggattttatgaaaacacatgacagcgtgaccgttctgctttttaacagcagtagaagaagcttggttctggtgaaacagttccgtcccgccgtctatgccggggaagtagagcggcgcttcccgggtagcttggccgctgtagaccaggatggaccaagagagctccagccagccctgcccggcagtgcaggcgttactgtggagctctgtgccggcctggtggaccagcccggcctcagtctggaagaagttgcttgcaaggaggcttgggaggaatgcggataccatttagctccatccgacctccgccgagtagccacctactggagtggcgtgggtcttactggctcaagacagaccatgttttacacagaggtgacagatgcgcagagaagcggccccggaggaggactggtagaagagggagagctcatcgaggtggttcacctgccgctcgagggcgcacaggcctttgccgacgatcctgacatccccaagaccctcggggtgatattcggagtatcatggttcctgtcccaagttgctcctaacctcgacctgcagtag

SEQ ID NO: 15824 - DNA, 876 bp, Artificial Sequence
  Description of Artificial Sequence: Synthetic coding sequence
atgaatatgatttggcgcaacagcattagctgtctgaggctggggaaggtgcctcacagataccaaagcggataccaccctgttgccccactgggctctcgaatcctgacagatcctgctaaagtcttcgaacataatatgtgggaccacatgcagtggagcaaagaagaagaagcagctgctagaaagaaggtgaaagagaactccgcagtgcgtgtccttttggaggagcaggttaagtatgagagagaagcatcgaagtactgggacactttttataagattcacaagaacaagttcttcaaagatcgtaactggcttctgcgggaattcccagaaattcttccagtggatcaaaagcctgaggaaaaagcacgcgagtctagttgggaccacgttaaaacaagcgccactaacagattttctcggatgcactgtccaacggtacctgacgaaaagaaccattatgaaaagtcctctggaagtagcgagggacagtcaaagaccgagtctgatttttcaaacttagacagcgaaaaacacaaaaagggtcctatggagactggactttttcctggctccaatgcaacctttcgcatcctggaagttggctgcggagctggcaacagcgtctttccgattcttaacaccctggagaactcccccgaaagttttctgtactgctgcgattttgcctctggagcggtggagttggtgaagagccattccagctacagggccactcaatgttttgctttcgtacatgatgtgtgcgacgatggattgccttacccctttccagatgggatccttgacgttatcttgctcgttttcgtgttgtcttccatccatcccgatcgcaccctcttcatatag

SEQ ID NO: 15825 - DNA, 630 bp, Artificial Sequence
  Description of Artificial Sequence: Synthetic coding sequence
atgaagaaagttaggctgaaagagctggaatccagattacaacaggtcgatggattcgagaaaccgaagctcttgcttgaacagtatccgacacgaccacacatcgccgcttgtatgctatatactatccacaacacctacgatgacatcgagaacaaggtagtcgctgacctgggctgcggatgcggcgtcttgagtattggcacagccatgttaggcgctggcttatgcgtaggctttgatatagacgaggatgccctagaaatcttcaaccgcaatgcagaggagtttgagttgaccaacattgacatggttcagtgcgacgtgtgcttgttgagtaacagaatgtcaaaaagttttgacaccgtgatcatgaatcccccattcggcactaagaacaataaaggcaccgacatggcattcctgaagaccgcgctggagatggccaggacagcagtatactcactgcataagagctcaacacgggagcacgtgcagaaaaaggccgcagagtggaaaatcaagatcgatataatagctgaactgagatatgatctgcccgcctcctataaattccacaagaaaaaatctgtcgatatcgaggtggacctcataagattcagcttctag

SEQ ID NO: 15826 - DNA, 504 bp, Artificial Sequence
  Description of Artificial Sequence: Synthetic coding sequence
atgccggcctatcactcgtccttgatggatccagacaccaaactcatcggcaatatggcactgctgcccatacggtctcagttcaagggtcctgcaccgagagagacgaaggataccgatatagtagatgaggcgatctactacttcaaggctaatgtgttcttcaagaactatgaaattaaaaacgaggccgaccgcacactcatctatatcacattatatatttcagaatgtctgaagaagcttcagaagtgtaatagtaagtctcagggtgaaaaagagatgtatacactggggatcacgaactttcccattcccggggaacctggcttccctctgaatgccatttacgccaagccggccaacaagcaggaggacgaggtcatgagagcatacctgcagcagctccgacaggagaccgggctgcggctgtgtgaaaaggtcattaagggagacttgaagttttccgccgcccttaaactcgcactgaacaagaataagtag

SEQ ID NO: 15827 - DNA, 4074 bp, Artificial Sequence
  Description of Artificial Sequence: Synthetic coding sequence
atggctgacacagatctgttcatggagtgcgaggaggaggagctggagccctggcagaagattagcgatgtcattgaggactctgtcgtggaagactacaattcggtagataaaacaaccaccgctggtaatccgctggttcagcaggggggccagccacttatccttactcagaatccggcgcctgggttaggtaccatggtgactcagccagtgctgcggccggtccaagtgatgcagaatgccaaccatgtaacaagtagccccgtggcgtctcagcctatattcatcacaacgcagggatttcctgtccgaaacgtccgtcccgtccagaatgccatgaatcaggttggtattgtcctgaacgtacagcagggccagacagtcaggccgatcacactggtccccgctccagggacccagtttgtcaagcctacggtgggcgtgcctcaggtgttttcacagatgacccccgtcaggcccggatccactatgccggtcagaccaactaccaacacctttactaccgtgatcccggcaaccttgaccatcagaagtactgtgccacaaagccagtctcagcagaccaagagcacaccatctacgtctacgacacctacagctactcagcctacatcattagggcagctggctgtccagtcccctggccaatccaaccaaactactaaccctaagctcgccccttcgtttcccagtccgccagctgtgagcatcgcgtcatttgtcaccgttaagcgcccaggtgtaacaggggagaattcaaacgaggtggcaaagctggtgaatacccttaacactattccatctttgggacaatcccccggccccgttgttgtgtcaaataacagcagcgctcacggaagtcaacgcacctctgggcccgagagttctatgaaggtgacaagtagtataccggtctttgatttacaggatggggggcggaagatctgtcccagatgtaacgctcagttcagagtcaccgaagctctgaggggccatatgtgttattgttgtcctgagatggtggaataccagaagaagggtaagagcttagactccgagccatccgtgccaagcgcagccaaacctcccagcccggaaaagacagcaccagttgcttcaactccatcttctacacccatacctgctctctcgccgccaaccaaagttccagaacccaatgagaatgtgggcgacgccgtacagactaagctgatcatgttagtcgacgacttttattatgggagggacggcggaaaagtggcgcagctcacgaatttccccaaagttgccacctcattccgctgcccacactgcactaaacgcctgaaaaataatatccggtttatgaaccacatgaagcatcatgtggaactggatcagcagaacggggaagttgacggtcacacaatctgccagcactgctatcgccagttcagcacgccttttcaactgcagtgccatctagaaaatgtgcatagcccatacgagtctactacgaagtgcaaaatttgcgaatgggcatttgaatcagaaccattgtttcttcagcatatgaaggacactcacaaacctggcgaaatgccctacgtttgccaggtctgtcagtaccggtcctccttgtactccgaggtggacgtccacttcaggatgatccacgaagatacgcgtcaccttctgtgcccatattgtttaaaggtcttcaaaaatgggaatgccttccaacagcattacatgcgccaccagaaaagaaacgtgtaccactgtaacaagtgtagattacagtttctcttcgcgaaggacaaaattgagcacaagttgcaacaccacaagactttccgtaagccaaagcagttggagggcctcaaaccaggcaccaaggtgactatcagggcgtctcggggtcagccaagaaccgtgcctgtttcttccaacgacactcccccaagcgcactgcaggaagccgctccgctgacaagcagtatggatcccttaccggtgttcttgtaccctcctgtccagcgctctattcagaaacgggctgtacggaaaatgagtgtgatgggcaggcagacctgtttagaatgctcatttgagattccagatttcccaaaccattttcctacctatgtgcactgcagtttgtgcaggtactcaacatgctgtagccgcgcctacgcaaaccacatgatcaacaaccatgtgccacggaaatcacctaaatacttggctctgtttaaaaatagcgtgtccggaatcaagttagcctgcacttcatgcaccttcgtaacgtccgtgggggatgcgatggccaagcatctggtctttaacccatcccacaggagttcatccattctgcctagagggctgacctggatcgcccatagtcgccatggtcagacccgcgacagagtgcacgataggaatgttaaaaatatgtatccacctcccagtttccctaccaacaaggctgctactgttaagagcgccggtgctacaccagccgagcccgaggagctgctcacccccttagcccccgccttgccaagtccagcttcgactgctacgccaccccctaccccaacccaccctcaggccctagccctgccaccactcgccacagaaggagctgaatgcctgaatgtggacgaccaagacgaaggaagcccagtcactcaagaacctgaactggcatccggaggtgggggatccggaggcgtgggcaagaaagagcagctctccgtgaagaagcttagagtggtgctctttgccctctgctgtaatactgagcaggctgcagaacactttaggaacccgcagaggaggattagacgctggctgagaaggttccaggcttctcagggcgaaaacctggaaggtaaatacttaagttttgaggccgaggagaagctggccgagtgggtcctcacgcagagggaacagcaactaccagttaacgaagaaacactttttcagaaggccacgaagattggccgctccctcgaggggggttttaagatatcgtatgagtgggctgttaggttcatgttgagacaccatcttacccctcacgcccggcgcgcagtcgcgcataccctgccgaaggatgttgccgaaaatgccggcctttttattgatttcgtccagcgtcagatccacaaccaagatttgccactgtcaatgatagtcgccatagatgaaatttccctctttctggacaccgaagttttgagttcagacgatagaaaggaaaacgccctgcagacagtcgggacaggcgagccatggtgcgacgtcgtgcttgctattttggcggacggtaccgtccttcccaccctcgtattctataggggtcaaatggatcagcccgccaacatgcctgacagtatactgcttgaggcgaaagagtctggttattctgacgacgagattatggaactgtggtcaacaagggtttggcaaaaacatacagcatgccagaggagcaagggcatgctggtaatggattgtcaccgcacacatttgtctgaggaggtgctggcaatgctgagcgcatcgtctactttgcccgctgtcgttccagccggctgctcttccaaaatacagccactggatgtttgcattaagcggacggtaaagaatttcctccacaaaaagtggaaggaacaggctagggagatggcagatactgcctgtgactccgacgtattgctgcagctcgtgctggtgtggcttggcgaggtgctcggggtcatcggcgattgcccagagctcgtgcagcggtctttcctggtggcttcggttttaccagggccagacggaaatatcaactcaccaaccaggaatgcggacatgcaagaggagttgatcgcttcactcgaagagcaattaaaactcagcggagagcacagtgaaagctccacccccaggcctagatcttccccagaagagactatcgaacctgagtccctgcatcaactctttgaaggagagtcggaaaccgaaagcttctacggtttcgaggaggcagatctagacctaatggagatttag

SEQ ID NO: 15828 - DNA, 288 bp, Artificial Sequence
  Description of Artificial Sequence: Synthetic coding sequence
atgttgaaaaacaagggtcatagctccaagaaagacaatctcgccgtcaacgctgtggcattgcaggaccacatccttcatgacctccagttgaggaatctttccgtggcggaccactcaaagacgcaggtgcagaagaaggagaataagtccctcaagagggacaccaaggccattatcgacacaggcctaaagaaaaccacccagtgtccaaagctggaggactctgagaaagagtatgtcttagaccccaagccccctccactgactcttgggtaccacagctag

SEQ ID NO: 15829 - DNA, 708 bp, Artificial Sequence
  Description of Artificial Sequence: Synthetic coding sequence
atgttgaagaataaaggccactctagcaagaaagacaaccttgctgtaaatgcagtggctctgcaggatcacatcctccatgatctgcaactccgcaacttatcggtggccgatcatagcaagactcaagtgcaaaagaaggagaataagtcacttaaacgggatacaaaggctataatcgacacagggctcaagaaaactacccaatgtccaaaattggaagatagtgagaaagaatatgtcttagaccctaaaccgcctccactgacactggctcagaagttaggcttaattggacccccccccccccctttaagcagcgatgagtgggaaaaggttaagcagcggtccctgttacaaggtgactcagtgcagccatgcccaatctgcaaagaagagtttgaactgaggccacaggtgctgttgtcctgttcgcatgttttccacaaggcctgcctgcaggcttttgaaaaattcactaacaaaaagacttgtcccctttgtaggaagaaccagtaccagacaagagtcatccatgatggggcacggctgtttcgaataaagtgcgtgaccagaatccaggcttattggagggggtgcgtggtgcgtaagtggtacaggaaccttcggaagacggtaccgcccaccgacgcgaaactgcgaaagaaatttttcgaaaaaaaaacacaggactggaagcctgcctag

SEQ ID NO: 15830 - DNA, 1089 bp, Artificial Sequence
  Description of Artificial Sequence: Synthetic coding sequence
atgctgaagaacaaagggcacagctctaagaaggacaacctcgctgtgaacgctgttgcactgcaagaccatattctgcatgacctgcaattgcgtaatctgagcgttgcagaccatagtaagacgcaggttcagaagaaagaaaataagtcccttaagagagacacaaaggcaatcattgataccgggttaaaaaagacaacacagtgccctaagcttgaggactccgagaaggaatacgtgctcgatcctaaacctccacctctgacgctggctcagaaattgggtctcatcggaccaccaccaccacctctatctagcgacgaatgggagaaggtcaaacaaagatccctgttgcaaggagacagcgtacagccgtgtccgatctgcaaagaagagtttgaacttcgccctcaggttctattgtcctgttcccacgtgtttcataaagcctgcttgcaggcatttgaaaagtttactaacaaaaaaacatgtccgctttgccgcaaaaatcaataccagaccagggtgattcatgatggcgccaggctcttccggattaaatgtgtcacacggattcaggcctactggcgcggatgtgtggtccggaaatggtataggaatctaagaaagaccgtcccccctacggacgctaagctgcggaagaagttcttcgaaaagaaatttactgagataagtcataggatcctctgcagttacaatactaacatcgaagagctctttgccgaaatcgaccagtgcttagcgatcaaccgctctgtcttgcagcaactcgaagagaaatgcggtcacgagataactgaggaagagtgggaaaagattcaggtgcaagccctgaggagggagacacacgagtgcagcatctgcttagctcccctgagtgcggccggaggccaaagggttggcgccggtcggaggtcccgagagatggcgttgctcagttgctcacatgtatttcatcacgcttgcctgttagccctggaggaattttccgtcggtgacagacccccctttcacgcttgtcctctgtgcagaagctgctatcagaaaaagatcctcgagtgctag

SEQ ID NO: 15831 - DNA, 1278 bp, Artificial Sequence
  Description of Artificial Sequence: Synthetic coding sequence
atggacaagaacattggggagcaactgaataaggcttatgaggctttcaggcaggcctgtatggaccgagactcagctgtgaaagaactacagcaaaaaactgagaattatgagcaaaggattcgcgagcaacaggagcagctctccctacagcagaccatcatagacaaactgaagtcacagctattgctcgttaactcgacccaagacaataattacggatgtgtgcctttgctcgaggactctgaaacacgtaaaaataatctcacgctggaccaaccacaggacaaggttatctcaggtattgctagagagaaattgcccaaagtaaggagacaggaggtgagcagccctcgcaaagaaacttccgcccgatcactcgggagccccctgctgcacgaacggggcaacatcgaaaagaccttttgggatttgaaagaagagttccacaaaatatgtatgctggccaaggcacagaaagatcacctcagtaagctgaatattccagatactgccaccgagacacagtgctctgtgccaattcagtgtacagataagactgacaaacaggaagcactgtttaagccccaggcaaaggatgatatcaatcgaggcgcccccagtatcacctcggttacccctcgaggcctgtgccgtgatgaagaggataccagcttcgagtccctgtccaagttcaatgttaagttccctccaatggataacgatagcactttcctgcactcgaccccagaacgtcccgggattctgtccccagccactagtgaagcagtctgccaggagaaattcaatatggaatttcgcgataaccccggtaacttcgtgaagactgaagagaccctgttcgagatccaaggcatcgatccgatcgctagtgcaattcaaaacctgaagaccactgacaaaacgaaaccatccaacttagtgaatacatgcattcggacgacgttggacagggcagcctgcctgcccccaggcgatcataacgccctgtatgtgaacagttttccactgctggacccaagcgacgcacccttcccttcgttggacagccctggaaaagccataagagggccacagcagcccatatggaagcccttccccaaccaggactctgactccgttgtacttagcggcaccgacagcgagcttcacattccacgggtgtgcgaattctgtcaggcagtgttcccacccagtatcacctcgcgcggtgatttcctgaggcaccttaacagccattttaatggagagacttag

SEQ ID NO: 15832 - DNA, 639 bp, Artificial Sequence
  Description of Artificial Sequence: Synthetic coding sequence
atggctccttggggtaagcgactggcaggtgtgaggggtgtgctcttggacatatctggcgtgctttacgactcgggggccggcggcgggacggccatagcagggtcagtggaagcagtagcgagattgaagcgatctcgtcttaaggtccgattctgtaccaacgaaagtcagaagtcccgcgcggaactagtgggtcagcttcagaggctcggatttgacataagcgagcaggaagtgaccgcccccgcacctgccgcgtgtcagatacttaaagaacaggggctgcgcccttatttgttgatacatgacggcgtgcgtagcgagttcgatcaaatcgatactagcaaccccaactgtgtcgtgatcgccgacgcgggagagtctttttcatatcagaacatgaataacgcttttcaagtgctcatggaattagaaaagccggtgctgatcagtctgggcaagggacggtactataaggagacgtcgggattaatgctggacgtgggtccctacatgaaggccctggaatacgcttgcgggatcaaagctgaggtggtgggtaagccgagtcccgaattcttcaaatcggctttgcaagccataggtgtggaggctcaccagctcttatctgtgtag

SEQ ID NO: 15833 - DNA, 2868 bp, Artificial Sequence
  Description of Artificial Sequence: Synthetic coding sequence
atggaagtgggcagtgaggaggagaaatgggagaaactggatgcggagtttgatcacttcgtggtggatatgaaaccttttgtgctgaaactgccccacagaaccgaaaggcagcgctgtgcgctgtggatacgtaaactctgtgaaccttccggaaccggcgcggggatcatgggtaggaagaaccgcaacctgtatgccaaactgctgctacatatgctgaaacgcggggccctggaaggcccatttacccaccgcccggagccaggcacactaaagatcctgccgtcatatatgtctatatattttgatgaaccaaatcctgcacgggcgaagggcagctctcctgagggtttgcccgcctgggtcctcggcgaactcgagaccagtgagcacaagctgaacgaaagctggaagctgtcctcaggggaagacaacacactagtgcagtcccccacagacgtgtacagtagagaacaatataccggcaagctgcgggttcgttctcactctctgtctccgacccatcgtgaggacgggcaaaatattactccaaaaatttgcgaagtgtatagcaagaagtctccggtctcactcgatgactctgacatcgaggcccggttgaactcctggaacctcggtatcgagaacccccgttacttgagacagaaaccaattcccgtgtccctaatgacgccaaagttctcgctgcgcaagagttccagttttcacgatgaccattttctgtctcggatccgggagaaggaactggacatgaagaccaagatgatggaggccaagtttcacgaggagaagctcaagctgcagcagaagcatgatgcggatgtccagaaaatactggaacggaagaacaatgagatcgaggagctcaaaaccctttacaggtctaaacaacacgaaacagaagaaacgatccggaagcttgaaaaaaaggtccagaccctcatacgggattgtcaagtaatcagagagactaaagaagatcagattgccgaactgaaaaaaatttgcgagcagtcaacagaaagcctcaacaatgactgggagaaaaagctacataacgccgtggcagagatggagcaagaaaagttcgatctgcaaaagcaacacaccgaaaatatccaagagctgctagaagacacaaacgtccgccttaataagatggagagtgaatacatggctcaaacccagtccaccaatcacatgatcaaagaactggaagcgcgggtgcagcagctgacaggtgaggctgagaatagcaacctgcagcgacagaaactgatccaagagaaggccgagctggaaagatgttaccagattacttgctctgaactgcaggaggtgaaagctagaaggaataccctgcacaaagaaaaagaccacttagtgaatgattacgaacagaacatgaaactgctccagacgaagtacgacgctgatatcaatctgttaaaacaggaacatgcgctgtcggcaagcaaggccagctctatgattgaagaactggagcaaaacgtatgccaactgaagcaacaactgcaggagagcgagctgcagagaaaacagcagctgagagatcaggaaaacaagtttcaaatggagaagagccatctgaagcatatctacgagaagaaggcccatgacctacagagtgagctcgacaaaggaaaagaagacacccagaaaaaaatacacaagtttgaggaagcacttaaggagaaggaggagcagcttacacgtgtcactgaggttcagcggctgcaggcccagcaggccgatgccgctctggaggagttcaagcgacaggtggagctgaactccgagaaggtgtacgctgagatgaaagaacagatggaaaaagtggaggctgatctaacgagatccaagagtttaagagaaaaacagtctaaagagtttttatggcagctcgaagacatccgccaacgctacgagcagcagatcgttgaacttaaactggagcatgagcaagaaaagacacacctcctacagcagcataatgcagaaaaagacagcctcgttcgggatcatgagagagaaatcgaaaacttggaaaagcagctgagggcagctaacatggaacacgagaaccagatacaagaatttaagaaacgcgacgcacaagtcattgctgacatggaagcccaggtgcacaagctgcgggaggagctgataaatgtgaattcacaacgcaaacagcagctcgtggagctgggcctactgagagaagaggaaaaacagagagccaccagggagcacgaaattgtggtgaataagttgaaggccgaatcagagaaaatgaaaatcgagctgaaaaaaacccacgctgccgaaactgaaatgaccctcgagaaagccaacagcaaactcaagcaaatcgaaaaagaatatactcagaagctggcaaagtcgtctcagataatcgccgagctacagacgaccataagtagtcttaaggaagaaaacagccagcagcaattagccgcagagagacgtcttcaagacgtgcggcagaaattcgaagatgagaagaagcagctgatcagagataatgatcaggccatcaaggtgttacaggatgagcttgagaataggtcgaaccaagtgagatgtgccgagaagaaactccaacataaggaactggagtcacaagaacagatcacttacatcagacaggagtatgaaactaagctgaagggacttatgcctgccagtctaaggcaggaactcgaggacacaatttctagcctcaagagccaggttaatttcctccagaagcgggcaagcattctgcaggaagaacttacaacctatcaaggcaggaggtag

SEQ ID NO: 15834 - DNA, 1269 bp, Artificial Sequence
  Description of Artificial Sequence: Synthetic coding sequence
atgccgcgtaaggggacacagccatctacagcccggaggagggaggaaggcccccctccaccatcacctgatggtgccagctctgatgctgagcctgagcctccgagcggacgaactgaaagccctgccaccgctgccgagacagcgtccgaggaactcgataatcgttcactggaggagatcctcaattccattccccccccgcctcccccagccatgactaatgaagcaggtgcgccaagactgatgattacccatattgtcaatcaaaactttaaatcatacgccggtgagaagatactgggtccatttcacaaaaggtttagttgcatcataggtcctaatggctcaggcaagtccaacgtgattgatagcatgctttttgttttcggatatcgagcccagaaaatacggagtaaaaagctcagtgtgctcatacacaactccgacgaacacaaggacatccaatcttgtaccgtcgaagtgcatttccagaagatcatcgataaagaaggtgacgattacgaggtcatcccaaactccaacttctatgtgagccgcaccgcatgccgcgataacacctcagtctatcacatctctggtaaaaagaagactttcaaggatgtgggtaacctcctcaggtcacatggaatcgatctagaccacaataggttccttatcctccagggggaagttgaacagatcgccatgatgaagcccaaagggcaaacagagcacgatgagggaatgctcgagtatttagaagacattatcggatgtggtaggctgaatgagcctatcaaggttctgtgccgccgggtcgaaatactaaatgagcacaggggtgaaaaactcaatcgggtgaaaatggtggagaaggaaaaagacgccctggaaggtgagaaaaacatagcaattgagttcctcaccctggagaacgaaatcttccgtaaaaaaaaccatgtgtgccagtattatatttacgagctacagaagagaatcgcagaaatggaaactcagaaggaaaagatccacgaggacaccaaggagattaatgaaaagagcaatatcctgagcaacgaaatgaaagcgaagaacaaggacgtgaaggataccgagaaaaaactcaataagatcaccaagtttattgaagaaaataaggaaaaattcacccagctggatttggaggacgtacaggtcagagaaaagctcaaacacgccacctccaaggccaaaactggtgagaccacgagtaagcgtaagaagtag

SEQ ID NO: 15835 - DNA, 303 bp, Artificial Sequence
  Description of Artificial Sequence: Synthetic coding sequence
atgcgcaagcggctctcggctcctgaactccggctctctcttacgaaggggccaggtaacgacggggccagtccaacacagtccgctccctccagcccagacggcagttctgatctcgaaatcgatgaactcgagaccccatctgactctgagcaattggattctggtcatgagttcgagtgggaggacgagctcccgcgggctgaaggacttggcacttccgaaaccgccgaacgattgggccggggctgtatgtgggacgtgacaggcgaggatgggcaccactggcgagttttccgctag

SEQ ID NO: 15836 - DNA, 1059 bp, Artificial Sequence
  Description of Artificial Sequence: Synthetic coding sequence
atgggcaaagtagagaattcaaagtcggcgcaaggcctcgccggtctcaggaatctcgggaatacctgttttatgaattcaatcctgcagtgcctgtctaacaccagggaactgcgcgactactgcttgcaacgtctgtacatgagagaccttcaccacggatccaacgctcacaccgcacttgtggaagaatttgccaagctcattcaaaccatctggacctcctccccaaacgatgtagtctcgccttctgaatttaaaacgcagatccagcggtacgctcccagatttgtgggctataatcagcaggacgctcaggagttcctgagatttctcctggacggacttcacaacgaagtgaatcgcgtgacactgagaccaaagagcaatccagaaaatttagatcacctacctgacgacgagaagggccggcagatgtggcggaaatacttagagagagaagattcaagaataggggacttgtttgtgggccagctgaagagttcacttacatgcacggactgcggatattgtagcaccgtctttgatcccttttgggaccttagtctgccaattgcaaaacggggataccccgaggtcactctgatggattgtatgcgcctgttcacaaaggaggatgttctggacggtgatgagaaacccacctgctgtcgttgtcgtggaaggaagcggtgtatcaagaaatttagcatccagcgcttccctaagattctggtgctgcatttgaagagatttagcgaaagtcgcattcggactagcaagcttactacatttgttaatttccccttgcgcgacctcgacctgagggagtttgcatctgagaatactaatcacgctgtgtacaacctctacgccgtttcaaaccactccgggaccactatgggcggtcactacaccgcctactgtcgatcccctgggaccggggaatggcacacattcaacgattcttccgtaactcctatgagctcatcacaggtgagaactagcgacgcctaccttctgttctacgaactcgcctcaccaccttctaggatgtag

SEQ ID NO: 15837 - DNA, 1497 bp, Artificial Sequence
  Description of Artificial Sequence: Synthetic coding sequence
atggtgatcgaggaagttaacttcatgcaaaaccacctggagattgaaaagacgtgtagagagtccgcagaggcccttgccacaaagctgaacaaagagaataaaaccctgaaaagaatcagtatgctttacatggcaaagctgggacccgacgtgattactgaggagattaatattgatgacgaggactctaccacagatactgatggcgctgccgagacctgtgtttctgtacagtgtcagaaacagatcaaagagttgagagaccagatcgttagtgtgcaggaagaaaagaaaatcctggccatcgaactcgaaaacttgaagagcaagctggtcgaggtcatcgaagaggtgaataaagtgaagcaagaaaagaccgtcctcaacagtgaggttctcgaacagaggaaagttttggagaagtgcaatagggttagcatgcttgccgttgaggagtacgaggagatgcaggtgaatcttgagttggagaaagacctaaggaagaaggccgagtcttttgcgcaggagatgtttattgaacagaataaactcaagcgccagtcccacttactgctccagagcagcatcccggatcaacagttactgaaagccctggacgagaatgctaagctgacacagcagttagaggaggagaggattcagcatcagcagaaagtgaaggaactggaagaacagcttgaaaacgaaacactgcacaaggagatccacaaccttaagcagcagctcgaacttctggaggaggataaaaaggagttggagctcaagtaccagaattctgaggagaaggcccgcaatctcaaacatagtgtcgacgagttacaaaagcgggtgaaccaaagcgaaaactctgtgccacctcctcctcctcctcccccccctctgccacctcccccaccaaacccgattcggtctttaatgtccatgattagaaaacgatcacacccatcaggcagtggtgcaaaaaaggagaaagctacccagcccgagaccacagaggaagtcacagatttgaagaggcaagctgtggaggaaatgatggatcgcattaagaaaggcgtgcacctgcggcctgtaaaccaaactgctaggcctaaaacaaagcccgaatcatctaaaggatgtgagagcgccgtggacgagctgaaaggcatccttggaactctcaacaagagtacgtcttcaaggagcctgaagagtcttgatcctgagaacagcgagaccgaactcgagaggattctgaggcggcggaaagtgactgccgaggccgattcttcttcccctaccgggatcctggcgactagcgagagcaaaagcatgcccgtgttaggctctgtctcttcagtgaccaagacagcactaaataagaagacactagaggccgaatttaattcgccctcaccgcctacccccgagccaggcgaaggaccccgaaaattggagggctgtacatcttctaaagtgactttccaatag

SEQ ID NO: 15838 - DNA, 1950 bp, Artificial Sequence
  Description of Artificial Sequence: Synthetic coding sequence
atgaacagtagcgacgaagagaaacagctgcaactgatcacaagtctgaaggaacaggccatcggtgagtacgaggatctccgtgcagaaaaccaaaagaccaaggagaagtgcgataaaattaggcaggaacgggacgaggctgtaaagaaactggaggagttccagaaaatctcccatatggtaatagaggaggtcaactttatgcaaaatcacctagagattgagaagacttgtcgggaatccgcagaggcactggcaaccaaacttaacaaggaaaataagactctcaaacggatttctatgctgtacatggccaagctggggccagatgtcatcacagaggaaattaacatcgatgacgaagattctacaaccgacacagacggagctgccgagacatgcgtgagtgttcagtgccagaaacagattaaagaattgcgtgatcaaattgttagcgtacaggaagagaaaaaaatccttgccatcgaactggaaaatcttaaatctaaattggttgaggtcattgaggaggtaaacaaggtcaagcaggaaaaaacagtactgaattccgaagtgctggagcagagaaaggtcctggaaaaatgcaatcgcgtttcaatgctcgccgtcgaagagtacgaagaaatgcaggtgaatctggaacttgagaaagatttgagaaagaaggcggaaagcttcgcgcaggagatgttcatcgaacagaataaactcaagcgccagtctcatctgttactgcaaagttctattccagaccagcagttacttaaagcccttgacgagaatgccaaactgacacaacaactggaggaggagcgaatacagcaccagcagaaagtgaaagaactcgaggaacaattagagaacgagactctgcataaggagatacacaacctcaaacagcagctcgaactcttagaagaggacaagaaggaattggagctcaaatatcagaactctgaagaaaaagcacgcaatcttaagcacagcgtcgacgaattgcagaagcgcgtgaatcagtctgagaattcagtgcctccaccacccccgccaccacctcccctaccccctccccctccaaaccctatcagatcgctcatgagtatgattcggaaaaggagccacccctcaggaagtggagccaagaaagagaaagctacacagcctgagaccaccgaggaagtgaccgacctgaagaggcaggctgtggaagaaatgatggatcggatcaagaaaggagtccacctccggccagtgaaccaaacagcacggccaaagacaaagccagagtctagtaaggggtgtgagagcgcggtcgatgagttgaaaggcatcctgggtactctgaataaatcaactagttcacgctccctcaagtccctagaccctgaaaacagtgagaccgaactggaacgcatcctccggcgccggaaggtaactgctgaggcagactcctcatcgccaaccgggattttagccactagcgaatcaaagagcatgcccgtacttggcagcgtctcgtctgtgacaaagactgcactgaataagaagaccttggaagccgagtttaattccccaagccctcccacacccgagcccggagagggaccacggaagctcgaaggatgtacttcttcgaaagtcacctttcagcctccctcatcaattggctgtcgaaagaaatacatcgacggggaaaagcaagctgagcctgttgtggtgctcgacccagttagcacacatgaacctcagacgaaagatcaggtggctgagaaggatcccacccagcacaaagaagatgaaggagagatacagcctgagaacaaagaagatagcatcgagaacttctttcctttccacttcggtttcgaaggggtgttgccactagccggcgtaactctctccactaaagcccgcgacccaaagtag

SEQ ID NO: 15839 - DNA, 837 bp, Artificial Sequence
  Description of Artificial Sequence: Synthetic coding sequence
atgggaaaaagttccgaatggtgtgagagaattgcgggaatccagaagttcgtgttggagaaatggacaaaaaaggccaagcctgaggatactctgaatctgtgtcaactgctaaacaatgacttggcgagcacggtcgtgtcctatcctagaaggttcgttggcctgggcactctgccaatgcaggcaccggagcttgctgtgaaagagatggagcgctgcgtgaaggagctgggcttccccggcgttcagatcggaactcacgtcaacgaatgggatttgaacgctcaagaactgttccctgtgtacgctgccgctgagagactgaaatgcagcctgtttgtccacccctgggacatgcaaatggacggcaggatggccaagtattggctcccatggcttgtcggcatgcctgccgagacaactatagccatctgttctatgataatgggtggcgtgtttgagaaattccccaagctgaaagtgtgctttgctcacggcggtggggccttcccattcaccgtaggcagaatatcccatggcttcagcatgagacccgatttatgtgcccaagataacccgatgaacccgaaaaagtaccttgggagcttctacaccgatgccctggttcacgatccactctcacttaagctgttgactgacgtgatcggcaaggataaagtgatcctgggaaccgactatccattccccctgggcgagctcgaacccggaaaactgatcgagagcatggaggagttcgatgaggaaaccaaaaataaactgaaagccgggaatgcattagcttttctagggctggagagaaaacagtttgagtag

SEQ ID NO: 15840 - DNA, 1368 bp, Artificial Sequence
  Description of Artificial Sequence: Synthetic coding sequence
atgttcacagagggtgaggagatgtacctgcaaggcagcactgtttggcacccagactgtaagcagtcaaccaaaacggaggagaaactaaggcttcctaatatacggagaagtagctccgatttcttctactccaaaagcctgatccggcgcaccgggaggtctccttcactacagccaacccgcacaagcagcgaatcgatctattcccgcccaggatcgagtatccctggttcacctggacacactatctatgccaaagttgataatgagattctggattacaaggatctggcagccatcccaaaagtgaaggccatctacgatattgagcgccccgacctgatcacatatgaaccattctacaccagtgggtatgatgataaacaggagagacagagcttaggtgaaagtccccggaccctgtctcccactccctccgcagaagggtaccaggatgtaagggacaggatgattcaccgctccacatcacagggctcaataaatagtccagtgtactcacgccattcatatacacctactacatcccgtagtcctcagcatttccataggccggatcaggggatcaatatctatcgcaaacctccaatttacaagcagcatgctgcactcgcagcacaatctaaaagctctgaggatattataaaatttagcaagttcccggccgctcaggctcccgatccaagtgagacgcccaagatcgaaaccgatcactggcccggtccaccttcgttcgccgtggtgggccccgatatgaagcggaggtcctctggccgcgaggaagatgacgaggagctcttgcggcggagacaactccaggaggagcagcttatgaagcttaactcaggcctcggacagctgattctcaaagaggagatggagaaagagtcccgggaaagaagttcattactggccagtagatacgattctccaattaattccgcttcccacatcccaagttctaaaactgccagccttccaggctatgggcgtaatggcctgcacagaccggtgagcactgatttcgcgcaatacaattcttatggcgatgtatccggcggcgtcagggactatcagaccctcccggatggccacatgccggctatgcgcatggataggggcgtgtcgatgcctaatatgctggagcctaaaattttcccgtacgaaatgctgatggtcaccaatagggggcggaataaaatcctgcgcgaggtggacagaaccaggctggagcgtcatttggctcctgaagtgtttcgtgagatcttcggtatgtcgattcaggagttcgatcgcctccctctgtggagacgaaacgatatgaaaaagaaagccaagctgttctag

SEQ ID NO: 15841 - DNA, 1959 bp, Artificial Sequence
  Description of Artificial Sequence: Synthetic coding sequence
tagagccatgcgttcatcagccagtgggtctgccgccactggagagacccggtcgcacatccgcaggacccgcatcacccgtcagaaaagcccgtgatccattgtcacaaatgcggtgaaccttgcaagggtgaggtgcttcgagtgcagacaaagcacttccacatcaaatgcttcacctgcaaggtctgcgggtgtgacttagcgcagggcggcttcttcattaagaacggcgagtatctgtgtacattggactatcaccctaattgcttcgcttgcaccatctgcaagagaccgtttcctcccggggatagagtgacctttaacggccgcgactgcctctgccaactgtgtgcgcagcccatgtcttcctctccgaaggagactacattcagcagtaactgcgccggatgcggtcgggatataaagaatggacaggctcttttggctctggataagcagtggcaccttggttgtttcaaatgtaaatcttgcggtaaggtgcttacaggtgaatacatcagcaaagatggggctccatactgtgagaaagactaccagggtctgttcggagtgaagtgtgaggcctgtcatcagtttattactggaaaagtccttgaggcgggcgacaagcattatcacccgtcctgtgcgaggtgttctcgctgtaatcaaatgtttaccgagggcgaggagatgtacctccagggcagcacggtgtggcaccctgactgtaaacagtccaccaagacggaggagaaactcagaccgacgagaaccagcagcgaatcaatctactcacggcccggctcttcaatcccaggtagtcctgggcacactatttacgcgaaggtcgacaacgagatattagactataaggacctggccgccattcctaaggtgaaggcaatctatgacatcgaaagaccagatcttataacctacgagcctttctacacatcagggtacgacgataaacaggaacgacaaagtctgggcgagtctcctcgaaccctgtccccaaccccaagcgctgaagggtatcaagatgtgcgggatcggatgatacaccggtctacttctcaaggaagtatcaattcgcccgtgtactccaggcacagctacactcctacaacgtcacgctcccctcaacacttccacagacccgaccaggggattaacatctatcggaagcctcccatctataagcagcatgctgctctggctgcccagtccaagtcttccgaggacatcatcaagttctcaaaattcccagccgcacaagctccagatccttctgaaacccctaagatcgagactgatcactggcctggtccaccctcctttgccgtcgtggggcccgatatgaaaaggcggagctctggacgagaggaagacgatgaagagctactgcggcgcaggcagctccaagaggaacagctcatgaagctcaattcaggcttaggccagctgattctcaaagaagagatggagaaagaatctcgcgaacgctccagcctgttggcctccaggtatgatagccctatcaactctgcaagccacataccaagctccaagaccgccagcctgcctgggtatgggcggaacggcttacaccgaccggtgtccaccgacttcgctcaatataactcatacggcgacgtttccggtggggtccgcgactatcaaaccctgcccgatggccatatgcccgccatgcggatggacaggggagtcagcatgccaaacatgttggaaccaaaaatattcccctatgagatgcttatggtcaccaataggggaaggaacaagatactaagggaagtcgaccgaacccggttggaacgccacttggcccccgaggtctttagagagatttttggcatgtcgattcaggagtttgatagactgccgctgtggaggagaaatgatatgaaaaagaaagctaaactgttctag

SEQ ID NO: 15842 - DNA, 837 bp, Artificial Sequence
  Description of Artificial Sequence: Synthetic coding sequence
atgacccagcagtggcgcgaagtgaatgaagatcgcgaagccgtcgctcaggcaaggtcctggcagtccctgaatttgggcgacagggatatgggagttagctttatcgagaccgcactggctctgtccgcggccagagccagacgacctcttcttactagtcacccaccctccaggccttttcagcctccaaaacacacacctagcccaccgcctgctccgcgggtgaattcaaggcaccccggtagatcagtgtctctgagcttaccctctgccagtcaggccccacccgtgcccctagcctcccccgaggggaggccacacaccgttggtgccccacatgcctcaacatggaagcggacgcgcggcaggcagcgtgcccgccctccaaagattgtgaaggaagctgaagtgccgcaagcagcccttggcgtcccggcgcagggaacgggagataacggtcatacacccgtggaggaggaggttggtggaatcccagtcccggccccagggctactccaggttactgagcgtaggcaacctttaagctctgtgtcatcgctcgaagttcatttcgacttgttagatctgacggagctcaccgatatgagtgatcaggagcttgctgaagtgttcgctgattccgatgacgagaacctcaacactgagagcccggccggtctacatcccttaccaagggccggatatctgaggagcccgagctggacacgtacacgggcagagcagagccacgagaagcagcccttgggagaccctgagagacaggctaccgtcctggacaccttcctcacagtagaaagacctcaggaggactag

SEQ ID NO: 15843 - DNA, 540 bp, Artificial Sequence
  Description of Artificial Sequence: Synthetic coding sequence
atgactgacctggtcgccgtgtgggatgtggcgctttctgatggagttcacaaaatcgaattcgagcatggcaccacgtcaggcaagagagtggtgtacgtggatgggaaggaggagattaggaaggagtggatgtttaaactcgtaggaaaggaaactttctatgtgggagctgctaagacaaaggcaactatcaacatagatgctatttccggcttcgcatatgagtacacgctagagatcaatggaaagagcctcaagaaatatatggaggaccgctctaagacgaccaacacatgggtcctccacatggacggcgaaaattttcgcatagttctggagaaggatgcaatggacgtgtggtgtaatgggaagaagttggagacggccggcgagtttgttgatgacgggacggaaacccatttctccatcggtaaccacgattgttacattaaagcagtatcttctggcaagaggaaggagggcattatccacacactgatcgttgacaaccgcgagatccccgaaatcgcctcatag

SEQ ID NO: 15844 - DNA, 540 bp, Artificial Sequence
  Description of Artificial Sequence: Synthetic coding sequence
atgacagaccttgtcgctgtatgggatgtcgccctgtccgatggggtccacaaaatagagtttgaacatggcacaacatctggcaaacgggtggtgtacgtggacgggaaggaggagatcagaaaagagtggatgttcaaactggtgggtaaggagacattctatgtgggagcggccaaaaccaaggcaacaatcaatattgatgccatcagtggattcgcctacgaatacactcttgagattaacggtaaaagtctgaagaaatatatggaagaccgcagcaagaccaccaacacttgggtgctgcacatggatggcgagaacttcaggatcgtactcgaaaaggacgcaatggatgtctggtgtaatggtaaaaagctggaaactgccggggagttcgtggatgacggtactgaaacccatttctctatcggcaaccatgattgctacataaaagctgtgtctagcggaaaacggaaagagggtatcattcatacactgatcgtggacaatcgcgagatccctgagattgcctcctag

SEQ ID NO: 15845 - DNA, 1053 bp, Artificial Sequence
  Description of Artificial Sequence: Synthetic coding sequence
atggggccttgcaatctatccagcgctgctggccctaccgctgagaagtctgtcccataccagaggacattgaaagagggacaaggtacttccgttgtagcccagggccccagtcgacccctaccttccactgccaatgtggtggtgattggggggggtagcctggggtgccagactctttaccatctcgccaagcttggaatgtctggcgctgtgctgctggagcgagaacgtctcacaagcggaactacttggcacaccgccggtctactgtggcagcttcggccgtctgatgtcgaagtagagctgctggcgcatacgagaagagtagtttccagagagcttgaggaggagactgggcttcataccgggtggattcagaacggtgggttgtttattgcctccaatagacagcggctcgacgagtacaagcgactaatgagcctggggaaagcttatggggttgaaagtcatgttctgtcccctgccgaaacgaagacactctaccccctcatgaacgtcgacgacctctacggtaccctgtatgtgccgcacgacggcactatggatcccgcgggcacttgcaccaccctggctagagcagcaagcgcaaggggtgcacaggtgattgaaaattgtcctgtgaccggcattcgtgtctggactgacgacttcggggtgcggcgcgtcgctggcgtggaaacgcagcacggatccattcagactccctgtgtggtgaattgtgctggcgtttgggctagtgcagtggggcgaatggccggcgtgaaagtgcctctcgttgccatgcaccacgcctatgtcgtgacagagagaattgaaggcattcagaatatgcccaatgtgcgagatcacgacgcatccgtctatctcagacttcagggggatgcgctgtcagtgggaggttacgaggcaaaccccatcttctgggaggaggccgtgaagtaccgccccagggctgcaggagggttgtgcctaaagacctctacagaaaaagtgtgtgcagtatggtcggacgatctccggcgggcctag

SEQ ID NO: 15846 - DNA, 2001 bp, Artificial Sequence
  Description of Artificial Sequence: Synthetic coding sequence
atggcacgggcggggtcatgtgggggtgctgcagcaggagcgggtagacctgagccatgggagctgagccttgaggaggtactcaaagcgtacgagcaaccacttaacgaagagcaggcttgggcagtgtgcttccagggttgtagaggactgaggggaagtcctggaagaaggttacgtgacacgggggaccttctgctgcgaggcgatggttcagtgggagcgcgggagcccgaggctgctgaacccgcgaccatggtggtaccgcttgcttcctctgaagcacaaaccgtgcagtcactgggcttcgcaatttaccgcgcactggactggggcctggatgagtccgaggagcgggaactatcaccacaattagagagactgatcgacttaatggctaacaatgactcagaagatagcggctgtggcgcagcagatgaaggatacggtgggcccgaggaggaggaggaggcggagggcgtaccacgcagtgtccggactttcgcgcaagcaatgagactgtgtgcagcccggctgaccgatcccaggggggcccaggcacactaccaggcagtgtgcagagcactcttcgtggaaactctagaattgagagcatttctcgcaagagtgcgggaagctaaagagatgcttcagaaactgagggaagacgagcctcacctggagacgccaagggccgaactggacagcctgggccatacagactgggctcgcctgtgggtgcagctcatgcgtgaactgcgaagaggagtcaagctgaaaaaggtccaggagcaagagttcaatcccttgccaactgagtttcaactcactccctttgaaatgttgatgcaggatatccgggcacggaactataaattgagaaaagtgatggtcgacggcgatatccccccaagggtcaagaaggacgcacacgagctgatcctcgactttatcaggtcaaggccccccctgaagcaggtgtcagaacgccgtctgcgtccactgccaccaaagcagcggtccctccacgaaaaaatactggaagagataaagcaggaacgcagactgaggccagtgagaggagagggatgggcggcgcgtggatttggcagcctgccttgtattttaaatgcttgttccggtgacgccaagagtactagttgtattaatcttagcgttactgatgccggcggctccgcacagcggccaagacctagggtgcttcttaaagcacctaccctggctgaaatggaggaaatgaatacatctgaagaggaagaaagcccttgtggcgaagtgaccttgaagcgggatcgctccttcagtgaacacgacttagcccaacttagatccgaggtggcctcaggtctccagtcggccacacatcccccgggggggacagagcctcccagaccccgcgcaggaagcgcccatgtgtggcgcccggggagcagagaccagggaacatgccctgcaagcgtctctgaccccagccacccattactcagcaatagaggatcaagcggggaccgccctgaggcgagcatgactcccgacgccaaacatctctggttggaattctctcaccccgtagagtcattagcgctcacagttgaggaggtgatggacgtgcgtagagttctggttaaagccgagatggagaagttcttacaaaacaaggaacttttttcatccttgaagaagggaaaaatctgctgctgctgtagagctaagttccctctcttttcatggcctcctagttgtctcttctgtaaaaggtccctgcagggacctcagtggcagagcgtcgaagaggccttcccccatatatatagccacggctgcgttctgaaagacgtctgtagcgagtgcacctcttttgtcgccgatgtggtgcgttcctccaggaaaagtgtggatgttctgaatactacgcctcgaaggtccagacagacgcagtcactgtacatccctaatacacggacattggacttcaaatag

SEQ ID NO: 15847 - DNA, 474 bp, Artificial Sequence
  Description of Artificial Sequence: Synthetic coding sequence
atggagacacttcagtcagagacaaaaaccagggtactcccttcttggctcaccgctcaagtggccactaagaacgtagcccctatgaaggcacctaaacgcatgaggatggcggccgtccctgttgcagccgctcgcctgcccgccacccggacggtgtactgcatgaacgaggccgagatcgtagacgtggccctcgggatattaatcgaatctcgcaagcaggagaaggcttgtgaacaacctgctcttgctggggctgacaatccagagcactccccaccatgcagcgtctcaccccacacctcatcaggcagttcctctgaggaggaagactccggcaaacaggcactggctcccgggttgtctccaagtcagcgtccaggtggaagctctagcgcgtgttccagatcaccagaggaggaggaagaagaggacgtacttaaatacgtgcgggagatattcttcagctag

SEQ ID NO: 15848 - DNA, 804 bp, Artificial Sequence
  Description of Artificial Sequence: Synthetic coding sequence
atggcaaactgcgagcgcacgttcattgccattaagccagatggggtacagaggggattggtgggcgagataatcaagcggtttgaacaaaaagggtttcggctcgtgggactgaagttcatgcaggctagcgaggatctgctgaaggagcattatgttgaccttaaggaccgtcccttcttcgccgggcttgtaaaatacatgcattctgggcccgtagtggccatggtctgggagggacttaatgttgtcaaaactggcagagtcatgctcggagagacaaacccagctgactcgaaacctggaactattcggggggacttctgtattcaggtcggtcggaccatggcaaatctggagcgcacatttatcgccattaagccggatggggtgcagcgaggtctggttggggaaatcattaagcgcttcgagcagaaaggttttagactggtcgcaatgaaattccttcgcgcctcagaagaacacttaaaacagcattacatcgacctgaaggacagaccatttttccccggactggttaaatatatgaattccggtcctgtcgtggcaatggtgtgggagggactgaatgtggtgaaaacggggcgagtgatgctcggcgagactaaccccgccgattccaagccaggtaccatcagaggggacttttgcatacaagtagggcgaaatatcattcacggctctgactctgtgaagtcagcagagaaagagatatccttgtggttcaagccagaggaactggtggactataagtcatgcgctcacgactgggtctacgagtag

SEQ ID NO: 15849 - DNA, 879 bp, Artificial Sequence
  Description of Artificial Sequence: Synthetic coding sequence
atggtcctcctttcgaccctgggcattgtcttccagggcgagggccctcctatttccagctgtgatactggcaccatggctaattgtgagcgtacatttatagcaattaaacctgatggcgtccaaagaggactagtgggggaaataattaagcgatttgagcagaagggatttagattggtgggcctgaagtttatgcaggccagcgaggatctgctcaaggaacattacgtcgacctaaaggatagacccttcttcgctgggttggtgaaatacatgcatagcggcccggtggttgccatggtatgggaaggactgaatgtcgtcaagaccggacgtgttatgctcggagagaccaacccagccgactcaaagcccggcacaatcagaggggatttctgcattcaggtgggccgcaccatggccaacctagagcgtaccttcatcgctatcaagcctgacggcgtccagagggggctggtcggcgagatcattaagcgcttcgaacagaaagggttcagactcgtcgcaatgaagttccttagagcatcagaagagcacctgaagcagcattacattgacttgaaggacagacccttcttcccgggcctggtgaagtacatgaattccggcccagtggtcgctatggtgtgggagggactgaacgtcgtgaagacaggacgcgtcatgctgggcgagaccaatcccgccgattctaaacctggcaccatccgcggtgatttctgcatccaggtgggccggaacatcatccacggcagcgacagcgtcaagagcgccgagaaagaaataagtctgtggttcaaacctgaggagcttgttgattataaatcttgtgcccatgactgggtgtatgagtag

SEQ ID NO: 15850 - DNA, 492 bp, Artificial Sequence
  Description of Artificial Sequence: Synthetic coding sequence
atgaaaagcagccaaacttttgaagaacaaaccgaatgcatcgtgaataccctgctgatggatttcttgtccccaactttacaggtggcgagtcgaaatctgtgctgcgtcgacgaagtagactcaggtgagccatgcagcttcgatgtcgctatcattgcaggcaggcttagaatgctgggcgaccaattcaatggcgaactggaagcaagcgcgaagaacgtgatcgctgagaccatcaagggtcagactggtgcaattcttcaggacaccgtcgaaagtttgtccaagacgtggtgcgctcaggattccagcctggcctacgaaagagctttccttgccgtgagcgtgaaactgctcgagtacatggcccacatcgcaccagaggtggtggggcaggtggcaattcctatgacgggcatgattaacggaaaccaagctatccgggaatttatccaaggacagggtggttgggagaatctggagagttag

SEQ ID NO: 15851 - DNA, 558 bp, Artificial Sequence
  Description of Artificial Sequence: Synthetic coding sequence
atgggaaaaaagcagaataagaaaaaggttgaagaggtccttgaggaggaagaggaagagtatgtagttgagaaagtactggatagacgcgtggtgaagggcaaagtcgagtaccttctgaaatggaagggcttctcagatgaggacaatacatgggagccagaggaaaatttggattgccctgacctgatcgctgaatttctacaatcacagaaaactgcccatgagaccgacaagtctgagggaggaaagaggaaggctgattccgattccgaggataaaggagaggagtccaaacccaagaaaaaaaaggaagaaagtgagaagccgaggggctttgctagggggctggagcccgagcgcataatcggggccaccgatagctctggagagttgatgttcctgatgaagtggaaaaacagtgacgaggccgatctggtcccagctaaagaggccaatgtcaaatgcccccaggtcgtgattagcttctacgaagagcggcttacttggcattcctacccaagcgaggacgacgataaaaaggacgacaaaaattag

SEQ ID NO: 15852 - DNA, 1350 bp, Artificial Sequence
  Description of Artificial Sequence: Synthetic coding sequence
atgatgctggggacagaaggcggcgaagggtttgttgtcaaggtccgaggactgccctggtcttgtagtgccgatgaagtgcagaggttctttagtgactgtaagatccagaacggcgcacagggaattaggttcatatacaccagagaaggcaggccgagcggcgaagcctttgtggagctagaaagtgaagatgaggttaagctcgcgctgaagaaggaccgcgagacaatggggcatcgctatgtggaggtctttaagtccaacaatgtcgaaatggactgggtactcaagcatacaggacctaatagcccagataccgccaatgacgggtttgtccgactgagaggtctcccattcggctgcagcaaagaggagatcgtacagtttttttcgggcctggagatcgtgcctaacggcataacactgcctgtggacttccagggccgttcaaccggtgaagccttcgtgcaattcgcatctcaggaaatcgcggagaaggccctcaaaaagcacaaggagaggattggccatcggtacatagagatctttaagagctcacgggccgaggtgaggactcattatgaccccccgcgaaagctcatggccatgcagaggccaggaccttatgatagacccggcgctgggcgcgggtataacagcatcgggagaggggccgggttcgaaagaatgaggcggggcgcgtacggtgggggctatggcggatacgacgattacaacggatacaatgatggatacggatttgggagcgacagatttgggcgcgatctcaactactgtttctccggcatgtcagaccaccggtacggcgatggcggctctacattccagtccacgaccggccactgcgtgcacatgcgcggcttgccataccgtgctacagagaatgacatctataacttttttagtccccttaatcctgtgcgggtgcacatagaaattggcccagacggtcgcgttacaggggaggcagacgttgagtttgctacacacgaagacgccgtcgcggccatgagcaaggataaagctaatatgcagcatagatacgtagagctctttttgaatagcaccgccggcgcttcgggtggtgcttacgaacaccggtacgtcgagcttttcctgaactccactgctggcgcctccggcggtgcttatggctctcagatgatgggcgggatgggactctccaatcaatcaagttacggtggtcccgcaagccaacaactatccggtggttatggcggtggctatggtggccagtcttccatgtctggatacgaccaagtgctgcaagagaattccagtgattttcaaagcaacattgcatag

SEQ ID NO: 15853 - DNA, 741 bp, Artificial Sequence
  Description of Artificial Sequence: Synthetic coding sequence
atgtctggcgctggtgaggcgcttgcacctggtcccgtgggtccacagcgagtcgccgaggctgggggaggacagctcgggtctacagctcaggggaaatgcgataaagacaacacagaaaaggatattacacaggcaactaattcacactttacacatggagaaatgcaggatcagagcatatggggaaacccctccgacggtgagttgatcaggactcaaccccaacggctgcctcagctgcagacatcagcccaagtgccatctggagaagaaatcgggaagatcaagaacggacataccgggctttcaaacggcaacgggatccaccatggcgcgaagcatggcagcgccgataaccgaaaactttccgccccagtctctcagaagatgcaccgtaaaattcaaagtagcctttccgtcaattctgacatttccaagaagtccaaggtgaacgctgtcttcagccagaaaactgggtcaagccccgaagattgctgcgtacactgcattctggcctgtctgttctgtgaattcctgaccctatgtaacatcgtgctggggcaggccagttgtgggatctgtacttccgaggcctgctgctgttgttgtggtgatgagatgggagatgactgtaactgcccatgtgatatggactgcgggattatggacgcttgctgtgagagttccgattgtctggagatctgcatggagtgttgtggtatttgttttcctagctag

SEQ ID NO: 15854 - DNA, 30 bp, Artificial Sequence
  Description of Artificial Sequence: Synthetic coding sequence
atgagttactaccagcggcctttctcttag

SEQ ID NO: 15855 - DNA, 2001 bp, Artificial Sequence
  Description of Artificial Sequence: Synthetic coding sequence
atgaatacgggcagggacagccagtctcctgatagtgctaaagggttccgatcggtgcggccaaatctgcaagacaagagatcccctacccagagccagattaccgtgaacggcaactccggcggggccgtgtcaccaatgtcctactaccaacgtcctttctcaccctccgcatacagcctaccagcatctttgaattcttcgattgtaatgcagcatggcacgagcttagactccacagatacatacccccagcatgcccagtctctcgatggaaccacgagcagctccatccccttgtatcgctcctctgaagaagaaaagagggtaaccgtcattaaagcccctcattaccctggtatcggacccgtggacgaaagtggaattcccaccgcaatcaggaccaccgtggaccgcccaaaagactggtacaaaacaatgtttaagcaaattcacatggtgcataaaccggacgatgacaccgatatgtataatactccttacacttacaatgccgggctttacaaccccccctatagtgcccaatcgcatccagctgctaagacacagacctatcgacccctctcaaaatcacacagcgataactctcccaacgcttttaaagatgcatcatctcctgtccctcctccccacgtgcctccaccagtcccaccactgaggccaagagatcgaagctccaccgaaaaacacgattgggaccccccggacagaaaggtcgacactagaaagttccggtcagagccccgttctattttcgaatacgagccaggcaagagttctatcctgcaacacgaacggcctactgacagaatcaatcccgatgacattgatctggagaacgagccctggtacaagttcttttccgaactggaatttggcaggcctccgccaaagaagccccttgattatgtgcaagatcacagttcaggtgtttttaatgaggcatctttatatcagtccagtatcgataggtctctggaacggcctatgtcatccgccagcatggcctcagattttcggaagagacgcaaatccgagccagccgtgggccccccacgaggactaggggaccagtctgcatcccgcacttcaccgggccgtgtggacctgcccggttcctctaccaccttgacaaaatcattcacctcaagctcccctagttcaccatcgcgtgcaaaagaccgggaaagccccagaagttacagctcaacactcacggacatggggcgctctgctccccgggagaggagaggtacacccgagaaggagaaactacccgcaaaggcggtgtatgacttcaaagcgcagacatccaaggaattgtcgtttaaaaagggcgataccgtgtacatcctgaggaagattgatcagaactggtatgaaggtgagcatcacggcagggtgggtatatttcccatcagctacgtggaaaagcttacacctcccgagaaggcccaacctgcgcgccctccaccccctgcgcaacctggggagatcggagaggccatcgccaaatacaacttcaacgcagatactaacgttgagctgagcctgaggaaaggggatcgagttatcctgttaaagcgcgtggaccaaaactggtatgaaggaaaaatacccggtacgaacaggcagggtatcttccccgtctcttatgtcgaagttgtgaagaagaatacaaagggtgccgaggattaccctgacccacctatcccacattcctacagtagtgaccgaattcacagtcttagctcaaacaagcctcagcggcctgtgttcacccacgagaatattcagggcggtggtgaaccattccaggcactctacaattacacacccaggaacgaggacgagctcgagctcagagaatccgacgtaattgacgtaatggaaaaatgtgacgatggttggttcgtggggaccagcaggcgtactaaattttttggcaccttccccggtaattacgtgaagagactgtag

SEQ ID NO: 15856 - DNA, 2472 bp, Artificial Sequence
  Description of Artificial Sequence: Synthetic coding sequence
atgaccctcttatccagccagagttcaagtcttgtcgccccctctgggtcggtaagtgccgaaaacccagaacagcgtatgctggaaaaaagggctaaagttatcgaagagctgctgcagacagagcgtgactacataagagacctggaaatgtgcattgaacggataatggtaccaatgcagcaggcccaagtgcccaacattgacttcgaaggcctctttggcaatatgcagatggtgattaaagtcagcaagcaactgcttgctgctctggaaatttctgatgctgttgggcccgtgtttctagggcatcgcgatgagttggagggcacttataaaatttactgtcagaatcatgacgaagctatcgcactcttagagatctatgaaaaagacgaaaaaattcagaaacacctccaggactccttggcagatctcaattctcttgtcctcaagaaaggctgtacgaactacatcaatctcgggagcttcctgatcaaacctgtccaaagagttatgcgctaccctctgctattaatggagctcctgaattctacacccgaaagccatccggacaaggtacccctgacgaatgccgttttggcggttaaagagatcaacgtaaacattaatgaatacaagagaagaaaggacctggtactcaaatatcgcaaaggcgacgaagattccctgatggaaaagatctccaaacttaacattcatagtatcattaagaagagtaaccgggtgagctcccatctgaaacacctcactggttttgccccccagatcaaagatgaggtgttcgaagaaaccgagaagaacttcagaatgcaggaacgccttataaaatccttcatccgcgacctcagcctatatctgcagcatattcgggagtcagcctgcgtcaaggtggttgcagcagtatcaatgtgggatgtgtgcatggagagaggccacagggatttggaacagttcgaacgcgtgcaccggtacattagcgaccagctttttaccaactttaaagagcggactgagcggctggtgatcagcccattgaatcagttactttctatgttcaccgggccgcacaaattggttcagaaaaggttcgacaaacttctggacttttataattgcactgaacgagcagagaagctgaaagataaaaagacattggaagagctccagagcgcaagaaataattatgaagctcttaacgcccagctgctggatgaattgccaaagtttcatcagtacgctcaaggcctgttcactaattgcgtgcatggatatgctgaagcgcattgcgattttgtgcaccaggccctagagcagcttaaacccttgctgtcgctccttaaggtggctggccgggaaggcaatttgatagctatctttcacgaagaacactcccgggtactgcagcagctccaggtatttacattttttccagagagcctgccggccacaaagaaaccttttgaacgtaagaccatcgataggcagtccgcgcggaaacctctgctcggcctcccatcttatatgctgcagtcagaggaactgcgcgcctccttgctcgcgaggtaccctcctgaaaagctgtttcaagccgaacgcaatttcaatgctgcacaagatctagacgtgtccctactggaaggcgacctggtgggcgtgatcaagaaaaaagaccctatgggctcgcagaacagatggctaatcgataatggagtaaccaagggtttcgtgtatagttcatttctgaaaccatacaacccgcgtcgaagccattccgatgcgtctgtcggatcccactcgagcacggagtcagagcatggctcttcttccccccggttccctcggcagaactccggttccactctgactttcaacccgagcagcatggcagttagctttaccagcggcagctgtcagaagcaacctcaggacgcttccccccccccaaaggagtgtgatcaggggactctgtcagcctcactcaatcctagcaacagcgagtcaagtccaagcaggtgtccgtccgatccggattctacctctcagcccaggtccggggacagcgctgacgtagcccgggacgtgaaacagccaactgccacgcctaggtcataccggaacttcaggcatccagaaattgtgggctactcagtgcccggccgcaacggtcagtctcaagatttggtgaaaggatgcgcacggactgcacaggcccccgaggataggagcacggagcctgacggctccgaagctgagggaaatcaagtgtatttcgccgtgtatacattcaaagcccggaatccgaatgaactgtctgtgagcgcgaaccaaaagctgaagatactcgagtttaaagacgttacggggaatacagaatggtggctggctgaagtcaacgggaagaagggatatgtgccctctaattacataaggaagaccgaatacacgtag

SEQ ID NO: 15857 - DNA, 2964 bp, Artificial Sequence
  Description of Artificial Sequence: Synthetic coding sequence
atggcagagtcctcctccgaaagtgatcatttcagatgtcgggatcgcctgtccccctgggctgctagatccacgcacagagggacgcgtagccttcccacggttgaggtaacagagaaagttaatacaataacttccactcttcaggacacatcccgaaacctgcgtcaggtcgaccagatgctaggcaggtaccgggaatacagcaacggccaggccggagccattgagcacctcaaggagagtctggagcagagcatcgaccagctgagaagtcagagactactgaggaactccggcggaaggagcataagcgtcacctctctatcagcatcagatctagatggagggacggggtccgagttgcaccacttcccccctaccagtccgctcaaggactatggagacccgcaaggcataaaacgcatgcgtagccggacaggcgtgagatttgtccaggaaacagatgatatgactcagcttcatggttttcatcagagcctaagagacttatcttcagaacagattcggctcggggacgatttcaaccgggagctgagtcgcaggagtcgcagtgatgccgaaactaagcgcgcgttagaggagctcacggaaaagcttaacgaagcccagaaacaggaagtggtcagcgaccgagttgagcgcagactgcaggagttagaaagagaaatgaggactgagcgcgagctcgtggaacgtcggcaggatcagctggggctcatgtctctgcagctccaggaagcgttgaaaaaacaggaggcaaaggccgatgagcatgagggcgctatcaagaacaagttgcgccagaccgaaactgaaaaaaaccagctggagcaagagttagagttgagcaggagactgctaaaccaatccgagggctcaagggagacacttctgcatcaggtcgaagaacttcggacacagttgacaaaagccgagggcgatcgaaaaggactgcaacatcaagtcagccagatttctaaacagcagtctaattaccaagacgagcaaggagaagattggcgcttcagacggggagtagagagggagaagcaagatctcgaaaaacagatgtccgacctgagagtccagctcaattttagtgctatggccagtgagttagaagaggtgaagcgatgtatggagagaaaggacaaagagaaagcacacctggccagccaggttgagaatctgacccgagagctggagaacggagagaagcagcagctgcagatgctcgatcgcctcaaggaaatccaaaaccactttgatacatgcgaagccgaacgaaagcatgccgatttacaaatctctgaactcactcggcacgccgaagatgctacaaagcaagctgaaagatatctgagtgagctccagcagagtgaggctctgaaagaggaggctgagaagaggagggaagacttgaagttgaaggcccaggaaagcatacgacagtggaagttgaaacacaagaaattggagcgtgcactcgagaagcagtctgaaacggtggatgagttgactggcaaaaacaatcagattctgaaggagaaagacgagttgaaaactcagttgtatgctgctctgcaacagatcgaaaacttaagaaaggaactgaatgatgtcctcacaaagcgtgcattacaggaggaggaactccacagtaaggaggagaaactgagagacataaagagccatcaggccgatctcgagttggaagttaagaatagtttagatacaatccaccgactcgagagtgaattgaagaagcagagtaaaattcagtctcagatgaaggtcgagaaggcccacttagaggaggagattgcagagctgaagaaaagtcaggcccaggataaggctaaactgctggagatgcaagaatccatcaaggacctctcagccatccgcgcagacttagccaataagctggccgaggaggagagagctaagaaagcggtgctgaaggacctgagtgatctcacagcgcaggccaagtcaagggatgaagagaccgcaacgataataacacagctgaagttagaaagagacgtgcaccagcgggagctgaaagaccttactagctcgctgcaatcagtcaagacaaagcacgagcagaacattcaagaactgatgaaacattttaagaaggaaaagagtgaggcagagaatcacattagaacattaaaagcggaatcactggaggagaaaaatatggctaaaattcacagaggccagcttgagaaactgaaaagtcaatgcgaccgactaactgaggagctgactcagaatgagaatgaaaacaagaagctgaaactgaaatatcagtgccttaaggaccagctggaagagagagagaagcacatctctattgaagaggaacacctgcgtcggatggaggaggcccggttgcagctgaaggaccagctcctgtgcttggaaaccgagcaggaatcgattctcggagtgattggaaaggaaattgatgccgcatgcaagacattttctaaggactccgtagaaaagctcaaagtcttctctagcggcccagacatacattatgaccctcaccgctggctcgccgaatcgaaaaccaagctgcagtggctgtgtgaggagctcaaggaacgcgaaaatagagagaaaaacctgcgacaccaactgatgctgtgtcgacagcagctccgaaaccttaccgaaaacaaggaatcagagttgcagtgcctcttccaacagatcgagcgccaagagcagctcttagatgagatccacagagaaaaacgcgacctactggaagagactcagagaaaagatgaagaaatgggatctctgcaggatcgcgttatcgcactggagacctctacgcaagtagcactcgaccatctggaaagcgtgccagagaaactgtccctgctcgaggactttaaggatttccgccgctag

SEQ ID NO: 15858 - DNA, 5157 bp, Artificial Sequence
  Description of Artificial Sequence: Synthetic coding sequence
atgtcaggaacctcctcccccgaggcagtgaaaaagctgctagagaacatgcaatcagatctgagagcccttagcctcgaatgtaagaagaagttccctcctgttaaagaagccgccgagtccggcataattaaggtcaagaccatcgcagcccgcaacaccgaaatccttgccgcacttaaggaaaattcaagtgaggtggtccagccgttcctaatgggatgtggcactaaggagccaaagatcacccaactgtgtctagccgccattcagcgacttatgagtcacgaagtagtgagtgagacagctgctgggaatattatcaacatgttatggcagctgatggagaactccctggaggaactcaaactcctgcaaactgtgctagtactgctgactactaatacagtagtccacgatgaggccctctccaaagccatagtgctttgtttccgtctccatttcactaaggataatataacgaataacaccgctgcagcaacagtgcggcaggtggtgacagtagtgttcgagaggatggttgctgaggatgaacgtcacagagacattattgagcagcccgtgctggtccagggaaattcgaaccgccgttctgtttctaccctgaagccttgtgccaaagacgcatacatgctgttccaagacctgtgtcagctcgtgaatgcagacgctccatactggctggttgggatgactgaaatgacacgcaccttcgggctggagttgctggagtcagtccttaatgatttcccacaggtgtttctccagcatcaagagttctcattcttgctgaaagagcgcgtctgtcctctggtgattaagctgttctctcctaacatcaaattcagacaagggagcagcacaagctcatctcccgccccagtcgaaaagccctatttcccaatatgcatgcggctcctgagagtcgtatccgtccttatcaaacagttttactccttgcttgtcactgagtgtgagatctttctttccctcctggtgaaattcctagacgccgataagcctcagtggctacgagcggttgccgtcgagtctatccataggttttgtgtgcagccccagctactgcggtcattctgccagtcctacgacatgaagcaacactccacaaaggtgttccgagacatagtgaacgccctcgggagtttcattcaaagcctgttcctcgtgccacctactggaaaccccgcaaccagcaatcaggccggaaacaacaatctcggaggcagtgtatctgcacctgcaaattcaggcatggtgggcattggaggcggcgtgaccctcctgcctgccttcgaatacagagggacgtggatcccaatactgacgattaccgtccaaggatccgcaaaggctacatatttagagatgctcgataaggtggagccaccaaccattcccgagggctatgcgatgtctgtggcattccattgtctattggacctcgtccggggaattacgtccatgatcgaaggagagcttggagaacttgagactgagtgtcagacaactacagaggaggggagcagtccgacccaatctacggagcaacaggacctgcagagcacatcagatcagatggacaaggagatagtgagccgagcggtgtgggaggaaatggtgaacgcctgctggtgtggactgctggcagccttaagcttgctgctggatgcaagcaccgacgaggccgccacagagaatattctcaaagccgagctcacaatggctgctttgtgcgggagactggggctagttacatcccgggatgccttcattacagccatttgcaaaggcagcctccctccacactatgcactgactgttttgaataccacaactgccgccacccttagtaacaagtcctacagtgtacagggccagagtgtcatgatgatatctccctccagcgagagccaccagcaggttgtggccgtcggccaacctctggcagttcagcctcaggggaccgtcatgttgaccagcaaaaacatccagtgcatgcgaactctgctgaatctcgcccactgtcatggggccgttttgggcacctcttggcagttagtgcttgctacactgcaacaccttgtgtggattctgggtttaaaaccttcatccgggggggcattgaaacctggaagggctgtagaaggccccagtaccgtactcacgactgctgtgatgaccgaccttcccgtaataagcaacatcctgagccgactgttcgagagtagccagtaccttgacgacgtgtccctgcatcacctgatcaacgcgctctgtagtctctcactggaagctatggacatggcgtatggtaacaacaaagagccatccctctttgccgtggcgaagctcctggagactggcctcgtgaacatgcaccgaatcgagatcctgtggcggccactgacaggtcatctgcttgagaaagtgtgtcagcatcccaactcccgtatgagggagtggggagcagaggccttgacctctttgattaaagctgggctgacgttcaaccatgatcccccactctctcaaaaccagcgactccagttattgctgcttaaccccctgaaggaaatgtcaaacatcaaccatccagacatccgcttaaagcagttagaatgcgtcctccagatactccaatcacagggcgatagtttagggccaggctggcctctggttctcggtgtcatgggggcaattaggaatgatcagggcgagagcttaatccgaactgctttccagtgcctgcagctcgtagttacggacttcttgcctacaatgccctgcacatgcctgcagattgtggttgacgttgccggttccttcggtctgcacaatcaggagcttaatatatccctgacttctatcggcctgctgtggaatatcagtgattatttctttcagcgcggagagaccattgaaaaagaattaaataaggaggaagccgctcagcagaaacaagcagaggagaagggggtggtgcttaaccgcccattccaccctgcaccgcccttcgactgtctgtggttgtgtctgtatgcaaagctcggcgagctttgtgtggaccctagacctgccgtccgaaaaagtgccggtcaaaccctgtttagtaccatcggagcccacggcactttgcttcagcactctacctggcataccgtaatatggaaagtgctgttccacctacttgatcgggtgagggaatcatcgacgacagccgataaggaaaagatagagagcggcggagggaacatcttaattcaccattcacgggacaccgcagagaagcagtgggctgagacgtgggttctgacacttgctggtgttgctcggatttttaacacccgacggtatctgttgcagcccctgggggatttctcccgggcttgggacgttctgctggatcatatccagagtgcagccctctcaaaaaacaacgaggtatcattggcggcgttaaagtcttttcaggaaatcctccaaattgtcagtcctgtgagggattctgataaacctgagacaccccccgttgttaacgttccagtgcccgtacttataggtcctatctcaggtatgtctcgaccctttgttcgaacagattctataggagaaaagctcggccgctacagctcgtctgagccgcctatcgtgacagacgaactcgaagatttaaacctttggtgggccgcttggaatacgtggtacaggatcgggagcgagtctaccaaaccccccatcaccttcgataaactcacttttattccaagccagccttttctaacagcattaatccagattttcccagctctttaccagcacatcaaaacaggcttcaatatggatgatctccagaaactgggggtgatactgcactccgccattagcgtcccaatatcttcggatgcctcccctttcattctgcctagttatacagaagccgtgctcacctccctgcaggaagccgtactcaccgccctggacgtcctccagaaggccatatgcgtgggacctgaaaacatgcagatcatgtatcccgctatcttcgatcagctgttggcgttcgtggagttttcatgtaagccccctcagtatggccaactggaaactaagcacattgcaaacgctaaatataaccagatccagctatttgctcctgctgaatgggtcgctctcaattatgtgccatttgcagaacgcagcctggaagtggtcgttgatctgtaccaaaaaacagcatgccataaggcagtcgttaatgagaaagtccttcagaacatcataaaaaccctgagagtccccctgtctctgaaatacagttgtcccagcgagtcaacctggaagttggccgtttctagtctcctgcgggtgttgagcattgggctgccggtcgcgcgccagcatgctagttcagggaagtttgattcgatgtggcctgaactggccaatacattcgaggatttcctctttacaaagtccataccacccgataacttatcaatccaggagttccagagaaacgagaacattgacgttgaggtggtgcagctcatctctaacgagatcttgccctatgctaattttatccccaaagaatttgtggggcagatcatgactatgctgaacaaaggaagcattcacagtcaaagtagtagttttacagaggctgagatagatatacgcctgcgggaagagttttccaaaatgtgcttcgagactctgcttcagtttagcttcagtaacaaagtgacaactccccaggaaggctatattagccgtatggctctgtccgtgctactgaagcgatcacaagatgttctccataggtacattgaggatgaaaggctgtctgggaaatgtcccctgcctaggcaacaggtcacggaaatcatttttgtgctaaaggctgtgagcaccttgatcgactccctcaaaaaaacacagccagaaaatgttgacggcaacacttgggcacaggtaattgccctctatcccactcttgttgagtgcattacttgctcctcctcggaagtatgcagcgctctgaaagaggctctggttcctttcaaagatttcatgcagcctcctgcttcgagagtacagaacggtgagtcatag

SEQ ID NO: 15859 - DNA, 2100 bp, Artificial Sequence
  Description of Artificial Sequence: Synthetic coding sequence
atgtcctcccgcaaagtgctcgcaattcaagcaaggaagagacgtcctaagcgggaaaagcatcccaagaaaccggaaccgcagcaaaaggcacctttggttccaccacctcccccgcctccaccccccccgcctccaccgctacccgatcccacacctccggagcctgaggaggagatcttggggagcgatgacgaagaacaggaagaccccgcagattactgtaaaggcggataccatcctgtcaagatcggagatctgtttaacgggagatatcatgttatcaggaaactggggtggggacattttagtacagtgtggctctgttgggatatgcagggaaagagatttgtcgcgatgaaggtagttaagtcagctcagcactataccgagacagctcttgacgagattaagctgctcaaatgtgtccgcgagagtgaccccagcgatcctaataaggacatggtagtgcagctcattgacgactttaagatatctggaatgaatggtatccatgtttgcatggtctttgaagtgcttgggcaccacttgctaaagtggatcatcaaatccaattaccaaggcttgccagtaaggtgtgtgaagagcattatcagacaggttctccaggggctggattatctgcacagcaagtgcaaaatcattcatactgatataaaacccgagaacatcctcatgtgtgtggatgatgcctatgtgcggagaatggctgctgaggctacggagtggcaaaaagcaggcgctccaccccccagcgggtcagctgtaagcaccgcaccacagcagaaaccaatcggaaagattagcaagaacaaaaagaagaaattgaaaaagaagcaaaaacgccaggcagaattactagaaaaacgcttgcaggaaattgaggaactcgagcgtgaagcagaaagaaagataatcgaggagaacataaccagtgccgccccaagcaatgaccaggatggagagtattgcccagaagtaaaactaaagacaacagggctcgaggaggcagctgaggcggagacagcgaaagacaacggagaagccgaggaccaggaggaaaaggaagatgccgaaaaggaaaacattgaaaaggacgaggacgatgtggatcaggaactggcgaatatcgatcccacttggattgagtcaccaaaaactaacgggcacattgagaacggtccatttagcctggagcagcaattggacgacgaggacgatgacgaggaggattgccctaatcccgaagagtacaatctggacgaacccaacgccgagtcagattacacttacagctcgagctacgaacaattcaacggggaactgcctaatggacggcacaagatacctgagagtcaattccctgaattttctacgagcctgtttagcggttccctggagccggtggcttgtggaagcgtgctgagcgagggctcgccactgaccgagcaggaagagagctcccccagtcacgataggagtaggaccgttagtgctagcagtactggggatctaccaaaagctaagactagggctgccgatttactggtgaatccactggatcctcgtaatgccgacaagattcgggtgaaaattgcggacctcggtaatgcttgctgggtccataagcacttcacagaagacatccagaccagacagtacaggagcatagaggtgctgatcggcgccggctacagcacccctgcagacatctggtccaccgcctgcatggcgtttgaacttgctaccggtgactacctttttgaaccacacagcggcgaggactacagccgcgacgaggaccacattgcgcacattatcgaactgctgggctccatccccaggcattttgctcttagcggaaagtattccagggagtttttcaacagaagaggcgagctgcggcacatcaccaaactgaaaccgtggtccctgttcgacgtccttgtggagaagtatggctggccccacgaagacgccgcccagtttacagattttctgatcccaatgctggagatggttcccgaaaagcgagccagtgcaggggagtgcttaaggcatccctggctaaactcctag

SEQ ID NO: 15860 - DNA, 1113 bp, Artificial Sequence
  Description of Artificial Sequence: Synthetic coding sequence
atgggcttcaataggccaagcaagatacaggaaaatgctctcccactgatgctggctgagccgccccaaaatctgatcgcccaatcccaatccggcactggaaagacggctgcctttgtccttgccatgctatcacaggtggagcctgctaataaatacccccagtgtctgtgcctgagcccaacatatgaactggctcttcaaactggaaaggtgattgagcagatgggcaagttctacccagagctgaaattggcttacgctgtccggggtaataagttggagagaggacagaagatctctgaacagattgttatcggaaccccaggaaccgtcctggactggtgctccaaattgaaattcatagaccctaaaaagattaaggtgtttgttctcgacgaggctgatgtaatgatcgcgacacagggtcatcaggaccagagcatcagaattcagcggatgctcccgcggaactgtcagatgcttttgttctctgccacttttgaagacagcgtttggaaatttgcccagaaagtggtcccagatcctaatgtcattaaactaaaaagagaggaggaaaccctggacaccattaaacaatactatgtgctgtgttcgtcccgggacgaaaaattccaggcactctgcaatttatatggggccattaccattgcccaggcaatgatcttttgccacacccggaagactgcatcctggctcgctgcagaattatctaaagaaggccaccaggtagccctgctatcaggagaaatgatggtggaacagcgagcggctgttatcgaacgttttagggaggggaaggagaaggtcttggtaacgaccaatgtatgcgcccgcgggattgacgttgagcaggtctcagtcgttatcaactttgacttacctgtcgataaggatggaaatcctgacaacgagacgtatttgcacagaattggccgcacaggaaggtttggaaaacgggggctggccgtaaacatggtcgatagtaagcactcaatgaatatcctcaatcggatccaagaacatttcaacaagaagatcgagcggctggacaccgacgatttagacgaaatcgaaaaaattgccaattag

SEQ ID NO: 15861 - DNA, 2640 bp, Artificial Sequence
  Description of Artificial Sequence: Synthetic coding sequence
atgttctggaagttcgacctgcactccagctcacacatcgatactctgcttgaacgcgaagatgttacccttaaggaattaatggacgaagaagatgtgctgcaggaatgcaaggctcagaataggaagcttatagaattcctcttgaaggctgaatgtctcgaagacctggtttcctttattatagaggaaccgccgcaggacatggacgaaaaaatcaggtacaagtacccgaatatatcttgcgagctcctaacaagcgatgtgtcacagatgaatgatcgcctcggggaagacgagtcgctgctgatgaagctgtactcttttttattaaacgatagcccgttgaatccattgttggcgtctttcttttccaaagtattaagcattctcatctcgcgcaaaccagaacagatcgttgattttctgaaaaaaaagcacgacttcgtcgatctgataatcaaacacattggtacctctgctatcatggacctgcttctccggctgttgacgtgcattgagcctcctcagccgcggcaggacgtgctgaattggctgaacgaagaaaaaatcattcagcggttggttgagattgtacaccctagtcaggaagaggatagacattcgaacgcgagccaaagcctgtgcgagattgtaagattgtccagggatcagatgctacagatccagaattccaccgagcccgatcctctcctggccactttagaaaagcaagaaatcattgaacagttacttagcaacatctttcacaaagaaaagaatgagtcagcgatagtgagtgccatccagatactccttaccctgctggaaacacgacggcccacatttgaggggcacatagagatctgcccgccagggatgagccattccgcttgtagcgtcaacaaatcagttctggaggccattcgggggcgcctgggctcgttccatgagctcctcctcgagccgcctaagaagtccgtaatgaagactacatggggcgtgctggaccctcctgttggaaacaccagactcaacgtgatccgtctcatctcttctttattgcagacgaataccagctctatcaatggggatctcatggaacttaactctattggcgtgatcctgaatatgtttttcaagtacacttggaacaactttctgcatacccaggtggagatatgcatagcattgatcctggcttccccgttcgaaaacaccgagaacgctaccattaccgaccaggactctaccggtgataatctgttgttaaagcacctgttccagaagtgtcagctaatcgaaagaatcctagaggcttgggagatgaacgagaaaaaacaagctgagggtggccggaggcacggatatatgggccaccttactagaatagctaactgcattgttcacagcaccgacaagggccccaacagcgccctggtgcagcagctgataaaagatctcccggatgaagtccgcgagcgctgggaaacattttgtacgtctagtttgggcgaaacaaataaaagaaacactgttgaccttgttaccacgtgtcacatccatagctctagcgatgacgagattgattttaaagagactggatttagccaggactcctcactacagcaggcattctccgactatcagatgcagcagatgacatctaatttcatcgatcagttcgggttcaacgacgaaaaattcgcagaccaggatgacatcgggaacgtttcttttgatcgcgtttcagacattaatttcaccctaaacacaaacgaatcaggcaatatagccttgtttgaggcctgctgtaaagaacgcattcagcagttcgacgacggcggatctgatgaggaagacatttgggaagaaaagcacattgcattcacaccggagtcccagaggcgcagtagctcaggaagcactgactctgaggaaagtactgactcggaggaagaggatggggcgaagcaagacctgtttgagccttctagtgctaacacagaggataaaatggaggtcgacctctccgagcccccaaactggtctgcgaatttcgacgtgccaatggaaacgacccatggcgcacctttggactcggtgggcagtgatgtgtggtccactgaggagccaatgccgactaaggaaaccggctgggctagctttagcgagtttacgagttccttgagcactaaggattccctgcgcagcaacagccccgtggaaatggagacgtcaaccgaaccgatggatccactgaccccctccgccgcagctctcgctgtccagcccgaagcagccggatctgtcgccatggaagcatccagcgatggggaagaggatgcagagtcaactgacaaggtcaccgagactgtgatgaacggagggatgaaagagacactatcccttacagtagatgctaaaaccgagaccgctgtgtttaaacgcctcctggggggttgcagtgaagaaggcaagttgagcacttcacaagatgccgcctgcaaggatgccgaagagtgcccagaaactgccgaggcaaaatgtgccgccccgcggcctccctctagttctccagagcagaggaccggccagccaagcgctcccggcgatacatctgttaacggcccagtctag

SEQ ID NO: 15862 - DNA, 2622 bp, Artificial Sequence
  Description of Artificial Sequence: Synthetic coding sequence
atgttttggaaattcgacctgcacagctcatcacacatagacaccctcttagagcgggaagatgttacattgaaagagttgatggacgaagaggacgtgctgcaggaatgcaaagctcaaaaccgcaaactgatcgagtttctactgaaagccgaatgtttggaggatctggtgtcatttattatagaggagcccccgcaggatatggatgaaaagatccgttacaaatatcctaacatctcctgcgagctgctgacctctgacgtgtctcagatgaacgacaggttaggggaagatgagagtcttcttatgaagctttatagcttcctgttgaatgactccccgttgaatcctctgttggcaagcttcttttctaaggtgttgtctattctcatctcgcgcaaacccgaacagatagtagacttcctgaagaagaagcatgacttcgttgacttgatcatcaagcatattggcacctctgctatcatggatctgctgctgcggctcctaacatgtatcgagcccccgcagcctaggcaggacgtcctgaactggctgaatgaggaaaaaattatacagcgcctggtggagatcgtccacccgagccaggaagaagatcgccacagcaacgcctcacagtcactttgcgaaatagttcgtcttagccgcgaccagatgctccagattcagaactctactgaacccgaccctctcctcgcgacactcgaaaaacaggagataattgagcaactcctcagcaacatctttcacaaggagaaaaatgaaagcgccatagtgtcagcaattcagattcttttgactctcctggaaactcgccgccctacattcgagggccacatcgagatttgtcccccaggtatgagccatagtgcatgctccgttaacaagtcagtgctcgaagccattagggggcgcctcggctcctttcacgaactgctgttggaacctccaaagaaatctgtgatgaaaactacatggggcgtccttgatcctcctgtcggtaacacacgactgaatgtgatcagacttatctcctctctgctacagactaacacctctagcatcaacggtgatttaatggaactgaatagcattggcgtcatcctcaatatgtttttcaaatatacctggaataattttcttcacacgcaggtagaaatatgcatcgccctcatactggcttcccccttcgagaacacagagaacgccactatcaccgaccaagatagtactggagacaatctgcttctcaaacacctctttcaaaagtgccagctcatcgagagaattctggaagcctgggaaatgaatgagaaaaaacaggcagagggaggcagacgacatggatacatgggtcaccttactcgtatagcaaattgcatcgtccactctaccgacaagggaccgaactcagctcttgtgcagcagctcataaaggacttgcccgatgaagtacgggagcgctgggaaacgttctgtacctcgagtctgggagaaactaataaaagaaatacagtggacctggtaaccacctgccacatacattcaagctcagacgacgaaattgatttcaaggagacaggcttctcacaagatagcagcctgcagcaggctttctcagattaccaaatgcagcagatgaccagcaacttcatcgaccaatttggatttaacgatgagaaattcgccgaccaagacgacatcgggaacgtgagttttgatcgggtttcagatataaactttacactcaacaccaatgaatctgggaacatcgccctcttcgaggcctgctgcaaggagagaatacagcagttcgatgatggaggttctgatgaagaggacatatgggaggaaaagcacattgcttttaccccagagagccagcggaggagcagctccggttccactgactctgaggagtccaccgattccgaagaggaagacggtgccaaacaggacctttttgaaccatccagcgccaacactgaggacaaaatggaagtggacctgagtgagccaccgaattggagtgccaacttcgacgttcccatggaaacaacccacggggcaccactggattcagtggggtccgacgtctggagcactgaagagcctatgccaaccaaggagactggatgggcaagcttcagtgaatttacatcttctctatcaaccaaagattcccttagaagcaactcccctgtcgagatggaaacctctacagaaccaatggaccctttgacaccatcagccgccgcgctggctgtgcagccggaggccgctgggtctgttgcaatggaggccagctcagacggtgaagaagacgctgagtctacggataaagtgaccgaaactgtgatgaacggaggtatgaaggaaacattgtccctgacagtggatgccaagacagaaacagccgttttcaagtcagaagaaggcaagctctccacatcccaagacgccgcctgtaaagacgcggaggagtgtccggaaaccgccgaagctaaatgtgctgcacctcgccccccttcatccagccctgagcaaaggacggggcagccctcagccccaggtgacacctccgtgaacggacccgtctag

SEQ ID NO: 15863 - DNA, 2640 bp, Artificial Sequence
  Description of Artificial Sequence: Synthetic coding sequence
atgttctggaaattcgatttgcattcaagctcccacatcgatacccttctggagcgggaggacgtaaccctcaaagagcttatggatgaggaagacgtccttcaggaatgcaaggctcagaacagaaaactgatagagttccttctgaaggctgagtgccttgaagacctggtgtcctttatcatcgaagagcccccccaggatatggacgagaaaatacgttataagtaccccaacatttcttgcgaactactgacgagcgatgtgtcacaaatgaatgaccgcttgggggaggacgagagcctcctcatgaagctttattctttcctgctgaatgattcccccctgaatcccttgctggcctcattctttagtaaagtgctgtcaatactcatcagtcggaaaccagagcaaatagtggacttcctaaagaaaaaacacgattttgtggacctcatcattaaacatatcgggacctccgcaatcatggacttgctcctgagactgttaacttgtattgagcccccccaaccacgccaggacgtgctcaactggctcaacgaagaaaaaattatacagcggctggttgagatcgtacatccatcgcaggaggaagacaggcactccaacgcctctcaatccttgtgtgaaattgtgcgcctgagccgcgatcaaatgttgcaaattcaaaactcaactgaacccgacccattacttgccacattggagaagcaagaaattatcgaacagctgctgtctaacatttttcataaagaaaaaaatgagagcgcaattgtttccgctattcagattctgctgaccctgctcgaaacccgcaggcccacctttgaaggccacatcgagatctgtccccccggaatgagtcactccgcctgttcagtgaacaaaagcgttttagaggccatccgcggtcgcctaggatcttttcatgagttgctgctggaaccccccaaaaagagtgtcatgaagacgacatggggggtcctcgatccaccggtgggtaatacccggctgaacgtgattcggctaatcagcagcctgttgcagactaacacatcaagcatcaacggggatctcatggaactgaactctattggagttatcctgaatatgtttttcaagtacacatggaacaattttctgcacacccaggtcgaaatttgcatcgctctcattctggcatccccatttgagaacaccgagaatgctactataacggaccaggactctacgggagacaatcttctacttaagcacctgtttcagaagtgtcagctcattgagagaatccttgaagcctgggaaatgaacgaaaagaaacaagcagaggggggcagaagacacgggtacatgggccatctcaccagaatagctaactgtattgtccactctacggataaaggaccaaacagcgcactcgtccagcagctcataaaagacctgcccgacgaggttagggagcggtgggagacattctgcacaagctcgctgggtgaaacaaataagagaaacaccgtggatctggtcaccacttgtcatatacacagctcctctgacgatgaaattgatttcaaagagactggattctcacaagactcatctcttcagcaggccttctccgactaccagatgcagcagatgacaagcaacttcatcgatcagttcggatttaacgacgaaaagtttgcagaccaggacgacatcgggaacgtgtctttcgatcgggttagcgacatcaattttaccctcaacactaatgagtccggcaatatagcattgtttgaagcatgttgtaaagagaggatccagcagttcgacgacggcggctccgacgaggaggatatttgggaagaaaagcacatcgccttcactcccgagtctcagcggcgaagctcgtcaggttctacagatagcgaagagtccacagactccgaggaggaggacggcgcgaagcaggacttgtttgaacctagcagcgccaataccgaggacaagatggaggttgatttatcagagccccctaactggtctgcaaactttgatgtgccaatggagacaacacacggagctccactagacagcgtggggagcgatgtgtggtcaaccgaggagcctatgcctacaaaggagaccggctgggccagctttagcgagtttacttccagtctgtccacgaaggactctctgagaagcaatagtccagtggaaatggagacgtccactgaaccaatggacccccttacccccagcgcagccgcactcgccgtgcaacctgaggctgcagggtctgtggccatggaagcaagcagtgatggggaagaggatgcagagtctacagacaaggtgactgagactgtgatgaacggcggaatgaaagagaccttgagtcttaccgtcgacgcaaagacggaaaccgccgtgtttaaacgcgtgctgaaaagctatagagaagaaggaaaactctccacatcacaagacgcagcttgcaaggacgccgaggaatgcccggagactgctgaagccaagtgcgccgctccccgtcctcccagctccagtcccgagcagagaacaggacaaccatctgcaccaggcgatacaagcgtgaacggcccggtgtag

SEQ ID NO: 15864 - DNA, 1134 bp, Artificial Sequence
  Description of Artificial Sequence: Synthetic coding sequence
atgtccgacgaagtgttctcaacaactttagcctacacaaaaagccccaaagtgactaagcgcacgacttttcaggacgaactaatcagagctatcactgctcgaagcgcccggcagcgcagctctgagtactccgacgactttgacagtgatgaaatcgtcagccttggggatttcagcgacacatccgcagacgagaattctgttaacaagaagatgaatgatttccacatcagcgatgatgaggagaaaaacccctccaaactgttattcctaaagacgaacaaatctaacggcaatataacgaaggacgagcctgtttgcgccatcaaaaatgaggaggagatggccccagatggctgcgaagatatcgtcgtaaagagtttctcagagtctcagaataaagacgaggaattcgagaaagacaagattaagatgaaaccaaagccaaggatcctttcaatcaagagtacatccagcgctgagaacaattccctggacacagacgaccacttcaaaccttcccctcgcccacggagcatgctaaagaaaaagtcccatatggaggaaaaggacggtctcgaggacaaggagacggcccttagcgaagaactagaactccacagcgcccccagttcattgcctacgccaaacggaatccagctggaggctgaaaaaaaagcattctcagagaaccttgatccagaagatagctgcctgaccagcttagcatcttcctccttgaagcaaatactcggcgactcgttttctcctggaagcgagggaaacgcctctggcaaggacccaaatgaggagatcaccgagaaccacaattccctcaagtctgatgaaaacaaggagaatagtttttcagccgaccatgtcactactgccgtggagaagtcaaaggaatcccaggtcaccgccgatgacctggaggaagaaaaggccaaggcagagctcattatggacgacgataggactgttgaccctctgctgtcaaaatcccagtctattctgatatctactagcgccaccgcatctagtaaaaaaacaattgaggatcggaacatcaagaacaagaagagtacaaataacagggcctcatcggcctcagcttcaaaggcaagctag

SEQ ID NO: 15865 - DNA, 576 bp, Artificial Sequence
  Description of Artificial Sequence: Synthetic coding sequence
atggggaagagttgcaaagtcgtggtctgtggccaggccagcgtcggtaagacttccattctggagcagctgttatatggcaatcacgtcgtaggatccgaaatgatcgaaactcaggaggatatctacgtggggagtatcgagaccgatcgcggcgtacgagaacaggtaaggttttatgataccagaggactcagggacggcgctgaactgcccaggcattgcttttcgtgtacagacgggtatgttctcgtttacagcacggactctcgggagagcttccagagggtggaactccttaaaaaggagatcgacaagagcaaagacaagaaagaagtgaccattgtcgtccttggcaataaatgtgacctgcaggaacagcggagagtggatccagacgtggcccagcactgggcaaagagtgagaaggtgaaactatgggaggtcagtgtagccgacagaaggagtttgcttgaaccatttgtctatctggccagcaagatgacccagccccagtctaaatccgcatttccgctctctcgcaagaataagggaagtggttccctcgacggctag

SEQ ID NO: 15866 - DNA, 576 bp, Artificial Sequence
  Description of Artificial Sequence: Synthetic coding sequence
atgggcaaatcctgtaaagttgtggtgtgcgggcaggcgagcgtcggaaaaacatctatcctcgaacaacttctgtacgggaatcatgtggtgggctcagaaatgatagagactcaggaagacatttatgttggaagcattgagactgaccgcggagtgagagagcaggtacgtttctatgacacccgcggcttaagggatggcgccgaactgcccaggcattgcttctcctgcaccgacggctacgttcttgtttactcaactgattccagggaaagttttcagcgggtcgaactgctgaagaaagagatcgataagagtaaagataaaaaagaagtgaccatcgtggtgctggggaacaaatgcgacctccaagagcagaggcgggtggatccagacgtcgcacagcattgggccaagagcgaaaaggtcaaattgtgggaggtatctgtagctgatcggcgatccctgctcgagccttttgtgtacctagcctccaagatgacccagccccagtcaaaatccgcattccccctaagccgcaagaataaaggctcaggcagtctggatgggtag

SEQ ID NO: 15867 - DNA, 570 bp, Artificial Sequence
  Description of Artificial Sequence: Synthetic coding sequence
atgggcaaaagctgcaaggtagtggtatgcggacaagctagcgtcgggaaaacatccatcctggaacagttgctgtatggaaaccacgttgtggctatgatagagacccaggaggatatttacgtgggctcgattgaaacggaccgcggtgtccgggagcaggtgaggttttatgatacgaggggcttgagggacggggcagagctgccccggcattgtttttcgtgcacggatggctacgtccttgtctactccacggattcacgcgagtcatttcaacgagttgagttgcttaaaaaggaaattgacaagtctaaggataagaaggaggttaccattgtcgtgctcggcaataagtgcgatcttcaggagcagaggagggtagaccctgacgtcgcccaacattgggccaaaagtgagaaggtgaaactgtgggaggtatctgtggcggataggcgatctctcctcgagccctttgtgtacctcgcttctaaaatgactcagccccagtccaagagtgcctttccgttgtcaaggaaaaataaaggctcaggctccctagacggctag

SEQ ID NO: 15868 - DNA, 576 bp, Artificial Sequence
  Description of Artificial Sequence: Synthetic coding sequence
atggggaagtcgtgcaaggttgtcgtgtgtggacaggcctccgtcggcaagacctcaatcttagagcagctgctgtatggtaatcacgtggttggttctgaaatgatcgaaactcaggaagatatttacgtagggagcatcgagacagaccgtggcgtgcgggagcaggtgagattttacgacacaaggggcctgcgtgacggcgccgagcttccccgccattgtttctcttgcacggatggctatgtactggtgtattctactgattcacgtgaatcttttcagagagtggagttgctcaagaaggagattgataaatccaaggataagaaggaagtaaccatcgtggtacttgggaacaaatgtgatctgcaggagcaaagacgtgtggaccccgatgtggcccagcactgggctaagtccgaaaaggtcaagctctgggaggtttcagtcgcagacaggcggagtctgcttgaaccatttgtatacctggctagtaaaatgacacagccccagtcgaagagcgcatttccactcagccggaagaacaagggaagcggctctctggacgggtag

SEQ ID NO: 15869 - DNA, 1005 bp, Artificial Sequence
  Description of Artificial Sequence: Synthetic coding sequence
atggcagaagaggtacgtagagaggaggcctcaggcgtcgggcgggcgaggacacctacacccggtgcgctgcgtgctccccaattagtgacagaggcccctccactgcatcccggacatactctaatgaaggctactgtcctgatgaggcagcccgggagagttcaagagatcgtcggcgccctgcgtaagggggggggagatagactgcaggtgatcagcgacttcgacatgaccttgtccaggttcgcttacaacgggaaaagatgcccctcatcctacaatatcctggataactccaaaattatatctgaagaatgccggaaggaactcacggcccttctccaccactactatcctattgaaatagatccacaccggacagtgaaggaaaagcttccacatatggtcgagtggtggactaaggcacacaacctgctgtgtcagcagaaaatccaaaaattccagatcgctcaagtggtgcgcgagtctaatgctatgctaagagaagggtacaagacattctttaataccctgtaccacaataacataccccttttcatcttctccgcaggtatcggcgacatcctagaggagattatccgacagatgaaggtgttccatcctaacattcacatcgtctctaattatatggattttaatgaggatggttttttgcagggtttcaaagggcagctcattcacacctacaacaagaatagctccgcctgtgagaacagcggctattttcagcagctggagggaaaaactaatgtcatactgctcggcgactccataggggatttaaccatggcagatggcgtaccgggggtgcagaatattctgaaaattggctttcttaatgacaaggtcgaggagcgtagggagagatacatggattcctatgacatagttcttgagaaagatgagactttggatgtggtcaacgggctccttcagcacatactgtgccagggtgtgcagctggaaatgcagggcccatag

SEQ ID NO: 15870 - DNA, 531 bp, Artificial Sequence
  Description of Artificial Sequence: Synthetic coding sequence
atggccgcatctactgatatggccggcctcgaggaatcatttcgcaagttcgccatccatggtgaccctaaggcgagtgggcaagagatgaacggaaagaactgggcaaagctctgtaaagattgcaaggtggcagacggcaaaagtgtgacaggcaccgatgtcgatatagtgttcagtaaggtgaagggtaaaagcgcacgggtcataaactatgaagagttcaagaaggctctcgaggagttagctactaagcgctttaaaggcaaaagtaaagaggaggccttcgacgcgatatgtcagctggtggcagggaaagaaccagcgaacgttggcgtcactaaagctaagacagggggagctgtggacagacttacagacacctccagatatacaggatcacataaggaacgctttgacgagtcgggcaagggtaagggtattgcgggacggcaggacattctggacgactccggttatgtgtcagcatacaaaaatgcaggtacttacgacgccaaagtgaaaaagtag

SEQ ID NO: 15871 - DNA, 912 bp, Artificial Sequence
  Description of Artificial Sequence: Synthetic coding sequence
atggatagcttgcccgatgaatttttcgtgcggcaccctgctgtcgaggatcagagaaaagaagagactgaaaacaagttggagaagagttccggccagttgaataaacaagagaacgacatcccaacggatcttgttccggtgaaccttttattagaagtgaagaaattgctcaacgcgattaacactctgcctaagggtgtcgttccacacatcaagaaatttctccaagaggacttcagtttccagactatgcagagggaggttgccgctaactcacagaacggcgaagaaatcgtgcctgccctgacactgagattcctgatcactcaactggaagcagccctaaggaacattcaggccggtaattatacagctcatcaaattaacattggatactacctgactctgctgtttctgtacggagttgcccttaccgaaagaggaaagaaagaagactacactgaagcagagaataaatttctggtgatgaaaatgatgatccaggaaaatgagatttgtgagaactttatgagtctagtctacttcggacgaggcttgctacggtgtgcccagaagcggtataatggcggtttgttggagtttcataagagtctgcaggagatcggagataaaaatgaccactggttcgatatcgacccaaccgaggacgaagatctgcccaccacttttaaggatctcctcaataacttcattaaaacaacagagtctaacatcatgaagcagacaatctgttcctatctggattgcgagcgtagttgcgaggcagatattctgaaaaatactagctataagggttttttccagctcatgtgcagcaaaagctgttgtgtatatttccataagatctgttggaagaagttcaagaacttgaaatatccaggcttctag

SEQ ID NO: 15872 - DNA, 1869 bp, Artificial Sequence
  Description of Artificial Sequence: Synthetic coding sequence
atggatttactaacaagggagaatgtagcgctcaaggtagaatctgctcagcagcccaagcaggtgctcaaaatggaggtggcagtattgaagaagcttcagggcaaggaccacgtttgccggttcatcggatgcggccggaatgagaaattcaattacgtggtgatgcagctgcaagggcgaaatctggcagacttgcggcgcagccaacctaggggtacattcactctctcaactacactcaggctaggcaagcaaattctggaatcaatagaagctatccatagcgtcgggtttcttcatcgcgacatcaaaccctccaactttgcaatgggcaggctgccctcaacttacaggaaatgttacatgctggactttggattggcccggcaatacactaacaccaccggagacgtgcgcccgcctcgtaacgtggccggcttcagaggaaccgtgagatatgcttctgttaacgcacataagaatagagagatgggccgtcacgatgacctgtggtcactgttctacatgctggtagagttcgcggttggacaactcccctggcgtaagatcaaagacaaggaacaggtgggcatgattaaagagaagtatgaacaccggatgctgctgaaacacatgcccagtgagttccacctgttcctcgaccacattgcgtccctagactactttacgaaaccagactatcagctgattatgagcgtgtttgagaattccatgaaggaacgcggaatcgccgagaatgaagccttcgactgggagaaggcggggactgacgccctgctttcaactagtaccagcacacccccacaacagaatacgcgtcaaactgccgctatgtttggcgtggtgaacgtgacacccgtacctggcgatctccttcgcgaaaatacagaagatgtgctgcagggcgaacacctcagcgatcaggaaaacgctccccccatactcccaggaagaccttccgagggccttggacctagcccacatctggtgccacacccgggcggtccagaggccgaagtgtgggaggagacagacgtcaatagaaataaactgcgcatcaatattggtaagagtccctgtgtcgaggaagaacagtccagaggaatgggtgttccatctagcccggtcagggcacctcccgatagtcccaccacgccagtccgctctcttcgttatcggcgcgtgaactctcctgaaagtgaacgcctgtctacagctgatgggcgggtcgagctgcctgagcggaggtcccggatggatctccccggatcaccttctaggcaggcttgctcatcccagcccgcccagatgttgtcggttgataccgggcatgccgaccgtcaggcttcagggaggatggacgtgtccgcctcagtggagcaggaggcattgagcaacgccttccggagcgtccctctcgccgaggaagaggactttgattccaaagagtgggtcataattgataaagagactgagctcaaggatttccccccgggcgctgaaccatccacgtctgggacgaccgacgaggagcctgaggaactgcggcctttaccggaggagggcgaggaacggcggcgcttaggtgctgaaccaccattcccactgactcccgctcttggtaccccacccagtactgaacgcgtgggaccccaccgcccaaccgagacagtgggcgggggccagaccctgggtgccttgcccccagctgtccagcccccggccactacaggggtactccgcgtgctgctactgcacgcgggggacggggctctgccaagtccaagacggcgacggttgctggggctgcttcggtttccccacagcgcccagccccttgggtag

SEQ ID NO: 15873 - DNA, 447 bp, Artificial Sequence
  Description of Artificial Sequence: Synthetic coding sequence
atggctgccgcgatggtgcctgggcgatccgaaagctgggagaggggagaaccaggccgaccagccttgtacttctgtggatccatcagggggggccgcgaggacaggaccctttatgaaagaatcgtcagtcgactgcggcgtttcggtactgtcctgacagagcacgtcgcagctgctgaacttggggcgagaggggaagaggctgcaggtggagataggctcatccacgaacaggaccttgagtggctccagcaagccgatgtagtcgttgctgaggtgacccagccttccttaggggttgggtatgagctcggcagagctgtggcctttaataagcgcatcttatgtttattccgcccccaaagtggccgcggtgagcaccctaaaccgccgagttggctatctatggatcccgccctgtccagtttccccggtgggctgtag

SEQ ID NO: 15874 - DNA, 606 bp, Artificial Sequence
  Description of Artificial Sequence: Synthetic coding sequence
atggtgaatagctgttgtggaagcgtgtgttcggatcagggctgcgggctggagaactgttgtagaccatcatgctgccagacaacttgttgccgtaccacatgctgtaggcccagctgttgcgtgagctcatgttgccgcccacagtgttgtcagtccgtttgttgccagccaacttgctgtagaccaagctgctgccaaacaacatgttgtagaactacctgctgcaggcctagttgctgcgtttcatcctgctgcaggcctcaatgctgccaaagtgtgtgttgccaacctacatgctgccgcccgtcttgctgtcaaaccacatgttgccggactacatgctgtcgcccaagctgttgtgtgtcgtcctgttgtcgtccccaatgttgtcagtccgtgtgctgtcaaccaacctgttgtcggccgtcctgttgtatcagcagctcatgttgcccgtcatgttgtgaatcttcctgttgtagaccatgttgttgccttcggcccgtgtgtgggagggtgtcttgtcacacaacctgctaccgtccgacctgcgtcatctccacatgtcccagaccattgtgctgtgcatcaagttgctgctag

SEQ ID NO: 15875 - DNA, 387 bp, Artificial Sequence
  Description of Artificial Sequence: Synthetic coding sequence
atgacaggctcttgctgtggcagcacactctcgagcctttcctacggcggaggttgttgccagccctgctgctgtcgtgacccctgttgttgtcgcccagtgacgtgccaaactaccgtgtgcagaccggtgacctgtgttccccgttgtacgcggcctatttgcgagccatgtagaaggcctgtctgctgtgacccatgttcccttcaagaaggatgctgtaggcccattacttgttgcccttctagctgtacagccgtagtgtgcagaccatgctgctgggccaccacctgttgtcagcccgtttccgttcaatcaccatgctgtcggcccccctgcggacagcccacaccatgttcaaccacatgccgcacctctagctgttag

SEQ ID NO: 15876 - DNA, 1140 bp, Artificial Sequence
  Description of Artificial Sequence: Synthetic coding sequence
atgtcactgcggcttagcagtgcaagccggcgaagctgtccaagacctactacagggtcactgaggctgtatgggggcgggacctctttcgggaccggcaattcctgtggcataagcggaatcggaagcggctttagctctgcctttgggggtagttcaagtggagggaacacaggtggaggaaatccctgcgccggcttcacagtaaatgaaagggggcttctttccgggaacgagaaggtgactatgcaaaacctaaacgaccgcctagcctcgtatctggattctgtccacgctctggaggaagccaacgccgatttggagcagaagattaagggttggtatgaaaagttcggacctggctcatgcagaggtctcgatcatgactattcacggtactttcccattatcgatgacttaaaaaatcagatcatcgcttccactacgagcaatgccaatgcggtgctgcaaatcgataatgcaaggttgacagcggatgactttagactgaagtacgagaacgagctggctctgcaccagagtgtcgaagccgatgtcaatggcctgcgccgtgtgcttgacgagatcacgctgtgcagaaccgacctggagatccagtacgagacactctccgaggaaatgacatacctaaagaagaaccacaaagaggagatgcaggtcctgcagtgtgcagctggtggcaatgtgaacgtagaaattgagctgcagtcactgctggccactaagcactctctggaatgctcactaaccgaaacagaatcaaattactgtgcacagctggcccagatacaggcacagattggcgctttggaggagcagttgcatcaagttcggactgagactgaaggccagaaactggagtatgagcaactgcttgatattaaactgcatctggaaaaggaaattgagacgtattgcctgctgatcggtggggacgatggcgcctgcaagtctgggggttacaagagcaaggactatgggtccggaaacgtaggcagccaggtcaaggacccagcaaaagctatcgtcgtgaaaaaagtccttgaggaagtcgatcagaggtcaaaaatcctgactactaggctccatagcctggaagagaaatcgcaaagtaactag

SEQ ID NO: 15877 - DNA, 768 bp, Artificial Sequence
  Description of Artificial Sequence: Synthetic coding sequence
atggataaggatgaagaggcgttgaaggcagcacaagccgaattaaaagaggccagaagacagtggcaccacctccaggtcgaaattgaatcccttcacgctgtggagcggggactggagaattccctccatgccagtgaacagcattaccaaatgcaactgcaggatctggagactgtgattgaaggcctcgagaaagaattgcaggaggtccgcagaggcatcgagaagcaattgcaggagcatgaaatgctgctcaacacaaaaatgaggctggaacaggagatcgctacctaccggcatctgctggagaaggaggagattcggtactatggttgtatacagggtggcaaaaaggacaaaaagcccaccacaagtcgcgttggttttgtcctcccaagcgcaatcattaatgaaattagcttcactaccaaagtcccacagaagtatgagaacgagaatgtcgagactgtgactaaacaggccatccttaatggctccatagtcaaggagagcactgaggcacacggcacaatccagactgagaaggtcgacgaggttatcaaagaatgggaaggtagtttctttaaagataatcctcgcctgaggaaaaagtctgtgtcacttcgtttcgacctgcatctagctgccacagacgaaggctgcctggagacaaagcaagataatctgcctgatattgaggtcagattgataatgagaaggagctgttctatccctagcattaagcccccctccacggctaactag

SEQ ID NO: 15878 - DNA, 888 bp, Artificial Sequence
  Description of Artificial Sequence: Synthetic coding sequence
atggaactgtctcagcttctgaatgaaatacgagctaattacgagaagatactgacaagaaaccagatcgagactgtgctcagcaccagaattcaactggaggaggatatcagtaagaagatggacaaggacgaagaggccctcaaggccgcacaggccgaactgaaggaagcgagacgacagtggcatcatctgcaggtcgagattgagagcctccatgcagttgaaagaggcctggagaactccctgcacgccagtgagcagcactaccaaatgcagctccaggacttggagaccgtgattgaaggcctcgagaaagaattacaagaggtcagacgaggaatcgagaagcaacttcaggagcacgaaatgctgctgaacacaaagatgcggctcgaacaggaaatcgcaacttaccggcatcttctggagaaagaagagattcgttactacggatgcatccaaggaggtaaaaaggacaaaaagccaaccacatcccgtgtcggttttgtgttaccctcagcaatcattaatgaaatctcctttaccactaaggttcctcagaaatacgagaacgaaaacgtcgagactgtcactaaacaggccatactgaacggttctatcgtcaaggaaagcactgaggcacatgggacaattcaaactgagaaagtggacgaggtgatcaaggaatgggagggatcctttttcaaagataaccctcgcctgaggaagaaatctgtctccctccggttcgacctgcacctggccgcaaccgatgaagggtgcttagagacaaagcaggacaaccttccagacatcgaggtgcgattgattatgagaaggagctgttccattccttctatcaagcctccaagtacagccaattag

SEQ ID NO: 15879 - DNA, 1860 bp, Artificial Sequence
  Description of Artificial Sequence: Synthetic coding sequence
atgtctggcttggtgcttgggcagagggatgagccagcaggacatcgtttgtcccaggaagaaatcctcggaagcaccaggctggtgagccaggggctcgaggccctcaggtctgagcaccaggctgttctccaaagcctctctcagaccatcgaatgcctgcagcagggcggccacgaggagggtctggtccacgaaaaagcccgccagctgagacgcagcatggaaaatattgagcttggactgagcgaggctcaggtgatgttggccctcgcttcacatctcagcacggtcgagtcagaaaaacagaaattacgagcccaggtgagacggctctgccaggagaaccagtggttgcgtgacgaattggcaggcacacagcagaggttgcaaagatcggaacaggctgtggctcagctggaagaggaaaagaaacacctggaattcctcgggcagctgaggcagtatgacgaagacggacacacatccgaagaaaaggagggagacgcaaccaaggactccctggacgacctgtttcccaatgaggaggaagaagacccttctaacgggcttagccgcggtcagggcgcaaccgccgctcagcagggcgggtacgagattcctgctagattgagaaccctccataatctcgtgattcagtacgcagcccagggaagatacgaagtggcagttcctctctgtaagcaggccctggaagatctcgagaggacatccgggagagggcaccctgatgttgccaccatgctgaatatcctggccttggtctacagagaccagaacaagtacaaagaggcagcccatcttctgaatgacgctttaagcatcagggagagtactctcggcccagaccatcctgccgtcgcggctactctcaacaacctcgcagttctctatggcaaacgagggaaatataaggaagctgaacccttgtgtcaaagggctctcgaaatcagggaaaaagtgctcggcactaaccatcctgatgtggccaaacagttgaataacctcgccctcctgtgtcagaatcaagggaagtatgaggctgtcgaacgttactatcagcgagccttggctatttacgaggggcagttgggacccgacaaccccaacgtagctaggactaaaaacaatctggccagttgctatcttaaacaagggaaatacgcagaggcagagacattgtacaaggagatactgactagagcacacgtgcaggagttcgggtctgtagacgatgaccataagcccatttggatgcatgcagaagaacgggaagagatgtccaagtccagacaccatgaggggggcaccccgtacgcagaatatgggggttggtataaagcctgtaaggtgtccagccccaccgtgaataccactttaagaaatctcggtgccttatatcggcgtcagggtaaattagaggccgccgagacgttggaggaatgcgcactgcggtcaaggaggcagggcaccgatccaatcagccagactaaggtggctgagctgttgggcgagagcgacgggaggcggacttcccaggagggccccggggattcagttaagttcgaaggtggtgaggacgcctccgtcgccgtggagtggagtggagacggctccgggacactgcaaagatctggtagcctgggcaaaatcagagacgttctacggcggtcaagtgagttgctggtgaggaagctccagggtactgaacctcgcccgtcctccagtaacatgaaacgcgctgccagtctcaattatttaaaccagccctctgccgcaccccttcaggtgagcaggggtctgtccgcctcaaccatggatctcagctcctcctcatag

SEQ ID NO: 15880 - DNA, 1860 bp, Artificial Sequence
  Description of Artificial Sequence: Synthetic coding sequence
atgtctggcctagtcctcggccagagagatgaacctgcgggccatcgcctttctcaggaagaaattctgggtagcacgaggcttgtgagtcaaggtctggaggctctgcgctctgaacaccaggccgtcttacaaagcttgtcccagaccattgagtgtctgcagcagggcggtcacgaggagggcctggtgcacgagaaagctcgacaactccggcgttccatggagaacatcgaattggggctgtccgaagcacaggttatgctagccctcgcgtcacacctctctaccgttgaatccgaaaagcagaagctccgggcacaggtgcggcgcctgtgccaggaaaaccagtggttacgagacgagctcgcaggaacccagcagagattgcagcgcagcgagcaggcagtggcgcagttggaggaggagaagaagcaccttgaattcttgggtcagctccggcagtatgatgaggacgggcatacatccgaggagaaagagggagatgccactaaagatagccttgacgacctgttccctaacgaggaagaggaggacccctcgaacggcctctctagaggccagggcgcgaccgccgcccagcaaggaggatacgagattccagcaaggctccggacgcttcacaatctggtcattcagtacgctgcccagggacgttatgaggtagctgtcccgctctgcaagcaggccctagaggacttagaaagaacgtccgggcggggccaccccgacgtggccaccatgctgaatattctggctctagtttatcgggatcagaataagtacaaagaagccgctcacctgctgaacgatgctctgtctattcgggagagcaccttgggtccagaccatcctgccgttgcagctaccctcaataatctggcagtgctctatgggaagcgcggcaaatataaagaagccgagcctctgtgtcaacgagcccttgagatcagagagaaggttttagggactaatcatccagacgtggcaaagcaactcaacaatctggctcttctttgtcagaatcaggggaagtacgaagccgtcgaacggtactaccagcgagccttagcaatctacgaggggcagcttggcccagacaatccgaatgtcgcgaggactaaaaacaacctggcctcctgttacctgaagcaggggaaatacgccgaggcagagaccctttacaaagagatcttgaccagagcccacgtgcaggagttcggcagcgtcgacgatgaccacaaacccatatggatgcacgcggaggagagggaagaaatgagcaagagcagacatcacgaaggagggactccctacgctgaatacggcgggtggtacaaggcctgcaaggtatcgtcacccaccgtgaacacaactctgaggaacttgggcgccctatacagacgtcagggtaaactcgaggccgccgaaacattggaagaatgcgccctcaggtcccggaggcaaggcactgaccccattagtcagactaaggtggctgagctcctgggtgagagcgatgggcggagaacctcacaggaagggcctggtgattccgtgaagttcgagggaggggaagacgccagcgttgccgtggaatggtccggagacgggagcggaacactccagcgctcgggatctctggggaaaatccgggatgtgctccgcagaagcagcgaactgttagtcaggaaactgcaaggcactgagcccagacccagttccagcaacatgaaacgtgccgcctctctgaactacttgaaccagcccagcgcggctcctctccaggtatcacggggcctgagtgcctccacaatggacttgtccagctcctcctag

SEQ ID NO: 15881 - DNA, 1170 bp, Artificial Sequence
  Description of Artificial Sequence: Synthetic coding sequence
atgcttcgttggaccgtgcacttagagggcgggccacgtagggtgaaccacgccgcagtggcagtcgggcatcgggtgtattcctttggagggtattgtagcggggaagactacgaaacgctgagacagatcgatgtacatattttcaacgccgtctctctgaggtggacaaaattgccacctgtgaagtcagccatacgaggacaggcaccagtggtaccatatatgcgctacggccactcaacagtgctcatcgacgacacagtacttctgtggggcggaagaaatgacaccgaaggagcgtgcaatgtcctgtacgcttttgacgtgaacactcataagtggttcacacctcgcgtttctggtacagtgcctggggctcgagatggccattcggcttgtgttcttggcaagatcatgtatattttcgggggctacgaacagcaggccgattgctttagcaacgacatacacaagctggacacgtctaccatgacttggaccctgatctgtaccaagggctctccagccagatggcgtgacttccattctgcaaccatgcttggcagtcatatgtatgtctttgggggaagagctgaccggttcggccctttccactctaacaatgaaatctactgtaaccgcatccgggtctttgacactagaacggaggcctggctcgactgccccccaactccagtgctcccagagggccggaggtctcacagcgcattcggatacaacggcgagctttatatatttggaggttataatgcccggttgaatcggcacttccatgacctttggaaattcaatcccgtaagcttcacctggaagaaaatagagcctaaagggaaggggccatgtccccgccgcagacagtgctgctgcatcgtgggagacaagatcgtcctcttcggtgggacctcaccatctcccgaagagggtctaggagacgaatttgacctcattgatcacagtgacctacacatcctggactttagcccaagcttaaaaactctgtgtaagctggccgttatccagtataatctcgaccagtcttgcctgccccatgacataagatgggagctgaacgccatgacgacaaattcgaacatatctagaccgatcgtctcttcaccgtttgcttatcctcttccaagtgcgtag

SEQ ID NO: 15882 - DNA, 549 bp, Artificial Sequence
  Description of Artificial Sequence: Synthetic coding sequence
atgcctatcccacctcccccgcccccgccccccggcccccctcctcccccaacgtttcatcaagccaataccgagcagccaaaactctcccgcgatgaacaacggggacgaggagccctcctgcaggacatctgcaaggggacaaagctgaaaaaggtaaccaacataaacgataggagcgctccaatactggagactccgcctcctccaccccccgtcatcaggaatggcgccagagacgccccccctccaccccctccatatcgcatgcacggctctgaacctccgtctcgaggaaaacctcccccgcctcctagccgaactcctgccggccctcctccaccgccaccacctccgctgcggaatggacaccgggactccataacgacggtgagatcatttctagacgactttgagtccaagtacagctttcaccccgtggaggattttcctgcaccggaagaatacaaacattttcaaagaatataccccagtaagacaaatcgggcagcccgtggcgccccacccctcccgccaatcttgaggtag

SEQ ID NO: 15883 - DNA, 831 bp, Artificial Sequence
  Description of Artificial Sequence: Synthetic coding sequence
atgacctcttttcgattggccctgatccagcttcaaatatctagcatcaagagcgacaatgtgaccagggcctgctcttttattagggaagcggctactcaaggcgcaaaaatcgtcagcttgcctgaatgtttcaatagtccctacggcgcgaagtacttcccagaatacgctgaaaaaattccgggtgagtccacacagaagcttagtgaagtcgcgaaggaatgctccatctatttgattggggggagtatcccggaggaagacgcaggtaaactctacaacacgtgcgctgtgttcgggccggatggtaccctgttagcaaagtatcgtaaaatccacctcttcgacatagatgtcccaggaaagatcactttccaggagtctaagaccctcagccccggagatagcttcagcactttcgacacgccctactgcagggtggggctcggtatttgctacgacatgcggtttgccgaactcgcccagatctatgcccaaagggggtgtcagctgctggtctaccccggggcattcaatcttactaccggcccagcccactgggagttactacagaggtcccgggccgtcgataatcaggtgtatgtcgcaactgcatcacctgccagggacgacaaagcctcttacgtagcttggggtcattccacagtcgtgaatccttggggcgaagtcttagccaaagccggtacagaggaggctatagtttactcggacattgacctgaagaagttggccgagatccgacagcaaatacccgtattccggcagaaacggtccgacctatacgcagtggaaatgaaaaagccgtag

SEQ ID NO: 15884 - DNA, 1476 bp, Artificial Sequence
  Description of Artificial Sequence: Synthetic coding sequence
atggaggaaatccccgcgcaggaagccgccgggtccccaagggtgcagttccagtctctggagacccagagtgagtgtctcagtccagagccccagttcgtgcaggataccgatatggaacaaggcttgaccggcgatggagagacccgagaggagaacaagctgctgattcccaaacagaaaatctcagaggaggtgcactcttacaaggtccgtgttggacgccttaagcatgatataactcaggtccccgaaacccgggaagtttacaagagcgaggaccgcctagagcggctgcaggagatcctgaggaagttcttgtacctcgagcgtgaattccgccagatcaccatatccaaggagactttcacaagcgagaaaaataacgagtgtcacgaaccggagaagagcttttcgctcgatagcactattgatgccgatcagcgggtgctacgcatccaaaacacggacgacaacgacaaatacgacatgagctttaaccaaaattctgcctctggaaagcatgaacacttaaatcttaccgaggatttccagtcatccgagtgcaaggagagtttgatggacctatctcacctcaataagtgggaaagcatcccaaacaccgagaagtcctacaagtgtgacgtgtgcggaaagattttccatcagtcctccgctcttactcggcaccagcgcatccatacccgggagaagccatacaaatgtaaggagtgcgaaaaaagcttctctcagtctagctccctctcccggcacaagagaatccacacacgagaaaaaccatacaagtgtgaggcctccgataagtcctgtgaagcttccgataaaagctgttctcctagctcagggattattcagcataagaagatccatacacgggctaaatcctacaaatgctccagttgtgagagagtcttttctcggtctgtacatctgacgcagcatcagaagatccataaagagatgccatgcaagtgtacagtgtgcgggtcggacttctgccataccagctacttgctggaacatcagcgggtgcatcacgaagaaaaagcatacgaatatgacgaatacgggctggcctatatcaaacagcagggcatacactttcgcgaaaagccttatacctgttctgagtgtggcaaagatttcaggttaaattcccatctcattcaacatcagcggattcacacaggagagaaagctcatgagtgtaatgagtgtggtaaagccttctcacagacctcctgtctgattcagcatcataagatgcaccgaaaggagaaatcctatgagtgtaatgaatatgagggatccttcagccattcctccgacctaatactgcaacaagaagtcttgacccgtcagaaagcattcgactgcgatgtctgggagaagaatagttctcaaagggcgcatctggtgcagcaccaatcaattcataccaaagagaacagttag

SEQ ID NO: 15885 - DNA, 1089 bp, Artificial Sequence
  Description of Artificial Sequence: Synthetic coding sequence
atggcacacagcagcttctttccagatgagtacttcacctgctctagcctgtgcctgtcctgtggtgtcgggtgcaaaaaatctatgaatcacgggaaggagggcgtcccacatgaggccaagtcccgttgtagatattcacatcagtatgataacagagtatatacctgcaaagcctgttacgagcggggagaggaagtcagcgtggtccccaagacgtctgcctccacggactcgccctggatggggctcgcaaaatatgcttggtcaggatatgtgatcgagtgccccaactgcggcgtcgtctaccgcagccgccagtactggtttggcaatcaggatccagtagacaccgtggttaggactgagatcgtgcatgtttggcccggcactgatggcttcttgaaggacaacaataatgccgcacagagactgctggacgggatgaatttcatggcccagtccgtctcagaattgtccttgggcccaaccaaggcagtgacctcctggcttaccgaccagatagcgcctgcatattggaggcctaattcgcaaattctatcctgcaacaagtgcgcgacctcctttaaagacaacgatactaagcatcactgcagagcctgtggagaggggttctgcgatagctgctctagcaaaacaagaccagtcccggagagaggctggggccccgcccccgtcagggtatgtgataactgctatgaggcccgcaacgttcagctggcagtaactgaggcccaggtggatgacgagggcgggacactaatagcccgcaaggtcggtgaagctgtgcagaacacccttggcgcagttgtaaccgcaatcgatattcctctcggactcgttaaggatgccgctcgcccagcttattgggttcctgatcacgagattctacactgccacaattgccgtaaagagttcagcatcaaattgtctaagcatcactgcagagcatgtggacaagggttttgcgatgagtgttcacatgacaggcgggcagtcccaagtagaggttgggaccatccggtaagagtgtgcttcaattgtaacaaaaaacctggggacctgtag

SEQ ID NO: 15886 - DNA, 348 bp, Artificial Sequence
  Description of Artificial Sequence: Synthetic coding sequence
atgagcggagagcccggtcagaccagcgtggccccaccaccagaggaagtcgagcctggctccggggtcaggatagttgtcgagtattgtgagccatgtggcttcgaggccacctatctggaattagctagtgccgtgaaagagcagtaccctggcatagaaattgagtctagactaggcggcactggtgcttttgagatcgaaattaacgggcagctggtcttctctaaactggaaaatggcggattcccctatgaaaaagacctcattgaggccattcggcgcgcgagcaacggcgagacgctagagaagatcactaacagcagacccccatgtgtgattctgtag

SEQ ID NO: 15887 - DNA, 507 bp, Artificial Sequence
  Description of Artificial Sequence: Synthetic coding sequence
atgctgttccgcctctccgaacactccagtcctgaagaagaggcatcacctcatcagcgcgcctcaggtgaaggtcatcacttaaagtccaagcgccccaacccttgcgcgtatacaccaccttccttgaaagccgtccaacgtatcgcagagagccacctgcagtctatttcaaacctcaatgaaaaccaggcatcagaggaggaggacgaactcggtgaattaagggaactcggatatccgcgagaggaggacgaggaggaggaagaagacgacgaggaagaagaagaggaggaagatagccaggctgaagttctcaaggtgatccggcagagcgccggccagaaaaccacctgcggccaaggcctagagggcccttgggagaggcctccccctctggacgagtctgagagagacggcggcagtgaagaccaagtcgaggatcctgcattgtctgagcccggtgaagaaccgcagcgcccctccccctccgaaccagggacttag

SEQ ID NO: 15888 - DNA, 507 bp, Artificial Sequence
  Description of Artificial Sequence: Synthetic coding sequence
atgctgttccgtctgtcggagcattcctcccctgaggaagaggcatcaccacaccagcgcgcctctggggagggacatcaccttaagtcaaagaggcccaatccctgcgcctatacaccaccttcattgaaggccgtacaaaggatcgccgagtctcatcttcagagcattagtaacctgaatgagaaccaagcatcagaagaggaggatgaattgggcgaactgagggaactcggttatcctcgggaggaagacgaggaggaggaggaagatgacgaagaggaggaggaagaggaagattcccaggccgaagtcctaaaagtcattagacaatcagccggccagaaaacgacatgtggccaaggccttgaggggccctgggagcgccccccccctcttgacgagtctgaaagggacggagggtcagaggatcaggtggaagacccagctctgtccgagccgggtgaagagccacagagacctagcccgagcgagcccggcacctag

SEQ ID NO: 15889 - DNA, 648 bp, Artificial Sequence
  Description of Artificial Sequence: Synthetic coding sequence
atggatccgaaggatagaaagaagatccagttctcggttccagcgccaccttctcagctggatccgagacaagtggagatgattcgccgtcggcgcccgaccccagctatgctattcaggctgagcgagcacagttcacctgaagaagaggcctctcctcaccaggtgaccccactgacttggcatttcccctggcagcgcgcctctggtgaggggcaccacctcaagtctaagagacctaatccgtgtgcttacacgcctccctcattgaaggccgtccaaaggattgcggagtcacacctccagtctatctcaaacctcaacgagaaccaggccagtgaggaggaagatgaattgggcgaacttcgggaactgggatatccacgcgaggaagacgaggaagaagaggaggatgacgaagaggaggaagaagaggaagactctcaagcagaagtgctgaaagtgattcgtcaaagcgctggtcagaagacgacatgcggccagggcctggaggggccttgggaaaggcctccgcctttagacgaaagtgagagggacggagggagcgaggatcaggtggaagaccccgctctttctgagccaggagaggagccacagcggccctcaccatcggaacccggaacgtag

SEQ ID NO: 15890 - DNA, 5169 bp, Artificial Sequence
  Description of Artificial Sequence: Synthetic coding sequence
atggagtctaatttcaaccaggaaggagttccccggccatcttacgtattcagtgccgatcctatcgccagacccagcgagatcaacttcgacggcattaagctagacctctcccacgagttctctcttgtagcgccaaatactgaagctaatagtttcgagtccaaagactacctgcaggtctgcctcaggataaggccttttactcagtccgaaaaggagctcgagtctgagggatgtgtgcacatattggattcacagactgtcgtgctcaaagaaccacaatgtatactgggacgcttgtctgaaaaatcctccggtcagatggcccagaaattttcctttagcaaagtgttcggacccgcaacgacccaaaaggaattttttcagggctgtataatgcagcctgtgaaggatctgctgaaaggacagtcccgattaatcttcacctacggcctgacaaacagtggtaagacttacactttccaggggaccgaggagaacattggcattctgccgaggacgcttaatgtgttgttcgatagtctccaggaaaggctttacaccaaaatgaacctgaaaccacaccgaagcagggaatatctgagactaagctcggagcaggagaaggaggaaattgccagcaagtcagctctactgagacaaataaaagaggttaccgtgcataacgactcggatgacaccctgtatggctctctgactaattccctgaacatttctgagtttgaagaatcaataaaggactacgaacaggccaacctgaatatggcaaacagcatcaagttcagtgtgtgggtgtctttttttgagatatacaacgaatacatatatgacctgttcgtaccggtgtcatcgaaattccagaagcgaaaaatgttaaggctgagtcaagatgttaaaggatacagttttattaaggatcttcaatggattcaggtttccgattccaaagaggcttaccgattgttgaaacttggcatcaagcatcagagcgtggcgtttacaaaactgaataatgcctcaagtcgcagccattctattttcaccgtgaagatactgcagatcgaggattccgagatgtctcgggttattcgagtttccgaacttagcctctgcgacttggctgggagtgaacggaccatgaagacccagaacgaaggcgaacggctcagggagactgggaacattaatacgagtctccttacacttgggaaatgtattaatgtcctaaagaattcagagaaatctaaattccagcagcacgtgcctttcagagagtctaagctgacccactactttcagagcttctttaacggaaagggaaaaatctgcatgattgttaatatctctcagtgctatctcgcctacgatgagaccctgaacgtcctaaaattttctgcgatagcgcagaaagtctgcgtgccggacaccctgaactcatcccaggagaagcttttcggccccgtcaagtcaagccaagatgtcagtttagactctaatagtaatagtaagattttaaacgtcaagcgggccaccatatcatgggaaaattcactcgaagatttgatggaggatgaagatctcgtggaagagctagagaatgccgaggagacacaaaatgtcgagaccaaactactggacgaggacttggataagacactcgaagagaacaaggcattcattagtcacgaagaaaaaaggaagcttctggacctgattgaggatctgaaaaagaagttgattaatgagaagaaggagaaattgactttagagttcaagatccgggaagaggtgacgcaggaatttacgcagtactgggcccagagagaggccgacttcaaggagacattgctccaggaaagagagattctggaagaaaacgccgaacggaggcttgccatcttcaaggacctggtgggaaaatgtgacactcgagaggaagccgctaaggatatttgcgcaacgaaggtggagactgaggaaacccacaactacgtcggttttgaagacatcattgattccttgcaggataatgtggcagatattaagaagcaggccgagattgcacacttatacattgctagcctgcccgatccacaggaagcaacagcatgtttggaattaaagtttaaccagattaaggccgagctagctaagactaaaggtgaactcattaaaaccaaggaagaattaaaaaagagagagaacgaaagcgacagcctcatccaggagcttgagaccagcaataaaaagattattacccaaaaccagagaatcaaagagttgattaacatcattgaccagaaggaagacactattaatgaattccagaacctcaaatcccacatggaaaacacctttaagtgtaacgacaaagcagacactagctccctgatcatcaataacaaactgatatgcaatgagacagtggaggtgccaaaagactccaaatcgaaaatctgcagtgaacgtaagcgtgtgaacgagaatgaattacagcaagacgaacctcccgccaagaagggcagtattcacgtgtcctctgccatcactgaagatcaaaagaagtccgaggaggtgcgtcccaatatcgcggagatagaagacattagggtcctgcaagagaataatgagggactgcgagccttccttttaaccatagaaaatgagctcaagaatgagaaagaagaaaaggcagagctcaacaaacagatcgtacactttcagcaggagctctcgttatcagagaaaaaaaacctgacactttcaaaagaagtgcagcagatccagtcaaactatgacattgcgatcgccgagttgcacgtgcaaaaatctaagaatcaggaacaagaggagaaaatcatgaaactctcgaatgagatcgagaccgcaaccagatcaattacaaacaacgtatcccagatcaaattgatgcacactaagattgacgagctgagaacactggactctgtctcccagatctcaaatatcgacctcctaaaccttcgagatcttagtaacggcagcgaggaagacaaccttcccaacacccagcttgacttgctcggaaatgactatttagtatctaaacaggttaaggagtatcgaatccaagaacctaaccgcgagaattcgttccattcatctattgaagctatctgggaggagtgcaaagaaatagtgaaggcaagctcaaagaagtcgcaccagatcgaagaactcgaacagcagatagaaaagttgcaggccgaggtcaaaggctataaggatgagaacaaccggctcaaagagaaggaacacaaaaatcaggatgacttgctgaaggaaaaggaaaccctgatccaacaacttaaggaggagctgcaggagaagaacgtgactctagacgtacaaatccagcacgtcgtcgaaggaaaacgcgccttatctgagctcacacaaggggtcacatgttacaaggccaagatcaaagagctggagaccatactggagacccaaaaagttgagtgctctcatagcgctaagcttgaacaggatattctggagaaagagagcatcattctgaagctggagcgcaacctgaaggaatttcaggagcaccttcaggacagcgtgaaaaacaccaaggacctgaacgtcaaagagcttaagctcaaggaagagatcactcagctaactaacaatctccaggacatgaagcatctgctacaattgaaagaggaagaagaagagacaaacagacaagaaacggagaaactgaaagaggaattgagcgcttcctctgcaagaacccaaaacctgaaggccgatttacaacggaaggaggaggactatgctgacctcaaagaaaagctgacagatgcgaagaagcagataaaacaggtccagaaggaagtgtccgttatgcgggatgaggataaactgctccggatcaagattaacgagttggagaagaaaaaaaatcaatgtagccaggagctggacatgaagcagcgcactattcagcagctgaaggagcagctgaacaaccagaaagtggaagaagcaattcagcagtatgagcgagcttgcaaagatctaaatgtaaaagaaaaaatcattgaggatatgcgcatgacactggaggagcaagagcagactcaggtggaacaggaccaagtcctggaggctaagttagaggaggtggagagactggccacggaattagaaaagtggaaggagaagtgcaatgacttagagactaagaataaccagcgttccaacaaagaacatgagaataatacggatgtgttggggaagctgaccaatctgcaggatgaactgcaggaaagcgaacagaaatacaatgctgaccgtaagaaatggttggaagaaaaaatgatgttaatcacccaagccaaggaagcagaaaatattcgcaataaggaaatgaaaaagtatgcggaggaccgggagcggttttttaagcagcagaacgagatggagatcctgacggcacagctcaccgaaaaggacagtgacctccagaagtggcgggaagaacgggaccaactggttgctgccctggagatacagctgaaagccctgatctcttccaacgtgcagaaggacaacgagatcgagcaacttaaacgcatcatcagcgagacttcaaagattgagacacaaatcatggacatcaaaccaaagagaatctcttccgcggaccccgataagctccagaccgaaccactgtccacctcctttgagatttctagaaacaagatcgaggacggtagcgtggtattggattcctgcgaagtgtccaccgaaaacgatcagtcaacaaggttccctaagcctgagttagagatacagtttactccactacagcccaacaagatggcagtcaagcacccagggtgcactactccagttactgtcaagatcccaaaagctcgcaagagaaaatctaatgaaatggaggagtctgcaagtcccccgcctaaagagtgctcatcgtcgcctgccatggagcagagctggaaagagaatgattttgacaagctacgcgaagagggctttaggcggtctaattactcggagttgcaagaggaaatacagacaaagggcaaagaagttgagaacttcgagaagaatcttgactag

SEQ ID NO: 15891 - DNA, 1215 bp, Artificial Sequence
  Description of Artificial Sequence: Synthetic coding sequence
atgagacgcgacgtgaacggcgtgacaaagagccggtttgaaatgttcagtaattcagacgaagcagtaatcaataagaaactccccaaagagctgctacttagaatcttttcatttcttgacgttgtcactctctgtagatgcgctcaggtatcgagggcatggaacgtgctggcactggatggatctaactggcaaagaatcgatctttttgattttcagcgcgacattgagggtcgtgtcgttgagaatatttccaagagatgtggtggtttcttgagaaaacttagtcttcggggttgcctcggggtgggggacaatgccttgcgaacttttgcacagaactgcagaaacatcgaggtacttaatctgaacgggtgcacaaaaactacggacgcggaaggctgtcctttacttgaacagctgaacatcagctggtgcgaccaggtcacaaaagatggcatacaggcactggttcgcgggtgtggcggccttaaagcgttgtttctgaagggatgcacccaactagaggacgaggcgctgaagtatattggcgcacattgtcctgagctggtgacgttgaacctgcagacctgcctacaaattacagacgagggtctgatcactatctgtagagggtgtcacaaactccagagtctgtgtgcctcagggtgcagcaatatcacagatgcaattcttaacgctttagggcagaattgcccacgactgaggatactggaagtcgcccggtgtagccaattgacggacgttgggtttactacactggcgcggaattgccatgagctcgaaaagatggatctggaggaatgtgtgcagattaccgacagcactctgatccaacttagcatccactgccctaggcttcaggtgctgagtctcagtcactgcgaactcatcactgacgatggcatacgccacctgggcaacggggcttgcgctcacgaccaattggaggttatcgaactagataattgtcccctcattacagacgccagtcttgagcacctcaaaagttgccactcccttgaacgcatcgaattgtacgactgccagcaaatcactcgagccggcattaagcggttgcggacccatctgccaaatatcaaagtccatgcgtatttcgcccccgtcaccccccctccttccgtcgggggaagccggcagcgtttttgccgctgctgcatcatactgtag

SEQ ID NO: 15892 - DNA, 1251 bp, Artificial Sequence
  Description of Artificial Sequence: Synthetic coding sequence
atggcccactctcccgtcgcagtgcaggtccccggcatgcagaacaacattgccgaccccgaagagttgttcacaaagctcgagcgcattggcaaaggcagctttggggaagtgtttaagggcatcgataaccggacacaacaggttgttgcgattaagatcatcgacctggaagaagctgaagatgagattgaagacatacagcaggaaattactgttctgtcccagtgtgactcttcttatgtgaccaaatactacggctcatacctcaaaggctcaaaactgtggatcataatggagtacctgggcgggggatcagccctagatctcctcagggccgggccatttgatgagtttcagatcgcgacgatgttgaaagagatccttaaaggattggattatcttcacagcgagaaaaaaattcatcgagatattaaagcagctaacgtgttactgagcgagcaaggagacgtgaaactcgccgacttcggggtggcagggcaattgactgacacacagatcaagcggaacacgttcgttggaacgcccttctggatggccccggaggtcatccagcagagcgcctacgactccaaagcagatatatggtccctcggaataacagctatcgaacttgctaagggggagcctccaaacagcgatatgcatcctatgagagtcctgtttttgattcctaaaaataatcctcctacgttggtcggagacttcacaaaaagtttcaaggaatttatagacgcctgcctgaataaagatcccagcttcagaccaacagccaaggaactcctgaagcataaattcatcgttaagaactctaagaaaactagctatctcaccgagttgatcgacaggtttaaacgctggaaggccgaagggcactcagatgacgagtcggactccgaaggatcggactcagagagcacgtcaagggagaataacacgcacccagaatggtctttcacaaccgtgcgtaagaaacccgaccctaagaaggtccagaacggggccgagcaggacctcgtgcagacactcagttgcctgagcatgataatcactcctgctttcgccgagctgaaacagcaagatgagaataatgcttctcgcaatcaggccatagaggagctggagaaatcaattgccgtggctgaggcagcatgtccggggatcacggataagatggtgaagaagctcattgaaaagtttcagaagtgctctgcggacgagagcccttag

SEQ ID NO: 15893 - DNA, 1020 bp, Artificial Sequence
  Description of Artificial Sequence: Synthetic coding sequence
atggcccattctccggtcgccgtccaggtgccagggatgcagggtagtaagctgtggataataatggagtaccttggcggcgggtccgcgttggatctgctcagagctggccccttcgacgaatttcagatcgctaccatgcttaaggaaatactgaaaggccttgactacctgcactctgagaaaaagatccacagggacattaaagctgctaacgtgctgttatccgagcagggggatgtaaaattggcagatttcggggtcgccgggcagctcaccgacacgcagatcaaaagaaacaccttcgtcgggacacctttctggatggctcctgaggtcatccaacagtccgcctacgattctaaagcagatatttggagtttgggtatcacagccatcgagctagccaagggagaacctcctaacagcgacatgcacccaatgagggtgctctttctgattcccaaaaataatcctccaacccttgtaggcgacttcactaaaagctttaaggagttcatagacgcctgccttaacaaggatccttcatttcgcccgacggccaaagaattgctcaagcataagttcatcgtgaaaaatagcaagaaaacttcttaccttacggaactcatcgatcgatttaagcgctggaaagcggaaggacattccgatgatgagagtgacagcgaggggagcgacagcgagagcacaagccgcgaaaacaacacacatccagagtggtcttttacaacagtccgcaaaaagccagacccaaagaaagtacagaatggtgcagagcaggacctcgttcagacgctgtcctgcctgtctatgatcatcacacccgcatttgccgaacttaagcaacaggacgagaacaacgcatctcgcaaccaggccattgaggagctggagaagtccattgctgtggcggaggccgcgtgtcccgggatcaccgacaaaatggtcaagaaacttatcgagaagttccagaaatgttctgcggacgaatcaccgtag

SEQ ID NO: 15894 - DNA, 2625 bp, Artificial Sequence
  Description of Artificial Sequence: Synthetic coding sequence
atggaggtcttacgggagaaagttgaggaggaggaagaagcggaacgcgaggaggcggccgaatgggctgaatgggctcggatggagaaaatgatgaggccggtcgaagtgcgcaaggaggagattacactgaagcaggaaactcttagagatctcgaaaagaagctgagtgaaatacagattaccgtttcagccgagctgcccgcctttacaaaagacaccatagatatatcaaaactgccgatttcctacaaaaccaatactccaaaggaggagcatctactgcaagtagcagataatttttctcggcagtatagccacctgtgtcccgaccgggtgccattgtttctgcatcccctgaatgagtgtgaggtgccgaagtttgtatcaactactctgcggccaaccctgatgccatacccagaattgtacaactgggacagctgtgctcagttcgtcagcgattttttgaccatggtgcctctgcctgaccccctgaaacccccatcccatttatattcgagcacaaccgtcctgaaatatcagaaaggtaactgcttcgacttctccacactgctgtgctctatgctgatcggtagcggctacgatgcatattgcgttaatggctacgggtctttggacttgtgtcatatggacctgacccgggaggtgtgccctttgactgttaagcccaaagaaaccataaaaaaagaagagaaggtgttgcccaagaaatacacaatcaagcctcccagggacctgtgttcccgtttcgagcaggagcaggaggtgaaaaaacaacaggaaattagggcacaggagaagaagcggctcagggaagaagaggagaggcttatggaggcagagaaggctaaacccgacgccctccacgggctacgtgtccactcatgggttctcgtcctttctggcaagcgggaggtgcccgaaaattttttcatagatccatttacgggacacagctactcaacccaggatgagcactttctaggtatcgagtccttgtggaaccacaaaaattattggattaatatgcaggactgctggaactgctgcaaagacctaatatttgatctgggggacccagtgcgctgggaatatatgcttcttggcaccgacaagtctcagctaagcctgacagaagaggacgattccggaatcaacgacgaggacgacgtcgaaaaccttggaaaagaggacgaagataaaagctttgatatgccacacagctgggtagaacagattgagatttcccccgaagcattcgagactagatgtcctaacggcaaaaaagtgatccaatacaagcgcgccaaactagaaaagtgggcaccttacctgaacagcaacggtttggtgagcagattgaccacgtacgaagacttacagtgcaccaacatcctggagataaaggaatggtaccaaaaccgggaagacatgttagaattaaagcatataaacaaaactactgatctgaaaacagactactttaagccgggccacccgcaggcgctgagggtgcacagctacaagtcgatgcaacccgagatggatcgtgtcattgagttttatgagactgcccgtgtggacggactaatgaaaagggaggagacgccgagaacaatgactgagtattaccagggacggccagattttctgagctaccgccacgcttcatttggcccgcgtgtaaagaaacttacactctctagcgccgagagtaaccctaggcccattgtgaaaattacagagcgtttttttagaaatccggccaaaccagccgaggaggatgtggccgaacgggtattccttgttgccgaggaacggattcaactgaggtaccactgtcgagaggatcacattacggcatcgaagcgagagttcctgaggcgaacggaagttgactccaaggggaacaaaatcatcatgaccccggacatgtgtatatcgtttgaagtggaaccaatggagcacacgaagaaattactgtatcagtacgaggctatgatgcacctgaagcgggaagaaaagctgtcccggcatcaagtgtgggagagtgagctagaagtgctcgagatactgaagctaagagaggaggaggaggctgcacataccctaactatttccatttacgataccaagagaaacgaaaagagtaaggagtaccgggaagcaatggagagaatgatgcatgaagagcatttgaggcaggtggaaacacagcttgattacctggcgccgtttctggcacaattaccaccaggggagaaactgacatgctggcaggccgtaaggctcaaagacgaatgcttgagtgattttaagcagagactcatcaacaaggctaatctcatccaggctcgtttcgaaaaggaaacacaggagctgcagaaaaaacagcaatggtaccaggaaaaccaggtgactctcacaccggaagacgaggacttgtacctgagctattgtagtcaggctatgtttcggatccgcattctggagcagcggttgaatcgccacaaggaactggctcctctaaagtatttggccctcgaggaaaagttatataaggacccacgtcttggcgaactgcagaaaatattcgcctag

SEQ ID NO: 15895 - DNA, 1449 bp, Artificial Sequence
  Description of Artificial Sequence: Synthetic coding sequence
atggagcagagcaacttagagaagctcgagctaaacgttaggaaactgcagcaggagctcgaccaactgaatagagataaactgtctttgcataatgatatctcggcaatgcagcagcagctgcaggagaagagagaggccgtcaactcacttcaggaagagctggccaatgttcaggaccacctgaatctggccaagcaggacctactacataccactaagcaccaagacgtgctgctctcagagcagacccggctgcaaaaggacatcagcgagtgggctaacagattcgaagattgccaaaaggaagaggagaccaagcaacagcagctacaggtgctgcagaatgaaatcgaggaaaacaagctgaagctggttcagcaggagatgatgtttcagcggttgcaaaaagagcgcgagagtgaaaagtctaaactggatcaagtactgagtaaagttctcgctgccgaggagagggtacggacattgcaggaagaggagcggtggtgtgaatcccttgagaagaccctctcccaaacgaagcgccagttgagcgaacgcgagcagcagcttgttgaaaagagtggcgagctcttagcacttcaaaaggaagctgattctatgagggccgatttctctttattaagaaatcaatttctgactgagcgaaagaaagcagagaagcaagtggcatctctcaaagaagcccttaagatccagcgcagtcagttagaaaagaatttacttgagcagaagcaggagaactcttgcattcagaaagagatggccacaattgaacttgtcgcacaggataaccacgagcgagctagaaggctcatgaaggaacttaaccagatgcaatatgagtataccgagttaaagaagcagatggctaaccagaaggacctcgaacgcaggcagatggaaatttcggatgccatgcgcacactcaagagcgaggttaaggacgagatcagaacctcacttaagaatctgaaccagttcttgcctgagctccctgctgacctggaggcaatcctggaaaggaatgaaaatctggagggagaactcgaatctcttaaggagaatctacctttcactatgaatgaaggaccttttgaggagaagctgaatttttcccaggttcatataatggacgaacattggagaggagaagccctacgtgagaaactgaggcatagagaggatcggctgaaagctcagctgaggcactgtatgagcaagcaggctgaagtgctgattaaaggcaaacgtcagacagagggtactcttcacagcctgaggagacaggtcgacgctttaggagagctagtgacgagcaccagcgcggactcagcttcctccccatcactgtcccaattggaatcatccctgactgaagactcacagctgggccaaaatcaggaaaaaaatgccagcgcgcgctag

SEQ ID NO: 15896 - DNA, 3780 bp, Artificial Sequence
  Description of Artificial Sequence: Synthetic coding sequence
atggcactccgaccaggggccggcagtgggggcggaggggccgctggagccggcgctggttctgccggggggggaggctttatgtttccagtggccgggggcattcgcccaccccaagctggtctgatgcctatgcaacagcaggggtttcccatggtgtccgtgatgcaacctaatatgcagggtatcatgggcatgaattactccagccagatgtctcagggcccgatcgccatgcaggctggaatccctatggggcccatgcccgccgccggcatgccttatcttgggcaagcccctttcttgggtatgcgaccccctgggccacagtacacaccagacatgcagaagcaattcgccgaggaacaacagaagaggttcgaacagcagcaaaaactgttggaagaggagaggaagcgccgccagtttgaagagcagaagcagaagctacgtctgctgtccagcgttaagcccaagacaggggagaaatctcgcgacgatgccctggaagcaattaagggaaatcttgacggattctcacgggacgctaagatgcatccaacaccagcttctcacccaaaaaaacccggggtcggcgtcttcccttcacaggatcctgcgcagccccgcatgccaccgtggatttacaacgaatccctggtccctgacgcttacaagaaaatactggagactacgatgacccccaccggaattgataccgccaagctctatccaattctgatgtctagtggccttcctagagagactctcggccaaatttgggctctagccaatcggaccacacccggtaagctgaccaaggaagagctgtacacggtgctggctatgatcgcggttacccagaggggcgttcctgcaatgtcacctgacgccctgaatcagttccctgcagcaccaatccccacattgagcggtttcagtatgacgctgcccacccctgtatcccagccaaccgttatcccgagcggcccagctggctccatgcccctcagtctgggtcagcccgttatgggcatcaatctggtgggccccgtgggcggagccgctgcccaagctagtagcggcttcatacctacttaccctgccaaccaggtggtcaaaccagaagaggacgatttccaggacttccaggatgctagtaaatccggctctcttgacgattctttcagcgacttccaagagctccctgcctccagcaaaacatccaactcacagcacggaaactcagctccttccctcctgatgcccctgccggggaccaaagcactgcccagcatggataagtatgccgtattcaaaggtattgcagccgacaagagctcggagaacacggtccctcctggcgacccaggcgataaatactccgctttcagagaactagagcagacagcagaaaataaaccgctcggagagagcttcgcagagttcaggagcgctggaaccgacgatgggtttacagacttcaagacggccgacagtgttagtcccttagaacccccaaccaaggataagactttccctcccagttttccatccggaaccattcaacagaagcagcagacgcaggtgaaaaaccctctcaacttggcagatctggacatgtttagctctgtgaattgtagttctgaaaagccactgagttttagcgccgtgttttctaccagtaagtccgtgtcaactcctcaaagtacggggagtgccgctaccatgaccgcattggcagcaactaaaacaagtagtttggccgatgactttggggaatttagtcttttcggcgaatatagcgggctcgcacctgttggcgagcaagacgactttgcagactttatggccttttcaaattctagtattagctctgagcaaaaaccagacgacaagtatgacgcactgaaggaggaagcatcaccggtcccacttacttctaatgtgggtagcaccgtgaagggcgggcagaactcaactgctgcatcaacgaaatacgacgttttccgccaacttagcttggaagggagtggtttaggcgtggaggatttgaaggataatacgccttccggcaagagtgatgatgatttcgccgatttccacagtagcaagtttagttcaatcaattcggacaaatctctcggcgaaaaagctgtggcctttagacatactaaagaagacagcgcttcggtgaagtcactagatctaccttcaattggaggctcctcggtgggcaaggaagactctgaggatgcactgagcgttcagttcgacatgaagctcgccgatgttggcggcgatttaaagcacgttatgtctgactcctcactagacttgccaacagtatcaggccagcatccccctgccgctgatatcgaggatctgaagtacgctgcgttcgggtcatacagctctaattttgcagtgtctacgctgacctcctatgattggagcgatagagacgatgcaacccaggggaggaaacttagccctttcgtactgtccgcaggtagcggctcaccatctgccaccagcatcctgcaaaagaaggaaacctctttcgggtctagtgagaacattaccatgaccagcctcagtaaggtgactaccttcgtttcggaggacgctctgcccgagacgacattccctgcattggcatcttttaaggacacaattcctcaaaccagcgaacaaaaggaatatgaaaacagagattacaaagacttcacgaagcaggatctcccaactgcagagaggtcgcaagaagccacttgtccaagcccagcaagttccggcgcctcccaggagactccaaatgagtgctctgatgacttcggagagtttcaatccgagaagcctaagatcagcaaatttgattttctggttgccacaagccagtcaaagatgaagagctcagaagagatgatcaagtcggaactggccactttcgatctctccgttcaggggtcacataaaaggtccttgagcttaggggacaaagagatcagccgatcaagccccagtccagctcttgagcaaccttttcgggaccgaagtaatacactgaacgagaaaccagctcttcctgtgattcgagacaaatataaggacctgactggagaggtggaggagaatgaaagatacgcgtacgagtggcagcgctgtcttggcagtgccctcaatgtgataaaaaaggccaacgatactctgaatgggatcagcagctccagcgtgtgcacagaagtgatccaatccgcacaagggatggagtacttgctgggtgtggtcgaagtctaccgcgtgacaaaaagggttgagctgggcataaaggccaccgccgtgtgttcagagaagctccagcagctcctgaaggacatagataaagtgtggaataaccttattgggttcatgagtctcgcgactctaacatgctgctgggagaagatgacggtgatcacaaagcacctctcaccctaccatgaattacttgaggagaaacccgacgagaactctttggatttcagcagctgcatgctgagacctggcatcaaaaacgcccaggaactcgcatgcggcgtatgtctcctgaacgtggactcccggtctcgcaaggaagaaaagccagccgaggagcaccccaaaaaggctttcaacagtgaaaccgactctttcaaactggcctacgggggacatcagtatcacgcaagctgtgccaacttctggattaattgcgtcgaacctaagcctccagggctggtactcccagatttgctctag

SEQ ID NO: 15897 - DNA, 1158 bp, Artificial Sequence
  Description of Artificial Sequence: Synthetic coding sequence
atggccctccgtcccggggctggatcaggcgggggcggggccgccggcgccggtgctggcagcgccggcggcggcggattcatgttcccagtagccggcgggattcgtcctccgcaggcaggactgatgcctatgcagcagcaaggattccccatggtgagcgtgatgcaacccaacatgcaagggattatgggaatgaattattcctcccagatgtctcagggccccatcgcaatgcaggccggcatcccaatgggacccatgccggctgctgggatgccttacctgggacaagcacccttcctggggatgcggccccccggaccccaatacactccggacatgcagaagcagttcgctgaggagcagcagaagcgatttgaacaacagcaaaagctattagaagaagagcgtaagaggcgtcagtttgaggagcagaagcaaaaactgcgtctgctaagctccgttaagcccaaaactggcgaaaaatccagggacgacgccctcgaagctataaaaggcaatctggacggattttctagggatgccaagatgcatcctactcctgcctctcaccctaagaagcctgactgccccacctcttcccactcgaccaagacggttagcccctcaccggccttcctcgacgaagaggaattttccgatttcatgcagggcccggtcgaggtgcctccatgtggcccgagctccacctctcagccattccagagctttcacccttcgactccactggggcagctccacacgcagaaggccggtacccaacccctccccccttctcagtctcccgtccccttcgccctgcacggtgtgccaggccagattccttatttctctacggcatccgcttctcacagtgtccctgaggcaggtccttccctggaggagaaatttttggtgagctgcgacatcagcaccagcgggcaggagcagatcaaattaaacacgtcggaggtaggacataaagctctcggccccggcagcagtaagaaatatccatccctcatggcctcgaacggcgtcgcggtggacggatgcgtatgggagtattttccccaccgcatcttactctcccccgaatgcttgctcggcttcactatgcgagtctggttccagatgcctatccgaaagtcttag

SEQ ID NO: 15898 - DNA, 939 bp, Artificial Sequence
  Description of Artificial Sequence: Synthetic coding sequence
atggccgactttggtataagcgccggtcagtttgttgccgtggtctgggacaaatccagccctgtggaagccctgaagggtctggtggacaagttacaggctctgacaggcaatgagggtcgggtctcagtcgagaacattaaacaacttttacagtcggcgcacaaggagtccagctttgacatcatcctgtcgggattagttcctgggtctaccactctccacagcgccgaaatcctcgctgaaatcgctagaattttgaggccaggcggatgcctcttcctgaaagagccagtggagaccgcagtagataacaacagcaaggtcaaaaccgcctcgaagttatgttctgcccttactctgtctggactggtggaagtgaaggagttgcaaagggaacccctgacaccagaggaggttcagagcgtgagagagcatctaggacacgaatccgacaatcttttgtttgttcagatcacaggaaaaaagcctaactttgaggtggggagctctcgacagctgaagctgtcaataactaaaaagtcttctccctcagtgaaacctgctgtggatcccgctgcagccaaactgtggactctctccgcgaatgacatggaagacgactctatggatctcatagacagtgacgaactgctggatcctgaagacctcaagaagccagatccagcctcactgcgggcagctagctgtggggagggaaagaagcggaaggcatgtaagaattgcacctgtggcctcgctgaagagctggaaaaggagaagtctagagaacaaatgtcgtcacagcccaaatcagcatgtggaaattgctatctcggagacgccttccgctgtgcaagttgcccatacctcggaatgccagccttcaagccaggagagaaggtgctcttgtccgatagcaatctccacgacgcctag

SEQ ID NO: 15899 - DNA, 1056 bp, Artificial Sequence
  Description of Artificial Sequence: Synthetic coding sequence
atgaatgagtcaaatgactcaaccaattatgacatggctccatattacgaggcactgtgtaagtcactcgactggcaaatcgacgtggatctcttaaacaagatgaaaaaggccaacgaagatgagttgaagaggctcgacgaggaactagaagacgctgaaaagaacctcggagaatctgaaattagggacgctatgatggcaaaggctgagtatttatgcagaatcggagacaaggagggggctcttaccgcatttcgaaaaacatacgataaaaccgtggccttaggacaccgcttggatatcgtgttctacctcctgcgaattggcctgttttatatggataacgacctcatcactaggaatacggagaaagcaaagtcactgatcgaagagggcggcgattgggacagaagaaatcgattgaaggtgtatcagggcctgtattgcgtagcgatcagagacttcaaacaggccgcagagctgtttctcgataccgtgtctacatttacttcctatgagctgatggattacaaaacctttgtcacctacactgtatatgtgtctatgatcgcgcttgaacgtccagacctgagagaaaaggttattaaaggcgctgagattctggaagtcttacattccctgcccgcagtacgccaatacctcttctccttatatgagtgcagatatagtgtgttctttcagtcactggccgtcgtcgaacaagaaatgaagaaagactggctgttcgcaccccactatcggtactacgtccgagagatgaggattcacgcttattcccagcttctggaatcttacagatctctgaccctggggtacatggccgaagcttttggggtgggagtggaatttatagatcaggagttgtctcggtttattgccgcagggcgcctccactgtaagatcgacaaggtcaatgaaatcgtcgagaccaatcgccctgattctaaaaattggcagtatcaggagactattaagaagggcgacttgctccttaatcgggtccagaagctgagtagagtgatcaatatgtag

SEQ ID NO: 15900 - DNA, 414 bp, Artificial Sequence
  Description of Artificial Sequence: Synthetic coding sequence
atgattttgcctactaaggccatggcaactcaagaactgactgttaaaaggaagttgtcaggaaatacactgcaggtgcaggcatcatctcccgttgccctaggtgtaagaatcccaaccgtagccttacacatgatggaacttttcgataccactgtggagcaactctattctattttcaccgtcaaggaactcaccaataaaaaaatcattatgaagtggcgttgtggcaattggccagaagaacactatgcgatggtcgctctgaatttcgtacctaccctgggccagactgaacttcagctgaaggaatttctctccatctgcaaggaagagaatatgaaattctgctggcagaagcagcatttcgaagagattaagggcagcctccaactcacaccgctcaatggctag

SEQ ID NO: 15901 - DNA, 2796 bp, Artificial Sequence
  Description of Artificial Sequence: Synthetic coding sequence
atggcggaggtggaggccgtccagttgaaggaggaaggcaatcgccattttcaattgcaggattacaaagccgcgacaaactcctactctcaggccctgaagctgacaaaggacaaagccttactggccaccttgtaccggaacagggccgcttgtggcctgaagaccgaatcctacgtgcaagctgcctcagatgcgagtagggcaatagatatcaatagctccgacattaaggccctttatcgtagatgccaggcgctggagcatctgggcaaactggaccaggccttcaaggatgttcagaggtgcgctaccctggaacctcggaatcagaacttccaagaaatgctgcgtcgactgaataccagcattcaagagaaactgcgggtgcagttctccactgactcgagagtacagaagatgttcgaaatccttctcgacgagaactcagaagctgacaaaagagagaaagccgccaataacctgatcgtgctgggacgagaagaagcaggggcagaaaagatttttcagaacaatggcgttgccctgctgctccagctgctagatacgaagaagcccgaactggttctcgcagccgtgagaactctctctggcatgtgctcaggccaccaagcaagggcgactgtcattcttcacgccgtgagaattgataggatctgcagtctgatggccgtggaaaacgaagaaatgtcactagccgtctgtaacctcttgcaggccatcatcgattcgctgtccggagaagataaacgagaacacagggggaaagaagaggctttagtcttagacactaagaaggacctcaagcaaatcacgagccacttattggatatgcttgtcagcaaaaaagtttccggccagggaagagaccaggctctgaacctgcttaataagaacgtgcctaggaaggatcttgcgatccacgacaacagcagaacaatttacgttgtcgacaacggactgagaaaaatcttgaaggtggttggccaagtgcctgacctaccaagttgcctgcccctcactgataacacacgcatgttggcgtccatccttatcaacaagctctacgatgacctgagatgtgacccagagcgtgatcattttaggaaaatttgcgaagagtacatcactgggaagttcgacccccaagatatggacaagaacctaaacgctattcagacggtttcaggaattcttcagggcccttttgatctcgggaatcaactgttgggcctgaaaggggtaatggaaatgatggtggccctctgcggatcagaacgagaaacggaccagttagtcgcagtcgaagctttaatacatgcttcaaccaaactgtcccgtgcaacgttcattatcactaacggagtgagcctgcttaaacagatttataagactactaagaacgaaaagattaagatccgtacgctggtggggctctgcaagttaggctctgcaggcgggacagattatggattgcggcagttcgccgaaggatctacggaaaaacttgcaaagcagtgtagaaaatggctctgtaacatgtcgatcgacacccgcaccaggcgatgggcggtggaggggttagcgtatctgacactcgacgctgatgtcaaagatgatttcgtgcaggacgtgccagctctccaggccatgttcgaacttgccaaagccggcacgtctgataaaacaatactgtacagtgtggccaccactcttgtcaactgcacgaattcgtatgatgtgaaagaggtgattccggagcttgtgcaactggcaaaattcagcaaacaacacgtccctgaggagcaccctaaggacaaaaaggatttcatagatatgagagtgaagagattgctgaaggccggcgttatctcggcgttggcctgtatggtgaaagctgattctgcaatcctaacagaccaaacaaaagaactgctggcccgggtcttcctggccctgtgcgataacccgaaggatagaggaactattgtggcgcagggaggcgggaaagcattgatccctctagccttggagggaactgacgtggggaaagtgaaggcggcccacgccctggcgaaaatcgccgccgtgtcaaacccagatatcgcatttccaggggagagagtgtatgaggttgtgcggcctctcgtgcggctgctggacactcagcgcgacgggctccagaattacgaggctctgctaggattgacaaacctctccggcagatctgacaaacttcggcagaaaatattcaaggaaagggctttaccagacatcgagaattatatgttcgaaaatcacgatcagttaagacaagccgcaacggagtgcatgtgtaatatggtgctgcacaaggaggtgcaggaacgattcctagccgacggcaacgaccgcttaaaactggttgtgctgctctgtggcgaagacgatgacaaagtgcagaatgccgccgccggcgccctggcgatgctgacagctgctcacaagaagctctgtttaaagatgactcaggttaccacccagtggctggagatcctacagcgcctatgtcttcacgatcagctgagtgtgcagcatagaggcctggtcattgcctacaacctgctggcagcggatgccgaacttgccaagaaacttgtcgaatccgagctgctggaaatccttaccgtcgtgggaaagcaggagcccgacgagaaaaaggccgaggtggtgcagactgcccgggaatgcctgatcaagtgtatggactacggctttattaagccagttagctag

SEQ ID NO: 15902 - DNA, 318 bp, Artificial Sequence
  Description of Artificial Sequence: Synthetic coding sequence
atggccttacgctatcccatggctgttggactgaacaaaggacataaagtgacaaagaatgtgtcaaaacccagacattctagacggcgcggacgactcacaaaacatacgaaattcgtgcgtgatatgatccgcgaggtttgcgggtttgcgccatacgagcgtagagccatggaactgctgaaggtgtctaaagataaaagggcccttaaatttatcaagaagcgggtggggacacacatccgggccaaaagaaagcgggaagaattaagtaatgtcctggctgcaatgaggaaggccgcggcaaagaaggactag

SEQ ID NO: 15903 - DNA, 663 bp, Artificial Sequence
  Description of Artificial Sequence: Synthetic coding sequence
atgaatagcatggaccgtcacattcagcagactaatgacagactgcagtgtataaagcagcacctgcagaacccagctaatttccacaacgcggcaacggaactgttggactggtgcggggatccaagggctttccagcgcccttttgagcagtcgctgatggggtgtttaacagtggtatccagagtcgccgctcagcagggttttgatctggacctgggctaccggctgctcgcggtgtgcgccgcgaaccgcgacaagttcactcccaagtctgctgccctacttagctcttggtgtgaggagttgggccgactcttgttactgcggcaccagaaaagcagacaaagcgatcctcctgggaagcttcctatgcagcctcctctgtcctcaatgtcaagcatgaaacccaccctcagccactccgacggcagctttccatacgattcagttccttggctacctgcttaccccgcttgcacccctccaccttctcagagccatcccaacagctgttcactgaagcaaaagcaacctctggccttcccacctcctctatgttcaatctggctcacaacattgcaggggcttctgggttccctctcttgtgtgcattttgtttcagggtggtctgtcccacgggagccgcacggcctggggtag

SEQ ID NO: 15904 - DNA, 354 bp, Artificial Sequence
  Description of Artificial Sequence: Synthetic coding sequence
atggtgcagcgcctcacataccgtcggcgcctgagctacaatacagcttctaataaaacgcgattgtctcgcacaccgggcaatcggatcgtttacttatacacgaaaaaagtgggcaaggcacccaaaagcgcctgcggtgtatgccccggacgacttaggggggtgagagccgtccgccccaaggtattgatgcgcctctccaagaccaagaagcacgtgtctagagcctatggaggaagtatgtgcgcaaaatgcgttcgcgaccgcattaagcgagccttcttaattgaggaacagaagatagtcgtaaaggtcctgaaggcacaggcgcagtcccaaaaggccaaatag

SEQ ID NO: 15905 - DNA, 354 bp, Artificial Sequence
  Description of Artificial Sequence: Synthetic coding sequence
atggtacagcggctaacatatagaagaaggctgtcttacaatacagcctcaaataaaactcgcctgtccagaaccccaggcaatcgcattgtgtatttatacaccaagaaagtggggaaggcccctaagtcagcttgtggcgtgtgccctggtaggctgcggggcgtccgcgcagttaggccgaaggtacttatgcgactaagtaagactaagaagcacgttagtagggcttatggtggcagcatgtgcgctaaatgtgtgagagatcgcattaaaagagcctttctgatcgaggagcaaaagatcgtcgtgaaggtgctgaaggctcaggcacaaagccagaaggccaagtag

SEQ ID NO: 15906 - DNA, 354 bp, Artificial Sequence
  Description of Artificial Sequence: Synthetic coding sequence
atggtgcaaagactcacctatagaagacggcttagctataataccgctagcaacaaaaccagactctctcgaacgccaggcaatcggatcgtttacctatatacgaagaaggtcgggaaagcgcctaaatccgcttgtggcgtatgccctggcagactgaggggggtgcgtgcagtcagacccaaggtgttgatgcgattgagcaagaccaagaaacacgtttcaagggcatatggtggaagtatgtgtgccaagtgtgtgcgtgataggattaagcgcgctttcctgatcgaagagcagaagatcgtggttaaggtcctaaaggctcaagctcagtcccagaaagctaagtag

SEQ ID NO: 15907 - DNA, 1902 bp, Artificial Sequence
  Description of Artificial Sequence: Synthetic coding sequence
atgaaagcgatcaagaagagtctgactgaagaagaatatctgtacctcgatttttcacatcagaccgagggatgtatttttcccctgcatacctcagtgacgctgtttttattatcatactgcgattgtaagattttcaagatctgtctcgtggtgaccaaggaagtttcgagggacagtagcctgcttcgcgatgaccttatccaggacgttgaaattcagattatttctaggcaggagcttccacccattgtgcaaaactgctgtctgccagccgtggtggagaggtctgataacttttgtagagctggtctcgcggtggtattacggcacatcattcagaagagctacgaagcagatccactgaagaaggagttactggagctgctgggtttcaagaaaacatgtcttaaggcttgcgccgaggtgtcccagtggactcggctctgtgagttgactattccattagcaattgagaactttctcagagaaagctccgaccagccacccactattcccgtcgagatcctgcagctggaaaaaaagctgtccgagccagttagagttcacaatgatgataagttaagacgccagaagctgaagcagcagaaggccgacggcgtaggacccccattaactaaaggcaaggccaagtctaaggttcacacgcaggagacaagcgaggggctggattcctccagtaagagcttggagctgaaggtggctttttcaaaactgactgttcaggaggagcccgcaaccacaaatagggagccctcgcatatccgtaaagccaaggcctctgatctccctccgcttgagcatgtgttcgccgaaggattgtacttcactctggccgacatcgtccttctgccatgcatacatcattttctggtgataataagccgcaaattcagcgaaaaacttgttgagtttccacttctggcatcttggtatcagagaatccaagaggtcccaggggtgaagaccgcggcatctaaatgcggcattcaattccttcacttacccaagctgttgactacttccaccgagcagcacccgaatctttgtgaagtaccaggcgtcgaagagcagagcgaccctctgttcatcggaggcccccgacccactatggctaagctgatggagaagggtattgaggtaatgttcagcccgcatccgtgccctacctggaccctagattggaatgtactgcccgccgctgtctcccccaaggagggcaagatgagctctgatagagccctgaggaagcagcagcaattgaataacctggtctacgtggttactaatcaggcaaagcccggggaccgtattgtggatttttgttccggcggtggccatgtgggcattgtgttagctcacatgttgccatcctgccaggtgactctcattgagaacaaagaactctctctgattagggctaagaaacgaagcgatgagctcgggctgtccaatatatggttcattcaagctaatatggaatacttcacgggaatgtttaacatcggagtggcactgcacgcatgcggagtcgccactgacatggtgattgagcattgtatcaagacacgtgcctctttcgtgacttgcccttgctgttatggctttatccagaatacctctaagttcaatttccccaagagcgaacagttcaaaaaaacactgtcttacaaagagcacatgatcctctgcaggtttgccgatcagaccgccgttcaactccctccacaacgacggcttataggcaagcagtgtatgtgtctggtcgatttggacagagccagggccgctgaggagtgtgggtactccgttcaggtcatatcaatggaacctgagtcttgcagtcctaaaaataatatgatcgtcggcgttcctatttag

SEQ ID NO: 15908 - DNA, 1641 bp, Artificial Sequence
  Description of Artificial Sequence: Synthetic coding sequence
atgaaggctatcaagaagtccttgactgaagaggaatatctctacctcgacttttcacaccagactgagggatgcatcttccccttacacactagtgtaacgcttttcctgttaagctattgtgattgtaaaatttttaagatctgtctcgtcgttaccaaagaggtttctcagtggaccaggctgtgcgaacttaccatccctctggctatcgaaaacttcctgagggagagctccgatcagccgcccaccattcccgtcgaaattcttcaactggaaaagaagttgagtgagcctgtcagagtccacaacgatgacaagctgcgtaggcagaaactgaagcagcaaaaggccgatggcgtggggccaccactgactaaaggaaaagctaagtctaaagtacatacccaggaaacatcagaagggctcgactcctcgtcaaagagtctggaacttaaggtagcattctctaagttgactgtacaggaggagcccgcaacgacaaatcgtgaacctagccatattcgaaaggccaaagctagtgatttacctcctctggagcatgtctttgccgagggtctctatttcacactggccgacattgtgttgttgccctgcattcatcatttcctggtgatcatcagccgtaaatttagcgagaaacttgtggagtttcctcttcttgcgtcatggtaccagaggatacaggaagtccccggagttaagacagcagcctccaagtgtggcatccagttcttacacctgcctaagcttctcacaacatccacagagcagcaccccaacttgtgcgaagtccccggggtggaggagcagtcagaccctctctttatcggcggacctcgcccaacaatggctaaactcatggaaaaggggattgaagtcatgttttctcctcacccttgtcccacttggacccttgattggaacgtgctgcctgcggcagtgtccccgaaggagggtaaaatgtcctctgatagggctctgaggaagcagcagcagctcaataatctcgtctatgtcgtgactaatcaggctaagccaggagataggattgtggacttttgctcagggggcggccatgtcggaattgttctggctcacatgctgcccagctgccaggtcacgctcatcgagaacaaagaactctcgttgattcgcgctaagaagcgaagtgacgaactgggcttaagcaacatttggttcattcaagcaaacatggagtattttaccggcatgttcaacattggggtagcccttcatgcctgtggagtcgccactgacatggtgatcgagcattgcatcaagactcgcgccagctttgttacctgcccatgctgctatggctttattcagaacaccagtaaatttaatttccccaaaagcgaacagtttaagaagacccttagctacaaggaacatatgattctgtgccggttcgctgaccagaccgccgtacagctccccccgcagaggagactgatcggcaaacagtgcatgtgtctggtcgacctggatagggcaagagctgcagaggaatgcggctattcagtccaggtgatttccatggaaccagagagctgctcaccaaagaacaatatgatcgtgggtgtccccatttag

SEQ ID NO: 15909 - DNA, 1542 bp, Artificial Sequence
  Description of Artificial Sequence: Synthetic coding sequence
atgctgttggagaacttgaccgacaacgagtccgaaaacacaaatctgaagaaaaaggtattcgaaaaggaagctcacatacaggaactctcctgcctttttcagagtgagaaagctaataccctcaaggccaatcgattttctcagtccgtaaaggtcgtccacgagagactccagatccagatccacaagagggaggcagagaatgataaactgaaagaatatgtaaaatctctggagacgaagatcgcaaagtggaacttacagtctaggatgaataaaaacgaagcaatcgttatgaaagaagcctctcgacaaaaaacagtggcgttaaagaaggcctcgaaagtttataaacagagacttgaccactttaccggcgctatcgagaagttaaccagtcagattcgggatcaggaggccaagctcagtgagacaatatccgcttccaatgcctggaagagccattatgagaaaatcgtcattgaaaagaccgaactggaggtccagattgagaccatgaagaaacagatcattaacctgcttgaggatttaaagaaaatggaggatcacgggaagaactcatgtgaggagattctccggaaggttcattcaattgagtatgagaacgaaactctgaatctcgaaaataccaaacttaagaccaccctagctgccttgaaagacgaggtggtctctgtagaaaacgagctcagcgagttacaggaagtagaaaaaaagcagaagacactgatcgagatgtataagacccaggtgcagaaactgcaggaggccgcagagatcgtgaagagcagatgcgagaacctacttcacaagaacaatcagatcacgaagaccaagaacaaaaacgtggaaaaaatgagaggacagatggaaagccacctgaaggagctggaacgcgtgtgcgattcgctaacagcagcagaacggcggctgcacgagtgccaggaatccctccagtgctgcaaggggaaatgtgccgatcaggagcacaccattcgggagctgcagggccaggttgacggtaatcacaacctcctaaccaagctgagccttgaggaagagaattgtcttatacaacttaagtgtgagaatctgcaacagaaactcgagcagatggacgctgagaacaaggagttagagaagaagcttgccaatcaggaagagtgccttaagcactccaacctgaagttcaaagagaaaagcgccgaatacaccgctttggctagacaattggaagccgccctggaagagggtaggcagaaagttgctgaggagatagaaaagatgtcttcacgggagagtgctctgcaaattaaaatactggatttggaaaccgaattaaggaagaagaacgaagagcagaatcagcttgtctgcaaaatgaatagtaaagcccaacatcaagaggtgtgcctgaaggaggtacagaatagcctggagaaatccgagaaccagaacgaaagtattaaaaattaccttcaatttctgaagaccagctatgtaactatgttcgagtag

SEQ ID NO: 15910 - DNA, 1167 bp, Artificial Sequence
  Description of Artificial Sequence: Synthetic coding sequence
atggccgccgccgccgctctcgcacggcttgaacagaaacagtctcgtgcctggggtccgacctctcaggacactattcggaaccaggtgcgcaaagaactgcaggccgaagcaaccgtgtctgggtcaccagaggctcctgggaccaacgtagtgtcggagcctcgtgaggagggctctgctcatctggccgtccccggagtgtactttacatgtccattaaccggtgccacgctgaggaaagatcagcgtgacgcctgtatcaaagaggcaatcctgctgcatttcagcacggaccccgtcgccgctagtattatgaagatatacacatttaataaagatcaagaccgggtgaaattgggcgtagacacaatcgcaaagtatctcgacaatatacacctgcacccagaggaggaaaagtataggaagattaagctccagaacaaggtatttcaggagcgtatcaactgtctcgagggcactcatgagtttttcgaagctattggctttcagaaggttctgctgcctgcacaggatcaggaagacccagaggaattttacgtgctgtctgagaccacactcgcccagccgcaaagcttagagagacataaagagcagctgcttgccgcggagccagttcgggccaaactagaccggcaacgcagagtgtttcagccttcccctctcgccagccagtttgagctacccggtgactttttcaatctgaccgccgaggaaatcaaacgagagcagcggctcagaagtgaagccgttgagcggctctcagtcctgcggaccaaagccatgcgcgagaaagaagaacagcgcggccttcgcaagtacaactatacgctgcttcgcgtgaggctgccagatggctgcttattgcagggcaccttctatgcccgcgaacggctcggcgctgtatatgggttcgtgcgagaagcacttcagtcagactggctgccctttgagctgttggcctccggaggccagaagctttccgaggatgagaacctggccctaaatgaatgcggactagtcccctctgccctgttgaccttttcttgggacatggcggtgcttgaagacatcaaggctgcaggggcagagcctgatagcatcctaaagcctgagttactgtcggctattgagaagctgctatag

SEQ ID NO: 15911 - DNA, 2691 bp, Artificial Sequence
  Description of Artificial Sequence: Synthetic coding sequence
atggacggagccgccggcccgggtgacggtcccgccagagaggctttacagtctttgtcgcaacgccttcgcgtacaggaacaggagatggaactggtcaaagcagcacttgccgaggccctgcgcctattaagattgcaagttcccccaagcagtctgcagggaagcgggacgcccgcaccccccggggatagtcttgcggccccccccgggctgccacccacatgcacgcccagtctagttagccgtggcacacagactgagacggaggttgagttaaaatcatcaccaggcccaccagggttgagtaacggtccccccgctccccagggggcctctgaggaaccgtccggtacccagagtgaagggggagggtcctcaagtagcggcgccggcagccccggaccccccggaattctgcgtcctcttcagcctccacagagagctgatacccccagaaggaatagcagttcctccagtagcccctccgagcgaccgcgacaaaagctgtctcgcaaagcaatatcatccgcgaatctgctggtcaggtctggctctaccgagagccggggcggaaaggaccctctgagcagcccaggcggccctgggagcaggcgatctaactataacctggagggcatctccgtgaagatgttcctgcggggacggcccatcacaatgtacatcccaagtgggatacgctcactagaagagctcccctcagggccacctcctgagaccctgtcattggattgggtctatgggtatcgggggcgggactctagatcaaacctgtttgtcctgcgtagtggcgaggtggtctattttatcgcctgcgtggtggtactatatagaccaggcggcggaccgggggggcctggggggggtggtcagcggcattaccggggccatacagattgcgtccgctgcctggccgtgcacccagacggcgtgcgagtggcttcaggccaaaccgccggcgttgataaggacggaaagcctctgcagcccgtggtacatatttgggatagtgaaactctcttaaaactacaggaaatcgggctgggcgcctttgagagaggcgttggggccctggccttcagtgccgccgaccagggagcgttcctttgtgttgtggacgacagcaacgaacatatgctcagcgtatgggactgcagcaggggcatgaaactggcagagatcaaatcaaccaacgattctgtgttagccgtcggcttcaatcctagagactctagttgtattgtgacatcgggcaagtcacatgtgcacttctggaattggagtggaggagtaggtgtccccgggaacgggaccctgacaagaaaacagggagtctttggaaagtataagaaaccgaaattcatcccatgttttgttttcctgccagatggagatatactaacaggtgattccgagggaaatattctaacctgggggagaagcccatccgactccaagacccctggccgaggtggggcaaaagaaacttacgggattgtagctcaagcccatgcccacgaaggcagtatcttcgccctgtgtttgcggcgggacggcactgtgctttcgggtggcggaagagacagacggttagtgcaatggggcccaggcctggttgccctccaggaggctgagatcccagaacacttcggcgcagtcagggcaatagctgaaggcctgggaagcgaactgctcgttggaacgactaaaaatgccctccttagaggcgatttggctcaggggttttccccggtgattcaaggccatactgatgaactgtggggcctctgcacgcacccatcccaaaaccgcttcctgacgtgtggacatgatcgccagttatgcctgtgggatggggagtctcacgccctggcatggagcattgatctcaaggagaccgggttatgcgcagactttcacccaagtggggccgttgtggcagtgggtctgaacaccggacgctggttggtcctggatactgagacccgggagatcgtctctgacgtaatcgatggaaatgaacagctctccgtggtgagatatagcccggacggcttgtatctcgcaatcggctcacatgataatgtgatatatatttactctgtgagttccgatggtgccaagagcagccggttcgggagatgcatggggcattcttccttcataacccacttagactggagcaaagatggcaatttcatcatgagtaattctggcgattatgaaattctgtactgggacgtggccggaggctgcaaacagctcaaaaaccgatatgaatctcgggaccgggagtgggctacctacacctgcgtgctcggattccatgtgtacggagtgtggcccgatggttccgatggaacggatatcaactccctctgcaggagccacaatgaacgggtggtggctgttgccgatgacttttgtaaagtccatctgtttcaatatccctgcgcgagagcaaaggcaccctctcgcatgtatggtgggcatggatcccatgtgacctccgtacgcttcacacatgatgatagccacctggtgagtctcggcggcaaagacgctagtatttttcaatggagagtcctcggtgcgggtggggccggccccgccccggccaccccctcacgtactcccagcctgagcccggccagctccctggacgtttag

SEQ ID NO: 15912 - DNA, 2934 bp, Artificial Sequence
  Description of Artificial Sequence: Synthetic coding sequence
atgggggcagaggaagaagtgctggtgacattatcaggcggcgccccgtgggggtttcgcctgcacggcggggccgaacagcgtaaaccgctccaggtctcaaagataaggcgcaggagccaggccggaagggcggggctgagagagcgtgatcaactgttggccatcaatggagtatcgtgtaccaatttaagccacgcttcagcgatgtccctgattgatgccagtggaaatcagctggtgttgactgtgcagagattagccgatgaaggccctgtgcagagtccaagcccccatgagcttcaggtcttgtctccgctgagtccactgtccccagagcctcccggcgcccctgttccccagccactccagcctgggtcccttcggagtcctccagattctgaggcttactatggtgagacggactctgacgccgacggaccagccactcaggaaaagcccagaaggccaagacgaagggggcccacacgcccaactccgccgggtgctcctcccgatgaggtctatctgtccgattcaccggcggaacccgctccgacaatacctggccctcccagccagggcgattccagagtcagctccccgtcctgggaggatggggctgcccttcaaccccctcctgctgaggcactgctcctacctcatggccccttgagacctggtccacacttgattcctatggtcggccccgtcccccaccctgtggctgaggatctcacaaccacttacactcagaaggcaaagcaggctaaacttcaacgtgcggaatcactgcaagaaaagagcattaaggaggctaagaccaaatgtcgtaccattgcttccctgcttaccgctgcccctaatcctcactctaagggcgtcttgatgtttaaaaaacggagacagcgtgcgaagaagtatactctggtgtcattcggggctgccgccggaaccggcgcagaggaggaagacggcgtgccacccacctcagagtctgagctggatgaggaagccttctcagacgcaaggtccctcacaaatcagtctgattgggattccccataccttgatatggagctggcccgcgctggttcgcgagccagcgagggtcaggggtccgggttaggtggtcagctgagcgaagtgtctggcaggggtgtacagttgtttgagcagcaacggcagcgtgctgactcaagcactcaggaattggcacgtgtcgaacccgctgccatgctaaatggcgaagggctgcagtcacccccaagagctcagagcgctcccccagaagccgccgtgctgcccccctctccgctccccgccccagtcgccagtcctcgccctttccaacccgggggtggggctccaactccagcgccaagtatattcaacaggtctgcccgtccattcacgcccgggctccagggccagcgtcccaccacaacctctgtgatattccggcctctagccccaaagagggctaacgatagcttgggcggcctcagccccgcccccccaccgtttctttcttcccaggggccaacccctctgccttcttttacatcaggggtgccttctcacgcacccgttagcggcagcccaagtacaccacgtagctctgggccagtgacagctacctctagcctttatattcccgcgccctctcgtccagtgactccaggcggggcacccgaaccgccagcaccaccttccgccgctgccatgacatccactgccagcattttcctaagcgcccccctacgaccctcagcaaggcccgaagctccagcaccaggcccaggggcccccgagcctccatccgcgcgcgaacagcggatctccgtccccgctgctcggaccgggatactccaggaggctcggcggaggggtacccggaaacaaatgttcagacctgggaaggaggaaactaagaatagtccgaatccagaactgctgtctctcgtacaaaacctggatgagaagccccgggccggaggagctgaatcggggccagaggaggatgccttgagtcttggggcggaggcatgtaactttatgcagccggtgggagcccggagttataaaaccctgccacatgtcactccaaagacgccaccgcccatggctcctaagacaccgcctcctatgaccccgaagacaccgcccccggtagcacctaaaccgccgagtcggggcctgctcgatggtctcgtcaatggggccgcctcctctgcaggcatccctgaaccaccccgattacagggaaggggtggtgagctttttgctaagcgacagtcaagggccgatagatacgtggtagagggcaccccagggccaggactagggccccggccccgatctccatctccaactccaagtcttcctccttcttggaagtactctcccaacataagggcgccaccaccaatcgcttacaaccctctcttgtcacccttcttcccacaggctgctcggaccttaccaaaggctcagtcacaagggccccgcgcaacgccaaaacagggtataaaggcacttgatttcatgagacaccaaccataccagcttaaaaccgcaatgttctgctttgacgaagtcccacccactcccggccccatcgcgtccggatccccaaagacagccagagtgcaggaaattcgccgcttctctacccccgccccccagccaacagctgagccactggccccgaccgtgttagcaccacgtgccgcaaccaccctggatgagcctatttggcgcacagaacttgcctccgctcctgttccatcaccagcccctccgcccgaggctcctcgcggcctcggagcaagtccgagctcttgtggctttcaagtcgccagacccagattttctgctacaaggaccgggttacaggctcacgtgtggcggccaggggccgggcaccagtag

SEQ ID NO: 15913 - DNA, 2757 bp, Artificial Sequence
  Description of Artificial Sequence: Synthetic coding sequence
atgggaaccacagcccctgggccaatccatctactcgaattatgtgaccagaaactgatggagttcctatgcaacatggacaataaagacttagtgtggctggaggaaatccaggaagaggctgagcgcatgttcacaagggaattctctaaggaacccgaactcatgcccaaaaccccctctcagaaaaataggaggaagaaaaggcggatctcttacgtgcaggatgagaacagagatccaattagacgaagattgtcccggagaaagagtagatcatcgcaattgtctagtaggcgcctcaggagtaaagattccgtggaaaaactggccacggtggttggcgaaaatggatctgtgttgaggcgcgttactagggcagccgcagcggctgcggcagcaacaatggcccttgctgccccttcctctccaaccccagaatcccctaccatgctgactaagaaaccggaggacaatcatacccagtgtcagctcgtccctgttgttgaaattggcatttccgaaaggcaaaacgcagagcaacatgtgactcagcttatgtcaaccgagcccctcccacggaccctcagtcctacgccagcatctgcaacagctccaactagtcagggcatccccacatctgatgaagagagcacacctaaaaagagtaaagccagaattctggaaagcatcacagtgtccagtctcatggcgacaccccaagaccctaagggacagggtgtggggaccggcaggtctgcatccaaactgagaatcgcacaggtcagccctgggccacgcgactcccctgcctttccagattccccatggcgagagcgagtattggctcccattttgcctgacaatttttcaacgccaaccgggtcgcggacggattcacagagtgtgcggcacagccctattgcaccaagcagcccttctccccaggtgctggcccagaagtactcgttggtcgcaaagcaggagtctgtggtccgccgtgcctctcggcggctcgcgaagaagaccgccgaagagccggcagcgtccggtagaattatctgccattcctatcttgagcggctgctgaatgtcgaagtgccacagaaagttgggtctgagcagaaggaaccccccgaggaggcggagccagtcgctgctgctgaacctgaggtgcccgaaaacaacggaaacaacagctggcctcataatgatacagagattgcgaattcaaccccaaacccaaaacctgctgccagctctccagagacccccagcgccggtcagcaagaagcaaaaacagaccaggcagacggccctagggaacccccccagagcgctcggaggaaaagatcctacaagcaggccgtttcggagctggatgaagagcagcatttagaggacgaggagttgcagccgcccaggagcaaaactccttcttctccttgtccagcctcaaaggtggtaagacctctccggacattcctccacaccgtgcaaagaaatcagatgctaatgactccaacgagcgctccccgcagcgtgatgaagagcttcattaagcgcaatacaccgctgcggatggatccaaaatgctcttttgtggagaaagagagacaaaggcttgagaatctgcgccggaaagaagaggctgaacagctgcgacggcaaaaagtcgaagaagacaaaagacgcaggctggaagaagtaaaactgaaacgggaggaacgactgcgaaaggtgttgcaagctagagagagggttgagcagatgaaagaggaaaagaaaaaacagattgaacagaaattcgcccaaatagatgaaaagactgagaaggccaaagaggagagattagccgaggaaaaggccaagaagaaagccgctgccaaaaagatggaggaagtggaggctagaagaaaacaggaagaggaggctcgcagactgcgctggctgcagcaggaagaagaagaaagaaggcatcaggagctcctccaaaaaaagaaggaagaggaacaggaacggttgaggaaagctgcagaggccaaaagactggcggagcagcgtgaacaggagaggcgggagcaggaacggcgagaacaagagcgtagggaacaggaaagaagagagcaggagcgacgagagcaggaaagacagctggctgagcaggagaggcggagggagcaggaacgattacaagctgagcgcgagttgcaagaaagggagaaagccttgaggctccagaaagagcagctgcagagagagttggaggagaagaaaaagaaagaggagcagcagcgtctggccgagcggcagctccaagaggagcaggagaagaaggccaaagaggcagccggggccagtaaagcgcttaacgttaccgtggatgtacaatctccggcctgtacctcctaccagatgacacctcagggccaccgtgctccaccaaagataaaccccgataattatgggatggacctcaattcagacgacagtaccgacgacgaggcacatccccgaaagccaatccccacctgggcacgcgggacccctctgtctcaagccattatacaccagtactatcatcccccaaacctgctggagctgtttggcaccatcttaccactcgacttggaggatatctttaaaaagagcaaaccaaggtaccacaagcggacatcttcagcggtttggaactctccaccactgcagggcgcgagagtgcctagttcattggcttactccctgaagaagcactag

SEQ ID NO: 15914 - DNA, 1728 bp, Artificial Sequence
  Description of Artificial Sequence: Synthetic coding sequence
atgacaagtaagaaattagttaatagtgtggcagggtgcgccgatgacgctctcgctggactggtggcatgcaaccccaatttacaactgcttcaagggcatcgggtagcccttcgtagtgatctggattcacttaagggaagggtagcccttttatccgggggtggcagtgggcacgaaccagcccatgcaggctttatcggaaaagggatgctgactggtgtgattgccggggccgtatttaccagtccagccgtgggttccatccttgccgctatcagggctgtggcacaggctggcaccgtcggcaccctgctgatcgtgaagaattatacgggcgatcgcctgaactttggcctagccagagagcaggctagagccgaaggcatcccggttgagatggttgttatcggagacgacagcgccttcacagtgctgaaaaaagcagggaggagggggctgtgcggaactgtgttgatccataaggtggctggagccctagccgaggcaggagtgggcctagaggagatcgccaaacaggtgaatgtcgtggctaaggctatgggaactctgggtgtgtctttatcatcctgcagtgtacctggaagcaagccaacattcgaattgagtgccgatgaggtcgagcttggcctggggatacacggggaggccggtgttcgccgaattaaaatggcaaccgctgatgaaatcgtcaaactaatgttagaccacatgaccaatacaactaatgcatcacatgttcccgtacaacctggttccagcgtcgtgatgatggtcaacaatctcggggggctttcttttctagaactcgggatcatagctgatgcaaccgtgcgaagcctcgaggggcggggtgtgaaaatagctcgagcactggttggaacattcatgagcgcactcgaaatgcctggaatctcactcaccctgctgcttgttgacgagccccttttgaaactgattgacgctgaaacaacagcagccgcctggccgaatgtggcagctgttagtattactggacgcaaacgcagcagagtggcccccgctgagccacaagaggctcccgactcaacagctgctggtggcagcgcctctaaacgcatggctctggtgcttgaacgggtgtgtagtaccctgttgggccttgaagaacacctgaatgctcttgatcgggccgctggagacggggactgtggaactacgcactctcgcgcggcgcgagcaatacaggagtggctgaaagagggcccgccacccgcctcgcctgcccagctgctctccaaactctcggtacttttactcgagaaaatgggcggctcctcaggagctctgtacgggctctttttaaccgcggctgctcaaccactgaaagcaaagacaagtctgcccgcttggagcgccgccatggatgccggtctagaagccatgcagaagtacggtaaagcagctccaggggacaggacaatgttagattcgttgtgggctgctggtcaggagctccaagcctggaagagccctggcgcggatctgctccaggtcctcaccaaggccgtaaaatcagccgaggctgctgccgaagccaccaagaatatggaggctggtgcagggagagcgagttatatttcctctgcgcgcctggagcagcccgaccccggtgcagtggctgccgcggccattctcagagctattctcgaggtgttgcagtcatag

SEQ ID NO: 15915 - DNA, 1080 bp, Artificial Sequence
  Description of Artificial Sequence: Synthetic coding sequence
atggccgcgccatgcgccgaagatccgtctctggaaagacactttaaaggtcacagagacgcggtgacctgcgttgatttcagtattaacactaaacagctcgcctctggttccatggacagttgtctgatggtgtggcacatgaagccgcagtcacgcgcttaccgttttacgggacataaggatgcagtgacttgcgtcaactttagcccaagcggtcatctgctagcatccgggagtcgcgacaaaaccgtgcgcatctgggtgcccaacgtgaaaggagagagcacagttttcagagcccatacagctacagtacggagtgttcacttctgcagtgatggacagagctttgtgaccgctagcgacgacaagaccgttaaagtttgggcaacccataggcagaagttcttgttctccctttcccagcacatcaactgggtgaggtgtgcaaagttcagtccggacggaagactcatcgtatccgcatccgacgataagaccgtaaagctgtgggacaagtctagtcgagaatgtgtgcacagttattgcgagcacggggggttcgtcacttacgtggacttccacccgagcggaacctgtattgcagccgccggtatggataacactgtgaaagtgtgggatgtccgcacacataggctattacagcactatcagctgcacagcgcggccgtcaatggactgtcctttcaccccagcggtaattatctgatcacggcctcctccgacagcaccttgaagatcttggacctcatggagggccgactgctgtatactctgcacgggcatcagggccccgcgaccacggtggcctttagtagaacaggcgaatactttgcgtccggcggcagtgatgagcaagtgatggtctggaaatcaaactttgacatcgtcgaccacggggaagttacaaaggtcccaaggcctcccgcaaccttagcttcctcaatggggaatctgactgtgtcaatactggaacagcggttaacgttgactgaggataagctgaagcaatgtctggagaaccagcagttgataatgcagagagctaccccctag

SEQ ID NO: 15916 - DNA, 633 bp, Artificial Sequence
  Description of Artificial Sequence: Synthetic coding sequence
atggctgcctctgtagagcaacgcgagggtaccatccaggtgcagggccaggctctgtttttcagggaggccctgcccgggagtggccaagcaagattttccgtgttactgctacacgggatcaggttctctagcgagacctggcagaatttgggcacccttcacaggctcgcccaggctggatatcgtgctgtcgccatcgatcttcctggactgggccactcgaaggaggcagccgcccctgccccaatcggagagctggctcctggatccttcctggccgctgtggtcgatgcactggagctgggtccccccgtcgtgattagcccaagcctgagtggtatgtactctttaccattcctgactgcccctggttcccaacttcctggatttgtgccggtggctcctatctgcactgacaagattaacgccgccaactatgccagcgtgaagaccccggcattgatcgtgtacggagatcaggaccccatggggcagacctcctttgagcatctgaaacagctgccaaatcatcgagtgctgatcatgaaaggagcaggccacccttgttatctcgacaagcccgaggaatggcacacaggcctcctggacttcttgcaaggactgcaatag

SEQ ID NO: 15917 - DNA, 1491 bp, Artificial Sequence
  Description of Artificial Sequence: Synthetic coding sequence
atggaccaagactatgaaagaagattattgagacaaattgtgatccagaatgaaaacaccatgccccgggtgactgaaatgcgtcggaccttgaccccagcgtcttcccctgtgtcaagtccttccaagcacggcgacagattcattccatcccgcgccggagcaaactggtccgtgaattttcacagaatcaacgagaatgaaaagtcccctagtcagaataggaaggccaaggatgctacatcagataacgggaaggacggcctggcatattccgccttgttgaaaaatgagctacttggtgccgggattgaaaaggtccaggatccgcagaccgaagatcgaagattacagccgagcacacctgaaaaaaagggtttatttacttattccctgagcactaagcggagctcaccggacgatggcaacgacgtcagcccgtactccctgagtccagtcagtaacaagtcccagaagcttctcagatctccgcggaagcccaccagaaagatttctaagatcccctttaaggtacttgacgccccagagttacaggacgatttttacctgaatcttgttgattggtctagcctgaacgtactgtccgtcggcctgggaacgtgtgtgtacctgtggtctgcatgcacaagccaagtgaccaggctgtgcgacctgagtgtcgaaggggactctgtaaccagcgtaggctggtctgagcgcggtaatcttgtggccgtcggaacacacaagggattcgtccaaatctgggacgctgcagctggcaagaaactttccatgctcgaagggcatacagcacgggtgggagctctcgcctggaacgctgagcagctttcctccggttcacgagataggatgattctgcagagagatataagaacccccccactacagtccgaacgcagattacagggacacaggcaggaggtctgcgggctaaagtggagcactgaccaccaactcctcgctagtggcggaaacgataacaagttgctagtgtggaaccactcaagcctaagtccggtgcagcagtacactgaacatttagccgcggtgaaggcgatcgcttggtcaccacatcaacacgggctgctggcatccggaggcggaacagctgaccgttgcatccgcttctggaacacgctgaccggacagccactccaatgtattgatacagggtcccaggtatgcaacctggcctggtctaagcacgccaacgaactcgtgagcacccacggttacagtcaaaaccagatcctggtgtggaagtacccttccctgactcaggtggctaaactgacaggccactcgtatcgggtcctttatctggctatgagcccagacggcgaggctatagtgactggcgccggagatgagaccctgcgcttctggaacgtttttagtaaaacccgaagtacaaaggtcaaatgggagtccgtctctgtgttaaacctgttcactaggattcgttag

SEQ ID NO: 15918 - DNA, 390 bp, Artificial Sequence
  Description of Artificial Sequence: Synthetic coding sequence
atggcagagctgattcagaaaaagcttcagggcgaagtggagaagtaccagcaactgcagaaggacttgagtaagtccatgtctggacggcaaaaactcgaggcgcagctcacagagaataacattgtcaaagaggagcttgctctgttggatggtagcaatgttgtgtttaagcttctaggtcccgtgttggtaaaacaggaactgggcgaggcgcgtgcaacagtcggcaaacgactggattatattactgcagaaataaagcggtatgagtctcagctgagggatcttgagcgacagagcgagcagcagcgcgagactctagcacagcttcagcaggagtttcaaagagctcaggccgcaaaagctggcgccccagggaaagcttag

SEQ ID NO: 15919 - DNA, 888 bp, Artificial Sequence
  Description of Artificial Sequence: Synthetic coding sequence
atggaactgattcaggataccagccgccccccacttgagtacgtcaagggcgttccactgatcaaatattttgcagaagcccttgggccgctgcagagcttccaggcccgccccgacgaccttttgatcaacacgtatcctaagagtggcacgacatgggttagtcagatccttgatatgatctaccagggcggggacctcgagaagtgtaaccgcgcccctatctacgtgcgcgtgccgttcctagaagttaatgaccctggagagcccagcggcctggaaacgctgaaagacaccccaccccctcggttgatcaagtcgcacctgcctcttgcattactccctcagacactgctggaccaaaaggtgaaggtagtctacgtggctaggaaccctaaagatgtggcggtgagttattaccacttccacagaatggaaaaagcacacccggagcccggcacatgggactctttcctggaaaaattcatggcaggcgaagtaagttacgggtcttggtaccagcacgtgcaggaatggtgggagctcagcaggacacaccctgtgctgtatcttttttacgaagatatgaaagaaaaccctaagcgggaaatccaaaaaattctggagtttgtgggcagaagtctccctgaagagaccatggacttcatggtacagcacacttctttcaaggagatgaaaaaaaatcctatgacaaactatacaactgtaccgcaggagctcatggatcattccatctcgccatttatgaggaaagggatggccggcgactggaagacaacctttactgtagcccagaatgaacggttcgacgcagattacgctgaaaagatggccgggtgctccctgtcattccgcagtgaattgtag

SEQ ID NO: 15920 - DNA, 888 bp, Artificial Sequence
  Description of Artificial Sequence: Synthetic coding sequence
atggagctgattcaggatactagccgcccccccctggaatatgtgaaaggggtccccctgataaagtattttgctgaagccctgggcccactgcagtcatttcaggcaagaccagacgatctgctcatcaacacctatcccaagtctggcaccacttgggtctctcagatattggatatgatttatcaagggggagacctggagaaatgcaaccgcgccccaatatatgtccgggtgcccttcttagaagtgaatgatccgggggaaccatcagggctggagaccctgaaagatacaccccctcctcgcctcattaagtctcatctgccacttgcgctcctacctcagacattattggatcagaaggtaaaagtggtgtatgtagctcgaaatcccaaagacgtggctgtatcatattatcatttccacagaatggagaaggctcatccagagcctggtacctgggactctttcctcgagaagttcatggctggcgaggtgtcctacgggagttggtatcaacacgtgcaggaatggtgggaactctctaggactcatccagtgctctacctattctacgaggacatgaaggaaaatcctaaaagagagattcagaaaatcctggaattcgtagggagatcactgccagaagaaactatggattttatggtgcaacatacaagttttaaagaaatgaagaaaaaccctatgactaactatactacagtcccccaagaactgatggaccacagcatcagccctttcatgcgcaaaggcatggcaggtgactggaaaactacgtttacagtggcccagaacgagagatttgacgccgattatgccgagaaaatggccggctgttctctctcttttcgctccgaactgtag

SEQ ID NO: 15921 - DNA, 354 bp, Artificial Sequence
  Description of Artificial Sequence: Synthetic coding sequence
atgttatgttggggcaatgcctcatttgggcagcttggccttggcggaatcgatgaggaaatcgtactggagcccaggaaatctgatttcttcatcaataagcgggtacgagacgtgggttgcgggctccggcacacagtgtttgttttggatgatgggacagtgtacacatgtgggtgtaacgacctcggccagctgggtcacgaaaagtctagaaagaaacctgaaattctgaaggtctgtcagatttccaggctgtatcggctgttagtggtgaccatcattcatttgcactttttaaagcaggtgaagagctccgtcggtgaccgtattaatatggccaattgggtgtag

SEQ ID NO: 15922 - DNA, 3174 bp, Artificial Sequence
  Description of Artificial Sequence: Synthetic coding sequence
atgctgtgttggggcaatgccagtttcggccagctgggtctgggcggaattgacgaggagatcgtgttagaacctcgtaaaagcgacttcttcatcaataaaagagtgagggacgtagggtgtgggctgagacacactgtgttcgtgctggacgatggcaccgtttatacgtgtgggtgtaatgacctgggccagctcggccacgaaaaaagtcgcaagaaacctgagcaagtagtggcactagacgctcaaaatatcgttgcagtttcatgcggggaagcgcacaccttggctctcaatgacaaggggcaggtgtacgcctggggactggatagcgacggtcagctggggcttgtcggttccgaggagtgtataagggtgcctaggaatattaagagccttagtgacatccagatcgtccaggttgcatgtgggtattaccatagcttggccctgtccaaggcctccgaagtcttctgttgggggcagaataaatacggtcagctggggttaggcaccgactgtaaaaagcagacaagcccacagctgctgaaatccctcctgggcatccctttcatgcaagttgcagctggcggggctcacagtttcgtgctcacgctgtctggggcaattttcgggtggggtcgcaacaagtttggacagctgggactgaatgacgaaaacgatcgatatgtcccgaacctgctaaaaagcctgaggtctcaaaaaattgtctatatctgctgcggcgaagatcataccgctgcgctcaccaaggaagggggtgtattcaccttcggagcgggaggatacggccagcttggacacaacagtacctctcatgagataaatcccaggaaggtattcgagcttatgggctctattgtcacggagattgcttgcgggcgccaacacacatccgcctttgtgccaagttccggacgaatttactcttttggattgggagggaacgggcaattaggaacaggttctactagcaaccggaagagcccattcacagtgaagggcaactggtacccctataacggacaatgtctgccagacattgatagcgaggagtacttctgcgttaaacggattttctccgggggtgatcagagcttctctcattattcatcacctcagaactgcggaccacctgacgattttcgctgtcctaatcctaccaagcagatctggacggtcaatgaggctcttatccagaagtggttgagctacccctccgggaggttccctgtggaaatcgcaaacgaaattgacgggacattctcaagttccggctgcctgaacggatctttcctcgccgttagtaatgatgaccactataggacaggcactcggttctccggagtggatatgaatgcggcccggctcctgtttcataaactgatccagccagatcacccccagatctcccagcaagtggccgcctccctggagaaaaatctgatcccgaagctgacctcgtctctgccagacgtggaggctctgcgcttttacctgacgcttcctgagtgccccttaatgtccgatagcaacaacttcactacgatagcaatacccttcggcaccgctctggtgaacctggagaaagcacccttgaaagtcctggaaaattggtggagtgtccttgagccacctctgttcctgaagattgttgaactgtttaaggaggtggttgtccacctcctgaagctctacaagattggaattccaccgtcagagcggagaatcttcaactcttttctccataccgctttgaaagtgctagagatactccacagagtgaacgaaaagatggggcagattattcagtacgacaagttctatattcacgaagttcaagagctgattgatattcgcaatgactacattaactgggtgcagcagcaggcttacgggatggacgttaatcatggcctgacggagctggctgacatccccgttactatatgcacttaccctttcgtttttgatgctcaggctaaaaccacccttctgcagacggacgctgtgttgcagatgcagatggctatagaccaggctcaccgacaaaatgtcagctccctgtttttgccagtgatcgagagcgtaaatccatgtctgatcctggtagttaggcgggagaacatagtaggcgatgctatggaggtcctgagaaagaccaaaaacatcgattataagaagccactgaaggtgatttttgtcggagaagatgcagtggatgctggtggagtgcggaaagagttctttctgcttataatgcgagagcttctggacccaaagtacggtatgttccgctactatgaagactcaaggctcatatggttctccgacaagacatttgaagacagtgatctgttccatcttattggggtgatctgtggactggccatttataactgcaccatagtcgatctccatttcccactcgccctctataagaagctcttgaagaagaaacctagcttagatgacctgaaggaattaatgccagacgttggtaggtcaatgcagcagcttcttgactaccccgaagatgatatcgaggagacattctgtctgaattttaccattacagtagagaattttggagccaccgaggtgaaagagcttgtcttgaacggggccgacaccgccgtgaataaacagaataggcaggagttcgtcgatgcctacgttgattatatcttcaataaatctgttgcctcccttttcgatgcttttcacgcaggattccataaagtctgcggggggaaggtactgttgctttttcagcccaacgaactacaagccatggtgatcggaaacaccaattatgattggaaagagttggagaagaacaccgagtacaagggcgaatactgggccgaacaccctactatcaagatcttctgggaagtgttccatgaactcccattagaaaagaaaaagcagtttctgcttttcctcacaggatctgacaggattcctatcctcggaatgaaatctctcaagctcgtgatccaaagtacaggtggaggcgaggaataccttcccgttagccatacttgcttcaacttgctcgacctccctaagtatacggagaaagaaactctgcggagcaaactgatccaagctattgatcacaacgaaggatttagtttgatttag

SEQ ID NO: 15923 - DNA, 1080 bp, Artificial Sequence
  Description of Artificial Sequence: Synthetic coding sequence
atgagctacagacgtgaactggagaaatatcgggatctcgacgaggacgagattcttggtgctctaactgaagaggagttgcggaccctagagaatgagctggacgagttggaccccgacaatgcactccttcccgccggccttcggcaaaaggaccagacaacaaaagcccctactggtccgtttaaaagggaggaactgctggaccacttggagaaacaggccaaagaattcaaagaccgggaggaccttgtgccctataccggcgaaaaaagaggcaaagtgtgggttcctaaacagaagcccctggacccggtcttggaatctgtaactcttgaacccgaactggaggaggccctggcaaatgccagcgacgcagaattgtgcgatatagccgcaatcctgggcatgcacacgttaatgtcaaatcagcaatactatcaagcactgagctcaagctctattatgaataaagaaggtctaaactctgtgattaagcccacccagtataagccagttccggatgaagagccaaactccacggatgtggaggagaccctcgagagaattaaaaacaatgaccctaagctggaagaagtcaatctaaacaacattcggaacattcctataccaaccctcaaggcctacgctgaagcattgaaagaaaattcatatgttaaaaaattctctatcgtcggaactcggtccaacgatcccgtagcctatgccctggctgagatgctgaaggagaacaaagtactgaagactttaaacgtggagagcaatttcatctcaggtgcgggaatactgcgactcgtcgaagctctgccatataatactagtctcgttgagatgaaaatcgacaatcagtcgcagccactggggaacaaggtggaaatggagatcgtgagcatgctcgaaaaaaacgcaacactgctgaagtttggctatcattttacccaacaaggtcccagactgcgtgcatccaatgcgatgatgaataacaatgacctggtacggaagcggagactcgctgacctaaccggaccaattatcccaaagtgccgttccggcgtctag

SEQ ID NO: 15924 - DNA, 714 bp, Artificial Sequence
  Description of Artificial Sequence: Synthetic coding sequence
atggaggtgatggaaggtcccttgaatctggcccatcagcagtctagacgcgccgacagactgttagcagcgggtaaatatgaggaggcaatttcttgccataaaaaggccgccgcttatctttcggaggccatgaaactgactcagagtgagcaggcgcatctcagtctagagctacaacgagattctcatatgaaacagcttctgcttattcaagagcgctggaagcgtgctcagagagaagaacggctcaaggcccagcagaatacagtgctttatttgcttcaacagaagtctgaacccgccgagccctgcatcggaagtaaagctcctaaagatgacaaaaccattattgaggagcaggcaacgaagatcgcagacttgaagaggcacgtagagtttctggttgccgaaaatgaacgactgcgcaaggaaaacaaacagctgaaagccgaaaaggcaagattgctcaaaggacctattgagaaagagctggacgtcgatgccgacttcgttgagacctccgagctatggtccctgcctcctcacgcggaaacggcaacagcttcttcaacatggcagaaatttgcagccaataccggaaaagcaaaagacatcccgattcctaacctgccgccgctggatttcccaagtccagaactgccactcatggagttatcagaggacattctgaaggggttcatgaacaactag

SEQ ID NO: 15925 - DNA, 1458 bp, Artificial Sequence
  Description of Artificial Sequence: Synthetic coding sequence
atgaatggaactctggatcatcccgatcagccagacttagacgctattaagatgtttgtcggtcaagttcctcggacgtggtcagagaaggacctacgcgagttgttcgagcaatatggcgccgtgtacgaaatcaatgttttgcgggaccggagccaaaatcccccacagtctaagggttgttgttttgttacgttttacacaaggaaagctgccctggaggctcagaatgccctccacaatatgaaggttctgcccggcatgcaccatcctatccagatgaagccagcggattccgaaaaaaacaacgtggaagatcggaagttgttcataggtatgattagtaagaagtgtactgaaaacgatatacgggtgatgttttcaagctttggtcaaatcgaagagtgcaggatactgcgaggccctgacggcctgtcacgcggctgtgcatttgtgacattcacgactagagccatggcgcagacagctataaaagccatgcatcaggctcagaccatggaggggtgctccagtccgatggttgtaaagtttgcagatacgcagaaggataaggagcagaaacgcatggcccagcagctgcagcagcaaatgcaacaaatctctgctgccagcgtgtggggaaatttagccggccttaatactcttggcccacagtatctcgcattgtatctacaactgctccaacagaccgcctcttctggcaacctgaacaccctctcaagtttgcacccaatgggaggactgaatgctatgcagctgcagaacttggccgccctggcagctgccgcgtccgctgctcagaatacaccgagtggcaccaatgctctgaccactagtagcagtcctctgtccgtcctgactagctccggctcttcgcctagctctagcagttcgaattccgtcaaccctatcgcttcattgggcgctctgcaaacactcgccggcgctacagcagggttaaacgtgggctccttggcaggcatggccgccttgaacggcggccttgggagctccggccttagcaatggcacagggagcaccatggaagctttgactcaggcttactctggcattcagcagtatgccgctgcagccctccccactttatacaatcaaaacttgcttacccagcagtctatcggcgccgctggctcccaaaaggagggtcccgaaggcgcaaacttgttcatttatcacctcccacaggagttcggtgatcaggacctccttcagatgttcatgccattcggaaacgttgtctccgccaaagttttcatcgacaagcagacaaacctcagtaagtgctttggtttcgtgtcatacgataatcctgtgagcgcccaggccgcaatccaaagtatgaatggatttcaaattgggatgaagcgtcttaaggtccaactaaagagatctaagaatgattctaagccctactag

SEQ ID NO: 15926 - DNA, 1452 bp, Artificial Sequence
  Description of Artificial Sequence: Synthetic coding sequence
atgaatgggaccttggaccacccagaccagcccgatctcgacgctatcaagatgtttgtcggccaggttccgcgtacctggagtgagaaagacctgagagagctgttcgagcagtatggcgcagtatacgagatcaatgtgcttcgggacagaagtcagaaccccccccagtcaaaagggtgctgctttgtaacgttttacactcggaaggcagccctggaggcacagaacgcacttcataacatgaaggtcttgcccggaatgcaccaccctatccagatgaagcctgccgactctgagaagaataacgcggtggaagaccggaagctcttcattggcatgatttctaagaagtgtaccgagaatgatattcgcgtgatgttctccagctttggccagattgaggaatgtagaatccttaggggaccagatggcctgtctagaggttgcgcatttgtgacattcacaacccgagctatggctcaaaccgcaatcaaggctatgcaccaggcacagacaatggagggctgttccagtccaatggtagtgaagtttgccgacacacagaaagacaaagagcagaaacgcatggctcagcaactgcagcagcagatgcaacagatcagtgcagcctctgtttggggcaatcttgccgggttgaatacgttgggaccacagtatctggcacttttgcagcagacagcgtcctccggtaatctgaatacactctcgtctttacatccaatgggcggtctaaatgcgatgcagcttcaaaatctggccgcactggctgcggcagcaagcgccgctcagaacacaccttctggaactaatgccctgactacgagttcctcgccgctctccgtgctgacttccagcgctgggagtagccccagctccagctcaagtaacagtgttaacccaattgcatcactgggcgctcttcaaaccttggcaggagccacagccgggcttaacgtgggctcgctggctggtatggcagctctgaatggcggactaggcagttcgggcctcagcaatgggaccggctcaactatggaagcattgactcaggcctattctggtatccaacagtatgcagcagctgcgctgccaacgctgtataatcagaacttactgacacaacaatccattggggcggccggttcccaaaaggaaggccctgagggagccaatctatttatctaccacctgccacaagaatttggcgaccaggatctgctgcaaatgttcatgccctttggaaacgtggtgtctgcgaaggtgttcattgataaacagacaaatctgagcaaatgcttcggtttcgtgtcttatgataacccggtgtccgcgcaggccgcaatccaatccatgaatgggtttcagattggaatgaagaggcttaaagtgcaactgaaacgttctaagaatgatagtaagccgtactag

SEQ ID NO: 15927 - DNA, 3570 bp, Artificial Sequence
  Description of Artificial Sequence: Synthetic coding sequence
atggatgataaaggcgatccatctaacgaggaggcacccaaggcaatcaagccaactagcaaagagttccgcaaaacgtggggctttagaagaacgacaattgctaagagggagggggctggggatgccgaagccgatcccctggaacctcccccacctcaacagcagttagggctaagtctgcgccgcagtggaaggcagcccaaacgcaccgagcgggttgagcagtttctcaccatagctcggcggagaggacggagaagcatgccggtttctctggaagattctggagaacctacctcgtgtccagctaccgatgccgagaccgcctccgaggggagtgtggaaagcgcctcggagacacgctccgggccccagtctgcttccacagctgttaaggaacgccccgctagctctgaaaaagtgaaaggcggtgacgaccatgatgatacctccgactccgattccgacgggctgaccttgaaagaactacagaaccgactgaggcggaagagggagcaggaaccgacagaacgccctctgaagggtatccagagtcgccttagaaaaaaacgcagggaagaggggcccgcagagaccgtggggagcgaagcatccgataccgttgagggcgtgcttccgtccaagcaagagccggaaaatgatcagggggtggtgagccaggcagggaaagatgatagggaatccaagcttgagggcaaggccgctcaagacatcaaagacgaagagcctggcgatctcggtagacccaagccagaatgtgaaggatacgacccaaacgcgttgtactgcatctgtaggcagcctcataacaatagattcatgatatgctgtgatcggtgcgaagaatggttccatggggattgcgtcggaatctctgaggcgagaggaagactccttgagcgtaatggtgaggactacatttgccccaactgcacgattttacaggtccaggacgaaacccattcggagacagcagatcagcaagaggccaagtggagacctggcgacgctgacggcactgactgcacatctatcgggaccatagaacaaaaatcgtctgaagaccaaggcattaaggggagaattgagaaagctgccaacccgtcgggcaaaaagaagttaaagatttttcagcccgttatcgaggccccgggagcaagcaagtgtatcggcccaggatgctgtcacgttgcacagcccgattcagtgtattgcagcaatgactgtatcttgaagcatgcagcggcaacaatgaaatttctaagctcaggcaaggagcagaaacctaaaccaaaagaaaagatgaagatgaagcccgaaaagccttccctccctaagtgtggcgcacaggctggcattaaaatcagtagcgtgcataagcgacctgccccagagaagaaagaaactaccgtgaagaaagcagtggtcgttcctgcaaggagcgaagcgcttggaaaggaggctgcttgcgagtccagcaccccatcttgggctagtgatcataactacaatgccgtgaaacccgagaaaacagctgccccgagcccttctctgttgtataagtccacaaaggaggacagacgatctgaagagaaggctgcagcgatggccgccagcaagaaaacggcacctcccggctcagctgttggaaaacagcctgccccccgaaacctggtacccaagaaatcctcctttgcaaatgtcgccgctgctactccagccataaaaaaacctcccagcggcttcaaagggactatccccaaaagaccttggctctcagccacaccctcctcaggcgcctctgccgctagacaagctgggccagcaccagcggccgccacagccgcatctaagaagtttccggggtctgctgccctagtcggggccgttcgaaaacccgttgtccctagtgttcccatggcctctcccgctcctggccgcctgggcgctatgagcgccgcacctagccaaccaaattcccagataaggcagaacataaggagaagtctaaaggagatcttatggaagagagttaacgactctgacgatcttattatgacagaaaacgaagtgggcaagatcgccttgcatatcgagaaggaaatgtttaatctcttccaggtgactgacaatcgctataagtcaaaatacagaagcattatgttcaacctgaaagatcctaagaatcagggtctttttcatagagttctcagggaggaaatctctttagctaaactcgtcaggctgaagccagaagaactcgtgtctaaagaactgtctacctggaaggagcgccctgcacggtcagtcatggagtctcgaactaagctgcacaatgagtcgaagaaaactgcgcccaggcaagaggctatcccagacttggaggattctcctcctgtgtccgatagcgaggagcagcaagagtccgcacgtgccgtcccagagaagtccaccgcccctttgctggacgtcttttcatccatgcttaaagatacaacaagccagcatagggctcatctcttcgatcttaattgtaagatatgtactggccaggttccgtcggctgaggacgagcccgctcccaagaaacagaagctttccgcctctgttaagaaggaggatctgaaatccaagcacgattcatcggcccccgatccagcacccgacagcgccgatgaggtgatgcccgaggccgtgccagaagtcgcttccgaaccagggctggagtccgccagccaccccaacgtagatcgcacatacttcccaggaccccccggcgacgggcaccctgaaccctcacctctggaagacctgtctccttgccccgcatcttgtgggtccggggtcgttaccactgttaccgtgtcaggtcgtgaccccagaacagccccatcgtcctcctgtaccgccgtggccagtgctgcgagccgacccgactctacacacatggtggaagcacggcaggatgtccctaaaccggtcctgaccagtgtaatggtaccgaaaagtatcctcgcgaaaccaagctcttcccccgatcccagatacctttccgtcccccctagccctaatattagcaccagcgagtccaggagtccaccggagggagacaccacattgtttctgtctcgcctgagcactatctggaaaggctttattaacatgcagagcgtcgcaaaatttgttacaaaagcctacccagtgtcaggttgcttcgattacttgagtgaagatcttccagacactatccacatcggcggccgtatcgcccctaagacagtatgggactacgtggggaagttgaagtcaagcgtgtcaaaggaattgtgcctaattaggtttcaccctgccaccgaggaggaagaggttgcctatatatccctgtatagttacttttcaagtaggggcagattcggggtggtggctaataataacagacatgtcaaggacctgtacctcattccactgagcgcacaagatccagtcccttctaagctgctaccattcgagggccccggcaagagaaggctgtccggctggcggtag

SEQ ID NO: 15928 - DNA, 3570 bp, Artificial Sequence
  Description of Artificial Sequence: Synthetic coding sequence
atggacgataagggcgatccttccaacgaagaggcccctaaggcgatcaagccaacctctaaggaattccgcaaaacttggggtttccggagaacgactatcgctaagagagagggggcaggagatgctgaggccgatcctctggagcctcctccccctcaacagcagctgggcctgtccctcaggaggtctggccgtcagccgaagaggactgaacgagttgagcaattcctgaccatagcccgccgacggggcagacggagcatgcctgtttccctcgaagactcaggggaacctactagttgcccagctacggatgctgagaccgcttctgaaggaagtgtagagtctgccagcgaaacccggtccgggccacagagcgctagcacagccgtgaaagaacgcccagcatcgtcagagaaggtgaagggcggggacgaccacgacgacacatcagattcagactctgacggcctcactctaaaggagctccagaataggctgaggaggaaaagggaacaagagcccactgagcggccacttaaaggcattcagagtaggttgcgaaaaaagagaagagaagaggggccagcggaaaccgtgggttcagaggcttccgatacggtggaaggggtacttcctagcaaacaggagccagaaaatgatcagggcgtggtgtcccaagccggtaaagatgatcgtgaatctaaactggagggtaaggccgcccaagatatcaaggatgaagagcctggtgatctaggtagaccaaaacctgaatgtgagggttatgatccaaacgcattgtactgcatatgtagacagccacacaacaaccgctttatgatctgctgcgaccgatgcgaggaatggtttcatggagactgtgtcggcatcagcgaggccaggggtcgccttcttgaacgtaacggagaggattatatctgccctaactgtacaatcctccaggtgcaggacgaaactcattccgaaacagcagaccaacaggaggccaaatggaggccaggcgatgccgatggcaccgattgtacaagcattggtactattgaacagaagtccagtgaagaccagggaatcaaaggaagaatcgaaaaggccgcgaacccgtcaggcaagaagaaacttaaaatatttcaacctgtcatcgaggcgcctggcgcctcaaaatgcatcgggcccgggtgttgccatgtggcccagccagatagtgtttattgttctaatgactgtatacttaagcacgcggcagcgaccatgaaattcctttcgagcgggaaagaacagaagccaaaacccaaagaaaagatgaagatgaaaccagagaaacccagcttgccaaagtgcggtgcccaggccggtatcaagatctccagcgtccataaacggcccgctcctgagaaaaaggagactacagtcaagaaagcggtcgtcgtccccgcacggtcagaggcccttgggaaagaagccgcctgtgagtcctccacaccttcttgggctagcgaccacaattataacgcagtgaagcccgagaagactgccgcgcctagcccatcgctcctgtataaaagcaccaaggaggatcggaggagcgaagaaaaagctgccgccatggccgccagcaagaagacagcaccaccagggtccgccgtcggcaaacaaccagccccgcgcaacttagtcccaaaaaagtcatcctttgccaacgtggcagccgccacccctgcaataaaaaaacccccgtctggatttaagggcaccattccaaagcggccatggctctctgccactccctcaagtggagccagtgccgcaagacaggccggtcctgcgcccgccgccgccaccgccgcctcaaaaaaattccccggaagcgccgccctcgtgggagccgtaagaaagcccgttgtgccttctgttcccatggcatcaccagctccaggccgactgggcgccatgtcagccgctccgagtcagcccaatagccagatccgtcaaaatataaggagatctctgaaggagattttgtggaaacgggtgaatgacagtgacgatttgatcatgaccgagaatgaggtgggaaagatcgccctccacattgagaaagagatgttcaacctgtttcaggttaccgataaccgatacaaatccaaataccggtccatcatgttcaatttgaaagatcccaagaaccaagggctgttccatagagttctgagagaggagatcagtctggctaagctagtgagactgaagcctgaggagctcgtgtctaaagaattatcaacatggaaggaaaggcctgctcgatcggttatggagagtcgcacaaagttgcacaacgagagtaagaagactgcccctagacaggaggccatccccgacttggaggactccccccctgtgtcagactcagaggaacagcaggaatccgctagggctgttcctgaaaaatcaactgcgccactgctagatgttttcagctcgatgctgaaagataccacaagccagcaccgcgcccacctgtttgatcttaactgcaagatatgtactggacaggtgcccagcgctgaggacgaacccgccccgaagaaacagaagctctcagcttctgtgaagaaggaagatctgaagtcaaaacacgactcctcagcacctgatcctgctcctgactcagccgatgaggtgatgccagaagccgttcctgaggtggccagcgaacccgggctggagagtgcatcccacccaaacgtcgatcggacctatttccctggaccacctggagacggacacccagaaccgagccccctggaggatctctcaccatgccctgcaagttgtgggtccggtgtagtgactacagtgacggtgtctggccgggaccctcggactgccccctcctcctcttgcacggccgtggcctcagccgcatccaggccagacagcactcacatggtggaagcaaggcaggacgtgcctaagcccgtcctcacatccgtcatggtccctaagtctattctggccaagccctctagttcccctgacccgcggtacctctctgtacctccaagtcctaatatcagcacatctgagtctcggtccccacctgagggggatacaaccctgtttctctcccggttgtcaaccatctggaagggatttattaatatgcagtctgttgccaagttcgtgactaaggcctatcctgtgagcgggtgctttgattatttatcggaagatctccccgataccatccatatcggaggcagaatcgctcctaagacagtatgggattatgtgggaaagctgaagtcttccgtaagcaaggagttatgcctgataaggtttcatccagccactgaggaggaagaagtggcttacatctcactctacagttacttttcatccaggggtcgattcggcgtagttgccaacaataaccggcatgtcaaagatctgtatctcattcctctgagtgctcaggacccagtgccctccaagctcctccctttcgaaggccctggaaagcgccggctcagtggctggcggtag

SEQ ID NO: 15929 - DNA, 6723 bp, Artificial Sequence
  Description of Artificial Sequence: Synthetic coding sequence
atggatgacaagggtgatccttctaacgaggaagcgccgaaagccatcaagccaaccagcaaggaattccggaagacttggggctttagacggactacaatcgcaaagcgagagggcgcaggcgacgccgaggccgatcctctagaaccgcctcccccccaacagcagctcggtctctccctccgcagaagtggaagacagcccaaacgcaccgaacgcgtggaacagttcttgaccattgctcgtcgcagaggacgtagaagcatgccggtgagtctcgaggattctggggagccaaccagttgtcctgctaccgacgcagagaccgctagcgaaggctccgtcgaaagtgcatccgagacaagaagtggccctcagagtgcgtctaccgccgtgaaagaaagacctgcgagctccgaaaaggtgaagggcggggacgaccacgacgacacgtctgattccgactcggatgggctgactctgaaggaactgcagaatcggctgcgccggaagcgagagcaggaacccactgaaagacctctcaaagggattcagagcaggctgcgaaaaaaaaggcgcgaagagggacccgccgagacggtcgggtctgaagcctccgacactgtggagggcgtgctgccctccaagcaggagcccgaaaatgatcaaggcgtcgtttcccaggctggaaaagacgaccgagaaagtaagttagaaggcaaggctgcccaagatatcaaggacgaggagcctggggaccttgggcgacctaaaccagagtgtgaggggtacgaccccaacgctctctattgcatttgtaggcaaccccataacaatagattcatgatctgctgtgataggtgcgaggagtggtttcacggcgactgtgtgggaatctcagaggctaggggtcggctgttggagcggaacggagaagactacatctgcccgaattgcaccatactgcaggtgcaggacgagacacactctgaaacagcagaccagcaagaggcaaagtggaggcccggagatgctgatggtactgactgtaccagtatcggcactattgagcagaagtcgagtgaagatcagggaatcaagggaaggatcgagaaagccgctaacccatctggtaagaagaagctgaaaatatttcagcctgtgatcgaagcacccggggcaagcaagtgcattgggcctggttgctgtcatgttgctcagccagactccgtgtattgcagtaatgattgcattctgaaacatgccgcagccaccatgaaatttctatcttccggcaaagagcaaaagcccaaaccaaaggaaaagatgaaaatgaaacctgaaaaaccctccctgcctaaatgcggagcccaggccggtatcaagattagttctgtgcataagcggcccgctcctgaaaaaaaagaaactaccgttaagaaggccgtggtcgtcccggcccgaagcgaggcactgggaaaggaagccgcatgcgaatcctctaccccatcctgggcaagcgatcacaactacaacgcagtaaagcccgaaaagactgcagcgcccagccctagcctcctgtacaaaagcactaaagaggacagacggagtgaagaaaaggcggcagccatggccgcgtcaaagaagacagccccaccgggtagtgctgtggggaagcaaccggcaccccgaaatcttgtccctaaaaagtcgtctttcgccaatgttgcagccgcaactccagctataaagaaacctcctagcggcttcaaaggtaccatccccaagcgcccttggctgtcagcgacccccagcagtggtgcttccgccgcaaggcaggctggtcctgcaccagccgccgcaaccgccgcctctaaaaagttcccggggtcagctgccctggtcggcgctgtgcggaaacccgtagtcccgtctgtgccaatggcctcacctgcccctggccgcctcggggcaatgtctgctgctccaagtcagcctaacagtcagattcggcagaatattcgacgcagtctgaaagagattttatggaagcgggtcaatgattcagatgacctcataatgaccgagaatgaggtgggcaagattgcactgcacatcgagaaagagatgtttaatctgttccaggttacagataatagatataagagtaagtataggtccattatgtttaacctgaaggacccaaagaaccagggcctgtttcatcgcgtcttacgagaagagattagcttggctaagcttgttagactcaaacccgaggaactggtgtccaaagagttgagcacatggaaggagcgaccggcgaggagcgtgatggaatcaagaactaaactgcacaatgagtcaaaaaagaccgccccccggcaggaagctatccccgacctggaagattctcccccagtttctgactcagaggagcagcaggagtctgcaagagcagtacccgaaaaatccactgctcccctgctggatgtattctcgagcatgttgaaggatacaacgtctcagcacagggctcacttgtttgaccttaattgtaagatttgtacaggccaggttccaagcgctgaggacgagccagctcccaaaaagcaaaagctctctgcctctgtgaagaaggaggacctaaaaagcaagcacgattcaagtgcacctgaccctgctcccgattctgccgacgaagttatgcccgaggccgtccctgaagttgcctccgaacccgggctggaaagcgccagccaccccaatgtggatcgtacttatttccctggtcctcccggcgatgggcaccccgaacccagtcccttagaggatttgtctccttgcccagctagttgtggctccggggttgtcacgaccgtcaccgtgtctggccgcgatcctaggactgccccatcttctagttgcactgcagtggccagtgctgccagcagacctgacagtacccacatggtagaagctcgccaagacgtgcccaaacccgttctcaccagcgtgatggtgcctaaatcaatcctagccaaacctagctcaagcccagaccctcggtacctgtccgttccaccatctcccaacataagcacatctgagtcgcgatctcctcccgagggcgacaccaccttattcctgagtcggctctcgactatttggaaaggattcataaatatgcagagcgtggccaaatttgtgaccaaggcgtaccccgtgtccgggtgcttcgattatctcagcgaggatctgccagacaccatccacattgggggcagaatcgctcccaaaacagtgtgggactatgtcgggaaattaaaaagttctgtgagtaaggaactgtgcttgattcggtttcatcctgccactgaagaagaggaagtggcctacatcagcctttatagttatttctcatccagggggagatttggagtggtggccaacaataaccgccatgtcaaggatttgtatctgattcccctgagtgctcaggaccctgttccaagtaagttgctgccttttgaagggcccgggctcgaaagtccccgcccgaatataattttaggtctcgtaatttgtcaaaaaatcaaaagacccgcaaacagcggagaactcgataagatggatgaaaaaagaaccagactgcagccagaggaagccgacgtgccagcctaccccaaagttgcgactgtgccccagtccgagaagaaaccctcgaagtatcccctgtgttcagctgacgcagcagttagcacaactcccccaggctcaccacctccaccccccccgctcccagaaccgcctgtgctgaaggtcctgagctccctcaaaccagcagccccttctccagccacggcggcgacgaccgcggccgccgcctccaccgcagcctcatccaccgcaagctctgctagcaagacagccagtcccctggaacatattctgcaaactctctttggcaaaaaaaagtccttcgacccatccgctcgcgaacctccaggaagtaccgctgggttgccacaggagccaaaaaccactgccgaagatggcgttccagctcctcccctgcttgaccccatcgtgcagcagttcgggcagttctctaaagacaaagctctggaggaggaagaagacgatcggccttacgatccggaggaggagtatgatcccgaacgggcgttcgatactcaactggtggagaggggcaggcgacacgaggtggagagggctccagaagccgcggccgccgagagggaggaagtcgcgtatgatccagaggatgagaccatcttggaagaagcaaaggtaaccgtcgatgacctcccaaataggatgtgcgccgacgtacggcggaattccgtggaaagaccagccgagcctgtggctggtgccgcgaccccctctcttgtggaacagcaaaagatgttagaggagctgaacaagcagatcgaggaacagaaaaggcaactggaggagcaggaggaggccctccgccagcaacgggccgccgtgggagtcagtatggcccacttttcagtcagtgacgcacttatgagcccaccaccaaagtctagcttgcccaaggcagaattatttcaacaggaacagcaatccgcggacaaaccagcatctctgccccctgcttctcaagcaagtaaccatagggaccctcggcaggccagacgcctagctactgaaacaggagagggtgagggagaacccctgtcccgattatcagcccgcggcgcccagggtgccctgccagagcgggatgcatcacggggaggcctcgtggggcaggcccccatgccagtgccagaggaaaaagagcctgcttctagcccatgggcttccggagagaagcctcccgcaggttccgagcaggatggatggaaggccgaaccaggtgaaggcacacgtccagctacggtcggtgacagtagcgcgcgcccagccaggcgtgtcctgctgccaacccccccatgtggtgccttacaacctgggttccccctccaacatgacggggaaagggatcctttcacatgcccaggatttgccagtcaggacaaagcacttggcagcgcccagtacgaagacccacgcaacctgcacagtgcaggtcgaagttctagtcccgcgggagagaccgagggtgatcgagagccccaggcacggccaggagaggggaccgcccccttacctccacccggccagaaagtggggggctctcaaccgccttttcaagggcagcgagagcccgggccccatgcccttggtatgtcaggtctccatggccctaattttcccggaccccgaggaccagcgccaccatttccagaggaaaatatcgcgagtaacgatggaccgagaggaccacctccggccaggtttggagcacagaaaggcccaatccccagtctgttctcgggccaacatggacctcccccatatggcgatagcagaggcccctcacccagctacctcggggggccgcggggtgtcgcgcccagtcagtttgaagaaaggaaggaccctcacggcgaaaagcgggagttccaagatgctccctataacgaagtcactggagccccagcacagtttgaaggaacagagcaggctccattcctgggatcccggggtggagcccccttccagttcggtggccagaggagacccttgctgagccagcttaaaggacctcgcggcggcccccctccatctcagttcggcgggcagaggggccccccaccaggtcactttgtcggtcctagaggcccgcatcctagccaatttgaaactgctagagggccccacccgaaccagttcgaaggtcctcgaggccaggcgcccaactttatgcctggccctaggggaatccaacctcagcagtttgaagatcaaagggtgcactcgccaccacgattcaccaatcaacgtgcacccgcaccgttacagttcggcggcctgcgcgggagcgccccatttagtgaaaaaaacgaacagaccccttcgaggttccattttcagggacaagctcctcaggtgatgaaacccggcccccggcccctgctggaactgccgagtcatcctcctcagcaccggaaagatcgatgggaggaggccgggccaccttcggccctgagctcatccgctccaggccagggccccgaagccgacggacagtgggccagtgcggacttccgggagggaaaaggccatgagtatcgcaaccagactttcgagggacgccagcgcgagcgcttcgatgttggaccgaaggagaaaccactggaggaacctgacgcccagggtagagcatcagaggacaggcggcgcgagcgggaaaggggccgcaactggagccgcgaacgagattgggacaggccacgcgaatgggaccgccatcgggacaaggattcctctcgcgattgggaccgcaatagagaacgctctgccaatagggatagagaacgcgaggccgacagaggcaaggaatgggatagatccagagaaagatccagaaacagagagcgcgaacgcgatcgcaggcgagatcgcgacagaagccggtcacgcgagagggatcgcgataaggctcgagatcgagaaaggggacgagatagaaaagaccggtcaaagtctaaggagtctgcgagggatccgaaacccgaggcctcccgggcaagcgacgcagggaccgctagccaggcctag

SEQ ID NO: 15930 - DNA, 888 bp, Artificial Sequence
  Description of Artificial Sequence: Synthetic coding sequence
atggaattaatccaggacaccagccgcccccccctggaatacgtaaaaggggtgcccctgattaaatattttgctgaggccttaggccccctccagtcttttcaggctcggcctgatgacttactaataaacacttatccaaagtctggtactacttgggtgtcacagatactggacatgatttaccagggtggtgatctggagaaatgtaacagggcacctatttatgtgagagtgccctttctagaggtgaacgatccgggcgaaccgagcggtctggaaaccctgaaggatactcctccccccagactaatcaaaagccatctcccattagcgctgctgccacagacactgctggaccaaaaggttaaggtagtgtatgtggctcggaatcctaaggacgtggccgtgagctattaccattttcacaggatggagaaagctcatcccgaacccggtacctgggatagcttcttggagaaatttatggcgggcgaagtgagctatgggagttggtaccagcatgtacaggaatggtgggaactttctcgcactcatcccgtcctctacctcttttacgaagatatgaaagaaaaccctaagagggaaattcagaaaattctagagtttgtggggcgctcactgcccgaggaaaccatggatttcatggttcagcacacgagctttaaagaaatgaagaaaaacccaatgacaaattacaccaccgtcccccaggagctgatggaccacagcataagtccgtttatgcggaaggggatggccggggactggaaaaccacattcacagttgcccaaaacgaaaggtttgatgctgattatgccgaaaagatggccggatgtagcctctccttccgatctgagttgtag

SEQ ID NO: 15931 - DNA, 834 bp, Artificial Sequence
  Description of Artificial Sequence: Synthetic coding sequence
atggaggccgccgagacagaggcagaagcagccgccttagaggtgctagcggaagttgccggcattctggaacctgttggccttcaagaggaggcagagctgcctgccaaaattctcgtagagttcgtcgtggatagtcagaagaaggataaactgctgtgttcgcagcttcaggtcgcagattttttgcagaacattctcgctcaggaagatacagcaaagggcttagatcctctcgccagtgaggacacttctcgccagaaagcgatcgccgctaaagagcaatggaaagaactgaaagcaacttatcgcgagcacgttgaggctatcaagatcgggctcacgaaagctttaacccagatggaagaagcccagcggaaacgcacacagctgcgggaggcattcgagcagctgcaggccaaaaaacaaatggccatggagaaacgtagagcggtgcagaatcagtggcagctgcagcaggaaaaacatctacagcatctggccgaagtgtcagccgaggtgcgtgagcgaaagactggcacacaacaggagctggatagagtgtttcagaagctgggaaatctgaagcagcaggcagaacaggaaagggacaaactgcaaaggtatcagaccttcctgcaactcctgtatactctgcaagggaagctcctgttcccagaggccgaggcagaggctgaaaatctccccgatgacaagcctcagcaacccacccgcccccaggagcagagcacgggagatactatgggccgggaccccggagtgtcatttaaggccgtcggcctccagccagctggagacgtgaacctgccctag

SEQ ID NO: 15932 - DNA, 1245 bp, Artificial Sequence
  Description of Artificial Sequence: Synthetic coding sequence
atgggaactgtaaccgaagacttgatccgcaggaacgccgagcacaacgactgtgtcatctttagtttggaggagctcagccttcaccagcaagagatcgaaaggctggagcacattgacaaatggtgcagagatctcaaaattctgtatctgcagaacaacctcatcggaaagattgagaatgtgtccaagcttaaaaaactggagtatctcaatctcgccttaaataatatcgaaaaaatcgagaatctcgagggttgtgaggaactggctaaactggacttgacggtgaatttcataggtgaactgagcagcattaaaaacctccagcacaatattcacttgaaagaattatttctgatgggaaatccttgcgcgtcattcgatcactatagggagttcgtagtggcaactctgcctcaactcaaatggcttgacgggaaagaaatcgaaccatctgagagaatcaaggcgcttcaggactacagcgtgatcgagcctcagattagggagcaggaaaaagatcattgcctcaaacgggcgaaattaaaggaagaggcccagaggaagcatcaggaggaggacaaaaacgaagacaagagaagtaacgcgggcttcgacggccggtggtatacggatattaacgccactctctcttcattggagagcaaagatcatctacaggctcccgatacagaggaacataatactaagaaacttgacaacagcgaggacgacctggagttctggaataagccctgcctgtttactcctgagagccggttagaaaccctgcggcacatggaaaagcagagaaagaagcaggaaaagctaagcgaaaaaaaaaaaaaagttaaacctccccgtacgctgattacggaggatggcaaggccttaaacgtgaatgaacctaagatcgatttttccctaaaggataacgagaagcagatcattctggacctcgctgtctatcgatatatggatacatccctcattgatgtggacgtgcagccaacctacgtccgggtcatgattaagggtaagccttttcagttggttcttcctgcagaggtgaagcccgattcaagcagcgcgaagcgcagccagactactggacatctggttatttgcatgccgaaagtgggcgaggtgattactggcggtcagcgcgcctttaaatctatgaagaccacatctgaccgctcacgtgagcagactaatacctcttattctaccggattttag

SEQ ID NO: 15933 - DNA, 2529 bp, Artificial Sequence
  Description of Artificial Sequence: Synthetic coding sequence
atgtctagtagccattttgcgtctaggcaccgcaaagacattagcactgagatgattaggacaaagatagcacaccgcaagagcttgtcacaaaaagagaaccgccacaaagagtacgaacggaatcgccactttggcctgaaagatgttaacatcccaacacttgaaggaaggatcttggtggagctcgatgagacatctcagggactcgtgcctgagaaaacaaatgttaaacctcgagctatgaagactatcctgggtgaccaacgaaaacagatgctccagaagtacaaagaggaaaagcagctccagaaactgaaagaacagcgggagaaggccaagagaggcattttcaaagtcggacgctaccgccccgatatgccctgtttcctgctctcgaatcaaaacgcagtgaaggccgaacctaagaaagctataccatcatccgtgcgcatcacccgctcaaaggcgaaagaccagatggagcagactaaaattgataacgagagcgatgtgcgggctatccggcccggaccgcggcagacctccgagaaaaaggtctccgataaagaaaagaaggtggtgcagcccgtaatgcccacatcactgaggatgacacgaagtgccacccaggctgctaagcaggtcccccgcaccgtgtcctcaaccacggccaggaagccagtgacgcgcgccgcgaatgaaaacgaacctgaggggaaggtccccagcaagggtagaccagccaaaaatgtagaaacgaagccggataagggcatctcgtgcaaagtggatagcgaagaaaatacactcaatagccagactaacgcgacatcaggtatgaatccggacggtgtgttgtccaagatggagaacctgcccgaaatcaacactgcaaaaatcaaggggaagaacagtttcgcccccaaagactttatgttccagcccttggacggcttaaaaacgtaccaggtaacccctatgactccaaggtcagctaatgccttcctgacaccaagctatacatggacaccattaaagaccgaggtggacgagagccaggctacgaaggaaattttagctcagaagtgtaagacctactctactaagacaattcagcaagattcgaacaaactgccctgtccacttggacccctgaccgtttggcatgaggagcatgtcctcaataagaatgaggccactacaaaaaatctgaatggcctgcccattaaagaagtgccttcactggaacgcaatgaggggagaatcgcacagcctcatcatggcgttccatacttccgcaatatcctgcagtccgagacagagaagttgacaagccactgctttgagtgggatagaaaattagagctggatatccccgacgatgccaaggacttgatcagaaccgccgtagggcagaccaggctgctgatgaaagagcgcttcaagcagtttgagggtctggttgacgactgcgagtacaaacgggggatcaaggagaccacatgcacagatctcgatggcttctgggacatggtgagctttcagatcgaagatgtcatacataagttcaacaacttaatcaagcttgaagaaagtggatggcaggtgaacaacaacatgaatcacaacatgaacaagaacgtgttcaggaaaaaagtggtatctggtatcgcctcaaaacccaagcaggatgacgcagggaggattgccgcccgcaaccgcctggccgctatcaagaacgccatgcgggaacggatcaggcaggaggaatgcgcggaaaccgccgtctccgtgattccaaaggaggtcgacaagatcgtgtttgatgccgggttctttcgggtcgaatcaccagtgaaattgttttccggattgtccgtgagctccgagggcccatcgcagcgccttggaacccctaaatcagtaaacaaagctgtttcccagagccgcaacgaaatggggattcctcagcagaccacctcccctgaaaacgcaggaccgcagaacaccaagtctgaacacgtcaagaagactctattcttgagcatcccagaatcgcgctctagtatagaggacgctcagtgtcctggcttgccagacctaatcgaggagaaccacgttgttaacaaaactgatctgaaggtagattgcctgtcatccgagcgcatgtcactgcccctcttagcaggaggggtggcggatgacatcaatactaacaagaaggagggaatctcagatgtggtcgagggaatggaactgaacagttccattacgagccaagacgtgcttatgagttctcctgagaagaacactgccagccagaactccatccttgaggaaggagaaacaaagatcagccaatctgagctttttgataataagtctctcacaacagagtgtcacctccttgattctgtcgggagctgttacgttgccagagctggactggaagtactggggtcctcagatcccacgacgagtgccagtagagtcgctgggaccacggcccgttcaaaactacagtag

SEQ ID NO: 15934 - DNA, 1710 bp, Artificial Sequence
  Description of Artificial Sequence: Synthetic coding sequence
atgttgtgctcgccctcgttctgcaaattgtgctggaagcggcagagagaaaacgggcagagaaagtacggcgggccccccccagggtgggacgctgccccacccgagcgcggttgtgaaatcttcattgggaaattgccaagagatctgtttgaagacgaacttatcccgctttgtgaaaaaattggaaagatctatgagatgcggatgatgatggatttcaacggaaacaatcgcggctacgccttcgttaccttctcgaacaaggttgaagccaaaaatgccataaaacagctgaataactatgagattaggaatggtagactgctgggggtgtgcgccagtgtggataactgtcgtctgttcgtcggcggcatcccgaagactaagaaacgcgaagagatcctcagcgagatgaagaaagtgacagagggagtggttgatgtgatcgtttatccgtctgcagcggataagacgaaaaacagaggttttgcctttgtcgaatatgaatcgcacagagcggctgcaatggctcgccggaagctcctgcctggccggatccagctgtgggggcatggtatcgcggtggactgggccgagccagaagtcgaagttgacgaggacactatgtcctctgtaaaaatactgtatgtgcgtaatcttatgctaagcaccagtgaagagatgatcgagaaggaatttaacaacatcaaaccgggtgccgtggagagggtaaagaaaattagggactacgcttttgtgcatttcagtaaccgagaggatgccgtggaagctatgaaggccttaaatggaaaggtgctggacggctcacccattgaggtaacactggccaagcctgtggataaggactcatatgtgaggtacaccaggggaactggcggacggggaaccatgctgcagggcgaatacacctacagcctcggccaggtctacgatccgactacaacctatttgggcgcccccgtgttttacgcacctcagacctacgctgcaatccctagcttgcactttccagccacgaagggtcacctgagtaatcgggcaatcatccgggccccatcggttaggggggccgccggcgtgcgcggtctgggaggacgcggttacctggcatatactggtctcggccgaggctaccaggtgaaaggggacaaacgagaagacaagctctatgacattctgcctggcatggaactgacacctatgaaccccgtcacactcaagccccagggcattaagctggcacctcaaatacttgaggaaatctgtcagaaaaataactgggggcaacccgtataccaattgcattccgctatagggcaagaccagcgacaacttttcctgtacaagatcaccattccagctctcgctagtcagaatcctgcaatccacccctttacacctcctaagctcagcgccttcgtggacgaggctaagacctacgccgccgagtacacacttcagaccttgggcataccaactgatggaggggatggcaccatggccacggccgctgctgccgctacagcctttcctggatacgccgttccgaacgcaacagcccctgtgagcgcagctcagctgaaacaggccgtaactttaggccaggacctcgctgcctataccacctatgaagtttatcccacattcgccgtgaccgcccgtggagacgggtacggcaccttctag

SEQ ID NO: 15935 - DNA, 1764 bp, Artificial Sequence
  Description of Artificial Sequence: Synthetic coding sequence
atgtcaactgctatccccgggctcaagaaggggaataacgccctgcagtccatcatcctccaaacccttttagagaaggagaacggacagcgaaagtatggaggtcccccacccggctgggacgctgcaccacctgaacggggatgcgaaattttcataggcaaactcccccgggacctgttcgaggacgagctcattccgctgtgcgaaaaaatcggaaagatctatgaaatgcgtatgatgatggattttaacggtaacaataggggctacgccttcgtgacgtttagcaataaggttgaagccaagaacgctatcaaacagttgaataactacgagatccggaacggcaggctcctcggtgtttgcgccagcgtggataactgccgcctgtttgtgggtgggattccaaagacaaagaagcgcgaggagatactgtctgagatgaaaaaggtgaccgagggggtggttgacgttattgtttacccttcagctgctgacaaaacaaagaaccgtgggttcgcgtttgtcgagtacgaaagccaccgtgccgccgcaatggccagacggaaattgttaccgggccggatccagctttggggtcacgggattgccgtcgattgggcggagcccgaggtggaagtggacgaggataccatgagttcagtgaagatcctatatgtgcgtaatctcatgttaagtacatcagaagagatgattgaaaaggaattcaataatatcaaaccgggcgccgttgaacgagtaaagaaaatcagagattacgccttcgtgcacttttctaacagagaagacgcggtggaagcgatgaaggcattaaacgggaaggtgctggacgggtccccaatcgaggtcaccctggccaagcccgtcgataaggattcgtacgtgcgctatactcgcggaacaggtggaaggggaaccatgctgcaaggagaatacacctattctctcggccaggtctacgaccccactactacctacctgggcgcccctgtcttttacgctccccaaacttatgctgcgattccttcactccacttccctgcaactaaaggtcatttgtcaaaccgtgcaatcattcgcgcccccagtgtgagagagatctatatgaacgtacctgtgggagccgcaggcgtacgaggactgggaggccgaggatatctagcttacaccggacttggcagaggctatcaggttaaaggcgacaagcgagaggacaagctgtatgatattcttccaggcatggaattgactccaatgaaccctgttaccctcaaaccccagggaataaagctggcccctcagattctggaagaaatctgtcagaaaaataactgggggcagcctgtctaccagctgcatagtgctatcggtcaggatcaacggcaactctttttgtataaaattaccattccagccttggcctcccagaaccctgcgattcaccctttcactcccccaaagctctctgcctttgtcgacgaagctaagacgtacgccgcagaatacacgctgcaaactctagggatcccaaccgacggtggagacgggacaatggcaacagccgccgccgcggccacagcgttccctggctacgcagtgcctaacgcgactgctccagtttctgcggctcagcttaaacaggccgtgacactggggcaagaccttgcggcttataccacatacgaggtctatcctacattcgcagttaccgctagaggcgacgggtacggcacgttctag

SEQ ID NO: 15936 - DNA, 1620 bp, Artificial Sequence
  Description of Artificial Sequence: Synthetic coding sequence
atggaaagcaatcacaagagtggggatggtctgtctggaacacaaaaggaagcagcactcagagcactcgtgcagcgcacagggtacagcttggtacaggaaaatggccagcggaagtacggggggccccctcccggatgggacgcggccccccccgaaagaggctgcgaaatcttcatcggcaagctccctagagacttgttcgaagatgaactgatccccctgtgcgagaagattggcaaaatctacgagatgcgaatgatgatggacttcaacggcaacaatcgtgggtacgcattcgttaccttctctaacaaggtggaggccaaaaacgctattaagcagcttaacaactatgaaatcaggaacgggcggctgcttggagtgtgtgcaagtgttgataattgtcgactcttcgttggtggcatcccaaaaacgaaaaaacgtgaggagatcctaagtgaaatgaaaaaggtaactgagggcgtggtcgatgtgatcgtctatccaagcgcggcagacaaaactaagaacagaggcttcgccttcgtggagtacgaatcacaccgggctgctgctatggccaggcggaagttgctgcctggcgcggtagagagggtgaagaaaatcagggattatgcctttgtgcatttcagcaacagggaggatgccgtggaagctatgaaggctttgaatgggaaggttctggacggcagccctattgaagtgaccctggccaagcccgtcgacaaagattcctatgtgcgatacacccgcggaaccggcggcaggggcaccatgcttcagggagaatatacctacagtcttgggcaggtttacgatcctaccactacataccttggggcccccgtgttttacgcgccacagacttatgctgcaatcccatcactgcattttccagccacgaagggccatctctccaaccgcgccataatccgagctcctagcgttcgggaaatctacatgaatgtgccagtgggcgcagcaggggttcgcggactcgggggccgtggatatctggcatacactggcttgggtaggggctatcaggtgaagggcgataaacgggaggataagctctatgacattctgccaggtatggaattaacccccatgaacccagtgacattaaagcctcaggggatcaaactggctccacagattctggaggagatttgccagaaaaacaattggggccaaccagtgtatcagttgcacagcgctatcggacaagaccagcggcagctcttcctgtataaaattacaatccctgcgctagcgtcccaaaaccctgcgattcatcctttcaccccacccaagctcagcgcatttgtagatgaggccaagacttacgccgccgagtatacactgcagaccctaggcattcctaccgatggcggagatggaaccatggctacagctgctgctgctgctactgcattcccgggctatgctgtcccaaacgcaaccgccccagtctcagcagcccagctcaagcaggccgtgactttgggccaggacttggccgcatatacaacgtacgaggtatatcctaccttcgccgttacagctcgcggcgatggctatgggactttttag

SEQ ID NO: 15937 - DNA, 1044 bp, Artificial Sequence
  Description of Artificial Sequence: Synthetic coding sequence
ttttcgctcttccctgcagtcgacaacgaggaagccgcccttttgcatgaagaggctaccatgaccatagaggaattactgacaagatacggtcaaaattgccacaaaggcccaccccatagcaagtccggcgcctctgataagctgccgcgcgtcgctaagtctaagttctttgaagactcagaggatgaaagcgacgaggccgaagaggaggaggaggactctgaggaatgctctgaagaggaggacggctatagtagcgaggaggcagaaaatgaggaagatgaggacgacaccgaggaagcagaagaggatgacgaagaggaggaggaggagatgatggtaccaggtatggagggcaaagaggaaccaggatctgattccggaactaccgcagttgtggcccttatcagaggcaaacagctgatagtggcaaacgctggggacagccgttgcgtggttagcgaggctgggaaggctctcgatatgtcgtacgaccacaaacctgaggacgaggtagagcttgcccggattaaaaatgccggcggcaaagtcaccatggacggcagggtgaacggtggcctcaatctcagcagggcaatcggggaccacttctacaaacgcaataaaaatctgccacccgaagaacagatgattagtgccctcccagatatcaaggttctcactcttacggacgatcatgaattcatggtgattgcgtgtgacggcatctggaacgttatgtcttcccaggaagtcgtagacttcatccagagcaaaatctcccagagggatgagaatggcgaacttaggctgctgagtagcatagttgaagagctcctggaccagtgtctggctccggatacctctggggatggaactggttgcgacaatatgacttgcattatcatctgcttcaaacctcggaacaccgccgagcttcagcccgagtcgggaaaaaggaaattagaagaggttctgtccaccgaaggcgccgaggagaacggaaatagtgacaagaaaaaaaaggctaaacgagactag

SEQ ID NO: 15938 - DNA, 1218 bp, Artificial Sequence
  Description of Artificial Sequence: Synthetic coding sequence
atggagacggatctgaacagtcaagacaggaaagacctcgataagtttattaaattctttgccctgaaaactgtgcaggtgatcgttcaggcccgactgggcgagaaaatttgtacgcgctccagctcttctcccacggggtcagactggttcaacctggcgattaaggacattcctgaggtgacccacgaggccaagaaggcgctagcgggccaactacccgctgtagggcgcagtatgtgcgtggagatcagcctgaagacctccgagggcgattctatggagctcgagatctggtgtctggagatgaatgagaaatgtgataaagaaatcaaagtgtcatacaccgtgtacaatcgactgagcctgctgctgaaatctctgctggctatcacgcgcgttactccagcataccggctctctcgcaagcagggacatgaatatgtgatcctgtatagaatttactttggcgaggtgcagttatccgggttgggcgagggatttcagactgtgagagtagggactgtgggaacccctgtcggcactataacacttagttgtgcctacaggatcaacttagcatttatgagcacgcgacagttcgagcggacccccccaataatgggtataataattgaccactttgtcgatcgcccttacccatcttctagtccaatgcatccatgtaactataggaccgctggcgaggatacgggagtgatctacccatccgtggaagacagccaagaggtgtgtacaacgtctttttcaacctctccaccgagccaactcatggttcctggcaaggagggcggtgtgccactcgccccgaaccagcccgtgcacggaacgcaggccgaccaggagcggctagccacatgtacaccctccgacagaacccactgcgcggccaccccctcatcctctgaggatacagagactgtatccaactcttccgaaggccgggctagtccccatgatgttctggaaacgatcttcgtcagaaaagtcggagcttttgttaacaaacccatcaaccaggtaaccctcacatctctcgatattcccttcgctatgttcgccccaaaaaatctcgaactggaggacacagatcctatggtcaatccccctgatagtcctgagaccgagtctccgctccagggtagccttccatgtagttggcccctaccttgtctgttgagccctagcacagtgtag

SEQ ID NO: 15939 - DNA, 2025 bp, Artificial Sequence
  Description of Artificial Sequence: Synthetic coding sequence
atgcagacttctagctctagatccgtgcacttatccgagtggcagaagaactacttcgctattacttcaggcatttgtacgggtcctaaagctgacgcatacagggcccagatattgcgcatccagtatgcctgggccaatagtgaaattagccaggtgtgtgctacgaaactatttaaaaagtatgctgaaaaatactccgccatcatagatagcgacaatgtggagtctggcctgaacaactatgcagagaacatcctgacacttgccgggagtcaacagaccgacagcgataagtggcagtctgggttgagtatcaataatgtcttcaagatgtctagcgtgcagaagatgatgcaggctggcaaaaagtttaaagattcccttctcgaacccgccttggcgagtgtagtgatacataaggaagcaacagtgtttgatctgcccaaattctctgtgtgtggcagcagccaggagagcgacagcctccctaactcagctcacgaccgcgaccgcacccaggatttcccagaatctaacaggctcaagctattacagaacgcccagcctcccatggtcacaaatacagctaggacatgtcctactttctcagcacccgtaggagagagcgcgaccgccaaatttcacgtgacccccctgttcgggaacgtgaagaaggagaaccacagctcggctaaggagaacattggtttaaatgtatttctgagtaatcagtcctgttttcctgctgcatgtgagaatcctcagcgtaagtcattttacggctctggtactatcgacgctttgagcaaccctatcttgaacaaggcgtgttcaaagactgaagataatgggcctaaggaagacagctctcttccaacatttaaaactgctaaagagcagctttgggtggaccagcagaaaaaatatcaccagccacaacgggcttctggatcctcctatggcggagttaagaagtccctgggagctagccgcagtcgcggaattctcggaaaattcgtccctcccattcccaaacaggacgggggcgagcagaatggcggtatgcagtgcaaaccctacggggccggtccgacagagcctgcacacccagttgacgaaaggttgaagaacttagaacccaagatgatcgagttgatcatgaatgagatcatggatcatggccctcctgtgaactgggaggatatcgccggggtagaatttgccaaggctacaatcaaagagattgtggtatggccaatgttaagacctgacatctttactggccttagggggccacccaagggaatcctgctattcggacctcccggtactggcaagaccctcataggtaagtgtatcgcctcccaatctggcgctacatttttctctatctctgccagctcattgacatctaagtgggtcggggaaggggagaaaatggtccgcgctctgtttgctgtggccaggtgccagcagccagccgtgatttttattgatgagatcgactccctgctgtcacagcggggtgacggtgagcatgagtcatctcgtagaatcaaaacagagttcctggttcaacttgacggcgccacgacctcctcagaggataggattctagtggtgggtgccaccaatcgcccccaagagattgatgaggctgcacgacgccggcttgtgaaaagattatacatccccctcccggaagcttcagcacggaagcagattgtcattaatcttatgtcaaaagagcaatgctgcctgtccgaggaagagatcgaacagatcgtgcagcagagtgacgccttctccggggctgatatgacccagctgtgtcgggaggctagtctgggaccgatccgcagcctacaaactgccgacatcgctacgattacccctgaccaggtgcggccgatagcctatatcgactttgaaaacgcattccggacagtcaggccttccgtgtcacccaaagatctcgagttgtacgaaaactggaacaagactttcggttgtgggaagtag

SEQ ID NO: 15940 - DNA, 2640 bp, Artificial Sequence
  Description of Artificial Sequence: Synthetic coding sequence
atgaactacccaggtaggggcagccctagatctccagaacacaatggacgggggggaggcggtggggcatgggaactggggtcagacgcccggcctgctttcggaggtggagtgtgctgctttgagcacttaccaggcggcgaccccgatgatggagacgtgccactcgccctgctacgaggtgagcctggactccatttagcgcccggcactgatgaccataaccatcacctcgcactggatccttgcctgtcggatgaaaattatgatttctcctctgcggagtcaggcagctccctccgatactatagtgaaggtgagtcaggtggtgggggaagttctttgagtctgcatccaccccagcagccacccttagtacctaccaactccgggggtggcggagctacagggggttctcccggcgaaagaaagaggacacggctgggcggtccagccgctaggcaccgatacgaagtggtgacagagcttggacctgaagaagtgaggtggttttacaaagaagataagaagacatggaaaccctttattgggtacgactccctcaggattgaactggcttttcggaccctccttcagacaacgggcgcaagacctcagggtggtgatagagacggagaccatgtttgtagccccaccggccccgctagctctagcggggaggacgatgatgaggacagagcttgcggcttttgtcagtcaactacaggtcacgagcccgagatggttgaactcgtcaacattgagcctgtgtgtgtgaggggaggtctctatgaagtcgacgtcacccagggagagtgttatcccgtgtattggaatcaggctgataaaatacctgttatgagagggcagtggtttattgatgggacctggcaaccattggaagaagaggagtctaatctgatcgaacaggaacatctgaactgtttccgcggccagcaaatgcaagagaacttcgacattgaggtttctaagtccatcgacgggaaggatggttcaggcatcaactacagcgccgtacatagttttaaactatctagaaaccatgtggattggcacagtgtggacgaagtttacttgtacagtgacgcaaccacaagtaagatcgctcgcaccgttactcagaaattgggattcagcaaggcttcctcaagcgggaccagactgcatcgcggctatgtggaagaggcaactctcgaagacaagccttcccaaactacccatatcgtgttcgtggttcacggtatcgggcaaaaaatggaccagggtcggatcattaaaaatacggccatgatgcgtgaggccgcccgtaagatagaggaaaggcacttctctaaccacgctacacatgtcgaatttttgccggtggagtggaggtccaagttaacacttgacggagacacagtggattccatcaccccggataaggttcgaggactgcgggatatgctgaatagtagtgcaatggacattatgtactatacatctcctttatatcgggatgagttagtcaaggggttgcaacaggagcttaatcgcctttatagccttttttgttcgagaaatcccgacttcgaggagaaaggtgggaaagtgagtatcgtttctcactcactgggatgtgtgattacttacgacatcatgaccggatggaatccggtcagactctatgagcaactcctccaaaaagaggaggaactgcccgatgaacggtggatgtcctatgaagaaaggcatttgctggatgagctctacattaccaagaggaggctgaaagagatagaggagaggctgcatggcctaaaggcatcttccatgacccagacaccggcgctgaagtttaaggttgagaatttcttctgtatgggctccccgctggccgttttcctggctcttcggggtatccgcccgggcaacaccggctcccaggaccatattctgcccagagaaatctgtaacaggctgttgaatatattccatcccactgatcccgtggcctatcggcttgagcccctgattctaaaacactactctaatatctctccggttcagattcattggtacaacacatcgaatccgctgccatatgagcacatgaagccctcctttctgaatccggctaaggagccgacctccgtctcagaaaacgaagggatctctaccatccctagtcctgtgacctctccagtgctgtcacgccgccactacggcgaatccatcacaaacatcggtaaggcaagcatactaggggccgccagcattggcaagggacttggtggaatgctattctcccgcttcgggcgcagctccacaacccagtccagtgaaacgtccaaagatagcatggaagacgagaaaaagccagtggcctccccatctgctacaactgtcgggacccagaccttgccccactcctcctcgggcttcctggacagcgctttggagctggaccatcggatcgacttcgagttgcgcgagggcctggtggagtcacggtactggtcggctgtgacctcccacaccgcatattggagcagtctggatgtggccctatttctactgacttttatgtataaacacgagcatgatgatgatgccaagcccaatctcgaccccatctag

SEQ ID NO: 15941 - DNA, 2316 bp, Artificial Sequence
  Description of Artificial Sequence: Synthetic coding sequence
atgaactaccccggtagaggctcgcccagatcccctgagcacaacggtagggggggagggggtggcgcatgggagctagggtctgatgccagacccgcattcgggggcggagtttgttgcttcgaacatttaccgggtggggaccccgatgacggagacgtgcccttggctttgctccggggagagcctggactccacctagcaccaggcaccgatgaccacaaccatcatctcgctctcgatccctgtctcagcgatgaaaactacgacttttcatcagccgaaagcggctccagccttcggtactattccgaaggagaatcaggcggcggtggttcatctctcagtttgcatccacctcagcagccacctctggtgccaactaacagtggagggggcctctatgaagtagacgtaacgcagggagagtgctaccccgtgtattggaaccaggcagataaaatccctgtgatgagagggcagtggttcatcgatgggacttggcagccattagaagaggaggaatctaacttaatcgagcaggaacatttgaattgttttcgaggacagcagatgcaagaaaacttcgatattgaagtctcgaaatccatcgatgggaaggatgccgtccatagttttaaactgtccaggaaccatgtcgattggcactcagtcgatgaagtgtacctctatagcgacgccacgacttccaaaattgcaagaacagttacccagaagttaggctttagtaaagcatcatcgagcggaacacgtctccataggggatatgtagaagaagctaccttggaagacaagccaagccagaccacccacatcgtgtttgtcgttcatggtattggacagaaaatggatcaggggagaatcatcaagaacacagccatgatgagagaggctgcacgcaagatcgaggaaaggcattttagtaatcatgctacacatgtcgagttccttcccgtggagtggcgctcaaagttaacccttgacggggacactgtagatagtataaccccagataaggtgcgcgggctacgcgacatgctgaactcttccgcgatggatattatgtactatacttcaccactttatcgagacgaactcgtgaagggcctgcagcaggaacttaatagactctactcattgttttgttccaggaatcctgactttgaagagaagggaggcaaggtctctatcgtttctcacagcttggggtgcgtaattacatatgatattatgaccggatggaaccccgtgcggttatacgagcaattgctgcaaaaggaagaggagcttcccgacgagcggtggatgagttacgaggagcgccatttactagacgagctgtatatcacaaagagaagactgaaagagatcgaggagagactgcacggtctgaaagcatcgtcaatgacgcagacccccgctttgaaatttaaagtcgaaaatttcttctgtatgggctccccccttgctgttttcctcgcattgcgcggcatacggcctggtaacactgggtcgcaggaccacatcttgccaagagagatctgcaataggcttctcaatatcttccacccaaccgaccctgtggcatacaggttagagccactcatcttgaagcattacagcaacatctctccagtacagatccactggtataacaccagcaacccgctaccatacgaacacatgaaaccttcgtttctcaaccctgccaaagaacctaccagtgtcagcgaaaacgagggaattagcacaataccttctccggtgacaagcccagtactgtcccgacgacattacggagaatccataaccaacatcggcaaggcttcgatcctgggggccgccagtataggtaaaggcctggggggtatgctgttttcacgatttggcaggtcttccacaacccagagcagcgagactagcaaagattcaatggaagatgaaaagaagcccgtggcatctcctagtgccactacggtgggtactcagacactcccacacagtagctcagggttcctggactctgcctattttcggctgcaggagtctttttttaacttgccccagctcctcttcccggaaaacgtaatgcagaataaggacaatgctctcgtggaactggatcatagaattgattttgaactgcgggagggtctcgtcgaaagccgctactggtccgcagttacgtcccacacggcctactggagctccctggacgtagcgttgttcttgttaacctttatgtacaagcacgagcacgacgatgatgcgaaaccaaatctggaccctatttag

SEQ ID NO: 15942 - DNA, 1179 bp, Artificial Sequence
  Description of Artificial Sequence: Synthetic coding sequence
atgggcacgacatgcctccacctgggcaccctagagcagtcactcgtctttgagaacaaagtcaactcagagaaagtcaaattgtccttgcgaaattttccccacaatgattatgaagacgtgtttgaagaaccaagcgaatcgggatcggatccaagcatgtggaccgcacgagggccatttagaagagacaggtggtccagtgaggacgaggaagccgctggaccgagccaagccctgagtcccttactgtctgacaccaggaaaatcgtgagcgagggggagctcgaccaacttgcgcaaatcaggccgctgatattcaacttccatgagcagaccgctattaaggactgccttaagatcctcgaggagaaaaccgccgcatacgatattatgcaagagttcatggccttagagttgaaaaacctccctggggaatttaatagtggcaaccagcccagcaatagagagaagaaccgctaccgtgacattttgccatacgatagcacccgcgtgccactgggaaagagtaaagattacataaacgcatcctacatacgcattgttaattgtggtgaggaatatttttacatcgcaacacagggccccctgcttagcacaatcgatgatttctggcagatggtgctcgagaataactccaatgtaattgccatgatcacacgagagatagaaggtggtatcatcaagtgttatcactactggccgatcagccttaaaaagccactagaactgaagcactttcgcgtgtttttggaaaactatcagatactgcagtattttattatccgcatgtttcaggtggtggaaaagagtaccggcacttctcactcagtgaaacaactgcagttcacgaagtggcccgatcatgggacacccgcgagcgcggactcctttatcaagtacattcggtacgctcgcaagtcccatttgacaggacccatggtggtccactgtagcgccggaatcggccgtaccggagtcttcctgtgcgttgacgtggtgttttgtgcgatagtgaaaaattgtagctttaatattatggatatagtggcccagatgagagaacagaggtctggaatggtgcagactaaagagcagtatcacttctgttacgatatcgtcctggaagtgctgaggaaattgctgacattggattag

SEQ ID NO: 15943 - DNA, 621 bp, Artificial Sequence
  Description of Artificial Sequence: Synthetic coding sequence
atgtcaagccctagggattttcgcgcggaacccgtgaacgattatgaaggcaatgactccgaagccgaggatttaaatttccgcgagacactccccagctccagtcaggagaatacaccacgaagcaaggtgttcgaaaataaagttaacagtgagaaggtgaagttgagtctccgtaatttcccccacaatgactacgaggatgttttcgaagagcctagcgaatctgggagcgaccctagcatgtggacagctcgcggtccatttcgcagggataggtggtcgagcgaggatgaagaggcggctggcccctctcaagcactgtcaccgttgctgtcagataccaggaagatcgtcagcgagggcgaactggaccagctagctcagattagaccacttatattcaacttccacgagcaaactgctatcaaggactgcctgaagatcctggaggaaaaaactgccgcctatgacatcatgcaggagtttatgttcaacataatggacatagttgcgcagatgagagagcagagatctggaatggtacagaccaaagagcaatatcatttctgctatgacatcgtgctggaggtgctgaggaagctcttgacactggactag

SEQ ID NO: 15944 - DNA, 438 bp, Artificial Sequence
  Description of Artificial Sequence: Synthetic coding sequence
atgtggaccgcccggggaccctttcgccgcgacaggtggagctcggaagacgaggaggccgctggaccaagccaggccttgtctcctctcctcagtgatacacggaagatcgtcagtgagggcgagctggaccagttagcccagattaggcccctgatctttaattttcacgagcagacagctatcaaagattgtctgaagattcttgaagaaaagaccgccgcctacgatataatgcaggaattcatggcccttgagctaaaaaatctaccgggcgaattcaactctgggaaccagccatccaatcgcgagaaaaatagatatcgggacatcctgcccttccagcatcacggctattccggacctaacgaacgcactaccttctggcacgggagcaatgaaggggctgtttccctccttctgaggtattgcgcgtag

SEQ ID NO: 15945 - DNA, 1020 bp, Artificial Sequence
  Description of Artificial Sequence: Synthetic coding sequence
atgtggacagcccggggaccattcagacgcgatcgttggagttcagaggacgaagaggctgcgggcccttcccaggcactgagcccgctgctctccgatacccgcaagatcgtgtcagagggggagctggaccagctggcgcagattcgcccactgatctttaatttccacgagcagacagcaatcaaagattgtttaaaaattctggaggagaagacagccgcatacgacattatgcaggagttcatggctctggagcttaagaatctcccaggcgagtttaacagcggtaatcaaccttctaaccgcgagaaaaataggtacagagacattttaccttacgatagcactcgcgtacctttgggcaaaagcaaggattacattaatgcttcatacataaggatagtaaactgtggcgaagaatatttttatattgcgactcaggggcccctcctatccaccatagatgacttctggcagatggtcctggaaaacaattctaatgtgatcgccatgatcaccagggaaattgaggggggcataatcaagtgctaccactactggcctatcagtctgaagaagcctctggagctgaagcacttcagagtgtttctggagaactaccagatcctgcaatactttattattagaatgttccaagtggtggagaagagcactggcacctctcattccgtgaaacaactgcagtttactaagtggcctgatcatggcacaccagcctccgcggactctttcatcaaatatattcgctacgccagaaagagccatctgactggacccatggtggtgcattgttccgcaggtatcggcagaaccggagtgtttctgtgtgtggacgtggtattttgcgcaatcgttaaaaactgcagtttcaacattatggacatagtcgcacagatgagagagcagcgctccggtatggtccagaccaaagaacagtatcacttctgctacgacatcgttctggaggtcctcaggaaactcctgaccttggattag

SEQ ID NO: 15946 - DNA, 1047 bp, Artificial Sequence
  Description of Artificial Sequence: Synthetic coding sequence
atgcaattcggcgagttgctggccgctgttcggaaggcgcaagcaaatgtgatgctgtttctcgaggaaaaagagcaggcagccttgagtcaggccaacggcattaaagctcacctggagtaccgctcagccgaaatggaaaagagcaagcaggaactggaaaccatggccgccatcagcaataccgttcaattcttggaagagtactgtaaattcaaaaacactgaggatatcacattcccatcagtgtacatcggactgaaagataagctgtcaggtattcgcaaggtaattacagaatccaccgtgcaccttattcagctgctcgaaaactacaagaaaaagctgcaggagttctcaaaggaagaagaatatgatatcagaacccaggtatctgccattgttcaacgtaaatactggaccagtaagccagagccctctacacgcgagcagttcttacaatatgtgcatgatattactttcgaccctgatactgctcacaagtacttacggctgcaagaagagaacagaaaagtgactaacacaaccccctgggagcatccctaccctgacctgcctagcagattcctgcactggaggcaggttctatcacagcagtcactctatctccatcggtactactttgaggtcgaaatctttggtgcagggacctacgttgggctaacatgtaaaggcatcgatcaaaagggcgaagaacggagttcatgcatcagcggcaataatttttcttggagcctacagtggaacggcaaagagttcaccgcctggtactcagatatggaaactccgctgaaggcgggaccgttctggcgcctgggggtatacattgacttccctgggggaattctctccttttatggggttgaatacgactcaatgaccctggtgcataaattcgcctgcaagttcagcgaaccagtctacgcagcattttggctctccaagaaggagaatgccatccgcatagtggacctcggggaggagccagaaaagccggcaccgagtctggtggggacggccccctag

SEQ ID NO: 15947 - DNA, 1047 bp, Artificial Sequence
  Description of Artificial Sequence: Synthetic coding sequence
atgcagttcggtgagctgctcgcagcggttagaaaggcacaggccaacgtcatgttgtttctggaagagaaggaacaggctgcactgtcccaggccaacggcataaaggcccacctggagtatcggagtgctgagatggaaaagagcaagcaagaactggagaccatggcagctataagtaatactgttcaatttctcgaagagtactgcaaattcaagaataccgaagatattactttcccttctgtctatattgggcttaaagataaactgagcggaattcggaaggtgattaccgagagcactgtccatctgattcaactgttagaaaactataaaaaaaagctgcaggagttcagtaaggaagaggaatatgatatccgcacacaggtttcggcaatagtgcagagaaaatactggacctccaagcccgaaccatccacacgagagcagtttttacagtacgtgcatgacatcacctttgacccagacactgcccacaaataccttcggctgcaggaagagaacagaaaggtaaccaatacaactccatgggagcatccctatccagacctaccttcacgcttcctgcattggcgtcaggttctgagtcaacagtctctgtacctgcacagatactatttcgaagtggaaatatttggggctgggacttacgtaggtctgacatgtaaggggatcgatcagaaaggtgaggaaagatcctcttgcatatccggtaataacttctcttggtcacttcaatggaacggtaaagaattcaccgcctggtattctgacatggaaacccccttgaaagcaggtccattttggagactcggggtttatatcgattttcctggcgggattctgtccttttacggcgtggagtacgatagcatgactctggtgcataaatttgcttgtaagtttagcgagcccgtgtatgccgctttctggttgagcaagaaagagaacgcaattcggatcgtcgatctgggagaggagcccgagaagcccgccccctcactggtgggaacagccccttag

SEQ ID NO: 15948 - DNA, 687 bp, Artificial Sequence
  Description of Artificial Sequence: Synthetic coding sequence
atgatagatgactctaccagggtccctctcggaaagtccaaggactatatcaacgcaagctatatcagaatcgttaattgcggcgaagagtacttctacatcgcaactcagggtccactattgtccacgattgacgatttttggcagatggtgcttgagaacaatagtaatgtgattgcaatgatcacccgcgagattgaagggggaattattaaatgctaccactattggccgataagccttaagaagcctttggagttgaagcactttagggtgtttcttgagaactatcagattctccagtacttcatcatccgcatgttccaagttgttgagaaatccacgggaacaagtcactctgtgaaacagctacaattcactaaatggcctgaccatggtaccccagccagcgcggatagcttcatcaagtatatccgctacgcacggaaaagtcatctgaccggaccaatggtggtccactgcagcgctgggatcgggaggaccggcgtcttcctgtgtgtggatgttgtattctgcgccattgtaaagaactgcagctttaatattatggatatcgtcgctcagatgagagagcagaggtctggtatggtacagaccaaggagcagtaccatttttgttacgatattgtcttggaggtgttgcgcaaactgctcacgcttgattag

SEQ ID NO: 15949 - DNA, 1449 bp, Artificial Sequence
  Description of Artificial Sequence: Synthetic coding sequence
atggtaatggagaagccaagccctctcctggtcggccgtgagttcgtgagacagtactatactttgttaaacaaagcacctgaatacctgcaccggttttacggcaggaattcttcatatgtgcacggaggggtggacgcgagcgggaaaccacaggaagctgtgtatggccagaacgatatccatcataaggttttgtccctaaatttcagtgagtgccacaccaagatccgtcatgtggacgctcacgccacactgtccgatggcgttgttgttcaggtcatgggtctcctgtccaatagtggccagccagagcgcaagtttatgcagacatttgtgttggcaccagagggctccgtcccgaataaattctacgttcacaacgatatgttccgctacgaagatgaggtgttcggggacagtgagcccgagctcgatgaagagtccgaagatgaggttgaggaggaacaggaagaacgacagccctctcccgaacctgttcaagaaaacgctaacagcggttactatgaggcccacccagttaccaatggcatcgaggagcccctcgaggagtcttcccacgagcccgagcctgagccagagtctgagaccaaaaccgaagagttgaaaccacaggtcgaagaaaaaaacttggaagagctcgaagaaaagagcactacacccccgcccgccgaacctgtaagccttccacaggaaccaccaaaggctttcagttgggcgagcgtcacctctaaaaatctcccgccttcgggaaccgtaagcagctcggggatcccgccgcatgtgaaagcgcccgtcagtcagccacgagtcgaagcaaagccagaagtgcagtcacagcctcctcgagtgcgcgagcagcggccaagggaaagaccagggttccctccccgtggacccagaccgggcagaggcgacatggagcagaatgatagtgacaatagaaggatcattcggtaccccgattcacaccagctcttcgtagggaatctgccgcacgatattgacgaaaacgagctgaaagagttttttatgtccttcggaaacgtggtggagctgaggattaataccaaaggagtaggtgggaagctccccaacttcggttttgtcgtgttcgacgattcagagcctgtacagcggatactgatcgccaaacccattatgttccggggagaagtacggttaaacgttgaggagaaaaaaactcgcgctgctagagaacgggaaaccaggggcggcggcgatgaccgccgggacatccgacgtaatgaccgaggcccaggcgggccccgcggaattgtgggaggagggatgatgcgggatcgggacggcagaggccccccgcctcggggagggatggctcaaaagctgggaagtggacgaggaaccggtcagatggaaggacgtttcaccgggcaacgcaggtag

SEQ ID NO: 15950 - DNA, 1020 bp, Artificial Sequence
  Description of Artificial Sequence: Synthetic coding sequence
atgtggactgcacgcgggcctttcagacgcgatagatggtcttctgaggatgaggaagctgccggaccgagccaagcactgtcaccactgctcagtgacactagaaagatcgtcagtgaaggggagttggaccagctggcccagatccgacccttaatcttcaactttcatgagcaaacggccattaaggactgcctaaagatcctcgaagaaaagacggccgcctacgacattatgcaggagtttatggcactggagcttaaaaatctcccaggggaattcaacagtggtaatcagcccagtaatcgtgagaaaaatcggtacagagacattttgccgtacgattccacaagagtccctctgggaaaatccaaggattatattaatgcctcttacattcgcatcgtgaactgcggtgaagaatacttctatattgctacccaggggcctctcttgagcacaatcgacgatttctggcagatggttctggaaaataactcgaacgtgattgcgatgattactagggagattgagggaggcattattaagtgttaccactattggccgatcagcctgaagaagcctctggagctcaagcattttcgcgtgttcctagagaactatcagattctacagtacttcattatccggatgttccaggtggttgagaagtccaccggaacctcacactcagttaaacaacttcagtttacgaaatggcccgatcacggcacgcctgccagcgcagatagttttataaagtatatccgttacgctcgaaaatcacacctgacaggccccatggtggttcattgctccgctggcatcggcagaaccggcgtgttcctttgcgttgacgtcgttttctgtgcaatagtgaaaaactgttccttcaatataatggacattgtcgcccagatgagagagcaacgtagcggtatggtgcagactaaggaacaataccatttctgctacgacattgtgctggaggttctgcgcaaattactaacactggactag

SEQ ID NO: 15951 - DNA, 621 bp, Artificial Sequence
  Description of Artificial Sequence: Synthetic coding sequence
atgtcttcgcccagagacttccgcgccgagcccgttaacgattatgaggggaacgattccgaggccgaggatctgaatttcagggaaacattaccctcttcatcccaggagaatacgcctaggtctaaggtgtttgagaacaaggttaacagcgaaaaagtcaaactttcactgcgtaactttccacacaatgactacgaggatgtgttcgaggagccctctgagtctggaagcgaccccagtatgtggactgctcgcggccccttccgacgtgaccgatggtcttctgaagatgaggaggcggccggtcctagccaggctctgtcacccctgctttcagatacccgcaagatagtatctgagggcgagctcgatcagctggcccagattcgacctctgattttcaatttccatgagcagacggccatcaaagattgcctgaaaatcctggaggagaaaacagcggcgtacgatattatgcaggagtttatgttcaacatcatggacattgtggctcagatgcgcgaacagcgctccggcatggtacagacaaaggaacaataccacttctgttacgacatcgtcctggaggtgcttagaaagttactgacactcgattag

SEQ ID NO: 15952 - DNA, 438 bp, Artificial Sequence
  Description of Artificial Sequence: Synthetic coding sequence
atgtggactgcacgaggtccatttagacgggaccgatggtcctccgaggacgaagaagccgcaggcccttcccaagctctctcacctctactttccgacactcgcaagatcgttagtgaaggggagttagatcagctggcacagataagacctctgattttcaattttcacgaacagaccgccattaaggactgcctgaagatactcgaggagaaaaccgccgcctacgacatcatgcaggagtttatggccttggaacttaagaaccttcctggcgaattcaattctggtaaccaaccttccaacagagagaagaaccgttatcgagacatattgccttttcagcaccacggctactctggtccaaatgagaggacaactttctggcacgggagtaatgaaggggccgtgtcactgctgctgcggtactgcgcttag

SEQ ID NO: 15953 - DNA, 687 bp, Artificial Sequence
  Description of Artificial Sequence: Synthetic coding sequence
atgatcgatgactcaactcgggtacccctaggaaaatcaaaagattatatcaatgcttcttatattcgaatcgtgaactgcggtgaggagtacttttacatcgctacccagggacccttgctcagcacaatcgatgatttttggcaaatggtgctcgaaaataattccaatgtcatcgctatgatcacgagagaaatcgaaggcggaataattaagtgttatcattactggcctattagtttgaagaaacccctggagctgaaacatttcagagtgttccttgaaaattaccagatcctccagtatttcattattagaatgttccaagtggtggagaaatctactggcacatcgcactccgtgaaacagctccagtttaccaaatggccagaccatggcacacctgcttctgcagattccttcataaagtatatcagatatgcccgcaagtcacacctcaccgggcctatggtggttcattgctcagccggtatcggcagaactggtgtattcctctgcgttgatgtcgtgttttgtgctatcgtaaaaaactgttcattcaatattatggacatcgtcgctcaaatgagggaacaacgatccggaatggttcagaccaaggagcagtatcacttttgctatgatatcgtactagaagtcctcaggaaactgcttaccttggattag

SEQ ID NO: 15954 - DNA, 2802 bp, Artificial Sequence
  Description of Artificial Sequence: Synthetic coding sequence
atgttttggaaatttgacctcaacaccacttcgcatgtggataagcttctcgataaagagcatgtgaccctgcaggagctgatggacgaagacgacatcttgcaggagtgtaaggcccaaaatcagaagctgcttgactttctgtgccgacagcagtgcatggaagaactggtgtcccttataacccaggacccaccacttgacatggaggaaaaagtcaggtttaaataccctaacacagcctgcgagcttctgacatgtgatgtgccccagattagcgatcgactggggggagacgagagcctgctctccctgctgtacgattttctggaccacgagcctccgcttaatcccttactagctagtttctttagtaagacaatcggtaatttaatagctcgaaagacagaacaagtaattacgttcctaaagaaaaaggataagtttataagtcttgtgttaaagcacatcgggacttctgccctgatggatcttttgctcaggttggtctcctgtgtcgagcccgccggcctgcggcaggacgtgctacactggctgaacgaggagaaggtcattcaacgtctagtggagctgatccatccgtcacaagacgaagatcgtcagtccaacgcgtctcagacactgtgtgatatcgtgcggttgggcagagaccaaggcagccagttacaggaggccctcgagcctgaccctcttcttactgctctcgagagccgccaagactgcgtggagcaattactaaagaatatgttcgacggagacaggacagagtcctgtctggtgtctgggactcaggtgcttttgactctcttagaaactcggagagtaggtactgagggactggtcgatagcttctcccaaggactggagcgctcttatgcggtgtcatcctcagtgttgcatggcattgaacccagactcaaagattttcatcagctcctgctcaaccctcccaagaagaaggccattctgacaacaattggggtcctggaagaaccattaggaaacgcgcgcctgcatggcgcccgcctaatggctgccctcttacacactaacaccccatctatcaaccaggagttgtgcaggctgaacacaatggacctgctgttggatctgttctttaagtatacatggaataattttctgcacttccaggtcgaactgtgcattgcagcaatcttgtcacacgctgctagggaagaacggaccgaggctagcggcagcgaatctagagtggagcctccacacgagaatggtaaccgctctctggaaactccacagcctgccgcgagtctccccgacaatacaatggttactcacctctttcagaaatgctgtctggtccagcggatcctggaggcttgggaggccaatgatcatacccaggctgcaggagggatgagacgaggcaatatggggcacctgactcggatcgctaatgctgtcgtgcagaatcttgagaggggcccagtgcagacacacatctccgaggttattagaggcctcccagccgattgtcgaggccgatgggagagttttgtggaggaaactcttactgagaccaatcgacggaacacagtggacctggccttcagcgattatcagatacagcaaatgacagcgaatttcgtcgaccaattcgggtttaacgacgaagagtttgcagatcaagacgataatatcaacgccccattcgaccggattgctgagattaattttaacattgacgctgacgaagactctccaagtgccgctctgtttgaagcttgctgtagcgaccgcatccagccctttgacgatgacgaggatgaggatatatgggaggacagcgacaccaggtgcgcagcgagggtgatggcccgcccacgatttggagcaccgcacgcctcagagtcttgcagtaaaaacggcccagaacgtggtggccaggacggaaaggcctcactagaagcccatcgcgacgctccaggtgcgggcgcgccgcctgccccgggaaagaaagaagctccccccgtggaaggtgactctgagggcgctatgtggacagccgtattcgacgagccagctaatagcactcccaccgcgcctggagtggtgcgcgacgtgggctcgagtgtatgggcagcgggcacgtcggccccagaagagaagggctgggcaaaatttacagacttccagccattctgttgctcggaatcgggcccccgttgctcttcgcctgtggacacggaatgcagccacgcagaaggcagtaggtcacagggacctgagaaagcattcagccctgccagcccatgtgcatggaacgtttgtgtgacccgcaaggcgccactcctggcctccgactcgagctcgtccggagggtctcactccgaagacggggaccagaaggcggcctctgccatggacgctgtgtctcggggtccaggccgggaagctccacctcttccgactgtagcgcgcaccgaagaggctgttggcagggttggctgtgcggactcaaggttgctgtcacccgcctgccccgcccctaaagaggtgaccgcggcccccgcagttgctgtgccccctgaggccactgtggcaataacaacagccctctcaaaggctggacccgcgataccaactcccgccgtgtcatcagccttagccgtggccgtgccccttggtcctattatggcagttactgccgcgcctgccatggtcgcaaccctcggaacggttactaaggatggcaagacggatgcacctcccgagggcgccgcactgaatggcccggtgtag

SEQ ID NO: 15955 - DNA, 2799 bp, Artificial Sequence
  Description of Artificial Sequence: Synthetic coding sequence
atgttctggaagttcgatctcaatactaccagccacgtggataaactcctggacaaagagcacgtgacacttcaggagctcatggatgaggacgatatactgcaggagtgcaaggcccaaaaccagaagctcctggacttcctgtgtcgacagcaatgtatggaggagctcgtcagtttgattacccaggaccctcctcttgatatggaggagaaggtccgcttcaagtaccccaacaccgcatgcgaactcctgacatgcgatgtgccgcagatctctgatcgactcggcggagatgaatccctcctcagcctgttatacgactttctggatcatgagccaccactgaaccctttacttgcatctttcttttctaagacaattggcaacctgatcgccagaaagaccgagcaggtgatcacattcttgaagaaaaaggataagtttataagcctcgtcctcaaacacatcggtacctcagccctgatggatcttctgctgcgcctcgtgtcttgtgtggagccagccgggttgcgtcaggatgtgttgcattggttgaacgaagagaaagtgatccagagattggtggagttaattcaccctagccaggacgaggaccggcagagcaatgccagtcagaccctgtgcgatatcgttcgcctgggtagagaccagggcagccaattacaagaggccttggaacctgaccctttgctcaccgctctagagtctcaggactgcgtcgaacaactccttaagaatatgttcgatggcgacaggacggaaagctgcctcgtttcagggacccaggtgcttctaacgctgctggagacgaggcgggtgggcactgaggggctagtagactcattctcccaggggctggaacgctcatatgctgtcagctctagcgtgctccatggcattgagccaaggcttaaggactttcaccaactcctcctcaatcctccaaagaaaaaggccattttgaccactattggcgttctggaagagcctcttggcaacgccagacttcacggcgccaggctgatggccgccctcctgcatactaacactccaagcatcaatcaggagctgtgccgtctgaacacaatggatctgctcttagatctgttttttaaatacacctggaacaacttcctacatttccaggtggagttatgtattgctgctattctgagccacgccgcacgcgaagagcgaacagaagcgtctggcagtgaatctagagtggaacctcctcatgagaacggaaataggtcactcgaaaccccacaacctgcagcctctctgccagataacacaatggttacacacctatttcagaagtgctgcctcgtgcaaagaatattagaggcctgggaggcgaatgatcatacccaggctgccggcggaatgcggcgtggaaacatgggacatcttacccgcattgcaaatgcagttgtgcaaaatttagagcggggaccagttcagacccacatcagtgaagtcattagaggccttcccgccgactgtcggggcaggtgggaaagctttgtggaggaaactctcactgagacaaatagacgaaacactgtagatctagctttttccgattaccaaatccagcagatgacagcgaattttgttgaccaattcggatttaatgatgaggaattcgctgatcaggatgacaacattaacgctccgttcgacaggattgccgagatcaactttaatatcgatgccgacgaagactctccctcagctgcgcttttcgaagcttgttgctccgaccggattcagcccttcgacgatgacgaggacgaggacatctgggaggactctgatacaagatgcgcagccagagtgatggcccgacccagatttggggctcctcacgcgagtgaaagctgttccaagaatggacccgagcggggcggccaggacggcaaggcttcactggaagcacatcgcgatgcacctggtgcaggcgctcctccagctcccggcaagaaagaagcacctccagtcgagggagatagtgagggtgcgatgtggacagccgtatttgatgaacctgctaacagcactcccacggcacccggggttgtccgggacgttggaagcagcgtctgggccgccggcactagcgcccccgaagaaaaaggctgggctaagtttacagattttcaaccattctgttgttcggaatccgggcccaggtgcagttcacctgttgacaccgagtgctcgcatgctgaaggcagccgctcccagggccccgagaaggccttcagccctgcgagcccctgtgcatggaacgtgtgtgttaccaggaaggcacctctgcttgcgagtgatagctcctccagcgggggctcccattccgaggatggcgaccagaaggcagctagtgctatggacgcagtgagccgcggcccgggccgcgaggctccgcctctaccaactgtggcaaggactgaggaggccgtcggtagagtgggctgtgctgactccaggctgctttcccctgcatgcccggccccaaaggaggtgacggcggctcctgccgtcgcagttcccccagaggctacggtcgccattaccactgccctgagcaaggctggtcccgctattcctactcctgctgttagtagtgccctggctgtggcagtccctctcggaccaatcatggcagttactgcagccccagcgatggtggcaactctggggactgtaactaaagatggtaagacggacgcccctcccgaaggcgcggctctgaacggacccgtgtag

SEQ ID NO: 15956 - DNA, 789 bp, Artificial Sequence
  Description of Artificial Sequence: Synthetic coding sequence
atggcacttagcctggggtggaaggcacatcggaaccattgcggcctgctattgcaggcgctgcggtcatccggattgctgctattcccatgcggccaatgtccgtggcgcggagccggctccttcctagaccccgaaattaaagcctttctcgaggagaataccgaagtgacttcttcaggtagtcttactcccgaaattcagctccggttgctgaccccccgatgcaaattttggtgggaaagggctgacctgtggccacactcagacccctactgggccatttattggcccggcggtcaggctctcagcagatatctgctggacaaccccgatgtggtccgcgggaagtctgtgttggacttaggctctgggtgcggcgcgaccgctattgccgccaagatgagcggtgcttcccgcatccttgccaatgatattgaccctatagccggaatggctatcactctcaactgtgagcttaaccggttaaacccctttccaatccttatccagaacattcttaacctcgagcaggataaatgggacctagtggtgctgggcgacatgttttacgacgaagatttggctgacagcctgcatcagtggttgaagaagtgcttttggacatatcggacaagggtgttgatcggcgaccccgggaggcctcagttctccggccactccatccagcatcacctacataaggttgtcgaatatagtctcctagagtccactcgccaggagaattccggcttgacgacgtcgacggtatggggcttccaaccttag

SEQ ID NO: 15957 - DNA, 2718 bp, Artificial Sequence
  Description of Artificial Sequence: Synthetic coding sequence
atggaggtacaggttagtcaggccagcctgggctttgaactaacctccgtggagaagtccttgcgcgagtggtccaggttgtctagggaagtgatagcatggttgtgcccttcctcgccgaattttatccttaacttccccccccctccatctgcttccagcgtgtctatggtgcagctgtttagtagcccgttcggctatcagagtccgagcggccatagtgaggaggagcgggagggaaacatgaagagcgcaaagccccaggtgaatcacagccaacatggcgaaagccaacgggcattgagcccactccagagcaccctatcatcagcagccagtccctctcaagcctacgagacctacattgagaatggattgatctgcttgaaacataagattagaaacatcgagaagaagaagctgaagctggaagattacaaagataggctgaaaagtggcgagcacctgaacccagatcaactggaagccgttgagaagtacgaagaagtgcttcataacctggaatttgctaaggagctccagaagacgttctctggtttgagtctggacctcctgaaggcccagaagaaagcccagcggagagaacacatgctcaaactggaagcggaaaaaaaaaaactccggacgatcttacaagtgcagtacgtcttgcagaatctgacccaggagcatgtgcagaaggactttaaaggagggttgaacggcgccgtctatttacccagtaaagaactggactacttgataaagttttccaagcttacatgccccgagaggaacgagtccctctccgtagaggaccaaatggagcaatctagcttgtatttttgggatttgctggagggctctgagaaggcagtggtgggtacaacctacaaacatcttaaagatctgctgtccaagcttctcaactcagggtacttcgagagtatccctgttcctaagaacgctaaggagaaggaggtccccttggaagaagagatgctgatccagagtgaaaagaagacacaattgagtaagacggaaagcgttaaggagagtgagtctctcatggaatttgcacagcctgagattcagccccaggagttcctgaatcgtaggtacatgaccgaggttgattatagtaacaaacagggcgaggagcagccatgggaggcagactatgctaggaagcctaacctgcccaaacgctgggatatgctgaccgagccagacggacaggaaaaaaagcaggagagttttaagagctgggaagcgagtgggaagcatcaagaggtgtctaaaccagcagtgtccttggaacagcgcaaacaggatacttccaagctgcgctctacactgcccgaagaacaaaaaaaacaggaaattagcaagtctaagcctagccccagtcagtggaagcaggacactccaaagtctaaggcaggatacgtgcaggaagagcagaaaaaacaggagaccccaaagctttggccggtccaactgcagaaggaacaggatcccaagaagcagaccccgaagtcatggaccccttcaatgcagagtgagcagaataccaccaaaagttggaccacccccatgtgtgaggaacaagattctaaacagcctgagacacccaagagttgggaaaacaatgttgagtcacaaaagcatagtctgacttctcaatcccagatctccccaaagtcttggggtgtggcaaccgcatctctcatccctaatgatcagctgctgccccggaagctgaataccgaacctaaagatgtgccgaaacccgtccatcagccggtgggctcctcctcgactctgcccaaggatcccgttctgagaaaagaaaagctgcaggatctcatgacgcagatccagggaacttgcaatttcatgcaggaatcggttcttgactttgacaagccatcaagtgccattcctacatcacagccacctagcgccacccccggctcccctgtagccagcaaagaacagaatctcagctcacagtccgacttcctccaggaaccactccaagccgccatcccacctggcaaacaacccagttctctggcctcccccaatccccccatggccaaggggtcagagcagggatttcaatcacctccagcatcttctagctccgtgaccattaataccgcacctttccaggcaatgcagacagtgttcaacgtgaacgcccctctccctccccgtaaggaacaagaaatcaaagagtccccctactctcctggttacaatcagtcttttactaccgcctccacacagacccccccacaatgtcaactccccagcattcacgtcgaacaaacagttcactcacaggaaaccgcacaaaccaacgttttccccagacctactcagccgtttgtgaactctagaggaagtgttaggggctgtactcggggaggacgcctgataactaatagttacagatcccctggcgggtataagggatttgatacctacagaggactccctagcatctctaacggcaactattcacaactgcagttccaagcccgcgaatatagcggcgctccttattcgcagagggataactttcagcagtgttacaaacgcggagggacttccggaggcccaagggctaattcccgcgcaaactgttttattatgagaaacagcctcttactcatcaaacagcagggcggcgtgatcctgcttcgatag

SEQ ID NO: 15958 - DNA, 1107 bp, Artificial Sequence
  Description of Artificial Sequence: Synthetic coding sequence
atgagcttgttcggtacaacatctggcttcggcactagtggcacctctatgttcggttccgctactaccgacaaccataatcccatgaaggacatcgaggtaactagctccccagatgacagtataggctgcttgtcattcagtccgcctacgctccccgggaattttctgatcgctggctcctgggcaaatgacgtacgctgctgggaagtacaggactcggggcaaaccattcctaaagcacagcaaatgcacactggtccagtactggatgtgtgctggtccgacgatggaagcaaagtgttcacagctagctgcgataaaaccgccaagatgtgggaccttagctctaatcaggcaatccaaatcgctcagcacgacgcgccagtcaaaactattcactggattaaagctccaaactattcttgcgttatgacaggtagttgggataagacgttgaagttttgggacacgaggtctagtaacccaatgatggtcctgcaactgcccgagagatgttactgtgccgatgtcatttatcccatggccgtcgtggcgacagcagagcgtggactgattgtgtatcaactggaaaatcagcccagcgaatttcggcggatcgagtctcccctgaaacatcagcatcgatgtgtggcaatttttaaggacaaacagaataagccaaccggttttgctctcgggagcattgagggacgcgtggctattcattatattaatccacccaatcccgcgaaggataacttcacttttaagtgtcatagatcaaacggcaccaacacaagtgctccccaggacatttatgccgtcaacggcatcgcgtttcaccctgttcacgggactctggcgaccgttggtagtgacggacgcttcagtttttgggataaagatgccagaaccaaattgaaaacctctgagcaactagatcagcctatcagcgcatgctgttttaatcataacggtaatatatttgcatacgctagcagttatgattggtccaaaggccatgagttctataaccctcaaaaaaagaattatatttttctcagaaacgccgctgaggagctgaagccaaggaacaaaaagtag

SEQ ID NO: 15959 - DNA, 1107 bp, Artificial Sequence
  Description of Artificial Sequence: Synthetic coding sequence
atgtccctgtttgggaccaccagcgggttcggtacctccggcacctctatgtttggctcagctacaactgataaccacaaccctatgaaggacatcgaggtcacatcctcacccgacgacagtattggttgtctatcattcagccctcctactctgcccggtaactttttaattgccggctcttgggccaacgatgtgcgctgctgggaggtgcaggattccggccaaacgattcctaaagctcagcaaatgcacacaggtccagttcttgacgtgtgttggtctgatgacgggagcaaggtgtttaccgcttcatgtgacaagaccgccaagatgtgggatttatctagcaatcaggccatccagattgctcaacacgacgcaccggtgaaaactatccactggattaaggcacccaattactcttgtgtcatgaccggtagttgggacaaaaccttaaaattctgggatactagatcaagcaacccgatgatggtacttcagttgcctgaaagatgttattgtgccgatgttatctatccaatggctgtcgtggcaactgccgagcgcggcctgattgtgtatcagcttgagaaccagccaagtgaatttaggagaattgaatccccccttaaacaccaacaccgctgcgtggccatctttaaggacaaacaaaacaaaccgaccggcttcgccctgggctcaatagaggggagagtggctatccattacataaatccaccaaaccccgccaaggataattttacgtttaagtgccacagaagcaatgggactaatacgagtgccccccaagatatatatgccgtgaacggaatcgcttttcaccctgtgcacggcacacttgccacagtgggttctgacggacggttcagcttttgggacaaagacgcgaggaccaaattaaagacttctgaacagttagatcagcccatctctgcctgctgcttcaaccataacgggaatatctttgcatatgcctccagctatgactggagcaaggggcacgaattttacaacccacagaaaaaaaattatatctttctacgaaatgccgctgaggagctgaaacctagaaataaaaagtag

SEQ ID NO: 15960 - DNA, 2745 bp, Artificial Sequence
  Description of Artificial Sequence: Synthetic coding sequence
atgtcaagcagtggctacccgccaaaccaaggcgccttctccacagagcagagccgttatccacctcacagtgtacaatacacttttcctaacaccaggcatcagcaggacccggcgtttggggggaagcatgaagccccaagtagtccaatttccggacaaccttgcggggatgaccagaacgcctccccatcaaagttatctaaagaggaattgattcaatctatggatcgagtggaccgtgaaattgccaaagttgagcagcaaattctgaagctcaagaaaaagcagcagcagttggaagaagaggctgcaaaaccacccgagcccgagaagccagtttctccacccccagtggagcagaaacacagatcgattgtccagatcatttatgatgagaatcggaaaaaggccgaagaggcccacaagatttttgagggcttgggccccaaggttgagctgcccctctacaaccagccaagcgacaccaaggtttaccacgagaatatcaaaaccaatcaggtcatgagaaaaaaacttattctcttcttcaagcggaggaatcacgctcggaaacagagggagcagaagatatgtcagcgatacgatcagctgatggaggcatgggagaagaaagtggataggatcgaaaacaaccccagaagaaaggccaaagagtcaaagacgcgcgaatactacgagaagcaattccccgagattaggaaacagagagagcagcaggagaggtttcaacgcgtgggccagcgcggtgctggactctccgctaccattgctcggtctgagcatgagatatctgagatcatcgatggcctttcagagcaggagaacaacgaaaagcagatgagacagctgtccgttattcctccaatgatgtttgacgccgaacagcgaagggtgaagtttataaacatgaacggcctcatggaggatcccatgaaggtgtataaggacagacagttcatgaatgtgtggaccgaccacgaaaaggaaatctttaaggacaagtttatacagcaccctaaaaattttggcctcatcgcctcctacctcgagcgtaagtctgtgccagattgcgtgctctattactacttgacaaagaagaatgaaaactacaaggccttggtcaggcggaattatggaaagagaagaggtcgcaatcaacagattgcgcgtccaagccaggaggaaaaagtggaagaaaaagaggaggataaagcggagaaaacagagaagaaggaggaggagaagaaggatgaggaagagaaagacgagaaagaggacagcaaagagaacacgaaggagaaagacaagatcgatggcaccgcggaggagacagaggaaagagagcaggccacaccacgtgggcggaagaccgccaactcccaaggaaggagaaaaggccgaattacccgttctatgaccaacgaagcagccgccgcaagcgcagcagccgctgcagctaccgaagaaccacccccaccgttgcccccacctccggaaccaattagcaccgagccggtggagaccagtaggtggacagaagaagagatggaagtggctaagaaaggcctggttgaacacggtagaaattgggctgctatagctaagatggtgggaacgaagagcgaggcccaatgtaagaatttctatttcaactacaaacgtcggcataatcttgacaatctgctgcaacagcacaaacagaagacctctaggaaacctcgtgaagagcgggacgtgtcacagtgcgagagcgtggctagcacagtgagtgctcaggaagacgaagacattgaggcgtcgaacgaggaggaaaatcctgaggactcagagggcgcagaaaatagcagcgataccgagtccgctcctagccctagtcccgtcgaagccgtcaaaccgtcagaggattctcccgagaacgccacctcccgggggaatactgaaccagcagtggagcttgaaccgactacagagactgccccatctacttccccaagcctggcggtaccgtctactaagccggcggaggatgagtctgtggagacccaggtcaatgacagcatatcagctgagaccgcagagcagatggacgtggaccaacaggaacactcagctgaagaagggagcgtatgtgacccaccccccgccaccaaggcagattctgttgacgttgaggtcagagtccccgaaaaccacgcttctaaagtggaaggagacaacactaaggagcgcgacttggacagggcctcagagaaggtagaacccagagatgaggacttggtagtggctcagcagatcaacgcacagcgcccagaaccacaaagcgacaatgattcttctgcaacttgcagtgcagacgaggacgtcgacggggagcctgagaggcagcgtatgtttcctatggacagcaagccaagtttactaaaccccacaggaagtatcctggtcagttctccactgaagccaaatccactggacctcccccagttacagcaccgcgccgcggtcatcccaccaatggtaagctgtaccccctgcaacatacccatagggactcctgttagcggatatgcgctttaccaaagacacatcaaagctatgcacgaatccgcgctgttggaggagcagcgtcaacggcaagaacagattgatctggaatgccgatcatccacaagcccatgcgggacctcaaaaagtccaaaccgggaatgggagggcaggtag

SEQ ID NO: 15961 - DNA, 7032 bp, Artificial Sequence
  Description of Artificial Sequence: Synthetic coding sequence
atgagtagtagcggatacccacccaaccagggtgccttttctacagagcagtcaaggtaccctccgcattcagtgcagtacacctttcccaatacaagacatcagcaggacccagctttcggtggaaagcatgaggccccttcatctccaatctccggtcagccatgcggcgacgaccagaacgctagcccctctaaattgagtaaagaggaactcattcagagtatggaccgggttgatagggagattgctaaggtcgagcagcaaattctgaaattgaagaagaagcaacaacagctggaggaggaagcagccaagccacccgagcctgagaaacccgtgagcccaccacccgtagagcagaagcatagatcgatcgttcagataatctatgatgaaaaccgcaagaaagcggaggaggcacacaaaatttttgagggtctaggtcctaaagttgagctccccctttataatcagccctctgacacaaaggtatatcacgagaatatcaagacaaatcaggtgatgcgaaagaagctcatcctattcttcaaaagaagaaatcacgcacgaaagcagcgggaacagaaaatttgccagcgctacgaccagttaatggaagcatgggagaaaaaagtggatcgaatagaaaacaaccctcgcagaaaggctaaagagagcaagactcgagaatactacgagaagcagttccctgagattagaaagcagagggaacagcaagaacggtttcagcgcgtgggacaaaggggcgccggtctcagcgcaaccattgcaagatctgaacatgagatctctgagatcatcgacggcctctctgagcaagaaaacaacgagaagcaaatgaggcagttaagcgtgattccccctatgatgtttgacgcggagcagcggagggtaaagttcattaacatgaacgggctaatggaggaccctatgaaggtttacaaagaccgccaatttatgaacgtatggactgatcacgaaaaggaaatttttaaagacaagtttattcaacacccaaagaattttggactgatagccagttatcttgagcgcaaatccgtcccagattgcgtcctctactactacctcacaaaaaagaatgaaaactacaaggcgttggtcagacgaaattacgggaagaggaggggccggaatcagcagattgcaagaccatcacaggaggaaaaggtggaggagaaggaggaagataaagcggagaagactgaaaaaaaagaagaggaaaagaaggacgaggaagagaaggacgagaaggaagacagcaaagaaaacacgaaagaaaaggataagatcgatgggacggccgaagagaccgaagaacgtgaacaggctacacctcgcggcagaaagactgcaaattctcaaggcaggcgcaagggccggattactcgctctatgacaaacgaggctgcagccgcctctgccgctgctgcggccgccactgaggaaccgcccccaccgctgcctccgccacccgagcctattagtacggagcctgttgagacaagcagatggaccgaggaggagatggaagtggctaaaaagggtctggtcgaacacgggaggaactgggccgccattgcgaaaatggtcggaacaaagagcgaagcacagtgcaagaatttctacttcaactacaagagacggcataatctggataatcttctgcaacagcataaacagaaaaccagtcgcaaacctagggaagagagagacgtgtcccagtgcgagagtgttgcatctactgtttccgcccaagaggacgaagacattgaagcatcaaatgaagaagagaacccggaagactccgaaggagccgagaatagttctgacactgagagtgctcctagtccttccccagtggaggccgtgaagccctcagaggattcccccgagaatgcaacctctaggggcaacaccgagcctgccgtcgagctggagcccactacggagactgcccctagcacatccccctcccttgctgttcctagtaccaagcctgcggaagatgaaagtgtggagactcaagtgaatgacagcatcagcgcggagacggctgagcagatggacgtcgaccagcaggagcatagcgccgaggagggctctgtctgtgatccaccaccggccaccaaggctgatagcgtggacgtggaggtccgcgtccctgagaaccacgcctccaaggtggagggcgacaacacaaaggagagggaccttgaccgcgcttcagagaaggtggaacctcgagacgaggatctcgtggtggctcagcaaataaacgctcagaggccagaaccacagagcgacaacgacagctccgctacctgctccgctgacgaggacgtcgatggagaaccagagagacagcgaatgttccccatggatagcaaacctagtttgctgaaccccaccggttcgattctggtgagtagtcccctcaagcctaatcctctggacctgcctcagctgcaacacagggccgctgtgataccaccgatggttagctgcactccatgtaatatccctatcggcacccctgtttctggctatgctctttaccaacggcacatcaaggccatgcacgaaagtgcacttctcgaagaacagcggcagcggcaagaacagatagatctcgagtgcaggtcctcaacatcaccttgtggaacctccaaatccccaaatagagaatgggaggtattgcagccagctccccatcaggtgatcactaaccttccagaaggcgtgcggctgccaaccaccagacccacccggcccccgcccccgctgattcccagctcaaaaaccaccgtggcgtctgagaagccttccttcataatgggcggcagcatctctcagggaacccccggcacctatctgacctcacacaatcaggcgtcatacactcaggagactcctaaaccctccgtcggttcaatttcgttgggcttacctaggcagcaggagtccgccaaatctgctactctaccctatattaagcaggaggagttctccccgcgctcccagaattctcagccggaagggctcttagtgagggcacagcatgaaggcgtggtgcgaggtaccgctggcgccattcaggaagggagcatcacgagaggaacgcccacttctaaaatctctgtggaatcgattcccagtttgcggggctccatcacacagggcacccccgccctgcctcagactggcattccgacagaagcgctggtgaagggcagcattagtcggatgcctatcgaggattcttccccagagaaggggcgagaggaggctgcctctaagggccatgtaatctatgagggtaaaagcggacacatattatcctacgacaatatcaagaatgcacgggaaggaacacgctcaccgcgtactgctcatgagatttccctaaagcgtagttatgagtctgtagaaggcaatattaagcaaggaatgtcgatgcgggagtctccggtgtccgccccactggaaggtttaatttgtagagctctgcctaggggttcacctcattcagacctgaaggagcggaccgttctgagcggatctatcatgcagggcacaccaagggccacaacggaaagcttcgaggacgggcttaaatatcccaaacagattaagagagagtctccgcctatcagagcatttgaaggtgctattacaaagggcaagccctacgatggaataaccactatcaaagaaatgggcaggtccatccatgaaattccccgccaagatattttgacacaggagtccaggaagacaccggaggtggtgcagagtacacggcccatcatcgaaggatccatctcccaagggacccccatcaagtttgataacaactctgggcagtcagctataaagcacaatgtcaaaagtctcattacgggaccttcaaaactgtcccgaggaatgccacccctggagatcgttcccgagaatatcaaagtcgtagagcgaggaaaatacgaagatgtgaaagccggcgaaacagtgcgcagcagacatacctccgtagtgtcatcgggcccaagcgtgctgcgaagtactttacacgaggcaccgaaggcacagttaagccctggaatttacgatgatacgagcgccagacggacacccgtctcctaccaaaatacaatgagtaggggcagtccaatgatgaaccggactagcgacgtcagctccaacaaaagtactaatcacgagagaaaaagcaccctgacccctacacagagggagtcaatcccggccaaatcccctgtgcctggagttgatcctgtggtaagtcatagcccctttgacccacatcatcggggtagtactgcaggcgaggtataccgttctcacctcccgactcatctcgaccctgctatgccgttccaccgagcacttgatccggccgccgcctatctatttcagcgccagctttcccctaccccaggttaccctagccagtaccaactgtacgcaatggaaaacacacggcagacaatcttgaacgactacattacttcacagcagatgcaagtaaaccttcgacctgacgtggctcgaggattgtcccctagagagcagccactggggctgccgtaccctgccacccgcggcatcatcgacctcaccaatatgcctcccactatcctggttccccaccctgggggcacatctacccctcccatggacagaattacatatatccccggtacacagatcactttccctcctagaccatataattccgcaagcatgtctcctgggcatccaacacacctcgccgcagcagcctctgcagagcgggagcgggagagagagagggagaaggagagggaaagggagaggatcgcggccgcttcttccgatctatacctgagacctggctcagaacagcccggacgacccggcagccacggctatgtgaggagcccgtctccttccgtgagaacccaagaaaccatgctgcagcagaggccaagcgtctttcaggggacgaatggcacaagcgtgatcaccccattggaccctacggcccagttgaggataatgcctctgcctgctggaggcccttctataagtcaggggctgcctgcttccaggtacaacaccgcggctgacgctctggcagctcttgtggacgcggccgccagcgccccacagatggacgtgtcaaagactaaggagagcaagcacgaggcagcccgcctggaagagaacttgcggtctagaagcgctgctgtgtccgagcagcaacagcttgagcagaaaactctggaggttgagaagcggtctgtgcagtgtctgtatacatcgagcgcttttccatccggcaaaccacagccacactcatcagtagtgtactccgaagcagggaaggataaaggaccccctcctaaatcaagatacgaggaagaattacggactcgtggcaagactacaatcactgcggccaattttattgatgtcatcatcactagacagattgcctccgataaggacgctcgggaaaggggcagccaatcctccgatagcagttcctctctgtccagccatagatacgagacaccgtctgatgctatagaagtgatcagtccagcttcaagccccgcaccacctcaggaaaagctgcaaacctatcagcccgaagttgtcaaggcgaatcaggcggagaacgatccaaccagacagtacgagggcccgttgcaccactacagaccccaacaggagtccccaagccctcagcagcagttgccaccttcctcacaggctgaaggcatgggtcaggtccctaggacccaccgactcataaccctcgctgatcatatttgtcagatcattacccaggattttgcgcggaaccaagtgtcgtcccagactccgcagcaacccccaaccagtacattccaaaacagcccctccgcgctggttagcactcctgtgcgcacaaaaaccagcaaccgctatagtccagagagccaggctcaatctgttcatcaccagcgtcctggatcccgcgtcagcccagaaaatctggtggataaatcccgggggagccggccaggtaagagccctgaaaggtcacacgttagctctgagccctatgagcccatctcacctccacaagttccagtggtgcacgaaaaacaggatagcctgcttctgctctctcagaggggcgccgaaccagcagagcagcggaacgatgcgcgtagtcccgggagcatcagctatttgccttcttttttcactaagttggagaataccagcccaatggtcaaaagtaaaaaacaagaaatcttccggaagctgaattcatccggtggaggagacagcgacatggccgctgctcaacccggcaccgagatcttcaacctgcctgcggttacaactagtggcagtgtctcttcccggggacatagttttgccgaccccgcctctaaccttggcctcgaggacataattaggaaggccctaatgggctcttttgatgacaaagtggaggaccacggcgtggtcatgtcccaacctatgggcgtcgtcccaggaactgctaatacctctgtagttacttcaggcgagaccagacgggaggagggggacccctcccctcatagtggggtttgcaaacccaagctcatttcaaaatccaactctagaaaatctaagagccctatccctggccagggttatctcgggacagaacgtccatcttccgtttcatcagtacatagcgagggagattatcaccgccagactcccggctgggcatgggaagataggccctctagcacaggcagcacacagtttccctataatcccctcactatgcggatgctgtccagcacaccgcctacacccatcgcttgcgccccatctgctgtaaaccaagctgccccccaccagcagaacaggatatgggagcgcgagccagcccctttgctgagtgctcaatatgaaactctaagtgacagcgatgactag

SEQ ID NO: 15962 - DNA, 7014 bp, Artificial Sequence
  Description of Artificial Sequence: Synthetic coding sequence
atgagctcctctgggtatccacccaatcagggcgctttttcaaccgagcaatccaggtacccacctcattccgtgcaatatacctttcctaatactcgccaccaacaggagtttgccgtgccagattatcggtccagtcacctggaggtgtctcaagcatcccagcttctacaacaacagcagcagcagcagctgcggaggaggccatcccttctgtctgaatttcaccccggctctgaccgccctcaggaaagaagaacatcttacgagccttttcaccccggaccctctcccgtggaccatgattccctggaatcaaaacgcccgagactggaacaggtgtccgacagccatttccagagagtctcggctgcggttctaccgcttgtccatcctctcccagaaggtcttcgagcctcagctgatgcaaaaaaggacccggcctttggaggaaagcatgaggcaccatcttcacccattagcggccagccatgtggggatgaccagaacgcttcaccaagtaagttgtctaaggaggagctcatacagtcaatggaccgagttgacagagaaatcgccaaggtcgagcagcaaatccttaagcttaagaagaagcagcagcaactggaggaagaggccgccaaaccgcccgaacctgagaagcctgtcagcccgcccccggtggagcagaaacatcggtccatcgtccaaatcatttatgacgaaaacaggaaaaaagcagaggaggcacataaaatttttgagggactgggtcccaaggtggagctaccactctacaatcagccttccgatacaaaagtctaccatgagaatattaaaaccaaccaggttatgcgcaagaaattaatcttattcttcaagcggagaaaccatgctcgcaagcaacgggagcagaagatatgccagagatatgaccagctgatggaggcctgggagaagaaggtggatcgcatcgagaataaccctcggcggaaggcgaaagagtcgaagacccgggagtattatgagaaacaattccctgaaatcaggaagcagagggaacagcaggagagatttcagcgtgtcggacagaggggggcgggactcagtgccactattgccagaagtgagcatgaaataagcgagatcatcgatggcctgtccgagcaggaaaacaacgagaaacaaatgcgtcagctgagcgtgatccctccaatgatgtttgatgccgaacagagacgagtgaagtttattaatatgaacggcctcatggaggatcctatgaaggtctataaggataggcagttcatgaacgtgtggacagaccatgaaaaggagattttcaaagataaattcatccagcatccaaagaattttggattgatcgcctcctacctggagagaaagagcgtgccagattgtgttctgtattattatttaaccaaaaagaatgagaattacaaggcactggtgaggcgtaactacggaaagcggaggggacgcaaccagcagattgccaggccctctcaagaggagaaagtcgaagaaaaggaagaagacaaggcggagaaaacagagaaaaaggaggaggagaaaaaggacgaggaggaaaaagacgagaaggaggatagtaaggagaacaccaaagagaaggataagatagatggaacagccgaggagaccgaggagagagaacaggcaaccccccgaggacgcaaaacagccaactcccagggtcgcaggaagggacgcatcacgcggagtatgactaatgaggcagcggccgcctccgccgccgccgccgcggcaacagaagagcctcctcccccactaccccccccacctgaacccatctcgactgaacccgtggagacgagtcgctggacggaggaggaaatggaagttgcgaagaaaggattggtggagcatgggcggaactgggccgcaattgctaagatggttggaaccaagagcgaagcccagtgcaagaacttttacttcaactataagcgcagacataatctggataatcttctgcaacaacacaaacagaagacgtcaagaaagccacgcgaggagagagacgtctcacagtgtgaatctgtcgccagcacggtgagtgcacaagaggacgaggacattgaagcatctaatgaagaggagaatcccgaggacagtgagggtgccgaaaattcatcggataccgagagtgcaccaagtccatcaccggtagaggccgttaagccgagcgaggactccccagaaaacgcaacttcaaggggtaacacagagcccgctgtggaacttgagcccacaaccgagaccgcaccttctaccagcccttctctcgccgtgcccagtacgaagcctgccgaggacgagagcgtcgaaacgcaggtcaatgactcaatttctgctgaaaccgctgaacaaatggacgttgatcagcaggaacactctgccgaggagggctcagtctgcgatcctccgccagccaccaaggcggacagcgtagatgtggaggtacgagtccctgagaaccatgcaagtaaagtcgaaggtgataataccaaagaacgggacctggatagagccagtgagaaggttgagcccagggatgaagatctggtggtggcccagcagatcaatgcccagcgtcctgagcctcagagtgacaatgactcatccgccacatgcagtgccgatgaagacgtcgatggagaacccgagcgtcagcggatgttcccgatggacagcaagccctccttattaaacccgaccggaagcatcttggtgagctctcccctcaaacctaatcctctcgatctgccacagctacagcatcgggccgcagttataccacccatggtttcgtgcaccccttgcaatatccccatagggactcctgtaagtggctatgcactgtaccaaaggcacattaaagccatgcatgaaagtgccctcctggaggaacagcggcagaggcaggagcagatcgatcttgaatgccgtagctctacctctccctgcgggacatctaaaagcccaaatagggagtgggaggtccttcagcccgcaccacaccaggtgattaccaatttaccagagggcgtcagactgccgaccacgagacccaccaggccaccccccccactaataccctcgagtaagacgaccgtggcctcggagaaaccttcattcatcatggggggcagtatttcgcaaggtacccccggcacatacctgacctctcacaaccaggccagctacacacaagaaacacccaaacccagcgtcggctcaatctccctcgggctgcccagacagcaggaaagcgcgaaaagtgctactttaccttacatcaagcaggaggaatttagccccagatctcagaacagccagcctgaaggcctattagtccgcgctcagcacgagggcgttgtgaggggcacggccggggccatccaggaaggaagcatcacccggggtacccctactagtaaaatttcagtggaatcgatccctagtctccgtgggagcatcacgcagggcacaccggcactgccgcagacaggtattccaacggaagcactggtcaaaggctccatttccagaatgcccattgaagacagtagccccgagaaagggagggaagaagctgcttcgaaaggtcacgtcatttatgagggtaagagcgggcatattcttagctacgacaacattaagaatgctagagaaggcacaaggtcgccacgcactgctcacgagataagtctgaaaaggtcatacgaatctgtggagggtaacattaagcagggcatgtcaatgagggaatcgcctgttagcgctcccctggagggactgatctgtagagcactgcccaggggttcacctcacagtgaccttaaagagagaactgtgctgtctggcagcattatgcaaggcacaccgagggccaccactgagagcttcgaagacgggcttaaatatccaaaacagatcaagagagagtcccccccaatccgggccttcgagggtgcgataacgaagggcaagccttatgatgggattactacaatcaaggagatggggaggtctattcacgagataccgaggcaagacatcctcacacaggagtcccgaaagacccccgaagtggtccaaagcactcgacctatcatcgaaggcagcatttctcaaggtacacctatcaaattcgacaataatagcgggcagagtgctattaagcataatgtcaaatcactgattacaggcccttcaaaactttcacggggtatgcctcctctggaaattgtgccagaaaacatcaaggtggttgagagaggcaaatatgaggatgtcaaagccggagagaccgtaagaagccggcatacttctgttgtctccagcgggccttctgttctgagatcgacactgcatgaggccccaaaggcgcaattgtctcctggaatttacgacgacacctccgcgcgaaggactccggttagttaccagaacaccatgagcagggggtcccccatgatgaatcgaactagcgacgtgaccatttcctcaaacaaatcaacaaaccacgaacgtaagagcaccctcacccccacccaacgcgaaagtattcccgccaagtctcctgtgccaggcgtagaccctgtggtgtcgcactcaccctttgatccgcaccatcgtggctctacagcgggtgaggtataccggtcccacctgccaacgcacttggatcctgctatgccattccaccgtgccctagatcctgcagctgctgcttatctcttccaacgccagttatccccaacacctggctaccctagccaataccagctgtatgccatggaaaatacacgccagacaatattgaatgattacatcacaagccagcaaatgcaggtgaatctacggcctgacgtggcccgcggcctgtctccccgtgaacagcccctggggctgccgtatccagcgacaaggggtatcatcgatctcactaacatgcctcctacaatcctagttccgcatcctggaggtaccagcacccccccgatggacagaatcacctatattcccggaacccagattacatttccaccccgcccttacaacagtgcatcaatgagtcctggccaccccacccatctggcggccgcagcctccgccgagcgtgagcgggaacgagagcgcgaaaaagagcgggagcgtgaaagaatcgccgctgcatcatctgatctctatctgaggcctggatccgagcagcccgggcgccccggatctcacggatatgtgcgttctccctcgccatcagtcaggactcaggagaccatgcttcagcagcggccttccgtcttccaggggacaaacggaacttctgttataacccccctagaccccaccgcccagctgagaatcatgccactgcctgccggcgggccatctatctctcagggactgcctgcctctaggtataataccgccgcggacgccctggccgccctcgtggatgctgctgctagcgcaccacaaatggatgttagcaaaaccaaggagatttctagccacaggtatgaaacaccatccgatgctatcgaagtcatttcaccagcctctagtccggcacccccccaagagaaactccaaacataccagccggaagtagtgaaagcaaatcaggccgagaatgaccctactaggcaatatgaaggccccctgcatcattacagaccacagcaggaatccccaagcccacaacagcagttgcctcctagtagtcaggcagagggaatgggccaggtgccacgcacccatcgccttatcaccctggcggaccacatctgccagatcatcactcaggattttgctagaaaccaagtttcaagccagacgccccaacaaccccctactagtaccttccaaaatagcccgtctgcgctagtctctacacccgtgagaacaaaaacctccaaccgctacagtccagaaagccaagcccagtcggtccatcatcaacgacccgggtcgagagtttcccctgagaacctggtggataagtctcgcgggagccggcctggcaagtctccagaacggagccacgtgagcagcgagccttacgaacctatctccccaccacaggtgcccgtcgttcatgagaaacaagattcactgctcctcttgtcccagcgcggcgcggaacctgccgaacagaggaatgacgcaagatcccctgggtcaattagctacttaccaagtttttttacgaaactggaaaatacgtcgcctatggtaaagtctaagaaacaggagatttttcggaagctaaattctagcggcggcggcgacagcgacatggccgcggctcagcctggcaccgagatttttaacctccctgctgtgacaacctcgggatccgtcagcagtagaggacacagcttcgctgaccccgcctcgaacctaggacttgaagatatcatccggaaggccttgatgggtagtttcgacgacaaggtcgaggatcatggagtcgtcatgtcccagccaatgggagtggtccctgggactgctaacacctccgtggtcacatccggtgaaacacgaagagaagaaggggatcctagtccccatagcggaggcgtgtgcaaacccaagcttatatcgaagtccaacagtcgaaaatctaagagtccaatccccggacagggttatttaggaacggagcggccttcatctgtaagctccgtgcactccgaaggcgattaccaccgccagacgcctggttgggcatgggaagaccgaccttccagcacgggctccactcaattcccttataaccctctcactatgcgtatgctcagctcaacgccacctaccccaattgcatgtgcaccaagcgctgtgaatcaggccgcccctcatcagcagaaccggatttgggagcgagagcccgccccactgctttccgcgcagtatgagactctgtccgactctgacgattag

SEQ ID NO: 15963 - DNA, 3075 bp, Artificial Sequence
  Description of Artificial Sequence: Synthetic coding sequence
atgcctccgcttgaaattgtgcctgagaatatcaaagtggtcgaacgcggtaaatatgaggacgtgaaggccggcgaaacggtgcgcagcaggcacacttcagtggtgtctagcggtcccagtgtgctgaggtccacactgcacgaggcacctaaggcacagctgagccccgggatttatgacgatacctcagcacgtcgaactcctgtgtcatatcagaacactatgagcagaggaagcccgatgatgaaccgaacttctgacgtcacgatttcttctaacaagagcacaaatcatgagcgaaaaagcactctgaccccaacgcagagagagagtatccctgcgaagagtcccgtgcctggcgtggatcccgtggtgagccacagtccattcgatcctcaccatagagggtcaaccgccggcgaggtttaccgatcacatcttccgactcatctcgatccagccatgccttttcaccgcgccctggaccccgctgctgcagcctacttgttccagagacagttgagccccaccccaggctacccatcacagtaccagttgtatgctatggaaaatactcgccaaactatcctgaacgattacataacttcccagcagatgcaggtcaacttaaggccagacgtcgccaggggcctgtctccaagagaacaacccctggggttaccataccccgctactcgaggcataattgacctgaccaacatgccgcctaccattctcgtgccgcacccaggcggtacttcaactcctcctatggaccgtatcacgtacataccaggcacccaaataacattcccgccacgtccatacaattccgcaagcatgagtccaggacatcccacccaccttgcagccgccgcatcggccgaacgggaacgcgagagggagagggaaaaggaaagagaacgggagcggatcgccgctgcaagcagtgacctgtacctgagacccgggagtgagcaacccggaagacccggatctcatggctacgtacgctcgcccagtcctagtgtccgcacccaggagacaatgctgcagcaacgaccttccgtgttccaaggcaccaatggtacctccgtgattacacctctggaccccaccgcacagttgcgcatcatgccactgccggccggtggaccatccatatctcagggccttcctgcctctcgctacaatactgctgcagatgccttagccgcgctggtagatgctgccgcctctgctcctcagatggatgtttctaagacaaaagaaagtaagcacgaggctgcccgcttagaggagaatctgcgcagtcggtcagctgcagtttccgagcagcaacagcttgagcagaagactctagaagtggagaagcgaagcgtgcaatgcttatatacctcgagtgctttcccctctgggaagccccagccccactctagcgtggtgtactcagaggccggcaaggataagggcccacctcccaagagtcggtatgaagaagagctccggacccgaggaaagaccaccattacagcagccaacttcatcgatgtaatcattacaaggcagattgcttcggacaaggacgcgcgcgagagaggtagtcagagctctgacagtagcagctcactgagcagtcaccgttacgagacgccgagtgatgcgattgaagtaatctccccagcttcctcaccagccccacctcaggaaaagcttcaaacataccagcccgaagtcgtcaaggctaaccaagccgagaacgatccgaccagacagtatgagggacccctgcatcactatagaccccagcaggagtctccgtccccccaacagcagctgcctccatccagtcaggcagaaggcatggggcaggtgccacgcactcacaggttgataaccctcgctgatcatatctgccagattattacccaggatttcgcccgaaatcaggtgagttcccagacaccacagcaaccacctacctctaccttccagaactcaccctccgcactcgtctccacccccgtaagaaccaagacgagtaaccgatactcccccgagtcgcaagcacaaagtgtgcatcaccagaggcccgggtcaagggtttcccctgaaaacctggttgacaagagcaggggcagtcggcccgggaaatcccctgagcggagccatgtgtcttccgaaccctacgagcctatcagccctccgcaggttcctgttgtccatgaaaaacaggattcgttgctgcttttgagccagaggggagccgaacctgccgaacaaagaaacgatgctcggtcacctggctcaataagttatctcccctccttctttacaaagctggaaaacactagcccaatggtgaagtccaaaaagcaggagatctttcggaagcttaatagttctggtggcggggattctgatatggccgctgcgcagccaggtactgaaatcttcaacttaccggctgttacaacctctgggtctgtatcctcacgcgggcactcattcgccgatcccgctagtaatctgggacttgaggatataatccgaaaggccctgatggggtcttttgacgacaaagttgaagatcacggcgtggttatgtcccagcctatgggcgttgtaccaggaactgctaacacatccgtggtcacatcaggcgagactcgacgggaggaaggcgacccttctccacactccggcggcgtctgcaagccaaaattaataagcaaatctaattccaggaaaagtaagtctcccattccagggcagggctacctgggaactgagaggccctcgagcgttagctccgtacactccgaaggggactatcaccgacagacccctggatgggcatgggaggataggccgagctctaccggctccacacagtttccttacaaccccctgacaatgagaatgctttcatccacccctccaactccgatcgcatgtgctccgtctgccgttaatcaggcagccccacaccagcaaaaccgcatctgggagcgtgagcctgcccccctcctgtcggcgcaatacgagacgctgtcagattccgacgattag

SEQ ID NO: 15964 - DNA, 4821 bp, Artificial Sequence
  Description of Artificial Sequence: Synthetic coding sequence
atgttgttgcatctctgctccgttaagaatctgtatcagaataggttcttgggactggccgccatggcgagtccctccagaaactctcagtcacgtcgtcgctgtaaggaaccactacgatattcatacaatccagaccagtttcacaatatggatctacgaggagggcctcatgacggagtcaccattccccgatcaacatctgatacagacttggtgacatctgattcacgcagcacactgatggtttcttcatcctactatagcatcgggcactcccaagacctggttatacactgggatataaaggaagaggtcgatgccggtgattggatcgggatgtatctcatcgatgaggtgttgtcagagaactttctcgactacaaaaatagaggggtcaacggctctcatagagggcaaatcatctggaaaatcgacgcgagctcatacttcgtggaaccagagacaaagatctgcttcaagtactatcacggtgtgtctggcgcactacgggctacgacccccagtgtgaccgttaagaactctgccgcacccatcttcaagtccatcggtgccgacgaaaccgtccagggacagggctcaagacgccttatttcttttagcttatctgacttccaagccatgggattgaagaaaggaatgttcttcaatccggatccttacttaaagataagcatccagccaggcaagcacagcatcttccccgcgctgccacaccacgggcaagagcgccgctccaaaataataggtaacacggtgaatcccatttggcaagctgaacaattttccttcgtctccctgccgaccgatgtcctcgagattgaggtcaaggacaagttcgcgaaatctcgaccgatcattaaacggttcctgggcaaattgtctatgccagtgcaaaggttgctggagcgtcacgcaattggcgatagagtcgtttcatatacactgggccgccgacttccaactgatcacgttagcgggcaacttcagttccgcttcgaaattacgagctcaatacaccctgatgacgaggagatcagcctttcaaccgagccggaaagtgcacagattcaggattcaccaatgaataacttgatggaatcaggttccggagagcctagaagtgaagcgccggaaagcagcgaaagctggaagcccgagcagcttggggagggctctgtcccggacggaccggggaatcagagcatcgagttgagtagacccgctgaggaggccgccgtgattacagaggcgggggatcagggcatggtaagcgtggggccagaaggggctggtgagctgctggcccaagtgcaaaaggacatccaacccgctcccagtgctgaggaactggccgagcagctggacctgggagaagaagcttctgctctcctccttgaggacggggaagctcctgcctccaccaaagaagagccacttgaggaggaagcgactacgcagtccagggccggccgcgaggaagaggaaaaggaacaggaggaggagggggacgtaagcaccctggagcagggggaaggaaggcttcaattacgggcaagcgtgaaacgtaagtccagaccatgtagcctgcctgtctcggaactggagactgtcattgcatctgcctgcggagacccagagaccccaaggacccattacatcaggattcacacgctcctgcactctatgccctcagctcagggcgggtccgctgctgaagaggaggacggcgccgaggaagagagtacactaaaagactcatctgaaaaggacgggctttccgaggtggacaccgtcgcggctgacccttcagcccttgaggaagaccgtgaggagcccgaaggtgccacaccggggactgcgcatccaggccacagcggcggccacttcccttccctggccaatggtgcagctcaagacggggacactcatccatcaacagggtcagagagcgatagcagcccacggcagggtggtgaccattcctgcgagggatgcgacgcctcgtgctgttccccttcttgttattcctcttcctgctattccacttcctgttatagctcatcatgttactctgcatcttgctactctccctcgtgttacaacggtaatagattcgcttcacatacaagattttcaagtgtggacagcgctaagattagcgagtctacagtattctcttcacaagacgacgaggaggaggagaattctgcttttgaatccgtgcctgactccatgcagtccccggagctggacccagagagcacaaatggtgccggaccatggcaggacgaactcgcagccccttctgggcatgtcgagaggtccccggaaggactagaaagcccagtcgcaggcccgtcgaataggcgagaaggggaatgccctattctgcacaactcccagcctgtgtctcaactcccctccctgaggcctgagcatcaccactaccccacgattgacgaacccctcccgcctaactgggaagcacgaatagattcccatggccgagtgttctatgtcgaccacgtgaatcgtacgacgacttggcaaagaccaaccgccgctgctaccccggacggaatgcgcaggtcaggatctatccagcaaatggagcagctgaatcgcaggtaccagaatatccagaggactatcgcaaccgaaaggtcggaggaggatagtgggagtcagagttgtgagcaagctcctgcaggcggcggcggagggggtggctccgatagcgaggccgagagtagccagtcatcacttgacttgaggagggaagggagtctaagccctgtcaattctcaaaagatcactctgttgttgcagagcccggcagttaaattcatcacgaatcccgagttcttcactgttctgcatgccaattacagtgcataccgcgtttttacctcaagcacctgccttaagcatatgatcctcaaagtgcgccgggatgcaaggaattttgagaggtaccagcacaatcgcgacctagtaaattttatcaacatgtttgctgacacccgacttgaactccctcggggttgggaaattaagaccgatcaacagggtaagtcattctttgtggaccacaactctcgcgctacaacgtttattgatcccaggatccctctgcagaacgggagattgccaaatcatctgacacataggcagcacttacagcggttgcgcagctatagcgctggcgaagcatctgaagtctctcgaaatcgcggggctagccttttggctaggccgggacatagcttggtcgcggcaatccggagccagcaccagcatgagtccctccctctggcttataatgacaagatagtggcctttctgaggcaaccaaacattttcgaaatgctacaggagaggcagccctccctggcgcggaaccacacattacgggagaagattcattatattcgaacagagggtaatcacggactggaaaaactgagctgcgatgcggacttggtaattctgttatcactgttcgaggaggagatcatgtcttacgtgccccttcaggcagcattccaccctggctattccttttcccctcgctgtagtccttgctccagccctcaaaatagcccaggcctacaaagagcctctgccagagctccgagtccctatcgacgcgacttcgaggcgaagttgcggaatttttatagaaagctggaggcaaaaggatttggccagggccccggtaagataaagcttattattcgtcgagatcatctgctcgagggtacgttcaaccaggtgatggcctattcacgaaaagaacttcaacgcaacaaactgtatgtgacgttcgttggagaggaaggcttggactatagtggacccagccgtgagttctttttcctgctctctcaggagctcttcaatccctactatgggctattcgaatactctgccaacgatacgtataccgtgcagatctcccctatgtcagctttcgtggagaaccacctcgagtggtttaggttttccggtcgtatcctgggtctagccctcatccatcagtatttgcttgacgcatttttcacccggccgttctacaaagccctgcttcggcttccatgcgacctttcagatctggagtatctagatgaggagttccaccaatcattacagtggatgaaggataataacatcactgatattctagatctaacattcacagtaaatgaggaagtcttcgggcaggtcaccgagcgcgaattaaagagtggtggtgccaatacgcaggtaactgaaaaaaataagaaagagtatattgagaggatggtgaagtggcgggtggagcgtggcgtagtacagcagacagaagcccttgttagggggttttatgaggtggttgactctcggctcgtaagtgtttttgacgcacgtgaattggaactggtgatcgcaggcacagccgaaatcgacctgaacgattggcggaataataccgagtaccgaggcggttaccacgacggacacctcgtcataagatggttttgggctgccgtggaacgctttaacaacgagcagcgtctgcgtctgctccaattcgttaccggcacttccagtgtgccctatgagggtttcgcagccctgcgcggatccaatgggctacgtagattctgcatcgaaaaatggggcaagatcactagtctccctagagcacacacttgctttaatcgactggatctcccaccatacccaagttactccatgctgtacgagaagctcctgacggccgtggaggagacctcgaccttcggcctggaatag

SEQ ID NO: 15965 - DNA, 1209 bp, Artificial Sequence
  Description of Artificial Sequence: Synthetic coding sequence
atggcagccttgtgtcggacagccgaatcacaggcagaactgcagtgcacccaactagacttagagaggaaattaaaactcaatgaaaacgcgatctcccggctgcaggccaaccagaaatcagtactcgtttctgtcagcgaggtcaaggctgtcgccgagatgcaatttggtgagctcctggcagccgtgcgtaaggcccaggctaacgtaatgctatttttggaagaaaaggagcaggccgcactatcacaggcaaatggcattaaagcacacctagagtaccgcagtgccgagatggaaaaatctaagcaggaattggagaccatggctgccatcagtaacacagtgcagtttcttgaagagtattgtaagttcaaaaatactgaggatattactttcccctctgtctatattggcctgaaagacaagctctctggcatccgaaaagtgatcaccgagtcaaccgtccatcttatacagctcctagaaaactataagaaaaaactccaagagttttcaaaagaggaggagtacgatatcaggactcaagtctcagccattgtgcagaggaaatactggaccagtaagcccgagccaagcactcgggagcagttcctgcaatatgtgcacgacataactttcgacccagatacagcccataaatacctaagattgcaggaagaaaataggaaggtcaccaatacgactccatgggaacatccataccccgacctcccaagtcgtttccttcactggcggcaggtcttaagtcaacagtcactttatctccatcgctattatttcgaggttgaaatctttggggcgggcacttatgtaggactgacgtgcaagggaattgatcagaagggcgaagaacggtcctcctgcatttcgggaaacaatttttcatggtcactgcagtggaacggtaaggaatttactgcttggtactcagatatggaaacacctctgaaggcaggccccttctggcggttgggtgtgtatatcgacttccccgggggcatactgtccttttatggtgtagagtatgattcaatgacactggtccacaagtttgcatgcaaattctctgagcccgtgtatgcagccttctggctgtccaaaaaagagaacgccatacggatcgttgatctgggtgaggaacccgagaagccagcgccgtctctggtgggcacggccccttag

SEQ ID NO: 15966 - DNA, 1677 bp, Artificial Sequence
  Description of Artificial Sequence: Synthetic coding sequence
atgcacagatcggccccttcacagactacaaagaggtccagatcacctttctctacaactaggcgctcttgggatgatagcgaatcgagtgggactaatctgaatatcgacaacgaggactattcccgttaccctcctagggagtatcgcgccagtggcagccgtcgcgggatggcctacggacatattgattcatatggagctgacgattcggaggaagagggagctggccctgtggaacgcccaccagtgagggggaaaacaggcaagtttaaggatgacaaactgctcgaccccgtgccagccgcgagatgttctgcatctcgtgctgacttcttgccacagtccagcgtcgcaagtcaatcttcgtctgagggtaaattggcaaccaaaggggacagcagtgaacgagaacggagggagcaaaacctgcccgccaggccaagccgcgcgcctgtgtctatctgcggagggggagaaaatacttccaaatctgcagaggaacctgttgtccgccctaagatccgaaacttggcctcacccaactgcgtcaagcccaaaatcttttttgataccgacgacgacgacgatatgcctcacagcacatctcgctggcgtgacacagctaatgataacgagggacacagtgacggtctggcgagaagaggcaggggcgaatctagttctgggtatccagagcccaagtaccccgaagacaaaagagaggcaaggagtgaccaggttaagcccgagaaagtcccccgcagacgacgtacaatggccgacccagacttctggacacactcagatgactactataagtattgcgatgaggatagtgacagcgacaaggaatggatcgccgctctgagaaggaagtacagatcgagggagcagaccttatcgagttctggagagtcatgggagaccctgcctgggaaggaagaacgtgaaccacctcaggccaaggtttccgcgagtacgggcacctcgcctggccccggcgcatctgcttctgctggggccggagccggcgcgtctgcaggtagtaatggctctaactacttggaggaggtgagagaaccttcattgcaggaggagcaggccagcctggaagagggcgaaattccgtggctgcagtaccacgagaatgattcttcttcagagggggacaatgattctgggcacgagctgatgcaacccggcgtcttcatgttggatggtaataataacctcgaggacgacagctcagtgtctgaggacctagaggtggattggtccctcttcgatggttttgcagacggcctgggcgtagccgaggccatcagttatgtggaccctcaatttttgacgtatatggctcttgaggaacgcctggcgcaagccatggaaacagcactagctcaccttgagtccttggccgtcgatgtggaagtggctaaccctccagcctcaaaggaatccatcgatgcattgcccgaaatattagtgaccgaggatcacggagccgttggccaggaaatgtgttgtcccatctgttgttctgaatatgtcaagggggaagtggccactgagctgccctgccatcattactttcacaaaccttgcgtgtccatttggttacagaagtctgggacgtgccctgtttgtcgctgcatgttccctcctccactttag

SEQ ID NO: 15967 - DNA, 3591 bp, Artificial Sequence
  Description of Artificial Sequence: Synthetic coding sequence
gtacctccttgtcctgctgagctccgctcagtcactaacggacaatccaatcagcccagcaacgaaggcgatgctatcaaggtgttcgtccgaataagaccacctgctgagaggtcaggttccgccgacggggaacaaaatctttgccttagcgttttgtctagcaccagtctgcgtctgcattctaaccctgaaccaaagacttttactttcgaccatgtcgccgacgtggacacaacacaggagagtgtgttcgcaaccgtcgctaagtccatagtggagagttgtatgtccggctacaatggcacaatttttgcctatgggcagactggaagcggtaaaactttcactatgatgggcccctccgaaagtgataacttcagtcacaacctgagaggcgtcataccacgcagttttgagtacctgttctctctcatcgatcgggaaaaagaaaaggctggcgctgggaaaagtttcttatgtaagtgttcattcatcgaaatctacaacgaacagatttacgatctcctggattcggcttccgccgggctctatctgagggagcacatcaaaaagggtgttttcgtggtgggcgcggtggagcaggtcgtcacatccgcggctgaagcatatcaggtactttcggggggttggaggaatcgccgcgtggcgtccacctcaatgaatcgtgaatcaagccggagtcatgctgtgtttacgatcacaattgagtcaatggagaaatccaatgagatagtgaacattcgcacttcactactgaacctggtggatctcgccggatcagagcgccaaaaagacactcatgccgagggtatgcgtctaaaggaggcggggaacatcaatcgatctctgtcttgtctcggccaggtcatcaccgcgctggtggacgtggggaacggcaaacaacgccacgtttgttaccgggacagcaaactaacctttctgctgcgcgatagcctcggcgggaacgccaagaccgcgatcattgcaaatgtgcaccctgggagccgctgttttggcgagaccctgagtaccctaaatttcgctcagagagccaagctgatcaagaataaagccgtcgtgaatgaagatacccaaggaaatgtttcacaactgcaggcagaggtcaagcgtctgaaggaacaactcgccgaactggcctccggccagacacctcccgaaagtttcttgactagagacaagaagaagaccaattatatggagtattttcaggaggccatgcttttttttaagaagtctgagcaggaaaaaaaaagtttgatcgagaaggtgacacagctcgaagacttgacactgaagaaagagaagttcattcaatccaataaaatgatcgttaagttcagagaggatcagattatcagactggaaaagctccataaagagtccaggggagggtttctgcccgaggagcaagatcgcctcctgtcggagttgaggaatgagatccaaacacttcgggaacagatcgagcatcacccccgcgtggctaagtacgccatggagaaccacagccttcgggaagagaaccggaggctgcgtctgcttgaacctgtgaagcgagcccaggagatggatgcacaaaccattgctaaactggagaaagcctttagtgagatctctggcatggagaagtccgataaaaaccagcagggattcagtccaaaggcccagaaggaaccatgtctatttgccaacactgagaaactgaaggctcagctcttgcagatacagaccgaactgaataacagcaagcaggagtacgaagagttcaaggaactcactcgcaagagacagttggagctcgaatcagagctacagtcactccagaaagctaacctgaacctggagaatttactggaggccactaaagcatgtaaacggcaagaggtctcgcagctgaacaaaatccatgctgaaaccctgaagatcataaccacccccaccaaggcttaccaactacattctaggcctgtccccaagcttagtcccgagatgggaagttttggcagtctgtacactcagaattcaagtatactagataatgacatcctaaacgaaccagtcccccccgaaatgaacgaacaggcatttgaagcaattagtgaagagctgcggactgtgcaggaacagatgagtgcgttacaggccaaactcgatgaggaagagcacaagaacctcaaactccagcagcacgtggacaaactggagcaccactcaacccagatgcaggaactcttcagctccgaacggatcgactggaccaagcagcaggaggaactgttgtctcaactgaacgtccttgaaaagcagctccaggagacccagaccaagaacgatttcctgaagagcgaggtgcacgacctgcgagtagtccttcacagcgcagacaaggagctttcatcagttaagctggaatattcctcctttaagacgaaccaggaaaaggaattcaataaattgtcggaaagacacatgcacgtccagcttcagcttgataatcttagactggagaatgagaagcttcttgagtctaaagcgtgtctgcaggactcttacgacaacttgcaggagattatgaagtttgagatcgatcagctgtcaagaaacctgcaaaactttaagaaggaaaacgaaacactgaaatcagacttgaataatctgatggaactgctcgaagcggagaaggaaagaaacaacaagctcagcctgcagttcgaggaggataaagaaaatagtagtaaggaaatcctgaaagtcctcgaggccgtgcggcaggaaaaacaaaaggagaccgcgaaatgcgagcagcaaatggcaaaggtccagaagctggaggaatcactactcgccaccgagaaggtgatttcttcactcgagaaatcccgggattcagataaaaaggtagtcgcagatctgatgaatcagattcaggaactaagaacttccgtatgcgaaaagacagaaacaatagataccttgaaacaggagttaaaagatattaattgtaaatataactccgcactggtcgatcgcgaggagtctcgagtgctgatcaaaaagcaggaagtggacatactagacctcaaagaaacgctcaggctgcgaattttgagcgaggacatcgaacgcgacatgttgtgtgaggacttggcacacgcaacggagcagctgaatatgcttactgaggcctcaaagaagcattcgggactcctccagtccgctcagcgcactgaccaggagggctcaccagatagtgggacgagcgcgcaggccaaacccaaggagcgtggttcgaggaccgaagaggagtataactttaagatgcggcagctcgagcacgtcatggattcagcggcggaggacccacagagccctaagactcccccccactttcaaacacacctcgcaaaacttcttgagacccaggagcaggagattgaggatgggagagcgtctaaaacttccctggaacatttggtgactaaactgaacgaggatcgcgaggtgaaaaatgctgagatcctgaggatgaaggagcagctccggtag

SEQ ID NO: 15968 - DNA, 3264 bp, Artificial Sequence
  Description of Artificial Sequence: Synthetic coding sequence
atggatccattcactgaaaaattgctggaacgaactcgggccaggcgggagaacctgcagcgcaaaatggcagaacgtcctactgcagcgcccagaagtatgactcatgccaaacgcgcgcggcaacccctctccgaggctagtaaccagcagcctctgtccggaggagaagagaaatcctgcaccaagccatctcccagcaaaaagcggtgttcagataacactgaggtcgaagtgagcaatcttgaaaacaagcagcctgtggagtctacttccgcgaagtcgtgcagccccagtccagtcagtccgcaagtccagccacaggcagccgatacaattagcgactccgtcgccgtgcccgcatcattgttggggatgcgaagaggactcaacagcaggcttgaggccaccgccgcctccagtgttaaaacgaggatgcagaagcttgcggaacagagaaggcgatgggataatgacgatatgaccgatgatatacccgaaagcagcctcttttcccctatgccgtctgaggaaaaagcagccagtccgccaaggcccctattgtcgaacgcttctgcaactcccgtgggtcggcgtggcagactggctaacctggctgccaccatctgcagctgggaggacgatgtcaaccactccttcgctaagcaaaactccgtacaagaacagcccggtactgcctgtctatcaaaattttccagcgcatcaggagcctcagcccggataaacagttcttctgtgaagcaggaggcaaccttttgcagccagcgcgacggagacgccagcctcaacaaagcactgagttctagtgccgatgatgcaagtctggtgaatgcttctatcagtagctctgtcaaagctacgagtccagtaaagtccaccacctcaataacagacgccaagagctgcgagggacaaaacccagagctcctccccaaaacacctatctcgcccctgaaaaccggcgttagcaaacctatcgttaagtcaacattgtcacagactgtccccagtaagggtgagctctcccgagaaatatgccttcagtctcaatcaaaagataaatccaccacccccggagggaccgggatcaaacctttcttggagcgtttcggagaacgatgtcaggagcactccaaggagtcccccgccagatctactcctcacaggacccctatcattactccgaatactaaagctattcaggagaggctcttcaagcaggatacctccagcagcaccactcacctagctcagcagctcaaacaagagagacagaaagagctggcctgtctccggggtcgctttgataaggggaatatatggagtgccgaaaagggtggcaactcgaagtcaaagcagctggagaccaaacaagagacacattgccaaagcacccccctcaaaaagcaccagggagtgagtaagacccagtcgcttccagtgactgaaaaagtgacggaaaaccagattcccgccaagaacagctctaccgagcctaaagaagtgatacgagagatcgaaatgtctgttgatgacgacgacatcaattcttcaaaggtgataaatgatctcttctccgacgttctcgaagagggggagctagatatggaaaaatcccaagaagagatggaccaggccctggccgaatcgtctgaagagcaggaagacgccctaaacatttccagcatgagccttctggcgccgctggcccagaccgtgggagtcgtcagccctgagtctcttgtgagtacacctcgcttggagcttaaggacacatcgcggagcgacgagagcccaaagcccgggaagtttcagcgcacacgcgtacccagggccgaaagcggggacagcctcggcagcgaagatcgagatcttttgtattccatcgatgcttatcgctcccagcgctttaaagaaaccgagcgacccagtatcaagcaagtgatcgttagaaaggaggatgttacttctaaactagacgagaaaaacaatgcgttcccatgtcaagttaacattaagcagaagatgcaggagctgaataacgaaataaatatgcaacagaccgtgatttatcaggcctcccaggctctgaactgctgtgtagacgaggaacatggcaaaggctctctggaagaagcagaagcagagaggctgctgctgattgccaccggcaagcggaccttactgatcgatgaattgaacaagctcaaaaacgagggtccgcagcggaagaataaggcctccccacagagcgaatttatgcctagtaaagggagcgtaactctttctgagataagactgccactcaaagccgatttcgtgtgctctacagtgcagaaaccagatgctgctaattactactacctgatcatccttaaggcaggcgccgaaaatatggtcgctactccacttgcctcgacctcaaattccctgaacggggacgctttgaccttcaccacaaccttcacccttcaggacgtttctaatgacttcgagatcaacatagaggtctatagcctggtccagaaaaaggacccaagtggactcgacaagaaaaagaagacttcaaaatctaaagctataacccccaaaagactgctgacatctattaccacaaaatccaatattcatagcagcgtgatggcctctcctggcggcctctccgccgtccgcacaagcaatttcgcccttgtggggtcttacactctttctctgagttcagtggggaataccaagtttgtgctggataaggtgcctttcctgtcttcactggagggccacatttatctcaagattaaatgtcaggtgaactcaagtgtcgaggagcggggctttttaacgatcttcgaggacgtgtcagggtttggtgcatggcatcggcgctggtgtgttctgtccggtaattgtatcagctattggacatacccagatgacgagaaaaggaagaatccaattggaagaatcaatctggctaactgtacgagtaggcagatcgagcccgcaaaccgggagttctgtgctcggagaaacactttcgagctcattactgttaggcctcaacgcgaggacgacagagagaccctagtgagtcagtgccgagatactttatgtgtgactaagaactggctctccgctgataccaaagaggagagggatctttggatgcaaaaattaaatcaggtgctcgttgacataaggttatggcaaccagatgcctgttataagccaatcggcaaaccttag

SEQ ID NO: 15969 - DNA, 648 bp, Artificial Sequence
  Description of Artificial Sequence: Synthetic coding sequence
atggtctttcgacgcttcgtggaagtgggacgggtggcgtacgtgagcttcggacctcacgccgggaagcttgtcgccatcgttgacgtaattgaccaaaaccgcgctctcgtcgacgggccctgcactcaggttcgacgtcaagcaatgccatttaaatgcatgcagctgacagatttcatcttaaagtttccacattccgcacatcagaaatacgtccgccaggcgtggcagaaagctgatatcaataccaaatgggccgcgacaagatgggctaaaaagattgaggcccgcgagagaaaggccaagatgaccgatttcgaccgttttaaggtcatgaaggccaagaaaatgcgcaacaggattattaaaaatgaggtgaaaaagctgcagaaagccgccctactcaaggccagtccaaaaaaggcacccggaaccaaggggacagctgccgccgccgctgccgccgctgctgcaaaagttcccgccaagaaaataactgccgcaagcaaaaaggctcccgctcagaaggtgccggctcagaaagctacggggcagaaggccgcacccgcaccaaaggcgcagaagggacagaaagccccagcacagaaagcaccagctcccaaagctagtggaaaaaaggcatag

SEQ ID NO: 15970 - DNA, 2976 bp, Artificial Sequence
  Description of Artificial Sequence: Synthetic coding sequence
atggaggaatatgagaaattctgcgagaagtccctggctcgcattcaagaggccagcctcagcacggaatctttcctgccagcccagtcagagtcgattagcctcatccggttccacggagtcgcgatactatctcctctcttgaatatcgagaaaaggaaagagatgcagcaggaaaaacagaaggcactagacgtggaggctcgaaagcaggtgaataggaagaaggcccttctcacaagggtgcaagagatcttagataacgtgcaagtccgcaaggccccaaatgctagcgacttcgatcaatgggaaatggaaactgtttatagcaattcagaggtgcgaaacttaaatgtgccggctactttcccgaattcgttcccatcacatacagagcactccactgcagccaagctagataagatcgctggaatcctgcccctcgacaatgaagatcagtgcaagaccgatgggattgacctggcacgcgactcagaaggatttaattcccccaaacagtgcgatagcagcaatatcagccacgtcgaaaatgaggcctttcccaaaacctctagtgcaactccgcaggaaaccttgatctctgatggcccattcagcgtcaacgaacagcaggatctgccactgcttgccgaggttatcccagacccgtatgtaatgtccttgcaaaacttaatgaaaaagtctaaggagtatatcgagcgcgagcaaagtagacggtccctgcgcggcagcattaataggatcgtaaacgaaagccatctcgataaagagcacgacgccgtggaggttgccgactgcgtgaaggaaaaagggcagctgaccgggaagcactgcgtctccgttatccccgacaaacccagtctgaataaaagtaacgtcctcctgcagggcgctagcacacaggcctcatctatgagtatgcctgtactggcctctttcagtaaggttgacattcctattaggactggacatccaaccgtcctggagtccaacagcgacttcaaagtcatccccacttttgtgaccgaaaacaatgtgataaaaagtttgaccggtagctatgccaagctcccctctcccgaaccttcaatgagtcctaagatgcatcgccgacgtagccggacctctagcgcttgtcacatactgattaataaccccatcaacgcctgcgaattgagcccaaaaggcaaagaacaggcaatggatcttattattcaggacacagatgagaacactaacgttcccgagattatgcccaaattgcccacggaccttgcaggtgtctgtagctccaaagtttacgtcggaaaaaataccagtgaagttaaggaggacgtcgtactcggtaaatcgaaccaggtgtgtcagtcctccggaaaccatctggagaataaagtgacccacgggttggtgactgtagaaggacagttaacgtctgacgagcgaggggcccacattatgaactcaacgtgtgccgctatgcctaaactgcacgagccttatgcaagttcccaatgcatcgcgtcaccaaatttcggaacggtatccggtctgaaaccagcaagtatgctggagaagaattgttctctgcagaccgagctgaataagtcctacgacgtgaaaaaccccagtcccctcctgatgcagaaccagaacactcgacagcagatggatacccccatggtgtcctgtggtaacgagcaatttctggataatagcttcgaaaaagtgaagaggcggctagacctggatatcgacggcttgcaaaaggagaactgtccgtacgtgatcaccagcggtattactgagcaggaaaggcagcatcttccggaaaagaggtaccctaagggcagtggctttgtcaataagaacaaaatgcttggtacttcaagtaaagaaagcgaagaattgctcaaatctaagatgctggccttcgaggaaatgcgcaagagattagaggagcaacatgcccagcagttgtctctcttgattgccgaacaggagcgcgaacaggagagactccagaaggagattgaggaacaggagaagatgctgaaagaaaagaaggccatgacagccgaagctagtgaactggacattaataacgccgtggagttggagtggagaaaaatcagcgattcaagtctgctggagacgatgctcagccaggcagacagtctgcacacctcaaatagtaatagcagcggcttcactaacagtgcaatgcagtactcctttgtgtctgcgaatgaggcacctttctacctgtggggtagctcaacctctggattaacaaagctgagtgttactcggccctttggaagggcgaagacaagatggtcccaggttttttcactcgaaattcaggctaagttcaataagatcactgcggtcgccaaggggtttctgacccgtagattaatgcagacagacaagctcaagcagctgaggcagaccgtgaaggacaccatggagttcatcaggtccttccagtcagaagccccactgaagagggggatcgtgagcgcacaggatgcctctctccaggagcgggttctggcgcagcttagggccgccctctacggtatccacgacatctttttcgttatggacgccgctgagcggatgtccattcttcaccatgatagggaagttaggaaagaaaaaatgcttagacaaatggacaaaatgaaatctcctagagtggctctttctgcagccactcagaagtcactagataggaaaaaatacatgaaggcagctgaaatggggatgccgaataaaaaattcctggttaaacagaatccaagcgagacgagagtgttgcagcctaatcaggggcagaacgctccggtccatcgattattaagtcgacagggctcaatctgcaggaagaacccaaagaaagctgcaaagtgttgcgataacctgcgccgtcagcatagcctggggtag

SEQ ID NO: 15971 - DNA, 2976 bp, Artificial Sequence
  Description of Artificial Sequence: Synthetic coding sequence
atggaagaatatgaaaagttctgcgaaaaatccctcgcgcgaattcaggaggcctcccttagcacagaaagttttctgcctgctcagagtgaaagtatctcactgattcgctttcacggggtcgctatcctttcccccttgctgaatatcgagaagaggaaagagatgcaacaagagaaacagaaggccctggacgtagaagccagaaaacaggttaatcgcaaaaaggcccttttgacacgagttcaggaaatcctcgacaacgttcaggtgaggaaggccccaaacgcatcagatttcgaccagtgggaaatggagacggtgtattctaattcagaggtcaggaatcttaatgtacccgccacctttccgaatagcttccccagccatacggagcatagcacggctgccaaactggataagatcgccggaattctccccttggacaatgaggatcagtgcaagaccgatggaatcgacttagctcgcgactccgaaggcttcaacagcccaaaacaatgtgacagtagtaacataagccatgtggagaatgaagccttccctaagacttcctccgctacgccacaagagacactgatttcagacggaccattttctgtcaacgaacagcaagatcttccactcctggccgaagttataccagacccttatgttatgtctctgcagaacctcatgaagaagtcgaaagagtacatagaaagggaacagtccaggaggtccctgagagggagcattaaccgaattgtgaacgaaagtcacttggataaggaacacgatgcggtcgaagtcgccgactgtgtcaaggaaaagggccagctcaccggtaagcactgcgtgtctgtgattccagacaaacccagtctgaacaaaagcaacgtgcttcttcagggggccagcacccaggcttccagtatgtccatgcctgtactggctagcttctccaaggtggacatcccaatcagaaccggacaccctacagtgcttgagagtaactctgatttcaaagtgatccctaccttcgtgacagaaaataatgtgattaaatcgctcacaggcagctacgcgaagcttccatctcccgaaccaagcatgtcccctaaaatgcaccgaaggcgtagtagaacatcaagtgcttgccacatcctgatcaataaccctatcaacgcctgtgagctgtcacctaaggggaaagaacaggcgatggatctgatcattcaagataccgacgagaatactaacgtcccagaaattatgccaaaactaccgaccgacttggcaggggtttgtagcagcaaagtttacgttggtaagaacactagtgaagtaaaggaagacgtggttctaggtaaaagcaaccaagtatgccaatcctcagggaaccacttagagaacaaagtgactcacgggttagtcacagtcgagggacagcttacctcggatgagcgcggagcccacattatgaattcaacctgcgctgccatgcccaaactgcacgagccatacgccagttcccaatgcattgcttcaccaaatttcgggacagtttctggcctgaagccagcctcgatgctcgagaaaaattgctcactgcaaaccgaattgaataagagctacgacgtcaaaaatccttctccactgttgatgcaaaatcagaataccagacagcagatggacactcctatggtgagctgcggaaacgagcagtttttggataacagttttgagaaggttaaaaggaggctggatctggatattgacggtcttcagaaggaaaattgcccatacgtgatcacctcaggcataacagagcaggagaggcagcacctgcccgagaagcgctatcctaaagggtccggattcgtcaacaaaaataagatgttgggtacgtcatcaaaggagagcgaggagcttctcaagtccaaaatgctggccttcgaggagatgaggaaaaggctagaggagcagcacgcccaacagctgtctctcctgattgctgagcaggaacgcgagcaggagaggctgcagaaggaaatcgaggaacaggaaaaaatgctgaaagagaagaaagcgatgacggcagaggccagcgagctcgacatcaataacgcagtggagctggagtggaggaaaataagtgacagctcacttctggaaactatgttaagtcaggcggattcactccacacaagtaattccaattcttccgggttcacaaatagcgccatgcagtacagctttgtcagcgccaacgaagccccgttctatctttggggatcgtccacttcaggcctgacgaagctgtcagtcacaagaccattcggtcgggcgaagaccaggtggtcgcaagtcttctcgctcgagatccaagccaaattcaacaagatcactgcagtcgccaaaggctttctgacgcggagactgatgcagaccgataagttaaaacagttaaggcagacagtcaaggataccatggaattcattcggtcttttcagagcgaagcgcctttgaaacggggcatcgtttcagcccaggatgccagtctgcaggaaagagtgctggcccagctccgagctgcactgtacggaattcacgatatttttttcgttatggatgccgccgagaggatgtcgattctccaccacgatcgtgaggtacggaaagaaaaaatgctgcgccagatggataaaatgaagagccctcgggtggccctctcagcggctactcagaaatcacttgatcgcaaaaagtacatgaaagccgccgaaatgggtatgcctaacaagaagtttctcgtgaagcagaacccctccgagacccgagtgctgcagccaaaccaggggcagaatgcaccggtccacagactcctgtccaggcaggggtcaatctgccgcaagaacccaaaaaaagccgccaagtgctgtgacaatttacgccgccagcattcactgggctag

SEQ ID NO: 15972 - DNA, 999 bp, Artificial Sequence
  Description of Artificial Sequence: Synthetic coding sequence
atggccacaattaagagcgagctgattaaaaactttgccgaagaagaggcaatccatcacaacaagataagtattgtagggacaggctccgtgggagtcgcctgcgcgatatccatacttctgaaaggactgtctgatgaactcgtgttagtggatgtggacgaaggtaaactgaagggggaaacaatggatctgcaacatggttcccctttcatgaaaatgcccaatatcgtgtcttctaaggattatctggtcaccgccaatagcaacctggtgattattacggcgggggcacggcagaagaaaggcgagaccaggttggacctggtgcaacgaaatgttagtatttttaagctgatgatcccaaacatcacacagtactcccctcactgcaagctccttatcgtaaccaatccagttgatattctcacttatgtggcctggaagctgtcaggattccccaagaaccgtgtgatcggaagcggctgtaatctagacagcgctcggttccgttacttcattggacagagactggggatccattcggaaagctgtcatggcttgattctcggcgaacacggtgatagctcggtaccagtttggagcggtgtcaacattgcaggcgtccccctgaaggacttgaacccggatatcggaaccgataaggacccagagcagtgggagaatgtccataaaaaggtgatcagcagtggctacgaaatggtgaaaatgaaaggatatacaagctggggcatatctctctctgtggctgatctcaccgaatcaattctgaagaatctacgccgcgtccaccccgtctccacgttatcaaaagggctctatggtattaacgaagatattttcttgtccgtgccatgcattctgggggagaatggcattaccgatttaattaaagttaagctgacactcgaggaagaggcatgccttcagaaatcagcagagactctctgggaaatccagaaggagctgaagttatag

SEQ ID NO: 15973 - DNA, 888 bp, Artificial Sequence
  Description of Artificial Sequence: Synthetic coding sequence
atgatggcaaagaagccccccaagcccgctcccagacgcatctttcaggagaggcttaagataactgcgttacccttgtactttgaaggattcctgttgattaaaagaagcgggtacagggagtacgagcactattggaccgagctcagagggaccacccttttcttttacaccgacaagaaatcgattatatacgtggataagctagacatcgtcgatcttacgtgcttgactgagcagaattcaactgagaagaactgtgccaaatttacactcgtgctgccaaaggaagaggttcaactgaagactgagaacactgagagcggagaggagtggcgtggcttcatactgacagtgactgagctgtcggtgcctcagaatgtttctctgctgcccggtcaagtgatcaagctgcacgaggtgctcgaacgagagaagaagcggcgaatcgagactgaacagtcgacttccgtggagaaagagaaggagcctaccgaagattatgtcgatgtgcttaatcccatgccagcgtgcttctatactgtaagtagaaaagaggctacggaaatgttgcagaagaacccctccttgggtaatatgatcctgcgccccgggagtgactctcggaattattccatcaccattcgccaggaaattgacattccacggattaagcactacaaagtgatgtctgttggccagaactacactattgagcttgagaagccggtgacattgccgaacctgtttagcgttattgattattttgtgaaagagacccgcggcaaccttaggccttttatttgcagcaccgacgagaatacggggcaggagcccagcatggagggtaggagtgagaaactgaaaaaaaacccacacatagcttag

SEQ ID NO: 15974 - DNA, 1368 bp, Artificial Sequence
  Description of Artificial Sequence: Synthetic coding sequence
atggagggagtgctttacaagtggaccaactacctttctggatggcagccacgttggtttcttctctgcggcggcattctgagttattacgactcaccggaggacgcatggaaaggctgcaaaggttccattcaaatggcagtgtgcgaaatccaagtgcatagtgtggataacacacgcatggatctaattatcccaggggagcaatacttctatctcaaggcccgctccgtcgctgagcggcagaggtggctggttgcccttggcagtgccaaagcctgtctgactgactctcggacacagaaagagaaggaattcgctgagaacactgagaatctgaaaacgaagatgtccgaactcagattgtattgcgacctgctcgttcagcaggtcgataaaaccaaagaagtgaccacgacgggagtgtcaaactctgaggagggaatcgacgtaggcacactgctgaagtccacttgcaatacctttcttaagacactagaagaatgtatgcagattgcaaacgccgccttcacaagcgaattgctgtacagaaccccgcctggctcaccgcaacttgccatgctgaaatcttccaaaatgaaacacccaatcattccaattcacaacagccttgaacgtcaaatggagcttagtacgtgcgagaatggtagtctcaacatggaaatcaacggagaagaagaaatcttgatgaagaacaaaaatagcctgtacctaaagtctgccgaaatcgattgttccatatccagcgaagagaacacagatgataatatcaccgtgcaaggcgagatccggaaggaagatggaatggaaaatctgaaaaatcatgacaataacctgacccaatctggttccgatagcagctgttcaccagagtgtctatgggaggaaggaaaggaagtcatccccacatttttctccacaatgaatacttcattctccgacattgagctgctggaggactctggcatcccaacagaggctttcctcgccagctgctacgctgtcgtgcccgtgctagataagcttggcccaactgtatttgcgcccgtgaagatggatctggtgggcaatattaagaaggtgaaccagaaatacattaccaacaaggaggagttcactactctgcagaagatcgttctgcatgaagtggaagctgacgtggcccaggtgcggaattccgccaccgaagccctgttgtggctgaaaagaggactgaagttcttaaagggcttcctgaccgaggtgaaaaacggggagaaagacattcagacagcacttaataacgcttacggaaaaactctacgtcagcaccatggatgggtggtgaggggcgtctttgccgtttag

SEQ ID NO: 15975 - DNA, 1320 bp, Artificial Sequence
  Description of Artificial Sequence: Synthetic coding sequence
atggaaggggttctgtataaatggactaactacctgagtggctggcaaccaaggtggtttctcttatgtggaggcattctgagctattacgattcacctgaagacgcctggaaagggtgcaaaggatcgatccagatggctgtgtgcgaaattcaagtgcactccgtggacaatacacgcatggatctcatcattccaggcgagcagtatttctaccttaaggcccggagcgtggccgaacggcaacgttggctcgtggctctgggctccgccaaggcttgcctaacagacagtagaacccagaaggaaaaggagtttgcagaaaatacagaaaatcttaagacaaagatgtctgaactgcggctgtactgcgatttgcttgtgcagcaggtagacaagactaaggaggtgaccacaacgggggtgagtaactctgaggaaggtattgatgttggtactctgcttaagagtacctgtaatacatttctaaaaacactggaggaatgcatgcagatcgccaacgctgccttcaccagcgaattgctatacagaacccctcccggtagtccccagctcgccatgttgaaatcatccaagatgaagcatcccattattccaatccataattccctagagcggcagatggagctgtccacctgcgagaacggctcactcaatatggagatcaacggtgaggaggaaatcctgatgaagaacaaaaattccctatatctgaaatcagctgaaatcgattgttcaataagttctgaggagaatacagacgataatattacagtgcagggcgagatccgcaaagaggacggcatggagaatctaaagaatcatgataataacctcacgcagtccggcagcgactcctcttgctcccctgagtgtctctgggaggaggggaaggaggtgatccccaccttcttcagcacgatgaacacatccttttccgatatcgagctgttggaggatagtggcattcctacagaagcttttctggcttcgtgctacgcagtggtgcccgtgctcgataagctgggccccactgtctttgcccctgtgaagatggacctggtcgggaacattaagaaagtgaatcaaaagtacatcaccaataaggaagagttcaccactctccagaagatcgtgcttcatgaagtcgaggccgatgtcgcccaggtcaggaacagcgcaactgaagcattgctgtggctgaagaggggactgaaattccttaagggctttctgacagaggttaaaaacggcgagaaggacatccagacagctctgtcagtggggatgtgggtgtag

SEQ ID NO: 15976 - DNA, 984 bp, Artificial Sequence
  Description of Artificial Sequence: Synthetic coding sequence
atgtgctctacaagcggctgcgacctcgaggagattccgctcgatgacgacgacctcaatactattgaattcaagatcctggcctattatacacgtcaccatgtcttcaagtcaaccccagcactgttcagcccaaaactattaagaacgcgtagtctgagccagagaggcctcggcaactgctccgcgaatgagtcatggaccgaagttagttggccctgtcgtaactcacagtctagtgagaaagcaataaacctggggaagaagaagtcctcctggaaggctttttttggcgtcgtggaaaaagaagactcacagtctacgcctgcgaaggtgtccgcccaggggcaaagaaccctggaataccaggacagccattcccagcagtggagtcgatgtctgtctaatgttgagcagtgtttggagcatgaagccgtggacccgaaggtgattagcattgccaaccgtgtggcagagatcgtctactcctggccgcccccccaggccacccaggccggcgggttcaagagcaaggaaatcttcgtgacagaggggctctccttccagctccagggccatgttccggtcgcatctagctcgaaaaaggatgaagaagaacagatccttgccaagattgtagagctcttgaagtactcaggcgaccagcttgagaggaagcttaaaaaggataaagccttgatgggccactttcaggatggactttcatacagtgttttcaagacaataaccgaccaggtgttgatgggcgtagatcctaggggcgaaagcgaggtgaaagcacagggctttaaggccgccttggtgatagacgtgacagccaagttgaccgccatcgataaccaccccatgaatagagtcttggggtttgggaccaaatacttaaaagagaatttctcgccatggattcagcagcatggtggatgggagaaaatcctcggaatctctcacgaagaagtagattag

SEQ ID NO: 15977 - DNA, 5229 bp, Artificial Sequence
  Description of Artificial Sequence: Synthetic coding sequence
atgatggagggcaacgggactgagaacagctgcagccgcactaggggctggctgcagcaggataacgacgcaaagccgtggctgtggaagttttcgaattgcttctcacggccagagcagacgctcccccacagtccccaaacaaaggagtacatggaaaataaaaaagtggcagtggaacttaaggacgttccaagtccacttcatgcgggtagtaagctgttcccagccgtgccgctccctgatatcagatctctgcaacagcctaaaattcagctctcctcagtccctaaggttagctgttgtgcccactgcccgaatgagccctctacttcacctatgcgattcggaggcggcggaggtggcagcggaggtacatccagccttatccaccctggggccctgcttgattcccagtctacccgcaccataacttgtcaggttggttcaggttttgcctttcagtcagcctcttcactgcagaatgctagcgctcggaacaatctggcaggtatcgcaagcgacttccccagcatgtgtctggagagcaacctgagcagctgtaaacacctgccctgctgtggaaaacttcattttcagtcatgtcacgggaatgtccataaactccatcagtttcccagtctgcagggctgcacctccgctgggtactttccctgctctgacttcacatccggggctcccggtcacctggaggaacatatttcgcagtccgaactcacccctcacctctgcacgaactctttgcatctgaatgtggttccacctgtttgtctgaagggaagtctctactgcgaagactgcctcaataagcccgcccggaactccattatcgacgcagccaaagtttggcctaatatcccaccaccaaacactcagcccgccccactggcagtgccgttatgtaacggttgtgggacaaaaggtactggaaaagaaactacactcctcctggctacttccttgggcaaagccgcatcaaagttcggctcaccggaagtagctgtggccggacaggtactggagaacctgcctccaatcggggtgttttgggatatcgaaaactgtagcgttccaagtggtcgctcagctacggccgtagttcaacgcatccgcgagaaattcttcaaggggcacagagaggccgagttcatctgcgtgtgcgatatcagtaaagaaaataaggaggtcatccaggaactcaataattgccaggtgacggtggcccatataaatgctaccgcgaagaacgccgctgatgacaagctgagacagtccctgagaagattcgcaaacactcataccgcccccgccaccgtagtgctggtgtccaccgacgtcaattttgccctcgaattatcagatctccgccaccggcatggtttccatatcattctagtgcataaaaatcaagccagcgaggctctgctgcaccatgcaaatgaactaatcagatttgaggagttcataagcgatctccctccccggctccccttaaagatgcctcagtgccacacactgctgtacgtgtataacctcccagctaacaaagacggaaagagcgtgagtaatcgcctcagacggttgagtgacaattgtggaggaaaagtcctgtctatcactggatgctccgccatcctgagatttatcaaccaggattccgcagagagggcacaaaaacggatggaaaacgaagacgtttttgggaaccgcataatcgtctcctttacccccaagaatcgagaactctgtgaaacaaagagctctaatgcgattgccgacaaggtgaaaagccccaagaagctcaagaatcccaaactgtgtttaataaaagacgcctccgagcagtcatcatcggcaaaagctaccccagggaagggctcacaggcaaatagcggaagcgcaaccaaaaacactaacgtgaaaagcctgcaggaactgtgcagaatggagtccaagactggtcatagaaacagcgaacatcagcaaggacatttgcggttagtggtgccaacccacggcaatagctctgccgctgttagtacccctaagaacagtggagtcgccgaacctgtatacaagacaagtcagaagaaggagaacttgtccgcacgatcagtaacgagcagtccagttgaaaagaaggataaggaggaaactgtgtttcaggtgtcctacccttctgcattttcaaagttagtggcttctagacaggtgtcaccattattggcaagtcagtcctggtcctcacggtccatgtccccaaatttgctgaaccgtgccagccctttggccttcaatatcgccaattcatccagcgaggccgattgccccgacccgttcgctaacggggctgatgtgcaagtatctaatattgactatcgtttgagccgtaaggaactgcaacaactgctacaggaagcctttgcccgacatggcaaggtcaaaagcgttgaactcagcccccataccgactaccagctcaaggccgtcgttcaaatggagaatctccaggatgctatcggagcagtgaatagcctccaccgatataaaattgggtccaagaaaatcctggtcagcctcgcgaccggggccgcctccaagagcctgagtctattgagtgccgaaaccatgtctgtgctgcaagatgcgcccgcctgttgcctgcctctgtttaaatttaccgatatttatgagaagaaatttggccacaagctgaatgtgagcgatctttacaaactcaccgatacagttgcgatccgagagcaagggaatggacggttagtgtgcttgctgccaagctctcaggccagacagagtccactgggtagtagccagtcacacgatggaagctctaccaactgctctcccatcatcttcgaggagctggaataccacgaaccggtctgccggcagcactgctcgaataaagatttttcggagcacgaatttgacccggatagctataagatacccttcgtgatcctgtcgctcaagacttttgcccctcaggtgcacagtctgctgcagactcatgaaggcactgtgcccctgttaagctttccagattgctatattgccgagtttggagacctggaagttgtacaagagaaccaggggggggtccctctagaacatttcattacctgcgtacctggagtgaacattgccaccgcacagaacgggatcaaagttgtcaaatggatccacaataaaccgccgccccccaacacagacccatggcttctgcgaagcaaatctcctgttggcaatcctcaactgattcagttcagtcgggaagttattgatttgctcaagtcacaacctagctgtgttatccccatctctcattttattccttcatatcatcatcactttgccaagcaatgcagggtcagcgactatgggtattcaaagctgattgagctgctggaggccgtaccgcatgttctccagatcttagggatgggcagtaagcgactgctcactctcacacatcgcgctcaggtaaagcgatttactcaggacctcctcaagctgctcaaaagtcaggcctccaaacaggttatagtgcgtgagttttctcaggcgtatcattggtgtttttctaaagactgggacgttactgaatatggtgtctgtgaacttatcgacatagtatcagaaatacccgatacaacaatttgtctgtctcagcaagacaatgagatggtcatttgcatccctaagagagaacggacacaagatgagatcgagcgcactaaacagttcagtaaggatgtcgtggatttgcttcgacaccaaccccacttccgcatgccgtttaataagtttattccgagctaccaccatcatttcggcaggcagtgtaaacttgcatattatggattcacaaaacttcttgagctttttgaagcgataccagatacactccaagtgctcgagtgcggcgaagagaaaatccttactttgaccgaggtagaaaggtttaaggctctggccgcccagtttgtgaaactgttaagatcccaaaaggacaattgcctcatgatgaccgatctgcttacagagtacgctaaaactttcggatatacctttaggttacaggactacgacgtgtcctcaatctccgctctcactcagaaactgtgtcacgtcgtcaaggtggccgacatcgaatccggtaggcagattcagctcattaaccgcaagagtcttcgtagcctgactgctcagctgttggtgctgctgatgagctgggaaggaaccactcacctgagcgtggaggagctcaaaagacattacgaatccactcataacactcctttgaatccttgcgagtatggtttcatgacactgaccgagctgctgaaatcgctgccttatcttgtcgaggtattcaccaatgataagatggaggagtgcgtcaagctcacttccttatacttgttcgccaaaaacgtgaggtccctactgcatacttatcactatcagcaaatcttcctgcacgagttcagcatggcttacacaaaatatgtcggcgagacactacagccaaagacttatggccacagcagcgtggaggagctgctaggagccatacctcaagtcgtctggatcaagggacacgggcataagcgcatcgtagtactcaagaatgacatgaagtcaaggctcagttcactctctcttagccccgctaatcacgagaaccagccttccgagggtgaaagaatactggaggtgccagaaagtcataccgcctcagagcttaaactgggagccgatggtagcggcccaagccacactgaacaggagttattgcgcctgacggacgacagtcccgtagatctgctttgcgcgccagtccctagctgtcttccaagtccccagttgcgccccgacccagtgattctacagtctgcagatctgatacagtttgaggaaaggccacaggaaccatccgagattatgatcctcaatcaggaggagaaaatggaaattcctatccctggtaagagtaagacattgacctccgactcgagcagcagctgtattagcgcggcagttcctgtgcccccgtgtccatcatccgaaacatctgagtcccttcttagtaaggatcccgtggagagcccagccaagaaacagcccaaaaatagggtgaagcttgctgctaacttctccctggctccaataacgaaattgtag

SEQ ID NO: 15978 - DNA, 831 bp, Artificial Sequence
  Description of Artificial Sequence: Synthetic coding sequence
atgtgttccacaagcggctgcgacctggaggagatcccactggacgacgacgacctcaatacgatcgaattcaaaatacttgcctattacacccggcatcacgtgttcaagagcacccccgcactgttttctcccaagctgctccgcacacgatctttaagtcagagggggctagggaattgctcggccaacgaaagctggaccgaggtgagctggccttgccgaaacagccagtcctcggagaaggccatcaacctggggaagaaaaagtcctcatggaaggccttcttcggcgtcgtcgaaaaggaggatagccaatccactccagcaaaggttagtgcacaggggcagcggacactggagtatcaggacagccacagccagcaatggagcagatgcctcagtaacgtcgaacaatgtctagaacatgaagccgtcgatccaaaggttataagcattgcaaatcgggtggctgaaattgtctacagttggccgccgcctcaggccactcaagccggaggatttaagtccaaggaaatctttgtgaccgagggactctcgttccagctgcagggacacgtccctgtggcgagttccagcaagaaggacgaagaggaacagattctggccaagattgtggagttgctgaagtactctggcgatcaattggaacgcaaagagaaagaatgggaggagagtgccaagactaaaatcaagatggctcttctgtggagatccagtgggggtgggccccgggttctgagtattcccgaggcgtttatgaagaatagctttactttgacccctccaggtttcagcgaacacaactag

SEQ ID NO: 15979 - DNA, 552 bp, Artificial Sequence
  Description of Artificial Sequence: Synthetic coding sequence
atggccagtaacaaaactaccctccagaagatgggaaagaaacagaatggtaagagcaagaaagtggaggaggctgagcccgaagagtttgtggtcgagaaggttctggacaggcgggtggtgaacggcaaagtcgagtactttctaaaatggaaggggtttactgacgcagacaatacctgggagcctgaggaaaatctggactgtcctgaactgatcgaggccttcctgaacagccaaaaagccgggaaagagaaggatggcactaaaaggaaatccctcagcgactctgagtctgatgacagcaagagtaagaaaaaaagagacgccgcagacaaacctcgcggattcgctcgtggcctcgaccccgagagaatcatcggtgctacagatagctctggggagttaatgttcttgatgaagtggaaggattcagacgaagccgatctcgttctggctaaagaagccaacatgaaatgcccccagattgtaattgcattctacgaagaacgattaacctggcattcatgccccgaagacgaggcccagtag

SEQ ID NO: 15980 - DNA, 960 bp, Artificial Sequence
  Description of Artificial Sequence: Synthetic coding sequence
atgctgaggtgcggtcagatgattttcgcccaagcattggtttgccgccacctgggaagggattggagatggactcagcgcaagagacagcctgatagctatttctccgtacttaacgctttcattgaccgaaaagatagctattatagtattcaccaaatagctcagatgggcgttggcgaagggaagtcaattggccaatggtatggcccgaatactgtggcccaggtgctaaaaaagctcgctgttttcgacacgtggtcaagtcttgcggtccacatcgcaatggataacacagtggtgatggaggaaattcgtcgtttatgtagaacctccgtgccgtgcgcaggtgctaccgccttcccagctgactctgatcgtcactgtaatggcttcccagcaggcgcggaggttacaaatagaccatcgccatggcgccccctggttttgctgatacccctccgactgggcctcacggatatcaacgaggcttatgtggaaacactcaagcactgtttcatgatgccgcaaagcttaggcgtgatcggcggcaagccaaatagcgcacactactttattgggtacgtcggagaggaactcatctatctggacccgcacaccacccaaccagctgtcgagcccactgatgggtgttttatccccgacgaatcctttcactgccaacatccaccatgccggatgtcaatcgcggagttggatccctcaattgctgtggggttcttttgtaagacagaggacgactttaacgattggtgccagcaggtaaagaagctgtcactgctgggcggagctctgcctatgttcgagctcgtagaactccagccctcccatctggcatgcccagacgtactcaacctatctctagattctagcgatgttgaaaggctcgagagattcttcgattcagaggatgaagatttcgagattcttagtctgtag

SEQ ID NO: 15981 - DNA, 564 bp, Artificial Sequence
  Description of Artificial Sequence: Synthetic coding sequence
atgaatggacgagctgactttagagaaccaaacgcagaagtgccccggcctataccccacatcgggcccgactatatccctaccgaagaggagaggagagtgttcgccgagtgcaatgacgagtccttttggttccgctccgtccctttggccgcgacttctatgctgatcactcaaggcctcattagcaagggaattttgtccagtcaccccaaatatggatctatcccaaagctcattctggcttgcatcatgggctactttgctgggaagctcagctatgtgaagacatgccaggagaagttcaagaagcttgaaaattcgccactgggcgaagccttaagatcgggacaggcccggcgcagttcccctcccggtcactactatcagaaatccaagtatgactcttccgtgtctgggcaatctagcttcgtgaccagccccgctgccgataacattgaaatgctgccacattacgagccaatacctttctctagtagtatgaacgagtctgcccccacaggaattacggatcacatcgttcaagggcggaacttctcttag

SEQ ID NO: 15982 - DNA, 270 bp, Artificial Sequence
  Description of Artificial Sequence: Synthetic coding sequence
atgagcgaacaaggggatctcaatcaggcgattgcagaagaggggggaaccgagcaggaaaccgcaacacctgagaacggcatcgtgaaatccgagtctctagacgaagaggaaaaactagagctccaaaggaggctcgaagcacaaaaccaggaaagaaggaaatccaaatccggtgccgggaaaggcaaactgactaggtccctggctgtgtgtgaagaatcctccgcccggcctgggggtgagtccctgcaggaccagaccctgtag

SEQ ID NO: 15983 - DNA, 270 bp, Artificial Sequence
  Description of Artificial Sequence: Synthetic coding sequence
atgtctgaacagggggatctcaaccaggcgattgcagaggaggggggcacggagcaggaaacagccacccccgaaaacggaatcgtcaaaagcgagagccttgatgaggaagaaaagctggagttgcagcgcaggctggaagcccaaaatcaggagcggaggaagtctaaaagtggggccggaaaggggaagcttaccagatccttggcagtttgtgaggagtcatccgcccgacctggcggcgagtcactgcaagaccagacgttgtag

SEQ ID NO: 15984 - DNA, 1473 bp, Artificial Sequence
  Description of Artificial Sequence: Synthetic coding sequence
atggaggattctgccagcgccagtctgtcctccgcagccgctacagggactagcaccagtacacccgccgcacccaccgcgaggaagcagctggataaagagcaagtcaggaaagcagtggatgccctgctcacacactgcaagagccggaagaacaactatggcttattactcaatgagaacgagtcattatttttgatggtggtcctgtggaaaattccgtctaaagaactccgggtccggttgacgcttccacactccattcgctctgatagtgaagacatctgcctttttactaaggatgagcccaacagcacccctgaaaagacagagcaattttacaggaaactcttgaataaacacggtatcaagaccgtgagtcagataatatcgttgcagacactgaaaaaggagtacaagtcatatgaggcaaagctgcgactgctcagttctttcgacttctttcttacggatgcccgcattcggcggttgcttccctctttgattgggagacacttttatcaaaggaagaaggtcccggtttccgtgaaccttctatccaaaaatctttccagagagataaacgattgcattggtggtaccgtcctgaatatcagtaagtctgggtcttgctctgcgatccgaatcggacatgttggaatgcaaatagaacacattattgagaacatcgtggccgtgacgaaggggctgtccgagaaactgccagagaaatgggagagtgtgaaactgctgtttgtgaagacagagaaatcggcggcattaccgattttctcctctttcgtgagcaactgggatgaggccacaaaacgttctctgctgaacaagaaaaaaaaggaagctaggaggaagcgaagggagcgtaatttcgaaaaacaaaaggaaagaaaaaaaaaacgacaacaagctagaaaaactgcctctgtgttgagtaaggacgacgtggctcccgaaagcggtgatacgaccgtgaaaaaacccgagagtaagaaggagcagactcctgagcatggcaagaaaaagaggggaagaggcaaggcccaagtaaaggctactaacgagtctgaagacgagatccctcagctcgtcccaatcgggaaaaagaccccggcaaatgagaaggttgagattcagaaacacgctacaggaaaaaaatccccagctaaaagccctaacccttcgactccaaggggtaaaaaaagaaaagccttgcctgcgagcgagaccccaaaagcagcggagtccgagactcctgggaagtctcctgagaagaaacctaagattaaggaggaggcagtaaaggagaagagtccttccctgggcaaaaaggatgccagacagacacccaagaagccagaggctaaatttttcacaacacccagtaaaagtgttcgcaaagcatctcatacgcccaagaagtggcctaaaaaaccaaaagtgccacagagcacctag

SEQ ID NO: 15985 - DNA, 495 bp, Artificial Sequence
  Description of Artificial Sequence: Synthetic coding sequence
atggcagagccagcgtccgtcgctgctgaatccctagccggtagtcgagcaagagctgctaggactgttctgggtcaggtcgtgctacctggcgaggagcttcttctccccgaacaagaagatgctgagggtcctggcggcgcggtcgagagacctctgtctttgaatgctcgagcctgcagccgggtccgcgtagtttgtggccccggcttgaggcgttgcggggataggctgctcgtgaccaaatgtggccgccttcgccacaaggagccgggctccgggtcgggtgggggagtctattgggtggacagccagcagaagagatacgtacctgtgaagggagaccatgtcatcgggattgtcactgccaaaagcggggatatatttaaagtggacgtgggcggtagtgaacccgccagcttgagctacctctcttttgagggggctacaaaaaggaacagacctaacgtgcaggccattagctcccggctgtag

SEQ ID NO: 15986 - DNA, 2508 bp, Artificial Sequence
  Description of Artificial Sequence: Synthetic coding sequence
atgacatgcaataaacacggctgcagacaggctttccacgtgacgtgtgcgcagtttgccggactgctatgcgaggaagaaggaaacggcgctgataatgtccaatattgcggttattgcaagtatcatttctctaagttgaaaaagagcaagagaggctctaacagatcctatgatcagagtctaagcgactcgagctcacatagccaggacaaacatcatgagaaagagaaaaaaaagtataaagagaaggacaaacacaagcagaagcacaagaaacagcctgaaccctcacctgccctggtcccttccttgactgtcacgaccgagaagacctatactagcacaagtaacaactctatcagcggctcattgaaacggctcgaggacaccaccgcgcgctttacgaacgccaactttcaagaggttagcgctcacacgtcttctggaaaggacgtcagcgaaacacgtgggtcagagggcaaagggaagaaatcaagtgcccactcctcagggcagcgcggccggaagcctgggggggggcggaatccaggtacaacagtgagtgcagctagtccatttccccagggttcttttagtgggactcccggatctgtgaagtcttcctctgggtcatcagtccagtcacctcaagattttctgagtttcaccgacagcgatctaagaaatgacagctatagccatagtcagcaaagtagcgccaccaaggatgttcacaagggcgaatccggtagtcaggagggaggcgtgaattcctttagtactctgatcggtctgccatccactagcgctgtgactagccaaccgaaatctttcgaaaatagccctggagatcttggaaactcatctctgcccaccgccggctataagcgcgcccagacctctggcattgaggaagagacagtcaaggaaaaaaaacggaagggcaataaacagagtaaacatggacccggccgtcccaagggcaataagaaccaagagaacgtttcacacctctccgtttctagtgccagcccaacttcctccgttgccagcgcagctgggtccattacaagctcttcgctccaaaaaagtccaacgcttctgcgaaatggcagcttacagagtctttccgtgggatcttcacctgtgggctccgaaattagcatgcagtaccgccacgatggggcatgtccaacgacctctatttacaactcaaatgacgtggccgtgtcttttccaaatgtggtgagcgggtcaggttctagcacgccagtgagctcttcacacttaccacagcagagcagtggacatctccagcaggtgggagcccttagtccatctgcggtctcctccgccgcgcctgctgtcgctaccacacaggccaacactttaagcgggtcaagtttaagccaggcccccagccacatgtatggtaataggtccaatagttccatggccgctctgatcgcgcaatccgaaaataaccagaccgatcaagacctcggtgacaattcaaggaacttagtcggtcgagggagttccccgcgggggtccctaagcccccgcagcccggtgagcagcttgcagatccgctatgaccagccagggaattcctctctggaaaacctccctcccgttgctgcttctattgaacagctgttagaacggcaatggagcgagggacaacagttcctgctggagcaaggaactcccagcgatattctcggaatgcttaagagcctgcatcaactgcaggtggagaatagaagactggaggagcagatcaaaaacctgacagcaaagaaggagcggttacaacttctaaatgcccaactgtctgttcccttccctaccatcaccgccaatccctctccctcccaccagatccatacgtttagcgcccaaactgcccccacaacagatagcctgaattcctcgaagtccccccacattgggaatagttttctcccagataactccttacccgtgctgaaccaggatctgacctcatccggacaaagcacatccagcagttcagcgctaagcaccccccctccggccggacagtcacctgcacagcagggatcaggggttagcggggttcaacaagttaacggagtgaccgtgggcgccctggccagcggcatgcaaccggttaccagtacgattcccgccgtcagcgccgtcggcgggattatcggcgctctgcctggaaaccagttggccattaacgggatcgtgggcgccttaaacggggttatgcagactcctgtgacaatgtctcagaatccgacccccttgacccatactacagtcccccccaatgccactcatccgatgccagcgactctgactaattcagcatcaggcctcggcctcttgagcgaccagcagcgccaaatcctgatccatcaacaacagttccagcaactgcttaactcacagcagctgaccccaaatatggtgaaagagttttctgctcagatcattgcatggaggccatag

SEQ ID NO: 15987 - DNA, 1620 bp, Artificial Sequence
  Description of Artificial Sequence: Synthetic coding sequence
atggcaacatcagcgccactccgaagcctggaagaggaagtgacttgtagtatctgcctggattacttacgtgatccggtgactattgattgcggccatgttttttgcagaagctgtaccactgacgtgcgcccaatcagcggatcaaggcctgtttgcccactgtgtaagaagcccttcaagaaggagaacatccggccagtttggcagctggcctctctcgtcgaaaatattgaaaggctgaaggtagacaaagggcggcaaccaggcgaagttactagagagcagcaagatgcaaagttgtgtgagcggcaccgcgagaagttacactactattgtgaggatgacgggaaacttctttgtgtgatgtgcagggagagccgggagcatcggccacataccgcggtgctgatggagaaggccgcgcagcctcaccgggaaaagattcttaaccatctgtcaacactgcgccgtgacagggataagatccagggttttcaagccaaaggcgaggccgacatactcgctgccctcaagaaattacaagatcagagacagtacatcgtcgccgagttcgagcaggggcatcaattcttgcgcgaaagggaggaacatctactcgaacaacttgcaaagctggaacaggaacttaccgaaggtcgggaaaagtttaaatccagaggagttggtgagctcgcccgtctggccctggtcatttctgaactcgagggaaaagcacaacagcccgcagcagagctcatgcaggatactagggatttcctgaaccgatatcctcgcaagaagttctgggtgggcaagcccatcgcgagagttgtgaaaaagaaaactggagagttttctgataagctactgtccttgcagaggggtctgcgtgagtttcaggggaagctgctgagggatctggaatacaagacggtgagtgtaacgctcgatccacagtctgctagcggatatctgcagctttcggaagactggaaatgtgtcacttatactagtctttacaagagcgcatatctccacccccagcagtttgactgcgagcccggggttctaggcagcaaggggtttacttggggtaaagtttattgggaagtggaagtggagagagaaggttggtccgaggatgaggaggagggcgacgaggaggaagagggtgaggaagaggaagaagaagaggaggcagggtatggagacgggtacgatgattgggagaccgatgaggacgaggagtccctcggcgatgaggaagaggaggaagaagaggaggaagaagaggtacttgagtcatgcatggttggggttgctcgggatagtgtcaagagaaaaggcgatctgtcactgcggccagaggatggagtgtgggccctgcgacttagttcaagtgggatttgggccaacaccagccctgaggctgagctgttccctgccctgagaccaagacgcgttggcatcgcactggactatgagggtggcaccgtaacgtttactaacgccgaaagccaggagctgatttacacattcaccgcaaccttcacaaggcggctggtaccttttctctggctgaagtggcctggcacgcggctgcttctgcgaccgtag

SEQ ID NO: 15988 - DNA, 444 bp, Artificial Sequence
  Description of Artificial Sequence: Synthetic coding sequence
atgtcttcagagccacccccaccacctcagccccccacacaccaggctagcgtgggcttgctggacacaccccgaagtcgcgaaaggagccccagtccgctgcgaggaaacgtggtgccttcaccgctcccaaccagacgcacacggacattttccgccaccgtgcgcgcgtcccaggggcctgtttacaagggcgtgtgcaaatgtttctgtcggtcaaagggtcatgggtttataactcccgcagatggtggcccagatatctttcttcatattagcgacgtcgagggggagtacgtccccgtggaaggcgacgaagtgacgtacaaaatgtgttcaattccccctaaaaacgagaagctccaagcagtggaagtggtcatcacccacctcgcacccggaactaaacacgaaacctggtccggccacgttattagctcatag

SEQ ID NO: 15989 - DNA, 951 bp, Artificial Sequence
  Description of Artificial Sequence: Synthetic coding sequence
atgaccccctctgagggggcaagggcaggcacaggacgcgagctcgaaatgctcgactctctgttagctttaggaggcctggtactcctgcgtgatagcgtcgagtgggaaggacgctcactcctcaaggccttagtaaaaaaatctgctctgtgcggagagcaagtacacatcctcgggtgcgaggtctccgaggaggaatttagggaaggcttcgattctgacatcaataataggttggtctatcatgattttttccgggacccccttaactggtcaaaaaccgaggaggcatttcctggtggtccgcttggggcactgcgcgccatgtgtaaacgaaccgaccctgtgcccgttacgattgcgctcgactccctgagttggctcctgctgcggttaccttgtaccacattgtgtcaggttcttcatgccgtgtctcaccaggattcttgtccaggggactccagcagcgtggggaaggttagtgttctcggcctgcttcatgaggagcttcatggaccaggacctgtgggcgcgctgtcctcactagcccagaccgaggtgactctcggcggaactatgggccaggctagtgctcatattttgtgcaggagaccacggcagcgaccaactgatcagacacagtggttttctatactacctgacttctccctggacctgcaagagggcccctccgtggagagtcagccatactccgacccgcacataccacctgtcgatcccacaacgcacttgactttcaacttgcacctaagcaaaaaagagcgggaggccagggattctcttattttgcctttccagttctcatccgaaaagcaacaggctctgctccgaccacgccccggtcaggcaacctcgcatattttttatgagcccgacgcatatgacgatctcgatcaggaagaccctgacgacgacctggatatttag

SEQ ID NO: 15990 - DNA, 951 bp, Artificial Sequence
  Description of Artificial Sequence: Synthetic coding sequence
atgacccctagcgaaggggcgcgggctggaactggcagggaacttgagatgctggattccttattagctcttgggggactggttctcctgcgggacagtgtggaatgggaggggaggagcctcctaaaagccctggtgaagaaatcagccctgtgcggtgagcaggtgcacattctgggctgcgaagttagcgaagaggaattcagagagggttttgattccgatattaacaacaggctcgtatatcacgatttttttagggatcctcttaactggtctaagaccgaggaagccttccctggcggacctctgggggctctgagagctatgtgcaaaaggacagatccagtcccagtgactatcgctctcgattcactgtcttggcttctgctgagacttccctgtacgactctgtgccaggtacttcacgccgtctcacaccaggactcatgtcccggcgactcttctagcgtgggtaaagtcagtgttcttgggctcttacatgaagaactccacggacccggaccggtgggcgctttaagttcactggcccagactgaggttaccctaggagggacaatggggcaggcttctgcccacatcctttgcagaagaccaaggcagcgaccaacagatcagacacagtggtttagtatccttccggatttcagtttggatctgcaggaggggccaagtgtggaaagtcagccatatagcgacccccacatccctccagtggatcccactactcacctgacatttaacctccatctatctaagaaggagagagaagcccgcgactcattgattctgcctttccagttctcctctgaaaagcagcaggctttgctcagaccgcgcccagggcaggctacatcccatattttttatgaacccgacgcctatgatgatctcgatcaagaggaccctgacgacgatcttgacatctag

SEQ ID NO: 15991 - DNA, 810 bp, Artificial Sequence
  Description of Artificial Sequence: Synthetic coding sequence
atgaaccaggaggatctggaccctgactcaactacagacgtgggtgacgtgacaaataccgaggaggagttgatccgtgaatgcgaagagatgtggaaagacatggaggagtgccagaacaagctcagcctcatcggcaccgaaacgctgaccgattctaatgcccagctgtctctgttgattatgcaggtgaaatgcctgactgccgagctgtctcagtggcagaaaaaaactcccgagactatacccctcactgaagatgtgctgatcactctgggaaaagaggagtttcaaaagctccgccaggatctcgaaatggtcctgtcgaccaaggagtccaaaaacgaaaaattgaaagaggacttagagcgggaacagcggtggctcgacgaacagcagcagatcatggagtccctcaacgtactccactccgaactgaagaataaagtggagacattctcagaatcacggattttcaatgaactaaagacaaagatgctaaatattaaagagtacaaggagaaattgctgagtaccctgggtgaatttcttgaagaccacttccccctgcctgatagatcagtgaagaaaaagaagaagaacattcaggaatcctcagtgaacctgattacactgcatgagatgctggagatcttgatcaataggttattcgatgtgccccatgacccatacgtaaagatttccgacagtttttggcctccttacgtggaactgttgcttcgaaacggcatcgcactcagacatcccgaagatcccacccggatccggcttgaggcgttccaccagtag

SEQ ID NO: 15992 - DNA, 1173 bp, Artificial Sequence
  Description of Artificial Sequence: Synthetic coding sequence
atggctaccggcgacttgaaacggtccctgcgaaacttagaacaagtattgcgcttgctcaactacccagaggaggtggactgtgtggggttgatcaagggtgatcccgccgcctcgctgccgatcatttcttacagttttacatcctactctccttatgtgaccgaactgattatggaaagcaacgtggaacttattgctaagaatgatctacgatttattgacgctgtatacaaattattgcgagatcaatttaactacaaacccatcctgaccaaaaagcaattcattcagtgcgggttcgccgagtggaagatacaaatagtttgcgatattttaaactgcgtgatgaagaagcacaaggaattatcatcactacagaagattcctagccagcagcggaaaaaaatatcctccgggaaatccgaacctcctctcggcaacgagaaaatttctgctgaagcggtgggggtggacatttctgggagatttatgacatcaggcaaaaagaaagctgtggtgatcaggcatctttacaatgaagacaacgtggatattagcgaagataccttgagtcccattaccgacgtaaacgaggccgtagacgtgtccgatctcaacgcgaccgaaatcaagatgcccgaggttaaggtgcccgagatcaaggctgagcaacaggatgtgaacgttaacccagaaattacagcactgcagacaatgctggccgagtgtcaggagaatctgaagaagctgacaagcatcgaaaagcgcctggactgcctggagcagaagatgaagggaaaggtgatggtcgacgaaaacacctggacgaatctcctatctcgcgttacacttctggagaccgagatgctgctgtccaagaaaaacgatgagtttatcgaattcaatgaagtcagcgaggattacgcttcttgctctgacatggatctgctgaatccccaccgtaagtcagaggtcgaacgtcctgccagtatcccactgagctctggctactctaccgcgagctctgacagcacaccaagggcatcgactgtaaattattgcggtctcaatgaaatatccgaagagaccaccattcagaagatggagcgaatgaagaaaatgttcgaagaaaccgccgagcttcttaaatgtccaaatcattacttgtag

SEQ ID NO: 15993 - DNA, 381 bp, Artificial Sequence
  Description of Artificial Sequence: Synthetic coding sequence
atgccgttcttcggtaatactttcagtcctaaaaagacgccccccagaaagtcagcaagcttgagcaatctacattctttggaccggtcaactcgggaggtcgaattgggcctggagtatggatcgcccaccatgaatctggcgggacagtccctgaaatttgagaacggtcagtggatagccgagacaggtgtctcagggggggtagatcggagagaggtgcagaggctacgccgacgcaatcagcagttggaggaagagaacaacctcctcaggcttaaggttgatattctgttagatatgctgagtgagtcgaccgctgaaagccacctgatggaaaaggaactcgatgagcttaggatcagtagaaagcggaaatag

SEQ ID NO: 15994 - DNA, 711 bp, Artificial Sequence
  Description of Artificial Sequence: Synthetic coding sequence
atgcaggtccaggatgatggagttaatctcattccgttcgctaagtgctcacgcgtcgtaagccggagcccacccccacggctgccaagtcaatctctgcggccaatgccccagcgctacggcgacgtgttctggaagaatctgaatcagagaccgacacctacatggctcgaagaacagcacatccctccaatgttgcgcgcaaccggctgtagccagctcgggctgtacccccccgaacagctgcccccacctgagatgctgtggcggcgaaaaaagagacgaccgtgtctggaaggaatgcagcaacagggattgggaggcgtgccggcacgcgtgcgggccgtcacttaccatctcgaggacctgcgccgccgccagtccattatcaatgagctcaagaaggcccagtgggggagttccggtgccgcgagcgagcctgtggtactgggggaggagggctgcggctttccgtcaacgaatgagtaccccgatcttgaagaggaacgagccacctacccgcaggaagaagacagattcctaaccccggggcgggcacaactactgtggagcccatggtcaccactggaccaggaagaagcctgcgcttcaaggcagttgcacagtttggcatctttttcaaccgtgaccgcccgcaggaaccccctgcacaacccttggggtatggagctggccgcctcagaggaatag

SEQ ID NO: 15995 - DNA, 1680 bp, Artificial Sequence
  Description of Artificial Sequence: Synthetic coding sequence
atgaatccgctgttcggaccaaatcttttcttactccaacaggagcagcagggtctggctgggcccttaggggatagcctgggaggagatcattttgctgggggaggggacctgccgcctgccccactgtcaccagctggccctgctgcgtattctccacccggccctggaccagcgcccccagccgccatggctctgcgaaacgacttaggatctaacatcaacgtccttaagactctaaatctgcggtttcgatgtttcctggcgaaggtgcacgagttagagcggaggaacagattgctagagaagcagctgcagcaagcccttgaggaaggaaaacaggggagacgggggttaggtagaagagatcaggctgtgcagaccgggttcgtgtctcctatacgtccactcggcctgcagcttggtgctcgtccggccgctgtgtgttctcctagtgctcgggtgttaggtagcccagcaaggagccccgcaggtccactggctccttcagcggcatccctgagctcctcctcaacaagtacctctacaacttattcttcttccgcccggttcatgccaggcaccatatggtctttctctcacgccaggcgtctgggacccgggctagagccgactctggtccaggggcccggcctctcatgggtgcacccagacggcgtgggcgttcagattgacaccataactcctgagatccgcgcgctgtacaatgtgcttgccaaagtaaaacgagagcgggacgagtataagcggcggtgggaggaagaatacaccgtgcgtattcaactccaggaccgagtgaacgagctccaggaagaggcccaggaagccgatgcctgccaggaagaacttgcactgaaggtagaacagcttaaggcagagctggtggtattcaaggggctcatgagcaacaatctctccgaattagatacaaaaatccaggaaaaagcaatgaaagttgacatggacatctgccgccgaatcgacatcactgcaaaactgtgcgacgtcgctcaacagagaaactgtgaggatatgatccagatgtttcaagtgccttctatgggaggtaggaagcgggaaagaaaggccgcagttgaagaagatacttccctgagtgagtctgaagggcctcggcagcccgacggagacgaggaggaatccactgccttgagcataaacgaagaaatgcagaggatgctgaatcagctgcgggaatatgatttcgaggatgattgcgactctttaacatgggaagagactgaggagacactcctgctctgggaagatttctccggctatgccatggcggctgctgaggcccagggagagcaagaggattctctggagaaggtcattaaggatacagagtcactgttcaagacccgggagaaggagtatcaggagacgatagatcagattgagctagagctggcaaccgctaaaaacgacatgaaccgccatctccacgagtacatggagatgtgcagcatgaagagaggcctcgacgtgcaaatggagacttgccgccgtctgatcacgcaatctggcgacaggaaatcgcctgcctttaccgccgtgcccctgtcggatccgcccccacccccctcggaagccgaagatagtgacagggacgtatcatctgactcttcaatgagatag

SEQ ID NO: 15996 - DNA, 1182 bp, Artificial Sequence
  Description of Artificial Sequence: Synthetic coding sequence
atggcttctggacgggctaggtgtacgaggaaattgcggaattgggtggtagaacaggtagagtccggacagttcccgggtgtctgctgggatgataccgcaaaaaccatgttccgcataccatggaaacacgctggcaaacaggattttcgtgaggaccaggatgcagcattttttaaggcttgggcaatattcaaaggaaagtacaaggagggcgatacggggggccccgccgtttggaagacccgactgcggtgtgctctgaataaaagtagtgaattcaaggaagttcctgagagaggccgaatggacgtcgccgaaccctataaggtttatcaattacttccaccagggatagtgagcggtcaaccgggaacacagaaagttccctcaaaacggcaacatagttcagtttcaagcgagcgtaaggaggaagaagatgcgatgcagaattgtactctgtcaccaagcgtgctgcaagactccctgaataacgaggaggaaggagcctctggaggggccgtgcattccgacataggaagcagcagttctagttcctctccagagccacaggaagttacggatactacagaggcccccttccagggagaccagcgcagtctggaattcctccttcctcccgaacccgattacagtctactcttaacctttatctataatgggagagtggtgggcgaggcacaggtgcagagtctggactgcaggcttgttgcggaaccttccggaagcgagtcttccatggaacaggtgctgtttccaaaaccagggccgctggagcctactcagagactgctctctcagctggagaggggtatcctagtggcttccaatccaagggggctatttgtgcaaagactgtgccccattcctatatcgtggaacgcaccccaggcaccccccggccctggtccccatctcctgccttctaacgaatgcgtggagctgttccggacagcttatttctgccgggatctggtacggtattttcagggattgggacccccaccaaaattccaagtaactcttaatttttgggaggaatcccacggctcatcacatacaccacagaatctcatcaccgtgaaaatggaacaggcttttgctagatatctgcttgagcagacaccagagcagcaggccgccatcctctctttagtgtag

SEQ ID NO: 15997 - DNA, 2454 bp, Artificial Sequence
  Description of Artificial Sequence: Synthetic coding sequence
atgtggtccctgacagcatccgagggcgagtctactacagctcatttcttcctgggcgccggcgacgaagggctgggcactcggggcatcggaatgcgaccagaggagtccgattctgaactcctggaggatgaggaagacgaagttccaccggaacctcagattatagtgggaatctgcgcgatgaccaagaaaagcaagagcaagccgatgacacagattcttgagcgcctgtgccgtttcgattatctcaccgtcgttatattaggtgaggacgttatcctcaatgaaccagtggagaactggcctagctgccattgcctgatttccttccactcaaaagggtttcctctggataaggccgtagcctactcgaagttacgaaacccatttcttattaatgatttagccatgcagtactatatccaggacaggcgcgaggtgtataggatcctgcaagaagaaggtatcgacttgccacggtacgcagtacttaacagagatcctgcccgcccagaagagtgcaacctgatcgagggggaagatcaagtcgaagtcaacggtgccgtcttccccaagcctttcgtggaaaaacccgtgagtgctgaagaccacaatgtgtacatatactacccctcttccgctgggggcgggagccagcggttgtttagaaagatcggttcacggtcgagcgtttacagtcctgaaagttcagtgagaaagactggatcttacatctacgaggaatttatgccgactgatgggaccgacgtaaaagtgtacacggtgggcccagattacgcccatgcagaagcaagaaagagccctgccctcgacgggaaggtggagcgcgacagtgagggcaaggaaattcagtacccagtgatgctgactgccatggagaagttagtcgccaggaaggtgtgcgtggcatttaagcaaacagtctgtgggttcgatctactgagggctaacgggcacagctttgtctgcgacgtgaacggattctcttttgtcaagaattccatgaaatactacgatgattgtgccaagatccttgggaatacgattatgcgagagcttgccccccagtttcagattccatggagcatcccaacagaagccgaggacatcccgatcgtccccaccacctctggaactatgatggagctgcgatgtgtgatcgcaattatcaggcacggggaccggacccctaagcagaagatgaagatggaagtgaaacatcctaggtttttcgccctttttgaaaaacatggaggatataaaactgggaaacttaaactcaagaggcctgaacagttgcaagaagtgctggatatcactcggctccttcttgcagaactcgagaaggagcccgggggggaaatcgaggaaaaaacgggaaaactcgagcagcttaagtcagttcttgaaatgtatggccactttagtggaatcaacagaaaagtccaacttacctattaccctcatggcgttaaggcatccaatgagggccaggatccccagcgcgagacactggcgcctagtcttcttctggttttgaagtggggaggggagctaaccccagcggggagggttcaagccgaggaattggggagggctttcagatgcatgtacccgggtggacagggcgactacgcgggcttccccggctgtggactcttgcgcctgcatagcacctttcgacacgatctcaagatctacgcctcagatgaaggtagggtgcagatgaccgctgccgcgttcgctaagggtttactcgccctggagggagagctgaccccaatcctggtgcagatggtgaagagcgccaatatgaacgggttgcttgactccgatggagactctctgtcatcctgccagcaccgggtgaaagctcgattgcaccacatcctgcagcaggatgcacctttcggcccagaggactatgaccaactagccccaaccaggtcgaccagcctgctcaatagcatgacaattatccagaatcctgtgaaggtttgtgatcaagtgtttgcgctgattgagaatctgacccaccagattcgggagaggatgcaagatcccagatccgtggatctccagctgtatcattcagaaaccctagagttgatgctccagagatggtcaaagctggagagagattttagacagaagtcgggacgatacgatatctctaagattcccgacatatacgactgtgtgaagtacgatgtgcagcacaatggctctctaggtttacagggaactgctgagcttctgcgcctctccaaggcgctggctgacgtggtgatcccacaagaatatggcatcagtagagaagagaaactggaaatcgcagtcggtttctgcttaccgctgttaagaaagatccttctggacttgcagaggactcacgaagatgagagcgttaacaaactgcaccccctctag

SEQ ID NO: 15998 - DNA, 417 bp, Artificial Sequence
  Description of Artificial Sequence: Synthetic coding sequence
atgatcttacagcaacccctccagagggggccccaaggcggtgcccagagattgccccgcgctgccttgggggtgacttggggcctggatgccagcagcccattgcgtggggccgtgcctatgtcaacaaagagacgcctcgaggaagaacaggaacccttgcggaaacagttcctgagtgaggaaaatatggcaacccactttagccaattgagtctgcacaatgaccacccatactgctctcccccaatgactttttccccggcacttccgcctttgcgaagcccctgcagtgaactgttactttggcgctatccgggaagtctgatccccgaggctctccgtctcctgcgcctgggggacacgccgagcccaccctatcctgccactccggccggcgacattatggagctttag

SEQ ID NO: 15999 - DNA, 4302 bp, Artificial Sequence
  Description of Artificial Sequence: Synthetic coding sequence
atgtggagcctgacggcttcggagggagagagcactaccgcccatttcttccttggagccggtgatgaagggttgggaacaaggggcatcggtatgcggcccgaggagtctgatagcgaacttcttgaagacgaggaggacgaagtgcctccagaaccgcaaatcatcgtgggcatttgtgcgatgacaaaaaaaagcaagagtaagcctatgactcagatactggagcgcctctgcagattcgattatcttacagtggtgatcctaggagaggatgtgatccttaatgaacccgtcgaaaattggccttcatgtcattgcctcatctcctttcacagtaagggcttccccctcgacaaagccgtggcatactccaagttacgcaacccttttttgatcaacgatttagccatgcagtattatatccaggacaggagggaggtctatcgcatacttcaggaggagggcatcgatctccccaggtacgcagttttgaaccgagacccagccaggcctgaggaatgcaatttaatcgagggtgaagatcaggtagaagtcaacggagctgtgttcccgaaaccattcgtggagaagccagtctcagccgaggatcacaacgtttacatatattacccctcaagcgctggaggagggtcacaacgactctttcgcaagattggttctaggagctcagtctatagtcccgagagcagtgtcaggaagacagggagctacatttatgaggagtttatgcctacggatggaaccgatgtgaaggtttacaccgtgggtcccgactacgcacacgccgaggccaggaaatcccccgcgctggatggaaaggtcgaacgcgattccgagggcaaggaaatcagatacccagtgatgttgacagctatggaaaaacttgtcgcaagaaaagtgtgtgtggccttcaaacagactgtgtgtggatttgacctgttgagagccaacggacattcatttgtgtgcgacgtgaatggtttctctttcgtcaagaactcaatgaagtactatgatgattgtgccaaaatacttggaaacacgatcatgcgagagctcgctccccagtttcagatcccctggtccatacccactgaggctgaagacattcctatcgtcccgaccacgtccggcacaatgatggagctccggtgtgtgatcgccatcatacggcacggagatcgaacccctaagcagaagatgaagatggaggtgaaacacccacggttcttcgcccttttcgaaaagcacgggggatataaaaccggtaagctgaaactgaaacggccagaacagcttcaggaggtcctggatattacacggcttcttctcgctgaactcgagaaggagccggggggtgaaattgaagagaagaccggaaaactagagcagctgaaaagcgtgctggaaatgtatggacacttttccggaatcaataggaaggttcagctgacgtattacccccatggcgtgaaggcctccaacgagggtcaggatccacagagggagaccctggcaccaagtctcctcctggtgcttaagtgggggggggagctcactccagccggcagagtgcaggcggaggaactcgggagggcatttcgctgcatgtatcctgggggtcagggtgactatgcaggcttcccaggctgtggcttgttaaggctgcactcaactttccgccacgatctgaagatctacgcatcagacgagggaagagtgcaaatgactgccgccgccttcgcgaagggactcctggccctcgagggcgagctgacgcccatcctcgtccagatggtgaaaagcgccaatatgaacggactgctggattccgacggagactctcttagttcatgccagcatcgggtgaaagcccggctgcaccacattctacagcaagacgccccatttggccctgaggactacgatcagctggcccctactcgaagcacatccctgttgaactctatgactattatccaaaaccccgtcaaggtgtgtgatcaggtctttgctttgattgagaatctgacccaccagattcgtgagcgcatgcaagatcccaggtcagtggacctgcagctttaccactccgaaactctggaattgatgttacagcgctggtcaaagctcgaacgcgatttcaggcaaaagtctgggcgatacgacatttcaaaaattccagatatttatgattgcgtaaaatatgacgttcagcacaatggtagtctgggcctccagggaacagctgagttgctcagactgtccaaggccctcgcggatgtagtgattccacaagagtacggtatctcacgggaggagaagttggagatcgctgtgggcttctgtctgcctctgctgaggaaaatcctcctcgatctgcaacggacccatgaagacgaatctgtgaataagttgcacccattatgttacctgcgatacagtcggggggtgctgagtcccggaagacacgtgcgtaccaggctgtattttactagcgaatcccatgtgcatagccttctttccgtgtttcgctacgggggactactggacgaaactcaggacgctcagtggcagagggcgttggactatctgagcgcaatcagtgagctgaattacatgacccaaattgttattatgctgtatgaagataacactcaggatcccctcagcgaagagcggttccacgtggagctgcattttagccccggggtgaagggcgttgaagaggagggttctgctcctgctgggtgcggttttcgacctgctagctccgaaaatgaagagatgaaaactaaccaggggtcaatggagaatttatgcccaggcaaggcctccgatgagcccgacagggctctgcagaccagtcctcagcctcccgaaggacccggtctgcctcggcgaagcccactaattaggaaccgcaaagccggttctatggaagtcttgagcgaaacttccagttctagacctggcggttatcggctgttttcttcctccagaccccctacagagatgaagcaatctggtttagggagtcagtgtacaggccttttcagcacgaccgtgttaggtggatcaagctcggctcctaacttacaggattatgcacgttctcatggaaaaaagttaccccccgcatcactgaaacacagagatgagctactgttcgtacctgccgtgaagcggttttctgtcagcttcgcaaaacatccaaccaacgggtttgagggttgcagcatggtcccaaccatctatcctcttgaaactctgcacaacgccctgagtctcaggcaagtgagcgagtttctgagcagggtttgccagagacacacagatgcccaagctcaggctagtgccgctctattcgattcaatgcatagcagtcaggcctcagataaccccttcagcccacctcggaccctgcactcacctcctttacagcttcagcagcggtcagaaaagcctccttggtacagttctggtccgtccagcaccgtgagttcagcaggacctagctcccctactactgtggatgggaactctcagttcgggttcagcgaccagccatctctaaactctcacgtcgccgaggagcaccagggactcgggttactgcaagagaccccaggttctggagctcaagagctgtctatcgagggcgagcaggaacttttcgagccaaaccagagccctcaggtgcccccaatggagacctcacagccctacgaggaagtctcccagccttgccaggaagttccggatatttctcagccttgtcaggacatcagcgaagcactaagccagccttgccaaaaggtgcccgacatttcacaacagtgtcaggagaaccacgacaacgggaaccacacttgccaggaggtgccccacatctctcaaccttgccagaagtcatcccaactttgtcaaaaggtgtctgaggaagtgtgtcagctttgcttggagaatagtgaagaggtgtcacagccctgtcagggcgtgtctgtggaggtaggtaagcttgttcacaaatttcacgtcggcgtgggttctctggtgcaggagactctggtggaagtgggctctccggctgaagaaattccagaggaggtgattcagccttatcaagaattcagcgtggaggtgggaagactggcgcaggagacctccgccataaatctgctttcccagggaattccagaaatcgacaaaccttctcaagagtttcctgaggagatagatctgcaggcacaggaagtccccgaggaaattaactag

SEQ ID NO: 16000 - DNA, 435 bp, Artificial Sequence
  Description of Artificial Sequence: Synthetic coding sequence
atggcagaagtgcaggtcctcgtcttagacggaaggggccatcttctgggaagactggccgctatcgtggctaagcaggtgctcctgggcagaaaggtggtggtagttcggtgcgaaggcatcaatattagtggtaatttttatcggaacaaactgaagtaccttgcttttttgcgcaagaggatgaacactaacccctctcgcggaccataccactttcgagcaccttctcgaatcttctggcgcacagtgagggggatgctgccacacaagacaaagcgcgggcaggcggccctcgacagactgaaagttttcgacggcattccaccaccatacgggaaccgtcccagacgtacctggcggcgaaagctgacgaacacccaaagaagttcccgcccaactgacagttggagcgagccgaataaggattgttag

SEQ ID NO: 16001 - DNA, 408 bp, Artificial Sequence
  Description of Artificial Sequence: Synthetic coding sequence
atggctgctctgcgaccactcgtaaagcctaagattgtgaaaaagcgcaccaagaagttcatcaggcaccaaagtgaccggtatgtgaaaatcaaaagaaattggcgcaagcctcggggaatagataacagagtgcggcggcggtttaaaggacaaattttaatgcccaacattggatacgggagcaacaaaaaaaccaaacatatgctgcctagcgggttccggaaattcctggtacacaacgtcaaagagctggaggtcctgctaatgtgcaataaaagttactgcgcggagattgcccataacgtctcttcgaagaacaggaaggcgattgtggagcgagcagcccagcttgcgatcagggtcacaaacccgaatgccaggctccgctccgaggaaaacgaatag

SEQ ID NO: 16002 - DNA, 408 bp, Artificial Sequence
  Description of Artificial Sequence: Synthetic coding sequence
atggctgccctcaggcctctggtgaaacccaagattgttaagaaaaggacaaagaagttcatcaggcaccagtctgacaggtatgtcaagatcaagcgaaattggcggaagcccagaggcatagacaacagggtgcgaagacgctttaaaggccagattctcatgcctaatattggctatggctctaataagaagactaagcacatgctccctagtgggttcaggaagttcctggttcataacgttaaggaacttgaggtgctcctcatgtgtaataagtcatactgcgctgaaatagcccataacgttagcagcaagaacagaaaggccatcgtggagcgagcggcccagctggccatcagagtcactaatcctaacgcccggctacggtccgaggagaacgaatag

SEQ ID NO: 16003 - DNA, 684 bp, Artificial Sequence
  Description of Artificial Sequence: Synthetic coding sequence
atggagccccaagggtatcctgcctttgggtgggatcacagcctgcacaagagaaagagactaccaccggttaaaaggtccctggtctattacctgaagaatagggaggtacggttgcagaatgagacctcgtacagcagagtgctgcacggctacgcagcgcaacagctgccatctttgctgaaagagagagagttccacctggggactctgaataaggttttcgcaagccagtggctgaatcacagacaagtagtgtgcggcactaagtgcaacacgttattcgtggtggacgttcagacatcccagataaccaagattccaattttaaaggatcgggagccggggggtgtgacacaacaggggtgtggcatacatgctatagagctaaatcccagcaggaccctactcgcgactggtggggacaatccaaactccctggcaatctaccggctgccaacattggatcccgtgtgtgtaggggacgacggccataaagactggattttcagtattgcctggatatccgacaccatggcagtctctggaagccgggatgggagcatgggcttatgggaagtcaccgacgatgttctgactaaatcagatgctagacataatgtatccagggtccccgtttacgctcatatcacacacaaggctctgaaggatatacctaagtag

SEQ ID NO: 16004 - DNA, 1554 bp, Artificial Sequence
  Description of Artificial Sequence: Synthetic coding sequence
atgactcggcttggaacagtgcctcgaaaggccctcgagatgtcgtgcgctatccagaatcagctggctcggatcctcgcggagtttgaaatgacgcttgagcgggacgtgctgcagccattgtcccgcctgagcgaggaagagctacctgctattcttaagcataaaaaatccctacaaaagctggtctcagattggaacacattaaagtctcggctgagccaggccactaaaaactctgggtctagccaagggctgggcggtagccctgggtcacacagtcacacaacaatggccaacaaggttgaaacgctcaaggaagaagaagaggagctgaagagaaaagtcgagcagtgccgtgacgaatacctcgcagacctgtatcatttcgtgactaaggaagactcctacgccaactatttcatcaggctgctcgagatccaggctgactaccaccgcaggagtctgtcttcgctggatacagcgctggccgaactccgggagaatcacggtcaggcagatcactccccatcgatgaccgcaacgcattttccccgcgtgtacggagtgtctttagcgactcaccttcaggaactgggacgggagattgcgctcccaattgaggcgtgcgtcatgatgctcctatctgaggggatgaaagaagaaggcctgttcaggctcgcagctggggctagcgtactgaagcggcttaaacaaaccatggcaagtgaccctcattctctggaggagttttgttcagatccccatgcagtggccggcgcattaaagagttacctgagggaactgcccgagcctctcatgacatttgacctgtacgacgactggatgcgtgcggcctccctcaaggaacccggcgcccgcctccaggcgttacaagaggtgtgcagccgcctgccgcccgagaacctctccaaccttaggtacctaatgaagttcctggccaggctcgccgaagagcaggaagtgaacaagatgaccccatcgaatattgctattgtgctaggccctaatctcctttggccccctgagaaagagggcgatcaggctcaacttgatgctgcaagcgtctcaagtattcaggttgtcggcgtcgtggaagctcttattcagagtgcggacaccctgttcccaggtgacataaatttcaacgtcagtggtcttttctcagccgttactctgcaagacaccgttagcgataggttggctagtgaggaacttcctagtactgcagtgccgacacccgctaccactccagcaccggcccccgcccctgccccagccccagcgcctgcactcgccagcgccgcgacaaaggaaagaactgaaagtgaagtgccgccccggcctgcatcccccaaagtcactcgatcaccgcctgaaaccgccgctcccgtggaagatatggctcgtaggagccccaggggcgccactggcagaaaggagagattcgcctgtagttacggcactgactccagtcttgctgatatgttctttgtcagattagtcaacaagctcttctggacaaaactttag

SEQ ID NO: 16005 - DNA, 918 bp, Artificial Sequence
  Description of Artificial Sequence: Synthetic coding sequence
atggacctgtccggggttaagaagaaatcattgctcggcgtcaaagaaaataataaaaagtcgagtacccgggccccctctcccactaagcgcaaagaccgtagcgacgagaagagcaaagaccgtagtaaggataagggggctactaaagagtcatcggagaaggacagaggaagagacaagaccaggaagcgcaggtctgcctctagcgggagctctagcacccgatcccggtcttccagcacatcatcatccgggagctcaaccagcaccggatcttcctccggaagttcttcatccagcgcttccagtcgatcaggatcgagctccacctctcgcagctcctcttcctctagctccagtggcagtccaagtccgtctcgccgccgccatgataatcgcaggcggtcacggagcaagtccaagccgccgaagcgtgatgaaaaggagagaaagcgaagatctccatccccaaaacctactaaggtgcacatcgggaggttaactagaaacgtaacaaaggatcacataatggagattttctcaacctatgggaagatcaaaatgatcgatatgcccgtggagagaatgcatcctcacttgtccaaggggtacgcatatgtcgagttcgaaaaccctgatgaggccgagaaagccctcaagcatatggacggggggcagatcgatggtcaagaaatcaccgctacagcagtgcttgccccttggccacgacctccacctaggcgcttttcacctcctagacgcatgttaccaccacctcctatgtggcggagatccccaccccgcatgagaagacgctcccggtctccccgtagaagatctccagtgcgcagacgtagtcgaagccctggcaggcgccggcatcgttcacgctccagttcaaacagctcccgctag

SEQ ID NO: 16006 - DNA, 927 bp, Artificial Sequence
  Description of Artificial Sequence: Synthetic coding sequence
atgattcacgacgcccaaatggactactatggaactcgtctggctacctgtagttccgaccggtccgttaagatcttcgatgtgcgcaacggaggccagatactgatcgccgacttgaggggccacgagggacccgtgtggcaagtagcatgggcccacccaatgtacggcaacatcctagcttcatgtagctacgatcgcaaagtcatcatctggagagaagagaatgggacgtgggaaaagtcccatgagcatgcagggcatgactctagcgtcaacagcgtgtgctgggctcctcatgactatggtctgattctcgcatgcggctcgtccgatggagccatcagcttactcacctacactggagaggggcagtgggaggtgaagaaaatcaacaatgcccacaccataggctgcaatgcggtgagttgggcgcctgctgtcgtgcccggcagtttgattgatcatccaagcggccagaagccaaactacatcaaacgatttgcttctggaggctgcgacaacctgattaagctgtggaaagaagaagaggatggccagtggaaagaagagcagaagttggaagcgcacagcgactgggtgcgcgacgttgcctgggcccctagcatcgggctgccaacctcaaccatagcttcttgctcacaggatggacgggtcttcatatggacctgcgatgacgcttcttccaatacctggagccccaagcttctgcacaaattcaacgacgtggtctggcacgtaagctggtccatcaccgcaaacattctcgccgtgtcgggaggtgacaacaaagtgactctttggaaggagagcgtagatggccagtgggtgtgtatcagcgatgtaaacaagggtcagggctccgtgtctgccagtgtaacagaaggacaacagaacgagcagtag

SEQ ID NO: 16007 - DNA, 1542 bp, Artificial Sequence
  Description of Artificial Sequence: Synthetic coding sequence
atgagtattgagatagagtccagtgacgtcattcgactcattatgcagtatctgaaagagaattccctgcatagggcgctggcgacgttgcaggaggagaccactgtgagcctgaacaccgtggattctatagagtcctttgtggcagacatcaattctggacactgggacaccgtacttcaagctatccagagcctcaaactgcccgacaagacgctaatcgatctgtacgaacaggtggtgctggagctcatcgagcttagagaattgggtgctgcaagatctctccttaggcagactgaccccatgatcatgctaaaacagacccagcctgaaagatatatccaccttgagaacctcttggcgcgtagctatttcgacccgagagaagcgtaccctgacggctcctctaaagagaagcgtagagctgcaatcgctcaagcattagccggagaggtgtctgtggttccccccagtcggctcatggccctccttggccaggcactcaagtggcagcagcaccagggactcctccctccaggcatgaccatagacctttttcgcggtaaagcagccgttaaggatgtagaggaggagaagtttccgactcagctgtcccgccatataaagtttggccagaagtcccacgtcgagtgcgcacgcttctcaccagatggacagtatcttgtgaccggatctgtggacgggtttatcgaagtgtggaatttcacaaccggtaagataagaaaagatttgaagtaccaggcacaagacaacttcatgatgatggatgacgccgtgctgtgcatgtgtttttctcgcgacactgagatgttggccaccggtgctcaggacggcaagattaaagtgtggaagatccagtccggacagtgcctgcgaagattcgagcgtgcacatagcaagggcgtgacctgcctctccttctccaaagactcctcacagatcctgtccgcgtcctttgaccagacgatccgtatccatggtttaaaatctgggaaaacacttaaagagtttcgtgggcacagcagcttcgtgaacgaagccacattcacccaagacggtcattatatcatctcagcttcctccgacggcacggtgaagatttggaacatgaaaaccacagagtgctccaacaccttcaaaagcctggggtcaactgctgggacagacatcaccgtaaattcagtgatcctgctgcctaaaaatcctgaacacttcgtggtgtgcaaccgaagtaacacagtggtgattatgaatatgcagggacagatcgtcagatccttctcttcaggtaagcgagaaggcggcgattttgtgtgttgtgccctatccccacgtggagaatggatttactgtgtgggagaggatttcgttctctactgcttttcaaccgtgactggcaaattggagcgaacattaactgtccacgagaaggatgtcatcgggattgctcatcatccccaccagaatttgatagcaacatactccgaggacggcctgctgaaactctggaagccgtag

SEQ ID NO: 16008 - DNA, 2136 bp, Artificial Sequence
  Description of Artificial Sequence: Synthetic coding sequence
atgagtagcgtgcagtcacagcaggagcagctgtcccagtcagatcccagccctagtccgaattcatgctcgagttttgagctgattgacatggatgcgggcagtctatacgaaccagtgtcaccgcactggttttactgtaagatcatagactcaaaggagacgtggatccctttcaacagtgaggattcacaacagctggaagaggcatatagcagcggcaaagggtgtaatggacgggttgtcccgaccgatggtggaaggtacgatgtccatctgggtgagcgaatgcggtatgcggtgtactgggacgaactcgcaagcgaggtgagacgctgcacatggttctacaaaggggataaagacaacaaatatgtaccgtattccgagtctttctctcaggtgctggaggaaacttacatgctggccgtgacactcgatgagtggaaaaagaagctggaatcgcccaaccgggagattatcatccttcacaacccaaagctcatggtgcactatcagcccgtcgccggttccgatgactggggctcgacccccaccgaacagggacgacctcgcacagtcaaaagaggggttgagaacatttccgtagacatccactgcggagagcccctccaaattgatcacctggtcttcgtcgtgcacggaattggaccagcctgcgatcttagattccggagcatcgtgcagtgcgtgaacgatttcagatcagtgtccctgaaccttctgcaaactcacttcaaaaaggctcaggaaaaccagcaaatcggccgcgtggagtttcttccagtgaattggcacagtccccttcattctactggcgtggacgtggatctgcaacgcataaccctcccttctattaatagattacgtcactttacgaacgacactatactagatgtatttttctacaatagccctacctattgtcagacaattgtcgataccgtggctagtgagatgaatagaatttatactctgttcttgcagcggaatcctgacttcaaggggggggtgtctattgctggccactccttggggtcactcatcctgttcgacatcctgaccaaccagaaagactccttgggcgatattgatagtgagaaagactctctgaacattgtgatggaccagggcgatacacctacccttgaggaagatctcaaaaagctgcagctcagtgagttctttgatattttcgagaaagagaaagtggacaaggaagccctggcactgtgcacagatagggacctgcaagagattggaatcccacttgggccgcgtaaaaaaatattgaattacttttccacccggaagaatagtatgggaatcaagcgcccggctccacagcccgccagtggcgccaatattcccaaagagtccgagttttgcagtagttccaacacccggaacggcgactacttggacgtgggcatcgggcaggtttcggttaagtatcctcgactcatatacaagcccgaaatcttttttgcgttcgggtcacccataggaatgttccttacagttcgaggtctcaagcgcatagatccaaactaccggtttccaacttgcaagggttttttcaatatttaccacccgtttgaccctgtggcttaccgcatcgaacctatggtggtcccaggagtcgaattcgagccaatgctcataccccaccacaaagggagaaagcgcatgcacctggagcttcgcgagggtctcacaaggatgagtatggatctgaagaataatctgctggggtcactaaggatggcatggaagtcttttactcgagccccctaccctgccctacaggcctcggagacacccgaagagactgaggccgagcccgaaagtacatccgaaaaacccagcgatgtgaacaccgaggagacatccgtggccgttaaagaggaggtcctgcccatcaacgtaggaatgctgaatggggggcagcgaattgactatgtgctgcaggaaaaacctattgaaagttttaatgaatatctgtttgctctgcagtctcacctgtgttactgggaaagtgaagatacagtgctgctggtccttaaggagatctatcagactcagggcatctttctggaccaaccactacagtag

SEQ ID NO: 16009 - DNA, 3351 bp, Artificial Sequence
  Description of Artificial Sequence: Synthetic coding sequence
atgtatggaagtgcccgtagcgtggggaaggttgagccatcatctcagagcccaggcagatccccccgtctccccaggagccccagactaggtcacaggagaacaaattctacaggcggctctagcgggtcgtccgtgggaggggggtctggcaagaccctgtctatggagaatattcaaagcctgaacgccgcatacgctacaagcgggcccatgtatctttctgaccacgagaacgtaggatctgagaccccaaagagtacgatgaccctggggagatctggaggccgcctgccttatggggtgcggatgacagcaatggggagttcaccaaatatcgcttcttccggggttgcctctgatacgatcgcattcggagagcatcacctgccccccgtgtccatggcatctaccgttccccattccctgcgtcaagctagagataacaccatcatggacctccagacccaactgaaagaagtgttgcgagagaatgacctgttaagaaaggacgtcgaagtaaaggaaagcaaactatcctcatcaatgaacagtattaagacattctggtcacccgagctgaaaaaggagagagccttgaggaaagatgaagccagtaagattacaatctggaaagagcagtatagggtcgtgcaggaagaaaatcagcatatgcagatgaccatccaagccctccaagatgaactgcggattcagcgcgatctcaatcaactgttccaacaggactcgtcctcaagaacaggcgagccatgcgtggccgaactcaccgaagaaaactttcaaaggcttcatgcggagcacgaaaggcaggccaaagagctgttcttgctccgtaagacgcttgaagaaatggagcttaggatagagactcagaagcagacgttaaacgcacgcgacgagtctatcaagaagctgttggaaatgctgcagtcaaaggggttatcagccaaggcaacagaggaagatcacgagcgcaccagaagactggcagaggctgaaatgcatgtccaccatctggaatctctcctagaacagaaggagaaggaaaacagcatgctgcgggaggagatgcaccggcgcttcgaaaacgctcctgactctgcaaagacgaaggctctccagactgtaattgagatgaaagatagtaagatctccagcatggagaggggcctgcgcgatctggaggaggagattcagatgctgaagagcaatggagctctgagcaccgaggaacgcgaggaggaaatgaagcagatggaggtctaccgctcacacagcaaatttatgaaaaataaagtggagcaattaaaggaggaattgtcgagtaaagaggcccagtgggaggagctcaaaaagaaggccgccggactacaggccgagattggtcaggtgaaacaggaattgtctcggaaagacactgagctactggcgctgcagacgaaactggagacactgaccaaccaattctcagattctaagcaacacatcgaagtacttaaggagtctctcaccgccaaggaacagagagccgccattttgcagaccgaagtggatgcactcaggctgcggctggaggaaaaggaaacaatgctgaacaaaaaaaccaagcagatccaggacatggctgaagaaaaaggcactcaggccggggagattcacgacctcaaagacatgcttgatgtaaaggaacgtaaagtgaacgtgctccaaaaaaaaatcgaaaacctgcaagaacaactgagggacaaggagaaacagatgagtagcttaaaagagcgtgtaaaaagtctccaggccgacacaacaaacacagacaccgcactcaccacactcgaagaagctttggctgagaaagaaagaacaatcgaacgtctgaaagagcaaagagatagagacgaacgcgaaaagcaagaggaaattgataattacaaaaaggacctcaaggatctgaaagagaaggtctccctgctccagggagatctcagcgaaaaagaggcctcactgttggatctgaaggagcacgcctcctcactcgcttcttcggggctgaaaaaagattctcgcttgaaaacattggaaattgccctggaacaaaagaaagaagagtgcctgaagatggagagtcagctgaagaaggcccacgaagccgctctagaggctcgcgcttcccccgaaatgagcgaccggatccagcacctggagcgcgagatcaccagatataaggatgaaagctccaaggctcaggcagaagtcgataggctgctggagatattgaaagaggtggaaaacgagaagaacgacaaggataagaagatcgccgaactggagaggcaggtgaaagaccagaataaaaaggtcgcaaatctgaagcacaaagaacaggtggagaaaaaaaagagcgctcagatgctggaggaggcccgcaggcgtgaggacaacctcaatgattcatctcaacagctgcaagactctctccgtaaaaaagacgatagaattgaagagctggaagaagccctcagggaaagtgtgcaaattacagcagagagggaaatggtactggctcaggaagagtccgctaggacaaatgcggaaaaacaggtggaggagttgttaatggccatggagaaggtaaaacaggaactggagtcaatgaaagcaaagcttagctccacgcaacaatcgctggcagaaaaagagactcacctgactaacctccgggccgaacggagaaaacatttggaggaagttctggaaatgaagcaggaagctctcctcgccgccatttccgagaaggatgctaacatcgcactcctggagctcagtagttccaaaaaaaagacacaagaagaggtcgccgccctcaagagggaaaaggatcgcctagtgcaacagctcaaacagcagacgcagaatcgcatgaagctgatggcagacaactacgaggatgaccattttaaaagcagtcacagcaaccaaaccaatcataagccttctccagatcagattatccagcctctgttggaactggaccagaatcgctctaaattaaagttgtacattggtcatcttacaacgttatgtcacgatcgggacccattgattctgagaggattgaccccacctgcgagctacaacctggacgacgaccaagcggcctgggaaaatgagcttcagaaaatgactcgtggccagctgcaagacgaactggagaagggggagcgggacaacgccgagctccaggagttcgcaaacgctattttgcagcaaatcgccgatcattgccccgatattctggaacaggtggtcaatgcactggaggagagctcctag

SEQ ID NO: 16010 - DNA, 1233 bp, Artificial Sequence
  Description of Artificial Sequence: Synthetic coding sequence
atgcagaacatccacggcaaggagattgatctgttgagaacaaccgtgaaggtgccgggaaaacggctgcctcgggccacgcctgctactgcacccgggacctctccgagggcaaacggcctgtccgtggagcgctccaacactcagttggggggaggcaccgcatctgggcccgcggaggttctgtcttcctccccaaagctagacccaccaccttcccctcactccaacaggaagaagcaccgccgaaagaagagtaccggaacccctcgaccagatggcccttcctccgctaccgaagaagcagaagagtcattcgaatttgtagtggtgagtttaaccggccagacgtggcatttcgaggcctccaccgcagaagagagagagctgtgggtccaatctgtgcaagcacagattctggcgtctctgcaggggtgccggagcgccaaagataagactcggttgggaaatcaaaacgcagcgttggctgtccaggcagtgaggactgtacggggtaattccttctgtatcgattgcgatgctcccaatccggactgggcatccttaaatctcggggccctcatgtgtattgaatgttccgggatacacaggcacttaggggcccacctgagtagggtccgatccttagaccttgatgactggcccccagagctacttgcagtgatgaccgccatgggtaacgccttggctaactcagtctgggaaggtgcactcgggggctattctaaaccagggcctgacgcctgccgggaagagaaggagagatggattcgcgcaaagtatgaacagaagctcttccttgcgcccctcccgagttccgacgtaccactagggcagcaacttctgcgggctgtcgtggaggatgacctgcgcctcttggtgatgttgctggcgcatggatccaaagaagaggttaatgagacctacggggacggtgacggacgcactgcactgcacctgagcagcgctatggcaaatgtggtgttcacacagctcctgatatggtatggtgttgacgttagaagccgggacgccaggggactcacaccactcgcctatgctcggagagccggaagccaagaatgtgccgacatcctgattcagcacgggtgccccggtgagggatgcggcctggcccctacaccaaatagagaaccagctaacggtaccaatcccagtgccgagttgcacaggagtccatcccttctgtag

SEQ ID NO: 16011 - DNA, 492 bp, Artificial Sequence
  Description of Artificial Sequence: Synthetic coding sequence
atgtccgacagcccagccggttccaatccacgaacccctgagagtagcggtagtggatccggaggaggcggtaaacggccagcggtaccggccgcagtttctctgctgcccccagcggatcctctgcgacaggcaaatagactccctatccgggttctcaagatgttaagcgctcacaccggccacttgctgcatccagagtatcttcagcctctcagctcaacccccgtctctcccatcgagttggatgctaagaaatctccgctggccctcctggcccaaacatgctcccaaatcggttcacccgggagcctcagcctcaggaatcctcatacactgggcctgtcccggtatcacccctacgggaaatcacacctttccactgcaggtggcctggcagtaccttcactgcccaccgcgggtccttattacagcccttatgccctgtacggacagcggctcgctagcgcctcagccttagggtaccaatag

SEQ ID NO: 16012 - DNA, 2736 bp, Artificial Sequence
  Description of Artificial Sequence: Synthetic coding sequence
atgaacttccaagctggaggcggccagtctccacagcagcagcaaagtcttgctgcccctggtgggggtggggccgccgctcaacagctcgtctgcgggggacaatttgggggggccggacctggggccggaggcggaggggggccgtcccagcaactggctggggggcccccgcagcagtttgctctgagtaactccgctgcaatccgcgctgaaatccagcgatttgagagtgtgcacccaaatatatacgcaatctacgacctgattgagagaatagaggatctggccctccaaaatcaaataagagagcatgtgatcagcattgaggatagtttcgtaaatagccaggaatggacgttatcccgatcagttcctgagctgaaggtcggcattgttggtaacctgtcaagcggcaaatccgcgctggtccataggtacttgaccggcacatatgtgcaagaggagtctcccgagggcggacgcttcaagaaggaaatcgtcgttgacggccaatcatatctgcttctgatcagagatgagggaggaccacctgaactgcagtttgctgcctgggtggatgccgtggtgttcgtgttcagcctagaggatgagatttcttttcagacagtgtataattactttctgcgcctgtgttcattccgcaatgccagcgaagtgccgatggtgcttgtcggaacccaggacgcaattagtgcagccaatcctcgtgttatagacgacagcagagcccggaaactgtcaacagatctcaaacggtgcacttattacgaaacctgtgctacatacggactgaacgttgagcgcgttttccaggacgtggcccagaaagtggttgccctgagaaagaagcaacaattggccatcggcccatgtaagtctctcccaaacagtcctagccactctgccgtgagtgccgctagcataccagccgtgcacatcaaccaggctacaaatgggggggggtcagccttctccgactactcaagctccgttccatccaccccaagcatcagtcagcgggagctgcggatagaaaccattgcggcttcctccactcctacccctataaggaagcagagtaaacgtaggagtaacatatttacatcgaggaaaggcgctgatcttgatagagagaagaaagccgctgaatgtaaagtggacagcatcggaagtggccgcgccattcctattaagcagggaattctccttaaaaggagtggaaagagcctgaataaagagtggaaaaagaaatacgtgacactttgtgataatggcctattaacatatcatccatctctgcacgattacatgcaaaacattcatgggaaggaaattgatctgttgcggacgacagtgaaggtacctggaaaaagactaccccgtgcgacgccagcaaccgctcctggaaccagcccaagagctaatggtttgagcgttgaacgaagcaatactcagctgggaggggggactggagctccacactcagccagctctgccagcctgcatagtgaacgtccactgagtagctctgcgtgggctggacccaggcctgagggcctccatcaacgcagttgtagcgtgtctagcgcagaccagtggtccgaggccactacatcgctccccccgggcatgcagcaccctgcctctggaccagccgaagttctgagtagttcacccaaactggatcctcctccctctccccatagcaacaggaagaagcacaggagaaaaaagtctacaggaaccccccgcccggacgggcctagtagtgctaccgaggaggctgaggaatcattcgagtttgttgtggtctcattaacaggacagacatggcatttcgaggcaagtactgccgaagaacgggagctctgggtgcagtcggtgcaggctcagatactggccagtctgcagggctgccggtcagctaaagacaaaactagacttggcaaccaaaacgcagccctggcagtgcaggccgtcaggaccgtgcgaggaaattctttctgcatagactgtgatgccccaaatcccgattgggcatccctgaacttgggtgctcttatgtgcatagagtgtagcggtattcaccgacacctgggagcccacctgtccagagtaaggtctctcgacctggacgactggccaccggaactcctagctgtcatgacggcgatgggtaatgccttagcaaactctgtatgggaaggcgctcttggtgggtactcgaagccgggacccgatgcatgcagggaggaaaaagaacgttggatccgggcgaagtacgagcagaagctgttcctggccccgctacccagcagtgatgtcccactcggtcagcagttactgcgcgcagtggtcgaagacgatctccgattactggtcatgcttctagctcatggaagtaaagaagaggtgaacgaaacgtacggtgacggagacggccgcaccgctcttcacctaagcagtgctatggctaacgtggtctttacacagctgctcatttggtacggagttgacgtcaggtcccgcgatgccagggggcttaccccactggcctacgcacgccgggcggggagccaagagtgtgcagatatattaattcagcatggttgtcctggcgaaggctgcggcctcgcccctactcctaatagggaacctgctaacggaacaaatccaagcgcagagctgcatagatccccatctttgctgtag

SEQ ID NO: 16013 - DNA, 1059 bp, Artificial Sequence
  Description of Artificial Sequence: Synthetic coding sequence
atggatatcgataaagatctcgaagctcctttgtacctgactccagagggctggtccctcttcctgcagagatactatcaagtcgtccacgaaggggccgagctacggcatctggatactcaggtccaacgttgtgaggatatacttcagcaactccaggccgttgttccacagatcgacatggagggcgacaggaacatttggatcgtgaaaccgggcgcaaaatcacgaggacgagggatcatgtgcatggatcacttggaggaaatgctaaaactggtgaacggtaatcccgtcgttatgaaagatggtaagtgggtggtgcagaagtacatcgaacgtcccctcctcattttcggtaccaaattcgatttgcgacagtggtttttggtgaccgactggaaccctctgacagtgtggttttaccgggatagctacataagattctctacgcagccattcagtctgaagaacctggataattcagtccatttatgcaacaacagtatacagaagcatctcgagaactcatgccacaggcatcccttgcttccaccagacaacatgtggtcgtctcagcgctttcaagcccatttacaggaaatgggtgcccctaatgcgtggtcaacgattatcgtgccaggcatgaaggatgcagttattcatgctctgcaaacgagccaggataccgttcagtgtcggaaggcatcgtttgagctttacggcgcggactttgtgttcggcgaggactttcagccatggttgattgaaatcaatgcttcacctaccatggctcccagcacagctgtgaccgccagattgtgtgccggagtccaagccgacacactcagggtggtcattgacaggatgctggatagaaattgcgataccggggctttcgagctcatatataaacagcctgtgacaacctctcctgctagcacacccaggccatcctgcctgttaccaatgtacagcgacactcgtgcccggagcagtgacgattctacggcaagctggtgggctctgcgtccgtgtcggccacaggctagaccctag

SEQ ID NO: 16014 - DNA, 507 bp, Artificial Sequence
  Description of Artificial Sequence: Synthetic coding sequence
atgacagcgaccctgcgcccataccttagtgcggtgcgtgccaccttgcaagccgcgctgtgcttagagaactttagctcacaagtcgtggagaggcacaataagcccgaggttgaagtcagatcatctaaagaactactcctgcaacctgtcaccataagtcggaatgagaaggagaaggtcctgatcgaaggatctattaattccgttcgcgtcagcatcgccgtgaagcaggccgatgagatcgaaaagattctgtgccacaagttcatgcggtttatgatgatgagggctgagaattttttcattttgcggaggaaacctgtggaaggatacgatatatcctttctgattaccaattttcatacagagcagatgtataagcacaaactcgttgactttgtgattcatttcatggaagagattgacaaggaaatctccgagatgaaactatctgtgaatgctagggcaaggatcgtggccgaagagtttctgaagaacttttag

SEQ ID NO: 16015 - DNA, 993 bp, Artificial Sequence
  Description of Artificial Sequence: Synthetic coding sequence
atggagcgttttatggaacaagtcgtttttaagtatttaagggcagaaccggaagaccattatttcttgatgaccgagcccccacttaacactccagagaacagggagtatctggctgaaatcatgttcgagtcctttaacgtgcccggactgtacattgctgtccaggctgtcctggccctggctgctagctggacctctaggcaggtgggtgaacgcacactcaccggtatcgttatcgattcaggcgatggcgtcacgcacgtcatccccgtggcggagggctacgtgatagggtcatgcattaaacatatacccattgccggtagggatatcacatatttcatccagcaactgctgcgcgagagagaagtcggtatcccccccgaacagtccctggagactgctaaggcaattaaggagaaatactgctatatatgccccgacatcgtgaaagagttcgccaagtacgacgtagatccccgtaagtggataaagcagtacacaggaataaatgctattaaccagaaaaagtttgtcattgacgttggttatgagaggtttcttggtcctgagatttttttccaccctgaatttgccaatcccgattttatggagtctatctccgacgttgtggacgaagtgattcaaaactgcccaattgatgtgcgtagaccactctacaagaatgtggtgctgtcgggtggcagcaccatgttccgggatttcggcaggagactgcagagagaccttaagagagtggtcgacgcccgcctacgcctgtctgaggagctttcagggggcaggattaaacccaagccagtggaagtacaggtcgtcacacatcacatgcaaaggtatgcagtctggtttggagggagcatgctggcatccacaccggaattctttcaggtgtgccacactaaaaaagattatgaagaatacggccccagcatatgcaggcataatccggtgttcggagttatgtcctag

SEQ ID NO: 16016 - DNA, 894 bp, Artificial Sequence
  Description of Artificial Sequence: Synthetic coding sequence
atgaaaaccctcagccccgacaggatccagccccatattatgaccgacgtgcctgcaacattcacccaggctgagtgcaacggcgacaaaccgcccgagaatggacagcagactatcacaaagatatcagaggagttaactgatgtcgacagccctttgccccactaccgggtagaaccaagcctcgagggagcattaacaaaggggtcacaggaagagaggcgtaagctacaagggaacatgttgctgaattcaagcatggaggacaagatgctgaaggaaaaccctgaggagaagctgtttattgtgcacaaggccatcactgatctcagtctgcaggagacatctgccgacgagatgacattcagagaaggacaccagtgggagaagatcccattgtccggctccaaccaggaaatcaggcgccaaaaagaacggatcacggagcagcctctgaaagaggaagaagatgaagatagaaagaacaagggtcatcaggccgctgagattgaatggcttgggtttcggaaaccatcccaagccgacatgcttcactccaagcacgatgaagagcaaaaggtgtgggacgaagagatcgacgacgatgacgacgataattgcaacaacgacgaggatgaagtcagagttatagagtttaaaaaaaaacacgaggaggttagccagtttaaagaggaaggggacgcttctgaggattctcctctgtcatctgctagtagtcaggccgtcacccccgatgagcagccaacccttggtaaaaaaagtgatattagtcgcaacgcttacagtaggtacaacaccatctcgtaccgcaagataaggaaaggcaatacaaagcagcgtatcgacgagtttgaaagtatgatgcacttgtag

SEQ ID NO: 16017 - DNA, 1074 bp, Artificial Sequence
  Description of Artificial Sequence: Synthetic coding sequence
atggtccagcctttcacaaccattccttttcctccccctcctcagaacggtattcctacggagtacggggttccccacactcaggactacgccgggcagacaggtgagcataatctcactctctacgggagtacccaagcccatggcgagcagtctagtaactcgcccagcacacagaacggatcccttactcagaccgaaggaggggcgcagacggacggtcaacagtcccaaacccaatcatcggaaaacagcgagtctaagtctacacccaagagattacatgtgtcgaatattcctttcagatttagggatcccgatctaagacagatgtttgggcagttcggtaaaatcctggacgtggagatcattttcaatgagagaggctcgaaggggttcgggttcgttacctttgagaactctgcggacgcagatagagctagggagaagctccacggcaccgtggtggagggtaggaaaatcgaggttaataatgctactgctcgcgttatgacaaataaaaagatggtcactccttacgctaatgggtggaagctgtccccggtcgtgggtgccgtgtacggccctgaactgtacgcggcttcctccttccaggcggacgtttcactcgggaatgatgctgctgtccccctgtcagggcgcggggggattaacacttatataccacttatcattccagggttcccatatcccactgccgcaacaacagccgcagcctttcgaggagcccatctccgtgggcgcgggcggacagtgtatggcgccgtgagggccgtaccacctactgccattcctgcataccctggagtggtttaccaggatggattctatggggctgacctgtacgggggatatgccgcgtatcggtatgcacagcccgctacagcaactgctgccaccgctgccgcagctgcggctgcagcatattccgatgggtatgggagggtctacaccgccgatccctatcacgcccttgccccggctgcatcttacggagtgggcgccgtggctagtctgtaccggggaggctacagccgctttgccccttactag

SEQ ID NO: 16018 - DNA, 387 bp, Artificial Sequence
  Description of Artificial Sequence: Synthetic coding sequence
atggttcagccctttactacgattcctttccccccccccccgcaaaacggaatcccaaccgaatatggtgtgcctcatacacaggactacgccggacagacgggcgagcataatctgacattatacggttctacccaggcacacggcgagcagagttctaactcacccagcacgcagaacgggtcactgacaactgagggcggggcacagacagatggacaacagtcacagacccagtcatcggagaactctgaaagcaaatccacccctaaaagactccatgtctctaacatcccattccgattccgagaccccgacctgcgccagatgtttggattcgggaagatccttgatgtcgagataattttcaatgagcgcggcagttag

SEQ ID NO: 16019 - DNA, 1071 bp, Artificial Sequence
  Description of Artificial Sequence: Synthetic coding sequence
atgcagggaattttgctgttggtgtttgccaagtaccagcacctgccatacatccagatcttgagcactaagtccacccctacagggttgttcggctattgggggaataagggtggggtgaacatttgtctgaagctgtacgggtactatgtaagtattattaattgtcacctgcccccccacatcagcaacaattatcaacgactggaacacttcgatcggattttagaaatgcagaattgtgaagggcgggacatccccaatatcctagatcatgatcttatcatctggttcggggacatgaacttccggatagaagatttcggactgcattttgtccgtgagtctattaagaacagatgctacggaggactatgggagaaagaccagctctccattgccaagaaacacgatccccttctgcgcgaatttcaggagggccggctgcttttcccacccacatataagttcgatcggaatagtaatgattatgataccagtgagaagaaacggaagccagcatggaccgataggatcttatggagactcaaaagacaaccgtgcgctggacccgacacacctatccctccagcctcgcatttcagcctgtcccttagaggttatagctcgcacatgacatacgggattagtgaccacaaacctgtttccggcacatttgatcttgagctcaagcccctcgtcagcgcccccctgattgtgctgatgccggaggatttatggacagtggagaatgacatgatggtgtcttattccagtacaagtgatttccctagctcaccgtgggactggataggactgtacaaggttggattgagagatgttaacgattacgtgtcttacgcttgggtgggggattccaaagtgtcatgttccgacaacctgaaccaggtatacattgacatcagtaatatccccaccactgaagatgaattcctactctgctactacagcaattctcttcgctcagttgtcgggatctcccgtccattccagatcccgcccggtagcttacgagaggaccctctcggcgaggcacagcctcagatctag

SEQ ID NO: 16020 - DNA, 1752 bp, Artificial Sequence
  Description of Artificial Sequence: Synthetic coding sequence
atgctgagtgagtccaaggagggagaggagaaggaggaggtgacaatggatactagcgaaaatcggcctgaaaacgacgtgccagagccgccgatgcctattgcggaccaggtgtccaacgatgatagacccgaaggatccgtcgaagatgaagaaaaaaaagagtcttccctgcccaaatccttcaagcgaaaaatctccgtcgtttccgctacgaagggcgttcccgcaggaaatagcgacaccgagggtggccagccgggccggaagcgcaggtggggcgcttctaccgcaaccacccagaagaagccgtccatctcaataactactgagagcctaaagtcgctcatccccgatatcaaaccgctcgccggacaggaggctgtggtcgatctccatgcggatgactcccggatctcagaagacgagactgagcgaaacggcgatgatgggactcatgacaaagggttgaaaatttgcaggactgttacccaggtcgtgccggccgaaggccaggagaacggccagcgcgaggaagaagaagaggagaaagagccagaagccgagccaccagtgccgcctcaggtatccgttgaggtggctctgcctccgcctgccgaacacgaagtcaagaaggtcaccctaggcgatacccttaccagacgatctatatctcagcagaaatctggagtctccatcaccatcgacgaccctgtgcggactgcacaggtccctagccccccacgtggcaagatttcaaatatcgtgcatatcagcaatttggttcggccattcactctggggcaactaaaggagctgctcgggagaacggggacattggttgaggaagcgttctggattgacaagattaaatcccactgcttcgtgacatactcaacggtggaggaggcagtagccactaggacagccctgcatggggtcaagtggccgcagtcaaatcctaaattcctgtgcgcagattacgctgaacaagacgaactcgactatcatagagggcttctcgtggacaggcccagtgaaactaaaacagaagagcagggaattccccggccgttgcacccccccccccctcccccagtgcagccccctcagcaccctcgggctgaacaacgggagcaggaacgcgccgtccgtgagcagtgggctgagagagaaagggagatggaacgccgggaaaggaccagaagcgagcgagagtgggatagggataaggtccgagagggccccaggtctcgttcccgctcaagggatcgcagacgaaaggagcgcgcgaagtcaaaggaaaagaagtccgaaaaaaaagaaaaggcccaagaggagccgcccgctaagcttctggatgatctctttcgaaaaactaaagccgcaccctgtatctactggctgcccttaactgacagccagatagttcagaaagaagcagaaagagccgagcgggccaaggagagggaaaagagacgcaaggagcaggaggaggaagaacagaaggaaagagagaaagaggctgaacgcgagaggaaccgtcagctggaaagagaaaagagaagggagcactcgagggagcgggaccgagagcgtgagcgtgagcgggaacgtgatcgcggcgacagggacagggacagagaaagggaccgagagcgcggacgtgagcgagacaggcgggacacaaagaggcattcacggtctcgttcacgctcgacgccagtacgggacaggggcggcagacgctag

SEQ ID NO: 16021 - DNA, 1329 bp, Artificial Sequence
  Description of Artificial Sequence: Synthetic coding sequence
atggccaatagcttcgccgcaagaatttttaccactctcagtgatttgcaaactaatatggcaaatctgaaagtgatcggaatcgtgattggaaaaaccgatgtcaagggatttccagaccgcaaaaatattggatcagagcgatacacatttagctttacaattcgggattccccggctcattttgttaatgcagcctcatggggcaatgaagattacatcaagtcgctgtccgattcattccgagttggcgactgcgtgatcatcgagaacccccttatccaacgcaaagagatcgagagagaggaaaagttcagtccggccaccccctcaaactgcaaactgcttctctcagaaaatcacagtaccgttaaggtgtgctccagctatgaagtagatactaagctactgtcccttattcacctgcctgtgaaggaatcccacgactattattctttgggagacatcgtagccaatggacacagccttaatgggcgcattatcaatgtcctggcagcagtgaaaagcgtgggggaaccaaaatacttcacgacatccgatagacgcaaaggacagcgttgcgaagtgcggttatatgatgagaccgagtcctcatttgcaatgacgtgttgggataacgaatctattctcttggctcagtcctggatgcctcgtgaaacggtcatctttgccagcgatgtaagaatcaattttgacaagttccggaactgcatgacggcgaccgtgatcagtaagacaatcatcacaaccaaccctgatatccccgaggctaacattttgctgaatttcataagggaaaacaaggagacgaatgtccttgacgatgaaattgattcctactttaaggaaagcattaatttgtccactattgtcgacgtgtacacagtggaacagctaaaaggcaaagcactaaaaaatgaaggaaaagcagatccttcttacggtattctttacgcgtacatctctacattgaacatcgatgatgagaccacgaaggttgtgcgtaacaggtgtagctcttgtggctacattgtgaatgaggctagcaacatgtgtacgacttgcaacaagaactcactcgattttaaatcggtgttcctatccttccacgtgctgatcgacctgacagaccacaccggaacattacacagttgctctctgacgggctcagttgccgaagaaactttaggatgtacatttgtactatcccaccgggcccgttcaggtctgaaaatatccgtcctgtcctgcaagctggccgatcccacagaagcctcgagaaacctttctggccagaagcacgtttag

SEQ ID NO: 16022 - DNA, 627 bp, Artificial Sequence
  Description of Artificial Sequence: Synthetic coding sequence
atggctggaactgcgagacatgaccgtgagatggccatccaggccaagaagaaactcaccacggccactgaccccattgagcgcctacggttgcagtgcctggctcgcgggagcgccggcatcaagggcctgggtagggtattccgcatcatggatgatgacaacaaccggaccctagatttcaaagaattcatgaagggcttaaacgactatgctgtagtaatggagaaagaagaagttgaggaactgttccgaaggttcgacaaggacggtaacggcaccatagattttaatgaatttcttctgactctgagacctccaatgagccgcgcaaggaaagaagtgattatgcaggcttttcgaaaactggataagactggggatggcgttataaccatagaagacttacgcgaagtctataatgctaaacaccatcccaagtaccagaacggcgagtggtcagaggaacaggtgtttagaaagttcctggataactttgactccccttacgataaggatggtttggtgaccccagaagaatttatgaactactatgccggtgtatccgcttctatcgatacagatgtgtattttattattatgatgcgcacagcttggaagctttag

SEQ ID NO: 16023 - DNA, 627 bp, Artificial Sequence
  Description of Artificial Sequence: Synthetic coding sequence
atggcaggcacagcccgtcatgatcgggagatggccatccaggccaaaaagaagctgacaacagcgacagatcccatcgagaggctccggctgcagtgtcttgcccgtggttcggcaggcattaagggactaggtcgcgtattccgcattatggacgacgacaataatagaacactggacttcaaggaatttatgaaaggactgaacgactacgcagtcgttatggagaaggaagaggtagaagaactatttaggcgattcgataaggacgggaacggcacaattgatttcaacgagtttctactgacgctacggccacccatgagtcgggcacgcaaagaagtgatcatgcaggcatttcgaaagctcgacaagacaggcgacggagtgattaccatcgaagacctgagagaagtgtacaacgccaaacaccaccctaaataccagaacggggagtggagcgaggaacaagttttccgaaaattcctggataacttcgactccccttacgacaaggatggactggttacgcctgaagagttcatgaattattatgcaggagtatccgcctcaatcgacaccgacgtttacttcataattatgatgcgcaccgcctggaaattgtag

SEQ ID NO: 16024 - DNA, 789 bp, Artificial Sequence
  Description of Artificial Sequence: Synthetic coding sequence
cactcctatagtgagggcctgggccacccaagagtctcacaggccctggtgaccttccaccagcaaaaaccaattgagccaagacgcgagctgcttacccagccctgtagacaaaaagatcccgccaatgtggattacgaagacctctttctctacagcaacgctgtcgctgaggaggcagcatgtcctgtgagtgcaccagaggaggcttcgccgaaaccagtgctttgtcaccagagcaaggaacgtaagccatccgctgagatgaatcggatcactactaaggaagccacctctagctgtccaccgaagtcccctctgggagagacgcgtcagaaactctggaggtctctcaagatgttgcccgaacggggtcagcgggtgcggcagcagaaatcccatcttgctactgtgaatctgtcaagcctgctggacgtcaggaggagtacggtcataagcggccccggaaccggtaagggcagccaagaccactcaggggacccaacatccggcgacagaggctatacagacccttgcgttgccaccagcctcaagtcaccaagtcagccacaggcgccaaaggacaggaaagtgcctacacggaaagccgagagatccgtgagctgcattgaagtgacgcctggagaccgctcctggcatcaaatggtagtacgggcactgagctcccaggaaagtaagcccgaacatcaaggcttagctgaaccggagaacgatcagctcccagaagagtatcaacagccaccccctttcgcgccaggatactgttag

SEQ ID NO: 16025 - DNA, 1941 bp, Artificial Sequence
  Description of Artificial Sequence: Synthetic coding sequence
atgtcatataccggattcgtgcagggctctgagaccacactccagtccacttacagcgacacatctgcccagccaacttgtgactatggctacggcacctggaactccggcactaaccgcgggtatgagggctatggctatggctacgggtacggtcaggacaacaccaccaactacgggtatggcatggccaccagtcatagctgggagatgccgagctccgataccaacgccaacacctccgcttccggcagcgcaagtgccgactccgtactttcccgcatcaaccagaggcttgacatggtcccccatttggagactgatatgatgcagggcggtgtgtacggatccggcggcgaacgctacgatagctacgaatcatgtgactcccgggccgtgctgtcagaacgggacctgtataggtccggctacgactatagcgaactggaccctgaaatggagatggcttacgagggccaatacgacgcttatcgagatcagtttcgcatgcgaggcaatgacacttttgggccaagagcgcagggatgggccagggatgccaggtcaggacgacccatggcatccggctacggccgaatgtgggaagatcccatgggcgcaagggggcaatgcatgtcgggcgcttcccgccttccctctctctttagtcaaaatataattccggaatacggaatgttccagggaatgaggggtggaggtgcatttccgggaggttcgcggttcggcttcggcttcggaaacggcatgaagcagatgaggcgtacctggaaaacatggaccaccgccgattttaggaccaaaaagaaaaagcgaaaacaagggggctcccctgatgaacccgacagcaaagccaccagaactgattgctccgacaatagcgactcagataacgatgagggtacagagggagaagcaacagaaggtcttgaaggcacagaagctgttgaaaaaggatcacgggtcgatggggaagatgaggagggcaaggaagatggcagagaagaggggaaggaggaccccgaaaagggagccctgacaacacaggacgagaacggccagactaagcggaagttacaggccggaaagaagtcacaggacaaacaaaaaaagagacagcgggaccgcatggtcgagagaatccagtttgtctgtagcctgtgcaagtatcggaccttttacgaagacgagatggcatcccacctcgacagcaagttccacaaagagcatttcaagtatgtgggcacgaaactacctaaacagaccgctgacttcctccaggaatacgtgacaaacaaaacgaagaaaacagaggagctgagaaagacagtggaggacctggatggattgattcaccagatttaccgcgatcaagatcttacacaggagatcgcaatggagcactttgtcaagaaggtggaggctgcccactgtgcagcttgcgatctgttcattcccatgcagttcggaatcatccaaaagcacctgaaaacgatggaccataaccggaaccgccgcctgatgatggaacaatcaaaaaaaagctccctcatggtggcgaggagcattctcaacaataaactgatctcgaagaaactggaaagatacctcaagggagagaacccttttaccgacagtcccgaggaagaaaaggagcaggaagaggctgaggggggtgccctcgatgagggagcacaaggagaagccgcaggaatctccgagggtgcggaaggcgtacccgctcagcctccagtgccacctgaaccagccccgggcgccgtgtcacctccccccccacccccacctgaagaagaagaagagggtgccgtgcccctcctcggtggcgcgctacaacgccagattcgcggaattcccggactcgacgtggaggatgacgaggaagggggggggggcgctccatag

SEQ ID NO: 16026 - DNA, 1401 bp, Artificial Sequence
  Description of Artificial Sequence: Synthetic coding sequence
atgcgaggccctaactctggcaccgaaaagggacggttggtcattccggagaagcaagggttcgactttctttgcatgccggtgttccaccctaggtttaagcgagagtttatccaagagcccgctaaaaacaggcctggaccccaaaccagatccgacctgttgctctccggtcgtgattggaacacactgatagtgggaaaactgagtccatggatacgaccagatagcaaggtggaaaaaattcggagaaactccgaagccctcgaggtgcaatttattatcaccggcaccaatcatcacagtgaaaaagaattttgcagttacttgcaatatctggagtacttgtcgcagaatcgccctccgcccaacgcctatgagttatttgccaaaggctacgaagactacctgcagtctccactccagcctctcatggacaacctagagtcgcagacttatgaggtcttcgagaaagaccctatcaagtactcacagtaccaacaagccatttacaagtgtctccttgaccgagtgcctgaggaagagaaggacactaacgtgcaggtgctaatggtacttggggcggggagagggcccctggtgaatgcctccctaagggctgccaagcaggcggatcgccgcatcaagctgtacgcagtggaaaagaatccaaatgccgttgttacccttgaaaattggcaatttgaggagtggggcagtcaagtcaccgttgtgtcatcagatatgagggagtgggttgctcctgagaaggcagacatcatcgtgtcagagctgctagggagctttgcagataacgagctgtctccagagtgtctggatggggctcagcactttctcaaggatgacggcgttagcatcccgggcgagtatacctcctttcttgctccaatttcgagcagtaaattgtataacgaagttcgagcctgcagggagaaggaccgggaccctgaagctcagttcgaaatgccctatgtggtcagattgcataatttccaccagttgagcgcgccacaaccttgttttacgttctctcatcctaacagggacccaatgatcgataataacaggtattgcacactggaatttccggtggaagtgaacacagtgctccatgggttcgcaggatatttcgaaaccgtcttgtaccaagatatcaccttatccattcgccccgaaactcattctcctgggatgtttagttggtttccaatcctgtttcctattaagcagccaattactgtgagggagggtcagacaatttgcgtgaggttttggcgatgctccaattccaagaaggtctggtatgagtgggctgtaaccgccccagtgtgtagtgctatacacaatccaacaggacggtcctacaccatcggcctgtag

SEQ ID NO: 16027 - DNA, 1863 bp, Artificial Sequence
  Description of Artificial Sequence: Synthetic coding sequence
atgcgcgggcccaattctggcacggagaaaggacgtttagtcatccctgagaagcagggattcgacttcctgtgcatgcccgtgtttcatccccgatttaaaagagagtttatccaagaacctgctaaaaaccggccaggcccacagaccagatccgatctgctgctcagtggccgggactggaatacgctcattgttgggaaactgtcaccctggatacggccagacagcaaggtggaaaagatcaggagaaacagcgaggccgcgatgttacaggagctcaacttcggcgcatatctgggtctgcctgccttcctgctgcctttaaaccaagaggacaataccaacctggctagggtactgacaaatcacatacatacagggcaccacagcagtatgttctggatgcgcgtgccactggtggcgcccgaggatcttcgcgacgatattatcgagaacgccccgacaacccacacagaagagtactctggagaagaaaagacctggatgtggtggcacaatttccgcacgttatgtgactatagcaagaggattgccgtcgcactggaaattggcgctgatcttccatccaatcatgtcatcgacaggtggctgggagaaccaataaaggcagcgatactgccaacctcaatcttcctgaccaacaaaaagggattcccagttctgtctaaaatgcaccagagacttattttcaggctacttaaactagaagtccagttcatcatcactggaacgaatcatcattccgagaaagagttctgctcttacctacaatatttagaatacctgtcgcagaatcggccaccccccaatgcctatgaactgtttgctaaaggatatgaagactatctgcaatctcccctacagcctcttatggataacctggagtcccagacgtatgaggtattcgaaaaggatccaataaagtactctcagtatcagcaagccatctataagtgtcttctcgatagggtaccagaagaggaaaaggacactaatgtgcaagtgctgatggtgctgggtgcaggccgaggccccctcgtaaacgctagcctgagagccgctaagcaggcagatcggaggattaaactgtacgcggtggagaaaaatcctaatgccgtggtgaccctagaaaactggcagttcgaggagtggggcagccaggtaactgtggtatcgagtgatatgagagagtgggtggctcctgaaaaggctgacataatagtctctgagctcctcggctcctttgctgacaatgaactatccccggaatgcttggatggggctcagcatttccttaaggacgatggagtctcgatccctggcgagtatacctcttttttagcccccatcagctcttccaagctgtacaatgaggtacgtgcctgccgtgagaaagacagggacccggaagcacagtttgaaatgccttacgttgttcggctgcacaactttcaccagctgtcagccccgcagccctgcttcactttttcgcatcccaacagagaccccatgattgataacaatcgttactgcactcttgaatttccagtcgaagtcaatactgtgctgcacggcttcgcaggttatttcgaaaccgttctgtatcaggatatcacgttatccatcagacccgaaacacattcccccggtatgttttcatggttcccgatactgtttcccattaaacaaccgataaccgtcagagagggtcagacaatttgtgtacgcttctggagatgttcaaatagcaaaaaggtgtggtacgagtgggcagttacggccccagtatgttctgcgatccacaatccgacgggcaggagttacacaatcggactgtag

SEQ ID NO: 16028 - DNA, 2271 bp, Artificial Sequence
  Description of Artificial Sequence: Synthetic coding sequence
atgccctccgtcagcaaggccgctgccgctgcgctgtccggcagtcctcctcagacagagaaaccgacccattatcgttacctgaaagaattccgtacggagcagtgtcccctgttctctcagcacaaatgtgcgcagcatcgaccattcacctgcttccattggcattttctgaatcaacggagacgcagacctttgcggcgacgagatggtacctttaactattctccagatgtctattgctctaagtacaacgaagcgaccggggtctgccccgatggcgatgagtctctcctcggagtactataccccctgtgggcaccgccaccggttccagccccggtgggagctccaacggtgcacccattcttggcaaggtggttttcccatgtcccatgggagccagctggctctgcagatcctcgggcctcatcaacacccgccgggggcactacatgggccactggcttgctgggcgacttcgatgcctgtggctcccagagcagggaatgtgttaagggagtgtggtggactttgctcggatttcgatgcccttaccttcaccggactactggggataccgaaaggaagtaccacctgcgctattacaaaaccgggacttgtatccacgaaaccgacgcacgcgggcattgtgtgaaaaacggtctgcattgcgctttcgcacacgggcctctagacctgaggccacctgtgtgcgacgttagagagctgcaagcccaagaggctctgcagaacggtcagctcggaggaggcgagggagttccggaccttcagccaggtgtcttggcctcccaagctatgatcgagaaaattctttccgaagaccctcgatggcaggccctcctgccagtggcactgttacggcaccgcgtcgcacattttagcgacgctaattttgtgcttggtagctacaaaactgagcagtgccctaagccgcccaggttgtgtagacaaggttacgcttgtcctcactaccataacagtcgagatcggcgcaggaaccctagacggttccagtatcgctctaccccgtgccccagtgtgaagcacggcgacgaatggggagaaccatctaggtgtgatggaggagatggttgccagtactgccactctaggactgagcagcagttccacccagagggacctgtcggctctccagttagtggcgctttctcagtgttttctcacgctgggctcgtggctgacccatccctttggtatcctgcagaatggtcctggcatcatgtcgggcactctagaaccatcaatcccgaaggtgataagcccagccggcttggtcccgcacctgaaaatattaaaagaggcaacgacttcgcatgtgacggacgagctgatgccgctggcatggccccacatgtgtgtgtgttccctatctacaagtctactaaatgcaatgatatgaggcagaccgggtactgcccacgcggacctttctgtgcctttgcccatgtggaaaagtccctgggtatggtcaacgagtggggatgccatgacttacatctgacgtcaccctcatctaccggcagtggacagccagggaacgctaaaaggcgggacagtcccgccgagggcggccctagaggttcggagcaagattctaagcagggcgtgcgcgcacacggagtgtacgttttcgaacaaaaccacttagcagtgtttgccgccgtgcatcccccagcacccagcgtgtctagcagtgtggcatcttccctcgcctcctcagccgggtcaggaagctctagccctaccgcattaccagcacctccggctcgagccctgcctctggggccagccagctccaccgtggaagcagtccttgctcttgagcctactccatcctcccccaccagcagtgccgtgcagggggtcgcaggagaactgggaatgggatctggcggccagggttgttggagccatgtagtcggcgcactggcagctgtgccggcctggacccacagtggcgacctcgaatgggaccctagcacgattcggacccgcgtgaatgtggggggtggcccggctgccaggcccgccatgactctcgctagagaaccccagttgctagtcgtgggggggtgtcctacgcggaactgttctggcccagctgctagcccccagcaactactagatgatgctggccagggaggcagaggtgagcgagattcatctcaaagaccactccggccacagactacgcatagacaggatacacggcctgtcccctcgtag

SEQ ID NO: 16029 - DNA, 549 bp, Artificial Sequence
  Description of Artificial Sequence: Synthetic coding sequence
atgaccccccctcaacagccacccccactgcgaagtgagccaggcaccttaggctcagcagccagctcatactcccctctgggactaaatggcgtgccgggctccatttgggattttgtctctggctctttttctccctcccctagccccatcctgtcagcagggcctcccagttcttcaagcgcgtcccctaacggcgctgagttggccagggtacggcggcagctcgacgaggcgaaacggaagatcaggcagtgggaggaaagttggcagcaggttaagcaggtgtgcgacgcttggcagcgcgaggctcaggaggctaaagaaagggctcgggtagctgattcagacaggcaattggccctgcagaaaaaagaggaggtcgaagcgcaggtgatctttcagcttagggcaaaacagtgcgtcgcttgcagagagcgcgcacacggagctgtgctcaggccctgccagcaccacatcctctgtgagccgtgtgcggccacagcgcctgaatgcccttactgcaagggtcaaccactgcagtggtag

SEQ ID NO: 16030 - DNA, 444 bp, Artificial Sequence
  Description of Artificial Sequence: Synthetic coding sequence
atggagggtgagccaccccctgtggaagaacggaggcggcttcaagaagagttgaatgagtttgtcgagtcgggctgccgcaccttggaggaggtgaccgcctctctaggttgggacctggattctctggaccctggggaggaggaagctgccgaggacgaagtggtgatatgcccgtacgacagcaatcaccacatgccaaaaagctccctggccaaacatatggcaagttgtcgacttcgaaaaatgggttataccaaagaggaagaggatgaaatgtacaatccggagttcttttatgaaaatgtgaaaatcccatctataacgcttaataaagactcgcaattccagattatcaaacaggccagaacagccgtcggaaaggatagtgactgctacaaccaaatcatcggtgtatctatcaagcgcaattataagatctag

SEQ ID NO: 16031 - DNA, 522 bp, Artificial Sequence
  Description of Artificial Sequence: Synthetic coding sequence
atggggaccttcgacctgtggaccgactacctcggcttggctcatctggttagggctctgagtggcaaagaggggcctgagacacgtctatccccgcaacccgagcccgaaccgatgctcgaaccagatcagaagcgctcgctcgagagttctcccgcgccagaaaggctgtgtagcttctgtaagcataatggcgaatctcgagctatataccagtcacacgtcttgaaggatgaagccggccgagtcctgtgcccgattttgcgggattatgtatgccctcaatgcggggcaacccgggagagggctcatactaggaggttctgtcccctgaccggtcaggggtatacttctgtatattcacacacaacacgcaattctgcaggtaaaaaactcgtgcgccccgataaggctaagacgcaggacaccggacacaggcggggaggcggaggcggtgccgggttccgtggagccggtaagagtgagccctcccccagctgctctcccagcatgagcacctag

SEQ ID NO: 16032 - DNA, 1722 bp, Artificial Sequence
  Description of Artificial Sequence: Synthetic coding sequence
atgagcgcattctgtctcgggttggtaggaagagccagcgcacctgcggaaccagacagcgcctgttgcatggagctccccgccgccgcgggagatgctgtgcgttctcccgcggcagccgctgccctgattttccctggcggcagcggcgagttggaactcgcactagaagaagagctcgcgctccttgcagccggagaacggcccagcgaccctggggaacatccacaggcggaaccggggagtctcgctgagggagctgggccacaacccccaccctctcaagacccggaactgctgtcagtcatcagacagaaggagaaggatctggtcctggctgctcgcctgggcaaagcccttttagaacgcaaccaggatatgtcccgtcaatacgaacaaatgcacaaagagttaactgacaagttggaacatctggagcaggaaaagcacgagctgagacgccgctttgaaaatcgagaaggcgagtgggaaggacgggtctcagagcttgaaagtgatgttaaacaattgcaggacgaactggaacgtcagcaaattcacctacgcgaagcagatcgggaaaaaagcagggccgttcaggagctgtcagagcagaatcagaggctgctggaccagttatccagagcatctgaagtggagcggcaactgagcatgcaagttcacgcacttcgagaagactttcgggagaagaacagctcgacaaaccagcacattatcaggctggagtcccttcaagcggaaattaaaatgctgtccgaccggaagagggaactggaacaccgactctctgctactttggaggaaaatgacctgctgcagggaaccgttgaagaacttcaggacagggtgttaatcctggagagacaaggccatgacaaagacctgcaactgcaccaaagccagcttgagttgcaggaggtgagactgagttgcaggcagcttcaagtgaaggtggaggagctgactgaggagcggagccttcagagctccgcggctacctcaacaagcctgcttagcgagatagagcagagcatggaggcagaggagctggagcaggagcgtgagcagctcaggttgcagctgtgggaagcttattgtcaggtgcggtatttgtgctctcacctgagaggcaatgatagtgctgattcggccgtcagcacagactccagtatggatgaatcctcggaaacctcttcagcaaaggacgtgccagcgggctctttgagaactgctctgaacgagctgaaacgactgatccaaagcattgtggatggaatggagcccacagtgacgctgctgtctgttgagatgacggcactgaaagaggagagagatagattgagagtgacttcagaggacaaagagcccaaagaacagcttcagaaggccattcgggaccgggacgaagcaattgctaaaaagaatgccgtagaattagaactggctaagtgccgcatggacatgatgtcactgaactcccagttgttagacgccattcagcagaagctcaatctgtcgcagcagctggaagcttggcaggacgatatgcacagggttattgatcgtcagctgatggatacacatcttaaggagcgttctcagccggctgctgcactatgtagagggcactcggccggaagaggggacgaaccgtccattgcagagggcaaacggctgttcagcttctttcggaagatctag

SEQ ID NO: 16033 - DNA, 1086 bp, Artificial Sequence
  Description of Artificial Sequence: Synthetic coding sequence
atggcacttaatgtcgcaccagtcagagataccaagtggctgacattggaggtttgtaggcagttccagagagggacctgttcgcggtccgatgaggaatgcaagttcgcccatccgcctaaatcctgtcaggtggagaatggaagggtcatcgcctgctttgactcccttaaaggacgatgttcacgggaaaactgcaagtatctccacccccccactcatctgaagacacagctggagattaatggacgaaataatttgatccagcagaagaccgcagccgccatgctggcacagcagatgcagtttatgttcccagggacaccactccatcctgtacccacgttccctgttgggccggcaatcgggacaaacactgccatctctttcgctccttacttggcccctgtgacccccggggtcgggctcgttcccaccgaaatcctacctactacaccagtaatcgtcccgggaagccctcccgtcaccgtgcccggatcaacggctacccagaaactgctccggacagacaaactagaggtctgtcgcgagttccagcgcggtaactgtgcccggggcgagactgactgcagatttgcacatcccgctgactcgaccatgatagacacctcagataataccgtgacagtctgtatggactacattaagggccgatgtatgcgcgagaaatgtaagtacttccaccccccagctcacctgcaggcaaaaattaaagccgcccaacaccaggccaaccaggccgcagtggccgcccaagccgctgccgcggcagctactgtcatggcttttcccccgggcgcgcttcatcccctaccaaagcgccaggccctggagaaatcaaacggcacctctgctgtcttcaacccttctgtcctgcactatcagcaagctctgaccagtgcgcagctacagcagcatgctgcattcattcccactgataatagcgaaattatcagcagaaacggtatggagtgccaagagtctgccctgcggatcaccaagcattgctattgcacatactatccagtgtcatcttcaatcgagctccctcaaactgcctgctag

SEQ ID NO: 16034 - DNA, 3099 bp, Artificial Sequence
  Description of Artificial Sequence: Synthetic coding sequence
atggcattcactaactattcatctttgaatagagctcaactaaccttcgagtacctacacacgaactctaccacacacgagttcctgttcggtgccctggcagagctggtggacaatgcccgggatgccgacgcaacaagaatcgacatctatgccgaacgcagggaggacctgcgaggaggattcatgctctgttttctcgacgacggcgccggaatggatccaagtgacgctgcctctgtcattcagtttgggaagagcgcaaaacgtacccccgaatcgacccagatagggcaatatggtaacggcctcaaatcaggctcgatgcgaatcgggaaagattttattctgtttactaagaaggaggatactatgacctgtctcttcctctctcgcacttttcacgaagaggaaggcatcgacgaggtaatcgtcccactgccgacatggaacgcaaggacccgagaaccagttactgataacgtcgaaaagttcgccattgaaactgaactcatctacaaatatagcccatttcgtaccgaagaagaggttatgacccagttcatgaagatccccggcgattccgggaccctcgtgatcattttcaaccttaaactgatggacaacggcgagcccgaacttgatataattagtaaccctcgcgatatccaaatggcagagacatcaccggagggaaccaaacccgagaggcgatccttcagggcgtacgcagcggtgctgtacatcgacccacgcatgcgcatcttcatccacgggcacaaggtccagacaaaaagattgtcctgctgtctatacaagccccggatgtacaaatataccagttcgcggttcaaaacaagggccgaacaggaagtgaaaaaggctgaacacgtggcgcgcatcgcagaggagaaagctagggaagccgagagcaaagctcgtacactcgaggtgcgactaggtggagacctgacacgggactcccgcgtcatgttaagacaggtgcagaaccgcgccatcaccttacgtcgcgaggcagatgtgaagaagcgcatcaaagaagcgaaacaaagggccctcaaggagcccaaagagctgaacttcgtgttcggggttaacattgagcatcgcgacttagacggcatgtttatttacaactgttcaagactgattaaaatgtatgagaaggtgggcccccagctcgagggagggatggcctgtggaggagtcgtgggagtggtcgacgtgccctacctggtgcttgagcctacccacaataagcaagacttcgccgacgcgaaggagtatcgtcacctgctgcgtgccatgggcgagcacctggcacaatactggaaggatatcgctatcgcacagcggggaatcatcaagttctgggacgaatttggatacctgagtgccaactggaatcagccaccaagttcagaactgaggtacaagaggaggcgagcaatggagattcctaccactatccagtgtgacctatgtctgaagtggagaacactgccttttcagctgtccagtgtcgagaaagattaccccgatacctgggtgtgctcaatgaacccagatcctgaacaggacaggtgcgaggcttcagagcaaaaacaaaaagtccctcttggtactttccgaaaggacatgaagactcaggaagagaagcagaaacagctcacggagaaaattcggcagcagcaggagaagctggaggcgctgcagaaaaccacccctatacggtcacaggctgacctgaaaaagcttccgcttgaggtgaccacacgacctagcactgaggagccggtgaggaggccccagcggcctcggagcccccccctgcctgctgtcatccgcaatgccccatccagacctccctctttgcccacccctaggcctgcatctcagccgaggaaagctcctgtgatctcctccacacctaagctccccgccctcgctgcccgcgaagaagcttctacgtctcggttgctgcagccacccgaagccccaagaaaacccgccaacacacttgtaaagacggccagccgacccgcccctttggtgcagcagctgtctccaagcctgctcccaaactcaaaatctcccagggaagtgccaagtcctaaggtgatcaagacaccagtggtgaagaaaacggagagccccatcaaactgagtcccgcaactccttctcggaagcgctcagttgccgtcagtgacgaggaggaggtggaggaagaggctgagcggcggaaagagcgatgcaaacggggccgattcgtggtcaaagaggagaagaaggatagcaacgaactgtccgactctgccggagaagaggacagtgccgatttaaaacgggcgcaaaaagataagggcctccacgttgaggtccgggtgaatcgcgagtggtacaccggcagagtgaccgccgtggaagtcgggaagcatgtggttcgttggaaggtgaagttcgactatgtacccacggatacgacacccagagacagatgggtcgagaaggggagtgaggatgtgcgcctgatgaaacctcccagccctgagcaccagtccttggatacacagcaagaaggcggggaggaagaagtgggccccgtggctcaacaggccatcgcggtggcggaacctagcacctccgagtgcttgcgaatagagccagacaccactgccctgagcactaaccacgagacgatagatctgttggtgcagatacttaggaactgtctgcgctactttctgccaccatctttcccaattagcaaaaagcaactctccgccatgaacagcgacgagctgatcagttttccactgaaggagtattttaagcagtatgaggtgggccttcagaacctgtgtaactcctaccagtcacgtgccgactctcgagccaaggccagcgaggagagcctgaggacaagtgaacgaaaactcagagaaactgaggagaaattgcagaagctgagaaccaatattgtagcattacttcagaaggtgcaggaggatatagacattaatactgacgacgaactcgatgcttatattgaggacttgattacaaaaggggactag

SEQ ID NO: 16035 - DNA, 5943 bp, Artificial Sequence
  Description of Artificial Sequence: Synthetic coding sequence
atgaatccaaccaatcccttctcaggccagcagcccagcgccttctccgcctcttcctcaaacgtgggaacactgccaagcaagccccctttccggtttggtcagccctctctgttcggccaaaattctaccctttctggaaagtccagcggcttctcgcaggtaagctcgtttccagcgtcgagcggcgtatctcacagtagctcagtgcagactcttggctttactcagacctctagtgtgggaccattttcagggctggaacatacttccacatttgtcgctacttcaggtcccagctcctctagtgtcctggggaacactggattctcctttaaaagccctacatcagttggtgccttcccttctactagcgcgttcggccaggaagccggggaaattgttaactctggattcggcaaaactgagttctccttcaagccactcgagaacgccgtgttcaaaccaatcctcggtgccgaatctgagccagaaaaaacgcagagccagatcgcaagcggctttttcacctttagtcaccccatcagtagtgcgccaggcggcctggcccctttcagcttcccacaagtcacttcttcttccgccactacaagcaactttacattttctaaacctgtgagttcaaacaactcattatccgccttcacccccgccctttccaaccaaaacgtagaggaagagaaacgaggacctaagagcatcttcggcagttcaaacaacagtttttcaagctttcctgtgagctccgctgtgctaggtgaaccctttcaggcttcgaaggctggtgtgagacagggctgcgaggaggcagtgagccaggtggaacccctaccctctctcatgaaaggcctcaaaagaaaagaagatcaggacagaagtccacgacggcacgggcatgaacccgccgaggactccgaccccctgtcccgaggtgaccatccccctgacaaacgaccggtgcgtttgaatagaccccgcggtggaacattattcggaaggaccatccaagacgtgtttaaaagcaacaaggaagtcggtagactcggcaacaaggaggcaaaaaaggagacgggcttcgtggagagcgcagaatctgaccatatggccattcctggcggaaatcaaagcgtgttagcccccagtaggataccaggagtcaacaaggaggaggagaccgaatccagggagaaaaaagaggactccctacgggggactcccgcccgccaatccaacagatctgagtctacagattccctcggaggactctctccaagcgaagtaacagctattcagtgcaaaaacatcccagattacctaaacgaccgcaccattcttgagaaccatttcggcaagatagcaaaggttcagcgtatcttcacaaggcgtagcaagaaattggctgtggtgcatttttttgatcatgcatcagccgcactggcaaggaaaaagggaaaatctctgcacaaagacatggccattttttggcacaggaagaagataagcccaaataagaaaccattttcattaaaagagaagaagcctggagacggagaggtctcaccaagtactgaggatgcgcctttccagcactctccgctgggaaaagctgcaggccgcacaggggcgagctccttgctgaacaagagctctcccgtgaagaagccgtcactgctgaaagcccaccaattcgagggtgactcattcgacagcgcctctgaaggatccgaggggctcgggccttgtgtgctctccctttccacactgattgggaccgtggctgaaacatctaaggaaaagtacaggttattagaccagcgggacaggatcatgcgacaggctagagtgaaacgcacagacctggataaagcgaggacttttgtaggcacctgcctagacatgtgcccagagaaggagcgttacatgcgcgagacacggtctcagttgtcagttttcgaggtggtaccgggcaccgatcaggttgaccatgccgccgctgtgaaggagtatagccggtcatcagctgaccaagaggagccactgccacatgagctcaggcctctgcccgtgctctcgaggaccatggactatctggtgacccagattatggatcagaaggagggatcattaagagactggtatgacttcgtctggaatcggacacgcggcattaggaaagacataacccagcagcacttatgcgatcccctcacagtatccttgatcgaaaagtgtaccaggtttcacatacattgtgcacattttatgtgtgaagagcccatgagctccttcgatgccaaaatcaacaacgaaaatatgacaaaatgcctgcagagtctgaaagagatgtatcaggacctcagaaataagggcgtgttctgcgcatccgaagctgaattccagggttataatgtccttctgagcctaaacaagggcgatattctgcgtgaagttcaacagttccatccagctgtgaggaatagttcggaagtaaagttcgccgtccaggcctttgccgccctgaactcaaacaacttcgttcgctttttcaaactcgtgcagtcagcctcctaccttaacgcctgccttctacactgctattttagccagatccggaaggatgccctaagggcactaaacttcgcatacaccgtgtcaacccagcggtccaccatatttccgctcgacggagtggtgaggatgctcttgttccgagattgtgaagaggcgacagacttcttgacttgccatggactgactgtgagcgatggatgcgtcgagcttaacaggtccgcatttctcgagcctgagggtctctccaaaactaggaagtccgtgttcatcaccagaaagctgaccgtgagcgtcggagaaattgtcaatggcggccctttaccccctgtgcctagacacactccagtatgctcctttaattcacagaacaaatacatcggcgagtcccttgccgctgaactgcccgtgagtacacaaaggcctgggtctgataccgtaggtgggggacggggggaggagtgcggggtggaacctgatgccccactgtctagcctgcctcagtccttgcctgcccccgccccgagcccagttcctctccccccggtccttgctctgacccctagcgtagctccatctctgttccagctttctgtgcagcctgaacctcccccgcccgaacccgttcccatgtacagtgatgaggatctggctcaggttgttgacgagctcatccaggaagccctccagagagattgtgaagaggttggttcagctggggcagcttacgctgctgcagcattaggcgtgtctaacgccgccatggaagatctgttgacagcggcaactaccggcattttgagacacatcgccgccgaagaagtgtctaaggagcgggaaaggagggaacaggagcgccagagggcagaggaggagaggctaaaacaggagagggagttggtgctttcagagcttagccagggcttggctgtggaactaatggaacgcgtcatgatggagtttgtacgcgagacatgtagtcaagaattgaaaaatgcagtggagacagatcagagagtccgagtagcgaggtgttgtgaagacgtgtgcgcccatcttgtggatctcttcctggttgaggagatctttcagaccgctaaggagacccttcaggaattgcagtgcttctgcaaatacttacagaggtggcgtgaggccgtaacagccaggaagaagttgcgaagacagatgcgtgcctttcccgctgctccctgctgcgtcgatgtcagtgataggctccgggcgctggccccctctgctgagtgtccgatcgccgaggagaatctggcccgcggactgctagacttggggcacgccggcagactggggatctcttgcactaggcttagacggctgaggaataagaccgcccaccaaatgaaagttcagcatttctatcagcaattgctgagcgatgtggcctgggctagtctggacctcccctctcttgtggctgagcacctccctggtcgacaggagcacgttttctggaagctggtactagtgttgcccgacgtcgaggaacagtccccggagagctgtggtcgcatactggcaaactggttgaaggtgaagttcatgggagacgaggggtctgtagatgacacttcctcggatgctgggggcatacagaccctgagcctgtttaattccctgtccagcaagggtgatcagatgatcagtgttaacgtgtgtattaaagttgcacacggcgcactcagcgatggggccatcgatgcagttgagacccaaaaagatctcctgggtgcatcagggctcatgcttctcctgcctccaaaaatgaaatccgaagacatggctgaggaagatgtttactggctgtcagctctgctgcagcttaagcagttactgcaggcgaagcccttccagcccgcattgccattagtcgtgctcgttccaagcccagggggagacgccgtagagaaagaagtggaagatggactcatgttgcaagatctggtgtccgccaagctgatcagcgactacacagttaccgagatcccagacaccatcaatgatttgcagggaagcactaaggttctacaggccgtacagtggttagtgtctcattgccctcactctcttgacttgtgctgtcagacccttatacagtatgtggaagatggtattggtcacgaattctccgggagatttttccatgaccgacgcgaacgcaggcttgggggcctggcctcgcaggagcccggggctattatcgagttattcaatagcgttctgcagtttctggcttctgtggtctctagcgaacagctctgcgacttatcttggcctgtgacagagtttgcggaggccggcggttcacgcctgttgcctcacctgcactggaacgcgccagaacatctggcatggctgaaacaggcagtgctgggcttccagctgccccagatggacttgcccccgctgggcgcaccatggttgcccgtatgttctatggtggtgcagtatgcttcacagattccttctagtaggcagacacaacccgttctgcaatctcaggtggagaatctgttgcaccggacttattgtcggtggaaatctaagtcccctagccctgtacacggagccgggccgtccgtgatggagatcccgtgggacgatcttattgccctgtgcattaaccacaaactccgcgattggacccccccccgattacccgtcacttcagaggccctcagtgaggatggccagatctgtgtctacttctttaagaacgacctcaagaaatatgatgtgccactaagttgggagcaggccagactgcagacacagaaggagctgcagttacgggagggccggctcgccattaagccattccacccgtcagctaataattttcccattccgctcttgcacatgcacaggaattggaaacgatccactgagtgtgctcaggaggggcgcatcccaagcacagaggatctcatgcgtggcgctagcgccgaggagctactagcacaatgtttgtcctcatcactcctgctggaaaaagaggaaaacaagcgcttcgaagatcagctgcagcagtggctgtctgaagattccggcgcttttaccgatctgacatccctgcccctatacctccctcagacgctcgtgtccctaagccatacaatagagcctgtgatgaaaacaagtgtgaccactagtccccaatcagacatgatgcgagaacagctgcagttgtctgaggccaccggaacctgcttaggtgaacgcctcaagcacctagagcggttgatccgaagctccagagaggaggaggtggccagtgaattacatctctccgccctgttggacatggtggatatttag

SEQ ID NO: 16036 - DNA, 513 bp, Artificial Sequence
  Description of Artificial Sequence: Synthetic coding sequence
atgggcaagaggtatttctgcgattactgcgaccgctcttttcaggataatctgcataaccgtaagaaacatctgaatggcctccagcatctgaaagctaagaaggtctggtatgacatgttcagagatgctgccgccatcttactcgatgaacaaaacaagagaccttgcaggaagttcctcttgaccggacagtgcgacttcgggtctaattgccggttctcccacatgtcggaaagagacctgcaggaactgtctattcaggtggaggaggaacgaagagctcgcgaatggctgctggatgcacctgaactgcctgagggacacctggaagattggcttgagaagcgggccaagcggttatctagtgcaccctcatcccgggccgagcctattcgcactactgtctttcaatatccagtgggatggcctccagtgcaggaactcccgccttccctcagagcaccacctccaggcggctggccccttcaacctcgcgtgcaatggggatag

SEQ ID NO: 16037 - DNA, 291 bp, Artificial Sequence
  Description of Artificial Sequence: Synthetic coding sequence
atgtgtcacacaagctgttcaccggcatgtcagcctacatgttgcatccatagcccctgtcaggcctcttgctacgtgccagtatcctgtcagtcttcagtgtgcatgccagtatcttgcactagaattgtttgtgtggccccttcttgtcaaccatctgtatgcgtgcccgtgtcttgccgcccgattatttatgtcacaccaagctgtcagagctccggctgctgccaacctccgtgcactacagcgttgtgccgccccatcagctgcagcacaccatcctgttgttag

SEQ ID NO: 16038 - DNA, 879 bp, Artificial Sequence
  Description of Artificial Sequence: Synthetic coding sequence
atggccgcctcaaccatgtcgataaggtccagcgcgtatagcgactcctggcaggtagacgactgccccgaaagctgctgtgaacccccgtgttgcgcgacgagctgctgcgctcctgccccctgtcttaccctcgtgtgtacacctgtgagtagggtctctagcccttgctgccaggtgacttgtgagccgtcaccgtgccaatccggttgtaccagctcatgtacaccttcatgctgccagcagagcagttgccagccagcgtactgcacttcaagtccctgtcagcaggcttgctgcgtccctgtctgctgtaaacccgtgtgttgtgtgccagtgtgttgtggggcatcttcctgctgccaacagtctagctatcagccggcctgttgcgcttcaagcagctgtcagcccgcatgttgcgttcctgtctgttgtaaacccgtctgttgtgcccccacctgttctgaagacagctactcctgttgtcagcagagttcttgccagcccgcgtgctgtacaagttctccctgccagcagtcgtattgtgtccccgtatgctgtaagccggtgtgttgcaagcccatttgctgtgttcccgtgtgttcaggggcatcatccctctgctgccagcaatccggttgtcagccagcctgttgtactacatcttgctgtagaccaagctctagtgtatctctgctctgcaggcctgtgtgccggcctgcctgctgtgtgccggtgtcctcctgctgtgcacctacttcttcaagacagccatcctactgtaggcaggcctcttgtgtctcactgctgtgcagacccgtgtgcagccggcctgcatgttactcattttcttccggccagaagtccagctgctag

SEQ ID NO: 16039 - DNA, 1608 bp, Artificial Sequence
  Description of Artificial Sequence: Synthetic coding sequence
atgaagaagatcagtttgaagaccttgaggaaaagcttcaaccttaacaagagcaaggaggaaaccgatttcatggtggtccagcagccttctctcgcaagcgactttggtaaagatgactccctatttggttcatgctacggcaaagatatggcgagttgtgatataaacggtgaggatgagaaaggagggaaaaataggagtaaatctgaatccctgatgggtacattgaagaggcggttgtccgctaaacagaagtccaaggggaaggctggaacgccaagtggttccagtgcagatgaggacaccttttcatcttcaagtgcccccatcgtctttaaggacgttcgtgctcaacgccccatcagaagcactagcctccggtcccatcactactcacccgcgccctggcccctgcgaccaacaaactctgaggagacttgtatcaagatggaggtacgtgtcaaagccctcgtgcattcaagtagcccttcccccgccctcaatggggttcgcaaagatttccacgatcttcagtccgagaccacttgccaggaacaggccaatagcctcaagagttctgcgtcacacaatggggatctgcatcttcatctggatgagcacgtccccgtagtcattgggcttatgccccaggactacatccagtatacggtgccattagatgagggcatgtaccctctggagggtagcaggagttattgtttagacagcagcagcccgatggaggtgtctgccgtccccccgcaggttggcgggcgcgccttccccgaggacgaaagccaagttgatcaggatcttgtggtggcccccgagattttcgttgaccagtcagtgaatggcctccttattggcacgactggagtcatgcttcagagccccagggccggccatgatgacgtgcctcccctgtctccgctgttgccacctatgcaaaacaaccagatccagagaaacttttcagggctgacagggacggaggcccatgtggcagagagcatgaggtgtcaccttaattttgatccaaactcggcgccgggtgtcgcccgagtgtatgactccgtgcaatcaagcggcccaatggtcgtgacaagcttgaccgaagaactgaagaaactcgccaagcaggggtggtactggggacctattaccaggtgggaggctgaaggtaagctggctaacgtgccagacggatccttcctggtccgggactcatcagatgaccgctaccttttatcgttgagcttcagatcacatggcaagacactgcatactagaatagaacattcaaacgggcgtttttcgttctacgaacagccagacgttgaggggcatactagtatcgtggacttgatcgagcattccataagggactcggagaacggagctttctgctacagccgatcccggttacccggaagtgctacttatccggtgcgtctcaccaatccagtctcaaggtttatgcaagtccgctctcttcagtacctgtgcaggttcgtgattcgtcagtacacccggattgacctgatccaaaaactccctctccccaataagatgaaggattacttgcaggaaaaacactactag

SEQ ID NO: 16040 - DNA, 1260 bp, Artificial Sequence
  Description of Artificial Sequence: Synthetic coding sequence
atggccgcgtccagtttggaacagaaactgtcacggcttgaggctaaattgaaacaggagaatcgcgaggcgcgtcgccggatagacttgaatctggatatcagtccccagagacctcgccccacgctgcagttgccactggccaacgacggcgggagtcgatcgcctagctcggagtcgtcccctcaacatccaacacctcccgcccgacctaggcacatgttgggccttccctctaccttattcactccccgtagcatggagagcatcgagatcgatcagaagttgcaagaaattatgaagcagaccggttacctgactattggcggtcagcgctatcaggcagagattaacgacttagagaacctgggcgagatgggcagcggcacctgcggacaggtttggaagatgcgattccgcaaaaccgggcacgtcatagctgtaaaacaaatgagaagatccggcaacaaagaagagaacaagaggatcctgatggatttagatgtagtgcttaagagccatgattgcccatacattgtgcagtgcttcgggacattcattaccaacaccgacgtgttcatagccatggaactaatgggaacatgcgcagaaaaactgaagaagaggatgcagggaccgatacccgaaagaatcctcggaaaaatgacagtcgccatcgtaaaagcactgtactatttgaaggagaagcatggggttatacaccgggacgtgaaaccgagtaacattctcctggacgagaggggccagataaagctgtgtgactttggcatcagtgggaggcttgtggactctaaagctaagaccaggtcggctgggtgtgctgcttatatggcaccagaaaggatcgaccctcctgatcccaccaaacctgactacgacattcgcgcagatgtgtggagcctcggcattagtttggtagagttggcaactgggcagttcccctacaagaattgtaagacagacttcgaggtgctgacaaaggttctgcaggaagagcccccactcctacccggccacatgggtttctctggggatttccaatcctttgtgaaggactgcttgacaaaagatcatagaaagcgaccaaaatacaataagctcttagaacattctttcataaagcgatacgaaaccttagaagtcgatgttgcctcctggttcaaagacgtcatggccaaaaccgagtctccacgcaccagcggggtgctgtcgcagccccacctcccgttttttcggtag

SEQ ID NO: 16041 - DNA, 963 bp, Artificial Sequence
  Description of Artificial Sequence: Synthetic coding sequence
atgtccaagtctgcctcccctaaggaaccagaacagctccgtaaactgtttatcgggggactgtcattcgagacaacagacgagtcccttaggtctcactttgaacagtgggggacactcactgactgcgtcgtgatgagagaccccaataccaaacggtctcggggttttgggtttgttacatacgccactgtggaggaggtcgatgctgcaatgaacactacacctcataaggtggatggccgcgtcgttgagcccaagagggccgtttcccgggaagatagccagcgtcctggagctcatcttactgtgaagaagatcttcgttgggggcataaaggaggacactgaggagcatcatcttcgcgattacttcgagcagtatggcaagattgaggtgatcgagattatgaccgatagagggtctggaaaaaagagaggctttgcctttgtcacatttgacgaccatgactccgtcgacaagatcgttattcagaagtatcacactgttaaagggcataattgtgaagtccgcaaagccctaccgaagcaggaaatggcctcagcttcttcctcccagagaggccgtcggggctcaggaaattttggcggaggtagaggcgatggcttcggcggaaacgataacttcggacgggggggtaatttttctggaaggggaggtttcggaggctcttgcggtgggggaggatatggaggtagcggagacggctataatgggttcggcaatgatggctctaattttggcgggggcgggtcctacaatgacttcggaaactataacaaccaatcttcaaacttcggaccgatgaaggggggaaatttcggcggacggagtagtgggccttacggaggtgggggacagtacttcgcgaagccacagaaccagggcggctacggagtgtcatcaagttcatccagttacgggtccgggcgacggttttag

SEQ ID NO: 16042 - DNA, 1737 bp, Artificial Sequence
  Description of Artificial Sequence: Synthetic coding sequence
atggagctggagaacatagtggccaacagtctccttttaaaggctcgccaggggggatatggcaagaagtcaggaagaagcaaaaagtggaaggaaatcctaaccttacctccggtgagtcagtgtagcgagctgaggcactcaattgaaaaggactactcatctttgtgtgataaacagccaataggccgcagactgtttagacagttctgcgacaccaagccgacactcaagcggcacattgaatttctggatgcagtggctgagtatgaggttgcagacgatgaagatcgctcagattgcggcttgagcattctcgatcgattcttcaatgacaagttagccgcccccctgcccgagatccctccggacgtggtgaccgagtgtcggctagggctgaaggaggagaaccccagcaaaaaagcttttgaggagtgtacacgagttgcccacaattaccttaggggcgagccattcgaggaataccaggagtccagctatttctcccagtttctgcaatggaaatggttggagcgccagccagtcactaagaacacgttccggcattatcgggttttggggaaaggaggttttggcgaagtgtgtgcctgtcaagtgcgcgcaacaggcaagatgtacgcttgtaaaaagctgcaaaaaaagagaatcaagaagcgtaaaggcgaggccatggcactgaatgaaaaacggattcttgagaaagtacagagtaggtttgttgtgagtctggcttatgcgtacgaaacaaaggatgctctctgtctggttctgacaatcatgaatggaggtgacctgaagtttcacatctataacttaggcaacccgggcttcgacgaacagagagcggtattttatgccgcagagctctgttgcggcctggaggacctccagcgcgagcggatcgtctatagggacttgaagcctgaaaatattctgctagacgatagggggcacataagaatctctgacctgggtctcgccactgaaattccggagggtcagagagtccgcggtcgggtcggcactgtagggtacatggcacctgaggtcgtgaacaatgagaaatatacttttagtcctgactggtgggggctgggctgtctcatctacgagatgatccagggccacagtccatttaaaaaatacaaggagaaagttaagtgggaagaggtcgatcagcgaatcaagaacgatacggaggagtatagtgaaaaattctccgaggatgcgaagtccatctgccgtatgctgctgacgaagaacccttccaaaagactgggctgccgcggggagggcgcagccggagttaaacaacaccccgtatttaaagacatcaattttcgccgcctggaggctaacatgctggaacctcctttttgtcccgacccacacgcggtgtactgtaaggatgtgttagacattgaacagttctcagtagtgaaaggaatctacctggacacagcagacgaggatttttacgccaggtttgcaaccggctgtgtctcgattccctggcaaaacgagatgatcgaaagcggctgctttaaggacattaataagagcgagtccgaagaagctctgccattagacttggacaagaatattcacacaccggtgagcaggccgaaccgagggtttttttaccggttgttccgaagagggggttgcttgaccatggtcccctccgagaaggaagttgagcctaagcaatgttag

SEQ ID NO: 16043 - DNA, 2625 bp, Artificial Sequence
  Description of Artificial Sequence: Synthetic coding sequence
atgaaccagcgttcccacctcggaacaacttacttagatacggcaaaaggggccgtcgagaccttcatgaagcttagggcacgggaccccgcatcaaggggagaccgttacatgttggtcaccttcgaggagcccccatatgccatcaaggcagggtggaaggaaaatcacgcaacctttatgaatgagttgaagaacctacaggcggaggggctcactaccttaggccagtcgctcaggactgcatttgatttgctgaatcttaaccgactggtgactggcattgataactacggacagggaagaaatccatttttcctggagccagccattattatcactatcaccgatgggagtaagctcacaactacgagtggtgtccaggacgagctgcatctgcctctgaactcccctctacctgggtccgagctgactaaggagcctttcagatgggatcagagactctttgccctcgtgttacgactgcctggcacgatgtccgtggaaagcgagcagttgaccggtgtccccctggacgacagcgcaatcactccaatgtgtgaagtgacgggcggtaggagttattctgtttgttccccgaggatgctgaaccagtgcctcgaatccctggtccagaaagtgcagtctggagtagttattaattttgagaaggccggtcctgatccaagtcctgtagaggatggacagcctgacatcagccgccctttcgggagtcaaccgtggcacagctgccataaactcatttatgtgcggcccaacccaaaaactggagtgcccatcggacactggcctgtacccgagtccttctggcctgaccaaaatagcccaaccctgcccccccgaacttctcaccctgttgtgaagttctcttgtactgactgtgaacccatggtcatcgataagttgccattcgataaatacgaattggagccttccccactgacccagttcatactcgagcgaaaatctccacagacgtgctggcaggtgtacgtgtcaaatagcgcgaaatactcggaactggggcatccctttggttatttaaaagcttccaccgccctgaactgtgtgaatctgtttgttatgccctataattatcctgtcctgctacctctgctggacgatctgtttaaggtccacaaggctaagccaacactgaaatggcgacaaagctttgagtcctacctgaagacgatgcctccatactacctaggacctcttaagaaggccgttcgcatgatgggagcccctaatctgattgccgattccatggagtacggactgagctatagtgtgatctcttaccttaagaaactgagccagcaagcgaaaatcgaaagcgaccgcgtaatcggcagtgtcggaaagaaagttgtgcaggaaacaggcattaaggtgaggtcccgcagccatgggcttagtatggcttatcgcaaggactttcagcagcttctccagggcatcagcgaggatgttcctcatcgattactggacttgaatatgaaggaatatactgggttccaggtggctctgctcaataaggatctaaaaccccagacctttcggaatgcatatgacattccgcgcagaaacttactggaccacctgacacggatgaggtctaacttgctgaagagcacccgacgctttctgaaggggcaggatgaagatcaggttcacagcgttccaattgctcagatgggaaattaccaggaatacctcaagcaggtgccctctcctctccgcgagcttgatccagaccagcccagaaggctgcatacatttggcaatcccttcaagttggacaaaaagggcatgatgatagacgaggcagacgaattcgtcgccggacctcagaataaacacaaaaggcccggagaaccaaatatgcagggcattcctaaacgcaggcgctgtatgagccctctgttgcggggccgccagcaaaatccagtggtaaacaaccatatcggggggaaaggtcctcctgcacccaccactcaggcccagcccgaccttattaagcccctccccctgcataagattagcgaaaccacgaacgactcaattatccacgatgttgtagagaatcatgtggctgatcaactgtcttcagatatcacacctaatgcgatggataccgagtttagtgcaagctctcccgcctcccttttagaaagacctacaaaccacatggaggcactggggcatgaccacctggggaccaacgatttaacggtcggggggtttttggagaatcatgaggaaccccgtgacaaggagcagtgcgcggaagagaacataccagcctccagcctaaacaagggcaagaagctgatgcactgccgcagccatgaagaggtgaacactgagctgaaggcccagattatgaaggagatccgcaagcctggaaggaagtacgagagaatttttaccctgctcaagcatgtgcagggatcactccagaccaggttgattttcctgcagaacgtgattaaagaggcatcaaggttcaagaaacggatgttgatcgagcagctcgagaactttctcgacgaaatacaccggcgcgcgaatcaaattaaccatattaactccaactag

SEQ ID NO: 16044 - DNA, 2340 bp, Artificial Sequence
  Description of Artificial Sequence: Synthetic coding sequence
atggctgattattctaacaagctgtactaccagctggagcaggagacaggaatccagacgggatacacccgaacagggagtatcttcctggcccagacacaggacaggctcatctcccttaaaaggataaatgccgggctgaatgtcatcggaattccgtccgagataatctcgcccaagaaagtggcggagttacatcatctgttgaacgtgcatgacttggtcggggccatgcacgtgccggaggatgccgtcgtgtcttccgccgatgtggctctggcgttggcaagcgctgcatcccagaacggtgttcagatctacgaccggacttcagtcctgcatgtgatggttaagaaggggcaagtgaccggggtcgaaacagataagggtcagattgaatgtcagtacttcgtgaattgcgcggggcagtgggcctacgaattggggctgtctaacgaagagccagtgagtatacctctgcacgcctgtgaacatttctatctgctaactcggcctctagagacaccacttcagtccagtaccccaacaattgtcgatgcagacggaaggatttatatcaggaactggcagggtggaatactaagcggtggttttgaaaagaatcccaagccaatctttacagaaggcaaaaatcagttggaaatccagaatctccaagaggattgggaccactttgaaccactcctctctagtctgctcagacgaatgcctgaattggaaacattagaaatcatgaaattggttaactgtccggagacgttcacaccggatatgcgctgcatcatgggagagagccccgccgtgcagggctactttgtgctagccggcatgaactccgctggcctttcttttggaggcggcgcgggcaagtacctggcagagtggatggtgcacgggtacccaagcgaaaacgtgtgggagctcgatctcaaacgctttggggcgctccagagctctcgtacctttctgaggcacagggtgatggaggtcatgcctcttatgtacgatctcaaagtgccccgatgggactttcagacagggcgtcagctaaggacatctcccctgtatgaccgcctggacgcccaaggagcaaggtggatggagaaacacggattcgagcgtcccaaatacttcgtccctccagataaggatcttctggccctggagcagtcgaaaacgttctacaagccagactggtttgacattgtcgagtcagaagtgaaatgctgcaaggaagccgtctgcgtgatcgacatgtccagcttcaccaaattcgaaataactagcacgggcgaccaggctttggaggtgttacagtatcttttctcaaatgacctagatgttcccgtgggccacatagtgcacacgggcatgcttaatgagggcgggggttatgagaacgattgtagtatcgcacgccttaacaaacgatccttttttatgattagtcccaccgatcagcaggtacattgctgggcatggttaaagaaacacatgcctaaagactctaacttgctgctggaggatgttacatggaagtacaccgctcttaatctcatagggccacgcgccgttgacgtgctgagtgagctctcatacgcaccgatgactccagatcactttccatccttgttctgcaaagagatgtctgtcggctatgctaacggtatccgcgtcatgagcatgacacacaccggagagccggggttcatgctgtacataccaatcgagtacgcactgcatgtgtataatgaagtgatgagtgttgggcaaaaatacggtatccgcaacgcggggtattacgccctccggtcacttcggattgaaaagtttttcgcattctgggggcaggatataaacaacctcacgacgcctctggagtgcggcagagaatcgagagtgaagttggaaaaggggatggacttcatcggtagagacgcactgctgcagcagaagcagaatggcgtgtataaacgactaactatgttcatcctggacgaccatgacagcgacttggacctgtggccctggtggggcgagccaatttatagaaatgggcagtatgtgggcaagacaacaagctcagcctattcctactccctggagaggcatgtgtgtctgggcttcgtacacaacttttctgaggacaccggggaggagcaggtagtaaccgcagactttattaataggggtgagtacgaaatcgatatcgctggctatagatttcaagccaaggctaaactgtatcccgtggctagtttgtttacgcagaaacggcggaaagatgacatggaactcagtgacctgcacggaaaatag

SEQ ID NO: 16045 - DNA, 1191 bp, Artificial Sequence
  Description of Artificial Sequence: Synthetic coding sequence
atggccaccagagttgaggaggctgcccgcggaagaggcggtggcgcagaagaagcaacagaagccggcaggggcgggaggaggcgatccccgcgccagaaacttgaagagtccaggtctgtccaaaaacaaatgaagatcctgcagaaaaaacaggcacagattgttaaggaaaaggtgcaccttcagtcagagcactcaaaggccatactggccagatccaaactagaatccttgtgtagggagctacagaggcataataagactctgaaagaggagaatatgcaacaggccagggaagaggaagaaagacgtaaagaagccacagcccattttcaaatcacactcaatgaaatccaggcacagcttgagcagcatgatattcacaatgccaagttgaggcaggagaatatcgagctaggcgagaagctcaagaaactgatcgagcagtatgccctgcgtgaggagcatatcgacaaggtctttaaacataaagaactgcaacaacagctggtggacgcaaaattacagcagacgacacagctcattaaagaagcagatgagaagcatcagagggaacgcgagttcctactgaaagaggctacagaatctcggcacaaatacgagcagatgaaacaacaggaagtgcagctgaagcagcaactgagcctctatatggacaaatttgaggaatttcagacaacaatggcgaaaagtaatgaattatttacgacttttcgccaggaaatggaaaagatgacgaaaaagatcaaaaagctagaaaaggagactatcatttggcggactaaatgggagaataacaacaaggcgttactgcagatggctgaagagaaaaccgtgcgggacaaagagtataaagctctgcaaataaagctggagagactagaaaagctttgtcgggccctgcaaactgagcgaaacgagctcaatgagaaggtagaagtgctgaaagagcaagtcagcattaaagcagccattaaggcagccaatagagatttagcaacccccgtgatgcagccatgtacagcattggacagtcacaaggagttgaacacatcctctaaacgagccctgggagctcatctggaggcagaacctaagtcacagagatcagctgtgcagaagccgccgagtactggaagcgctcctgcaattgagagcgtggattag

SEQ ID NO: 16046 - DNA, 1443 bp, Artificial Sequence
  Description of Artificial Sequence: Synthetic coding sequence
atggctggttacctgtcagagtctgattttgtaatggtggaagaaggatttagtacccgtgatctcttaaaagagctgactctaggggcgtcgcaggctactacagacgaagtagcagccttctttgtggccgacctgggcgccatcgtgcgaaagcacttttgcttcctcaagtgtctcccaagagtccgcccgttctatgctgtgaaatgcaactcctctcctggtgtccttaaggttctggctcaattgggcctgggcttctcatgtgcgaacaaagctgagatggaattagtgcaacacattggaatccctgcaagcaagatcatatgtgcgaacccttgtaagcagatcgcccagataaaatacgccgccaaacatggtatccagttactgagctttgacaatgagatggaattggcgaaggttgtgaagtctcatccgtccgccaagatggtactgtgtatagcaacagacgactcacatagcttgtcttgcctgagcctgaaatttggtgtatctctcaaatcgtgccgccacctcctggagaacgcaaaaaagcaccacgtggaggtggtgggtgtgagtttccatatcgggtccgggtgcccggatccgcaggcctacgcccaatctattgctgacgctagactggtgtttgagatgggcacggagctgggccataagatgcatgtattagacctcggcgggggtttcccagggactgagggcgccaaggtaagattcgaggagattgcttctgtgataaactcagcgctggacctgtactttcccgagggatgtggcgtcgacatctttgctgaattagggaggtactacgttactagcgcgttcaccgtggcggtgtcaatcatagccaagaaggaggtgctcctagatcagcccgggagggaggcccccctcccccccccgcatatcgccacttgcgctgccagtgagccgtccccaccagctgaggagaacggcagtacctctaaaactatcgtttaccacctggacgagggcgtctacgggatttttaactccgtgctgttcgataatatttgtcctaccccaatccttcagaagaagccttcaacggaacagcctctgtactcctcttctttgtggggccccgcagtcgatgggtgtgattgtgtggctgaaggcctgtggcttcctcagctgcatgtgggggactggctggtgttcgacaacatgggcgcctacaccgtaggcatgggaagtcccttctggggcactcaagcttgccatattacgtatgccatgtcacgcgtggcctgggaggcccttaggcgtcagctcatggcagcggaacaagaagacgatgtcgagggagtatgtaagccccttagctgcggatgggaaatcaccgatactctatgcgttggtcctgtgtttaccccggcgtccattatgtag

SEQ ID NO: 16047 - DNA, 3774 bp, Artificial Sequence
  Description of Artificial Sequence: Synthetic coding sequence
atggcgcacttttcctctgaggaccaggccatgctccaggcgatgttgcgcaggttgttccagtccgttaaagagaagattaccggagcaccatcccttgaatgcgccgaagaaattctactccaccttgaggaaaccgacgaaaacttccataattatgaattcgtgaagtacttaagacaacacattgggaacaccctcggtagcatgatcgaagaagaaatggaaaagtgtacctccgatcggaaccaaggtgaagagtgcggatacgacactgtggtgcaacaggtcacaaagcggactcaagaaagcaaagagtataaagagatgatgcactacctcaaaaatatcatgatcgcggtggtggagagtatgataaataaatttgaggaagacgaaactaggaatcaggagcggcaaaaaaagatacagaaagagaagtcccattcctacagaacggataactgtagcgactccgactcttctctgaaccagtcttacaaattttgccaggggaagctgcagctgatacttgaccaacttgaccccggacagccaaaggaggtacgctacgaagccttgcaaacattatgctccgcccccccgagcgacgttctcaactgtgagaactggactactctgtgtgagaaactgacagtaagcctctctgaccctgaccctgttttctctgaccgaatacttaagttctgtgcgcaaacctttctactttctcccctgcacatgactaaagagatttacacttccctggccaaatatctggaatcatacttcttgtcccgcgagaaccacatccctactctgtctgccggggtagatatcacgaacccaaacatgaccaggctcctcaagaaggtaagactactgaacgaataccagaaggaggctccctctttctggatcagacatcccgaaaagtatatggaggagatcgttgagagtacgctatctctactcacagtaaagcataatcaaagtcacgtggtgtcgcagaaaattctggaccccatctacttcttcgcactagtcgacaccaaagcggtgtggttcaaaaagtggatgcacgctcattactccaggactactgttctgagactgttagaaacaaaatataagtctctggtgaccaccgccatccagcagtgcgtccaatacttcgaaatgtgcaagacaaggaaagctgacgaaacactcggccattctaagcactgccgcaacaagcagaaaacgttttactatctaggtcaggagctccagtacatttactttatccactctttgtgtctgttaggcagacttctgatttacaaacagggccggaaactgttcccaatcaagttgaagaacaagaaaggcctggtgtctctgatcgacctgctcgtgctctttacacagctgatatattactccccttcatgcccaaaaatgaccagcgccgctcattccgaaaactatagtcccgcatcaatggtcacagaagtgctgtggatcctttctgatcagaaagagtgtgccgtcgaatgtttgtacaataatatagttatcgagaccctgctgcagcccatacataacctcatgaaagggaatgaggcctctccaaactgcagcgaaactgcactaatccatatcgcaggcattctggcccggatcgcctctgtcgaagagggcctaatcctgctactgtacggggcaaacatgaatagcagtgaggaatcgcccacaggcgctcacataatcgcccaattttcgaaaaagctccttgacgaagatatttccattttcagtggctcagagatgctgcccgtggtcaagggagcctttattagtgtgtgcagacacatatactcaacttgcgagggactccaggtactgatcacttataacctgcatgagtcgattgcaaaggcttggaaaaaaacatcactcctgtccgagaggattcctaccccagtggaggggagcgatagtgtctccagtgtgagtcaggaatctcagaacattatggcgtgggaagacaatctgctcgacgatctccttcacttcgccgctacacctaaggggctcctgctgttgcagcggactggcgcgatcaatgaatgcgtgacctttatttttaaccggtatgcaaagaagctccaggtgtccaggcataagaagtttgggtacggggtccttgtgacaagagtagccagcacagccgcaggaggcattgctctgaagaagtctggcttcatcaatgagctgattacagagttatggagtaacctcgaatatggacgcgacgatgtgagggtgacacatcctaggaccactccggtcgatcccattgaccgcagctgtcaaaagagttttctcgccctggtcaatctgctcagctatcctgcgatttacgaactcgtcagaaatcaggacctgccaaacaaaacagagtatagcctcagagaggtgcccacatgtgtcatcgatattatcgatcggctaatcatcctcaactctgaggcaaagataagatccctctttaattacgaacaaagccacatattcgggctgcgtgacttcattatcgatggcttatcagtagaacgcaatcatgtattggttcgcatcaacctagtaggcgggccgctagagcggatattaccaccgcgcctcctggagaagtcagataatccatacccctggccaatgttcagttcttacccccttcccaattgctatctatcagatattactcgcaacgctggcattaaacaagacaatgatttggataagttgctcctttgcctgaaaatctcagataaacagactgagtggattgaaaactgccaaagacaattttgtaagatgatgaaggctaagccagacattatcagcggggaggccttgattgagttgctggaaaagtttgtactacaccttactgagtccccgtccgaatgttattttccgtctgtcgagtacactgcgaccgatgcaaatgtgaaaaatgaatccttgtcctctgtacagcagctcggcatcaaaatgactgtccgttacggcaaattcctaagcctcctcaaggacggagccgagaatgatctgacctgggtcttgaagcactgtgaacgcttccttaaacaacagcagacatcaattaagtcttcccttctttgccttcagggaaattacgccggacacgattggttcgtgtcatctctcttcatgataatgctaggtgacaaggagaagacctttcagtttctgcaccaattcagccgtctcctgacctccgccttcctgtggctgccacgcctgcacatcagctcgtacctgcccaatgacacggtggagtcaggcattcaccccgtctatttttgttccacccactacatcgaaatgcttctgaaggcggagctgccgttagtctttagcgccttccacatgagtgggtttgcccccagccaaatttgtctccagtggatcacacaatgcttctggaattatctagactggatcgagatatgtcactacatagccacgtgcgtgttcctgggtccagattaccaggtctacatttgcattgctgttttcaagcacttgcaacaggacatcttacagcatacacagacgcaggatctccaggtcttcctgaaggaagaagccttgcatgggtttagagtcagtgactatttcgaatacatggagatcctcgaacagaattaccggacagtgcttctacgggacatgaggaatataaggttgcagagcacatag

SEQ ID NO: 16048 - DNA, 612 bp, Artificial Sequence
  Description of Artificial Sequence: Synthetic coding sequence
atggccaccccgtacgtcacagacgaaacaggagggaagtacattgcctccactcaacgacctgacgggacctggcgcaagcagagaagagtgaaggaaggatatgtcccgcaggaggaggtgccggtttacgagaataaatacgtcaaattctttaagtcaaaaccggagctgccacccggtttatcaccagaagccaccgctccagttaccccctctaggcccgagggaggcgagcccggcttgtccaagaccgcaaagaggaatcttaaacgaaaagaaaagagaagacagcagcaggagaagggcgaggcagaggccttgtcccgcacactcgacaaagtcagcctcgaagagaccgctcagctgccgagtgcaccgcaaggaagccgtgccgcccccactgcagcttccgaccagcctgactctgctgccactacagagaaagccaagaagataaagaatcttaagaagaagctgagacaggtcgaggagctgcagcaaaggattcaggctggggaagtgtcacagccaagtaaagaacagctggagaaacttgctcgcagacgcgcactggaggaagagctggaggacctggaactagggttgtag

SEQ ID NO: 16049 - DNA, 729 bp, Artificial Sequence
  Description of Artificial Sequence: Synthetic coding sequence
atggctgctgtgaaggcgtccacctctaaggccacaagaccgtggtattctcatcctgtgtatgctcgatattggcaacattatcaccaggctatggcttggatgcagtcccatcataacgcctacaggaaagccgttgaatcttgttttaacttgccctggtacttgccttccgctttgctgccgcagtcttcctacgataacgaggcagcttacccacaaagcttctatgatcatcatgtcgcatggcaggattacccttgtagtagttctcactttcgacggtcaggtcagcacccccggtattcatctagaatccaggcttccactaaagaagatcaagccctttccaaagaggaggagatggagactgagtcagacgccgaagtagagtgcgacttgtccaacatggaaatcacagaggagctgcgccaatattttgccgaaaccgaacgtcaccgggaggagcggagaagacagcagcaactggacgctgagaggcttgactcatatgtgaatgccgaccatgacttgtactgtaatacacggcgcagcgttgaagctccaacagagcgacctggcgagaggcgacaggccgaaatgaagcgcctctacggcgattctgctgccaaaattcaggccatggaagccgctgtgcagctttccttcgataaacattgcgatcggaagcaaccaaaatactggcctgtcatcccactcaaattctag

SEQ ID NO: 16050 - DNA, 738 bp, Artificial Sequence
  Description of Artificial Sequence: Synthetic coding sequence
atgatcggtgtatccttcgaggaagcaaagtccataattacaggggcaaagcttagtacgcgcctggaaagcgcttgggaaatcgcatttatccggcagaagtctgacaacattcagcctgagaacctgagctgtaccagtctgattgaagcaagtggtgagtatggtccacaggcctcaacgctttcactgttttcctctcctcctgaaattctgattcctaagaccagcagtacaccaaaaacaaataatgatatcttgagctcttgcgagatcaaaacgggttacaacaagaccgtgcagatccctatcactagcgaaaattctacagtgggattatccaatactgacgttgcttcagcttggactgagaattacgggctccaagagaaaatctcccttaatccctctgtgagattcaaagcagaaaaactggagatggccctgaactacttgggaatacagcccaccaaagagcaacaccaggcactgagacagcaggtgcaagccgatagcaaagggacagtcagctttggggatttcgtgcaggtggcacgcaacctcttctgtctacagttagacgaagtcaatgtcggggctcatgagatcagcaatattctagattcccagcttttgccatgcgattcatcagaggcggatgagatggagcgtctcaaatgtgagagggacgatgccctgaaagaggttaacacattaaaatggccaggacaaaactag

SEQ ID NO: 16051 - DNA, 1020 bp, Artificial Sequence
  Description of Artificial Sequence: Synthetic coding sequence
atgatggactcacagctggtggctggggtcgcgtttaaaaagacattcagttacgccggatttgaaatgcagcctaagaaatatcacaatcccaagatcgccctgctgaacgtggagctcgagttaaaggccgaaaaagataacgctgagatccgggtccacacagtggaggactatcaagccattgtggatgcagagtggaacatcctgtatgacaagttagagaagatacaccacagcggggccaaagtcgtcctgtcaaaattacccattggggacgtagcgactcagtacttcgcagacagagacatgttttgcgctgggagagttcccgaggaagacttgaaaagaacaatgatggcatgcggagggagcattcaaactagcgtgaatgcactcagcgcagacgtcctaggtcgatgtcaggtgtttgaggagactcagatcggaggtgaaaggtataacttctttaccgggtgtcctaaagctaagacatgtaccttcatcctacgtggaggggccgaacagttcatggaggagactgaaaggtctctccacgatgcaatcatgatcgttcgtagagctatcaagaacgactccgtcgtcgccggaggaggtgctatcgaaatggagctctctaagtacttgcgcgattattcccggaccatcccagggaagcagcagttgctgataggcgcatatgcaaaggctctggagatcattcctcggcagctctgcgataatgcagggttcgacgcaaccaatattctaaacaaattgcgggccagacatgctcagggggggacatggtatggcgtagatataaacaacgaagacattgctgacaatttcgaggctttcgtgtgggaacctgccatggtgcggattaacgccttgactgccgctagcgaggccgcctgcctcattgtgtccgtcgatgaaaccattaagaacccccggtccactgtcgacgcccctactgccgccggcagagggaggggacggggtagaccacattag

SEQ ID NO: 16052 - DNA, 768 bp, Artificial Sequence
  Description of Artificial Sequence: Synthetic coding sequence
atggcatcctccgatctggagcaactctgcagccatgtgaatgagaaaatcggcaatattaaaaagactttatctctaaggaactgtggtcaggagccgactttgaagactgtcctgaataagatcggcgacgagatcattgtcattaacgaactcctcaacaagctcgagctggagattcagtaccaggagcaaaccaacaattcgttgaaagaactctgcgaatctcttgaggaggactacaaggacatcgagcatctcaaagaaaatgtgccctctcatctcccccaggttaccgtgacgcaaagttgtgtgaaggggtctgacctcgaccccgaagagcccatcaaggtcgaagaaccggagcctgtgaagaagcctccgaaagagcaacgctcgattaaagagatgcctttcattacatgcgacgaatttaacggcgttccgtcttatatgaagtcacgactgacctacaaccaaattaacgatgttatcaaagaaattaataaagccgtgattagtaaatataaaatcctacaccagcccaagaaaagtatgaatagcgtgacccgtaacctctatcataggtttatcgacgaagagactaaggataccaagggaaggtacttcatcgtcgaggctgacatcaaagaatttacaaccctcaaggccgataagaagttccacgtccttcttaatattcttaggcactgcaggcggctatcagaggtccggggcggtggacttaccaggtatgttatcacctag

SEQ ID NO: 16053 - DNA, 441 bp, Artificial Sequence
  Description of Artificial Sequence: Synthetic coding sequence
atggttaattcttgttgtggatctgtgtgcagcgaccagggttgtgaccagggactttgtcaagaaacctgctgccgccccagctgctgccagacgacctgttgctgcccatcttgtgtggtatctagttgttgtaggccctcctgctctcagaccacctgttgtcagactacctgctgcaggccttcttgttgccatcctgtttgttgccagaccacctgtaggccatcatgtggcgtatcgtcatgctgtcggcccctctgttgtcagacgacatgtcacccatcttgcggtatgtcatcatgctgccgaccgttatgttgccagacgacatgcagacctagctgcggagtgagcagctgctgcaggcccctttgttgccagactacttgctgcagagccacctgttgtcgcccctcttgttgtggctcctcctgttag

SEQ ID NO: 16054 - DNA, 1296 bp, Artificial Sequence
  Description of Artificial Sequence: Synthetic coding sequence
atgacaagcgactgtagcagcacacactgtagtcctgaatcttgcggaaccgccagcggctgtgccccggccagcagttgttcagtcgaaaccgcctgccttccagggacatgcgctacatctcgatgtcagaccccgagctttttgtcccgctctcgcgggttgacaggttgtctcctcccttgctattttaccgggtcatgcaattcgccttgtctagttggcaattgcgcttggtgtgaggacggggtcttcacctccaacgagaaagagaccatgcagttcttgaatgacaggctggcaagctacttagaaaaagtccgttcacttgaagagaccaatgcagagctagagagcaggatacaggaacaatgcgagcaggacatccctatggtctgtcccgactaccagagatacttcaatacgatcgaagatctccaacagaaaatcctgtgcactaaggccgagaactctaggctcgcggttcagttagacaattgcaagctcgcaaccgatgacttcaagagtaagtatgagtctgagctgagcctgaggcaactactggaagcagacatcagttctctccatggaatcctggaagagttgactctttgtaagagcgatctcgaagcccatgtggagtcgctgaaagaagacctcctatgtctgaagaaaaatcacgaagaagaagtcaatctgttgcgcgaacagttgggcgaccgtctaagcgtggagcttgacaccgcccctacactcgacctcaatcgtgttcttgatgagatgcgctgtcaatgcgaaactgttctagccaataacaggagggaagcggaggagtggctagcagtgcagaccgaggagctgaatcagcagcagctgtcctccgctgaacagctccagggatgccagatggaaatcttggagctgaagagaacagcttcagccctggaaatcgagctgcaggctcagcagtctctgaccgaaagtttggagtgtacagtcgccgagaccgaggctcagtactctagccagctcgctcagatacagtgcctgattgacaacctggaaaaccaattggctgaaattcgatgtgatctggagcgtcagaaccaggaataccaggtgctgctggatgtcaaggctcgtctggagggggagataaatacctattggggcctgttagactcggaggactcccggctaagttgcagcccatgctctaccacctgcaccagcagtaacacctgcgaaccttgtagtgcctacgtcatctgtaccgttgaaaattgttgcctttag

SEQ ID NO: 16055 - DNA, 471 bp, Artificial Sequence
  Description of Artificial Sequence: Synthetic coding sequence
atggggtgttgtggatgctctggcggatgtggcagtggttgtggtggatgtgggtcaggcagtggagggtgtggttccggatgtggtggctgcggttcctcgtgttgcgtgcccatatgttgctgcaaacctgtttgttgctgcgttcccgcctgctcttgcagcagctgcggaagctgcggcggatccaagggtggttgcggctcatgtggctcctcgaagggcggttgcggctcttgtggttgctcccagtcaaattgctgcaaaccttgctgcagtagcagcggttgcggcagcttctgttgtcagagttcctgctctaagccatgctgctgccagagttcatgctgccagagctcttgctgcaaaccatgttgttgtcagagctcatgttgtcagtcatcgtgctttaaaccatgctgctgtcagtccagctgctgtgtgccagtctgctgccagtgcaaaatatag

SEQ ID NO: 16056 - DNA, 609 bp, Artificial Sequence
  Description of Artificial Sequence: Synthetic coding sequence
atggggtgttgcggctgttcaggcgggtgtgggagcggttgcggcggctgtggtagtgggtgtgggggatgcgggtcgggttgcggcggatatggcagcgggtgcggcggatgcggaagtagttgctgtgtgcccgtgtgttgttgcaagcctgtctgctgttgtgtacccgcatgttcctgtagcagttgtggcagctgcggcggcagcaagggcgattgcgggagctgcggcggcagtaaaggcgggtgcggctcctgcggagggtccaagggagggtgcggtagctgcggcggctcgaagggtggctgcggcagttgtggcggttcaaaggggggatgcggctcctgtggcggtagtaagggcgggtgtggttcatgcggcgggagtaagggaggatgcggctcttgcggctgtagccagtgcaactgttgcaagccgtgctgttgttcctccggatgcgggagctgttgccagtcttcgtgctgtaacccttgctgctgccagagctcgtgctgcgtgcctgtatgctgtcagagcagctgttgtaagccttgttgctgtcagtcatcatgctgcgtgcccgtgtgctgccagtgtaagatttag

SEQ ID NO: 16057 - DNA, 498 bp, Artificial Sequence
  Description of Artificial Sequence: Synthetic coding sequence
atgggctgctgcggctgtagtgagggctgcgggagtgggtgtggaggctgcggaagcgggtgcggaggatgcgggagtggctgtggaggatgtggtagttcgtgttgcgttcctgtgtgctgctgcaagcccgtctgttgttgcgttcccgcatgtagttgctccagctgcggtagttgcgggggttctaaggggggctgtggcagctgtgggggcagcaagggaggatgcggctcctgtgggggtagtaaaggcggttgcggctcatgtgggtgttctcagtgcagttgttacaagccatgctgctgttcatccggatgtggcagctcctgctgccagtcttcatgctgcaagccctgctgctgccagtcaagctgctgcaagccctgctgttgcagctccggctgtggttctagctgttgtcagtcttcctgttgtaatccgtgctgttcccaaagctcatgttgcgtgcctgtctgttgccagtgcaagatatag

SEQ ID NO: 16058 - DNA, 3105 bp, Artificial Sequence
  Description of Artificial Sequence: Synthetic coding sequence
atggcctcagtgtttatgtgtggagttgaggatctcttattcagcgggagtcgctttgtctggaacctcaccgtcagtactctacgacgctggtataccgagcgtcttcgtgcttgtcaccaagtactcaggacctggtgcggactgcaagacgtctaccagatgaccgagggacgccattgccaggtgcacctcctcgacgaccgtcgcttggagctgttggtacagcctaaactccttgcccgcgagctgctggatctggtcgcttctcatttcaatctgaaggagaaagagtactttggtatcacgtttatcgatgatacagggcagcaaaattggctacagctcgaccacagagtgctggatcacgatctccctaagaaacccggtccaacaatcctgcactttgcggtgcgcttttatatcgaaagcatctcattcctgaaagacaagaccactgtcgagctcttctttctgaacgctaaggcatgcgtgcataaaggccagattgaagtggaatccgagacaatttttaaattggccgccttcattctgcaggaggccaaaggagactatacgagcgatgagaacgcgcggaaggatctgaaaaccctgcctgcattcccaaccaagaccctccaggaacacccatcattggcttactgtgaagatagagtgatcgaacattacctgaagattaaagggttaactcgaggacaggccgtggtccagtacatgaagattgttgaggcactccctacttacggggtacattattacgctgttaaggacaagcaaggcctgccctggtggctcggtattagttataaaggcatcgggcagtacgacattcaggataaagtcaagcctcgcaagctatttcagtggaagcagcttgagaacctgtatttcagggagaagaagttcgccgtggaggtgcatgacccgcgacgcatatctgtttctcgccgaactttcggccagtccggcctgtttgtacagacctggtacgccaactcatcccttattaagagcatttgggtgatggccatcagccagcatcagttctacctcgaccgcaaacagtctaaggcaaagatccctagcgccaggtcattggatgagattgcaatggatctcaccgagacaggcacgcaaagagctagcaaactggtgactctcgagaccaagagtcagttcatcatggccagtaacgggtctttgattagttctggctcccaggatagtgaggtgagcgaagaacagaagcgcgagaagatactggagctaaagaagaaggagaagcttctgcaggaaaagcttctcaaaaaagttgaagaacttaagaagatctgtctccgagaagcggagttgaccgggaagatgcctaaagaatacccgctgaatatcggcgagaaaccaccacaggtgagacggcgggtgggaaccgccttcaagcttgatgacaacttgctaccaagcgaagaagaccccgctctccaagagttagagtccaattttcttattcaacagaaactcgtcgaggccgcaaaaaagctcgctaacgagccggatttatgcaagacagtgaagaaaaaacgcaaacaggattacactgacgcgatgaaaaagctgcaggagattgaaaatgctatcaacgaatacagaatacggtgcggcaaaaaaccttctcaaaaggccactgtactgcccgaggatatcattccgtctgagagtagcagtttatcagataccacaacatatgacgacccttcagacgcttttacttttcctggccagaggtcttcttctgttcctcattccccacgtatcctgccgcctaagtcactgggcatcgagcgcattcatttcaggaaatcctccattaatgagcagtttgtggacaccagacagtcaagagaaatgctatcgacccactctagtccctacaagactctggagagacgcccccagggaggccgttccatgcccactacgcccgtactgactaggaatgcctattccagcagccatctcgaacctgaatcctcttctcaacactgccgccagcgttctgggagcctagaatcccagtctcatctgttgagcgagatggacagtgacaagccattcttctcccttagcaaatcccaacggtcaagctccacagagatccttgacgacggcagttcgtatacatcacagtcttctacagaatattattgcgtgactcccgtcacaggcccttactataccactcagaccctggatacaaggactcgaggaagacggcggtcaaagaagcagaacgtgtcaacaagtaacagcggatctatgccaaacctcgcccagaaggacagccttaggaacggggtgtactcaaagtcccaggagcctccaagctctagttactacattgctggctatactccctatgccgaatgcgatttctattactcaggggggtatgtgtatgagaacgatactgagggacagtacagtgtcaacccctcatacagatcttcggctcactacgggtacgaaaggcaacgagactatagtagatcatttcacgaagacgaagttgaccgcgtgcctcacaacccctatgccacacttagattgccccgcaaagccgccgctaagtctgagcacatcaccaagaacatccataaggcccttgttgcagaacatctccgcggctggtaccaacgcgcttcagggcagaaagatcagggccacagcccacagaccagctttgattctgatagaggatcacaacgctgcctcggcttcgctggcctgcaggttccctgtagtcccagcagtcgggcatcttcgtattccagcgtatccagtactaacgcgtcggggaattggaggacacagttaaccatcggtctgtcggattatgagacgcctgcccatagttcctacacctcctgttatggcaacgtctataatcctctgccctctccctctcgacagtacactgaaatctcacagctggacggaaccgacggtaatcaactggaggataacctagaatctagcgagcagcggttattctggcacgaggattctaaacctggaactttggtgtag

SEQ ID NO: 16059 - DNA, 501 bp, Artificial Sequence
  Description of Artificial Sequence: Synthetic coding sequence
atgctttcacagtcttgcaatctggatcccctgactgagacctatggtatcccattttatctccaatatctggcgcactggccggaatattttattgtggcggaggcccctggaggggaactgatgggatatatcatgggaaaggccgaaggatctgtcgcgcgggaggagtggcacggccatgtgacggccttgagtgtggcccctgaattccgccgcctcggcctcgcagccaagctgatggaattattggaggaaatcagtgaaagaaaggggggattctttgttgaccttttcgtgagagtctctaatcaggtggcagtcaacatgtataagcagcttgggtacagtgtgtacagaaccgtaattgagtactactccgcctcaaatggagagcccgatgaagacgcttacgacatgcgcaaggctctgagccgagacactgaaaagaaaagtatcatccctcttcctcacccagtacgtcccgaggacatagagtag

SEQ ID NO: 16060 - DNA, 399 bp, Artificial Sequence
  Description of Artificial Sequence: Synthetic coding sequence
atgcgggcgtcgccttgtatcagccagcccgccgccagctggcacccacgtccaagtgctctgcggccaaccgccggttccgggccagacacccgcactcccgggacggtggaggatggcagcgctccctgtccagccttccgatctccagctgtgagcccttgtggcgaggaaccgtgttgcttccagatttctccggctgaagagaccctggaactgggtaggctcgtatcaccaggaaactgcgatactctttctccgcgggccgcgggattctatgcttgtcatgtgaggtcccttatcccctgtaggagtacgaaaggtcgatggccacttaccgccagtgctgcaggcctgtccagacacgcgcagtgcgggccctctctgggcttgggttag

SEQ ID NO: 16061 - DNA, 375 bp, Artificial Sequence
  Description of Artificial Sequence: Synthetic coding sequence
atgagggcatctccatgcatttctcaacctgccgcttcttggcacccacggcccagcgcactgaggcccaccgcaggctctggccccgacacaagaacccccggaaccgtggaagacggaagcgccccatgccctgccttccggtctcctgccgtgtcaccatgtggcgaagagccttgctgtttccaaattagtccagcggaggaaactctggagctgggaaggctcgttagccctggaaattgtgacactctttccccccgcgctgctggcttctatgcttgccacgtccggtctctcattccatgtaggtctactaaagggcgatggccactgaccgcttctgccgcgggattaagctctttctccggctag

SEQ ID NO: 16062 - DNA, 336 bp, Artificial Sequence
  Description of Artificial Sequence: Synthetic coding sequence
cttatggatctggacagcggggacgtgaagcgccgcgtgcacttattcgagactcaaagacgtacaaaggaggaagatcccatcatccctttctctgatggtcccatcatcagcaaatggggggccatttcaaggtcaagtaggaccgggtaccataccactgaccctgttcaagccactgcatctcaggggtctgctacaaagccaattagcgtctcaggcggcgtacacatggcaacacgtccgcaccatcagcacaccatgcttaaaggcacagactcccttctcctgatatatcttgtcatcgagtccatcccagtgttggggactttttag

SEQ ID NO: 16063 - DNA, 399 bp, Artificial Sequence
  Description of Artificial Sequence: Synthetic coding sequence
atgagagccagtccatgcatcagccaacccgccgcaagttggcatccgaggccgagtgcattgaggccgaccgccggctctggccccgatacccgtactcccggcacagtagaggatggatctgccccttgtccagcctttcgcagtccggccgtgagcccctgcggcgaggaaccttgctgctttcagatatctccagctgaagaaacactggagctcggaagactggtctcaccagggaactgcgacactctaagtccccgtgcagcaggattctacgcctgccacgtccgctctctgattccttgcagatctactaagggacgatggccccttaccgctagcgcagctgggctgtctcgccatgctcaatgcggacctagcctggggttggggtag

SEQ ID NO: 16064 - DNA, 375 bp, Artificial Sequence
  Description of Artificial Sequence: Synthetic coding sequence
atgcgggccagcccatgcatctcacagcccgccgcctcctggcaccctcggccaagcgccctcaggcctacagcaggttcaggtccagacacacgtacgcccgggactgtggaagatggctctgcaccctgtccagcatttcgtagccccgctgtgtctccgtgcggggaggagccttgttgcttccaaatttcaccagccgaggaaaccctggaactcggacggctggtgtctcccggaaattgcgataccctgtctcctcgggcagccggtttttacgcctgccacgtgagatctctcataccctgcaggtccaccaagggtcgctggcccctgacggctagcgcagccggactttcctctttcagcggctag

SEQ ID NO: 16065 - DNA, 1038 bp, Artificial Sequence
  Description of Artificial Sequence: Synthetic coding sequence
atgttgcccaatacgggaagactagcgggttgcacagtctttattaccggagcttccagggggattggcaaggccatcgcactgaaagccgctaaagatggagctaacattgtgatcgctgccaaaactgcgcagccccaccctaaactgctgggcactatctacaccgccgctgaggagattgaagctgtgggcggtaaggcattaccgtgcatagtggacgtgagagacgaacaacaaatcagcgctgctgtggaaaaggccatcaagaagttcggcgcctacacaatagcgaagtacggcatgtcaatgtacgtcctgggaatggctgaggaatttaagggggagatagctgtcaatgccttatggcccaagacagctatacacacggcagcaatggacatgcttgggggacccggaatagaatcccaatgccggaaggtcgacatcatcgcagacgcggcttactccatcttccagaaaccaaagagctttaccggcaactttgtaatcgatgagaatatcctgaaagaggaggggattgagaacttcgatgtatatgccatcaagcccggacaccccctgcagccggatttttttctggatgaataccccgaggcagtctctaagaaggtcgaaagcactggagctgtgccagaatttaaggaggagaagctccagttgcagcctaagccaaggtcaggggccgtggaagagacttttcggatagtgaaagattctctatccgatgatgttgtcaaggccacccaggctatctacctgtttgagttatcgggggaggatgggggtacctggtttcttgacctgaaatcaaagggagggaatgtcgggtatggagagccctccgaccaagccgatgtcgtcatgtcaatgactaccgatgatttcgtgaagatgttctccggcaaactgaaaccaacgatggcattcatgagcggtaagttgaagataaagggcaatatggctctggctatcaaactcgagaagctaatgaatcaaatgaacgcgagactgtag

SEQ ID NO: 16066 - DNA, 1257 bp, Artificial Sequence
  Description of Artificial Sequence: Synthetic coding sequence
atgttacccaatactggtaggcttgcaggatgtacagtattcatcacgggggcatccaggggaatcggcaaagcaattgcattgaaggctgcgaaagacggtgcgaacatcgttatcgctgccaaaacagctcaacctcacccaaaactcctgggcactatttataccgctgctgaagagatagaggctgtcggtggtaaagccctcccatgtattgtggatgtaagagacgagcagcaaatctcagccgctgtggagaaggccatcaagaaatttggcgggattgatatcctggtgaataatgcgtccgcaatcagtctcaccaacactctcgacacaccaactaagcgcttagacctgatgatgaacgtgaacacacggggtacttacctcgcctcaaaggcatgcatcccttatctcaagaaaagcaaagttgcccatatactgaatatcagcccaccactcaacttgaatcccgtctggttcaaacagcattgcgcttacaccatagcgaagtatggcatgtcaatgtatgtgctgggcatggccgaagaatttaaaggagagattgccgtgaatgctctgtggcccaagaccgccattcacactgcagctatggacatgctcggcggacctggcattgagtcacagtgtcgtaaggtcgatatcatcgcagatgcagcctactccatattccagaaacccaagagtttcacaggtaactttgtcatcgacgagaacattctgaaagaagaaggtatcgagaacttcgatgtatacgccattaagcccgggcaccctctgcagcccgatttttttctggatgagtaccccgaggccgtgtcaaaaaaagtcgagagcaccggagcagtcccagaatttaaagaggagaaactgcaattgcagcccaaacctcgcagtggagccgtcgaagaaacatttaggatcgtgaaggactctttgtcagatgatgtcgtaaaagctactcaggctatatacctgtttgagctgagtggggaggatggaggcacgtggttcctggacctgaagtctaagggagggaacgtgggctatggagagccatcagaccaggccgacgttgtcatgagcatgactacagatgacttcgttaagatgtttagcggaaagttaaagccaacaatggctttcatgtctggaaaattgaagatcaaaggcaatatggcactggcaataaagctggagaaattgatgaatcagatgaacgccagactttag

SEQ ID NO: 16067 - DNA, 1077 bp, Artificial Sequence
  Description of Artificial Sequence: Synthetic coding sequence
atgcctggttgcgagttgccggtgggcacatgccctgatatgtgtccagcagcagagagagcccaaagggagagggaacatcgtctgcacagactggaagtggtccccggatgccggcaggacccccccagggccgacccgcagagggccgtgaaggagtattcaagacccgctgctggcaagccaagaccccctcccagccagctgcggccgccatcagtactgcttgcgacggtgcgctatctggcaggggaggtggctgagtccgctgacattgccagggccgaggtggctagttttgtggctgaccgtctgcgggcagtattgctcgacctggccttgcagggtgcaggggacgcagaggctgcagtagttctggaagctgctctcgccacgttgctgacagtggtcgccaggctggggcccgacgcagcaagaggcccggccgacccagtgttgctgcaagctcaggtccaggaggggttcggtagcctaagaaggtgctacgctcgaggggctggaccccacccacggcagcccgccttccaggggctgttcttgctatataacttggggtccgtggaagcgcttcatgaggttctccagctcccagccgctctccgagcctgcccccctctgcggaaggctctagccgtggacgctgctttccgtgaggggaacgcagctagactgtttcggttgctgcagactctgccctacctgcctagctgtgctgtccagtgtcacgtaggtcacgcacgaagagaagctctggcccgctttgctagggctttttctacacctaagggccagaccctgcctctcggattcatggtgaatcttctcgctctggacggactgagagaagccagagacctgtgccaagctcacgggctgcctctcgacggcgaggaacgagtggtgttcctaagggggcggtacgtggaagagggcctcccgccggcatctacttgcaaagtattagtggaatcgaagttgcgcggcaggaccctggaagaggttgtgatggctgaggaggaagatgaggggacagaccgacctggtagtccagcatag

SEQ ID NO: 16068 - DNA, 150 bp, Artificial Sequence
  Description of Artificial Sequence: Synthetic coding sequence
atgtcaagttgcgtgagttcacagcctagttctaatcgcgccgccccgcaagacgagctaggcggacggggttcctcatcaagcgaaagccagaagccctgtgaggccctgcgcgggttgtcatctctctccatccatctcggtatgtag

SEQ ID NO: 16069 - DNA, 2598 bp, Artificial Sequence
  Description of Artificial Sequence: Synthetic coding sequence
atgccagctgtatctctcccacctaaagagaatgccctatttaagcgcatcctgcgctgttatgagcataagcaatatagaaatggtctgaaattttgcaagcaaatactttctaatcctaaattcgctgagcacggggagacattagctatgaaaggattgacactgaattgcctggggaagaaagaagaagcttatgaactcgtacgcagaggattgagaaatgatctcaaatcccatgtgtgttggcatgtctacggactcttacaaaggtctgacaagaagtacgatgaagctatcaaatgctataggaacgccctgaagtgggacaaggacaacctccagattctccgtgatctgtcactgttacagattcaaatgagggatcttgagggttatagggagacccgctaccaactcctacagctaaggcctgcacagcgggccagctggataggctatgctatcgcctatcacctactggaggattatgagatggccgccaagatcctggaggagttccgcaagactcagcagacttcacccgacaaagtcgattatgagtatagcgagctgctgctgtatcagaatcaggtgctcagggaggcagggctctacagggaagcccttgaacacttgtgtacttacgaaaagcagatatgcgacaagcttgctgtagaagagacaaagggagagctcctgttgcaactatgtcgccttgaggacgcagccgatgtgtatcgaggattgcaggagagaaaccctgaaaattgggcatactacaagggcctggaaaaagctttgaaacccgccaatatgctagagcggttgaagatatatgaggaggcctggactaagtatcccaggggtctggttcctcgccggctgcctctaaatttcctgtccggcgaaaaatttaaggaatgtttagataaatttttacggatgaatttcagcaaaggttgtccaccggtgttcaatactctgaggtcactgtacaaggataaggagaaagtagccatcattgaggagctggtggtcggttacgagacttccctgaaaagctgtagactctttaacccaaacgatgacggaaaggaggaacctcctactacactgctctgggtgcagtattatttagcacagcattacgacaagatagggcagccttccatagcgcttgaatacatcaacacagccatcgagagcacccctaccctgatcgagcttttccttgtgaaagccaaaatctataagcacgccggcaatataaaggaggcagcgaggtggatggatgaggcgcaggccttggatactgcggatcgctttattaatagcaaatgcgccaaatacatgctgaaggctaacttgattaaggaggccgaggagatgtgcagtaagtttacacgggaaggcacatcagctgtggagaacctaaatgaaatgcagtgcatgtggtttcagaccgagtgtgcccaggcttataaggctatgaacaaattcggcgaagcccttaaaaagtgccacgagatcgagagacacttcattgagataaccgatgatcagttcgatttccatacctattgtatgaggaagataaccctgcgcagttatgtggatttgctgaagctcgaggatgtgcttcgacagcatcctttctactttaaagcagcccgcatcgccattgaaatttatctcaaattgcatgacaacccgctcaccgacgagaataaggagcatgaagccgatactgctaatatgagcgataaagaattgaagaaactgagaaataagcaaagacgcgcccagaaaaaagcacagatcgaggaagagaaaaaaaatgctgaaaaggagaagcagcagaggaatcaaaaaaaaaagaaggacgatgacgatgaggagattggggggccgaaggaagaacttattcctgaaaagttggccaaggtcgagactccgctggaggaagcaataaagttcctcacccctctgaaaaaccttgtgaaaaataagattgagacccacctgtttgcattcgagatttacttccggaaggagaaattcctccttatgctgcagtcagtcaagagggcattcgcaatcgacagttcccatccttggttgcacgagtgcatgattcgccttttcaataccgtgtgcgaatctaaggacctgagcgatacagtgaggacagtcttgaagcaggagatgaaccggctctttggggcaacaaaccctaagaacttcaatgaaaccttcttgaaaagaaattcagactcacttcctcacaggttatccgctgcaaaaatggtgtactacctcgacccctccagtcagaagagagcgatagagctcgctacgactctagacgaaagcctcactaatcgcaatctccaaacttgtatggaagtactggaggctctttatgatggaagcttgggagactgtaaagaagcggccgaaatttaccgagctaattgccacaagttgtttccttatgcccttgccttcatgccacccggttacgaagaggatatgaaaattactgtgaatggcgactcctccgcagaggctgaggagcttgcaaatgagatatag

SEQ ID NO: 16070 - DNA, 1797 bp, Artificial Sequence
  Description of Artificial Sequence: Synthetic coding sequence
atgggaggatgtttctctaaaccaaagcccgtcgagctcaaaatcgaggttgtcctcccagaaaaagagcggggaaaagaggaactgtcggcgtctggcaaaggtagccctagagcctaccagggcaacgggaccgcacgccatttccacaccgaggaacgactcagcactccccacccctacccttccccacaggactgcgtcgaagcggctgtgtgccacgtgaaggatcttgagaatggacagatgagagaagtggaacttggctggggtaaagtgctattggtaaaggataacggggaattccacgcacttggccacaaatgcccccattacggagcaccgctggttaagggggtgttgagtagggggcgagtgcgatgtccttggcacggcgcatgcttcaacatttctactggtgatctggaggattttcccggattggatagcctacacaaattccaggtgaaaatcgagaaagagaaggtctatgtccgtgcctcaaagcaggcgctgcagctgcagagaagaaccaaggtgatggctaagtgcattagcccttcagcaggctattcctcctcaactaatgtgctgattgtcggggcaggcgctgcaggattggtgtgtgccgaaacgctaagacaggaggggttcagtgatcgaatagtattatgcacactcgacagacatctcccttacgaccggcccaaacttagtaagtctctggacactcaaccagagcaacttgccctgagacccaaggagtttttcagagcctatggaatcgaggtcctcacagaggcacaagtcgtgaccgttgacgtaagaaccaaaaaggtggtgttcaaagatgggtttaagctggagtactcaaagctgctccttgcccctggatcttctccaaagactctgtcctgtaaaggtaaagaggtcgagaacgtgtttaccatcaggacgccggaagacgctaaccgggtagtaagactggcccggggcagaaatgttgtcgtggtcggagccggctttctcgggatggaagtagccgcgtacctcacagaaaaggcacacagcgtgtcagtggttgagctggaggagactcccttcagaaggttcctgggagagagagtggggcgcgcgctgatgaagatgttcgaaaacaatagggtgaaattttacatgcagaccgaggtttccgaacttagagggcaagaggggaagctcaaagaggtggttctaaaaagctctaaagtggttcgagccgacgtgtgcgtcgtgggtataggggccgtgccggccacaggattcctaaggcagtcgggaattggactggattcgcgagggttcattcctgtgaataagatgatgcagacaaatgtgccaggggtgttcgccgccggggatgccgtgaccttcccgctggcctggagaaacaacaggaaagttaacataccccactggcagatggctcacgcccagggacgcgttgctgcccagaacatgctggcacaggaggctgaaatgagcacagtgccctacctgtggacagcaatgttcggtaagagcctgaggtatgcaggctatggcgagggattcgatgacgtcatcattcagggtgacctagaagaactgaagttcgtggctttctataccaaaggagatgaagtcattgcggtggcaagcatgaactatgatcctatagtctccaaagtagcagaagtcttggcgtcgggcagggccatccggaaaagagaggtcgaaacaggcgatatgagctggctcaccggaaaaggctcctag

SEQ ID NO: 16071 - DNA, 1818 bp, Artificial Sequence
  Description of Artificial Sequence: Synthetic coding sequence
atggggggctgcttttcaaaacccaagcccgttgagctcaaaatagaagttgtgctccctgaaaaagagagaggaaaggaagagttaagcgcctccggaaagggctccccacgggcataccaaggtaacgggacagcccgccactttcacactgaagaaagattatcgacacctcacccgtacccatcaccacaggactgcgttgaagctgccgtttgccatgtgaaggatcttgagaacgggcaaatgcgggaggtcgagctggggtggggaaaggtgcttctagtgaaggataatggcgaatttcatgctctcgggcataaatgcccacactatggcgccccgcttgtcaagggggtcctgagtcgcggtcgcgtgcgatgcccatggcatggagcctgcttcaacataagcacaggagacctggaggacttccccggtctcgattctctgcataaattccaggtgaaaattgaaaaggaaaaagtctacgtgcgtgctagcaaacaagctctgcagctgcagaggaggacaaaagtaatggccaagtgcatttcacctagcgccggctattcctcctccacaaatgtgctaattgtgggggccggtgctgccggcctcgtgtgcgccgagactcttcggcaagaaggcttctcagacagaatagtgctgtgcacgctcgatcggcacctaccctatgatcggccgaagctctctaaatctctggacacacagccagaacagctcgcactccgtcccaaagagtttttccgtgcttacgggatcgaggtactgacagaggcccaggtggtcacagtcgatgtgcggaccaagaaagtggtcttcaaagacgggtttaagctcgagtattctaaactgttgctcgctcccgggagctccccaaaaaccctgtcatgtaaagggaaggaagtagaaaatgtttttaccatcagaaccccggaggacgctaatcgtgttgtcagacttgcaagaggcaggaacgtcgtcgtcgtgggtgcggggtttctcgggatggaggtggcagcctacctcacggaaaaagctcacagtgtgtccgtggtggagttggaggagacccccttcaggagatttttgggcgaaagggtgggtagagctctgatgaagatgttcgagaataatcgcgtaaaattttatatgcagaccgaagtcagtgaattgagaggccaggaaggaaaattgaaggaagtcgtgctgaaatcttccaaagtggttagagctgacgtatgcgtggtgggcattggggccgttcccgcgaccggatttcttaggcaaagtgggatcggtctggactcccgcgggtttattccagtcaacaaaatgatgcagacaaacgtcccaggcgtctttgcagccggagatgcggtcacctttcccctagcatggcgaaacaaccggaaagtcaacataccacactggcagatggcccacgcccagggccgcgtcgcggcccagaatatgctggctcaggaggcagaaatgtctaccgtgccctatctctggactgccatgttcggcaagtctcttagatatgccggctacggggaggggtttgacgatgtgatcatacagggtgatctggaggaactgaagtttgttgctttctataccaaaggagacgaggtgattgcagtcgctagcatgaactacgaccccattgtgagcaaggtggcagaggtcctggcctcagggcgtgccatcaggaaaagggaggtggagttattcgttcttcattcaaaaactggagacatgtcttggctgactgggaagggcagttag

SEQ ID NO: 16072 - DNA, 1374 bp, Artificial Sequence
  Description of Artificial Sequence: Synthetic coding sequence
atgaaccagccctgcaactcgatggaaccgcgtgtgatggacgatgacatgctcaaacttgcagtgggggatcaaggtcctcaggaggaagctggtcagctggctaagcaggagggcatactttttaaagatgtcctttcactgcagctcgactttcggaacatccttcgcatagacaatctttggcagttcgagaaccttcggaagctgcagctggataacaatatcatagaaaaaattgagggattggagaaccttgcacacctggtgtggctagatctaagcttcaacaacatagaaacgatagagggcctcgatactcttgtcaatttggaagatctgtctctctttaacaaccgaatctctaagatcgatagtctcgacgctctagtgaaattgcaagtactcagtttggggaataatcgcatcgacaacatgatgaacattatttatctgcgaaggttcaagtgtctgaggactttatctttgagccgcaaccctatttcagaggctgaggattacaagatgtttatttgcgcttatctgcccgaccttatgtatctcgattatagaagaatcgatgatcataccaaaaaactggctgaagccaagcatcagtactctatcgatgaactcaagcaccaggaaaacctgatgcaggcacagttggaagatgagcaagctcagagagaagagctggaaaagcataagaccgcctttgtagaacacctgaacgggagcttcctcttcgacagcatgtacgccgaggactctgagggaaacaacttatcttacctgcctggagtgggggagctcctagagacatataaggacaaattcgtgatcatctgtgtaaacatattcgagtatggactgaagcaacaagagaagaggaagactgagctggacaccttcagcgaatgcgtacgggaagctattcaggagaatcaggagcagggcaagcgaaaaattgccaaatttgaggagaagcacctgtcttctctgagtgcgatccgtgaagagctggagctgccaaacatcgaaaagatgatccttgagtgctcagccgatatttcagaactgtttgatgctctcatgacccttgaaatgcagctcgtggagcagctggaggaaacgatcaatatgtttgagagaaatatcgtcgacatggtaggccttttcatagagaatgtgcagagcctcatggcccagtgccgcgaccttgaaaatcaccaccatgaaaagttactggagatatccatcagtaccctggaaaagatcgtggagggcgacctggatgaggacctgcccaatgacctacgggcaggcagattccagaagtttaattatgtcgaggcatctggcactttttag

SEQ ID NO: 16073 - DNA, 1374 bp, Artificial Sequence
  Description of Artificial Sequence: Synthetic coding sequence
atgaatcaaccctgcaacagtatggaaccgcgagttatggatgatgacatgctaaagctcgctgttggagatcagggtccccaggaggaggccggccagctggcaaagcaggaagggattctgtttaaagacgttctgtctctccagttggacttccggaacattttgagaatcgacaatctgtggcagttcgaaaacctccgaaagttgcaactggacaataacataatcgaaaagatagaaggccttgaaaatctggcccacctggtctggctggacttaagtttcaacaacatcgagactattgaaggcctcgacaccctggtgaacctggaggatcttagtttatttaacaatcggatctccaagattgatagtctggatgctctagtgaaattacaagtgctgtcactgggcaataaccgtattgataacatgatgaacattatctatctccgacgattcaagtgcctgaggactttaagcctaagccgtaatcccatcagcgaggccgaagactacaaaatgtttatatgcgcctacctgccagatctcatgtatttggattatagacgaatcgatgaccacacgaagaagttggccgaggccaaacaccaatactctattgatgaactgaaacaccaagaaaacctcatgcaggcacagctggaagatgagcaagctcaacgggaggaactggaaaaacacaagacagcttttgttgaacatctgaatgggtctttcttgttcgacagcatgtacgctgaggattcagaagggaacaacctgagctatctgcccggcgtcggcgagctactcgagacgtacaaagacaaatttgtcattatctgtgttaatatatttgagtacggcctcaaacaacaggagaaacggaaaactgaactggacaccttcagcgaatgcgtgagagaggccattcaggagaatcaggagcaaggcaagaggaaaatcgcaaaattcgaagagaagcacctctctagcctgagcgcgatcagggaggaactagagcttcctaacattgagaagatgattttggaatgctcagctgacatctctgagctgtttgatgcgctgatgacccttgagatgcagctcgtggagcagctggaagaaacaattaacatgttcgaaaggaatatagtggatatggttgggctatttatcgagaatgttcagtccttaatggctcaatgtagggatctggaaaaccatcaccacgagaagcttcttgagattagcatctcaactctagaaaagatcgttgagggggatcttgacgaagacttaccaaatgatctgcgggcgggacgcttccaaaagtttaactatgtggaagcaagcgggacgttctag

SEQ ID NO: 16074 - DNA, 1572 bp, Artificial Sequence
  Description of Artificial Sequence: Synthetic coding sequence
atgaaccaaccctgtaactctatggagcctagagttatggacgatgacatgctgaagcttgccgtgggggatcaggggccccaggaggaagctggacagttggcgaagcaagagggtatactgtttaaagatgtcctgtcgttacagcttgactttagaaatattctgcgcatagataatctctggcagttcgagaatctaagaaagctccagttagacaacaacatcatcgaaaagatcgaaggcctagaaaacctcgctcatctggtgtggcttgacctatccttcaataatatcgagacaattgagggactagacaccctcgtaaacctcgaagacctgtcactatttaacaatagaatcagtaagatcgatagcttggatgcactcgtgaaactgcaagtcctctccctaggaaataatcgcatcgataatatgatgaacatcatttatctgaggcgtttcaaatgtctgcgaacactgtcactgtcaaggaatcccatctccgaggcagaggactataagatgtttatttgtgcgtacctgcccgatttgatgtatctcgattaccgcaggatcgatgatcacacaaagaaattggcagaggccaagcaccaatactcaatcgatgaactcaaacatcaggaaaacttgatgcaggcacaactcgaggatgagcaggctcagcgcgaggagcttgaaaagcacaagaccgcctttgtggaacatttaaacgggagctttttgtttgactcaatgtatgctgaggacagcgaaggtaataatcttagctaccttcccggagtgggagaactgctggaaacgtataaggataaatttgtgatcatttgtgttaatattttcgagtacggattaaagcagcaggagaagcggaaaacagaactggatacatttagtgaatgcgttcgcgaggctatacaagagaatcaggaacagggaaagcgaaagatagccaagttcgaggaaaaacatctgagctctctgtcagctattcgggaggaactggaattaccaaacattgagaaaatgatcttggagtgtagtgcagacatcagtgaactcttcgacgctctgatgacattggagatgcagctcgtggagcaactcgaagaaactattaatatgtttgaaagaaacatagtggacatggttggcctgtttatcgagaatgtccaatctcttatggctcaatgcagagacctggagaaccaccatcacgagaagctcctggagatatccatctccaccctggaaaaaatcgttgagggcgatctcgacgaagatttgcccaatgaccttagggcgttgtttgtggacaaagacactattgttaatgccgtaggggcttctcacgatatccacctcctcaagatagataaccgcgaagatgagctggtaactcgcatcaatagttggtgcactcgattgatcgaccgcatacataaggacgagatcatgagaaatagaaaacgagttaaagagattaaccaatacattgatcatatgcagagcgaactggataatctcgagtgcggggacatcctggattag

SEQ ID NO: 16075 - DNA, 1572 bp, Artificial Sequence
  Description of Artificial Sequence: Synthetic coding sequence
atgaaccagccctgcaatagtatggagcctcgcgtaatggatgacgacatgctcaagctcgcggttggtgatcagggcccacaggaggaggcaggccaactcgccaagcaggaaggaatcctgttcaaggacgttctatctctgcagttggattttcgaaacatcctgagaattgataacctgtggcagtttgaaaacttacgaaagttacagctggacaataatatcatcgagaagatcgagggcctagaaaatcttgcacacctggtctggctcgacctgtctttcaataatatagaaaccatagaaggactggacacattggtaaatctggaagacctgtccctgtttaataatcggattagtaagatcgatagcctggatgccctcgtgaagttgcaggtactgtcactgggaaacaacaggatcgacaatatgatgaacataatctatctaaggagatttaagtgcctcaggaccctctctctctctaggaatcctatatctgaggcagaagactataagatgttcatctgcgcttacttgcctgatctgatgtatctggactatcgcaggatcgatgatcacaccaaaaaacttgcagaagccaaacaccaatatagcatagatgagctcaagcaccaggaaaacctgatgcaggcccaactggaggacgaacaagcccaacgggaggaactggagaaacacaagacggctttcgttgagcacctgaatggcagcttcttatttgatagtatgtacgcagaggatagtgagggtaacaacttgtcctatcttccgggggttggcgagctgctggagacctataaggataagttcgtgataatttgcgtgaacatcttcgagtacggcctgaaacaacaagagaaacgaaaaaccgaactcgatacctttagtgagtgcgtccgggaagccattcaggagaaccaggagcagggcaaacggaaaatcgcaaagtttgaggaaaaacacctgagctcattgtcagctatcagggaggaactggagctcccaaacattgagaagatgatcctggagtgttccgcggatatttcagaactgtttgacgctctgatgactttggaaatgcagctggtggaacaacttgaagagacaataaatatgtttgagcgaaatatcgtggacatggtgggtcttttcatcgagaacgtccagtccctgatggctcaatgccgcgatctggaaaaccatcaccatgagaagctattggaaatatctatcagcacgctcgagaagatcgtcgagggagacctagacgaggatcttccgaacgatttacgtgccctttttgttgataaagacaccatcgttaacgctgtgggcgcaagccacgacatccacctgctgaaaatcgacaatagggaggatgagctggtcacaagaattaattcatggtgtactcgcctgatcgatcgtattcacaaagatgaaataatgagaaacaggaaacgcgtgaaagaaatcaaccaatacatagaccacatgcagtccgaactcgacaatctggagtgcggagacatattggactag

SEQ ID NO: 16076 - DNA, 1842 bp, Artificial Sequence
  Description of Artificial Sequence: Synthetic coding sequence
atggcgaccatccccgactggaagcttcagcttttggcccggaggaggcaggaggaagctagcgtccgagggagagagaaagcagagcgggaaagattgagtcagatgcctgcttggaagagagggctactggagcgtcggcgtgctaagctaggtctgagcccgggtgagccctctccagtcctcggcacggttgaggccggcccgcctgatccagacgagtctgccgtactgctcgaggccatcgggccagtgcatcaaaacaggtttattagacaggagcgccaacaacagcagcaacagcagcaacggtccgaggagctgcttgccgaacggaagccgggtcctctggaggcaagagaacgacggccaagtccgggcgaaatgcgagatcagtcccccaagggacgagaatctcgggaagaacgcttgtcccctagagaaaccagagaacgccggctagggattggcggcgctcaggaacttagtctgcgtcctctggaagcaagagactggcggcaaagccctggcgaagtgggcgacagaagctccaggctgagtgaggcgtggaagtggaggttatctcctggcgagacccctgagagaagcctccggttggcggaatccagggaacaatctcccagacgcaaagaggtagaatccaggttgagccccggtgagagtgcctatcagaaactcgggctgacagaagcccacaagtggcgcccagactcccgggagagccaagaacagagcctggtgcagctggaggcaacggagtggcgccttcgttcaggagaggaacggcaggattattcggaagaatgtggaaggaaggaggagtggccagtgcccggagtggcacctaaagaaactgccgaactgagtgagaccctcactcgggaggcccagggaaatagcagcgcaggggtcgaagcggcggagcagcgtccagtagaggacggcgagcgaggaatgaaacctacagaggggtggaagtggaccctgaacagcggtaaggccagagagtggactcctagggacatcgaagcccagacgcagaaacccgaacccccagagagcgcggagaagttgctggaatcacccggcgttgaggctggagagggggaggccgagaaggaggaagcaggagcccagggcagacctctgcgggcgctccaaaactgttgctccgtgccgtctccccttcctcctgaagacgctggaactgggggcctaagacaacaggaggaagaagccgtggaacttcagccaccaccaccagcgccactgtcacctcccccccctgccccaactgcccctcagccaccaggagatcccctgatgagtcgcctgttctacggcgttaaagccggccccggcgtcggggctcccaggcgctctggacacacatttaccgtcaaccctaggcgctccgtgccaccagcgacaccagccacacccaccagccccgccaccgttgacgcagcggttcctggggctgggaaaaagcggtatcccactgctgaagagatactcgtacttggtggttatctccgcttgtcccgatcctgtcttgcgaagggctcacccgagcgccatcataagcagctgaagatcagcttttcagagaccgctttggaaaccacttatcaatatccaagtgagagcagcgtcttggaagagttaggccccgagcccgaagtcccttcagccccaaacccccctgcagctcaacccgatgacgaggaagacgaggaagaactgctgcttctccagccagagttgcagggtgggctgaggacaaaggctttgattgtggatgagtcctgcagaagatag

SEQ ID NO: 16077 - DNA, 390 bp, Artificial Sequence
  Description of Artificial Sequence: Synthetic coding sequence
atggcggagctcattcaaaaaaaactccagggcgaggtcgaaaaataccaacagttgcagaaggatctgtccaagagtatgagtgggaggcagaagctggaagcccagttaactgagaacaacattgtgaaggaggagctcgcattgcttgacgggtcaaacgtcgtcttcaaattgctgggccctgtgcttgtgaaacaagaactcggtgaggctagggctactgtgggtaagcgccttgactacattacggcggagatcaaacggtacgagtcccaacttcgggacttagaacgccagtccgagcagcagcgcgagaccctggcccaactccagcaggagtttcagagagctcaagctgcaaaggcaggcgcgccaggaaaagcctag

SEQ ID NO: 16078 - DNA, 390 bp, Artificial Sequence
  Description of Artificial Sequence: Synthetic coding sequence
atggcggagctgatacagaagaagctccaaggggaggtggagaagtaccagcagttacaaaaggacttgtccaagtccatgtcgggacgccagaagttagaggcccaactgaccgagaataatatagtgaaggaggaattggctctcctggacgggtccaatgtggttttcaagctcttggggcccgttctggtgaaacaggaattgggcgaggcccgcgccacagtggggaaacgcctggactatattaccgcagagataaaacgctacgagtcccagctacgagacctcgagcgccagagcgagcagcaacgcgaaaccctcgcccagttgcagcaagagtttcagagggcccaagcagccaaggccggggctccgggcaaggcgtag

SEQ ID NO: 16079 - DNA, 4128 bp, Artificial Sequence
  Description of Artificial Sequence: Synthetic coding sequence
atggtgccaggagaggaaaatcaactggtgcccaaggaagacgtcttctggcgctgcaggcagaacatatttgatgaaatgaaaaagaaattcctccagatcgagaacgccgccgaggagccacgggtactgtgcatcatacaggacaccactaactccaaaactgtcaatgagcgaatcactctgaatctgcccgcatcaactccggttaggaaactgtttgaagatgttgccaacaaagtaggctacatcaatgggacttttgacttagtgtggggaaacggcatcaatactgccgatatggctccacttgatcacacttctgacaaaagtctcctggacgccaatttcgaacctggaaagaagaacttcttacacctaacagataaagacggcgagcagccacagattttgttggaggactccagtgccggcgaagattctgtccacgatagatttattggaccccttcccagggagggcagtggcgggagcactagcgactatgtttcgcagagctattcatattccagcattctcaacaagtccgaaaccggatatgtcggtttggtaaaccaggccatgacttgctacctgaactctcttctgcagactctgttcatgacccctgagtttcgcaacgcgctttacaaatgggagttcgaggagtccgaggaggacccagtcaccagcataccatatcagttgcagcggctgtttgtgctactacagacatctaagaagagagccattgaaactaccgatgtaacacgatcgtttggttgggactcatcagaagcgtggcagcagcacgacgtgcaggagctctgcagggttatgttcgacgcccttgagcagaagtggaaacagactgagcaggccgacctgatcaatgaactctaccagggcaaactgaaagattacgtgcgatgtttagagtgtggttacgagggttggcgtattgacacgtaccttgatatccccctcgtgattcggccgtacggctcttcccaagctttcgcatccgttgaagaagccctgcacgcgttcatacaacccgagatcctcgacggcccgaaccagtatttttgtgagcggtgcaagaagaaatgcgacgctcgaaaaggtttgcgcttcttgcatttcccctacttattgactctgcagctgaaacgcttcgactttgactataccaccatgcatagaataaaactcaacgacaggatgactttccccgaagaactcgacatgtccacattcatcgatgtcgaagacgagaaatccccacaaaccgagtcgtgtaccgatagcggagcagagaatgaaggtagctgccactcagatcaaatgagcaatgatttttccaatgatgacggagtcgacgagggtatatgtctggagactaacagtggcacggagaaaatcagtaaaagcgggctcgagaaaaacagcctgatctatgaactatttagcgtgatggtgcattccgggagcgctgcgggaggccattattacgcctgcatcaagagtttcagcgacgagcagtggtatagtttcaatgatcaacatgtttctcggatcacccaggaagacatcaagaagacacatgggggaagttctggctcacgcgggtactattctagtgcttttgccagtagtactaatgcctatatgctcatctatcggctgaaagacccagcccgtaacgccaaatttcttgaggtagacgagtacccggaacacattaagaacctcgtgcagaaggagagggaacttgaggagcaggagaagcgccagagagagatcgaacgcaacacatgtaagatcaagctgttttgtttgcatccaacaaagcaggtgatgatggagaacaaactcgaagtccataaggataagacactgaaggaggctgtggagatggcctataagatgatggacctcgaggaggtcatccctcttgattgttgtcgcttagtgaaatacgatgagttccacgactatctggagcggagttacgagggtgaggaagacacacctatgggtctccttctgggcggagtgaagtccacatatatgttcgacctgttgttggagacccgaaagccagatcaggttttccagtcgtataagcccggcgaagtcatggtgaaggtccacgtggttgatttgaaagccgaatccgttgcagccccaatcacagtccgtgcgtatctgaaccaaactgtgacagagttcaagcagctcatctccaaagcaatccacttacctgccgaaacaatgcggattgtgcttgagagatgctacaatgatttacgactcctctccgtttcctcaaagactctcaaggctgaggggttttttcgaagcaataaagtctttgtggagtcctcggagactttggactaccagatggcttttgccgatagccacttatggaaactcttggatagacacgctaacactattcgcttattcgtgctgctgcctgaacaatcccccgtgagctactctaagcgcacagcttaccagaaagcgggaggggacagcggaaacgttgatgacgattgtgagagagtcaaagggccagtgggaagcctgaagtcagtggaagctattctggaagagtcaacggagaaactgaagtctctgagcctgcaacagcagcaggacggggacaacggcgacagcagtaagagtacggagacttcagatttcgagaacatagagtcaccgctgaatgaaagggacagctcggcatcagttgacaacagggagttggagcagcatatccagactagtgatccagagaacttccagtccgaggaaaggagcgattccgacgtgaacaatgatagatccacctcctcagtcgactctgatattctgagttcttctcactcatccgacacattatgtaacgccgacaacgctcagatcccactcgcgaatggcctcgattctcattcaatcacaagttcccgcaggaccaaggccaacgagggcaagaaagaaacgtgggacactgcagaagaggattcaggcacggattccgaatatgatgaatcggggaaatctagaggcgagatgcagtacatgtacttcaaagcagaaccctatgccgcagatgaaggaagtggcgaggggcacaagtggctcatggtccacgtggacaagagaatcactttggccgcttttaaacagcacctcgagccctttgtgggtgttctgtcaagccattttaaagtgttcagggtgtacgcctcaaaccaggagttcgagtcagtgcgactgaacgagacacttagttcgttctctgatgacaataagataactattaggctggggagggctctaaaaaagggcgaataccgggttaaggtgtatcagttactggtcaatgaacaagaaccatgtaagttcctgctggacgcggtgtttgccaagggaatgaccgtccgacagagtaaggaggaattgatcccccagctccgagagcagtgcgggttggagctgagcatagacagattcagacttcgcaagaaaacctggaagaacccggggaccgtgttcctggactaccacatctacgaggaagacatcaatatttcatcaaattgggaggtgttccttgaggtactcgatggggttgagaaaatgaagtcaatgagtcaactggccgtgctgagtcgccggtggaagccgtctgagatgaagctcgatccattccaggaagtcgtgctagaatcgtcaagtgtcgacgaattgcgagaaaaattgagcgagattagcggcatccctctggacgacatcgagttcgctaaaggtagaggaacgtttccatgcgacatctccgtgttagacatacaccaggacctcgactggaatcctaaggtgtcaacactgaacgtctggcctttatacatctgcgacgacggagccgtcatcttttaccgggataagaccgaagaactcatggagctgacagatgagcagagaaacgagctcatgaaaaaggaatcttctcgcctgcaaaaaacagggcatcgcgttacttactcccccaggaaagagaaggccctcaaaatctacctcgatggggctcctaataaggatcttacccaggattag

SEQ ID NO: 16080 - DNA, 600 bp, Artificial Sequence
  Description of Artificial Sequence: Synthetic coding sequence
atgaggactgcggaccgagaagctcggcccggactgccctccctgttgctacttctgttggccggggccggcctctccgccgcctcccccccagcggccccaaggttcaacgtgtcactggactccgtgcccgaactgcgctggctgcccgtcctgagacactacgacctggacttggttagagccgcaatggcccaggtgatcggggatcgtgtccccaaatgggtgcacgtactcattggcaaggtggtcctggagctcgaaagatttctgcctcagccattcacgggagagattcgcgggatgtgtgacttcatgaatttgtccctagcagactgcttgctcgttaatctcgcctacgagtcgtcagtgttctgtacatcgatagtagctcaggacagcagaggacatatctatcatggcaggaacctggattatcccttcggaaacgtactacgcaagctcaccgtcgatgtccagtttctgaagaatggacaaatagctttcacgggcacaacatttatcggctatgtggggctgtggacagggcagtctcctcataagtttacagtaagcggcgatgagcgagacccacattag

SEQ ID NO: 16081 - DNA, 972 bp, Artificial Sequence
  Description of Artificial Sequence: Synthetic coding sequence
atgcgtacagccgatagggaagctagaccaggacttccttccctgctgcttctcctgctggctggggctggactatccgccgcatcacccccggccgcccccaggtttaatgtgagtctcgacagcgtccctgagttaaggtggctgcccgtgctccgacactacgacctcgacctggttcgagctgcaatggcacaagtaatcggcgacagggttcccaagtgggtacatgtgctgattgggaaagtggtgctggagctcgaaaggttcttaccccagccttttactggggaaattcgtggtatgtgcgatttcatgaacctgtcactggccgattgcttactggtcaacctcgcttatgaatccagcgtgttttgtacatcaatcgttgcccaggattccagaggacatatataccatggtcggaacctcgactatccatttgggaacgtcctccgtaaactgactgtggacgtgcaattcctcaagaacggtcaaatcgcattcaccggaactacattcatagggtacgtcggtttatggacagggcaaagcccacacaaatttacagtgtccggggatgaaagagacaaagggtggtggtgggagaacgccatcgcggcgctctttaggaggcatattccggtgagctggctcataagagccaccctcagtgagtctgagaacttcgaagctgcagtgggtaagcttgctaagacgccacttattgctgacgtgtattacatcgtcggagggacctcccccagagagggcgtggtcatcacccggaaccgagacggccccgcagacatttggcctctcgatccccttaatggagcctggtttagggtagaaactaactacgaccactggaaaccagccccaaaagaagatgataggcgcacatcagctattaaggctctgaacgctacgggacaagctaatttgagtttggaagccctcttccagtag

SEQ ID NO: 16082 - DNA, 4539 bp, Artificial Sequence
  Description of Artificial Sequence: Synthetic coding sequence
atggccgctgccgctggaaaccgcgcctcatcctcaggatttcccggtgctcgggcaacaagccccgaggctgggggtggcgggggcgcactcaaagcatcgtccgcccccgctgccgcggctgggctcttacgggaagctggctcaggcggaagagaacgcgcggattggagacgcaggcagcttcggaaggtcaggagcgtcgagctggatcagctcccagaacaacctctgtttctggctgcatccccaccagcatcaagcacctctccctctccggagcctgcagacgctgccggctccggtacaggtttccagccagtggctgtgccacctccacacggggctgcatctcgcggtggggcccatttgaccgagtcagtggcagcccctgactcaggcgcctcttcacccgcggccgctgaacccggggagaaacgtgcccccgcagccgagccatccccggccgcagcccccgccgggcgcgagatggaaaacaaggagacacttaagggcctccataaaatggacgatagaccggaagagagaatgatccgggagaaattaaaagctacctgcatgcctgcctggaaacatgaatggttggagaggagaaatcgccgcgggccagttgtggtgaagccaatacctgttaagggggatgggtctgagatgaatcacttggctgcagagagccctggtgaagtccaagcttccgccgctagccccgcctctaagggccgacgaagccccagtccgggaaatagccccagcggtaggaccgtcaagtccgaaagtcctggggttcggcgcaagagggtgtcacccgtccccttccaatccggacgcattacgccccctaggagagccccatcccccgatggcttcagcccatattccccagaggagaccaacaggcgcgttaacaaggtgatgcgggcccggctgtatttgctgcagcagatcggcccaaacagtttccttataggcggggacagtcctgacaataagtatagagtgtttatcggtccgcaaaattgttcatgcgcgcgcggcacattttgcattcatctgctgttcgtcatgctgcgggtcttccagctggaaccatctgatccaatgctgtggcggaaaaccctgaaaaatttcgaggtggagtctctctttcagaaataccattcaaggcgctcttcaaggatcaaggccccctctcgtaacaccatccagaaattcgtctcccggatgtcgaactctcatacactttcgagcagttctacctccacatcctcatcagagaactcaattaaggacgaggaggagcaaatgtgtccaatttgcctgctcggaatgctggatgaggaatccctgacagtttgcgaggatgggtgtaggaacaaattgcatcaccactgcatgtctatttgggctgaggaatgtcggagaaaccgcgaaccactgatttgtcctctgtgcagatccaaatggcggtcccatgacttttattcacatgagctgtcctctcccgtggactcccccagttcactacgcgctgcgcagcagcaaactgttcaacaacagcctctggccggcagccgcagaaaccaggaatccaatttcaatctgactcattacgggacacaacagattcctccagcttataaggacttagccgagccttggatccaggttttcggcatggaattggttggctgcctgttttctcggaattggaacgttcgcgaaatggccctcaggcgcctctcccatgatgtgagcggggcacttctgttggcgaatggtgagtccaccggaaacagcggaggtagctctggctcctctccatctggtggtgccacatccgggagcagtcagaccagcatcagtggtgatgtggtcgaggcatgctgctcggtgctgtcaatggtgtgtgccgatccagtttataaagtttatgtggccgcattaaaaaccctgcgcgctatgctagtttatactccttgtcatagtttggctgaacggattaaacttcagcggcttttacaaccggtggtggatactatcctggtgaagtgcgcagatgctaattctaggacctcccaattgagcatttcaacgctcctggagctgtgcaaaggacaggctggcgagctagccgttgggagagagattctgaaggctggtagcataggaattggaggagtggattacgtgttaaattgcatcctgggtaaccagactgagagtaacaactggcaggaattgctcggccgtctgtgtctgattgatcggctgctgctggagtttcccgccgagttctacccccacatagtaagcactgacgtgagccaagccgagccggtggagattcggtataagaaactactcagtctgctgacattcgccttgcagtctatcgacaattcacattcaatggtggggaaactgagcaggcgaatatacctcagctcagcccggatggtcaccaccgtaccccacgtattctccaagttgctggagatgctgtccgtgtcgtctagcacacatttcacacggatgagacgtagactgatggccatcgcggatgaagtggagatcgccgaggccatccagttgggtgttgaagacaccttggatggccagcaggacagctttctccaggcttctgttcccaataactacttagagacgactgagaattcctcacccgaatgcaccgtccacctcgaaaagactggcaagggactttgcgcaacgaaactaagcgctagcagcgaagacatcagtgagcggctggcaagtatctcggtcggtccaagtagtagtaccacgactacaaccactactactgagcagcctaaacctatggtacaaactaaagggagaccccacagtcagtgccttaactctagcccactgagccaccacagccagctgatgtttcccgcattgtctacaccgtctagtagcacaccatcagtgccggccggcacggccacagatgtatctaaacaccggctccaaggctttatcccctgccgtatccccagcgcctctccacagacacagcgcaagttctccttacagttccaccgcaactgtcctgagaataaggatagcgacaagctcagcccagtattcacccaaagtaggcccctgccatcaagcaacatccaccgaccgaaaccctcaaggcccacacctggtaatactagcaagcagggagatccctcaaagaatagtatgacgctggatctgaacagttcatcaaaatgcgacgatagctttggctgctcaagcaactccagcaacgccgtaataccctcagacgagaccgtcttcacaccggtggaagagaagtgccgactggatgttaataccgagctgaactctagcattgaagatctattggaagcaagcatgccctcgagcgacaccacagtaaccttcaagagcgaggtggcagtactcagccctgaaaaagcagaaaacgatgacacctacaaggacgacgtgaaccacaaccagaaatgcaaggagaagatggaagccgaagaagaagaggcccttgcaatcgccatggcaatgtcagccagtcaagacgcactgcccatagtgccccagctccaggtggagaatggtgaggacattatcatcattcaacaagatactcctgaaaccctccccggccacacaaaggctaaacagccctatagggaggacaccgaatggcttaaggggcagcaaattgggctgggcgcctttagttcatgttatcaggcccaggacgtgggcacagggactctcatggcagttaaacaggttacttacgtgagaaatacatcatcagaacaggaagaggtggtggaagccctgcgggaagaaattcgtatgatgagccatctgaaccatccaaacattatccgaatgctaggagcgacttgtgaaaagagtaattacaatctgttcatcgagtggatggccggcggtagcgtggcacatctcctgtcgaaatacggagcattcaaggaatccgtagtgatcaattatactgagcaactcctgcgggggctatcgtatttgcacgagaaccagataattcatagggacgtcaagggggcaaacctgttgatcgattctactggtcaacgcctccggatagccgactttggggccgctgctcgtctggctagcaagggaactggcgctggcgagtttcagggccagctgctaggaactatagcctttatggcccccgaggttctcagaggacagcaatatgggaggagctgcgacgtgtggagcgtggggtgtgccattatcgagatggcctgtgccaagccgccttggaatgcggaaaagcactccaaccacctggccctgatatttaaaatcgctagcgcgacaaccgccccaagtattccaagccacctttccccaggtctccgtgacgtggctctgcgatgcctcgagctgcaacctcaggaccgacccccgtctagggagcttcttaaacatcctgtgtttcgaacaacgtggtag

SEQ ID NO: 16083 - DNA, 2274 bp, Artificial Sequence
  Description of Artificial Sequence: Synthetic coding sequence
gcagacgggggggactcacaagccttccggtgtacgagctgtggccatgcgggaacgacacctgctccacgcgaagccctcagtccggccgatgcccacgtgggaagaggattcgccgaaagagagccaatacccgcacaagggctgttagtcctggctgtgctgtcggacggcgccggcgatcacatccggcagcgcctgttaccccccctgctccagatcgtgtgtaaaggattagaagacccgtcacaggtcgttcgtaatgctgcgctcttcgctttagggcagttcagcgagaatctccagccacacatctcatcttattctagagaggtgatgccgctgctgctggcatacctcaaatctgtccctctgggacacacacaccacctagcgaaagcttgctacgccttggagaattttgtagagaacctgggtccaaaagtacagccctacctgcctgaattgatggaatgtatgttacaactgctgcgaaacccgagtagtccccgggccaaggagctcgctgtgtctgctttaggtgccatcgccaccgccgcccaggcatccctgttaccttactttcccgccatcatggaacatctgagggagtttctcctgacaggtcgcgaggacctgcagccagtgcaaatccaaagcctggaaacattaggggtgctcgcgcgcgctgttggcgaaccgatgcgccccctggccgaggagtgctgccagctaggtcttggactgtgtgaccaggtggatgatcctgatctgagacgatgtacttactctctgtttgctgccctgtccggcctgatgggggaaggactcgcaccacacttagaacagatcactaccctgatgctgctctcactgcgctctacagaggggatcgttccgcagtacgatggctcttcttccttcttgctgttcgacgatgaatcagatggagaggaagaagaagagctcatggacgaggatgttgaggaagaagacgattccgagatctctgggtattctgtagaaaatgccttcttcgacgaaaaggaggatacgtgcgcagccgtgggtgagatctcggtcaacacatccgtggcctttctgccttatatggagagtgtgtttgaggaggtctttaaattgctcgagtgtccccacctgaatgtgcgcaaagctgctcatgaggcactcggccagttctgttgtgccctacacaaagcttgtcaatcttgccctagcgagccgaatacagctgctctacaggccgccctggctagggtggtgcctagttatatgcaagccgtgaaccgggaacgagagcgccaagtggtcatggccgtgctcgaagccttgacaggtgtgcttagatcctgcggcacgttaacgctgaagcctcctggacggctcgctgagctctgcggggtcttgaaggctgttttgcagcggaagaccgcatgccaggacacagatgaggaagaggaggaggaggacgacgaccaggctgagtacgacgccatgctgttggagcatgccggtgaggctattcccgctctggctgcggccgctggcggcgatagctttgctcccttcttcgccggatttcttcctctcctggtctgcaagacgaagcaggggtgtaccgtggctgaaaaatcctttgccgtgggcaccctggctgaaaccatccagggtctgggagctgctagcgcccagttcgtatcaaggctgctgccagtcttgctgtctacagcccaggaggctgatccggaggtgagaagcaatgctattttcggtatgggagtcctggctgagcatggaggtcatccagctcaggagcacttccccaagctgcttggactgctcttccctttgctggcacgcgagcgccacgatcgggttcgggacaatatctgcggggccctggctcggctacttatggcttctcctactcgcaaacctgaaccccaggtactagccgccttgctgcacgccctcccgctgaaggaggacctagaggaatgggttaccataggccgtcttttctccttcttgtaccagtcttcccctgatcaagtcattgacgtagccccagagttgctcaggatttgctctctcattctcgccgacaataaaatccccccagatacgaaagccgccctgttgttgctcttaacctttttggcaaaacagcataccgactccttccaggccgctctgggcagtcttccagtcgataaagctcaggagctacaggcggttctggggctttcctag

SEQ ID NO: 16084 - DNA, 1812 bp, Artificial Sequence
  Description of Artificial Sequence: Synthetic coding sequence
atgggggtcattcctgaaggccctctatgggtgagcggcagcgatgataatctttccggtacgtctggcatggaggttgacgacagagtgagtgccttggagcagcggctccagctgcaggaggacgaattggctgttctgaaggccgctcttgccgatgccctgcggagactgagagcttgcgaagaacagggagccgcgctgagggccagaggtactccaaaaggccgcgcaccaccacggttagggactactgcttcagtgtgccagctgttgaaaggcctgcctaccagaacacccctgaatggcagcggccccccacgccgcgtcggcggctacgcaaccagcccttcctctccaaaaaaagaggctacaagcgggagatcttcagttcgcaggtacctgtcacccgaacggcttgctagcgtgcgtcgggaggacccgcgtagcaggacaaccagctcttctagcaactgttctgcaaagaaggagggcaagacaaaagaagtgatttttagcgtggaggatgggtctgttaaaatgttcctgagaggccgaccagtgcccatgatgatccctgacgaactagctcccacgtactcactcgataccaggtccgaactgccttcatgtaggctcaagcttgagtgggtttatggatacagaggaagggattgccgagcaaacctctacttactccctacaggcgagattgtgtactttgtcgccagcgtggcggtgctctatagtgtcgaagaacagaggcagcgacactatttggggcacaatgatgatattaagtgtttagctatccatccggatatggtgacaatcgctaccgggcaagtggccggtaccactaaagagggcaaacctctacctccacatgtgcggatttgggactctgtgtctctgtccacattgcatgttctggggctcggggtctttgacagagctgtgtgctgcgtggggttttctaaatctaatggtgggaacttgctgtgtgccgttgacgagagtaatgatcacatgctgtcagtttgggactgggcaaaggaaacaaaggtcgtcgatgttaagtgcagtaacgaagccgtcctagttgccacgttccacccaactgaccccacagtcctaattacgtgcggcaagtcacatatttatttctggacacttgagggaggatccctttccaaaaggcagggcctgttcgagaagcacgagaagccaaaatacgtgctttgcgtgacattcctggaaggcggtgatgtcgtgacaggcgattctggtggcaatctgtacgtttggggaaaaggcggaaataggatcacccaggccgtcctgggcgctcacgatggtggagtcttcggcctgtgcgcgctgcgagacgggactctcgtgtccggaggcgggcgagaccggagggtcgtcctgtggggtagcgattattccaaactgcaggaagtggaggtcccagaagactttggcccagtgcggaccgtagcggaaggacacggtgacactttgtacgtcgggacgacccgaaacagcatattacagggtagtgtccacactggattttcactgctggtgcagggtcatgtggaggagctttggggtctggccacacatccatctcgggcacagtttgtaacgtgtggccaggataaactcgttcatctgtggtcctccgacagtcaccagccgctgtggtcaaggattatagaagtggaaagccgcagtgttacacaggcaggggggcagtggcacgacttgggcagtcttcagccaccaccacccgggttcaagtag

SEQ ID NO: 16085 - DNA, 996 bp, Artificial Sequence
  Description of Artificial Sequence: Synthetic coding sequence
atggccgagggcggaggaccagaaccaggggaacaggagcggagatcaagcggccccaggcctccatccgccagagatctgcaactcgccctggccgaactgtacgaagacgaggtaaaatgtaagtctagcaagagtaaccgcccgaaagcaacagtcttcaaaagcccacgcactccaccacaacggttttactcttccgaacatgaatatagcgggttgaacatcgtcagaccgtctactggaaagattgtaaacgaactgtttaaggaggcgagggagcacggcgccgttcctcttaatgaggcaactcgagctagcggggacgataagtctaagtcctttactggtgggggttaccgcctcggatcctccttctgtaagcgttcggaatacatttatggggagaaccagttgcaggacgtgcagattctattgaaactctggtccaatggcttctctttagacgatggcgaactccgtccctataatgaaccaaccaacgcccagttcctggagtcggtgaagcgcggcgaaattccacttgagctgcagagactggtgcacggcggccaggtaaacctggatatggaggaccatcaagaccaggagtacatcaagccgaggttacggtttaaggcctttagcggagagggccagaaactggggtcacttacccccgaaatcgtttcaacaccttcaagcccagaagaggaggataagagcatcctgaacgcggtagtgctgattgacgactctgttccaacaactaagatccagatccgtcttgccgatggcagccggttgattcaacgatttaatagcacccatagaatcctggacgtgagaaacttcatcgtccaaagccgcccagaattcgcagcactagacttcatcctcgtgacctccttccccaacaaggagctgactgacgaatccttaaccttgctggaggctgacatcctgaatactgtgctgctgcagcagctgaagtag

SEQ ID NO: 16086 - DNA, 2064 bp, Artificial Sequence
  Description of Artificial Sequence: Synthetic coding sequence
atggatggcggcgcgctgacagatacctccctcaccgactcatacttcagcacttcctttatcggcgtgaacggctttgggtcccctgtggagacaaaataccctcttatgcagagaatgaccaattcttcatcatcaccctccctgctcaacgacagtgccaaaccctactctgctcacgaccccctcaccagccctgctagcagcctctttaatgatttcggcgccctgaatatctcacaacgcagaaagacacctaacccaaccgcctcagagtttatccccaaaggcggcagtacttctcgcctctctaatgtctcgcagagcaacatgtcagctttcagccaagtgttctctcacccatcaatggggtcaccggccaccgctggcttggctcctggtatgtctctgagtgcgggcagcagtcccttgcacagtcccaagatcacaccacatacaagtcccgccccgcgacgccggtctcatacgcctaaccctgccagttatatggttcccagttcagcatcaacatccgttaataatcctgtgagccagaccccgagctccggccaggtgatccagaaggaaacagtaggggggaccacgtacttctacactgacaccacccccgccccgctcactgggatggtcttcccaaattatcacatatatccacctacggcaccccacgtggcctacatgcagccaaaagccaatgccccctcattctttatggctgacgaactccggcaggaacttatcaatcgccatctgataactatggcccagattgaccaggccgatatgcctgccgttccaacagaggtggattcatatcactcattattccccctggaacctctcccgccccccaataggatacaaaaatccagtaactttggttacatcacctcgtgttacaaggctgtcaattccaaagacgatctgccctattgcctgcgccgcatacacgggtttcgacttgtgaataccaagtgtatggttctggtggatatgtggaaaaagattcagcacagcaatattgtcaccttgcgagaagtcttcacaactaaggccttcgccgaaccgtccttggtcttcgcttatgattttcacgcggggggggagacaatgatgtcccgccatttcaatgatccgaatgctgatgcatacttcacgaaacggaaatggggacagcatgaggggcccttgccacggcagcatgcaggactcttgccagagtccctaatctgggcttatattgtgcagctgagctcggcgttacgcacaatacacaccgctggcctggcatgtcgcgtaatggatcctacaaagatcctaattacaggtaagacccgcctgcgcgtgaattgcgtgggggtcttcgatgtactgacgttcgataatagccagaacaataacccgcttgccctgatggcccagtatcagcaagcagacctgatctctctcggcaaagttgttctggcattagcgtgtaactcgctggcaggaattcagagggagaatctgcagaaggccatggaactggtgaccattaactatagtagcgacctgaaaaacctcattctgtatctgctgacagatcaaaatcgcatgaggtccgttaacgatattatgccaatgatcggggcacgattctacacacagcttgatgctgcacagatgagaaatgacgtaattgaggaggatctcgctaaagaagtgcagaatggccggctgttcagattgctggctaaattgggcaccattaatgagcgacccgagttccagaaggatccgacttggtccgaaaccggcgaccgatacctgcttaagctgtttagagaccatctgtttcatcaggtcaccgaagctggcgccccctggattgatctgagccacattatttcctgcttgaataagcttgacgcgggcgtacctgagaaaatatccctaatctcccgcgacgaaaagagtgtcttagttgtgacctactctgacctcaaacgctgcttcgagaacaccttccaggaattgattgctgccgcgaacgggcagctgtag

SEQ ID NO: 16087 - DNA, 6951 bp, Artificial Sequence
  Description of Artificial Sequence: Synthetic coding sequence
atggatggagtgtcctccgaggccaacgaggaaaatgacaatatcgagcgcccggttcgccggcgccactcaagcatactcaagccaccccggtcccccctccaggatctgagggggggaaacgagcgggtgcaggaaagcaacgctttgcggaacaaaaaaaactcccgccgagtgagtttcgccgatacaatcaaagtcttccagactgaatctcacatgaaaattgtcagaaagagcgaaatggaagagaccgagaccggggagaacctcctgctgatccagaacaaaaagctggaagacaattactgcgagattaccgggatgaacaccttactttcagcccctatacatacccagatgcagcagaaggaattttctatcatcgagcatacccgggagagaaagcacgctaatgaccagacggtgatattctctgacgaaaatcagatggatcttacttcttcccacactgtcatgatcaccaaaggtctgctggataatcccattagcgagaagtcgacaaagattgacaccaccagcttccttgccaatctgaagttgcataccgaggattctcgcatgaaaaaagaagtgaacttctccgtggaccagaatacgagtagtgagaacaaaattgatttcaacgactttatcaaacggctcaagacaggaaaatgtagcgccttcccagacgttccagataaggagaattttgaaattccgatctatagcaaggaacctaactcagcatctagcactcatcagatgcacgtgtcccttaaggaagacgagaacaactccaacatcacaagactctttcgtgagaaggacgacggcatgaatttcacacagtgccacactgcgaatattcagacactgataccaacttcatccgagactaatagtagggaatctaagggcaacgatatcaccatctacgggaatgatttcatggacctgacatttaaccacaccttacagatcctgccggcaactgggaatttttccgaaattgagaatcagacacagaacgccatggatgtcaccaccggctatggaactaaggcaagtgggaataagactgtgttcaaatctaaacaaaacactgcctttcaggacttaagcattaatagtgccgacaagatccatattacacggtctcacataatgggggccgagacccacatcgtgtctcaaacatgcaatcaggatgcccgtattctagccatgactcctgaatcaatatactcgaacccatctatccagggttgtaaaaccgtattctactcctcatgcaacgatgcaatggagatgacgaaatgcctctctaacatgcgcgaagagaaaaacttgttgaagcatgactcaaattacgcaaagatgtactgtaatccggacgctatgtcttcccttactgagaagacaatttacagcggagaagagaatatggacattaccaaatcgcacactgtagccattgataaccagatttttaaacaggatcagtcaaacgttcagatcgctgccgccccaacccccgaaaaggaaatgatgctgcagaatctgatgacgacctccgaggacggcaagatgaatgtgaattgtaactccgtgccgcacgtatctaaggagcgcatacagcagtcattgagcaatccactgtctatcagcctgactgaccgaaagaccgagcttctgtcaggagaaaacatggatcttaccgaaagccacacttccaacctgggctctcaagtacctttggccgcctacaatctcgcgccagagtccacatccgaaagccattctcagagtaagtcgtctagcgacgagtgtgaggagataacaaagtcccgcaatgagccgtttcagagatcagacattatagccaaaaactccctgaccgacacttggaacaaggataaggattgggtactgaaaattttgccctatctcgataaggactcaccacagtcagccgattgcaatcaggagatcgctaccagtcacaacatagtctattgtggaggcgtcctggacaagcagatcacgaaccggaacaccgtttcatgggaacagtcccttttttctacaacaaaacctctgtttagtagtggccagttttctatgaagaaccacgatactgctatttcctcacatacagtgaagtccgtcttgggtcagaactctaaactggctgagccgttgcggaagagccttagcaatccaaccccagactattgtcacgacaaaatgatcatatgctccgaagaggagcagaatatggacttaaccaaatcccacactgtcgtcattgggtttggtccctcagagctgcaagagctcggaaagaccaatctggagcatacaactgggcaactcactactatgaatcggcaaattgctgtaaaggtggagaaatgtgggaagtctcccattgaaaagtctggcgtgctgaaatccaattgcataatggacgtgcttgaggacgaaagcgtccagaagccgaagttcccaaaggagaaacagaacgtgaaaatctggggcagaaaaagtgtaggcggcccgaagattgacaaaactatcgtttttagtgaagatgataagaacgatatggatatcactaaatcgtacactatcgaaattaaccatcgtcccctgctggaaaaaagggactgccatctcgtgccccttgccggtacctccgagaccatcctctacacatgccgacaggacgacatggagattacacgaagccataccaccgccctggagtgtaagactgtctcacccgacgagattaccacgagaccaatggacaaaacagtagtttttgtggataatcacgtggagttggaaatgacggaaagccatacagtgttcattgattatcaagaaaaagagagaacagatagacccaatttcgaattaagtcagcggaaatcccttggaacacccaccgtgatttgtacgcctactgaagaaagcgtgttctttcccggtaacggtgaatcagatagactcgtggctaatgattcacagctcacaccactggaagaatggtcaaacaatcgcggacctgtggaagtggctgataacatggagctttccaagtcagcaacatgcaagaacatcaaagacgtgcagtctccaggctttttaaacgagcccctatccagcaaaagccagagaagaaaatccctgaaattaaagaacgataagactatcgtgttcagcgaaaaccataagaatgacatggatatcacccagtcttgcatggttgaaatcgataacgagtccgctcttgaggacaaggaggatttccaccttgccggggcttcgaagacaatcctttactcttgtggccaggatgacatggagatcacccgttctcacaccacggccttggagtgtaaaaccctgctgccaaacgagatcgccatccgccctatggacaaaaccgtgctcttcaccgacaattactccgatctggaggtgaccgatagccacaccgtgtttatagactgccaggccacggagaaaatccttgaggagaacccgaaatttgggatcggcaaaggcaaaaacctgggtgtgtcctttcctaaagacaactcttgtgtgcaagaaatagctgaaaaacaggccctcgcagtgggcaataaaattgttctgcacacagagcagaaacagcagttattcgccgctacaaacaggactaccaatgagattatcaaattccacagcgcagcaatggacgaaaaggttattggaaaggttgttgaccaagcctgcaccctggagaaagcacaagtcgagagctgccagctgaacaatcgcgacaggaggaatgttgatttcactagcagccatgctacggctgtctgtggttcttcggacaattattcctgcctgccaaatgtgatctcctgtaccgacaacctggagggaagcgcaatgctgctttgtgacaaggacgaagagaaagctaattattgcccagtgcagaacgacctggcgtacgctaatgatttcgcatccgagtactatctggagagtgagggacagcccctgagtgctccttgtccgctgctcgagaaagaggaagtgatacagacgagtactaaaggccaactcgactgtgttataacactacacaaagatcaggaccttataaaggacccacggaacttactcgctaatcaaacacttgtgtatagccaggacctgggcgaaatgacaaaactgaactcaaaacgagtcagctttaaattacccaaagaccaaatgaaggtttatgttgatgatatttacgtgattccccagccacatttttccaccgaccagccacctctccctaagaagggacagtcttcgattaataaagaggaagtgatcctgtctaaggcgggcaataagagtctcaacattatagaaaatagcagtgcccccatctgcgaaaataaacccaagatcttgaattccgaagagtggttcgcagccgcatgcaagaaggagttgaaggagaatatacagaccacgaattataatactgcccttgatttccacagcaacagcgacgtgacaaagcaggtaatacagacgcacgtcaatgctggagaagcccctgacccagtgatcacctctaacgtcccatgcttccactccattaagcctaacctgaataacctgaatgggaagaccggcgaatttctggcctttcagacagttcaccttccgccgctcccggagcagctgcttgagttgggtaacaaggcgcataacgacatgcacattgtgcaggcaactgagatacacaatataaacatcatctccagtaacgccaaggactcccgagacgaggaaaacaagaagagtcacaacggagccgaaaccacctcactacctccaaagacagtgtttaaggacaaggtgagacgttgctcactcgggatctttctgcctcggttaccgaacaagaggaactgctccgtaactggcatagacgatcttgagcaaattccagccgataccacggatataaaccatctagaaacgcagcccgtcagttcaaaggactcagggatcggaagtgtcgccggtaaattaaatctgtccccaagtcagtatatcaacgaggagaatctacccgtttaccctgatgagataaacagcagtgatagtattaatatcgaaaccgaggagaaggccctcattgagacctatcagaaggaaataagcccttacgaaaataaaatggggaagacctgcaactctcagaaacgtacatgggtgcaagaagaagaggatattcataaggaaaagaagatccgtaagaacgaaatcaagttctccgatacaacgcaggaccgagaaatcttcgaccaccataccgaggaggatattgataagtccgccaatagtgtgttgatcaagaacctgtctagaactccatcgtcctgttcgtcttcgctggattctatcaaggccgacggaacaagcctggacttttcaacctacagaagttcccaaatggaatctcaattcctgcgggatacaatatgcgaagagtctctcagggaaaaactacaggatggccgtattaccatccgtgagtttttcattttgctgcaagtgcatattctgatccagaagccaagacagtccaatctccctggtaatttcactgtcaacacccctccgacccccgaagacttgatgttgtctcaatatgtctatcgccctaaaatacagatctacagggaagattgcgaagcaagacgacagaaaatcgaggaacttaagctgtcggcatcgaaccaggataagctgcttgtggatatcaacaagaatctttgggaaaagatgcgtcactgcagcgacaaggaactgaaagcatttggaatttaccttaataaaataaagtcctgttttacaaaaatgaccaaagtgttcactcaccaggggaaggtggctctctacggaaaactcgttcaatccgctcagaatgagagagaaaaactccagattaagatcgacgaaatggacaaaattttaaagaagatcgacaattgcctgacagaaatggaaaccgagacaaagaatcttgaagatgaagagaaaaataaccctgtggaggagtgggattctgagatgcgggccgcggagaaggagcttgagcagttgaaaacagaggaggaggaactacaacggaatctcctggaactcgaggtgcagaaggaacagacactggcacagatcgactttatgcagaagcaacgcaatcggaccgaggagctcctggatcagctgagcctgtcggaatgggatgtagtcgaatggtctgacgaccaagctgtctttacgtttgtttatgataccattcagctgactatcaccttcgaggaatcggtggtggggttccccttcttagataagaggtaccgcaaaatcgtggatgtcaatttccagagcctgcttgacgaggaccaggccccaccgagctcactgttggtacacaagctgatttttcagtacgtggaggagaaagagagctggaaaaaaacctgtacgacccagcatcagcttcccaagatgctggaggaattctctctggtggtgcatcattgtcgtttactgggggaggagattgagtacctcaaaagatggggacccaattataatttgatgaacatagacataaacaacaatgaattaagactgttattttcatccagtgctgccttcgccaaattcgagatcaccctatttcttagcgcatattacccgtcagtgcccttgcccagtaccatccaaaaccatgtagggaatacaagccaagacgatatcgcaacaatcctgagcaaagtccccctggagaataactatctgaaaaatgttgttaaacaaatttaccaagatctctttcaggattgtcatttctaccattag

SEQ ID NO: 16088 - DNA, 714 bp, Artificial Sequence
  Description of Artificial Sequence: Synthetic coding sequence
atgggctgctgcggctgctctggcggctgtgggtcaggctgtggagggcgcggtagcggttgtggcggctgcggatccggctgtgggggctgtgggagcggttgcggcggatgcggtagtggctgcgggggctgcggcggatgcggctcagggtgcgcaggttgcggaggatgcggaagtggttgttgcgtgcccgtgtgctgttgcaaacctatgtgctgttgcgtgcctgcttgtagttgttcaagctgtgggaaaggtgggtgcggcagctgcggggggagcaaacgcggttgcgtgtcctgcggcgtctcaaagggcgcatgtggctcttgcggtggcagcaaaggcgggtgtggatcatgcggagggagcaaagggggttgcggatcgtgcggtggtagcaaaggaggttgcggatcctgcggcggatcaaagggagggtgtggctcctatgggtgtagccaatcctcttgctgcaagccctgctgctgttcctccggatgcggatcttcctgctgtcagagctcgtgctgcaaaccctactgctgtcagtcctcatgctgcaagccatattgttgccaaagcagttgctgcaagccctgctcatgcttctctggctgcggctccagctgttgccagtcctcctgctacaagccgtgttgctgccaatcgtcttgctgcgtcccggtctgttgccaatgtaaaatttag

SEQ ID NO: 16089 - DNA, 717 bp, Artificial Sequence
  Description of Artificial Sequence: Synthetic coding sequence
atggggtgcagtgggtgcagcggaggatgtggctcttcctgtggcggatgtggctctagctgcggcgggtgtggctccgggtacggaggttgcgggagcgggtgttgcgtgcctgtgtgctgctgtaagcccgtttgctgctgtgtccccgcctgctcttgcagcagctgcgggtcctgtggcggcagcaagggtgtatgcggcagttgtggcggctgcaaaggcggctgtggaagttgcggaggcagcaagggcggatgcgggagttcctgctgtgttccagtttgctgtagctcctcttgcggatcatgcggtggttctaaaggtgtctgtggcttcagaggaggctcaaaaggtgggtgcggctcatgtggatgttcacagtgtagctgctataagccctgttgttgctcttctggttgtggttcatcatgctgtcaatcttcctgttgcaagccaagctgtagtcagagctcatgctgtaagccctgttgttctcagtcttcgtgctgtaagccgtgttgttgctcatcagggtgtgggtcttcatgttgccagtcttcctgctgcaagccgtgttgcagtcaaagtagctgttgtaagccatgctgctgctcatcaggttgtggcagcagctgttgccagtctagctgttgcaagccatgcagtagtcagagttcttgctgtgtgcctatttgctgccaatgcaaaatttag

SEQ ID NO: 16090 - DNA, 1473 bp, Artificial Sequence
  Description of Artificial Sequence: Synthetic coding sequence
atgaatggggccctagatcacagcgaccagccggaccccgatgctattaagatgttcgtgggacagattccacggtcctggtccgagaaagaactaaaagagctatttgaaccatacggagctgtttatcagataaatgtccttcgggaccgtagtcaaaatcccccccagtcaaaaggatgttgctttgtgaccttctataccagaaaggcagccctggaagctcagaacgctttgcacaatattaagaccctccctggtatgcaccatcccatccagatgaaacctgctgattctgagaagtcgaatgctgtggaggatagaaagctttttatcggcatggtgtcgaaaaaatgcaatgagaatgacatccgcgtgatgttctcaccgtttggacagatagaggaatgccgcatcttgcgcggccctgacggactatcgagaggctgcgcattcgtgactttctcaacgagggctatggcccaaaatgccattaaggccatgcaccagtcacagacaatggaaggatgctcgtctccaattgtggtgaagttcgccgatacacagaaagacaaggagcagcgtcggctacagcagcagctggcccaacagatgcagcagcttaatactgccacctgggggaacctcacgggtcttggagggcttaccccccagtatttagctctgctgcagcaggcgacaagcagtagtaacttaggggctttttcaggcattcaacagatggcaggtatgaacgctcttcagctccagaatctggctactcttgccgccgctgccgccgccgcccaaactagcgcaacaagcacgaacgctaaccccctctcaactactagttcagctctgggagccctgacttctcccgtagccgccagtaccccgaattctacagcaggtgcagccatgaacagcctaacatctctaggaaccctgcagggacttgccggggcaacagtcggcctcaataatataaatgccctggccgtggctcaaatgttaagcgggatggccgccctgaacgggggtcttggcgccactgggctgactaacggaacagcaggcactatggatgcgctgacccaggcctactccggaattcagcaatacgcagctgcggcgctgcctactctgtacagtcagtccctccttcagcaacagagcgccgcaggcagccaaaaggaaggcccagagggcgctaatctgttcatctaccatcttcctcaggaattcggagaccaggatatactgcaaatgtttatgccgttcggaaatgtgattagcgctaaggtatttattgacaaacagacgaacctgagtaaatgcttcgggttcgtgagttacgataaccctgtgagcgcccaggctgccattcaggccatgaacgggtttcagatcgggatgaagcggctcaaagtccagctgaagaggtcaaaaaatgatagtaaaccctactag

SEQ ID NO: 16091 - DNA, 5826 bp, Artificial Sequence
  Description of Artificial Sequence: Synthetic coding sequence
ttactgacgagcgtgctgatgccctccttcggatactttatacgcagccctgagaagcgggagccaatcgccctgatacggaagtccgacgtctctcgtggcaatctggagaaagagatggcccacctgaatcacgatctctattcaggtgacctgaacgaacagtctcaggctcaattgtcagaaggatctattaccctccaagtggaagccgttgagtctaccagtcaggtcgacgaaaacgacgtcacgctaaccgctgacaaaggaaagaccgaggacacattcttcatgtctaataagccgcagcgatacaaggataaactgcccgattcaggcgatagtatgctgagaatatctaccatcgcttccgccatagctgaggcatcagtgaacaccgaccctagtcagctagcagcaatgatcaaagctctgtccaataagaccagggacaaaactttccaggaagatgagaaacaaaaagactattctcacgtgcggcactttctcccgaatgatctagagaagagtaacggttcgaatgccctggacatggaaaagtatctcaagaagacggaggtgtctcggtatgaaagcgccctcgagaacttctccagggctagtatgagtgacacttgggatctttctctccctaaagagcagacaacacaagatattcacccagttgatctgtcagctacaagcgtgtcagtaagggcacctgaagagaatactgccgctatcgtttacgttgaaaacggggagtctgagaatcaagagagtttccgcaccatcaattcctccaattccgtcacgaacagagagaacaattccgccgtagtcgatgtgaagacatgtagcatcgataataaacttcaggacgtgggcaacgacgagaaggcgacatccatttcaactccctccgatagttattcttccgtgcggaatcccagaattaccagcctgtgcctcctgaaagattgtgaagagatcagggacaaccgagaaaaccagcgacagaacgagtgcgtgtcagagatttcaaattccgagaagcacgtgacttttgagaaccataggattgtgtctccgaagaactccgacctgaaaaacaccagccctgaacacggtggtaggggcagtgaagacgaacaggaaagttttcgaccatcaacatcaccattgagccacagttctccatctgagatctctggcacttcatcttccgggtgcgccttagaatcatttgggtccgcagcccagcagcagcagcctccttgcgagcaggagctcagccctctggtgtgcagcccggcaggcgtttcgaggctgacatatgttagtgagcctgagtcctcctatcccactaccgccacagatgacgcactggaggatcggaaatccgatattaccagcgagctcagcacgaccatcatccagggttcgccagctgccctggaggaaagagctatggaaaaactgagggagaaggtcccctttcagaaccgcggaaaggggactctgtcctctattatacagaacaatagcgacacccggaaagctacagagactacaagcctgagtagtaagcctgagtacgtcaagcctgattttaggtggtcaaaagacccctcttccaaaagcggaaacctgctcgagacatctgaagtggggtggacctccaaccccgaagagctggatcctatcagattagcattacttggtaaaagcggcctatcgtgccaggtaggctccgctacatctcacccggtgagctgccaggagcctattgatgaggaccaaaggattagcccaaaagataagtctacagctgggagagaattcagtggacaggtaagtcaccagacgacgagtgagaaccaatgcacacctattccatcaagtaccgtccattcgtccgtggctgatatgcagaatatgcctgccgccgtgcatgctctactgacacaaccctctctatccgctgcaccattcgcccagagatacctcggaactctcccctcaacaggtagtactaccctcccccagtgtcacgcaggtaatgctactgtatgcggcttctcaggggggttgccgtatccagcggtcgccggcgagcctgtgcagaattccgtggccgtgggtatttgccttggttctaatataggcagtggctggatggggacatcctctctgtgcaatccttatagcaataccctgaaccagaacctgctgagcaccactaaaccattccctgtgcccagtgtgggaaccaactgcggcattgagccatgggactccggtgtgacgtccgggttgggctcagttcgggtgccagaagagttgaagctgccacacgcttgttgtgttggaattgcaagccaaactctgctgtctgtgctcaatccaacggaccgatggctgcaggtgtccatcggtgttttgagcatatctgtcaacggggagaaagtggatctcagcacatatcgttgcttagtattcaaaaacaaggctattatcaggccgcacgcaactgaagaaattaaagtgctgtttattccgagcagtccgggcgtgtttaggtgcacattcagtgtggcttcttggccgtgcagtactgatgcagaaaccattgtgcaagccgaggccctcgcgagtacagtcacattaactgctatcgcggagagcccagtgattgaggtcgagaccgaaaaaaaagacgtcctggattttggagacctgacctatggcgggtggaaggcgttacccctgaaacttatcaatcggacccacgctaccgtgcccatccgtctgattatcaatgccaacgccgtggcatggcgctgcttcaccttttcaaaggagtcagtgcgcgcacccgttgaggtggccccgtgcgctgacgtggtcactagactggccggaccatctgtggttaaccacatgatgcccgcctcttacgatggccaagatcctgagttcttgatgatttgggtactgtttcacagtccaaagaagcagatcagttcaagcgacatattggactcagccgaggaattctccgccaaggttgacatcgaggtcgattctcccaatcccaccccggtactcagatcagtgtcactcagggccagggccggaatcgcccgtattcacgcaccccgggaccttcagaccatgcatttcctggccaaagttgcttcaagcagaaaacagcacctgccgctgaagaatgcaggcaatatcgaagtctatttggatatcaaagtccctgagcagggatcccatttctctgttgatccaaagaatttgttactcaagccgggtgaggagcacgaggtgatcgtgtcatttacccctaaagacccagaggcatgcgaggagcggatcctcaagatctttgtgcagccctttggcccacagtacgaggtggtgctgaagggcgaagtgatcagttcaggttccaagccactgagcccgggaccttgtcttgacatccccagcatcctcagtaacaaacaattcttagcttggggtggcgtgcccctgggaagaacgcagcttcagaaactcgctctacggaacaactccgcatccaccacacagcacctgagactgctgatcagaggtcaggatcaggattgctttcagttacagaacacgttcgggtccgagcagcgcttgacctccaactgcgagatcaggattcacccaaaagaggacattttcatcagtgtcctgtttgcgccaactcgcttatcgtgtatgctcgctaggctagagataaagcagctggggaatcgcagccagcccggaatcaaatttacaatcccactcagcggatatggaggaacatctaacctgatactcgaaggggtcaagaaactcagtgattcctacatggttacagtgaatggcctcgttcccggtaaagagagtaaaattgtgttctccgtcaggaataccggcagccgggctgcattcgtgaaggccgtcggatttaaagactcccaaaagaaggtcctgctcgatccaaaggtacttaggatcttccccgataagtttgtgctgaaggagcggacccaggagaatgttacgctgatctacaacccatcagatcggggcattaacaacaagacagccacggagttgagtactgtctatttgtttggaggcgacgagatctctcggcagcagtaccgcagagcacttctgcacaagccagagatgattaaacagattcttcctgagcacagtgtgctgcagaacatcaattttgttgaggcctttcaagatgaacttctcgtcactgaggtatatgatttaccacaacgtccgaacgatgtccagctgttctatgggtctatgtgtaagattattttatctgtgataggtgagttccgggactgtatctcctctagggagttcctccagccctccagcaaggcctcccttgagtccaccagtgacttgggggcctctgggaaacacggtggtaacgtttccctcgacgtcctcccagtaaagggtccacaaggatctccacttctatctagagccgcacgcccacccctggaccagctagcttccgaggaaccatggactgtgctgccggagcacctcatcctggtagccccaagcccctgcgatatggcaaagacaggcagattccagatagtgaacaactccgtccggctgttacggtttgagctgtgctggcccgcgcactgcctgactgtgacaccccagcatggttgtgtagccccggagagcaagttacagatcctcgtcagccctaacagctctctttcgaccaagcagtcaatgtttccatggtcaggtctcatatacattcactgtgacgatggccagaaaaaaatcgtaaaggtgcagataagagaggatttgactcaagtcgagctgctcaccagattgacgtctaaaccatttggcatcctttcacccgtgagcgagcctagcgtgagccacctagtaaagcctatgacgaaaccccctagcacaaaagtggaaattcgaaataaatcaataacatttcccacaactgagcccggcgagacaagcgagagttgtctggagttagaaaaccatggcactactgacgtgaagtggcacttgtccagcttggcacccccatacgttaagggcgtggatgaaagtggcgatgtgtttcgggccacttacgccgccttcagatgtagcccgattagtggcttattggaatcgcacgggatccagaaagtttcaattaccttcttaccacgcggacgcggggactatgcccaattctgggacgtggaatgccacccacttaaggagccccacatgaaacacactctgaggtttcagctatctggtcagtcaatcgaggcagagaatgagcccgaaaacgcttgtctgagtactgattctctgatcaagattgatcacctggtcaaaccccgaaggcaggctgtctctgaggcctccgcccgcatcccagagcagctggatgtcaccgccagaggtgtgtacgctccagaagacgtgtataggttccgccccacgtctgtgggggagtctaggacactaaaagtgaatctgcgaaacaattcttttataacccactcactgaagtttctgtcaccacgagagcccttctacgtcaagcattcaaaatactcgctaagagcacagcactacatcaacatgcccgtgcaatttaagcctaagtctgctgggaagttcgaggcactgcttgtgattcaaacagatgaaggcaagtccattgctataaggctcataggcgaagctctgggaaaaaactag

SEQ ID NO: 16092 - DNA, 111 bp, Artificial Sequence
  Description of Artificial Sequence: Synthetic coding sequence
atgtgctactacggcaactactatggaggatacggctacggcggtctgggctgtggttacgggagctgctgcggctgcggattcagaagactggggtgtggttatggatag

SEQ ID NO: 16093 - DNA, 528 bp, Artificial Sequence
  Description of Artificial Sequence: Synthetic coding sequence
atgtcttataattgctgtagtggaaatttttcatccagatcttgcggggattacttaagatatccagccagcagtaggggcttttcatacccaagtaatctcgtctactcaaccgatctctgcagtccgtcaacttgccaattgggctcctctctctatcggggatgccaggaaatttgctgggagcctacttcctgccagacttcatacgtcgagtcctcaccctgtcagactagctgttacagacctagaacaagtctgctatgttccccctgcaaaaccacatattcaggcagtcttggcttcggctcctccagctgtagaagccttggttacggatcccggtcttgttattccgttggctgtgggagctcaggggtgcgtagtctgggatacggaagctgtgggtttccctctctgggctatggcagtggattctgcagacctacctatctggcctcacgcagttgtcagtccccatgctataggccagcctatggttcaaccttttgcagatcaacctgttag

SEQ ID NO: 16094 - DNA, 324 bp, Artificial Sequence
  Description of Artificial Sequence: Synthetic coding sequence
atggggaaaaagagaaccaaggggaaaaccgtgcccattgacgacagttccgaaacccttgaacctgtgtgcagacacattcgcaagggcttggagcaaggtaatctgaaaaaggcgctcgtgaatgtggagtggaatatttgtcaggattgtaagaccgataacaaggtgaaggataaagccgaggaagagaccgaagagaaaccaagtgtgtggctctgcctgaagtgcggccaccaaggttgcggacggaattcccaggaacagcacgcgttgaagcactacctcaccccacgctccgagccacattgcctcgttttatag

SEQ ID NO: 16095 - DNA, 2469 bp, Artificial Sequence
  Description of Artificial Sequence: Synthetic coding sequence
atgggcaagaagcgaacgaaagggaagaccgtcccgatcgacgattccagtgaaacccttgagccagtgtgccgacacatccgcaagggcctcgaacaggggaatttgaagaaggcccttgtgaatgtagaatggaacatatgtcaggattgcaaaacggacaacaaggtgaaggataaggcggaggaggaaactgaagaaaagccaagtgtctggttatgcctcaagtgcggacatcagggatgcgggcgaaattcccaggagcagcatgcactgaaacactacctgacaccaaggagcgagccgcactgcctagttttgagcctggacaattggagtgtttggtgctatgtgtgcgacaatgaggtccagtactgttcaagcaaccagttaggtcaggtggtagactacgtgaggaagcaggcctctatcactactcctaaacctgagaaagacaacggaaatatagagctggagaataagaaattggagaaggagtccaaaaatgagcaggagagagagaagaaggagaacatggccaaagaaaacccccccatgaactcgccttgccagattactgtaaaaggactgagtaatttggggaatacctgtttcttcaacgctgtgatgcagaacctgagccagacccccgtcctgcgggagctgctcaaagaagtgaaaatgtcaggaacaattgttaagatcgaaccacccgatctagcactcacagagccattagagataaatctagagccgcccggacctctgactctggccatgtcccagtttctgaatgagatgcaagaaactaaaaagggagtcgttacccctaaggagctcttctcccaagtctgcaagaaggcggtgagattcaaaggctaccagcagcaggattcacaggagctgctgaggtaccttctcgacgggatgagggctgaagagcaccagagggtcagcaaaggcatcctgaaggcttttggaaactcaaccgagaagctggacgaggagctgaaaaataaggtgaaggactacgaaaaaaagaagtctatgccaagctttgtggatcgcatcttcggcggcgaactgacaagcatgattatgtgtgaccagtgccggactgtgtctctcgtgcacgaatcattcttagatctcagtctccccgtgctcgatgatcagtctggaaagaaatcagtgaacgacaaaaacctcaagaaaaccgtggaagacgaggaccaggactccgaagaagaaaaggacaacgatagctatattaaagagcgatccgatatcccttcggggaccagcaaacatttacagaagaaagccaaaaaacaggccaagaagcaggcaaaaaatcaacgaaggcaacagaagatccaaggcaaagtgctgcatctgaacgatatttgcacaattgatcaccccgaggacagtgaatatgaggccgagatgagccttcagggagaggttaacattaaaagcaatcacataagccaagagggcgttatgcataaagagtactgcgtcaaccagaaagatctaaacgggcaggccaaaatgattgagtcggtcaccgacaaccagaaatcaacagaggaagtcgatatgaaaaacattaatatggacaatgaccttgaggtgctcacctcctcccccaccagaaacttgaatggcgcctaccttacggaagggtccaatggtgaggtcgacataagtaacggcttcaagaatcttaacctcaatgccgccctacacccggacgagataaatatagagattctgaatgactcacatactcctggtactaaagtatacgaggtcgttaacgaggacccagagactgcattttgtacgttagctaatcgggaggtgtttaacacggatgagtgctctatccaacattgtctgtaccaatttacccggaatgaaaaactgagggatgccaacaagctgttgtgcgaggtttgcacacgcaggcagtgcaacggccccaaagccaatattaaaggcgagcggaagcacgtctacaccaatgctaaaaagcaaatgctcatttctcttgcacctcctgtgctgacgcttcacctaaagaggtttcagcaggctggattcaatctgagaaaagtgaataagcatattaagttccctgagatccttgatctggctcccttttgcaccctgaagtgcaagaacgtggctgaggagaatactcgggtgctgtattcgctttacggtgtggtcgagcattccggaactatgcgctcgggccattataccgcctatgctaaggctcgaaccgcgaattcccacctgtcaaaccttgtacttcacggagatatcccgcaggacttcgagatggaatcgaaggggcagtggttccacatttcggatacacatgtgcaggcggttcctaccacgaaggtcctgaactctcaggcctatctactgttctatgaacgaattctttag

SEQ ID NO: 16096 - DNA, 2472 bp, Artificial Sequence
  Description of Artificial Sequence: Synthetic coding sequence
atggggaagaaacgcaccaaggggaagaccgtgcctatcgatgactccagcgaaaccctggaacccgtttgtcgccatattcggaaaggcctggaacaggggaacctgaagaaagccctggtgaatgttgagtggaatatctgccaggactgtaaaactgacaataaagtgaaagacaaagcggaagaagagacggaagagaagccatccgtgtggctgtgtttgaaatgtggtcaccagggatgtggaaggaacagccaggagcagcatgctctgaagcattatctgacccctcgatctgagcctcattgtcttgtcttatccctggataattggagtgtgtggtgttacgtgtgcgacaatgaggtacaatactgctcctctaatcagctgggtcaggtggtggattatgtgcgaaaacaggcctccataaccactcctaaacccgctgagaaagacaacggaaacattgagctagagaacaagaagctggagaaagagtccaaaaacgaacaagagcgggagaaaaaggagaacatggcgaaggagaatccacccatgaatagtccgtgccagataacagtgaaggggctgtctaatctgggcaatacatgtttttttaacgccgtcatgcaaaacctgtctcagactcccgtccttagggaactcctgaaggaggtaaaaatgtccggaacaattgtgaaaattgagcccccggatctcgcactgaccgagcctctcgagattaatctcgagccgcctggccctttaactctggctatgagccagtttcttaatgaaatgcaggaaactaaaaaaggagttgtcacccctaaagagctatttagccaggtctgcaagaaggccgttcggtttaaagggtatcagcagcaggacagtcaagagctgctgcgctatctgttggatggaatgcgcgctgaggagcaccagcgggtttccaaggggatattaaaggcctttggcaatagcaccgaaaagttggacgaggaactgaagaataaagtcaaggactacgaaaagaaaaaatccatgccctctttcgttgaccgcatctttggcggagagcttacatctatgattatgtgcgaccagtgccgtactgtaagccttgtccatgagtcctttctggatttatcactccctgttctggatgaccagtccggtaagaagtccgtgaacgacaaaaatctgaaaaagacagtggaggatgaggaccaagatagcgaggaggagaaggataacgatagctatatcaaagagagatccgatatcccctctgggactagcaagcatttgcagaagaaagctaaaaagcaggctaaaaagcaagccaaaaaccagcggagacagcaaaaaatacagggcaaggtgctccacctgaacgacatttgtaccatcgatcaccccgaggactcagagtatgaggccgaaatgagcctccaaggggaggtcaatatcaagtctaaccacatctctcaagagggcgtcatgcacaaagagtactgcgtgaatcagaaggatctcaacggccaggcaaaaatgatcgagtccgtgacagataatcagaaatccacagaagaggtcgacatgaaaaatatcaacatggacaatgacttggaagtccttacgagcagcccgactcgaaacctgaatggcgcctacctgacagaggggtccaacggagaggtcgacatttcaaacggatttaagaaccttaaccttaatgctgccctacacccggatgagatcaacattgaaattctgaatgactcacacacccctggcactaaggtctacgaagtggtgaacgaagatcctgaaaccgccttttgtacgctggcaaaccgagaagtttttaacaccgacgaatgctctatacaacattgcctttaccagttcacccgcaacgaaaaattaagggacgctaacaagctgttgtgtgaggtgtgcacacggaggcaatgcaacgggcctaaagccaatatcaagggagagcgaaagcatgtgtataccaacgccaaaaagcaaatgctgatctctctggcgccccccgtgctgactctccatctgaagcgcttccaacaggccgggttcaaccttcgcaaggtcaacaagcatatcaagttccctgagattctggacctggcccccttctgtacactgaagtgcaaaaacgtggccgaagaaaataccagggtactgtactcactgtatggcgtggttgagcatagcggcacaatgaggtcaggccattacaccgcctatgccaaagcacgtacagccaattctcacctgagcaatctggtcctgcacggtgatatccctcaggattttgagatggagtcaaaggggcagtggtttcacatcagtgatacgcacgttcaggccgtgcccaccaccaaagtgctcaacagccaagcctatctgctgttctatgagcggatactctag

SEQ ID NO: 16097 - DNA, 1167 bp, Artificial Sequence
  Description of Artificial Sequence: Synthetic coding sequence
atggatccaataaggtctttctgtggtaagctccggtcccttgcatccacactggattgtgagaccgcgcgcctccaacgggcactggatggcgaagagtcggactttgaggattaccctatgcgcatcttgtacgatctgcactcagaggtccagaccctgaaggacgacgtcaacatcctcttggacaaagcccgtttggaaaatcaggagggaatcgattttattaaggcaacaaaggtactgatggagaagaacagtatggatatcatgaagattcgggagtattttcaaaaatatggatacagccctcgggtgaagaagaatagtgtgcacgaacaggaggccatcaacagcgatccagagctgtccaattgcgaaaactttcagaaaaccgacgtgaaggatgatctgtcagacccccctgtggccagctcctgcatatccgagaagtcgccgcgttcacctcagctttcagatttcggcctcgaaaggtatattgtgtcccaggtgttgcctaaccccccacaggccgtgaacaattacaaggaagagcctgtgatcgtgacaccccctacaaaacagtcattggtcaaagtgctcaaaaccccaaagtgtgcactgaaaatggatgatttcgaatgcgtgactcctaagctggaacactttggaatttccgagtatacgatgtgtttgaacgaggattatactatggggctgaagaacgctaggaataataagagcgaagaggctatcgacaccgagagccgtctaaacgataacgtttttgccaccccttcccctattatccagcagctcgagaaaagcgatgccgagtacacaaattctcctttagtgccgaccttttgcaccccaggactaaagataccttccactaagaattcaatagcgctcgtgtctacaaactaccctctcagtaagaccaactcttcttccaacgatttagaggtcgaggaccgcacatcactcgtgctgaacagtgatacctgtttcgagaacctcacagatcccagttcacctacaatctcttcctacgaaaaccttctcagaacaccgaccccacctgaagtgactaaaattcccgaggacatcctgcagaagttccaatggatctacccaactcagaaactgaacaagatgaggtag

SEQ ID NO: 16098 - DNA, 1353 bp, Artificial Sequence
  Description of Artificial Sequence: Synthetic coding sequence
atgcgcgagtgcatctcaattcacgtgggccaggccggcgtacagatcggcaatgcttgttgggagctttactgcctggagcacggcatacagcctgatggacagatgccatcagacaagacaatcggcgggggcgatgatagctttaataccttcttcagtgaaactggtgctggaaaacacgtgccgcgagccgtttttgtcgacctcgaaccaactgtcgtggacgaggtgcgcacagggacatatcggcaactatttcatcccgaacagctgatcacaggcaaggaagatgccgccaataattacgcccgaggtcactataccattggaaaggagatcgtggacctggtccttgaccgcatacggaaattggctgacctctgtacgggcctccaaggtttcctgatctttcatagctttggcgggggcaccggctcaggcttcgcctcactgcttatggaaagactgtcggtggactacggcaaaaagtctaagctggagtttgcaatctatcccgccccgcaggtatcaacagctgtggtggaaccgtacaattctatcctcacgactcacacaacactcgaacatagcgattgtgcctttatggtggacaatgaagccatatacgacatttgcagaaggaatctagatatcgaacgccccacttacaccaacctgaatagactaataggccagattgtgtcgtcaatcaccgcttctctgcggtttgacggggctttgaacgttgacctgacggagtttcaaactaatcttgtcccgtacccaaggattcacttcccattggcaacatatgcacccgtgatctctgcagaaaaggcgtaccatgagcagttgtctgtcgccgagatcacaaatgcttgtttcgagccagccaatcagatggtgaaatgcgaccctcgtcacggtaagtatatggcctgttgtatgttgtacaggggtgacgtggtgcctaaagatgtcaacgctgctattgcaacaataaagacgaagcggacaattcagttcgtagactggtgccccacaggattcaaagtgggcatcaactatcagccgcccactgtggtcccagggggcgacctcgccaaagtgcagagagccgtttgcatgctttctaacaccacagctatcgctgaagcttgggctaggctggaccataaatttgaccttatgtatgcaaaaagggccttcgtacattggtacgttggagagggcatggaagagggtgagttctccgaagccagagaagacctggctgctttggagaaggattacgaggaagtgggtgttgattccgtggaggccgaagcagaggaaggcgaggagtattag

SEQ ID NO: 16099 - DNA, 3378 bp, Artificial Sequence
  Description of Artificial Sequence: Synthetic coding sequence
atgactgttgaacagaacgtattacaacaaagcgcggcacagaagcatcaacaaacattcctcaaccagcttagggagataacaggaattaatgacacacaaattctgcagcaggccctcaaggactcaaatggcaatctggagctggctgtggcctttctgactgcgaagaatgccaagacgccacagcaagaggagaccacttactaccagactgccctcccaggtaacgatcggtatatctcagtggggtcccaagccgatacgaacgtcattgacctgaccggtgacgataaggacgatctacagagggccattgccctgtcattagccgagtccaaccgagcatttcgcgagactggtataacagatgaagaacaggcgatatccagagtgctggaggccagcatagctgaaaacaaagcatgtctcaagaggacacccacggaggtttggagggacagtcgtaatccttacgatagaaagagacaagataaagctcctgtcggcctcaagaatgtcggaaatacctgctggtttagcgcggttattcagagcctgtttaacctgctggagtttcggagattggtacttaactacaagcctccaagcaacgcacaggacctaccacgtaaccaaaaggagcacagaaaccttccgtttatgcgggagctgcgttatctcttcgccctcttggtgggcaccaagcggaaatacgtggacccatccagagctgtggaaatcctgaaggacgcctttaaaagcaacgattcacaacagcaagacgtgtctgaatttacacacaaactcttggactggctggaggacgctttccagatgaaagccgaagaggagaccgatgaagagaaacctaagaaccctatggtcgaactgttttacgggcgtttcctggccgtgggggtgctggaagggaaaaaattcgaaaatacagaaatgttcgggcagtatccgttgcaagtgaatggcttcaaagacctacacgaatgcctggaggccgctatgattgaaggggagattgagtcactgcactcagaaaattcagggaagagtgggcaggaacattggtttacagaactgccgcctgtcctgaccttcgaactctcacggtttgagttcaatcaagctctgggtagacccgaaaagatacataataagttggagtttccacaggtgctttaccttgaccgctatatgcatcggaaccgagagatcactcggataaagcgcgaagaaatcaaacgcctcaaagattacctaactgtgctgcaacaacgcctagaacggtacttgtcgtacggcagcggccccaagcgattccctctagtcgacgtcctgcagtacgctctggagttcgcatcctcgaaacctgtctgtacaagcccggtggatgacattgatgcatcatctcctcctagcggttctatccctagtcagacactccctagtacgaccgaacagcaaggggctctgtcatcagaattgccaagtacaagtccctccagtgtcgcggccattagctccagatcggtaattcacaaaccatttacccagagccgaataccgcctgaccttcctatgcaccccgcaccccgacatattactgaagaggagctgtctgtcttagaatcgtgcctgcatcggtggcgcactgaaatagagaacgacacgagggatttacaggaatccatcagtcgaattcacagaaccatcgaactcatgtattccgacaagagcatgattcaagtgccttacagactacatgcagtgctcgttcacgaaggccaggcaaacgcaggtcattattgggcctatattttcgaccatcgagaatcaaggtggatgaagtacaatgacatagctgtaaccaagtctagctgggaagagctcgttagagatagctttggtgggtatcgtaatgcctcagcatactgcctgatgtacattaatgataaggcgcagttcctgatccaggaggaatttaataaggagacaggccaaccactggtgggcattgaaacactgccacccgacctgcgagacttcgtagaagaggacaaccaacgcttcgagaaggagctggaagagtgggatgcacaactggcccagaaagccctgcaggaaaagctcttggcttctcagaagctgcgagagtcggaaacatcagtcacaacagcccaggcggccggtgatcccgaataccttgagcaaccgagcagaagtgactttagtaagcacttgaaagaggagaccattcagatcataacgaaggccagtcatgagcacgaggacaagtccccggagactgttctccagagcaagcccgaaaacacaaccagccagcctctgagcaatcaacgtgtggtcgaggtagcaatcccacacgtgggaaagttcatgattgagagcaaagagggaggctacgatgacgagataatgatgacaccaaatatgcagggaatcattatggcgattggcaaaagtaggagtgtgtatgatagatgtggacctgaagctggcttcttcaaggccatcaagctagagtatgcccgattggtcaagttggcccaagaggatactcctcccgaaactgattatcgtttgcatcatgtagttgtctatttcatacagaaccaggctcccaagaaaatcatcgagaaaaccctgcttgagcagttcggggatcgcaacctttctttcgacgaacgctgtcacaacattatgaaagttgcgcaggcgaaactcgagatgattaaaccagaagaagtaaacctggaagagtatgaagaatggcatcaagattataggaagtttcgcgagaccactatgtacctcatcatcgggctagaaaactttcagcgcgagtcatatatcgactctctgctgttcctcatttgcgcctaccagaataataaggagttacttagcaaaggactgtacagaggccacgacgaggagctgatttcccattaccgcagggagtgcctgcttaagctgaacgaacaggcagccgaactcttcgagagcggcgaagaccgcgaggtgaacaatggcctcattattatgaacgaattcatcgtgccatttcttcccctgctgctcgtggatgagatggaggaaaaggatattctggccgtcgaggatatgcggaacaggtggtgcagttacctgggacaggaaatggaaccgcatctgcaagagaagctgactgactttctacccaagctactggattgctctatggagattaagagcttccacgaacccccaaagctgccttcctattcaacacacgagctgtgtgagcggttcgctaggattatgctgtcactgtccagaacccccgctgacggacggtag

SEQ ID NO: 16100 - DNA, 1608 bp, Artificial Sequence
  Description of Artificial Sequence: Synthetic coding sequence
atggatcttcggcaggcatgccgaacgcctagccgtgacgaagccggtgtagaattgctgatgacttacttcatccagctgggtttcgttgagagcagattctttccaccgaccagacagatgggattgctctttacctggtacgattcgctcaccggcgttcccgtgtcccagcagaacctacttttagagaaagcctccgttttattcaacacaggggctctttatacacagattgggacccgatgcgatagacagacacaggctggactggaaagtgccatcgacgcatttcagagagcagctggagtgttgaattaccttaaagataccttcactcacactcccagttacgacatgagccccgctatgctgtccgttcttgtcaagatgatgttggcccaggcccaagagtccgtgttcgaaaaaatttccttacctgggatacggaacgagttttttatgctcgtgaaagtcgcgcaggaggctgctaaggtcggagaggtgtaccagcagttgcatgctgcgatgtcccaggctccagttaaggagaacattccatactcgtgggcatccctggcctgtgtgaaagcccatcactatgccgccctcgcacattacttcaccgcaatcctgttaattgaccatcaggtaaagccgggaacagatctcgaccaccaggaaaaatgcctcagccagctctacgaccatatgcccgagggcctgacacctctggccacactgaagaacgaccagcagaggaggcagttgggtaaaagtcatcttaggagggcaatggcacatcacgaggaaagtgttcgggaagccagtctttgtaagaagctgcggagtattgaagtgcttcaaaaagtgttgtgtgctgcacaggagcgatcccgcttaacatatgctcagcaccaggaggaggatgacctgctcaacctcatcgatgcaccctcagttgtggcaaagaccgagcaggaggtggacatcatccttccccagtttagcaagctgaccgtcacagatttttttcagaagcttgggcctctcagtgtgttcagcgctaataaaagatggacaccacctcgctcaatacgtttcacggccgaagagggagacctgggctttacactgcgcggaaatgccccggtacaggttcactttctggacccatactgtagtgcctctgtagccggcgcgcgcgagggcgactatatcgtttccatccagttggtggattgtaagtggctgactcttagcgaagtgatgaaactgctaaagagctttggagaggacgagatcgaaatgaaagtcgtaagtctgctggactctacctcctcgatgcacaacaagagcgcgacttactcagtaggaatgcaaaagacgtacagcatgatatgtcttgcgatcgatgacgatgacaaaaccgataagacaaaaaaaattagtaagaaacttagttttctgtcttggggcactaacaagaatcggcagaaaagtgcctccactctctgtttgccaagtgtgggagccgctcggccgcaggtgaaaaaaaagctgccaagccccttctctctccttaactctgacagttcctggtattag

SEQ ID NO: 16101 - DNA, 2952 bp, Artificial Sequence
  Description of Artificial Sequence: Synthetic coding sequence
atggccccaaggttgcagcttgaaaaggcagcctggcggtgggctgagactgtccgacctgaagaagtaagccaagagcacatagagacggcttaccggatctggttggagccatgcattagaggggtctgccggcgtaattgcaagggcaatcccaactgtctcgtggggataggagagcacatatggctcggagagatagacgagaatagtttccacaatattgacgaccccaattgcgagaggcggaagaagaatagcttcgtgggtctcacaaacctgggtgccacttgctatgtgaatacattcctgcaggtgtggttcctgaatctggaattaagacaggctctgtatctatgtccaagtacctgttctgattatatgttgggagatggcatccaggaggaaaaggattatgagccccagaccatctgcgagcatctgcagtatctttttgcactgttacagaattctaaccggaggtatattgacccgtccggcttcgtgaaggctctcgggttggacacgggccagcaacaggacgcacaggagttctcaaaattattcatgagcctgctggaagatacacttagtaagcaaaagaaccctgatgtgcgaaatattgtacagcagcagttttgcggcgaatacgcatacgttacggtctgcaatcaatgtgggcgggaatcgaaacttctgtccaagttctatgagctggagctcaatatccaggggcacaaacaactgacagactgcatctccgagtttctcaaagaggagaaattggaaggtgataatcggtacttctgcgagaattgtcagagtaagcaaaacgccacgagaaaaatccgattgctgagcctaccatgtacactcaatctccaactgatgagatttgtctttgatcggcaaactggtcataaaaaaaaattaaacacctacatcgggttctcagaaattctcgacatggaaccctatgttgagcataagggtggctcctatgtgtacgagctctccgccgtgcttattcatcggggcgtgtctgcctattctggccattatatagcccacgtcaaggatccacagagcggcgagtggtacaagtttaatgacgaggatattgaaaaaatggagggaaaaaaactgcagctgggcatcgaggaggacctggctgagccaagcaagagccagacccgtaagcctaaatgcggcaaaggcacccattgctcgcgcaatgcctacatgctcgtgtataggttgcagactcaggaaaaaccaaacacaaccgtgcaagttcccgcctttctgcaggagctagtggacagagacaatagcaaatttgaggaatggtgcatcgagatggccgagatgcgcaagcagtccgtggataaaggaaaagctaaacacgaagaggtgaaggaactgtatcaaagattgccagccggagctgagccatacgagtttgtaagtctggaatggcttcagaaatggctggatgagtctactcccactaaacctatcgataatcacgcctgtttgtgttcccatgacaagttgcaccctgataaaatttcaataatgaagcgtataagcgaatatgcagctgacatcttttatagcaggtatggtggcggaccccgcctaactgtgaaagctctttgcaaagagtgtgtcgtcgagcggtgcagaattctgcgcctgaaaaaccaattgaacgaagactacaagactgttaacaacttattgaaggccgcggtgaaggggtccgacgggttttgggttgggaagtcatctctgaggtcttggagacagttagcactagaacagcttgatgaacaggatggtgatgcagagcaaagtaatggtaagatgaatgggtcgactctgaacaaagacgagtcgaaggaagagcgcaaggaggaagaggaactgaacttcaatgaggatatcctatgtccgcacggtgaactgtgtatcagtgagaacgagagacgcctggtatctaaggaggcgtggtctaagctgcagcagtacttccccaaagcccctgagtttccttcctataaagagtgttgctctcagtgtaagatattggagcgcgagggggaagaaaatgaggcgctccataagatgattgcgaatgagcaaaagacctcactgcccaacttgtttcaagataagaatcgtccttgcctcagtaattggccagaggacaccgacgtactttatattgtaagccagtttttcgtggaggagtggcggaagttcgtgcgtaaaccgacacgctgcagccctgtcagtagcgtcggtaatagtgctctgctgtgtcctcacggaggcttaatgtttacatttgctagtatgaccaaggaggactcaaaactcattgccctgatttggccttctgaatggcagatgattcagaagttattcgtggtggaccatgtcatcaagataaccaggattgaagtaggagacgtgaacccgtcagagacgcagtatatctccgaacccaaactgtgcccagagtgcagagaggggctgttatgccaacagcagagagatctgcgggaatacacacaggctactatctacgtgcacaaggtggtggacaacaagaaggtgatgaaagactcagctcctgaactcaatgtctcaagctctgaaaccgaggaggacaaggaggaagcgaagcccgacggagagaaagatcccgatttcaaccaaatcatgcacgcattttctgtggccccatttgatcaaaacctctctatcgatggaaagatactttctgatgactgtgcaaccctgggcaccctaggagtgattcccgagtcagtgattctcctcaaggccgatgaaccaatcgcagactacgcagcaatggatgatgtaatgcaggtttgtatgcctgaggagggctttaaggggacaggactgctgggccactag

SEQ ID NO: 16102 - DNA, 738 bp, Artificial Sequence
  Description of Artificial Sequence: Synthetic coding sequence
atgtcggtgtgcagttctgatctgtcatatgggtcaagggtgtgtctcccaggctcatgtgatagttgttctgattcatggcaggtcgacgattgccccgagtcctgttgtgaacccccctgctgcgcacccgctccttgcctgagcttagtgtgtacaccggtgagtcgcgtgtcctctccctgttgccgggtgacctgtgaaccgtccccttgtcaaagtggttgtacaagcagctgcactccaagctgctgccagcagtcgtcttgccagcctgcttgttgcaccagcagtccctgccaacaagcttgctgcgtcccagtgtgttgcaagaccgtgtgctgtaaacccgtgtgctgtatgcccgtgtgttgtggaccatcctcttcttgctgccaacagtcctcctgccagccagcttgttgtatatcatccccttgccagcagagctgttgcgttcccgtttgctgcaagccaatttgctgtgtgccggtatgctccggtgccagctccctgtgttgccaacaatctagttgtcagccagcctgctgcacaacctcgtgttgtagacctagtagctcagtgtcattactgtgcaggcctgtctgccgtcccgcacggcgggtccccgtgccatcgtgttgtgtacccacttcctcatgtcagccatcgtgcggccgacttgccagctgtgggtccctgctctgtaggcccacctgctcacgcctagcttgttag

SEQ ID NO: 16103 - DNA, 1098 bp, Artificial Sequence
  Description of Artificial Sequence: Synthetic coding sequence
atggccgcatccactatgagcgtctgttcatctgacttatcttacggtagtagggtctgcctccctggttcttgtgatagctgttcagattcctggcaggtagacgattgtccagagtcctgctgtgagccgccttgttgtgcccccgccccctgtctgagcctggtctgcacccctgtctcccgcgtgagcagcccttgctgtcccgtgacttgcgagccatccccctgccagtctggttgcacttcaagctgcacaccttcgtgctgccagcagagctcgtgtcagctggcttgctgcgcatcgagtccttgccaacaggcttgctgcgtgccggtgtgctgtaagacagtgtgttgcaagccggtatgttgtgtctcagtgtgctgtggcgactcttcttgttgccaacagtcctcctgccaatcagcgtgttgcacttcctccccctgccagcaggcatgttgcgtgccagtatgctgcaaaccggtatgttctggcatatcttcttcctgctgccaacagtcttcttgtgtctcatgcgtgagctcaccttgctgtcaggccgtttgtgaacccagtccttgccagtccggctgcacttcgagctgtactccttcctgttgccagcagagctcatgtcagcctacctgttgtacatccagtccgtgtcaacaggcttgttgcgtgcctgtctgctgtgtgcccgtctgctgcgtcccaacctgctctgaagatagtagctcatgctgtcagcagtcttcatgtcagccagcatgctgtaccagctcgccctgtcagcacgcctgctgtgtgcctgtctgttctggagcaagcacctcctgttgtcagcagtccagctgtcagccggcttgttgtaccgcctcctgctgccgccctagttcatccgtgagcctactgtgccacccagtctgcaaatcaacatgttgcgtcccggttcccagttgtggggcctcagcatcaagctgccagccttcttgttgtcggactgcttcctgtgtgagcctgctgtgtcgcccaatgtgttctcggccagcatgttacagcctttgtagcggtcagaagagctcatgctag

SEQ ID NO: 16104 - DNA, 816 bp, Artificial Sequence
  Description of Artificial Sequence: Synthetic coding sequence
atggccgcgtgtacgatgagcgtctgttcaagcgcatgttctgactcgtggcgggttgatgactgtcccgaaagttgttgtgaacccccttgcggcactgccccatgcctgaccctcgtctgcacccctgtgtcctgcgtctctagcccttgttgccaggccgcttgcgaacctagcccctgccagtccgggtgtacaagcagctgtacgcccagttgctgtcagcccgcctgctgtgcctcatctccgtgccagcaggcatgctgtgttccggtgtgctgcaaacccgtctgttgtttgcccacatgctccaaggactctagctcatgttgccagcaatctagctgccagcccacctgttgcgcttcttccagttgtcaacaatcatgttgcgttcccgtctgttgcaagcctgtgtgttgcgtgcccacttgcagcgaagactcaagttcatgttgccagcacagctcttgtcaaccaacttgctgtacctcctccccctgccagcagtcttgttacgtgcccgtgtgctgtaagcctgtttgcttcaagccaatttgctgcgtacctgtttgttctggggcctctacgtcctgttgccagcagtcctcttgccagcctgcttgttgcactacttcttgttgccgcccctcttctagcgtaagcctcttgtgcaggcccatctgccggccggcttgctgcgttcccattagctcatgctgtgcccccgcctcttcatatcaggcctcctgttgccgcccagcgtcctgcgtctctctgctttgcaggcctgcctgctcccgcttagcatgttag

SEQ ID NO: 16105 - DNA, 1206 bp, Artificial Sequence
  Description of Artificial Sequence: Synthetic coding sequence
atgagcgtatgctcaagcgacttatcgtactcttcgcgcgtatgcttgcccggctcctgcgattcatgtagtgactcttggcaggtcgacgattgccccgagagttgctgcgagcccccatgttgcgcccccagttgttgtgcccccgccccttgtctgagcctggtatgtacacctgtcagtagggtttcttcaccttgttgccctgttacctgtgagccgtctccctgtcagagtgggtgtacctccagctgtactccctcatgctgtcagcagagctcatgccagctcgcttgttgtgctagtagcccctgccagcaggcctgctgcgtaccggtgtgttgcaaaaccgtctgctgcaaacccgtgtgctgtgtaccggtgtgttgcggggattccagctgctgtcaacagtcgtcctgtcaatctgcgtgctgcaccagcagcccttgccagcaggcctgctgtgtgcccatatgctgtaaaccagtgtgctcaggtatttcatcatcttgctgccagcagtcttcatgtgtgagctgtgtgtccagcccctgttgtcaagccgtatgcgagccaagcccttgtcagagcggttgtataagttcttgcacgcctagctgctgccaacagagcagctgtcagcctgcctgttgtacaagcagctcctgccaacaggcctgctgtgtgcccgtgtgttgtaagacagtgtgctgcaaacccgtgtgttctgaggattcctccagctgctgccagcaatcttcttgtcagcctgcttgctgcaccagtagtccctgtcagcaggcgtgttgtgtccccgtgtgttgcaagcctgtatgctgtaaaccggtagggtcggtgccaatatgctctggggcgagctctctttgttgccagcagtcaagctgccaacctgcctgttgcacttctagccagtcgcagcagggctgttgcgtaccggtatgctgcaaacctgtgagctgtgtgcccgtgtgctcaggagcgtcgtcctcttgttgccaacagtcatcttgccagcccgcgtgctgcactacatcatgctgccggcccagcagctcagtgagccttctgtgccggccggtatgccgacctgcctgctgcgtccctgtgccttcttgttgcgcacccaccagttcctgccaacctagctgctgtcggcctgccagttgtgttagtttgctgtag

SEQ ID NO: 16106 - DNA, 849 bp, Artificial Sequence
  Description of Artificial Sequence: Synthetic coding sequence
atggcagcctccactatgtccgtgtgttcgtccgcatgttccgacagctggcaggtggacgcatgcccagagagctgctgcgaacctcactgttgcgctttaagttgctgcgctcccgcaccttgcctgactctcgtctgcacccccgtcagccgggtttcgagtccctgctgtcaggccgcttgcgaaccatctccctgtcagtctggctgtactagcagctgtacacctagctgttgccagcagagctcttgtcagcctgcatgctgcacatcctctccttgtcagcaggcttgttgtgtgcctgtgtgctgcaagcctgtgtgttgtctccccacctgctccaaagattcttcgtcatgctgccaacagtccagttgccagcccacgtgttgtgcctcctccagctcgcagcagagttgttgcgtgcctgtttgctgtaagcccgtgtgttatgttccgacgtgtagtgaagactcatcgtcttgttgccagcaaagttcttgccaccccgcctgctgtacttctagcccttgtcaacaggcctgctgtgtgcctgtgcgatgcaaacctgtatgctgtaagccaatctgctgcgtccctgtgtgtagtggcgcatctacttcatgctgtcaacagtcatcatgtcaaccagcctgctgtacaacgagctgctgccggcccagctcatccgtatctctgctgtgtaggcccgtctgccggcccgcctgctgcatgcctgttagctcttgctgtgctccggcttctagctgtcaggctagctgctgcagacccgcctcttgcgtctccttgctgtgccgcccagcctgctcccgccccgcttgctag

SEQ ID NO: 16107 - DNA, 891 bp, Artificial Sequence
  Description of Artificial Sequence: Synthetic coding sequence
atggcatccagcccactcccggggcctaacgacatactccttgcctcaccctcttctgcatttcagccagatacactctctcagccccgcccaggacatgcaaaccttaagcctaatcaagtgggccaggtgatcctttatggtattcccattgtgtctctggtcatagatgggcaggaacgactttgcctggctcagatcagcaacacacttctgaaaaacttcagctataatgaaatccacaatcggagggtggcactaggaatcacctgcgtccagtgtacaccggtacagcttgaaatcctgcgccgagctggggctatgcccatcagctcaagaaggtgcgggatgattactaagcgggaagctgaacggttgtgcaagtcgttcctgggcgagaacagaccaccaaaacttcctgataactttgcattcgatgtgagtcatgaatgtgcctggggttgcagggggagcttcatccccgctagatacaactctagtagggccaagtgtattaagtgctcttactgtaatatgtacttttctccgaacaaattcatcttccactcacacaggacgcctgatgccaagtatacccaacccgacgccgccaactttaattcctggcgcagacatctcaagcttacagataagtccccacaggatgagctcgtttttgcttgggaggacgtgaaagctatgtttaatgggggatctaggaaacgtgcactccctcagcccggtgcgcatcctgcctgtcacccgttatcctccattcgcacccggtctatcgccttttctagccaaacactgatgctgcttgaagagattttcggcgaaaaggatcaggaggattacatgcggattaatgaggacaacatttggctgtag

SEQ ID NO: 16108 - DNA, 5346 bp, Artificial Sequence
  Description of Artificial Sequence: Synthetic coding sequence
gttaagaaaatccatcgtcatcgccttagtccagccacggagaagggcgcagcatcctccggggaaggcgacaaggatcccccccctcccgctcatgaggatatcgctgtgaaaggaaccgctactgccgccggcacaggacccggtaccggcgcagcagctgccgctgcggccgcagtgcctcccccgcatccagcggcagcagccgctgcggccgctgcagccgccgccgcggccgctgcagcagtcccaccacctcacccaaacattcgcgcactgcagactcaagctccccagcagattccacggggtcctgtgcagcagcccctcgaggacagaattttcacccctgctgtgagtgccgtatatagcactgttacccaggtggccaggcaacctggcacccccaccccctcgccttacagtgcgcacgagataaacaagggccaccccaacctggccgccaccccacccggccacgcatcaagccctggcctcagccaaactccttacccatcaggacagaacgccggacctacaacactcgtgtaccctcagacgccgcagaccatgaactcacagccgcagaccagatccccggtgatcttcagcccatctcaattttttcaacgccctcagattcagccgccaagggccactatcccaaacagcagtccgagcattcgtcccggtgcccagacgccaacggctgtttaccaggccaaccagcatataatgatggttaaccatcttcccatgccctaccctgttccacagggccctcagtattgcataccgcagtacagacactctggcccaccttacgttggaccaccccagcaataccccgtgcagccacccgggcccgggccgttctatcccggacccggccccggtgatttcccaaatgcttacggtactcccttttatccttcacaacctgtgtaccagagcgctcctatcattgtgccaacacagcagcagccccctccagctaaacgagagaagaagaccatcaggatccgcgatcccaaccagggaggtaaggatatcacggaagaaatcatgtctggagggggcagtagaaatcccaccccccccatcggtcgtccaaccagcactccgactcccccacagttgccatctcaggtgccagagcatagccccgtcgtctacggtactgttgagtcagcccatcttgccgccagcacgcctgttactgcagctagcgatcaaaagcaggaggagaaacccaaaccagatcctgtgctgaagtctcctagtccagtgttgcgattagtcctgagcggggagaagaaggagcaggaggggcaaacctcagagacaactgctatagtgagtatcgccgagctgcccctccccccaagccccaccacagtgtccagcgtcgcaaggtcaaccatcgccgctcccacatccagtgccctctcttcacagccgatatttaccacggcgatcgatgatcggtgtgaattgagcagcccgcgagaagacaccatacctatccccagcctcacatcctgcacagaaacgagtgatcccttgcctaccaatgagaacgacgatgacatctgcaagaaaccatgtagcgtggcacccaatgatatcccgctggtcagtagcacaaatctgatcaacgagataaatggcgtctctgaaaaactgtcagcaaccgagtccattgtggaaattgtaaaacaggaggtgctacctctgactctggagctcgaaattttagagaacccgcctgaagagatgaagctggagtgcattcccgcaccgatcaccccctcgacagtgccttcattccctccgacacctccaactccccccgcgagccctccccatacaccagtgatagtgccagccgcagccacgacagtaagcagcccgtccgcggcaataacagtgcagagagtgctggaggaagacgagtctatcagaacttgtctgtctgaagatgcaaaggagatacaaaacaagatcgaggtcgaagccgacggccagactgaggagattcttgatagccagaatctgaattcccgccgctccccggtgcctgcacagatcgcaattacggtcccaaagacctggaaaaaaccaaaagaccgcactcgcacaaccgaagaaatgttggaggctgagctcgagcttaaagctgaagaggaactgagcatagacaaggtcctagagagtgaacaggacaaaatgtcccagggcttccatccggaaagagacccctccgatctcaagaaagttaaggctgttgaagagaacggcgaggaggccgaacctgtgcgaaacggagcagagagtgtgtctgaaggcgagggcatagacgctaactcaggctcaaccgatagcagcggcgatggcgtgaccttcccctttaaaccagaatcttggaagcccaccgacacagaaggcaaaaaacagtacgacagagagttcctgttggactttcaatttatgccagcatgcatccaaaaacccgaggggctgccgccgatcagtgatgtcgtattagacaaaattaaccagcctaagctcccgatgcgcaccctggacccaaggatcctaccgagaggccccgattttacacctgcctttgccgatttcgggagacagacacctggtggaagaggggtaccccttctaaatgtagggagcaggcgtagccagcccggccagagacgtgagcccaggaaaatcattacagtttcagtgaaagaggacgtgcacctgaaaaaagcggagaatgcgtggaagccctcacagaaacgagactctcaagccgacgatccggagaacattaaaacgcaggagctgttcaggaaagtgcggtccatcctgaataaacttacacctcagatgtttaatcaactgatgaaacaggtttctggcttgaccgtggacactgaggaacggctgaagggcgtgatagacctcgtgtttgaaaaagcaattgacgagcccagcttcagtgtagcctatgccaacatgtgccggtgtctggtgactctaaaagtccctatggcagataagcctggtaatactgttaattttcgcaagctgctactgaataggtgccagaaggagttcgaaaaggataaggccgatgacgatgtgttcgagaaaaagcagaaggagctggaagctgcctcagcacctgaggagcgcactagactccatgatgaacttgaagaggcgaaggacaaagcccgcagacgctcaataggcaacatcaaatttatcggcgagctgtttaaactcaagatgttgaccgaggccattatgcacgactgcgtggtaaaactcctaaaaaatcatgacgaggaatcattggagtgtctttgccggcttctcactacaatcggcaaggacctggacttcgaaaaagctaagccacgaatggaccagtattttaatcagatggaaaagatagtcaaagagcgaaagactagttcacgcatacgatttatgctgcaggacgtaattgatctacgcctgtgcaactgggtttctcgcagagcagaccagggaccaaaaaccatcgagcagatccacaaggaagctaagatcgaagagcaggaggaacagagaaaggtgcagcagttaatgaccaaggagaaacgacgacccggcgtgcagagagtcgacgaaggcgggtggaatactgtgcagggagccaaaaactcccgagtgctggacccatccaaattcctgaagatcacaaaacccacaatagatgaaaagatacagttagtaccaaaagcgcaactcggatcttggggtaaaggctcctccgggggcgctaaagctagcgaaacggatgccctccgctccagcgccagctctttaaatagattctccgccctgcaacctccagcccctagcggaagcactccttccactcccgtcgaattcgactcacgccgcactttaacgtctcgcggctccatgggccgagagaagaacgacaagcccctaccctccgccacagccagaccaaatacgtttatgcgggggggctctagcaaagatcttctggacaaccaaagtcaagaggaacagcgccgcgaaatgctggagaccgtgaaacagctcacggggggtgtcgatgtggagaggaattcgacagaggctgagcgtaataaaacaagggaatctgccaaacctgagatcagcgctatgagcgcacatgataaggcagcgctgtctgaggaagagctcgagcggaaaagcaaatccattatagatgaattcctgcatataaacgacttcaaggaagccatgcagtgtgtggaagaactcaatgctcagggcctccttcatgtgtttgtgagggtgggagttgagagcaccctagaacgttctcaaataacacgtgaccatatgggacagctgctctaccaactggtgcaatcagaaaagctatcaaagcaggactttttcaagggatttagcgagacactcgagcttgccgacgacatggctatagacatacctcatatctggctgtatctcgcggaactagtgacacctatgttgaaggagggtggcatctccatgcgcgagctgaccattgagttctctaagcctctcctgcccgttggccgtgccggtgtactcctcagcgagattttacacctcctgtgcaagcagatgtcacataagaaagtgggagcattatggcgcgaggccgatttgagctggaaggactttctgccagaaggcgaagatgtgcataatttcttgcttgagcagaagttagacttcatcgagtcagattccccctgttcttccgaagccctctctaagaaggagctgagcgccgaagagctgtacaagcgtctggaaaagctcatcatcgaggataaggccaacgacgagcaaatctttgattgggtggaggcaaatctcgacgagatccaaatgagttcccctaccttcttgagggccttgatgactgcagtgtgtaaagcagccattattgccgattcttctacctttagagtcgacactgccgtgatcaagcaacgagtacctattctcctgaagtatttggactcggatacagagaaggagcttcaggctctgtacgccttgcaggctagtatcgtaaagctggatcagccagctaatctgctccgcatgtttttcgattgcttgtatgatgaagaggttatttctgaagacgccttttacaagtgggaaagctccaaagatccagctgagcagaacgggaagggggtggctcttaaatcagtgacagccttttttacctggctgcgggaggctgaggaagaatccgaggataactag

SEQ ID NO: 16109 - DNA, 4758 bp, Artificial Sequence
  Description of Artificial Sequence: Synthetic coding sequence
atgaattctcagccccaaacacggtcacccttttttcaaaggccacaaattcagccgccgagagcgactattcccaattccagcccatctataaggcctggagcccagacccccactgcagtttatcaggcgaaccaacatatcatgatggtgaatcacctccccatgccttatccagtgcctcagggcccgcagtactgcatccctcaataccgccactcaggccctccctacgttgggccaccgcaacagtatccagttcagccccctggacctggtccattttaccccggccccgggccaggagattttcctaacgcctatggcacccccttctatccatctcagcctgtgtatcagagcgcacccatcatcgtacctacacagcaacagccacctccggccaagcgggaaaaaaaaactattcgcataagggaccctaatcagggggggaaagacattaccgaggagatcatgtccggaggcggttctcgaaacccaacccctcctattgggaggcctaccagcacgcccaccccccctcagcagctaccgtctcaagtccctgagcatagtcccgtagtgtatggcacggtggagtcagctcatctcgccgcttccacacccgtaacggccgcgtcagatcaaaaacaggaggagaaacccaagccagacccagtgctgaaatcaccatccccagttctgcgcctggtcctgagtggggagaaaaaggaacaggagggacagacatctgaaaccaccgcgatcgtgagtatagctgagctaccgctcccaccctcccccactacagtgagctcggtcgccagaagtaccattgccgcaccaacatcctccgcgctgagttctcagcctatctttacgacagcaatcgatgacaggtgcgagctttcttctccacgggaggacacaattcccataccttctttgacctcttgcaccgagacctccgatcccctccccacgaacgagaatgacgacgatatttgcaaaaaaccttgcagtgtcgcccccaatgacattcccttagtgagctctacaaatctgattaacgagataaacggggtctccgagaagttgagcgcaactgaatctatcgtggagatcgtcaagcaggaggtcctgccgctgacgcttgagctggagatcctcgaaaatccgcccgaggaaatgaaactagagtgcatacccgcacccatcactccttccacagttccatccttcccccctaccccccccacaccaccagcatcgcctcctcacacacccgtgatagttcccgcagctgcgaccacggtgagctcaccatctgccgcaataacagtgcagcgggtcctggaagaggacgagtctataaggacctgcctctcggaggacgctaaggaaatccagaacaagatcgaagtggaggccgacggtcaaaccgaggagattctggacagccagaacctcaactctagacgttcaccggtgcccgctcagattgctatcacagttcccaagacttggaaaaagcctaaagacagaactagaactaccgaggaaatgctagaggctgaattggagctcaaggctgaggaagagctgtccattgacaaggtgctagagagcgaacaggataagatgtctcaggggttccatcccgagcgtgatccatctgacttaaaaaaggtgaaagcagtggaagagaacggtgaggaggctgaacccgtgcgcaacggtgccgagagcgtgtcagaaggcgaagggatcgatgcgaattctgggagtacggatagctccggagatggcgtgactttcccatttaagcctgagtcttggaaacccactgatacagaagggaagaaacagtacgacagggaattcctgctcgattttcaatttatgcccgcttgcatccagaaacctgaagggttgccccccatcagcgacgttgtgctggataagattaaccaacccaaactgccaatgcgtactctggacccaagaatcctgccaaggggccccgactttactcccgcctttgccgatttcggcagacaaaccccaggcggaaggggggttcctctgctgaatgtgggctctcgccgaagccaaccaggacagcgcagggaacctagaaaaatcataacggtttcagtaaaggaagatgtccatctcaagaaggcagaaaatgcctggaagccatcccaaaagagggacagtcaagctgatgaccctgaaaacattaagacccaggaactgtttagaaaggttcgcagcattctcaacaaactgacaccacagatgttcaatcagctgatgaagcaggtgagcggcttaacagtcgataccgaggaacgcctgaaaggggtcatcgatttggtgtttgaaaaggctatcgacgaaccgagcttctctgtagcatacgctaacatgtgtcggtgtctggtcactttaaaagtgccaatggcggacaagccaggcaatactgttaactttagaaaactgctgctcaacaggtgtcagaaggaattcgaaaaagacaaggctgatgacgacgtcttcgagaaaaaacagaaagaattggaggccgcgtctgctcctgaagagaggaccaggctccatgacgagctggaagaagctaaggataaagcccgacggagatctatcgggaacatcaagttcatcggggagctgttcaagttaaaaatgctcacggaggccattatgcacgattgcgtggttaaattgttaaagaaccacgacgaggagtctctggagtgcctctgtagactcttaactactattggcaaggatctggactttgagaaagctaaacctcgaatggatcagtactttaaccagatggaaaagattgtgaaagaacgaaagaccagctcccggattaggtttatgctacaggacgtgatagatctgcggctttgtaactgggtaagccggcgcgccgaccaggggcccaagaccattgaacaaatccacaaggaggctaaaattgaggaacaagaggaacaacggaaagtgcaacagctgatgaccaaggaaaagcgcaggccaggcgtgcagagggttgatgaagggggatggaacaccgttcagggtgcaaaaaacagccgagtgcttgacccctctaaatttctcaagattaccaaaccaacgattgacgagaaaatccagctggtgcctaaagcacagctcggaagttgggggaagggtagctctggcggtgctaaggcctccgagacagacgcattgcgcagttcagcgtcttccctcaaccgctttagtgcgctgcagcccccagccccctctggctccactcctagtacccctgttgaatttgacagtcgcagaacacttacatccagagggtcaatgggacgggaaaagaatgacaagccgctgccctctgctacagcccgtcccaacacatttatgcgaggcgggtcctccaaggatttattggacaaccagtcacaagaggagcagcggcgcgagatgctggaaacagtaaaacaactaactgggggtgtcgacgtagaacgtaattcaaccgaagccgagcgaaataagacccgtgaaagtgcaaaaccagaaatttctgctatgagtgcccacgacaaggcagccctgtcagaagaagagctcgaacggaaatctaaatccataatcgatgaattcctacacattaatgactttaaggaggcaatgcagtgcgtagaggagttgaacgcgcagggtctactgcacgtgttcgtgcgggttggcgtagagtctaccttagaacggagccaaatcacccgggatcacatgggccaacttctctatcaactggtgcagtctgagaaacttagtaagcaagattttttcaagggattctccgagacgctcgaactggccgatgacatggccattgatattcctcatatatggctctacctggcggagctggtgacccctatgctcaaggaaggtggcatttcaatgcgagaactcactattgagttctctaagccactcctgcctgtcggaagggctggagtactgctttcagaaattctgcacctgctgtgtaagcaaatgtctcataaaaaggttggtgccttgtggagggaggccgatctgtcctggaaagacttcctaccggaaggggaagatgtgcataatttcctacttgagcagaagctcgactttattgaatctgactccccctgcagcagcgaggctctctccaagaaagaactgtcagcggaagagctgtacaaacgtctcgaaaagctgatcatagaagacaaggcaaatgatgaacagattttcgattgggtcgaggctaaccttgatgagattcagatgagttcgccaacgtttctccgggctcttatgacagccgtatgtaaagcagctataatagcagacagctcgacgtttcgggtcgatactgccgtgataaagcagcgtgtacctattctgctcaagtaccttgattccgataccgagaaggaattacaggccctttatgcgctacaggcctccatcgtgaagcttgatcaacctgcgaacctgcttagaatgttttttgattgtctgtacgatgaagaggtgattagcgaggatgccttctacaagtgggagtcttctaaggatcccgccgaacagaatgggaagggagtggctcttaagtcagttaccgcttttttcacgtggctacgggaagctgaagaagagtctgaagacaattag

SEQ ID NO: 16110 - DNA, 3087 bp, Artificial Sequence
  Description of Artificial Sequence: Synthetic coding sequence
atggcctctgaagctgtcaaggtggttgtgcggtgccgcccgatgaatcagcgcgaaagggaactcagatgtcaacccgtagtcacagtggactgcgctcgggctcagtgttgcattcaaaacccgggcgccgccgacgaacctccaaagcagttcacgttcgacggtgcctaccatgtcgatcatgtaacagagcagatatataatgaaattgcatacccgttggtcgagggcgtgactgaggggtacaacggcacaatcttcgcatacggtcagacggggagcggtaaatcttttacaatgcagggccttcctgaccctccctcacagcgaggcatcatccctcgggcatttgaacacgtgtttgagtccgtgcaatgtgctgagaacacaaagttcctggtccgagctagttacctggagatctacaacgaggacgtgagggacctgctcggagcggacacgaaacaaaaacttgaattgaaagagcaccccgagaagggtgtgtatgtgaaaggactctctatgcatacggtgcattcagtggctcagtgcgagcatattatggagactggatggaagaacagatcagttgggtacactctcatgaacaaggactcaagcagaagccattccatctttaccatcagtatagagatgtccgccgtagacgaacgcgggaaggaccacttgcgtgcaggtaagttgaacctggtggacctcgctggctctgagcgccagtctaagactggggcaactggagagagactgaaggaggccactaaaatcaatctaagcctcagcgctcttgggaacgttattagcgcgctcgtggacggccgctgcaaacatgtgccctacagagattcgaagctgacgaggctgcttcaggacagccttggaggaaatacgaaaaccctgatggtcgcatgcctgagccctgctgacaacaattatgatgagactttgtccactctgaggtacgccaatcgagcaaaaaatatacggaacaagccaagaattaatgaggacccaaaggacgcactactcagggaataccaggaggaaattaaaaagttaaaggctatcttgacccagcagatgagcccctccagtttgagcgcactgctgagtagacaggtccctcccgatccagtgcaggtggaggagaagctcttaccacaaccggtcattcagcacgatgtggaagcagaaaagcagctgattagagaagagtatgaggaacgtctcgccaggcttaaggctgattataaggctgaacaggaaagcagagctcgactcgaggaggacattactgctatgagaaatagttatgatgtgcgcctttcaactctggaggaaaacctgcgcaaagaaacggaagccgtcctacaggtgggggtgctttacaaagcagaagtaatgtccagggctgaattcgcaagcagtgctgagtacccccctgcattccagtacgaaactgtggtgaagcctaaggtgtttagcaccacagatacactcccgagcgacgacgtgtcaaagacccaggtatccagtcgttttgcagaactgcccaaagtggagccctccaagtctgaaataagtctggggagcagcgagtcctcatccctagaagagacttccgtctcagaggcgttcccaggccccgaggagccctcaaatgtggaagtgtcaatgcctactgaggaatctcggagtcggtactttctggatgagtgcctgggccaggaggcagcagggcacttgctgggagagcagaactatctgccacaggaggagccccaagaagtgccacttcagggactcttgggccttcaggatccatttgctgaggtggaagctaagcttgcccgcctttcatccactgttgcaaggacagatgccccacaggccgacgttccaaaagtgccggtgcaggtgcctgcacccactgatttgcttgagccttccgatgcaagacccgaagcagaagccgccgatgatttccctccccggcccgaggtggacctggctagcgaagtggctctggaagtggtgcggacagccgagccaggcgtatggctggaagcccaagccccagtagcgctcgtcgctcagcccgagccactgcccgccacggccggggttaagcgtgaatcagtgggaatggaggtggctgtgttgaccgatgacccgcttccagtcgtggaccaacagcaagtgctagcccgtctgcagctcctggagcagcaggttgtaggcggagaacaggccaagaacaaagacctgaaggagaagcacaagagaaggaagaggtacgctgatgagcgcagaaagcaactggtcgctgctttacagaactcagatgaagatagcggcgactgggtgctgctgaatgtgtacgatagcattcaggaggaggtcagggcaaagtcaaagcttctggagaagatgcagagaaaattgcgggccgccgaggtggagataaaggatctgcagtcagaatttcagttagagaagatcgactatctggctacaattaggagacaagagagggatagcatgttgctgcaacagctgttggaacaagtgcagccactcattaggagagactgcaattacagtaacctagagaaaatcctcagggagtcttgctgggatgaagacaacggtttctggaagattcctcaccctgtgattaccaagacatccctgccagtggtctcgaccggtccacagaataaaccggcccgaaaaaccagtgccgccgataacggagagcccaatatggaggacgatcgatatcgactcatgctgtcgcgctcgaattcagaaaacatcgcatcaaactatttcaggagcaagagggcgagccagattctgagcaccgatgcacggaagtccctgacacaccataacagcccacccggcctaagttgtcctttgagcaataactcagccattccaccgactcaggcccccgaaatgccccagcctcgcccatttcggctggagtctctggacatcccgttcaccaaagccaagaggaagaagagtaaatctaactttggcagcgagccactgtag

SEQ ID NO: 16111 - DNA, 921 bp, Artificial Sequence
  Description of Artificial Sequence: Synthetic coding sequence
atgcggcagcatgatacacgaaacggtcgtattgtgctcatcagtgggcgccgctctttctgtagcattttcagtgtcctcccctatcgcgattccactcaagtgggcgacctgaagctggacgggggccggcagtcaactggcgccgtgtcactcaaagagatcatagggcttgagggggtggaattgggagccgatggtaaaactgtcagttacactcaatttctgctccctacgaatgcttttggtgccagaagaaataccatcgactcgactagttcgttttcacagttcaggaatctctctcataggagtctctcaattggccgggcaagtggaacacagggctcacttgacacaggttctgacctaggcgactttatggattatgacccaaatctgctcgatgacccacagtggccatgtggcaagcacaagcgggtgcttattttcccctcatacatgactactgtcatcgactatgtgaagccatccgatttaaaaaaagacatgaatgagacctttaaggaaaaattcccccacatcaagctgaccctgtccaaaattcgttcactgaagcgtgaaatgcgcaagttagcgcaagaagattgcggcttggaggaaccaactgtggctatggcattcgtatactttgagaagctcgctctgaagggcaaactcaacaagcagaatagaaaactatgtgccggagcttgcgtgctgcttgcagccaagatcgggtcggacctgaaaaaacatgaggttaaacacctaatcgacaaactggaggagaaattcaggctgaacagacgcgaactgatcgcattcgaattccccgtcctggtcgccctcgagttcgccctgcaccttcctgagcatgaggtgatgccacattacaggagactggtgcagtcatcctag

SEQ ID NO: 16112 - DNA, 2820 bp, Artificial Sequence
  Description of Artificial Sequence: Synthetic coding sequence
atggcagcgcagccaccgcgtggtatcagattgagtgcactgtgccctaagtttctccacacaaacagcacctcccacacgtggccattttccgctgtcgccgagctgatcgacaacgcatacgaccctgacgtcaatgccaaacagatatggatcgataagacagtgattaacgatcacatctgtttgactttcactgacaacgggaacggaatgacatctgataaattacataagatgctctcctttggattctctgacaaggtcacaatgaatggccacgtgcctgtgggcctgtatggaaatggatttaagtccgggagcatgcgcctgggaaaggacgcaattgtgttcactaagaacggcgagagcatgtcagtgggcctgctcagccagacatacctcgaagtcattaaagcagagcacgttgttgttccgatagtggcttttaataaacaccgacagatgataaatctagcagaatcgaaggcctcgctggcagccatcctggaacatagcctcttctccaccgagcagaagctgctggccgagctagacgccatcataggaaagaagggcacccgcattattatatggaacctcaggtcatacaagaatgccaccgagtttgatttcgaaaaagacaagtatgatatacggatacctgaagacttggacgagatcacaggtaagaagggttataagaaacaggagcggatggaccagatcgcccccgagagcgactatagcttgcgcgcatactgcagtatcctgtacctgaaaccaaggatgcagatcattctgcgtggacaaaaggttaagacacagttggtcagtaagagcctggcctatattgaaagggacgtgtaccgtccgaaattcctgagcaaaacagtacggatcacctttggcttcaactgtagaaataaagaccactatggcattatgatgtaccatagaaatcggctgattaaggcttacgaaaaggtgggctgtcagctcagggctaacaatatgggcgtaggtgtcgtgggaattatcgagtgcaattttctcaagcctacacacaataagcaggactttgactatacaaacgagtatcggctcactatcaccgcattgggggagaagcttaacgactactggaatgagatgaaagtcaaaaaaaacacggagtaccccctaaatctgcctgtagaagacatacagaaaagacctgaccagacatgggtccagtgcgatgcatgcttaaagtggaggaaacttccagacggaatggaccagctgcctgaaaaatggtattgtagtaacaatcctgatccacaattccggaactgcgaagtgccggaggagccggaagatgaggacctggtccaccctacgtatgaaaagacctacaagaaaactaataaggagaagttccgcatccggcagccagagatgatcccacgaataaatgctgagctgctgttcagacccacagccctgtctacaccctctttttcctctccaaaagaaagcgtacctcgaaggcacctgtctgagggcaccaattcatacgccaccaggctgctgaacaatcatcaagtgcccccacagtccgaaccagagagcaattcacttaagcgaaggttgtctactcgaagctccatcctaaatgctaagaacagaagattgagctcccagttcgaaaacagtgtttacaagggggacgatgatgatgaagacgttataatccttgaggagaactccactccaaagcccgccgtggatcatgacatagatatgaagagtgagcaatcacacgtggaacagggcggagtccaagtggagttcgtgggcgactctgaaccatgtggccagacaggcagtacctcaacttccagcagccgctgtgatcaaggcaacaccgcagctacacagacagaggtaccgtctctggtggtcaagaaggaagaaacagtcgaggatgaaatagatgtgagaaacgatgccgtgattttgccatcttgtgtggaagccgaagcaaaaatccacgaaacccaggagacaactgataagtctgccgacgacgcaggatgtcaactacaggagctgcgtaaccagctgctgctcgtcacagaagaaaaagagaattacaaaagacagtgccatatgttcactgatcagataaaggtcctccagcagcgtattctggagatgaacgacaaatacgtgaagaaggagacttgtcatcagagcaccgagactgacgccgtgttcctgctcgagagtattaatggcaaaagcgagagcccagaccatatggtgagccaatatcagcaggccctggaagagatcgagagacttaagaaacagtgctctgctctgcagcacgtgaaagccgaatgctcgcagtgttccaataacgaatctaaatcggagatggacgagatggctgtacagcttgatgatgtgttcaggcaactggacaaatgtagtatcgaaagagatcagtataaatctgaggtcgaactcctcgagatggagaaaagccagatacggtctcaatgcgaggagttgaaaaccgaggttgagcagctgaaatcaactaaccagcagacagctacagatgtatccacctcctccaatatagaagagagtgtcaaccacatggacggtgagagcttgaagcttagatccctgagagttaatgttggacagctgctggctatgatcgttcctgacttggacctgcagcaggtgaactatgatgtggatgtagtggacgaaattttgggccaggttgtggagcagatgtccgagatatctagtacctag

SEQ ID NO: 16113 - DNA, 1149 bp, Artificial Sequence
  Description of Artificial Sequence: Synthetic coding sequence
atgtccgcagcaaacccagaaactcctaattccacaatttcacgggaagcctccactcagagttcatctgccgccgcatcccagggctgggtcttgcctgagggcaaaattgtaccaaacaccgtgttcgtcggcggaatcgatgcacgtatggatgaaaccgaaatcggcagctgctttggccggtatggcagtgtaaaggaagttaaaatcattaccaaccgcacgggggtgtctaaaggctatggatttgtgtctttcgtcaacgacgtggatgttcaaaagatagtggggagtcagatccatttccatggaaaaaagctcaaactgggcccagctatccgcaagcagaagctgtgtgcaagacatgtgcaacctcgccccctagtggttaacccccctcctccaccacagttccagaatgtgtggcgcaacccaaatacagagacctacctgcagccacagattaccccaaatcccgttacacagcacgtgcaggcatacagtgcttatccacacagccctggccaagttattacagggtgccagctcctggtttacaactatcaggaataccccacatacccagactccgctttccaggtgacaactggataccaactcccagtgtataactatcagccatttcccgcctaccctcgcagtcctttccaggtgaccgctgggtatcaactgcccgtttacaactatcaggccttcccagcttacccaaattcgcccttccaggtggcaaccggatatcaattccccgtttataattaccagccattccccgcctatccatcctcgccatttcaggtgacagctggatatcagctgccagtttacaactatcaagcctttcctgcatatcctaactctccctttcaggttgcaacgggctatcagtttcctgtgtataattaccaagcgtttcctgcatatcccaattcccccgtccaggttactaccggatatcagctgcccgtgtacaattaccaggcatttcctgcttatcccaattctccattccaggtagcgacgggataccagttcccagtgtacaactatcaagccttccccgcctacccgaatagtcccgtacaagtcacaaccgggtaccagttgcctgtgtacaattaccagtag

SEQ ID NO: 16114 - DNA, 5058 bp, Artificial Sequence
  Description of Artificial Sequence: Synthetic coding sequence
atgtccctgcctttctaccagcgctgccaccaacactatgacctctcttacagaaataaagatgtgaggtctactgtgtctcattatcagcgggagaagaaacgttctgccgtgtacacacaagggtcaacagcttacagctcacggtccagtgcagcccatcggagggaatcagaggcgttccggagagcctccgccagctcttcacagcagcaggcctcccagcatgcgctgagcagcgaggtttcccggaaagcggcatccgcctatgattatggcagctcacacggcttaactgactcctccctcttattagacgattattcctccaaactcagccccaagcccaaaagggctaaacactccctgttaagcggcgaagaaaaggaaaacttgcctagcgactacatggttcctatatttagcggtcgccagaagcatgtcagcggcatcacagataccgaggaggagcggatcaaagaggctgctgcctatattgcgcagcggaaccttctggccagcgaagaaggcatcaccaccagcaagcagtccaccgcgtccaagcaaacgaccgcatctaagcagtccactgcttctaaacagtctactgcaagcaagcagagcactgcaagccgccagtccaccgctagtaggcaatctgtagtgagcaagcaggctacttcagctctgcaacaagaagagacttctgaaaaaaagtcgaggaaggtagtcattagggagaaagcagagagactgagcttgcgaaagaccctcgaggagaccgagacctatcatgccaaactgaatgaggatcacctactccatgccccggagtttattattaagcctcgctctcacaccgtgtgggaaaaggagaacgtcaagttacactgttctatcgcaggttggccggaaccccgcgtgacatggtataagaaccaggtccccatcaatgtgcatgctaatcccggaaaatacatcatcgagtcacgctatggcatgcataccctggagataaacggctgcgacttcgaagatacagcccaatatagagcctcggccatgaacgtgaagggggagttgtctgcttatgcaagcgtggtcgtaaagaggtataagggtgagtttgatgagacccgattccacgcaggcgcttccactatgcccctatcttttggagtcactccctatggctacgcttcgcgctttgagatccacttcgatgacaagttcgatgtgtcattcgggcgggagggagagaccatgtccctcgggtgtagggtggtgatcactccagagatcaagcactttcagccagaaattcagtggtacagaaacggcgtgcctctatcaccttctaagtgggtgcagactctgtggtccggggaaagagccaccctgaccttctcacacttaaacaaagaggacgaggggttgtacaccatcagggtaagaatgggtgaatactatgagcagtatagcgcctacgtattcgtgcgagacgccgacgcagaaattgaaggcgctcccgcagctcctctggatgtgaagtgtctggaggccaacaaggattatattattatttcctggaagcagcctgccgttgatggaggtagccccattctgggatacttcatagacaagtgcgaggttggcaccgactcatggagccaatgcaacgacactcccgtgaaatttgccagatttcccgtcaccgggctcatcgaagggcggagctatatatttcgggtgcgagcagtcaacaaaatgggtattgggtttcccagtagggtgtccgaaccagtcgctgccctggatccagcagagaaggctcggctgaagagccgacccagcgccccctggacagggcagattatcgtaaccgaagaagaaccttcagagggcatcgtgcccggtccacctaccgatctgtcagtcaccgaggcaacacgatcctatgtcgtactctcttggaagccccctgggcagcgtggacacgagggaatcatgtacttcgttgagaaatgcgaggctggtacagagaactggcagagggtcaacaccgagctccccgtgaagagtccacgattcgccctctttgacctcgccgaaggaaaatcttactgttttcgcgtccggtgcagcaacagtgccggcgtgggagagccttctgaggctaccgaggtgactgtggtgggcgataaactggacattccaaaagcgccgggaaagattattccttcacggaatacagatactagtgtggtggtaagttgggaggagtcaaaggacgctaaggagctggtgggctattacattgaagcttctgtagcagggtcaggcaagtgggagccttgcaataacaatcccgtgaaaggatcacgcttcacttgccacgggctggtgaccgggcagtcttacatcttccgtgtgcgtgctgtcaacgctgctggcttgtctgaatactcccaggattcagaggccattgaggttaaagctgccattggcggaggtgtgagccctgatgtgtgccctgcactgtctgatgagcctgggggcctcacggcctctcgcggccgcgtgcatgaagcgtcccctcccaccttccagaaagacgcactgttgggaagcaagcctaacaaaccgtcactcccttcgagcagccagaacctgggccagacagaagtgagtaaggtgtccgagactgtgcaggaagaattgacacctcctccacagaaggctgctccccagggtaaatctaaaagtgacccactcaaaaaaaaaaccgatcgagctccaccttctcccccctgtgatatcacgtgtctagagagtttcagagacagcatggtgctgggatggaaacagcctgacaagatcggaggcgccgagattacgggttactatgtcaattaccgagaagttattgacggtgtgcctgggaaatggcgggaggccaacgtgaaagctgtctccgaggaggcatataagatctctaatttgaaagaaaatatggtctaccagttccaggtggccgctatgaacatggctgggctcggagcaccctccgccgtcagcgagtgtttcaagtgtgaggaatggaccatcgccgtgccagggccccctcactccttgaagtgctccgaggtacggaaagatagtcttgtactccagtggaagcctcccgtgcatagtggcaggacccccgtgactggctacttcgtggatttgaaggaagctaaagccaaagaagatcagtggcggggactgaacgaggctgccataaaaaatgtgtacctgaaagtcagaggtctcaaagagggagtcagttacgtcttccgggtgcgcgccataaatcaggccggcgtggggaaaccgtccgacctggctggacctgtagtggcggagaccaggccaggcactaaagaggttgttgtgaacgtggacgacgacggggtgatcagcctaaactttgagtgcgacaaaatgaccccaaagtccgagttttcctggtccaaggactacgtaagcaccgaggattctccccgtctggaagtcgagagtaaaggaaacaaaacaaaaatgacttttaaggatttagggatggacgacctagggatctacagttgtgacgtgacagacactgatgggattgcctcgtcttaccttattgacgaggaggaattgaaacgcctccttgcactctctcacgaacataagttccccacggtgccagtcaaatctgagcttgctgtagagatcttagagaaaggtcaggtgagattttggatgcaggcagaaaaattgagcgggaatgcaaaagtgaactatatcttcaatgagaaagaaatctttgaaggccctaagtataagatgcatatcgataggaacaccggtatcattgagatgtttatggaaaaactgcaggatgaggatgaagggacttacaccttccagctccaagacgggaaggctactaaccactctaccgttgtcctagtgggcgacgtgtttaaaaagcttcagaaggaagcggagttccaacggcaagagtggattaggaaacaaggacctcacttcgttgagtatctcagttgggaggtgaccggagaatgtaatgtgctacttaaatgtaaagtggcaaatataaagaaagaaacccacatagtgtggtacaaggatgagcgagagattagcgtcgacgagaaacacgacttcaaggatggtatatgtactttgcttattacagagttctctaagaaggacgccggaatctatgaggtgattctgaaggacgaccgtggcaaggacaagagcaggctgaagcttgtggacgaggcatttaaggaactcatgatggaggtgtgcaaaaagattgctctctccgctacagacttaaaaatccagtctaccgccgagggcatccaactatactcatttgtgacttactacgtggaggacctcaaagttaattggagccataacggctcggccataagatactctgatagagttaagaccggcgttacaggggagcagatatggttgcagattaacgaacccacgcccaacgacaagggaaaatacgtcatggagctgtttgacgggaagaccggtcatcagaagacagtcgatttgtcaggacaggcctatgacgaggcctacgccgaattccaacggttgaagaagagcctgctgttccaaaaggatagagcccgcgttctgggcggcctccccgacgtcgtcaccatccaggaaggaaaagccctgaatctgacatgtaatgtgtggggggacccaccgccagaggtgagctggcttaaaaacgagaaagctctggcaagcgatgaccactgcaaccttaagtttgaagcaggacggacggcatacttcacaatcaatggtgtgtcaaccgcagacagtggaaagtatggactcgtggtaaagaacaagtacgggagcgagacgtctgatttcactgtatcagtcttcatcccggaagaagaagccaggatggctgccctcgaaagcctgaaaggcgggaagaaggccaagtag

SEQ ID NO: 16115 - DNA, 3456 bp, Artificial Sequence
  Description of Artificial Sequence: Synthetic coding sequence
atgatggccgcggccctcggcccccccgaagtcatcgcacagcttgagaatgctgcgaaggtgctaatggctcccccatcgatggttaataatgagcagcgccagcacgctgaacatatcttcctgtccttccgcaaaagtaagagcccattcgctgtttgtaagcatatcctggagaccagcaaagttgactacgtgctgttccaggctgcgaccgctatcatggaagccgtggttagagagtggattcttttggaaaagggttctatagaatcactgcgcacatttctccttacctatgtactccagagacctaatctgcagaagtacgttagggaacaaatcttgcttgcagtagctgtcatcgtgaagaggggcagtttggacaagtccatcgattgtaagtcaatttttcatgaagtgtcgcagttgatatcctccggaaacccaaccgtacaaaccctggcctgtagcattctcactgcccttttaagtgagtttagttcttctagcaagacctccaacataggactgagtatggagtttcacgggaattgtaagcgggtgtttcaggaggaagacttacgtcaaatcttcatgctgacagtggaagtactccaggagtttagcagacgggagaatctgaacgctcagatgagcagtgtattccaacgctatctggcccttgccaatcaggtgctgagttggaattttctcccccccaaactgggccgccattacatcgcgatgttcgaatcgtcccagaatgtcttgctaaaaccaactgagtcctggagagaaaccctcctggattcaagagtgatggagctcttctttactgtgcaccgcaagataagggaagacagtgatatggcacaggatagtctacagtgcttggcgcagttggcctccctgcatggacccatctttcctgatgaagggagtcaggtcgactacctggctcacttcatcgaagggttgctcaataccattaacgggattgagatcgaggactcggaggccgttgggatatcaagtattatcagcaatttgatcacagtcttccctcggaacgttctgaccgccataccttccgaattattttcttcctttgtgaattgcctaacgcacctgacctgttctttcggccgctctgccgccctggaggaggtgctggataaagacgacatggtctatatggaagcttacgataaattacttgaaagttggttaactctagtccaagacgataagcattttcacaaaggctttttcacccagcatgctgtacaagtttttaactcatatattcagtgtcacttggccgcccctgatggaactagaaacctgacagctaacggcgtcgcatcaagagaggaggaagagattagtgagctccaggaagacgaccgggatcagttctccgaccagctggctagtgtcggcatgttaggcaggatcgcagccgaacattgcatcccactgttgacatcactgctcgaggaacgcgtcactagattacacggccagctccagagacaccaacagcagctgcttgcatctccggggtctagcaccgtggacaataaaatgctggacgatctctatgaagacatacactggctgattctcgttacaggataccttttggccgacgacacacagggggaaacgcctttaattcctccagaaattatggaatactccatcaaacactctagcgaggtggatatcaatacgacattgcagattttgggaagcccgggggagaaggccagcagcattccggggtataatcggactgactctgtgatcaggctgctttcagccattttgagggtttcggaggtggaatccagggcaattcgggcagacctaacgcacctcctgtcaccacaaatgggaaaagacatcgtctggttcctgaaaaggtgggccaagacgtacctcttagtcgacgagaagctgtatgaccaaatctccctgcccttttccaccgcattcggggccgacactgaaggatcccaatggatcataggatatcttcttcagaaggtgatctccaatctgtccgtgtggtcttcagagcaggatctagctaacgacaccgttcagctgctggtaacactcgtcgagcgtcgggagcgggccaatctggttattcagtgcgaaaattggtggaacttggccaagcagtttgcttcccgctccccccctttgaacttcctttcttcgcctgtacagaggacgctgatgaaggcactcgtcctgggagggttcgcccatatggatactgagacgaaacagcagtactggacagaggtgttgcagcctctacaacaacggttcttgagagtgattaatcaggaaaacttccagcagatgtgccaacaggaagaagtgaagcaggagattacagccacgctcgaagccttatgcgggatcgccgaggctacccaaattgataacgttgcgatcttattcaatttcctgatggacttcctaactaattgcattggactgatggaagtgtacaagaacacacccgaaaccgtgaatctgataatagaggttttcgtggaagtggcccacaagcagatatgttacctcggagagtcaaaggccatgaatctctacgaagcctgcctcaccctgctgcaggtatactctaagaataacctcggccgacagcggatcgatgttactgcggaggaagagcagtaccaggacttgttactcatcatggagctgctcacaaatcttctgtcaaaggaattcatcgatttttccgacaccgacgaagtgttcaggggtcatgagccagggcaagcagctaacaggagtgtctcagctgcagatgttgtgctatatggtgtaaacctcattctgcctttgatgtcccaggacctgctcaaatttccaactctgtgtaatcagtactacaaacttattacttttatttgtgagatctttcctgagaagatcccacagcttccggaggatctattcaagagcctgatgtactccctcgagctcggtatgacttctatgtcgtccgaagtgtgccagttgtgtttggaagccctgacacccttggcagagcagtgtgctaaggctcaggaaacggacagcccgttattcctggcaacccgtcattttttaaaacttgtctttgatatgttggttcttcagaaacacaacacagaaatgacaaccgctgcaggggaagcattttacaccttagtgtgtctccaccaggccgagtattccgaactcgtggagaccctccttagctctcagcaggatcccgtgatttaccagaggctggctgatgcttttaataagctcactgcatcttctacccccccaaccttggacaggaagcagaaaatggccttcctgaagtcactcgaggagtttatggcgaacgtgggcggactgctgtgtgttaagtag

SEQ ID NO: 16116 - DNA, 420 bp, Artificial Sequence
  Description of Artificial Sequence: Synthetic coding sequence
atgggaggcggggagcggtacaacatccccgccccacagtcaaggaatgtttccaaaaatcaacagcagctgaatcggcagaagaccaaggagcagaactcccagatgaagattgttcataaaaagaaggaacggggccacgggtacaactccagcgccgcggcctggcaggcaatgcagaacggtggcaagaataagaactttcctaataaccagtcttggaattcttccttgtccggcccccgcctcctgtttaagtcacaggccaaccagaattacgcgggcgccaaattcagcgagcccccgtccccgagtgtgctgccaaaaccgccctcccactgggtgcccgttagctttaacccaagcgacaaggagatcatgacatttcaactgaagacactgctcaaagtccaggtctag

SEQ ID NO: 16117 - DNA, 984 bp, Artificial Sequence
  Description of Artificial Sequence: Synthetic coding sequence
atgaaagagatgctagccaaggatctagaagagagtcagggggggaagagcagtgaggtactgtcggctacagagcttcgggtacagctggcgcagaaggagcaggaactcgcccgcgcaaaggaagccctacaggccatgaaggctgaccgtaaaagattaaaaggcgaaaaaacagacctggtgtctcagatgcaacagctgtacgccacactggagtctagggaggaacaactgagagacttcattaggaattacgaacagcacagaaaagagtcggaagatgcggtgaaagctttagcaaaagagaaggacttactcgagagagagaagtgggagttacggagacaagccaaggaggcgactgaccacgctaccgcccttagaagtcaactggacctgaaggataaccggatgaaggagttagaagcagagctcgcgatggctaagcagagtctcgccactctaaccaaggacgttcccaagcggcattctctggcaatgccaggggaaaccgtgctgaacgggaaccaggagtgggtagtacaggccgacctacctctcactgctgccattaggcagtcgcagcaaaccctgtaccacagtcaccccccacatcctgcagaccgccaggccgtgcgcgtttcaccctgccacagtcgtcagccttcagttatcagtgacgctagcgcagctgaaggcgatagaagcagtactccctcagatattaattcccctaggcaccgcacgcattctctctgcaacggcgacagtccaggccccgtgcagaagaatttgcacaatcccattgttcagtcccttgaggatctggaggaccaaaagcgcaaaaagaaaaaggaaaaaatgggctttggctccatctccagggtctttgctaggggaaagcagcgcaaatcccttgaccccggcctgtttgatggtaccgcaccggactactacatcgaggaagacgccgattggtag

SEQ ID NO: 16118 - DNA, 984 bp, Artificial Sequence
  Description of Artificial Sequence: Synthetic coding sequence
atgaaggaaatgttggcaaaggatctggaagaatcacaggggggcaagagcagtgaggtgctgtccgcaactgaactccgcgtgcagctggcccagaaagaacaggagttggctcgagccaaggaagctctgcaggcaatgaaggccgaccggaaaagactcaagggggaaaagaccgacctggtgtcgcaaatgcaacagctgtacgctacactggaaagccgcgaagaacaactccgagattttatccgaaactacgaacagcacagaaaggagtctgaggatgccgtgaaagccctggcgaaagaaaaggatctactggaaagggaaaagtgggagctgcgccgacaagcgaaggaagccacagaccatgccactgcccttaggtctcagctggatttgaaggataaccgtatgaaggaattagaggctgaactcgccatggccaaacagtccctggcgaccctgacgaaagatgtgccgaaacggcacagcttggcaatgccaggggagacagttctaaacggcaatcaagaatgggttgtccaggctgatctgcccctgacagcagcaatccggcaatcccagcagacactgtaccatagccacccccctcatcccgcggaccgccaagcggttcgggtttccccctgccacagccgccagccctcagtcatttctgatgcctccgctgctgaaggcgacagaagctccacaccttctgatatcaacagcccgagacatcggacccactccctgtgcaatggcgactcccccggtcccgtccaaaaaaatttgcacaatccaattgtgcagtccctggaggacctcgaggaccagaaacggaagaaaaaaaaggaaaagatggggtttgggtcaatatctagagtgttcgcccgcggaaagcaaagaaagagcctagatccaggcctgttcgatggaacagccccagactactacattgaagaggatgccgattggtag

SEQ ID NO: 16119 - DNA, 609 bp, Artificial Sequence
  Description of Artificial Sequence: Synthetic coding sequence
atggatgagcaggcccttttgggcctgaatccgaatgccgattctgattttaggcagagagccttggcatatttcgaacagctgaagatctcccccgatgcgtggcaggtgtgcgccgaggcgttggctcaaagaacttactcagatgatcatgttaaatttttctgtttccaagtgctcgaacaccaggtgaagtacaagtattctgagctgaccaccgtgcaacagcagcttattcgagagacactgatctcatggctccaggctcagatgctaaatcctcagcctgaaaagacatttatcaggaataaagccgcccaagtgttcgctctactcttcgttacggaatacttgactaagtggcccaaatttttcttcgatatcctgtcagttgtagatctcaatccccggggggtcgatctttacctcaggattctgatggctatcgacagtgagctcgtcgaccgagatgtagtccatacgtctgaagaagctaggcgaaacacactcattaaagacaccatgagggaacagtgcatccctaacctggtagagtcctggtaccagatcctgcagaactaccagtttactaacagcgaggtgacctag

SEQ ID NO: 16120 - DNA, 1803 bp, Artificial Sequence
  Description of Artificial Sequence: Synthetic coding sequence
atgtctagagttgcgaagtaccgcaggcaagtgagtgaagaccccgatattgactcactgctcgaaacactgtccccagaggaaatggaagagctagaaaaagagctggatgttgtagaccctgatggctcagtgccagtggggttacgccagagaaatcagacggaaaagcaatccaccggggtgtacaatcgcgaagcgatgctaaacttttgcgaaaaggaaaccaaaaagctcatgcaaagagaaatgtctatggacgaatccaaacaggtggagaccaagacagacgccaagaacggcgaggaacgcggcagagacgcctccaaaaaagctctaggccccagacgcgatagcgatctcggaaaagagcctaaacgtgggggcctcaagaaatcgttctccagagaccgcgacgaggctggcggcaagagcggcgaaaagccgaaagaggaaaaaatcattcgcggcattgacaaaggaagggtgcgagccgcagtagacaagaaagaggcaggcaaagacggccggggcgaagaaagagcagtggctaccaagaaggaggaggagaagaagggctcagatcgcaacacaggactcagccgggataaagataaaaagcgcgaggaaatgaaagaggtagcaaagaaggaggacgacgagaaggtgaagggcgaacgtcgcaacactgatactaggaaagaaggcgaaaagatgaaacgagccggaggaaacacagatatgaagaaggaggatgaaaaggttaagcggggtacaggcaatacggacaccaaaaaagacgatgagaaggtaaagaagaatgaacctctgcacgaaaaagaggccaaagacgatagcaagacgaaaacccccgagaaacaaactccttccggccccaccaaaccctctgaagggcccgctaaggtcgaggaggaagctgccccctccatattcgatgagccgcttgaacgggtgaagaataatgatcccgagatgactgaagtcaatgttaacaacagcgattgcatcactaacgagattctcgtgcggtttacggaggcgctggaattcaataccgtagttaaattgtttgccctcgctaatacgagagccgacgaccatgttgcattcgccattgccatcatgttgaaggcaaataaaactatcacaagcctcaacctcgattctaaccatataacaggtaaggggatcctcgctatcttccgcgctttgctgcagaacaacactctgactgagcttcggttccataaccaacgccatatttgtggcggcaagaccgaaatggaaattgccaagctccttaaagaaaatacaacactccttaagctcggataccacttcgaacttgccggcccgaggatgaccgtgacaaatcttctctcccggaacatggacaagcagcgacagaagcggctgcaagagcagaggcaggcccaggaagctaagggcgagaaaaaggatttgctggaggtccccaaagcgggtgccgtggctaagggctctcctaagccgtcaccacaaccaagcccaaagccctctccgaaaaactcacctaagaaggggggagctcccgctgctccaccccctccaccaccgcccttggcacccccactgataatggaaaacctcaaaaactcactgtcccctgccacccagcgaaaaatgggtgacaaggtcctgcccgctcaagaaaagaactcgcgggatcaactgctggctgctattcgctcttctaatctgaaacagctcaagaagctggaactgcccttactgcttcagtag

SEQ ID NO: 16121 - DNA, 201 bp, Artificial Sequence
  Description of Artificial Sequence: Synthetic coding sequence
atgataggcaccacggaagttccctgctgtggcccttctgctacatgggccctcagatggagtgatcagataaccttgccttctctgccttggacaatgagctctctgtggtgcatcccgctaaaggggatgctggctacttgccccgtgtcgttgcttgaacatgcctactccaacgccctaagaggctggaaaccctag

SEQ ID NO: 16122 - DNA, 2121 bp, Artificial Sequence
  Description of Artificial Sequence: Synthetic coding sequence
atggctacagccaattttgggaagatccagatcgggatctacgttgaaattaagcgctccgacggtcgtattcaccaggctatggtgaccagcctaaatgaggataatgagtctgtgactgtcgagtggattgagaacggagacacaaaaggaaaagagattgatctggagtctattttcagtctcaacccggacttggtcccagatgaagagatcgaaccctctcccgaaacgccaccgccgcccgcctcaagtgccaaggtaaacaaaattgttaagaatcggcggacagtggccagcattaaaaacgatcctcctagccgcgataaccgagttgttgggtctgcccgcgccagaccttcccaatttccagaacaaagcagctcggcccaacagaatgggagtgtgtccgatattagccccgtgcaggcggccaaaaaagaattcgggccgccttcccgtaggaagagcaattgtgttaaggaagtcgaaaagctccaagagaagcgcgagaagcgcaggctgcagcaacaggagctgagggaaaaacgggcacaagacgttgatgccactaacccaaactacgaaataatgtgcatgattcgggactttcgagggtctttagattacaggcctctgaccaccgccgatcccattgatgaacaccgcatatgtgtgtgcgtaaggaaacgccctctgaataagaaagaaacacaaatgaaagacctagacgtgattacaatcccttccaaggacgtagtgatggtacacgaacccaaacagaaggtggatttaacacgttacttggaaaatcaaacgtttagattcgactacgcattcgacgactcggcccccaacgagatggtctatcgctttaccgctcgcccgcttgttgagacaatctttgagaggggtatggcaacctgcttcgcatacggccaaaccggatctggaaagactcacacaatgggtggcgactttagcggcaaaaaccaggattgctctaaaggaatctacgccctggctgccagggacgtgtttttaatgttaaagaaaccaaactacaaaaagctggaactgcaggtgtatgccaccttttttgaaatatactctgggaaagtttttgatctcctcaaccgcaaaacaaaactgagggttctggaagacggaaagcaacaggttcaggtagtgggtctccaggaaagggaagtcaagtgcgtggaagatgtgttgaagcttatcgatattggaaattcctgcaggacttccgggcagacaagtgccaatgcacactccagccgatcgcatgctgtgtttcagatcattctgagaaggaagggaaagctgcacggaaagttctcacttattgacctggccgggaatgagagaggagcagacactagttctgctgaccgccaaactcgcctcgaaggtgccgagattaacaaaagcttacttgctttgaaggaatgcattcgcgctttagggcgaaataagccccatactccatttcgagctagcaaactaactcaggttctgcgcgattccttcatcggggaaaatagccgtacttgtatgattgcaacgatcagccctggaatggcaagctgcgagaataccctgaacacattacgctatgccaacagagtgaaggagcttactgtggatcccacagctgctggcgatgtaagacctattatgcaccaccccccgaaccagatcgacgatcttgagacacaatggggcgttggttcatcaccccagagagatgatctgaagctgctctgtgagcagaatgaagaagaagtatctccgcagctgtttacgtttcatgaggccgtgagccagatggtcgaaatggaggagcaagtggtggaggatcaccgcgccgtgtttcaggaatcaattcgttggctcgaggacgagaaggcattgctagagatgacagaggaggtggactatgacgttgattcatatgcgactcagttggaggcaatcttggagcagaaaatcgatatactgacggaattacgtgacaaggtgaagtccttcagagcagccctacaggaagaagagcaggcctcaaagcagattaatccaaaaaggccccgcgccctctag

SEQ ID NO: 16123 - DNA, 1281 bp, Artificial Sequence
  Description of Artificial Sequence: Synthetic coding sequence
atggcacaccttcggggctttgcaaatcaacactcccgggttgatccggaagaacttttcacgaagctggacagaattgggaagggtagtttcggagaggtatacaagggaatcgacaatcatactaaagaggtagtcgcaattaaaataatcgatctggaggaagccgaggacgagatcgaggacattcagcaagaaattactgttctgagccagtgcgactccccatacataactagatatttcggaagttatctaaaatccaccaagttgtggattatcatggagtacctgggaggaggatccgccctcgacttactcaagcctggtcctctagaagagacatacatcgctacaattctgcgcgagatcctgaaagggctagactacctgcatagtgagcgcaaaattcaccgcgacatcaaagcggctaatgtactgttaagcgagcaaggcgatgtgaaattggctgattttggcgtagcaggacagctgaccgatacacaaatcaagaggaatacctttgttggaaccccgttctggatggcccctgaggttattaaacagtctgcatatgacttcaaggctgatatttggtctctcggaatcaccgcaatagaactggctaaaggtgaaccacctaactccgacctgcaccccatgagggtattgttccttatccctaagaactccccacccacactggagggccagcactccaagccgttcaaagagtttgttgaggcttgtttaaataaagatccaagatttcgccccacagctaaggagctgctgaagcacaagttcattacaaggtacaccaaaaagaccagttttctcacggagcttattgacagatacaaacgctggaagtcggaaggacacggcgaggagagttcttcagaggatagtgacattgatggcgaggccgaggatggggaacaggggcccatctggacttttccaccaacgatacggcctagcccacacagcaagttacataaaggcaccgctctgcacagctcacaaaagcccgccgagcctgttaagcggcaacccagaagccaatgtctgagtacccttgtgagacctgtcttcggtgaattaaaggaaaaacacaagcagagcggagggagcgtgggggctttggaagaactagaaaacgctttcagcctggctgaggaatcatgcccgggtatctccgataagctgatggtccatctggtggagcgagttcagagattcagtcacaaccgtaaccacctgacatcaacccggtag

SEQ ID NO: 16124 - DNA, 996 bp, Artificial Sequence
  Description of Artificial Sequence: Synthetic coding sequence
atgctcaggtgcggacagatgatcttcgcacaggcacttgtgtgtagacaccttggtcgggattggaggtggacccagcggaaacggcaacccgacagctacttctccgttctcaacgccttcattgaccgcaaagacagttactactctattcatcagatcgcgcagatgggcgtgggtgagggcaagagtattgggcagtggtacgggcctaacaccgttgcgcaagtgctgaagaagcttgccgtcttcgatacctggtcatctctggcagtccacattgccatggataatacggtcgtaatggaagagatcagacgtctgtgccggacctcagttccatgcgccggggccacagcctttcccgccgattcagatcgccattgtaacggctttccggcgggcgcagaggtgactaatcgtccctcaccttggcggcctctggtgttgctgatccctctaaggttgggtcttaccgacatcaacgaggcctacgtggagaccctgaagcattgcttcatgatgccacagagtctaggggtcataggtggcaaaccaaatagcgcacactatttcatagggtatgtcggcgaggagctcatctacctggatccccacaccacccagccggctgtggagccaacagatggatgtttcattcctgatgagtcctttcattgtcagcatccaccttgtagaatgagtattgccgagcttgacccctcaattgccgtcggatttttttgtaaaacggaggacgatttcaatgactggtgtcagcaggtgaaaaaactgagccttttgggcggcgctctccctatgttcgagctggttgagctgcagccctcccatctcgcgtgccctgacgtgctaaatttgtcacttggagagtcctgtcaggtacaagtgggcagtctcggggactctagcgatgtggagcgactggagcgatttttcgacagcgaagacgaggactttgagatcctgagcctctag

SEQ ID NO: 16125 - DNA, 1461 bp, Artificial Sequence
  Description of Artificial Sequence: Synthetic coding sequence
atgtcggtaacctacgatgattccgtgggagtggaggtgtcaagtgattcattttgggaggttggaaactataagcggactgttaaacgaattgacgatggtcacaggctgtgcagcgatctgatgaattgcctccacgagagagcacgcatcgaaaaagcctacgcccagcagcttacagagtgggctcgccgttggcgccagttagtggagaaggggcctcagtacggcacagtagagaaagcctggatggcatttatgagcgaggccgaacgcgtcagcgaattgcacctagaggtgaaggcatccttaatgaacgacgacttcgaaaaaataaagaactggcagaaggaggctttccacaagcaaatgatgggtggctttaaagaaaccaaagaagcagaggacggctttcggaaagcacagaagccgtgggcgaagaagttaaaggaggtggaagctgctaaaaaagctcaccatgcggcttgcaaagaagaaaagttggctatttcgcgggaggccaacagtaaggccgatccaagcctaaacccagagcagcttaaaaaactacaggataaaattgaaaaatgcaaacaggacgttctcaagactaaggaaaagtatgaaaagagtctcaaggaattagaccaggggactccacagtatatggagaacatggagcaggtctttgaacagtgccagcagttcgaagaaaaaagactgcggttctttagggaagttttgcttgaggtgcaaaaacacctggacctgtccaatgtggccggctataaagccatttatcacgacttagaacaaagcattagggccgcagatgctgttgaggatctgcggtggtttcgggctaatcacggcccaggcatggcaatgaactggccccagtttgaagagtggtctgcagatctgaacaggacattgtcaagacgcgagaaaaagaaggcgaccgacggcgtgacactaaccggaatcaatcagactggggaccaatctctgccgagtaagccctccagcacactcaatgtgccatcaaaccctgctcagagcgcgcagtcacagagcagttacaatccgttcgaggacgaagacgatactggttccacagtatccgaaaaggatgataccaaggccaagaatgtcagtagttatgaaaagacgcagagctacccgacagactggagcgacgatgagtccaacaaccccttcagcagtaccgatgccaatggtgattctaatccctttgatgacgatgcaacctctgggacagaggtgagagtcagagccctgtacgattacgagggacaggagcatgacgagctttcttttaaggcaggtgacgagttaactaaaatggaggatgaggatgaacaaggatggtgcaagggtcgcttagataatgggcaagttggtttgtaccccgccaactacgtggaggcgattcagtag

SEQ ID NO: 16126 - DNA, 3075 bp, Artificial Sequence
  Description of Artificial Sequence: Synthetic coding sequence
atgaatttcatcaaggacaatagccgggccctgatccagcgcatgggcatgaccgtcatcaagcaaatcacagacgatctgttcgtctggaatgtgctgaatagagaagaggttaacatcatatgctgtgaaaaagtggagcaggacgctgctaggggaattattcatatgattcttaaaaaaggcagcgagtcttgcaatctctttctgaaatctttaaaagagtggaactatcccctgtttcaggatctcaatggacagtctttgttccaccagactagtgagggggatctggatgatcttgcgcaggatctcaaagacctgtatcacaccccgtcattcctaaacttttatcctctcggggaggatattgatatcatctttaaccttaagtcaaccttcactgaaccagtgctgtggagaaaagaccagcatcaccaccgcgtcgagcaattaactctgaatggactattacaagcattacagagcccttgcataatagagggtgagagcggaaaaggaaaaagcactctgctccaacgtattgccatgctgtgggggagcggtaaatgtaaagcactgacaaaatttaagttcgtgttcttcctcagactcagcagggcccagggcgggctgtttgagactctgtgcgatcagcttttggatattcccgggaccatccgcaagcagacatttatggctatgttgctgaaactaagacaaagggtgttgtttctgctggacgggtacaacgagttcaaaccgcaaaactgtcccgagatcgaagcgcttataaaggaaaaccaccggtttaaaaatatggttatcgtcactaccaccaccgaatgtcttcgtcacatccggcaattcggggctctcacggccgaggtcggggacatgacggaggactctgcccaggcattgattcgggaagtgttgattaaagagttagcagagggcttgctgctccagattcaaaagtcacgctgcctgaggaacttgatgaagactccccttttcgtcgttataacctgcgccattcaaatgggggagagtgagttccattctcatacacagactaccctattccatacattttatgatctactcatccagaaaaacaaacacaaacacaaaggcgttgctgctagcgacttcatacggagcctggaccattgtggcgaccttgcgctggagggagtctttagtcacaagtttgactttgaacttcaggacgtgagctcggttaatgaagacgttctcctgactactgggttgctgtgtaagtataccgcacaaaggttcaagccaaaatataagtttttccataagagtttccaggaatatacagcaggccgccgcctgtcaagcttgttaacttctcacgagccggaggaggtgactaaaggtaatgggtacctccagaagatggtctctatttccgacattacatctacctattccagccttctgcgatacacctgcgggtcctcagtcgaggctacgcgcgccgtaatgaagcacctggcagccgtgtatcagcacggttgccttctgggcctgagcattgctaagcgccccttatggcgtcaggagtcactccagtcggttaaaaacactacagaacaggaaatcctgaaagctattaatattaactcttttgtggaatgtgggatacacctgtatcaggagtctacatcaaagtctgctctctcccaggaatttgaggccttcttccagggcaagagtctttatataaactccggaaacataccagactatctgttcgacttttttgaacatttgcctaactgtgcttcagctctcgacttcatcaagcttgatttctacggtggagcaatggcaagctgggaaaaggctgctgaagatacaggaggtatccatatggaagaggctccagaaacctacatccctagccgcgcagtgtccctctttttcaactggaaacaggagttcagaaccctggaagtgacactacgggatttttctaagctaaacaaacaagatattcgatacttaggcaagatcttctcaagtgccacaagtttgagactccaaatcaaacgatgcgccggagtggccggcagtctgagcctggtcttgtccacctgcaaaaacatttactctctgatggttgaggcctcccccttgaccatcgaggacgagagacacatcactagcgtaaccaatctgaagactctttcgatccacgacttacaaaaccagcgcctgcctggcggccttaccgactccctcggtaatctgaagaatctaactaagctgattatggacaacattaagatgaatgaggaggatgctatcaagttagccgaaggccttaaaaacctcaagaagatgtgtctattccacttaacccacctgtcggacatcggagagggaatggattacatagtgaagtcactgtcctcggagccatgcgacctggaggagattcaactcgtttcttgctgtctgtccgcaaatgctgttaagatcctggcacagaatttacataacttagtcaaactaagtatactggatctgtctgagaattatctcgaaaaggacggcaacgaggccttacacgagctgattgaccgcatgaacgtgctggaacagttgacggctctcatgttgccatggggatgtgacgtgcagggctccttgtccagtctactgaagcatctggaggaggtcccgcaactcgtcaaacttgggctcaagaactggaggcttacagacacagagatcaggattctgggcgccttttttggtaaaaacccgcttaagaactttcagcagcttaacctagctggaaatagagtttctagcgatggatggctggcatttatgggagtctttgagaatctcaaacaactcgtcttcttcgattttagcactaaagagtttctgcccgatccagctttagtgaggaaactgtcccaggttctgagtaagctaacatttctccaggaagctcgcctggtgggctggcagtttgacgacgacgacctatctgtcataaccggcgccttcaaactcgtcactgcctag

SEQ ID NO: 16127 - DNA, 339 bp, Artificial Sequence
  Description of Artificial Sequence: Synthetic coding sequence
atggacgataaagcttctgtcggcaaaatctctgtaagcagcgattccgtgtctactttgaactctgaggatttcgtcctggtctctagacagggtgacgaaactccaagcactaacaacggatctgatgatgaaaaaaccgggctcaagatagttgggaacggatccgagcaacagcttcaaaaggagcttgcagatgttctgatggaccctccaatggatgatcagcctggcgagaaggagctcgtaaaacgatcccaattggacggcgaaggcgacggccccctttcgaaccaactgtctgcctcgagtaccatcaaccctgttcccttggtctag

SEQ ID NO: 16128 - DNA, 441 bp, Artificial Sequence
  Description of Artificial Sequence: Synthetic coding sequence
atgctgaaagaagactgtgcaagcgaactgaaggtgcacttggctaaatcactgcccctgccttcctcagtaaataggccccgcatcgacctgatcgtctttgtggtgaacctccatagcaaatacagcttacagaacacagaggaatccttgaggcatgttgacgcgagcttctttctgggaaaggtctgtttcctggcgaccggggccggcagagagtcacattgcagtatccaccggcatacggtagttaaactcgcacacacatatcagtcccctctgctatactgtgacttagaggtcgagggcttccgagcaactatggcccagcgcttggtgagagtgctccagatctgcgcaggtcacgtccccggggtcagtgccctgaacctgctctccctgctcagaagctccgaagggccctccctcgaagatttgtag

SEQ ID NO: 16129 - DNA, 1203 bp, Artificial Sequence
  Description of Artificial Sequence: Synthetic coding sequence
atggcctccgacacccaggctgtgcctgatgtgtcaggccgatccagggcccggcgttacgccgaatggagctctggtttgcgcagcggccgagcaggcggcggagagacatcagtggagcgacgccgaacatgcgcttttgatacactggaggcatttcttatcatggatggcgaagacatccctgactttagctcactaaaagaggaaactgcctattggaaggagttgtcgctgaagtacaaacagagctttcaagaagcgcgagacgaattggtggagtttcaggaagggagccgggaactggaggcagagctggaagcgcagctcgtgcaggccgaacagcggaatcgtgatctgcaggcagataaccagcgcctgaagtacgaggtggaagctctcaaggaaaaactggagcaccagtatgctcagtcatacaaacaagtgtccgtactggaggacgatttatctcagacacgggcaattaaagagcagctccataagtatgtgagagaacttgaacaggccaacgatgatctggaacgagccaaaagagctactattgtgagtctcgaggattttgagcaacgcctgaaccaggctatagagagaaacgcttttttggagtcggaactggatgagaaggagtccctgctggtctctgtacagaggctgaaagacgaggctagggacctgcggcaggagctggcggtccgtgagagacagcaagaggttactaggaagagcgccccctcttcacccactctggactgcgaaaaaatggattctgcggttcaagcctctctgtctctccccgctacccctgttgggaagggcacagaaaacacgtttccctctccaaaggccatacccaatgggtttgggacatcaccactgaccccaagcgctcgcatctctgcgttaaatattgttggtgacttgttaaggaaggtgggcgcccttgagtccaaactggctgcttgtcggaattttgccaaggaccaggcctcacgtaaatcttatatctctggcaatgtgaactgtggcgtcctcaacggaaacggcaccaaattctctaggagcggacacacttctttctttgataagggcgccgtgaatggtttcgatcccgccccacctcccccgggactgggctcgtcccggccaagttctgcgccaggcatgcttcccctctccgtgtag

SEQ ID NO: 16130 - DNA, 699 bp, Artificial Sequence
  Description of Artificial Sequence: Synthetic coding sequence
atgacgcctcctcagcaaccccccccactccgctctgagcccggtactcttgggagtgcagcgtcatcatactccccattaggcctgaacggcgtacccggatccatctgggacttcgtgtccggaagctttagtccaagtccatcccccatcctcagtgccggcccaccaagctccagctctgccagccctaacggcgctgagctagcacgagtgcgcaggcagttggatgaagccaaacgcaagatcagacagtgggaagaatcgtggcagcaggtgaaacaggtttgtgacgcctggcagagggaagcccaagaggcaaaggagagagcccgggtggccgactccgatagacagctagctttacaaaaaaaagaagaggttgaagctcaagttaagcaattacaggaagaactggaggggctgggtgtggcatctacccttcctggtctgcggggatgtggagacatcggcactattcctctgccaaagctgcactcattgcagtctcagctgcgactcgacctcgaagccgttgacggggtgattttccagttacgggccaagcaatgcgtcgcctgcagagagagggctcatggagccgttttgagaccatgtcagcaccacatcctttgtgaaccttgcgccgccacagctccggaatgcccctattgtaagggtcagcccttgcagtggtag

SEQ ID NO: 16131 - DNA, 1500 bp, Artificial Sequence
  Description of Artificial Sequence: Synthetic coding sequence
atgctgccatggcctcccgctcttgcgatgcctatgccgactgaggggaccccgccacctctctctggaactcctatcccggtacccgcctacttcagacacgccgagccgggattctccctgaagagaccgagaggactgtcaagatcccttcccccacctccccccgcgaaggggtccatcccaatctctagacttttccctccgcgcacaccagggtggcatcaattacagccccgtagggtgtccttcaggggagaagcgagtgagaccctgcagagcccggggtacgaccccagtcggccagagtcattttttcagcaatcgttccagcgtctaagccgcttgggtcacggctcctacggggaggtctttaaggtgaggtccaaggaggacggccgcttgtatgccgtcaaacgcagcatgtccccgtttcggggaccgaaggatcgcgctaggaaattggcagaagtcggttcacatgagaaagtcggccagcacccgtgctgtgtgagactcgaacaggcatgggaggagggagggattctgtatcttcagacagagctttgcggacccagtttgcaacagcactgcgaggcttggggggcatcactgccagaggcccaggtctggggatacctgagagacacactgctagcgctggcacacttgcattcacaggggctggtccacctcgatgtaaaacccgctaatatcttcctaggcccccgaggacggtgcaagctgggagactttggcttgttggtggagctggggacagccggagccggcgaggtgcaggagggcgacccgaggtacatggcccccgaactgctgcagggcagctacgggactgcagccgatgtttttagtctgggcctgacaatcctggaggtagcatgcaatatggagctgcctcacggcggtgagggttggcagcagctaagacagggatacttgcctcccgagtttaccgccggcctgtcttccgagctgagaagcgtcctggtcatgatgctggaacccgatcctaagctgcgcgccactgccgaggcactgctcgctctgcctgtgctgagacagccaagggcttggggagtgctgtggtgcatggccgccgaggcgctgagtcgcggatgggccctatggcaggctctcctcgcattgctatgctggctctggcacggcctggcccatcctgcttcctggcttcagccacttgggcccccagctacgcctccaggaagtccgccctgctctctgctgctcgattcttccctaagtagcaattgggatgacgattcgttaggcccaagtctcagtcctgaggcggtgctcgccaggactgttgggagcacatcaacccctcgctcccggtgcactccacgggacgctctagatctgagcgatatcaactccgagcctccacgtggttcttttcctagtttcgaacctcgaaacctgctgagcctctttgaagacacactcgaccccacctag

SEQ ID NO: 16132 - DNA, 3153 bp, Artificial Sequence
  Description of Artificial Sequence: Synthetic coding sequence
atgctctgttggggctattggtccctcggtcagccaggtatctcgacgaatttgcaaggcattgtggccgaaccccaggtctgcgggtttatatcggatagatccgtaaaggaggttgcttgcggtggaaaccactcagtgttcctgctcgaagacggcgaggtttacacctgcggactgaataccaagggacagctggggcacgagcgcgagggcaacaaaccagagcaaatcggagcgctagctgatcaacacattatacacgtagcgtgcggagagagtcattcacttgcgttgtcggaccgcggccaactcttcagttggggcgcaggaagtgacgggcagctgggcctcatgactaccgaggacagcgtggctgtgcccaggctgatccagaaactgaaccaacagaccatcctccaggtgtcatgcggcaactggcactgcttggcgctggctgctgacgggcaatttttcacctgggggaaaaacagtcacggccagctaggactgggcaaggaattcccatcccaggcctccccccaaagggtgcgaagcctggaggggatccccctcgcccaggttgctgccgggggcgcgcacagttttgccttgtccctaagtggcgctgtctttggctggggcatgaacaacgccgggcagctggggttgagcgacgagaaagacagggaatcaccctgtcatgttaaactactccgcacccaaaaggtcgtgtatatctcgtgcggcgaggaacacaccgctgttctgactaaatccgggggcgtgtttacgttcggggccggcagttgcgggcagctgggacacgatagtatgaatgacgaggtcaacccaaggagagtgctggagctcatggggtctgaagtgacacagatagcgtgtggccgccaacacaccctcgccttcgtgccgagtagtggtcttatctacgcctttggctgtggagcgcggggccagctagggacagggcacacctgtaacgtgaaatgtccttcccctgtgaaaggctattgggcagcacattcggggcaactcagcgcacgcgccgaccgatttaaataccatattgtgaagcaaattttttctggcggcgatcagaccttcgtgctttgctcaaagtatgagaactactctccagctgtcgactttcggaccatgaaccaggcccattacacctcactgatcaatgacgagaccatagccgtatggagacaaaaactcagcgagcacaacaacgcaaataccatcaatggtgtggtgcagatattgtcatccgctgcatgttggaacggtagttttttggaaaaaaaaatcgacgagcacttcaagacttcgccgaagattccaggaattgatctgaatagcactagggtcctcttcgagaagctgatgaattctcagcatagcatgatcctcgagcaaatcctaaactcattcgagagttgtttaataccccagttgtccagtagccctccggatgtcgaagctatgaggatctacctcatattgccagagttccccctgcttcaggacagtaagtactatataactctcaccattcctctggcaatggctatcctgcgcctcgacacaaaccccagcaaggtgctagacaattggtggtcccaggtgtgcccaaagtattttatgaaactggtaaatctctataaaggtgcagtcctctacctcctgaggggtcggaaaaccttcctgatcccagtgctgtttaataactatatcacagctgctctgaagttgttggaaaaactgtacaaggttaatctcaaggtcaagcatgtagaatacgatactttctacatccccgagatctccaacctcgtcgatatccaggaagactatctcatgtggttcctacatcaggcggggatgaaggccaggccgtccattatccaggacacagtgaccctctgtagttaccctttcatttttgatgcccaggcgaaaaccaagatgctgcaaacagatgccgagctgcagatgcaggtagctgttaatggggctaacctgcagaacgtgttcatgctcctgaccctggagcccctgctggcacggagcccttttctggttctgcacgttcggcgcaataatctagtcggagatgcccttagagagctttccattcatagcgatatcgaccttaagaaacctcttaaagtgatcttcgacggggaggaggctgtggacgccggaggggtgacgaaggaatttttcctcttattgcttaaagaactcctgaaccccatctacggaatgttcacttattaccaagactccaatttgctttggttttcggacacatgcttcgtggaacataactggtttcacctcatcggtattacctgtggcctggccatttacaacagcaccgtggtggatctgcacttcccgctggccctgtataagaaactgctaaacgtgaaacccggcctggaggacctgaaggagctcagccccaccgaaggcaggtctcttcaggagctcttagactacccgggagaagacgtggaagagacattctgtctcaacttcaccatctgcagagaatcctatggagttatcgagcaaaaaaaactgattcctgggggggacaatgttactgtttgcaaagacaaccgccaggagtttgtagatgcctacgtcaattacgtatttcagatcagtgtgcacgagtggtatacggctttcagcagcggatttctgaaagtgtgcggaggcaaagtgctcgagctgtttcagcccagcgaactcagagccatgatggtgggcaattcaaactataattgggaagaactcgaagagacagcaatttacaaaggtgactattctgcgacacacccaacggtgaagctcttctgggagacatttcatgagtttcctctggagaagaaaaaaaagttcctgctgtttctaacagggagcgaccggattccaatttacggaatggcatcccttcaaatagtgattcagagtacagcgtctggtgaagaataccttcctgtggcccacacatgctacaatctactggatctgccaaaatatagtagtaaggaaatcctctccgctcgcctgacccaagccctggacaattacgagggttttagcctggcatag

SEQ ID NO: 16133 - DNA, 363 bp, Artificial Sequence
  Description of Artificial Sequence: Synthetic coding sequence
atgagtatcggagtgcctattaaggtacttcacgaagctgagggtcacattgtgacttgcgaaaccaatactggagaagtgtatcgcggtaagctgatcgaagctgaggacaacatgaactgtcaaatgagcaacatcacagtaacctaccgcgacggaagagtcgcccaactggagcaggtgtatatcagagggtccaaaatcaggtttctgatcctgccagacatgttgaagaatgcccctatgttgaagtctatgaagaacaaaaatcagggtagcggagccggtcggggaaaagcagcgatcctaaaggcacaaggctacttatcttccctggagtgggtcctcgtgcacatttgctag

SEQ ID NO: 16134 - DNA, 1182 bp, Artificial Sequence
  Description of Artificial Sequence: Synthetic coding sequence
atggaggaaaataatctgcagtgcagcagtgtggttgatggtaattttgaggaagttccaagggagaccgcaattcaattcaagccacccctgtacaggcagcgctaccagttcgtcaaaaatttggtggatcagcacgagcccaagaaggttgccgatctcgggtgcggcgataccagtctcttaaggttgctgaaagttaacccttgcattgagctgttagtgggggtcgatatcaacgaggataaactaaggtggagaggggattcccttgcgccctttctcggcgactttttaaagccaagagacctcaatttgacgattaccttgtaccatggttcagtcgtcgagcgagacagccgtcttctgggtttcgacctcatcacctgcatagaattaattgagcacctcgatagtggcgatttagctagattccctgaggtggtcttcgggtatctgagcccctcaatgatcgtcatctctactcctaacagcgagtttaaccccctgtttccctcggtgaccctgcgagactctgatcataaatttgagtggactaggatggagttccagacatgggctctgtacgtagcaaacaggtacgactactccgtcgagttcaccggcgttggagaaccccctgccggggctgaaaatgtcgggtactgcacccagatcgggatcttccggaaaaacggcgggaaggctaccgagagctgtttatctgaacaacatgaccagcatgtgtataaagctgtgttcaccacgtcatatccttctctccagcaggagcgtttcttcaaactcgtgctggtgaacgaggtaagtcaacaggtggaatctctacgcgtcagtcatctacctcgtaggaaggagcaggcaggtgaaaggggtgacaaacccaaagatatcggggggtccaaagcgcctgtgccttgcttcgggcccgtcttcacagaggttgagaaggccaaaatagaaaattctccaacaccgttttgtgtcggggataagttcttcgtgcccttgcagagacttctagcatatcccaagcttaataggctttgcgcaaacgaagagatgatgcggtcagtcattgctgattctattcccctgagctccgatggatctgcagtagttgcagacttgcgtaactattttgatgagcagtttgaattctag

SEQ ID NO: 16135 - DNA, 228 bp, Artificial Sequence
  Description of Artificial Sequence: Synthetic coding sequence
atgagcccacagaaacgagttaaaaacgtgcaagcacaaaacaggacctcccaggggagctctagttttcaaacaaccctaagtgcatggaaagtgaagcaggatccatcgaacagcaaaaatatcagcaaacatggtcaaaataacccagtcggagactatgagcacgccgacgaccaggcagaagaggacgcgctacagatggcagtcggatacttcgaaaagtag

SEQ ID NO: 16136 - DNA, 996 bp, Artificial Sequence
  Description of Artificial Sequence: Synthetic coding sequence
atggcttttgtgactcggcagtttatgcgctcagtgtcaagcagctcgacagctagtgcctctgcaaagaagattatcgtcaagcatgttaccgttattgggggagggttgatgggggctggaatcgctcaggtagcagccgctacaggccataccgtagtgctggtggatcaaaccgaggacatattggccaagtccaaaaagggcatcgaagagagtctacgcaaagtcgctaaaaagaaatttgcggagaacctaaaggccggggatgagtttgtagagaagacgctctcgactatagccacttcgacagacgcagcttcagttgttcacagcaccgaccttgtggttgaagcaatagtagagaacttgaaagttaagaacgaattgtttaaacgattggacaagttcgccgctgagcacacaattttcgctagcaatacgagttctctccaaatcacttccatcgccaacgctacgactcgtcaggataggttcgccggattgcattttttcaacccagtgcccgtaatgaagctcgtagaggtgatcaagacaccaatgacaagccagaagacattcgagagtttagtagacttcagcaaggcacttgggaaacatccagtcagctgcaaggacacaccaggatttatcgtgaataggctgctggtgccgtacctcatggaggcaatccgcctgtatgagcgtgacttccagacctgtggcgatagcaactcaggactcggcttcagcctgaagggcgatgcctcaaaagaggatatcgacacggcaatgaaacttggtgctggctatcccatgggcccgttcgaactgctcgactatgtcgggctggacactactaagttcatcgttgacggctggcacgaaatggacgccgaaaaccctttgcaccaacctagtccctcgttaaataagctggtcgctgagaacaaattcggaaaaaagactggagaaggattttacaagtacaaatag

SEQ ID NO: 16137 - DNA, 1281 bp, Artificial Sequence
  Description of Artificial Sequence: Synthetic coding sequence
atggctcatcttagagggttcgctaatcagcattccagagtcgaccccgaagagctgtttaccaaattggaccgaatcggtaagggctctttcggggaggtttataagggcatagacaaccatactaaggaggtggtagccataaagatcatagatttggaggaagccgaagatgagatagaagacatccagcaggagataacagtgctgtctcagtgtgacagcccctatattacccggtacttcggctcatacctgaagagtacaaagctctggatcataatggagtatctggggggagggagcgcactggaccttttaaagccgggccctctagaggagacctacatcgccactattctgcgggagatcctcaagggactggattacctgcattccgagagaaaaattcatagagacatcaaggccgccaacgttttgctatctgagcagggtgatgttaagctggcagactttggagtggctggccagctgaccgacacacaaataaagagaaatacatttgtaggcacccctttctggatggcccctgaggtcatcaaacaatcagcatacgattttaaagcagacatttggtccttgggtatcacagccattgaattggctaaaggggagcctcccaatagcgatctgcacccaatgcgagtgctgtttcttatcccaaaaaactctcccccaactttggagggccagcactcgaagcctttcaaagagttcgtcgaggcatgcctgaataaggatccccggttcaggccaactgcaaaagagctgctgaagcacaaattcataacgcgttacacgaagaaaactagtttcctgactgagctcattgatcggtataagagatggaagtcagagggccacggcgaggaaagctcctcagaagactcagatatcgatggagaggccgaggatggcgaacagggacctatctggacgttcccccctaccatcagaccatcgccacacagcaaactgcacaaaggcaccgcactccatagctcacagaaacctgctgaaccggtcaagcgccaaccccggtctcagtgtctgtctacactagttcgtccagtgttcggtgagctcaaggagaagcataagcagagtggtgggtctgtgggtgccctggaagaactggagaacgcctttagcctcgctgaagagagctgtcccgggatcagcgataagttgatggtgcacctcgtcgaacgcgtacagcggtttagtcacaatcgcaaccaccttacaagtactcggtag

SEQ ID NO: 16138 - DNA, 1290 bp, Artificial Sequence
  Description of Artificial Sequence: Synthetic coding sequence
atgcccaatgtactattaccaccaaaggagtcaaaccttttcaagagaatactcaagtgttacgagcagaaacagtataaaaatggcctgaaattttgcaagatgattttaagcaatcctaagtttgcggagcatggcgagaccctggccatgaaggggctgaccttgaactgccttggtaaaaaggaggaagcctatgagttcgtgaggaaaggcctcaggaatgatgtgaagagtcacgtgtgttggcacgtgtatgggttactccagaggtctgataaaaaatacgatgaggccattaagtgctatcggaatgcactgaaactcgacaaagacaatttacagatattaagggaccttagcctccttcaaattcagatgagggacctcgaagggtacagggagacccgatatcagttactacagttgcggcccactcaaagagctagctggatcgggtatgccatcgcctaccacctcctaaaggattacgacatggcactgaaactgttagaggaatttagacaaacacagcaggtgcctcccaacaaaatagactatgagtattcggaactgatcctgtatcagaaccaggtaatgcgagaggccgatcttctgcaggaatcattggaacatatcgaaatgtatgagaagcaaatttgtgataagctgctagtggaggagatcaagggcgaaattctactcaaactgggacgcttaaaagaggcctccgaggtctttaaaaatctgattgatcgaaacgccgagaattggtgttactatgaaggactggagaaagctcttcagatcagtacactagaggagcgactgcaaatttacgaagaaatctcgaagcagcaccctaaagctattacccctcggcggctaccattgacactggtgcccggtgagcggttcagagagttgatggataagtttctgcgcgtgaatttctccaaaggatgccctccgctgtttacaactttaaaaagcctctattacaataccgagaaagttagcattatccaagagttagtcaccaattacgaggcctctttgaagacttgtgactttttttcaccatacgagaacggggagaaagaacctcccactaccctgctgtgggtgcagtattttctggcccagcacttcgacaaactgggccagtatagccttgccctggactacatcaatgccgcaatcgctagcacgcctacgcttattgagttgttctatatgaaggccaagatctacaaggtgaagagtgagtcttgctttctaagcagttag

SEQ ID NO: 16139 - DNA, 360 bp, Artificial Sequence
  Description of Artificial Sequence: Synthetic coding sequence
atggacaagaacataggggagcagcttaataaggcttatgaggctttcaggcaagcctgtatggatcgtgattcagccgttaaagaattacaacagaaaactgagaattacgagcagcggatacgagaacagcaggagcagctttctctccagcagaccattatagacaagctgaaatcccagctcctcctggtgaactctacgcaggacaataactatgggtgtgtgccactgcttgaagactccgagacccgcaaaaacaacttgacccttgaccagccccaagacaaagttatctccggtatcgccagagaaaaactgcccaaggtagacatcgcatccgccgagagctccatttag

SEQ ID NO: 16140 - DNA, 699 bp, Artificial Sequence
  Description of Artificial Sequence: Synthetic coding sequence
atgactcctccccagcagccacccccgctgcgttccgagcccgggacactcggatccgctgcctcttcttacagtcccctgggcctgaacggggtgccggggtctatttgggattttgtaagcggcagcttttcgccctcgccatcacctattctgtctgctggccctccctctagctcctctgctagccctaatggcgccgaactcgcccgggttcggaggcagctggatgaagcgaaacgaaagattcggcagtgggaggagagttggcagcaggtgaagcaggtgtgtgacgcatggcagagagaggcgcaggaggccaaggaaagagcgcgggtagcagattctgaccgtcagctggccttacagaaaaaggaggaggtggaggcccaggttaagcaattgcaagaggaattggagggcctcggtgtggcctcaacactccctggcctgcgggggtgtggagacatcggtaccattccactgcctaaacttcactcattgcagagtcagctccgtttagacctggaggcagtggatggtgtcatttttcagctgagagccaagcaatgcgtggcctgtcgtgagcgagctcatggcgcggtcctccggccttgccagcatcacattctctgcgagccctgtgctgccacagcgcctgaatgcccatactgtaagggccagccccttcaatggtag

SEQ ID NO: 16141 - DNA, 1461 bp, Artificial Sequence
  Description of Artificial Sequence: Synthetic coding sequence
atgagcgtaacatacgacgattctgttggggtggaggtgtcatcggactccttctgggaggtgggcaactacaagagaactgtgaagagaattgatgacggccaccgcctgtgttcagatctgatgaactgcctgcatgagcgcgcgcggatagaaaaagcctatgctcagcagctgacggaatgggcgcgtagatggagacagctagtggagaaggggccacaatacggaaccgttgagaaggcctggatggccttcatgagcgaagcagagagggtgagcgagctgcacttagaagtgaaggcatcgctgatgaacgacgactttgaaaaaattaagaactggcagaaggaggcgttccacaaacagatgatggggggtttcaaagagacaaaagaagccgaggacggatttagaaaggcgcagaaaccttgggcaaaaaaactcaaggaagtggaagctgctaagaaagctcaccatgcggcctgtaaagaagagaagctggccattagtcgggaagcgaactcaaaggctgacccgtcattgaatcccgaacagttaaagaagctgcaagacaaaattgagaagtgcaaacaggatgttctgaaaaccaaggaaaaatatgaaaagagtttgaaagagctagaccaaggcacaccacagtatatggaaaatatggaacaggtatttgaacagtgtcagcagtttgaagagaagcgtctgcgcttttttcgagaggtgctgctcgaggttcagaagcatttggatctgagcaatgttgcgggatataaagccatataccatgatttggaacagtccatcagggcagcggacgccgtggaggatctgcgttggttccgggccaaccacggacctggcatggcaatgaactggcctcagttcgaagaatggagtgccgacttaaacaggactctaagtcggagggaaaagaaaaaggcaacagacggagttacactgactgggatcaaccagactggtgatcagagcctgcccagcaagcctagcagcactttaaacgttccttccaacccggcacagtcagcacagtctcagtcgtcctacaatccctttgaggacgaggacgacactgggtccactgtgtcggaaaaagacgacactaaagccaagaatgtatcaagttacgaaaaaacccagtcctaccccaccgactggtcggacgatgagtccaacaatccattttctagcacagatgctaacggggattcaaacccattcgatgacgatgccacatccggaacagaggtccgtgttagagccttgtacgattacgaaggccaagaacacgatgaactgtccttcaaggctggggatgagctgacaaagatggaggacgaagacgaacaggggtggtgcaaaggacggctggacaacggccaggtcggtctctatcctgccaattatgtcgaagccattcagtag

SEQ ID NO: 16142 - DNA, 3075 bp, Artificial Sequence
  Description of Artificial Sequence: Synthetic coding sequence
atgaatttcatcaaagataattccagagccctcatccagcgaatgggaatgaccgttataaaacagattactgatgatttgttcgtgtggaacgtcttgaaccgagaagaagtgaatatcatttgttgcgagaaagtcgaacaggacgccgcccgcggcatcatacacatgatcttgaaaaagggatctgagagctgtaatctttttctgaaatcccttaaagaatggaattacccccttttccaggatcttaacggtcagagtctttttcaccagaccagtgaaggggatttagacgatttagcacaggatctgaaggatttgtaccacactccatcctttcttaacttctatccactcggagaagatatagatattattttcaatctcaaatcgacattcacagaaccagtgctctggagaaaggatcagcaccatcaccgagtagaacaattgacacttaacggactgctgcaggctcttcaaagcccgtgcataatcgagggtgaatcaggcaaaggaaaaagcacactgcttcagagaattgcaatgctctggggctctggaaaatgtaaggctctaactaagttcaaattcgtgttctttctgaggttatctcgcgcccagggaggcctttttgagacgctgtgtgatcagctcctggatattccagggactatccgtaaacagacgttcatggccatgttgctgaagctgcggcagcgggtcctttttctcttagacggatacaatgaatttaaaccacagaattgcccagagatcgaggcactgataaaagagaaccaccgcttcaagaatatggtgattgtgaccactaccactgagtgcctgagacacattcggcagttcggggcccttaccgcagaagtcggagacatgactgaagacagtgctcaggctctcatcagggaagtacttattaaggagctcgcggaaggtctgcttctccagatacagaagtcacgctgcctcagaaaccttatgaagactcctttgttcgtcgtaattacatgcgctatccagatgggggaatcggaatttcactcccacacccagacaacactgttccacacattctatgatctcctgattcagaagaacaagcacaagcataaaggcgtcgcagccagcgattttatccgttctctagaccactgcggagatctggcacttgaaggggtgttttcccacaaattcgacttcgagctgcaggacgtgagtagtgtgaacgaagacgtcctgctaactactggcctcctgtgcaaatataccgcccagagattcaagcccaaatataagtttttccacaaatctttccaggaatatacagcgggccggcgcttaagcagcctgctgacgagccacgaaccagaggaggtgacgaaaggaaacgggtatctgcaaaaaatggtatcaatctcggatataacctccacgtattcatccctgctgcggtatacatgcggtagctccgtcgaagcaacccgagccgtcatgaagcacctggccgctgtctatcagcatggatgtcttcttggcctgtccatcgctaagcggcctctgtggcgacaggaaagtttgcaaagtgtgaagaacaccaccgagcaggaaatcctgaaagctatcaatatcaactctttcgtggagtgtgggattcacctgtaccaggaaagcacgtccaaatcggcactgagccaggagttcgaggccttctttcagggcaaatccctttatatcaattctggaaacattcctgactatcttttcgatttcttcgagcatcttcctaattgcgcatccgccctcgactttattaagctggatttctacgggggagctatggctagctgggaaaaagccgctgaagatacgggaggaatccatatggaagaggcgccggaaacttatatcccctctagagccgtcagcctgttcttcaactggaaacaggagtttaggacccttgaagttacactaagggatttctcaaaactgaacaagcaagatatccgctatctgggtaagatctttagtagtgcaacgtcgcttaggctgcaaattaaacggtgcgctggtgttgccggctcccttagtctggtgctgagcacgtgtaagaatatttattctctgatggtggaagcttcgccgctgacgatagaagatgagcggcacatcactagcgttaccaatcttaagacgctctctattcacgaccttcagaaccagcgccttcccggaggcctcaccgacagtctcggaaatctgaaaaatctgacaaagctcattatggataatatcaagatgaacgaagaagatgcaatcaagcttgccgaggggttaaaaaatttaaaaaaaatgtgtctatttcaccttacacatctctcagatatcggagaaggaatggattatatcgtgaagtctctttccagtgagccatgcgatctcgaggagatccagttagtgtcgtgctgcctcagtgcgaatgccgtaaagatcctggcccagaatttgcataacctcgtcaaactttccatcctggatttgagcgagaattatttggaaaaagacgggaacgaggcccttcacgagctgatcgatcggatgaatgtattggaacagcttaccgctctcatgttgccttggggatgcgacgtgcagggatcccttagtagcctactcaaacacctggaggaggtaccccagttagtaaaactcggcctgaagaattggagactcacagataccgaaatcaggatcctgggcgcatttttcggaaaaaatccactgaagaatttccaacagttgaaccttgcaggcaatagggtttcttccgatggatggcttgcttttatgggcgtctttgagaacctgaaacaattggtattttttgacttctcaaccaaggaattcttgccagatcctgcattggtgcgcaaactatctcaggtcctttcaaagttgactttcttgcaggaggccagactggtgggctggcagttcgatgatgatgacctgtccgtaatcacaggagccttcaagctggtgacagcctag

SEQ ID NO: 16143 - DNA, 1767 bp, Artificial Sequence
  Description of Artificial Sequence: Synthetic coding sequence
atgtcttcatgtgtgtcatcccaaccctccagcaatagagccgctccccaggacgagttggggggaagggggagctcatccagcgagtcacagaaaccatgcgaggctttgcggggcctctctagcttatccatccatcttgggatggagagcttcattgtggtgaccgaatgtgaacccggatgcgccgtcgacctggggttagcccgggaccgcccgttggaggccgacggacaagaagtacctctggatacatcaggttctcaggcccgcccacatttgtccggacgaaaactgagtctacaggaaagatctcagggcgggctggcagcaggcgggtcactggatatgaatggtcgatgcatctgtccctcactgccatacagccccgtcagcagccctcagtccagcccgagactgccacgcaggcctactgttgaatcacaccacgtcagtattaccggcatgcaggattgcgtgcagctcaatcaatacacattgaaagatgaaatcggaaagggctcgtacggcgtggtgaagttggcgtacaacgaaaatgataatacctactacgctatgaaagttctgagtaaaaaaaaacttattcggcaggctgggtttcccaggcggcctcccccgcgcggaaccagacccgctcctggaggatgcatacaacccagagggccaatcgaacaggtttatcaggaaatcgccatcctcaaaaaattggaccatcctaatgttgtcaaactggtagaggtgctggacgatccaaacgaggatcatctgtatatggtgttcgaactggtgaatcagggtccagtcatggaggtgcctaccttaaaaccactttcagaggatcaggctagattctactttcaggacctcataaagggtattgaatacctccattaccagaagataattcaccgcgacatcaaaccgtctaatctgctcgtcggagaggatggacatattaagatcgcagacttcggggttagtaatgagttcaagggatccgatgccctgttatccaacactgttggcacccctgcattcatggcgcccgagagcctctcggaaactaggaagattttcagtggtaaggctttggacgtgtgggcgatgggcgtgactctatattgcttcgttttcgggcagtgtcctttcatggatgagcgtattatgtgtttacacagtaaaataaaatcacaggccctcgaattccctgaccagcccgacatagcagaggacctcaaagatttgatcaccaggatgttggacaaaaatcccgaaagtcgaattgtagtgcctgaaataaagctacatccttgggtgacgagacatggtgccgaacctctgccctccgaggacgagaactgtacacttgtggaggtgactgaagaggaggtggaaaactctgttaagcacattccatctctggccactgtgattttagttaagacaatgatccggaagcggtctttcggcaacccctttgaaggatctcggagagaagaacggtctctgtcagctcccggtaatctgttgacgaaaaagccaacccgggagtgcgaaagccttagtgagctcaaagaggcaaggcagcgtagacaaccgcctggccatcgccccgcaccacggggcggaggtggcagcgccttggtccgcggatccccctgtgtggaaagctgctgggctcctgcccccggttcacctgctcggatgcatcccttacgcccagaggaagcaatggaaccagaatag

SEQ ID NO: 16144 - DNA, 666 bp, Artificial Sequence
  Description of Artificial Sequence: Synthetic coding sequence
atgctcaaaaataaggggcatagcagcaagaaagacaaccttgccgtaaacgcagtggccctacaggaccatatacttcatgatctgcagctccggaatctctccgtggctgatcattctaaaacgcaggtacaaaagaaggagaacaagtctctgaagagagacaccaaggcaataattgataccggcctcaagaagaccacgcagtgccccaagctggaagactctgagaaggagtacgttttagacccaaaacctccaccgctgaccttagcccagaagctcggactaatcggacctcccccgccccctttgtcatccgacgagtgggagaaggttaagcagaggtcactccttcagggcgactccgtgcagccctgccctatctgcaaggaggagttcgagctgaggcctcaggtgctcctctcctgtagtcacgttttccacaaggcctgcttgcaggccttcgagaagtttactaacaagaagacctgtcctctgtgtcgcaagaatcagtatcagaccagggtaattcacgatggtgcacggttgtttcggataaagtgcgtcacgaggattcaggcatattggcgcggatgcgtggtgagaaaatggtatcggaacctccggaaaacagtccctccgactgatgctaagctcagatag

SEQ ID NO: 16145 - DNA, 900 bp, Artificial Sequence
  Description of Artificial Sequence: Synthetic coding sequence
atggtggacaaaaagctggtggtcgtcttcgggggcaccggcgcccaaggtggttcagtcgcacgcacccttttagaagatgggacctttaaggtgcgcgtggtgacaaggaatcccagaaaaaaagcggccaaggaactgaggctgcagggcgccgaggtggtgcagggcgatcaggatgatcaggtcattatggaactagctctgaacggtgcgtacgccacctttattgtgacgaattactgggaaagttgctcacaggagcaggaagtgaagcagggtaaactcctggctgacctggctcggaggttgggtctgcactatgtggtatacagtgggctcgagaacataaagaaactgacagctgggagacttgccgctgcccacttcgatgggaagggcgaggtggaggagtatttccgcgatattggcgtgccaatgacttctgtacggttgccctgctatttcgaaaatctactgtcccatttcctgccccagaaggcgcctgatggcaagtcttatctattaagcttacccaccggggatgtgcccatggatggaatgtctgtgtcagacctcggcccagtagtgttatctctattgaaaatgcctgaaaaatacgtggggcagaacattggcctctcaacctgcagacatactgcagaggaatatgccgcgctcctgaccaagcatacgcgcaaggtggtgcacgacgctaagatgaccccagaggattacgagaaactcggcttccccggagcacgagacttggctaacatgttcaggttttacgcgctccggcccgaccgtgacatcgagcttacactgcgattgaacccaaaggcgttaacactcgaccagtggttagaacaacataagggcgacttcaacctgctctag

SEQ ID NO: 16146 - DNA, 2193 bp, Artificial Sequence
  Description of Artificial Sequence: Synthetic coding sequence
atggaagatctatttgagacgttccaggatgagatgggtttctctaacatggaagacgatggtcccgaggaagaagagagggtagccgaacctcaggctaacttcaacacccctcaggcgctgcgattcgaggaactgctcgccaatctgctcaacgagcaacaccaaatcgcgaaagagctgtttgaacaactaaaaatgaagaagccttctgccaagcaacagaaagaggtcgaaaaggtcaagccccagtgcaaggaagtgcatcagactctgatattggaccccgcccaaaggaagcgtctgcagcaacaaatgcagcaacacgtgcagctcctcacacagatacatctgctggcaacttgcaatccgaacttaaatcctgaggcctccagcacacgcatttgtctcaaggaactgggaaccttcgcccaaagtagcattgcactgcaccatcagtacaatccaaaattccagaccctcttccaaccttgcaatcttatgggcgccatgcagcttatcgaagacttttccacgcacgttagcattgattgctcaccacacaagaccgtgaaaaagaccgccaacgaatttccttgccttccaaaacaagtggcttggattctggcaacatcaaaagtgtttatgtacccagagctgctgcccgtctgctccctcaaagcaaaaaacccgcaggataagatcttgttcactaaggccgaagacaacaaatacttgctcacttgcaagacagctcgccaacttactgtcaggatcaaaaatctcaatatgaacagagcccctgataacatcatcaaattctacaagaaaacgaagcaacttcccgttctgggcaaatgttgcgaggaaatacagcctcaccagtggaagccgccgattgaacgcgaagaacaccggcttccattttggctcaaggccagtctcccctccatccaggaagaacttagacacatggccgatggtgccagggaggttgggaatatgacaggaactaccgagattaattccgatcaagggctggagaaggataattcagagttgggatctgaaactagatatcccctgctgctcccaaaaggggtcgtactcaagctgaagcccgtcgccgatcgctttcctaaaaaagcttggcgccagaagcgctcttctgtcctgaagcccctgctcatacagccgtcaccatcgctccagccaagcttcaacccaggaaagaccccagcccagtcaacacactctgaagctcccccatctaagatggtgctccggatcccccatcccatccagccggccactgtacttcaaacagtcccaggggtaccaccactgggggtgtctggtggggagtcttttgagtcacccgctgctctgcccgcaatgcctcctgaggctcgtacctcatttccgctgtccgagagtcaaacactcttatcaagcgctccggttcctaaagtgatgatgccgtctcccgcctctagcatgtttaggaaaccctacgtgcggcggcggccgtccaagcggcgaggcgctcgcgcattcaggtgtataaagccggccccagtgattcatccagcatcagtgattttcacagtgccagctacaactgtgaagattgtgagcctcggagggggatgcaacatgatccaacccgttaacgccgccgtggcccaatcccctcaaactattccgattgccacactccttgtcaatccaacgtccttcccctgccctttaaatcagcccctggtagccagtagtgtttctcccctcatcgtgagtggaaactccgtcaatctccccatcccatcaacccctgaggataaagcccatatgaacgtggatattgcgtgcgccgtagcggacggagaaaatgcgtttcaaggtctggaacccaagctggaaccccaggagttgtctcccttaagcgccaccgtgtttcccaaggtggaacacagccccggaccaccccctgtagataagcagtgtcaggaaggtctgtccgagaactcggcctaccgttggacggtggtgaagacggaagaggggagacaagccctggaacctctaccacagggcatccaagagtcgcttaacaattctagcccaggagacctggaggaggtggtaaagatggagcctgaggatgctaccgaggagatttctggcttcctttag

SEQ ID NO: 16147 - DNA, 1563 bp, Artificial Sequence
  Description of Artificial Sequence: Synthetic coding sequence
atgttcgtctccgatttcaggaaggaattctacgaagtggtccaatcccagcgcgttctcttgttcgtggctagcgatgtcgacgccctgtgcgcttgcaaaatactacaggccttgttccagtgcgaccatgttcagtatactctggtgcccgtgagtgggtggcaggagctggagacggcattcctcgagcacaaagaacagatcaagcttctgataaagcaggatgatgatcttgaggttcccgcttatgaagatattttcagggatgaggaggaggacgaggagcattcgggaaatgattctgacgggagcgagcccagtgagaaaagaacccggctcgaggaagagattgtggaacaaactatgcgccgcaggcagagaagagagtgggaagcaaggcgcagggatattctgtttgattacgagcaatacgagtatcacggcacctccagcgccatggttatgtttgaactagcctggatgctttctaaggatctgaatgatatgttatggtgggccattgtcggcctgacagatcagtgggtccaggataaaatcacccagatgaagtacgtaactgatgtgggggttctgcagaggcatgtatcgagacacaaccataggaatgaggacgaggaaaacacactgagcgttgattgtactcgcatcagcttcgaatatgatctgaggctggtcctctatcagcactggagcttgcacgactctctttgtaatacaagctatacagctgcaaggtttaaattatggtccgtgcacggacagaagcggctgcaggaattccttgccgatatggggctgcccttaaagcaagtgaagcagaaattccaggcaatggatataagcctaaaggagaatttgcgcgagatgatcgaagaatctgcaaataaattcgggatgaaagacatgagggtgcaaacatttagcattcattttgggtttaagcacaaatttctggcttccgacgtcgtgttcgccactatgagcctcatggagagtcccgaaaaggacggaagcgggaccgatcactttatccaggcactagacagcctctcccggagcaatttggataagctctatcacggactggagctcgccaagaaacagctccgtgccacgcagcaaacaattgcttcctgcctgtgtaccaacttggttatcagccagggaccatttttatactgttcacttatggagggaacacctgatgttatgctgttttctcggcccgctagtctctccttattgagcaaacacctcttgaaatccttcgtctgttccaccaagaatagaaggtgtaaacttctacctttagttatggctgcgcccctgtccatggagcacggaaccgtgaccgttgtgggaataccacccgagaccgactcctctgacaggaaaaacttcttcgggagggcttttgaaaaggcggcagagtccacctctagccgcatgctgcataaccattttgacctgagcgtaatagaactgaaagcagaggacagatcaaaatttctcgatgccctcatttcccttttgtcttag

SEQ ID NO: 16148 - DNA, 567 bp, Artificial Sequence
  Description of Artificial Sequence: Synthetic coding sequence
atgacagccccctcttgtgcctttccagttcagtttcggcagccgagtgtgagtgggctttctcagataactaagtccctctacatttctaatggtgtggcagcaaacaacaagctcatgctctcttcaaaccaaatcacgatggtaattaatgtgagcgtggaggtcgtgaacacactctatgaagatatacagtatatgcaggttcctgtcgccgacagccctaactcacgcctgtgcgacttctttgacccaatcgctgatcatattcacagtgtcgagatgaagcaagggcgcacactcctccactgcgctgcaggtgtatccagatctgccgctctgtgtctcgcttacttgatgaagtaccatgcgatgtcactgctcgacgcccacacttggaccaagagttgtcgaccaattatccggccaaactcagggttctgggagcagctgatacattacgagttccagctgttcggaaagaacacagtgcacatggtctctagccccgtgggtatgattcctgacatttacgaaaaggaggttaggctgatgatccccctgtag

SEQ ID NO: 16149 - DNA, 1182 bp, Artificial Sequence
  Description of Artificial Sequence: Synthetic coding sequence
atggatgcagccacgcttacatacgatacgttgcgatttgcagagtttgaggattttcccgagacatcagaaccagtgtggattctggggcgaaagtattccatcttcaccgaaaaggatgaaattctatccgatgtggctagcaggctgtggttcacctacagaaaaaattttcccgccattggtggaacaggccctacatccgatacaggttgggggtgcatgctgcgatgtgggcagatgatcttcgcacaggcgttagtgtgtcgccacttaggacgcgactggagatggactcaacgtaagaggcaaccggatagttatttcagcgtgctgaatgcctttattgatcgcaaagacagctactactcaatccaccaaattgctcagatgggagttggcgagggcaaatctatcggccagtggtacggtcccaatactgtggctcaggtgttgaagaaactggcagtgtttgatacctggagctccctcgccgttcacattgcaatggacaacaccgtggtcatggaagagatccggaggctgtgccgcacttcagtcccctgtgccggagccactgcattcccagccgatagtgaccgccattgtaatggattcccagcaggtgctgaggtgaccaatcgccctagcccttggagaccactcgtcctgctgatcccattgaggttgggcttgactgacatcaatgaggcctatgtggagactttgaaacactgctttatgatgccgcaaagcttgggcgtgatcggcggaaagcccaactcagctcattatttcatcggttatgttggggaggagttaatttatctagatcctcacacaacccagcctgccgtggagcctactgatggatgctttatccctgacgaaagctttcactgtcagcacccaccatgcaggatgagcattgccgaactggacccgtccattgccgtgggattcttctgtaagaccgaggatgactttaatgattggtgtcaacaagtgaagaaactcagtctgctggggggagccttgcccatgttcgaactcgttgaacttcagccttcccacctggcttgtcccgatgttttgaatctgtcgctcgattcatcggacgttgagagactcgagcggtttttcgacagcgaagacgaagatttcgaaatactgagcttatag

SEQ ID NO: 16150 - DNA, 780 bp, Artificial Sequence
  Description of Artificial Sequence: Synthetic coding sequence
atgaaggacgtggataatctgaagagtatcaaagaagagtgggtctgcgaaaccggctccgacaaccagcccctgggtaataatcagcaaagtaattgtgagtacttcgttgatagcctcttcgaggaagcccaaaaggtctcttcaaagtgcgttagcccagccgaacagaaaaaacaggttgatgttaatatcaagctgtggaagaacggttttacagtgaacgacgatttcaggagctactcagacggagcatcccagcaatttctgaattctattaagaaaggcgaactgccctcggagcttcagggcatattcgacaaagaagaggttgatgttaaggtggaagacaagaagaacgaaatctgtctgtcaacaaagccggtgtttcagcccttttctggccagggacatagactagggagtgccaccccaaaaatcgtctcaaaggctaaaaacatcgaagtggagaataaaaataacctgagcgctgtgccgctgaacaatcttgagcctatcaccaatatccagatttggctcgccaatggcaagagaatcgtacagaagttcaacatcactcatagggtctcccacataaaggactttatagagaaataccagggttcacaacgctccccccctttcagcctcgccaccgcacttcccgttctgaggctgctagatgaaaccctgacacttgaggaggcggacctccaaaatgccgtcattatccagcggttgcagaagaccgctagtttccgcgaactgagcgaacattag

SEQ ID NO: 16151 - DNA, 852 bp, Artificial Sequence
  Description of Artificial Sequence: Synthetic coding sequence
atgattcctccccaagaagcctccgcacggcgaagagagattgaggacaagctgaaacaggaggaggagacgctgtcctttattcgcgattcgctagagaaaagcgatcaattaacgaagaacatggtgtcgattctgtcttccttcgagtcgcggcttatgaaactcgagaattccataatcccagtgcacaagcagacggagaatctacagcgcctgcaagagaatgttgaaaagaccctgtcctgcctggaccacgttatatcttactatcacgtggcgagtgacactgaaaagatcatccgcgaaggtccaacgggtaggttggaggaatatttggggagcatggcgaagatccaaaaggctgtcgagtatttccaggacaattctcccgacagcccagagctcaacaaggtgaagcttctctttgagcgcggtaaagaggccctagaaagcgagttcagaagcctgatgaccaggcattccaaagttgtgagccccgtgctcattctcgacttaatcagcggcgacgacgatctggaagcccaggaggatgtcaccctggagcatctcccagagtccgtgttgcaggacgtgattcggatatctcggtggctggtggaatacggacgcaaccaagatttcatgaatgtctattaccagatccgctcaagccagctggataggagtatcaagggccttaaagagcactttcacaagagctccagttcaagtggggtgccctattctccggctatacccaacaagcggaaagacacccctaccaagaaaccagtgaaacgcccaggggagccccctagctggcccatcagtgccactgcacgcggatag

SEQ ID NO: 16152 - DNA, 2121 bp, Artificial Sequence
  Description of Artificial Sequence: Synthetic coding sequence
atgaatgaggctatggccaccgattctcctcggaggcccagtcggtgtacaggcggggtggtcgtgaggccccaggctgttaccgaacagtcatatatggaatcagtggtgacattccttcaagatgtggtgccacaagcctattctggaactcctctgactgaggagaaagaaaagatcgtctgggtgaggttcgagaacgcagatctcaatgacacatctcgcaatttggagttccacgagatccattctactggaaacgagcctcctctgcttatcatgattgggtattccgacggcatgcaggtgtggtccattccgatttctggagaagcccaggaactattttctgtaagacacggccctatccgggccgcgcgaatcctcccagccccacagttcggtgcacagaagtgcgacaattttgccgagaaacgcccactgctgggggtctgcaaatcaattggctcttccggcacaagcccgccatactgttgcgtggacctgtatagcctgcgcaccggcgagatggtgaagtcgatacagtttaaaactcccatatacgatctccactgtaacaaacgtatcctcgttgttgtattgcaggaaaaaattgccgcattcgattcttgcacttttacgaaaaagttcttcgttacctcatgttacccatgtcccggcccaaatatgaaccctattgcccttgggagtcggtggctggcttatgccgaaaacaaactgattcgttgccaccaatccagaggcggcgcctgtggggataatatccagtcctacacagctacggttatctctgccgcaaaaacccttaaatcagggctgacgatggttggaaaagtggtgacccagctgacagggacactaccgtccggggtgacagaagacgatgtggctattcacagcaacagtagacgcagtccactcgtcccagggatcattactgtaattgataccgaaaccgtgggagagggccaggtgctggttagcgaggactccgattccgacggaatcgtggctcatttcccagcccacgaaaagcctgtgtgctgcatggcttttaacacctctggcatgcttctggtgaccacagacaccctgggccatgacttccacgtgtttcaaattctaactcacccatggtcaagctcccaatgcgccgtccatcacctgtacacactgcaccggggcgagaccgaagcgaaggtgcaggacatctgtttctcacatgactgtcgctgggtggtggttagcacgctgcgtggtactagccatgtgtttccaatcaatccatatggcggacagccttgtgtcaggacccacatgtccccgcgagtggtgaataggatgtccagatttcagaagagtgccggcctagaggagatcgagcaggagttaacgtcaaaacaggggggtcggtgttcgcccgtccccgggctaagtagttccccaagcggaagtcccctccacgggaaactaaatagtcaagattcatataacaatttcacaaacaataatcctggcaacccccgcttatctccgttacccagcctgatggtggtgatgcccctcgcacagattaaacagcccatgacgctgggaacgattaccaaacgcaccggaccgtacctgtttggagccggctgctttagtataaaggctccctggtcctacataatgaccaaatacatcttttacatcaagcccccgaataaagttaaacctccacctcagatttctcctagtaagtcaatgggcggagagttttgcgtcgcggccattttcggcacaagtcgatcttggtttgccaacaatgctggcctgaagcgagaaaaggaccaatccaagcaggtcgttgtggagagtctgtacattatcagctgctatggcactttggttgagcacatgatggagccaaggcccctgtcaacggctcccaagatctccgatgatacccctctcgaaatgatgacttcaccaagagcaagctggacattggtgaggacccctcaatggaacgaattacagccccccttcaacgccaaccacccgctactactagcagcagacgccgtacaatactaccaattcctacttgcaggctag

SEQ ID NO: 16153 - DNA, 1815 bp, Artificial Sequence
  Description of Artificial Sequence: Synthetic coding sequence
atggggggctgtttttcaaagccgaagccaggcgctgctctcccaaccgtcgaactgaaaatcgaagtcgtattacccgagaaagagcggggcaaggaggaactgagcgcgagcggaaaggggtcgccaagagcataccagggtaacgggaccgcaaggcacttccacactgaggagcgtctgtccacgccccacccctacccttcaccacaagactgtgtggaggctgccgtctgccacgtgaaagatctggagaatgggcaaatgagagaggtggaattgggctggggaaaagtgcttctggtgaaggacaacggggagtttcatgcactgggacataaatgtccacactatggcgccccgctcgtgaagggagttttgagtcggggccgtgtcagatgtccctggcatggagcctgttttaatatatcaacaggagacctggaggattttccgggcctcgactccttgcacaaatttcaggttaagatcgagaaagagaaggtctatgtgcgagctagtaagcaggccttgcagctgcagcgccggaccaaagttatggctaagtgcatttcgccttcggcaggctattccagcagcacaaacgtcctgatcgttggtgccggcgcagctggacttgtgtgcgccgaaactctgagacaggaaggctttagcgataggatagtgctctgtaccctcgataggcacctgccctatgacagaccaaaattgtccaagagtctggacacgcagccagagcagctggcactccggcctaaggagttctttagggcttatgggatcgaagtgctaacagaagcacaggtggtaacagttgatgtccgtaccaaaaaggtcgtcttcaaagacggattcaagttggaatactctaaactgctgctggcccccggcagcagtcccaaaacactgtcttgcaagggtaaggaggtagagaatgtgttcacaatccgaactcctgaggatgctaatcgggttgttaggttggcccgcggacgcaatgtcgtcgtggtcggcgccggattcctgggcatggaggttgctgcgtacctgaccgaaaaagctcatagcgtgagcgtcgtagagctggaggagactcccttcagacggttcttaggcgaacgggtcggaagggcactaatgaaaatgtttgagaataacagggtgaaattctacatgcaaactgaagtctctgagctgcgaggccaggaagggaaattaaaagaagtggtgctgaaatcctcaaaggtggtcagagccgacgtgtgtgtggtcggaattggtgccgtcccagccacggggttcttgagacagagcgggattggattggattcacgcggattcattcccgtgaacaagatgatgcagacaaacgtgccgggcgtgttcgctgcaggtgacgctgtgacttttccactagcttggaggaacaatcggaaggtgaacattcctcattggcagatggcccatgcccaggggagggtggccgcccaaaacatgctggcgcaggaggcagaaatgtcgacagtgccgtacttgtggacagccatgtttgggaaatcattgagatacgctggttacggtgagggcttcgatgacgtcataattcagggcgatctggaggagctgaagtttgtcgcattttatactaaaggggatgaggtgatcgccgttgccagcatgaattacgaccccatagtgtcaaaggtggcagaagtgctcgctagcggtagggccatccgtaagagggaagtggagaccggcgatatgtcttggctcaccggcaaagggtcctag

SEQ ID NO: 16154 - DNA, 744 bp, Artificial Sequence
  Description of Artificial Sequence: Synthetic coding sequence
atgagcacggcagccgttcctgagctcaaacagatctctagagttgaagccatgcggcttggaccaggctggagccactcctgtcacgccatgctgtatgccgccaaccccggtcaacttttcgggcgaattccaatgcgattcagtgtgctcatgcaaatgcgcttcgacgggcttctgggtttcccagggggttttgtggataggaggttttggagcctagaagacggcctgaacagagttctgggactcgggttgggttgcctgagactgacagaagctgactacctgtccagtcacctgaccgagggtcctcatcgcgtggtcgcccatctgtatgcccgtcagctgactctggagcagttgcacgctgtggaaatctctgcagtgcatagcagggatcacggactcgaggtcggtccacccccagggccacgcccaccaccaagggggctggccctcgccccctggaaggcgcctatgggaaacactagccccgagggacctctggccggcttaggtagggtttccctaagtcccgcaatgggttggggggaaggcagcggggccggccgtcctggaaaggagggtagaggatgggggcctgctctcgggctccctcaggggtgcgtcacgtcggccctgctcccagccatcgccaatcccgggagcgggggggttggctctgtgggccgtaagggttggggccgttccggtgactgtttgggtagttgggagacctag

SEQ ID NO: 16155 - DNA, 1338 bp, Artificial Sequence
  Description of Artificial Sequence: Synthetic coding sequence
atgtacccgaatccccttatctactgtacctgctgggacccgtggaacctgggccccagaaagctgatcaagaccccccagctccctcgtaaaaacagcactggctccagcaagctgactccactggtgccagccccaaagaaccataactacctacaacccaccaagcctgtcgtatcaccaaagatgaaaattcatagcgcaaggcaggaagagaccaacaaatccttttacgaggtaatcaatgtgagtccggggtaccaactcgtccgcaacagggaacagatatcagtcaccctgggagacgaaatgtttgatagaaagaaacggtgggagtcagaaatcccggataaaggcagattctctcgaactaatatcatttccgacctggaagaacagatctcagaactcaccgcaatcatcgagcagatgaatcgggatcaccagtccgcacagaaactgctgtcttccgagatggacctccgctgtgctgagatgaagcagaacttcgagaacaaaaatagggagctaaaggaagcccatgaggctgagttatcagaactggaaaacaattacaaggcagccttaaaagcagagaaactggcggctcaggagaaattggaagaaatgggtaaagagtacaaatatctcaagaatatgtttcgaacatatcaagattccatatacgacgagatggaggaaaagtggtccaagcagaaggccaaatggaaaaaggacgaaaagtttgagcgggaaaacatcctcctgcaacagaaaaagaagatgactaaaaagtttgagatggaatctggagaagaggacaaaaaaattaacgaatcctgtagcgcagtattcgaaaacttcatccaggaaaaagaggagttgctgaagcagcaccagagcgataccctccagttggaggagttacgcaaaaccaaggaggtgccctggagaagggaccagatcaatcgacactggcacgacgtgctgcagcaattactgttaatgcaagtgatgcaggaggaattacacgctcaggccttgatactggaaagcctgaataccaatctgtactatacccaattggagctccagaaagaaaaggctatagtcgggaatttggagaaaatgctgcagaccaaattcgcggaaacggaggagaagtacaaacacactattcagatcctcacggaagagaatatacaccttaagcaaaagataataagcaagaacgaggaaatttgcgagggctgttctgggcggctagcttctattacggtcagtaaggatgactctgacacggtccaggacgggtccaaaaagggtcaggaatcctag

SEQ ID NO: 16156 - DNA, 1335 bp, Artificial Sequence
  Description of Artificial Sequence: Synthetic coding sequence
ttcagggtcccagccgctggaaggaggtgcccactggctcgaggagccaggcggcctcctgacagcgcctgcggcaggtttccacccgaccctggatctcccccagaggaagaggatgcagacctaagcgagcgggaggagagctggctgctggccgaaagagaggagaatcaggaggcagagtttcctggactccggcgtgctgtgcaactaaatttgtcccgcccgattgaggagcagggtccgttggatgttattatacacaagttaacagacgttatacttgaggccgatcagaatgacagccagtcactcgaactggttcataggttccaggagtatatagacgctcatcccgagaccatcgtgctcgatccactccctgccatccgaaccctgcttgatagatctaagagctacgaactgataaggaagatcgaagcctatatggaggatgataggatctgttctccaccctttatggaattaacaagtctgtgtggggacgacaccatgaggttgttggaaaagaatggcttgacctttcccttcatttgtaagactcgtgttgcccatgggaccaattcgcacgagatggccatcgtcttcaatcaggagggactgaatgcgatccagcctccatgcgtggtgcagaattttattaaccataatgcagtcctgtacaaggtcttcgtagtgggcgaatcttacactgtggttcagaggccaagcttaaagaacttttccgccggaacatcagacagagagagcatctttttcaacagccacaatgttagcaaaccagagagttcctctgttttgacagagctagacaagattgagggagtttttgaaagaccgtccgatgaagtgatcagagagctctctcgcgcgctgcgccaggccctgggcgtgtccctcttcgggatcgacatcattatcaataatcaaacgggtcagcacgccgtgattgacattaatgcttttcccggatatgaaggagtgagcgaattcttcactgatctgctgaatcatattgctactgtgctccagggtcagtcaactgcgatggcggcaactggcgacgtcgcgcttctcagacactccaagttactggctgagcctgccggggggctcgttggcgagagaacctgctctgcgagcccaggatgttgcggctctatgatgggccaggatgccccatggaaagctgaagccgacgccggagggacagccaagttgccacatcagcgcctgggttgtaacgcgggagtcagtccttcgtttcagcagcactgcgtggctagcttagcaaccaaagcctctagccagtag

SEQ ID NO: 16157 - DNA, 864 bp, Artificial Sequence
  Description of Artificial Sequence: Synthetic coding sequence
atgtgtggacgcaggagaaggcaaagagcagccctgctttcgcactgggatcccactctgagttctgactgggatggggagcgaacagctcctcagtgcctgctgagaattaagagggacatcatgtccatttacaaggagcccccccctggcatgttcgtagtcccagacaccgtggacatgactaaaatacatgcactgatcaccggcccttttgatactccatatgaaggcgggtttttcttattcgtatttaggtgtcctccagactatcctatccaccctccccgggttaaacttatgactacagggaacaataccgtgaggtttaaccctaatttttacaggaatggtaaagtgtgcctctcgatccttggcacttggacaggacctgcatggagcccagcccagagtatctcatccgttctgatatcgatccaaagtcttatgactgagaacccatatcacaacgaacccggattcgagcaggaacggcacccaggagactctaagaactataatgaatgtataagacacgaaactattagggtggcagtctgcgacatgatggagggtaaatgtccctgtcctgagcccctgcggggagtgatggagaaaagcttcttagagtactacgatttttatgaggtcgcatgtaaggaccggctccacctacaggggcagaccatgcaggatccttttggcgagaagcgaggccactttgactaccagagtctgttgatgcgactcgggttgatcagacagaaagtgctggaaaggctgcataatgagaacgcggaaatggatagcgattcctcaagcagtggtacagagaccgatttgcatgggtccctcagggtgtag

SEQ ID NO: 16158 - DNA, 852 bp, Artificial Sequence
  Description of Artificial Sequence: Synthetic coding sequence
cccccatgcagcctcatttcagattgttgcgccggcaatcagagggatagcgtcggcgtgggcccctccgaacccggctgttacccgtgtcctggaccaaatatgaacccgatagccctgggctcccgctggctcgcgtatgccgagaataagttaatccggtgtcatcagtcacgagggggagcctgcggcgataatatacagtcatataccgccactgtaattagtgcagctaaaaccctgaagagtggattgactatggtaggcaaggtggtcacacaattaacaggaacccttcctagcggggtaaccgaagacgacgtggccatccattctaactctagacggtctcctctggtgcctgggataatcacagtcatagacaccgagactgtgggagagggccaggtccttgttagtgaggacagcgatagcgatgggatagtagctcattttcccgcacacgaaaaaccggtctgctgcatggcgtttaacactagtggaatgcttctcgtaacaacagatacactcggacacgattttcacgtgttccagatcctgacccatccttggagttcatcgcagtgcgctgttcaccatctctataccctccaccggggcgagactgaagccaaagtgcaagatatctgcttttcacatgattgcagatgggttgtcgtgtctaccctgcgtgggacttcacatgtcttccccatcaacccctacggagggcagccctgtgttcgcacacatatgtcacccagggttgtgaatcggatgtcaagattccagaaaagcgccggcctggaggaaatagagcaggaactgacctctaaacagggtgggcgttag

SEQ ID NO: 16159 - DNA, 2235 bp, Artificial Sequence
  Description of Artificial Sequence: Synthetic coding sequence
atgagcgcagccaatcccgagactcccaattcgacgataagccgcgaggctagtactcagagtagctctgcggccgcgagtcagggctgggtcctccctgagggcaagattgtgccaaatactgtgtttgtggggggaattgatgctaggatggatgagacagagatcggctcatgttttgggagatacggctctgttaaagaggtcaaaattatcacgaatcggacgggtgtttcaaaggggtatggattcgtcagctttgttaatgacgtggacgtgcaaaagatagtcgggtcgcaaatccatttccacgggaagaagctgaaattgggacctgcaattcggaaacaaaagctgtgcgctaggcatgtgcaacccagacctcttgtggtgaatcctcccccccccccacaatttcaaaatgtttggcggaaccctaacaccgagacctacctccagccccaaatcacacccaatcctgtcacccagcacgtccagagcgctgccaatccagagactcccaattccacaatctcgcgggaggcatccacgcaaagcagtagcgccgccgctagccaaggctgggtgctgcctgagggaaagatcgttccaaatacggtctttgtagggggaatcgacgccagaatggatgagaccgaaattggctcctgcttcgggaggtatggcagtgttaaagaggtcaagataattacaaatcgcactggcgtaagcaaaggatacgggtttgtgagcttcgtgaacgatgtggatgtccaaaaaatcgtgggatcacaaatccatttccatggaaaaaaactcaaactggggccagcaatcagaaagcaaaagttgtgtgcaaggcatgtgcagccccgcccattggtggtcaaccctccccccccgccccagtttcagaacgtatggaggaaccctaacactgaaacctacttgcaaccccagattacaccgaacccagtcacacaacacgtgcagagcgcggccaatccagaaactcccaactctacaatctctcgggaggcgtccactcagtctagctccgcagcggccagtcagggctgggttctcccagaagggaagattgtacccaatacagtgttcgtcggaggtatcgatgcccgaatggacgaaactgaaatcggatcttgtttcggaagatacggctccgtgaaggaggtgaagatcataaccaacagaaccggggtgtctaagggctatgggttcgtgagttttgtgaacgacgtagacgtacaaaagatcgtggggagtcagatccactttcatggcaagaagttgaaattggggcctgcgattagaaaacagaagctgtgcgcaagacacgtgcaacctcgcccactggttgtgaatccaccacctcctccccagttccagaacgtgtggcgtaaccccaacaccgagacctaccttcagccacagattactcctaaccccgtgacacagcacgtgcaggcttattctgcctatccacatagtcccggtcaggtgattaccggttgccaattgttagtctacaactatcaggagtaccctacctaccccgattctgccttccaggtaactacaggttaccaactgcccgtgtataattatcaaccttttccagcttaccccagaagtcccttccaggtgaccgcaggataccagctgcccgtctataattatcaagcattccctgcctacccaaactctccgtttcaggtggccacaggataccagttcccagtctataactaccagcctttccccgcctatccatcctcaccatttcaagtcaccgctggataccaactgcctgtctacaactaccaagcttttcccgcctatcccaactctcccttccaggtggcaactggataccagtttcctgtatataactaccaggcatttcctgcataccctaacagtccagtgcaggtgactacaggctaccagctccccgtctataactaccaagcgttccccgcttacccttcaagtccctttcaagttacaactgggtaccaactcccagtctataattaccaggcattccccgcctaccccaatagcgctgttcaagtgaccactggctatcagtttcatgtgtataattatcagatgccccctcagtgtcctgtcggcgagcagcgtcgcaacctgtggacagaggcctacaagtggtggtacctggtgtgcctcattcaaaggcgagactag

SEQ ID NO: 16160 - DNA, 1089 bp, Artificial Sequence
  Description of Artificial Sequence: Synthetic coding sequence
atgctcaaaaataaggggcattcgtctaaaaaagacaacctggcggttaatgctgtcgccttgcaggaccacatactgcatgacctgcagctgcgcaacctatcagtggccgatcattccaagacgcaagtccaaaagaaagaaaacaagtcactgaagagggacacgaaagcaattatcgacacaggcctgaaaaaaaccacccagtgtcccaaactggaagacagcgagaaggagtacgtgctggaccctaaaccacctccactcactttagcccagaaactcggcctcatcggtccgcctcccccaccactgagctctgatgagtgggaaaaagtgaaacagaggtccctgttgcaaggagattccgtgcagccatgcccgatctgtaaggaggagtttgagctaagaccccaagtgcttctcagttgcagtcatgtgttccacaaagcttgtctgcaagctttcgagaagttcactaacaaaaaaacttgtcccctgtgccggaagaaccagtatcaaacaagggtgatccatgatggcgctaggctgttcaggattaaatgcgtcacacgaatacaggcgtactggcgtggttgtgtagtccggaagtggtatcgtaatctgagaaagaccgtgccacctaccgatgctaagctcagaaagaaattttttgaaaaaaagttcactgaaatatctcaccggatcttgtgctcttacaatacaaatattgaagaacttttcgccgagatagatcagtgcctggccatcaaccgctctgttctgcagcagcttgaagagaagtgtggtcatgaaattacagaggaggagtgggaaaagatccaggtgcaggctctccggagggagacccatgaatgcagcatctgccttgcccctcttagcgcagctggcggacagagagtgggcgcagggaggagatcccgcgaaatggccctgttgtcttgcagccatgtcttccatcatgcttgcttattggctcttgaggagttctcagtgggagatcggccccccttccacgcctgtcctctgtgtaggtcatgttatcagaagaagatattggagtgctag

SEQ ID NO: 16161 - DNA, 2130 bp, Artificial Sequence
  Description of Artificial Sequence: Synthetic coding sequence
atggccgatgccggtatccgccgggtggtcccttccgatctgtacccattggtcctggggtttttgcgtgataaccaactctctgaggttgctaataaattcgctaaggcaaccggcgcaacccaacaagacgccaatgccagctccttactggacatttattccttctggctgaagagcgcaaaagttcctgagcgcaagttgcaggcaaatggacccgtggctaagaaagcgaagaagaaagcatcgtcgtcagatagcgaggactcatccgaggaagaggaagaggtccaaggcccccccgcaaagaaagccgccgtacctgctaaaagagtgggactgccgccagggaaggccgccgccaaggcttctgagtcttccagtagtgaggaatcgtctgacgatgacgatgaggaagatcaaaaaaagcagcccgtgcagaagggagtgaaaccccaggcaaaggcagccaaggcgcctccaaaaaaagcgaagagttccgactctgacagcgacagtagtagcgaggacgagcctcccaaaaatcagaaacctaaaatcactcccgtcaccgtaaaggcccagacaaaggcccctcctaaaccggctagagccgctcctaagatagccaacggaaaagctgcaagtagctcttccagttcatcctcttcttcctcaagcgatgattccgaggaagagaaggccgccgctactccaaagaaagtctggacgatcacaagtgtccgagctgagacagtgcccaaaaagcaggttgtggccaaagcacccgtgaaggcggccaccacccctacgagaaaatcctccagcagcgaggattcttcttcggatgaggaagaggaacaaaaaaagccgatgaagaacaagcctgggccttactcttcggtgcctcccccctcagccccccctcccaaaaagtccctgggcacacagcctcctaagaaagccgtggagaagcagcagcctgtggaaagctccgaggattctagcgacgagtccgacagctcctctgaagaagagaagaaacctcctaccaaagccgtggtcagcaaggccacaaccaagccaccccctgccaaaaaggccgccgagtcgtcttctgattccagtgactctgacagttctgaggacgatgaggcaccatctaagcctgccgggaccaccaagaactcctccaacaagcctgccgtgactacaaagagtcccgcagtgaaacccgccgccgctcctaaacagccagtcgggggcggccagaagttgttaacacggaaagctgactcttctagctctgaagaagaatcttcatcctctgaagaggaaaaaacaaagaaaatggtggccacaaccaagcctaaggctacggccaaagctgctctgagcctccccgccaaacaggcccctcaaggttccagagatagttcctctgacagtgattccagctcctcagaggaagaagaagaaaaaacatcgaagtcagccgtgaaaaaaaagccacagaaggtcgcaggtggcgcggccccctctaagcccgcttcggccaaaaaggggaaggcagagtccagtaatagctcatcttctgatgattcgagcgaagaggaggaggagaagttgaaaggaaaaggctcccctaggccacaggctcccaaagcaaatgggacatccgcccttaccgcccagaacggtaaagctgccaagaactccgaggaagaagaggaggagaagaagaaagccgccgtggtagtcagcaagtcaggcagcctgaagaaaaggaaacaaaatgaagccgctaaagaggcggaaacaccacaggcaaaaaagatcaagcttcaaactcctaacacctttcccaagaggaaaaagggcgagaagcgggcttcatcaccttttaggcgtgtgcgcgaagaagagattgaggtggactcacgagttgccgataactcatttgacgccaaacgaggggccgccggagattggggagagcgagccaatcaggtgctgaaattcacaaaggggaaatcttttagacatgaaaagactaagaaaaagcgcggttcttaccgaggtgggtctatctcagtgcaggtgaactccatcaaatttgattccgaatag

SEQ ID NO: 16162 - DNA, 558 bp, Artificial Sequence
  Description of Artificial Sequence: Synthetic coding sequence
atgcagcagaagtcacaaaaaaaggcggaactgctggataacgaaaaacctgccgccgtggtcgcccccatcactactggttacaccgtgaagatatcaaactatggctgggaccagtctgacaaattcgtgaagatttatatcaccctcacaggtgtgcatcaggttccaacagagaacgtgcaagtgcactttaccgagagatcgtttgacctgttagtaaagaacctcaacggcaaatcctactctatgatcgtgaataaccttctcaagcccatttccgttgaaggatcctccaaaaaggtaaagaccgataccgttctgattctgtgcaggaaaaaggtcgagaatactcggtgggactacttgacgcaggtggaaaaggagtgcaaggaaaaagagaagccatcttacgacacggaaacggatccatctgagggtctcatgaatgttctgaagaagatttacgaagatggcgacgacgacatgaagagaaccataaacaaagcttgggttgaaagccgggaaaagcaggccaagggagacaccgagttctag

SEQ ID NO: 16163 - DNA, 1764 bp, Artificial Sequence
  Description of Artificial Sequence: Synthetic coding sequence
atggccagtgaggatatagccaagctggccgagacacttgctaagacgcaagtggccggcgggcaacttagtttcaagggcaaatccctgaaattaaacactgcagaagatgccaaggatgtgataaaggaaatcgaggatttcgatagcttagaagccctccgcctggaaggtaacacagtgggcgtggaagccgccagagtcatcgccaaggcattggagaagaaaagtgaactgaagaggtgtcattggagcgatatgttcacaggcaggctcagaactgagatcccccccgcactcatttcgctgggcgaaggcctgatcactgctggcgcgcaactggtggagttggatctttcagataacgcctttggaccagatggtgtgcagggattcgaagccctcctaaagagttctgcatgttttaccctgcaggaactgaaactgaataactgtggcatggggattggaggaggcaagatcttagctgccgccctcaccgagtgccatcggaaatccagcgcccagggaaaacctctggccctgaaggtattcgtcgcgggccggaaccgcctggagaacgacggagccactgccctagccgaggcctttcgagttataggaactcttgaagaggtgcatatgccacagaacgggatcaatcacccaggaatcacagccctcgcccaggcttttgccgtgaaccccctcctccgcgtaattaatcttaacgataacacctttaccgaaaagggggccgtggccatggcagaaaccctgaaaacgctgcggcaggtcgaggtcattaatttcggtgattgtttggtgcgatcgaagggtgctgttgccatcgcagatgcaatccgaggtggtttgcctaagctgaaagaactaaacctctcattctgtgagattaagcgggatgccgcccttgcggtcgcagaagctatggccgacaaagctgagttggagaagctggacctcaacgggaacaccctgggcgaggagggatgcgaacaattgcaagaggtactggagggattcaacatggccaaggtgttagcctctctgtccgatgatgaggatgaggaagaggaagaggaaggggaagaagaggaggaagaggccgaagaggaggaggaggaagatgaagaggaagaggaggaggaagaagaagaggaagaagaggaaccccagcagcgtggacagggcgaaaagagcgcaaccccgagccgtaagatcttagacccgaatacaggcgagcctgctcctgttctgtcctcaccgccccccgccgacgtgtcaacttttctggcctttccgtctccagaaaagctgctgagacttgggcctaagtcaagcgtgttaatcgctcagcaaactgatacatctgatcccgaaaaagttgtcagtgctttcctgaaggtcagcagcgtcttcaaggacgaggcaaccgtgcgcatggcagtgcaggacgctgtggacgcattgatgcagaaagcatttaactcgtctagctttaactccaatacatttctgacccgactgctggtgcatatgggattgctgaaaagtgaggacaaggtaaaagcgattgcaaacctgtatggcccgctgatggctttaaaccatatggtgcagcaagattatttcccaaaggccctggccccactcctactggcttttgtgacaaagcccaactccgcgctcgagtcttgctctttcgccagacattcactgttacagaccttgtataaggtgtag

SEQ ID NO: 16164 - DNA, 1098 bp, Artificial Sequence
  Description of Artificial Sequence: Synthetic coding sequence
atgaaggagttatggtgcgtgatggactgggcagtgccgggcctgctgggaagcggcacctacttcaagaagcagttctccgacccagtggaacatgggcagagacatacagccactaagcgggaattggcaacggggcgaaaggcaatgcagcggctcgccaagaagatgtcgggttggttcttgcgacgaaccaaaacactgatcaaagaccagctgcccaagaaagaggaccggatggtgtactgtagcttgacagattttcagaaagccgtctaccagacagttttggagactgaggacgttaccctcatcttgcagtccagcgaaccctgtacttgcagatctggacaaaagagaaggaattgttgctataagactaattcacacggtgagactgtgaaaaccctgtacctctcctacttgaccgtgctacagaaggtggccaaccatgtggctctgcttcaggctgcctctacctccaaacagcaggagaccctcattaaaaggatttgtgaccaagtcttttctagatttccagatttcgtccaaaagtctaaagatgctgcctttgaaactctgagtgatcctaagtactctgggaaaatgaaagtcttacaacaattgctgaaccactgccgtaaaaacagggataaggtgctgctgttttcgttcagcacgaaactgctcgatgtattgcagcagtattgtatggccagcggtctggattaccgtagactggacggttcaactaaatctgaagaaagacttaagatcgttaaggagtttaactccactcaggatgtgaatatctgtctggtgagtactatggcgggggggttgggactgaacttcgtgggtgcaaacgtagtagttctgtttgaccctacatggaacccggccaatgatctgcaggccattgatcggacgcagacgcactgcaggcgagagcgtgatgctgaaccactttcctcggcgcctggcctgcaaaacggcagtgaaaacgccgttccttatccatggtggtgttgcgtgacaggggccagtatatcatgttggaggtgtgagatatgccgcatccaagatgtgcttgagtag

SEQ ID NO: 16165 - DNA, 1104 bp, Artificial Sequence
  Description of Artificial Sequence: Synthetic coding sequence
atggagaaaaagaagatggtcacacaaggaaaccaagagcccacaaccactccagatgccatggtccagccattcaccacaatacccttccctccccccccccaaaatggcatccccaccgagtacggagtgccccacacacaggattacgctgggcaaactggtgagcataatctcacgctgtatggctctactcaagcccacggcgagcagagtagcaactcaccgtcaacccaaaatggaagccttacacagaccgaaggaggcgcacagacagatggccagcagtctcaaactcagtcgtctgagaattccgagtcaaagtcgactcctaagagacttcatgtgagcaacattcctttccgattcagagaccctgacctaagacaaatgttcggccagttcggcaagatcctcgacgtcgagattattttcaatgaacgagggagtaagggcttcggcttcgtcacgttcgagaactcagctgatgctgatcgggcaagagaaaagctgcatgggacagtcgtcgaggggaggaagatcgaagttaataacgccacggcgagggtaatgacaaataaaaaaatggtgacaccatatgctaacggatggaaactcagccctgtcgtcggcgccgtatacggccctgaactgtatgccgctagctccttccaagctgacgtgtccctgggcaacgatgctgcagtgcccctttctggccgaggcggcataaacacctacattccattaataatccccggtttcccatacccgaccgccgctacgactgccgcagccttcaggggggcccatctgcgggggaggggccgcacagtgtatggcgccgttagggctgtgcctccaacagctatcccagcctaccccggtgttgacatgcagccaaccgatatgcattccctactgctccagcctcagccccctctgctgcagcccttgcaacctttgacagtcaccgtcatggctgggtgtacacaacctacccctaccatgcccctgcccctgccgttggccatggagctggccctgtggagggtctatacggaagtagccacggccgacctgccacctacagaggtgacctag

SEQ ID NO: 16166 - DNA, 1764 bp, Artificial Sequence
  Description of Artificial Sequence: Synthetic coding sequence
atggcttccgaagacatagccaaacttgccgaaacactggcgaagacacaagtggcaggtggccaacttagcttcaaaggcaaatctctgaagctcaatacagccgaagacgctaaggacgttattaaggaaattgaagatttcgacagcctggaggccttgcggttggaaggcaacacggttggcgtcgaggccgcgagagtgatcgccaaagcactagaaaaaaagagcgagctaaagcgctgccattggtcggacatgttcaccggtcgcctgcggacagagattcctcccgccctgatctctctcggcgagggactaattactgcaggagctcagttagtggaacttgacctttcggacaacgcgttcgggccagacggagtacaggggttcgaggccctccttaaatcttccgcatgctttactctgcaggaactgaagctcaataactgcggaatgggtatcgggggcgggaaaattcttgcagcggccttgactgaatgccaccgcaagtcttccgcacagggtaagcctcttgccttaaaggtgttcgtcgctggccggaacaggcttgagaacgatggggcaaccgcactggccgaggctttcagggttattggcaccttggaagaagttcatatgccccaaaatgggatcaaccacccaggtatcacggctctggcccaggcattcgccgtcaatcctctcctgcgcgtaattaatctgaacgacaacacgtttacagagaagggagcagtagcgatggctgagactctgaagactcttcggcaggtagaagttatcaacttcggcgattgtcttgtaaggtctaaaggcgccgtagctatcgccgatgcaatcagaggtggactgcccaaactcaaagaactcaatctttccttttgcgagatcaagcgggacgccgccctggctgtagctgaagccatggccgataaagctgaactggagaagctggacctcaacggcaacacactgggcgaggaagggtgtgaacaactgcaagaggtactggagggttttaatatggcaaaggttctggcttctctctctgacgatgaggatgaagaggaagaggaggagggcgaagaagaagaggaagaggccgaggaggaggaggaggaggatgaggaagaagaagaggaagaggaagaagaagaagaggaagaaccacaacagcgagggcagggggagaagagcgccaccccctcccgtaagattctagacccaaatacaggtgaaccggcaccagtattgtcaagtccaccaccggcggacgtctctactttcctggccttccccagtcccgaaaagctgctgcgtctgggacctaagtccagcgttctgatagcacagcagacggatacatcagaccctgagaaggtcgtctcagcttttctgaaggtgagcagcgtttttaaagatgaagcgacagtacggatggccgtccaggatgcagtagacgcgctcatgcagaaggcattcaattctagcagcttcaattcgaacacattccttactaggctgctcgttcatatggggctgctcaagtctgaggataaagtaaaagcaatagcgaacctctacggaccgcttatggctctcaaccacatggtgcagcaggactactttcccaaagccctggcgcctctgttgctggcattcgtgactaagccaaacagcgccctggagtcctgctctttcgcacggcatagcttgcttcagaccctgtacaaggtgtag

SEQ ID NO: 16167 - DNA, 1143 bp, Artificial Sequence
  Description of Artificial Sequence: Synthetic coding sequence
atggacgccgctactctcacgtacgacactctgaggttcgctgagttcgaggacttcccagaaacctctgaacctgtttggattttgggcaggaagtactctatcttcactgaaaaggacgagatcctctccgatgtggccagtaggttatggtttacttaccgcaagaattttccagccatcggcggcaccgggcccacatcagacacaggatggggctgtatgctgcggtgcggccagatgatttttgcacaggccctggtctgcaggcatcttggaagggattggaggtggactcaaaggaagaggcagccagactcttatttttcagttttgaacgctttcattgatagaaaagacagctactattcaatccatcagatcgcacagatgggagtgggagagggcaagtccatcggccaatggtacggcccaaataccgttgcccaggtcctcaaaaagctggctgtttttgacacctggtcaagtctcgctgtgcatatcgccatggacaacaccgtagttatggaagagatcagaaggctgtgccggacgtctgtaccttgcgcaggagctaccgccttcccagccgatagtgatcggcactgcaacggattccctgcgggagcagaggtgactaataggccctctccatggagacctctggtgcttctgattcctctgcgactcggtctaactgatattaacgaagcatacgtggagaccctaaagcactgcttcatgatgccgcaatcactcggtgttatcggggggaagccaaactcggcccattatttcatcgggtatgtcggggaagagctgatctaccttgatcctcatacaacacagcctgcagtcgagcccactgacgggtgtttcatccctgacgagtcttttcactgtcagcacccaccctgcaggatgtcaattgcagagctggatccatccattgccgtaggctttttttgtaaaacggaggacgactttaacgattggtgtcagcaagttaagaaactttccctcctgggtggcgctctacccatgtttgagctggtcgaattgcagccctctcacttagcttgtcccgacgtgcttaatctctctctcggggagagctgccaggtgcagatcctgttaatgtag

SEQ ID NO: 16168 - DNA, 2124 bp, Artificial Sequence
  Description of Artificial Sequence: Synthetic coding sequence
atgatccctccccaggaggccagcgccaggcgcagagagatcgaagataaactgaagcaggaggaggaaaccttaagctttatcagagactcgctggaaaagtctgatcagctcactaagaacatggtcagtattctgagctccttcgaatccagactgatgaagctcgagaattccattatacctgttcataagcagacggagaatttgcagaggcttcaggagaacgtcgaaaaaacattatcttgtctggatcacgtgatctcatactatcacgtcgcctctgacacagaaaaaattatccgggaagggcccactgggcgcctcgaggagtacctgggcagtatggctaaaatccagaaggctgttgaatatttccaggataacagccccgactcccccgagctgaacaaggtgaaactgctgtttgaaagaggcaaagaagcattggaatcggagttcaggtccctaatgactcggcactccaaagtggtcagcccagtcctgatcttggatctgattagcggtgatgacgacctagaagctcaggaggatgtcaccctggagcacttgcccgagtctgtgctgcaggacgtgatcaggatcagccgatggctggtcgagtatggtagaaaccaggattttatgaatgtgtactatcaaattagaagctcacagctggatagatctataaagggactgaaggaacatttccacaagtccagctcctcttccggtgttccctacagcccagcaatacctaataagcgaaaagatacgcctaccaaaaagcccgtgaaacggcctggaacaatacgcaaggcccagaatctgctcaagcagtactcacagcatggtctggacggcaagaagggaggatccaatcttattcctcttgaaggacatgagcacgacttccgcgtgaagcatctgtcggaagctctgaacgacaagcacgggcctttggctggacgtgacgacatgctagacgtggagaccgatgcatatatccactgtgtttcggcgtttgtaaagttggcacagtctgagtaccagttgctggcagatatcatcccagaacatcaccagaagaaaacattcgactctctgattcaggacgccctcgacgggctaatgcttgaaggcgaaaacattgtctccgcggctcgcaaagcaattgtgcggcatgactttagcaccgtgctgacagtgtttccaatcttgagacatttaaagcagaccaagccggagttcgaccaggtactccagggcaccgctgcttctacaaaaaataaattacctgggctgatcacatctatggagaccatcggcgctaaggccctggaagatttcgctgacaatattaaaaacgatcccgacaaggagtacaatatgccgaaggatggcacagttcacgagctgacaagtaacgccattctgttcctgcagcagcttttggattttcaggagacagccggcgcaatgctggcctctcaggagaccagtagctctgctacatcttacagttccgaattctctaagagattattgtcaacatacatctgcaaggtgctgggtaacctgcagctgaaccttcttagcaagagtaaggtctatgaagacccagcactgtcagctatctttctgcacaataattacaattacatactcaagtctctggagaaatctgaactgattcaacttgtggccgtaacacagaaaactgcagagaggtcatacagggagcacatcgagcagcaaatccagacttaccaacggtcctggctgaaggttactgactacatcgcagagaaaaatctgcccgtgttccagcctggagtgaaacttagggacaaggagcggcagattatcaaggagcgcttcaaaggttttaacgacggactggaggaactgtgtaaaatacaaaaagcctgggcaatccctgacaccgagcagcgggaccgcatccggcaagcgcaaaagaccatcgtcaaggaaacatacggtgcattcctgcagaaattcggcagcgtaccttttactaagaacccggaaaagtatatcaaatacggagtggagcaagtaggcgacatgatcgaccgcttgtttgataccagtgcatag

SEQ ID NO: 16169 - DNA, 1026 bp, Artificial Sequence
  Description of Artificial Sequence: Synthetic coding sequence
atggcacaggagagtcccaagaattctgccgcagaaatcccagtgacaagtaacggcgaggtggacgattcacgggaacattccttcaatcgcgacctcaagcacagcctgcctagcgggctgggtctgtcggaaacccagatcacgtcccacggattcgacaacaccaaagaaggcgttattgaagccggggccttccagggcggtcaacggacgcagaccaagtccgggcctgtgatcttagctgatgagattaagaaccctgccatggagaaactggaactggtgcgaaaatggtcattaaacacctataaatgcacacggcaaattatttcagaaaagctgggccgtggctctaggaccgtggacctggaactcgaagcgcaaatcgatatcctgcgcgacaacaagaagaaatacgagaacattcttaaattagcacagacactgtctacacagctgttccagatggtgcacactcaacggcagctgggggatgcatttgccgatctgtctctcaagtctttggagctgcatgaggagttcggttacaatgcagacactcagaagttgctggcgaaaaacggcgagacacttctgggggcgatcaacttttttatagctagcgtgaataccctggtaaacaagactatcgaggatacactgatgaccgtcaagcagtatgaatcagcgcgcattgagtacgatgcatacaggactgatctagaggaattgaacctcggccctagagatgccaatactcttcctaagattgagcagtctcagcacctttttcaggcccacaaggaaaagtacgataagatgagaaatgacgtgtccgtgaagctgaaattcttagaagaaaacaaggtgaaggtgttgcacaatcagctggtccttttccacaatgccattgcggcgtattttgcgggcaatcagaaacagttggagcagaccctgaagcagttccacataaaactaaaaacgccaggcgtagacgccccgtcatggctcgaggagcagtag

SEQ ID NO: 16170 - DNA, 1488 bp, Artificial Sequence
  Description of Artificial Sequence: Synthetic coding sequence
atggccggagttggccggagtggagggccatggggacggactaggggggggagatcaggccggctgggggtaagtctgggagctttaagcagcctgcccctcgaagagttgccaagacccctttgttgcagacgctgtagacggcattttggctttgccttacgaggagagaccattccagtatcagtggcagggagcgcatcttcgcagtttgcacctttagccctccacttaagcctcctgctcagccgcataagcgcctcaaggctcacaaggtggccccctcccgacaagagagagggttctgccgtggatccaggtaagcgccgaagcctggccgccactccatcttcgagcctcccatgcacactgattgccctcgggctgcgccatgaaaaggaggctaatgaattgatggaggacttatttgagacttttcaggatgaaatgggcttcagtaacatggaagatgacggacctgaagaggaggagcgagtggccgaacctcaagcaaatttcaacacgccacaggccctgcgctttgaggaactgctagccaacctgctgaatgaacagcatcagatcgccaaagagttattcgagcagttaaagatgaagaagccttcagcaaaacagcaaaaagaagtggaaaaggtgaaacctcaatgcaaagaagttcaccagactctaattctggatccagcccagagaaagcgcttgcagcaacagatgcagcagcatgtgcagttactcacacagatacacctgctggcaacttgtaatcctaacctgaacccagaggctagctccaccaggatctgtctcaaggagcttggaacatttgctcagtcatctatcgctctgcatcaccaatacaaccctaaatttcagaccctgttccagccgtgtaacctcatgggagccatgcagctgattgaggatttctccacccacgtatctattgattgtagccctcataaaacagttaagaaaacggcgaacgaattcccatgtctgcccaagcaagttgcctggattctcgccacttctaaggtgttcatgtaccccgagcttctacccgtatgcagtctcaaggcgaagaatcctcaggacaagatcctgttcactaaggccgaggacaacctcctcgctctgggtctgaaacatttcgaggggactgaattccttaaccctctcattagtaagtatctgctgacctgtaaaacagccagacaacttaccgtcagaatcaaaaacctgaacatgaatagagcccctgacaatatcatcaaattctataaaaagaccaagcaactgcccgtcctcggaaagtgctgtgaagaaattcagcctcaccaatggaagcctcctatcgagagggaggaacacagacttccattctggctgaaagtacagcccagttctagcaagtccgtggggggtcgaagatcactgaaggtactgagggaataccaggggctgccatag

SEQ ID NO: 16171 - DNA, 180 bp, Artificial Sequence
  Description of Artificial Sequence: Synthetic coding sequence
atggcagcacctggcgcccttcttgtgatgggcgtttctggctctgggaactgggatggaaactcgatgatgttgatgattatcaccagaaggaagatcgagggaaggtgggagaaggcctaccgatccatgacacgtaccggttttcacgggagtgtaacttgtatgacgttctattag

SEQ ID NO: 16172 - DNA, 207 bp, Artificial Sequence
  Description of Artificial Sequence: Synthetic coding sequence
atgggcgagactgaggggaagaaagatgaagcagattacaaacgcttacagactttcccccttgtaagacatagcgacatgcctgaagaaatgagggtcgagactatggagctctgtgtgacagcctgcgagaaattttctaacaataatgaagttctgcccgctgttcaggctgctccacgagcgttcgacggcccgtgcgggtag

SEQ ID NO: 16173 - DNA, 2451 bp, Artificial Sequence
  Description of Artificial Sequence: Synthetic coding sequence
atggtacttatgttccaaatccgctatatctcccagacccagggactgcccgcagaatatctacttagcgctggaactaaaacaacgcgcttcttcaaccgcgatcccaaccttggctatcccctctggcgacttaagacccccgaagaacacgaactcgagacaggcattaaaagcaaagaagccaggaaatacatattcaactgcttagatgacatggcacaggttaacatgtccacagacctggaggggacagacatgctcgctgagaaagccgaccggcgggaatacatagacttgctgaaaaaaatgctaacaatcgatgccgataaaagaatcactcctctgaagacccttaatcatcagttcgttaccatgacccacctgctagattttcctcactctaatcacgtgaagagctgtttccagaatatggagatctgcaagcgcagggtccacatgtatgacaccgtttcccagatcaagagccccttcactacgcacgtcgcacccaacactagtacgaacctgaccatgtctttctcaaaccagcttaataccgtgcacaaccaggcgtccgttctagcgtccagctctactgctgcagccgccaccctttccttggccaactcggatgtctctttgctgaactatcaaagcgcactgtatcccagttccgcggctccagtgcccggagtcgcccagcaaggggtgtctcttcagcccggcaccacccagatctgcactcagaccgatccttttcaacaaacgttcatagtctgcccccctgcttttcagaccgggctccaggcaacaaccaagcactctggattccctgttagaatggataatgccgtgcctattgtgcctcaggctcccgccgcacagcctcttcaaattcagagcggcgtgttgacacagggatcatgcacccctcttatggtggcaacactacatcctcaggtcgcgacaatcacccctcagtatgcagtccctttcaccctgtcctgtgccgcaggtcggccagccctcgtggaacagacagctgccgtgctgcaggcatggccaggagggactcagcagatcctgctcccttccacctggcaacagctgcccggggtggctctccacaactcagtccaaccaaccgctatgatccctgaggccatggggtctggacagcaactagctgactggaggaatgcccatagccatggtaatcagtactctaccattatgcagcagccttccttgttgactaaccacgtgactctggctactgcccagccactcaacgtaggtgtggctcacgtggtccggcagcagcaatcatctagcctgccctctaaaaagaacaaacagagcgcaccggtgagctcgaagagcagtctggacgtgcttcctagccaagtgtatagcctcgtggggagttctccactgagaacaacatccagctacaactccctggtccccgtccaagatcagcatcagcctattattatccccgacactcctagcccccccgtatctgttataaccattcggtccgacacagatgaggaggaggacaacaaatataagccaagcagcagtgggctgaagcctcgctcaaacgtaatttcctacgtaaccgtgaacgactcacccgattctgattcctctctgtcttcgccatattccacagatactctctcagccctgcggggcaattcaggtagtgtgctagaggggcctggccgagtggtggcagatggaacaggcacccgtactattatcgtaccacccttgaagacgcagttgggcgattgtacagttgccactcaagcaagcggcctgttaagtaataaaacaaagccagtcgcttctgtgtcaggccaaagttccggctgctgcatcaccccaacaggttatagggcccagagaggcggaacttctgctgctcagcctctaaatctttcccagaaccagcagagtagcgccgccccaacaagccaggagagatcgtctaacccagctcctcgcagacagcaggcgttcgtggctccattgtcgcaagccccgtatactttccagcacggatcccccctgcattcaaccggacatccccatctcgccccggccccagcccacttgccaagccaggcccacctgtacacctacgctgcaccaacttccgcagcagccctgggctcgacttcaagcatcgctcacttgttctcaccccaagggagttcaagacacgcagcggcctacacaactcacccctccaccttggtgcaccaggtcccagtgagcgtcggcccaagcctcctgaccagcgccagcgtcgctccggctcagtatcagcaccagttcgctacccaaagctatatcggctcctccagaggttcaaccatctatacggggtatcctctcagccctactaagatctctcagtacagctacttgtag

SEQ ID NO: 16174 - DNA, 1119 bp, Artificial Sequence
  Description of Artificial Sequence: Synthetic coding sequence
atggacgttctctcccctttaagcttcattaaagtgtctcacgtgaggatgcagggtattctgctgttagtcttcgctaagtatcagcacctgccttatatccaaatactgagtacaaagtccacccccactggtctgttcggctactggggcaataaaggcggggtcaacatttgtctgaaactgtatggttactatgtgagtatcattaattgtcatctgccgccacatatttcaaacaactaccaaagactggagcactttgataggatactcgagatgcaaaactgtgaggggcgagacattcctaatatcttggatcacgacctgattatctggttcggcgatatgaattttcgcatcgaggattttggtttacatttcgtgagagagtccattaagaataggtgctacggaggcctttgggaaaaggaccagctttccatagccaagaagcacgacccactgctgcgcgagtttcaggagggaagactgctgttcccccctacatataaatttgacagaaattccaacgactacgacacatccgaaaagaagcggaagccggcctggaccgatagaatactgtggcgcctaaagaggcagccttgtgcaggccctgacactccgatcccccccgccagccatttttcattgtcactacgcgggtactccagtcacatgacttacgggatctcagatcacaaaccagtatctgggaccttcgatctggagctcaaacctctcgtgagtgcaccgctgatcgtgctaatgccggaagatctatggactgtggaaaacgatatgatggtctcttattcttctaccagcgatttcccttcatctccatgggattggataggcctgtacaaggtaggcctgagagacgtaaatgattatgtgagttacgcctgggtgggcgattccaaggtttcttgctctgacaacctcaatcaagtttatatcgatataagtaatatccctaccaccgaggatgaattccttctgtgctactacagtaattcactcaggtcagtggtcggaatctcgcggccatttcagatccccccaggaagtctcagggaggatcccttaggagaagcccagccgcaaatatag

SEQ ID NO: 16175 - DNA, 480 bp, Artificial Sequence
  Description of Artificial Sequence: Synthetic coding sequence
atgattccaccacaggaggcatcagctcgtaggcgagagatcgaggataagctcaaacaagaggaggaaactctgagtttcattcgagattctctggagaagagtgatcagctgacaaaaaatatggtctctattctcagctcattcgagtctaggctgatgaagctggagaactcaatcattcccgtacataagcaaaccgaaaacctgcagcgtctccaggaaaacgtggaaaaaactctttcctgtttagatcatgtcattagctattaccatgtagctagcgatacagagaagattattcgggaggggccaactggccgactcgaggaatacctgggttctatggccaaaatccagaaggctgtggaatacttccaggataatagtccagacagtccagaactaaataaagtcgtgcgggggccgcagaataacgtccgatctcttgggatctccgtctctgccctcgtgtcctag

SEQ ID NO: 16176 - DNA, 243 bp, Artificial Sequence
  Description of Artificial Sequence: Synthetic coding sequence
atggccagcgaagagctgcagaaggacctggaggaagttaaagtcctgctggagaaggccacgcgtaagcgagtacgggatgctctcacggccgagaaatccaaaatcgagaccgagatcaaaaacaaaatgcaacagaagtcccagaaaaaagctgagctgctggataatgaaaagcccgctgctgtcgtagccccaataactacagggtacaccgacgggatttcacagatcagtctatag

SEQ ID NO: 16177 - DNA, 606 bp, Artificial Sequence
  Description of Artificial Sequence: Synthetic coding sequence
atgcctagcgagaccctctgggaaatcgcaaaagccgaggtggaaaagcgagggatcaatggctccgagggagatggcgccgagatagcagagaagttcgtctttttcatagggtcaaagaatggaggcaaaacaacaatcattctccgctgccttgaccgcgacgaaccaccaaaacccaccctcgcgcttgagtatacatatggacgtagagccaaggggcacaatacccctaaggacatcgcccatttctgggaacttggcggcgggactagtctgcttgaccttattagcatccctatcactggtgataccctcagaacgttcagcttggtcctggttctggacctgagcaagccgaatgacttatggccaacaatggagaatctgctacaggccacgaaaagccatgtcgacaaggtcattatgaagctcgggaaaaccaatgccaaagccgtgtccgaaatgcggcagaagatctggaacaacatgcctaaagaccaccccgtttcatgctgcctgggactgttactcgaatctcttgtacccttcatcgtcaatgacaatataactaacaatttctttagattcctctgcatgacctag

SEQ ID NO: 16178 - DNA, 1401 bp, Artificial Sequence
  Description of Artificial Sequence: Synthetic coding sequence
atgtcctaccggcctgtggtcagcccagtgatgtcattgacccgaaggtgcatgcgatctaggaccagtatgcggactgacgctgtttttttgatactgtacaaggagctttattatcgacatatatacgcgaaggtttcaggcggccccagcctggaacagcggtttgaatcctattacaactattgcaacttatttaattacatccttaatgctgatgggccagcccccctcgaactgcctaaccagtggttgtgggacatcatagatgaatttatttaccagttccagtcattctcacagtatcggtgtaaaacagcgaaaaagtccgaagaggaaatagatttcctcagaagcaacccaaagatatggaacgtgcatagtgtgctgaatgtcctacactctctggtcgataagagcaatattaaccgacagctcgaggtgtataccagcggcggagaccccgagtcggtggccggcgagtatggccgccactctttgtataagatgctgggatatttctctctggtgggtttattacgcctccactctcttttaggcgactactaccaggccattaaggttctggagaacatcgaactgaataagaaaagtatgtacagtcgtgtaccagaatgccaggtcacgacgtattactatgtcggattcgcctacctcatgatgagaagatatcaggatgcaattcgggtctttgcgaatatcttgttgtatatacagcggactaagtccatgtttcaacgcaccacatacaagtatgaaatgataaataagcaaaacgaacagatgcatgccctgctagctatcgctctgactatgtatccgatgcggatcgacgaatctattcatctgcagttgagggagaaatatggagataagatgctgaggatgcaaaaaggcgatcctcaagtgtatgaggagctcttctcttactcttgtcccaaatttctgagccctgtagtcccaaactatgacaacgtccaccccaactatcataaagagccctttctgcaacagctcaaagtattctcggatgaagtgcagcagcaggcccagctgtccacgatacgatctttcttgaagctgtataccactatgcctgtggcgaagctggcaggatttctcgatctgacagaacaggaattccggattcaacttctcgtgtttaaacataagatgaaaaatctggtttggacctcaggaatctctgccttagatggtgaatttcaatctgcctcggaagtggacttctatattgataaggatatgatccacatcgctgacactaaagtcgctcgcaggtatggcgattttttcatccgacagatccacaagtttgaggagctgaatagaacgctgaaaaaaatgggacagagaccctag

SEQ ID NO: 16179 - DNA, 597 bp, Artificial Sequence
  Description of Artificial Sequence: Synthetic coding sequence
atgagccgggccgtgacgatcgccgaagctttctgtcacatcctttttcggatcatctccgaaatcttaatgcgcatgctggaagaacaatgcctgtttcctctccccgagccccaggacttgttccaggctagtcagatgaagttcgaggactttcagaaagacctgcgaaaactgaaaaaagatctgaaagcgtgcgaagtggaagctggtaaggtgtatcaagtgtcatccaaagaacacatgcaaccattcaaggaaaacatggaacagtttatcatccaggcaaaaatagaccaggaggctgaggagaactctctgactgagacccacaaatgttttctggagacaaccgcatatttttttatgaaacctaaactaggggagaaggaggtgagccctaacgccttctttagtatctggcacgagttttcttcagattttaaagacttctggaaaaaagagaacaagctcctcctacaggaacgggtcaaagaagccgaggaagtatgccgccagaagaagggaaaatcattatataaaataaaacccagacatgactctggaatcaaggccaagatctctatgaagacctag

SEQ ID NO: 16180 - DNA, 441 bp, Artificial Sequence
  Description of Artificial Sequence: Synthetic coding sequence
atggagcctacccgagactgcccccttttcggaggagctttcagcgccatcttacccatgggcgcaatcgacgtcagcgacctgaggcctgtgccagacaaccaagaagtattctgtcacccagtgacagaccagagccttattgtggagctgctggagctgcaggcacatgttcgtggagaggccgccgctaggtaccacttcgaggacgtaggaggagtgcagggggccagagccgtgcacgtggaaagcgtccagcccctgtccctcgagaacctggcactgcggggcagatgtcaggaagcttgggtccttagtggcaagcagcaaatagctaaggaaaaccagcaggtggcaaaagatgtcaccctgcaccaggccttgctgcgcctgcctcaatatcagacagatctgcttctcacattcaatcagccaccatag

SEQ ID NO: 16181 - DNA, 1584 bp, Artificial Sequence
  Description of Artificial Sequence: Synthetic coding sequence
atgtccctctgcggagcacgggcaaacgctaaaatgatggctgcatacaatggaggaacttctgcagccgccgccggacaccatcatcaccaccatcaccatctacctcatctgccaccaccacacctgcaccatcatcaccatccacagcaccacctgcaccccggcagcgccgctgcggtgcacccagtgcagcagcatacaagttccgccgccgcagccgctgcggcagccgcggccgctgccgctatgctcaatcccggacagcagcagccgtattttccttcccctgccccaggtcaggccccagggcccgccgctgccgccccagcccaggtgcaagccgctgctgccgccactgtgaaggctcatcaccaccagcattcacaccacccacaacagcaactggatattgagcccgacaggccaattgggtatggcgctttcggcgtcgtgtggagcgtgaccgatcctcgtgatgggaaacgggttgctctcaaaaaaatgcctaacgtcttccagaacctggttagttgcaaaagggtgttccgggagctcaagatgctgtgtttttttaaacatgacaacgtgctctccgccctggacattctgcaaccaccccacattgattacttcgaggaaatatatgtggtgaccgagctgatgcaatctgacctccataagatcatagtttcaccgcagcctctctcatcggatcacgtgaaagtgtttttataccagatccttcgcggcctaaagtatctgcacagtgctggtattctgcaccgcgatattaaacctgggaaccttttagttaactccaattgtgtgctgaaaatatgtgactttggactggccagagtcgaagaattggacgaaagccggcacatgacccaggaggttgttactcagtattatcgagcccccgagatattgatggggtctcggcactactctaatgccattgacatttggtccgttgggtgtatctttgcggagttgctgggcagacgcatcctcttccaggctcagtcccccatccagcaactggacctaatcaccgatctactgggcacgcctagcttggaagcgatgcgaaccgcgtgcgagggggctaaggctcatatcctgcggggtccacacaaacagccatccctgccggtcctttacacccttagctctcaggcaacccacgaagccgttcacctgctgtgtcgtatgctagtctttgacccttcaaaacggatctcagcaaaggacgccctggcccacccgtaccttgatgaggggcggttaaggtaccatacgtgcatgtgcaagtgctgttttagcacatccactggcagagtgtatacatctgacttcgagccagtcaccaaccctaaatttgacgacacattcgagaaaaatctttcgagcgtaagacaagtgaaagagatcatacaccaattcatcctggagcagcagaagggcaaccgtgtacccctgtgtatcaacccacagtccgccgcttttaagtcttttataagcagcactgtggcacagccttcagagatgcccccctcccctctggtgtgggaatag

SEQ ID NO: 16182 - DNA, 2742 bp, Artificial Sequence
  Description of Artificial Sequence: Synthetic coding sequence
atgaacgaagccatggccacagatagcccgcgcagaccgtcaaggtgcacggggggcgtcgtggtgcgtccccaggcagtgacagaacagtcctatatggagtctgtcgtgacctttctgcaagacgtcgtcccccaggcttactcaggaactcctttgactgaagaaaaggagaaaattgtctgggtccgctttgagaacgccgacctcaatgacacatcccggaatctggaattccacgagatccactccaccggaaacgagcccccactcttaatcatgattgggtactccgatggcatgcaggtgtggagcattccaataagtggtgaggcacaggagctctttagcgtgcgccatggtcccatcagggcggctaggattctgccagctccccagttcggcgcccaaaagtgtgataattttgctgaaaagcgcccgctcttgggtgtgtgcaagtccattggatcctcggggacgagtcccccgtattgttgcgttgatttatattctttgagaacgggggaaatggtcaaaagcatccaatttaagactcctatctacgacctccactgtaacaaacggatactcgtagttgtactgcaggagaaaatcgctgcctttgatagctgcacgtttacgaagaaatttttcgtgacaagctgttacccatgcccgggacctaatatgaatcctattgctctcggatctagatggctcgcttatgcagaaaacaaacttattaggtgccaccagagccggggaggtgcttgcggcgacaacatccagagttacaccgccactgtcatctccgcagctaaaacattaaagtccggcttaaccatggtgggtaaggttgtgacccagctgaccggcacactccctagtggggttaccgaagacgatgtcgctatccattcgaatagccgtcggtcgccgctcgttccagggataattacggtgatcgacactgaaacagtcggggaagggcaagtacttgtatccgaggatagtgactccgatggcattgtcgcccactttcccgctcacgagaaaccagtatgctgcatggccttcaatacatctggaatgctgctggtcacaactgatacactcgggcacgacttccacgttttccagatccttacacacccctggagctctagtcaatgtgcagtgcatcacctctatacgttacataggggggagacggaagctaaagtccaagacatatgcttttcccacgactgtcgttgggtggtggtgtcgaccctgaggggtacctcacatgtttttcctatcaatccttacggcggccagccatgcgtgagaacccatatgtcccctcgggtggtgaatcgcatgagcaggtttcagaaatccgcaggcctggaggagatcgagcaagaactgacttctaagcaggggggtaggtgctcccctgtcccgggtttgtcctcatctccttctggttcacccctccacggcaagctcaactctcaggattcctataacaactttaccaacaacaaccctggcaaccctcggctcagtccgcttcctagccttatggtggtgatgccactagcccaaatcaagcaacccatgaccttggggacaataactaagcgaacaggtaaggtgaagccacctccccagataagcccctccaaatctatgggaggcgagttttgcgttgcagctattttcggaacatcaaggtcatggttcgctaataacgcgggactcaagcgagagaaggaccaaagcaaacaagttgtggtcgaaagcttatacattatctcatgctatgggacactggtagaacacatgatggagccacggcccctttcaaccgcccccaaaatctctgacgatactccactcgaaatgatgactagcccaagggcatcttggactctggtgagaacacctcagtggaatgagcttcaaccccctttcaatgcaaatcacccactgctgctcgccgcggatgcggtgcagtattaccagtttttgcttgctgggcttgtcccccctggcagccccggacccattactcgccacggttcctacgacagtcttgcaagtgaccacagcgggcaggaggatgaggagtggctgagccaggttgagatcgtgacccatacaggtcctcatcgcaggctctggatgggcccacagttccaattcaagaccatacaccctagtggccagacgacagtgatcagctcgtcttcgtctgtgctgcaaagccacgggcccagcgacaccccacagcctcttctggacttcgatacagacgaccttgatctgaactcgcttagaatccaacctgttcggagcgatcccgttagtatgcctggatccagccggccagtatccgatcgcagaggcgtctctaccgtaatcgacgccgcctctggaaccttcgacagatctgttactctgctggaggtgtgcggttcatggccagagggcttcggcctgcgccatatgtcatctatggaacacaccgaggaggggcttcgggaacgtctagccgacgctatggccgagtccccatccagggacgtcgttgggtccggaaccgagctgcaaagagaaggctcgattgaaactttatctaactcttctggaagtaccagtggctctatacctcgcaacttcgatggctaccgcagtccccttccaactaacgagagccagccactgagtcttttcccaaccggcttcccgtag

SEQ ID NO: 16183 - DNA, 2160 bp, Artificial Sequence
  Description of Artificial Sequence: Synthetic coding sequence
atgggtttcagtaatatggaggatgatggacctgaggaagaggagcgcgtggctgagccgcaggcaaatttcaacacacctcaggccttgcgattcgaggaactactcgctaacctgttgaatgagcaacaccaaattgctaaagaactcttcgagcaactgaagatgaagaaaccctctgctaagcagcagaaggaggtggagaaggtgaagccccagtgtaaggaggtgcaccagaccctaatcctggatcctgcccagaggaaacggctgcagcagcagatgcagcaacacgtccagctgctcactcaaattcacctcctggccacctgcaaccctaatttgaatccagaagcatccagtaccagaatctgcctaaaggagcttgggacttttgcgcagagttctatcgctcttcaccatcagtacaatccgaaattccaaacgctctttcaaccttgcaatcttatgggcgcgatgcaattaatcgaggacttctccacgcacgtatcgattgattgctccccgcataaaacagtcaagaagacggccaacgagtttccttgcttacccaagcaggttgcttggatattggctacgagtaaagtgtttatgtatcccgagctcctccctgtgtgctctctgaaagccaagaatccccaggacaaaatcctgttcactaaagccgaggacaataagtatctcctaacatgtaagacagccaggcaactgacagtgagaattaagaaccttaatatgaaccgggccccagacaatattataaagttttacaagaaaaccaagcagctgcccgttctcggtaaatgttgtgaggagatccagccccaccagtggaagccccctatcgaacgggaagaacatagacttcccttttggttaaaggcaagccttccgtccatccaggaggaactgcggcacatggccgatggcgccagggaggtggggaacatgaccggaaccacagagatcaatagcgaccaagggctcgaaaaagacaacagcgaacttgggagcgaaacccgctaccccctcctgttacccaaaggtgtggtcttgaagctcaagccagtggctgaccgtttccccaagaaagcctggcgccagaaacgcagttcagtgcttaaacccctacttattcaacctagcccttcgttgcagccgtcatttaaccctgggaaaaccccagcacagtctactcatagcgaagccccgccgtctaagatggtccttcgcataccacaccccatacagccagctacagtgctgcaaaccgtgcctggcgttccccccctcggcgtgtccgggggagagtcatttgagagtccagcagctctgccagcgatgcccccagaggccagaacgtcattcccactgagtgagagccagaccctgctctcatccgctccggtgcccaaggttatgatgccctccccagcctcctccatgttcagaaaaccatacgttcggagacgtccgtctaagagaagaggggccagagcattccgctgtatcaagcccgcacccgttatacatccagctagcgtgatatttacagtgcctgccacaacagtgaagatcgtcagcctgggcggcggctgtaatatgatccagccagtcaacgccgccgtggctcagtccccacaaacgattcccattgccaccttgctggtaaaccccacaagttttccatgtccactaaaccaacctctggtcgcctcgagcgtgtcgccccttatagtctccggaaacagcgtgaacttgcctatcccatccactccagaggacaaagcccacatgaacgtcgacatcgcctgtgccgtcgctgacggggaaaacgccttccaggggctggagccgaaactggagcctcaagagttaagccctttgagcgcaaccgtgtttcccaaggttgagcacagtccaggcccgcccccagtcgataaacaatgccaggagggcctatccgaaaatagcgcctataggtggacggttgttaaaaccgaggagggccgccaggctctggaaccattaccgcaaggcatccaagaatcattgaataattccagcccaggcgatctggaagaagtcgtgaagatggaaccagaggatgctaccgaagaaatctccggattcctctag

SEQ ID NO: 16184 - DNA, 324 bp, Artificial Sequence
  Description of Artificial Sequence: Synthetic coding sequence
atgagcgtcctgagacctctcgacaagctgcccggcctcaatacagctacaatcctcttggtgggtactgaggacgctctcttacagcagctggccgattccatgctgaaagaggattgcgccagcgagcttaaagtgcatctggccaaatccctgcctctgccctcctcggttaatagaccccgaatcgatcttatcgtgtttgtggtgaatttgcatagcaagtactcgttgcagaacacagaagagtccctgcgacatgtagacgcttcctttttcttaggcaaagtatgctttcttgccactggcggcggtagactgtag

SEQ ID NO: 16185 - DNA, 1599 bp, Artificial Sequence
  Description of Artificial Sequence: Synthetic coding sequence
atgtttgtgctcggaattccactgtgcccagccctcagttttagtggaggagatgattctcaaacacagctcttcgtttcaagcaaggacgtgatcaaagaaatcgaagactttgactcattagaagccctgcggctcgagggcaatactgtgggcgttgaggcagcacgagtgatcgcgaaggccctcgagaagaaatcggaactgaagagatgccattggtccgacatgttcacggggcgtctacgcacagagatcccccctgccctgatctctctgggtgaagggctcattactgcgggtgctcagctagtggaactcgacttgtccgacaacgcctttggacctgatggcgtgcagggttttgaagcactgcttaagagcagcgcctgttttactctgcaggaattgaagctgaataactgcggcatggggattggcggggggaaggttattggcacgctggaggaggttcatatgccacagaacggtatcaaccaccccggcatcacagctttggctcaagccttcgccgtcaaccctctgctcagagtgataaacttgaacgacaatacctttactgagaaaggcgccgttgctatggccgaaaccctgaagacactacgccaggttgaggtcattaactttggagattgcttagtccgcagtaaaggagctgtcgcaatagccgatgctatcagaggaggccttcccaagctgaaggaactcaacctgtcattctgcgaaatcaaacgggatgccgcccttgctgtagccgaagccatggccgacaaagccgaactggaaaaactggatctaaacggaaacacccttggcgaagaaggttgtgagcagctccaggaggtgttggaagggtttaacatggccaaggtcctcgcttcgctgagcgatgacgaagatgaggaagaagaagaagagggcgaagaagaggaagaggaggcagaggaggaggaagaggaggacgaggaggaggaagaagaagaagaggaggaggaagaggaggagccccagcagcggggacagggcgaaaaaagtgcaacacctagtcggaagatcctggacccaaacaccggtgagccggctcccgtgctatcctcgcctccaccagcagacgtttcgaccttcctcgccttcccatctcccgaaaagctgctccgcttgggaccaaaatcttctgttctaatagcccaacagacagacacatctgatccggaaaaggtagtaagcgcctttttaaaggtgtcctccgtattcaaagatgaggccacagtaaggatggctgtgcaagatgcagtggatgcattaatgcaaaaagcatttaatagtagctcgttcaactccaatacctttcttacgcgcctcttagtgcacatggggttactcaagagtgaggataaggtgaaggcaatcgccaacctttatggccctctgatggccctgaatcatatggtgcagcaggactacttcccgaaggcgctggctccactgttgttagcctttgtcaccaaaccgaacagtgctctagagagttgttcttttgctaggcattcactcttgcaaaccttgtacaaggtgtag

SEQ ID NO: 16186 - DNA, 1383 bp, Artificial Sequence
  Description of Artificial Sequence: Synthetic coding sequence
atggatagcgaattgatgcacagtattgtgggcagctatcacaaacctcctgaaagagtgttcgtgccttcttttactcagaacgaaccttcccaaaattgtcaccccgcaaacttggaagtgacttcgccaaaaatcctgcactctcctaattcccaggccctcattctcgcattaaaaaccctccaggagaaaattcacagattggagctggagagaacacaagccgaggataatttaaacatactgagtcgcgaagccgcacaatataagaaagcactggaaaatgaaaccaatgagcggaaccttgcccatcaggagcttattaaacaaaagaaagacataagtattcaactatcgagtgcccagtctcgatgcacccttctcgagaaacagcttgaatacacaaaacggatggtactaaatgttgaacgcgaaaaaaacatgatcctggaacagcaggcccagctccagcgtgaaaaagaacaggaccaaatgaaactgtacgccaagctggaaaagctcgacgtgctggagaaagagtgcttccggttaaccacgacccaaaaaactgcagaggacaagattaaacacctggaggaaaaacttaaggaagaagaacatcaaaggaagctgtttcaggacaaagcttccgaactgcagaccggcctggaaatcagtaagatcataatgtctagtgtgagtaatctcaaacattctaaggagaagaagaagagctccaagaagacaaagtgcattaagcgcagaccaccatggcaaatctgctcaaagttcggggccctgcctttcgttgcggagaagatgcggcagcacagggaccctcacatcctacaaaagcctttcaacgttaccgaaacaaggtgtctgccaaagccaagtagaaccacctcttggtgcaaggccattccccctgattcggagaagagcatcagcatctgcgataacctgagcgagcttttaatggctatgcaagacgaactcgaccaaatgtctatggagcatcaggagctattgaagcagatgaaggaaacggaatcacattccgtgtgcgatgatattgagtgtgaactcgaatgtctcttgaagaagatggaaatcaagggagagcagatttccaaacttaaaaaacatcaggactccgtttgtaaactgcagcaaaaggtccagaacagtaaaatgtccgaggctagcgggatccagcaggaagactcctatcccaaagggtctaagaacattaaaaactcaccccgcaaatgcctgacagacaccaatctgtttcagaagaattcatcatttcatccaatccgagtccacaacctgcagatgaagctgcggagagacgatatcatgtgggagcagtag

SEQ ID NO: 16187 - DNA, 567 bp, Artificial Sequence
  Description of Artificial Sequence: Synthetic coding sequence
atgacggcccctagctgcgcatttccagtgcagttccgccagccctcagtgtctggcctatcccagattactaagtctctgtatatctccaacggagtggccgctaataacaaactgatgctgagctcaaatcagatcactatggtgattaacgtgtccgtcgaggtggtgaacaccctgtatgaggatatacagtacatgcaggtgccagtcgcggactcgcccaatagcaggctgtgtgatttcttcgaccccattgccgatcacattcattcagtcgaaatgaaacagggacgcacattactgcattgcgctgcaggtgtcagccgatcagcggctctctgcctggcatacctaatgaagtatcacgcaatgtctcttctcgacgcgcacacatggacgaagtcctgcaggccaattatcaggccgaactccggattctgggaacagctgattcactacgagttccagctcttcggcaagaacactgtccacatggtctcatccccagtgggcatgatccctgacatttacgaaaaggaggtgaggctgatgatccctctgtag

SEQ ID NO: 16188 - DNA, 1596 bp, Artificial Sequence
  Description of Artificial Sequence: Synthetic coding sequence
atgaataaaacgaaccaggtctacgcggcaaatgaggatcataattcacagtttatcgatgactacagttcctctgacgagtctctgagcgtgtctcatttttcttttagcaagcaatcacaccgccctcggacaattagagatcgaacaagcttctcgagtaagttgccttctcataacaagaaaaactctacattcatccctcgcaaaccgatgaagtgctccaatgagaaggtggtgaaccaggaacagtcatacgagagcatggacaagtttcttgacggcgtgcaagaagttgcctacatacacagcaaccaaaacgtgatcggttcctccaaagctgaaaatcatatgagccgatgggctgctcacgatgtgtttgagctgaagcagtttagtcagctgcccgccaatattgctgtttgtagctccaagacatacaaggagaaggtggacgccgacacactaccacacactaagaagggccaacagccctctgaggggtcaatttctctgccactttacatttcgaatcccgtgaatcaaaagaagaaaaaagtatatcataccaaccagacaactttcatcatcggtgagacacccaaaggcatccgcagaaagcagttcgaggaaatggccagttactttaactcctcctccgtgaacgaatttgccaaacacattaccaacgcgacatccgaggagagacagaaaatgcttagggatttctacgcgtcgcaatatcccgaggtaaaagagtttttcgtggacagcgtgtctcagttcaacaacagttcgttcgagaagggagagcagaggacccgcaagaaatctgacaagagggagtccctcattaagcccagattatcagattcagaaaccctgagcttcaaggactctacgaataagatctcacaggtatgctctcttaagacgtataagcggaagagcgtgaagttccagaatcacatttcctacagagaggaggtctttttcaatgacgcagagacgaagaaatcccccgtaagctccacgcaagagattgactccggtaagaatagccaggcttccgaagataccgtaaccagccgctcactgaacagtgagtccgaaactagagaacggcggctcgaaaacacaatgaaggaccagcaggatttgacacgcactggaatctctcggaaggaacccctgctaaagctggagaataaaaaaattgaaaatcccgtacttgagaacacctcagtgatctccctgctgggcgacaccagcatcctagacgacctgttcaagagccacggaaattctcctactcagctcccaaaaaaagtgttgtcagggcctatggagaaggccaaacagcgacccaaagacttttgggacatcctcaatgagcagaatgatgagagcctaagtaaactgaccgatctggctgtgattgagactctttgcgaaaaagccccgctggccgccccctttaagaggcgagaggaaccggctacttccttgtggaagagcaacgagaaatttctgtggaaaaaattctccccctcagacacagacgagaatgccacgaatacccaatcaaccacttag

SEQ ID NO: 16189 - DNA, 1089 bp, Artificial Sequence
  Description of Artificial Sequence: Synthetic coding sequence
atgactggtcatactaggagctccctgccacggtgcacaggcatcgtgctgcttattaagctgaggttttcagaacgcctgacaggccacctccacgcccaaggaaccccaccgtacgtaatcaatttggaccccgcagtccacgaggtccctttccctgccaatatagacatccgagacacggttaagtataaggaggtcatgaagcaatacggcctcggacccaatggcggtatcgtgacatccctgaatctattcgctactcgctttgaccaggtgatgaagttcatcgagaaagcgcaaaacatgtcaaagtatgtcctaattgatactcccggacagattgaggtctttacgtggagcgctagtggtactattattaccgaggcactggcgtctagctttcctacagttgtgatttatgtaatggatacttctcggagcactaatcctgtcaccttcatgagcaatatgctgtacgcttgctctatcctgtacaagactaagctgccctttatcgtcgtgatgaacaaaaccgacatcattgatcactctttcgctgttgaatggatgcaagactttgaagccttccaggacgctctcaatcaggagacaacatatgtgagcaaccttacacggtcaatgtctttggtcctggacgagttctacagttccttacgcgtggttggggtaagcgcagttctgggcaccggtttggacgagctcttcgtgcaggttaccagtgctgctgaggaatacgagagggaatatcggcctgagtatgaacgactgaaaaagagtctggcgaatgctgagtcccagcaacagcgtgagcagctggagagattacgcaaagacatgggtagcgtcgccctcgacgccgggaccgctaaggactccttgagtccagtcctccatcctagtgatctgattctgacgcggggaacacttgatgaggaggatgaggaggccgattctgacacagacgacatcgaccacagagtgacagaggagtcgcatgaggaaccagcttttcagaatttcatgcaggagtccatggcgcagtactggaaacggaataacaagtag

SEQ ID NO: 16190 - DNA, 1338 bp, Artificial Sequence
  Description of Artificial Sequence: Synthetic coding sequence
atgtctgtaacttatgacgatagtgttggagtggaagtcagctctgactcattttgggaggttggtaactacaaacgaaccgttaaacggatcgacgacggtcaccgcctctgctctgacctgatgaactgtctccacgaacgagcgcgcattgaaaaggcctacgcgcagcagctgaccgaatgggccaggcgttggaggcagctagtggaaaagggcccccagtacggaactgtcgaaaaagcttggatggcctttatgtccgaggcagagagagtttcagaacttcatttagaggtcaaagcatctcttatgaacgatgattttgagaaaatcaagaattggcaaaaagaggcattccataagcagatgatgggcgggttcaaggaaactaaagaagcggaggatggcttcaggaaggctcaaaaaccttgggcgaaaaaactcaaggaagttgaagctgctaagaaagctcaccacgccgcgtgtaaggaagagaaactggccatctcaagggaagcgaatagtaaggcagatccttcactgaatccggaacagttgaagaagctgcaggataagatcgagaagtgtaaacaggatgtcctgaagaccaaggaaaaatacgagaagtcactgaaggagttggaccaagggactcctcagtacatggaaaatatggaacaggttttcgagcaatgccagcaattcgaggaaaaacggctgaggttttttcgggaagtcctgttagaagtccagaaacacctcgacctaagcaatgtggcggggtacaaagcgatttaccacgacctggagcagagtatcagggcggcggacgccgtggaggatcttcggtggtttagagctaatcatggcccgggaatggccatgaattggcctcagttcgaagagtggagcgctgatcttaatcggacgctcagtagacgagagaaaaagaaggccacggacggagttaccctgactggaataaatcagactggtgatcagtcactacccagcaagccaagctccgtgtctagttatgaaaaaacccagtcttacccaaccgactggtctgatgatgagtcaaacaacccgttttcctctactgatgccaatggtgacagcaatcccttcgacgacgacgctaccagcggcacagaggtccgggtgagggccctgtacgattatgaaggacaggaacacgacgaactctccttcaaggcgggcgatgaacttacgaagatggaagatgaggatgaacagggatggtgtaaagggaggctggataacggacaggtcggactgtatcccgccaattatgttgaggcaatacagtag

SEQ ID NO: 16191 - DNA, 405 bp, Artificial Sequence
  Description of Artificial Sequence: Synthetic coding sequence
atgagcgagaacgctgcgccaggactcatctcggaactactcctgcagagaggcacaaccaaggtcgccactgggctggtgttgaatagagaccagagactcgcctgggctgagaattcaattgactttataagtagggagctctgtgcccactcaatccggaagctgcaggctcacgtgctcctgattaaggcggtgcatgggtacttcgactctcggcaaaattactcagaaaaagaatccctttcgtttatgatcgatacaatgaagtccacactgaaggagcaatttcagttcgtagaagtgcccggcaaccattgcgtacacatgagtgaaccgcagcatgttgcgagcattatctcttctttccttcagtgtacccatatgttacctgcacagctgtag

SEQ ID NO: 16192 - DNA, 321 bp, Artificial Sequence
  Description of Artificial Sequence: Synthetic coding sequence
atgagtagtaagggctcaagcaccgacggaaggaccgacctggcaaacgggtctctgtcctcctcccccgaggaaatgagcggagcagaagagggacgcgaaacttcttctggaatcgaagtggaggctagcgatttgagcctgagtttaaccggcgatgatggtgggcctaaccggacatcaaccgagagccgagggaccgacaccgagtcctccggtgaggacaaggacagcgacagcatggaggacacagggcactactctataaatgatgagaacagagtacatgacaggtccgaggaggaggaggaagaagagtag

SEQ ID NO: 16193 - DNA, 990 bp, Artificial Sequence
  Description of Artificial Sequence: Synthetic coding sequence
atggtccgcacaaaaacgtggacacttaagaagcatttcgtgggttatcctacaaactctgattttgaactgaaaacggccgagctgcctccccttaagaatggcgaagtgcttctggaagcactgtttcttactgtggacccctacatgcgggtggccgccaaaaggctgaaagagggcgacactatgatgggccagcaggtcgccaaagtggtggagtccaagaatgtagccctgcctaaggggaccattgtactcgctagccctggttggaccacacattcaatttctgatggcaaagacctggaaaagctgctgaccgagtggcccgacacaatacccctgtcactggcccttggcaccgtcggcatgcccggtctcacagcatatttcggccttctggagatttgcggcgtcaaaggcggtgaaacagtgatggtcaatgccgccgcaggcgccgttggctctgttgtgggtcagattgccaagctcaaggggtgtaaggtggtgggagccgtcggcagcgatgagaaggtggcatatctgcagaagctcggcttcgatgtagtgtttaactacaagactgtggagtctcttgaggaaaccctcaaaaaagcctcccctgacggatatgactgctattttgacaacgtaggcggcgagttctctaatacagtaattggccagatgaagaagtttggcaggatagccatctgcggggctatctccacatataaccgcacgggaccgctaccccctgggccaccacccgaaatcgtaatttaccaggagcttagaatggaggctttcgtcgtgtatcgttggcagggcgacgcccgccagaaagctctgaaggacctgctgaaatgggtgctggagggtaagatccagtacaaggagtacatcatcgaagggtttgagaacatgcctgccgccttcatggggatgctgaagggcgataatctgggcaaaacaattgttaaagcctag

SEQ ID NO: 16194 - DNA, 2235 bp, Artificial Sequence
  Description of Artificial Sequence: Synthetic coding sequence
atggcaaccgctaactttgggaagatacaaatagggatatatgtggagatcaaacgcagtgatgggaggatccaccaagctatggtcacgtcactcaacgaggacaacgagtctgtgactgttgagtggatcgaaaacggtgacaccaagggtaaagagatcgatctcgagtccatcttttccctgaacccagatttggtgccagatgaggagattgaaccctcgccagaaactcctccaccacctgcgtctagtgctaaagtgaacaagattgttaaaaatcggagaaccgtggcaagcattaaaaatgaccctccttcccgagataaccgagtcgtgggctccgctagagcgcggccctctcaattcccggagcagagtagctctgcacaacagaatgggtccgtgagcgatatcagccctgtgcaagccgctaaaaaggagttcggcccaccaagccgacggaaatcaaactgtgttaaggaagtcgagaaactccaagaaaaacgcgaaaaaaggcgcttgcagcagcaggagcttagagagaagcgtgcccaggatgtggacgcgactaaccctaactatgagattatgtgcatgattagggactttagaggtagtctggattaccgccctctaaccaccgcggatccaatcgacgagcatcggatctgtgtgtgtgtgcgcaagagaccgctcaacaagaaagaaacacaaatgaaagacctggacgtgatcacgatcccatccaaagacgtggtgatggttcacgaacccaaacaaaaggtggatttgaccaggtacctggagaaccagacattccggtttgactacgcattcgatgacagcgctccaaatgagatggtctaccgttttacagctaggcctttagtggagactatttttgaacgaggaatggctacatgctttgcttatggacagacaggatccggcaagacacacacaatgggaggcgacttctctggaaagaatcaggactgtagcaaaggtatatatgcattagccgctcgcgatgtgtttctgatgcttaaaaagcctaattataaaaaactcgaacttcaggtgtacgcaacatttttcgagatctatagtggaaaagtgtttgatttgttaaataggaaaacgaaactgcgagttctggaggatgggaaacagcaggttcaggtggtcgggttacaggaaagggaggttaagtgcgtggaggacgtgctgaagttgatcgatatcggaaattcttgtcgcaccagtggtcagacctctgcaaatgctcattcctcacggagtcacgccgtgttccagattatcctgcgccgcaaaggcaaactccatggtaagttttctttgattgatctggcaggaaacgagcgtggcgcagacacttcttcagcagacaggcagacaaggttagagggcgccgaaatcaacaagtcattacttgccttgaaagagtgcattagggctcttggtcggaacaagccccacacacccttccgcgcgtctaagctgacgcaggtgctccgtgacagctttattggcgagaactccaggacatgtatgatagctacaatctctcctggaatggcttcctgcgaaaatactctgaacacgctccggtacgctaatcgtgttaaagagtttggaatatcacctagcgatattcctttcagtcagggctctggctccaggcccgatctatctcctagctatgaatacgatgacttctcaccttccgtcacccgggtgaaggagctgaccgtcgacccaaccgcagcaggcgatgttaggcccatcatgcaccatcctcctaatcaaatagacgatctggaaacacagtggggtgtcgggtcaagtccacagcgggacgatctcaaactcctctgcgaacagaacgaagaagaggtctccccgcagctgtttacatttcatgaggccgtatcacaaatggtcgagatggaggaacaggtcgtagaagaccacagggcagtgtttcaggaaagtatcagatggctggaagatgagaaagctcttttggaaatgactgaggaagtggattatgacgtggacagttatgcaacccagctggaggcaatattggagcagaagattgacatcctcacagaactgagggacaaagttaagtcctttagagccgcactgcaggaagaggagcaggcttccaaacagatcaacccaaaaaggcccagagcgctatag

SEQ ID NO: 16195 - DNA, 1701 bp, Artificial Sequence
  Description of Artificial Sequence: Synthetic coding sequence
atgtttgtgtccgatttcaggaaggaattctacgaagtcgttcagtcccagcgcgtgctgctatttgtggctagcgatgtggatgcgctctgcgcatgcaaaatactgcaggccctgtttcagtgtgaccacgttcagtacacactggtgcccgtgagcggttggcaagagctcgagacagcattcttggagcataaagaacagttccactacttcatcctgataaactgcggggccaatgtcgacttattggacatactgcagccagatgaggacacaatatttttcgtgtgcgatacacatcggcctgtcaacgtagtcaacgtatataatgacacgcagattaagctactcattaagcaagacgacgacctcgaggtccccgcctacgaggatatatttagagacgaagaagaggacgaagagcattccgggaacgatagcgacgggtctgagccatccgagaagaggacaaggttggaggaagagattgtagagcagactatgagacgtcgacaacgacgggagtgggaggcaaggcggcgagatattttgttcgattacgagcagtatgagtaccacggcacttccagcgctatggtcatgttcgagcttgcatggatgctctccaaagacctgaacgatatgctgtggtgggccattgtggggcttaccgatcaatgggtgcaggataaaattacacaaatgaagtacgtgaccgacgtgggggttttacagaggcatgtctcgcgccacaaccataggaatgaggatgaagagaacactctgagcgtggactgcacaaggatctccttcgaatacgatcttagacttgtactttatcaacattggagcttacacgattctctttgcaataccagttatactgccgccagattcaagttatggtctgtgcacggtcagaaacgcctgcaagaatttctggctgacatgggtctcccacttaagcaggtcaaacagaaatttcaagccatggacatcagcctgaaggagaatttgcgagaaatgattgaggagtcggccaacaagttcggcatgaaggacatgagagtgcagacttttagcatccactttggcttcaagcacaagttcctggcctctgacgtcgtgtttgcgaccatgtccctcatggaatctccagagaaggatggctccggtaccgatcattttatccaggctttagacagtctgagcaggtcaaacctggacaaattgtatcacgggttagaattggccaagaaacaattgagggctactcagcagaccattgcctcttgcctctgcacaaacttagtaatatctcagggcccttttctttattgttcactgatggaaggcacccctgacgttatgctcttctcaaggccggcctctctaagcctcctgtccaaacatctcctgaaatcctttgtctgctctacgaagaacagacgatgcaagttactgccactagtgatggccgcccctctcagcatggaacatggaactgtgacggtggtcggcattccaccagaaacagacagctcagaccgcaaaaatttctttgggcgcgcgtttgagaaggccgcggaatccacttcttctcggatgttgcacaaccactttgacctgtctgtgattgagttgaaggctgaggatcgctctaaatttttagatgcactcatctcactgctgtcctag

SEQ ID NO: 16196 - DNA, 798 bp, Artificial Sequence
  Description of Artificial Sequence: Synthetic coding sequence
atgtgcacgtccgagaccttccaggccctcgatacgttcgaagccagacatgacgacatagttctggcaagctatcccaaatgtggttccaattggattttgcatatcgtgtctgaactgatatatgctgtgtctaagaaaaaatacaaataccccgaatttccagtgcttgagtgcggcgacagtgagaaatatcagcgtatgaaaggattcccgagtccaagaatcttagcgactcacctgcactacgacaagttacccggcagcattttcgagaacaaagccaaaatcctggtgatttttaggaatcctaaggacaccgcagtgtccttcctccacttccataacgacgttcctgacatcccctcatatggatcctgggacgaattttttcgtcagtttatgaaaggacaggtgtcctggggcagatacttcgatttcgcaataaattggaacaaacatctcgatggcgataacgtgaaattcatactctacgaggatctaaaggaaaatctcgctgccggaatcaaacaaatcgctgagtttctggggtttttcttgaccggggaacagatacagacaatctcagtccagtctacattccaagccatgagggctaaatctcaggatacccatggtgctgtcggtccttttttgtttcgtaagggcgaagtgggcgattggaagaacttattcagcgagatccagaaccaagaaatggatgagaaattcaaagagtgcctggcgggaacatcactgggcgccaaactgaaatatgaatcctattgtcagggctag

SEQ ID NO: 16197 - DNA, 2808 bp, Artificial Sequence
  Description of Artificial Sequence: Synthetic coding sequence
atgaatgaggcaatggccactgatagtcctagacgccctagccgctgcactggtggagtggttgtgagacctcaggctgtgacagaacaaagttacatggagtccgtagtgactttcctgcaggacgtcgtcccccaggcctatagcggaactcccctgactgaggagaaagaaaagatagtttgggttcgattcgaaaatgccgatctgaatgacacatccagaaaccttgagttccatgagatacactcgaccggtaatgagccacctctgcttataatgattggatactctgatggcatgcaggtctggagtattcccatttctggagaagcccaggagttattttcagtgaggcatgggcccatcagagccgcacgaattctgcccgcaccgcagtttggcgcccagaagtgtgacaacttcgctgaaaaaaggcccttactgggggtttgcaaaagtattggctcaagtggaacttctccaccctactgttgtgtggacctgtactccttgagaactggggagatggtaaaaagtatccagttcaagacccctatctatgaccttcactgcaataaacggatcttagtggtggttttgcaagaaaagattgctgccttcgactcctgtactttcactaagaaattctttgtgacctcctgctatccttgtcccgggcctaacatgaatccaattgctctcggaagcagatggctggcctatgcagagaacaaactgatccgctgccaccagagcagggggggcgcatgtggtgacaacatccagtcgtacacagccacagttatttccgctgctaagacacttaagagtggtttgactatggttggcaaggtggtgacccagctcacaggcacactaccaagcggggtcactgaagacgacgtggctatccatagtaactcccgtcgaagcccactggtgcctgggattattaccgtcatagacaccgagaccgtgggcgaaggccaggtgctggtgtccgaggattccgatagtgacggcatcgtcgcacacttccctgctcacgagaagcctgtgtgctgtatggcttttaacacctctgggatgctcctcgttactaccgacacactgggtcacgacttccatgttttccagatcctcacccatccctggagctcctcacaatgcgccgtgcaccacctgtatactcttcataggggcgaaactgaggcgaaagtgcaggacatttgcttcagtcacgattgtagatgggtcgtggtgagcaccctgagggggacttcgcacgtgttccctatcaatccctacggaggtcagccctgtgtgagaacacacatgtctcccagagtggttaatcgaatgtcacgtttccagaaaagcgctgggttggaagagatcgaacaggagctgacatccaaacaagggggcagatgttcacctgtgccaggattgagttcttcacctagcgggtcacctctccacggcaagctgaattctcaggattcttacaataatttcaccaataacaaccctggaaaccctcgccttagccccttgcccagcctgatggtcgtcatgccgttggcgcagattaaacagcccatgaccctgggaaccatcaccaagagaactggtaaagtgaagccacccccacagatttcaccctctaagagtatgggcggcgagttctgcgttgctgctatcttcgggacctcacggagctggttcgctaacaatgccggactgaagagggaaaaggatcagagcaagcaagttgtagtggagagtctgtatattatcagctgttacgggacactagtcgagcatatgatggagccaagacccctgagtactgcgcccaagatcagcgacgacacaccgttggagatgatgacctctccacgtgcatcttggacactggtgcgaacccctcaatggaacgagctgcagcctcctttcaacgcaaaccacccattactgctcgccgccgatgccgtgcagtattatcagttcctgctggccggactggttcctccgggatcaccgggccctattactagacatggatcttatgatagcctcgcaagcgaccatagcggtcaggaagacgaagaatggctgagtcaagttgaaattgttacccacactggcccacaccgacgcctatggatgggtccccagtttcagttcaagactatacacccatctgggcaaaccacagtcatttctagcagctcttccgtactccagtcgcatggcccaagcgatacgccgcagcctctgttggatttcgacacagacgatcttgacctcaatagtcttagaatccagcctgttagaagcgaccccgtgtcaatgccgggatcttccagacccgtctccgaccggcgcggtgtgtcaactgtgatagacgcagccagtgggacatttgaccgaagcgttacccttctggaggtgtgcggcagctggcccgaagggtttgggcttcgacatatgtcctctatggagcatacagaggagggcctgagagaaagattagcagatgccatggccgaatccccatccagagacgttgtcggtagcgggacagacaccgcattggatgtggcagtcaagactttcccccccgagcgccacgtggctgtgaagtgctttgaactccagcgagaagggtctattgaaacactgagcaatagcagtggttccacctctggtagcatccctagaaatttcgacggctaccgctctcctcttccgaccaacgagtcacagcctttgtcactgtttcccaccggttttccctag

SEQ ID NO: 16198 - DNA, 615 bp, Artificial Sequence
  Description of Artificial Sequence: Synthetic coding sequence
atggaggctgctggcagtccagctgccacggagaccggaaagtatattgcttctactcaaaggcctgatggaacctggagaaaacagaggcgcgttaaggaggggtatgtccctcaggaggaggtgccagtttatgaaaacaagtatgttaagtttttcaagtcaaagcctgagttgccaccaggattatcaccggaggctaccgcacctgtgacccccagccgaccagaggggggagagccaggactgagcaaaaccgcgaaacggaaccttaagcgcaaggagaagaggcgtcagcagcaggagaaaggagaggctgaggccctcagccggaccttggataaggtgtctctggaagagaccgcccagttgccctccgcacctcaggggagtcgggccgcacccacagccgcctctgatcagcccgactcagcagccactaccgagaaagcaaaaaaaattaaaaacctgaaaaagaagttaaggcaggtcgaggagttgcagcagcggattcaggctggggaggtgtctcaacctagcaaagagcaactggaaaaactggctcgaaggagggctctggaggaggagctagaggacctcgaactgggactctag

SEQ ID NO: 16199 - DNA, 663 bp, Artificial Sequence
  Description of Artificial Sequence: Synthetic coding sequence
atgtcaagtggaaattatcagcagtctgaagcgttaagtaagccaactttcagtgaggagcaggcttctgcactcgttgaatcagtcttcgggctcaaagtgagtaaggtgaggcccttaccctcatatgacgaccaaaatttccacgtctatgtaagtaagaccaaagacggacctacagagtatgtgttaaagatttccaacacaaaagctagcaagaaccctgatctgattgaggtgcaaaaccacattattatgttccttaaggcagccggttttcctacagcgtccgtgtgtcacactaaaggggataataccgccagtctcgtgagcgtggactccgggtccgagatcaagagctatctggtgcggctgcttacttacttgcccggcagacctatcgccgaactccctgtgagtcctcaacttctttacgagattggaaagttagcggcgaagctggataagactcttcaacggttccaccaccctaaactgagctcactgcaccgagagaattttatttggaatctgaagaatgtgcccctgctggaaaagtatctgtacgctttaggtcagaaccgtaacagagaaatcgtggaacatgtgatccatctgttcaaggaggaggtgatgacaaagctgtcccatttccgggaatag

SEQ ID NO: 16200 - DNA, 603 bp, Artificial Sequence
  Description of Artificial Sequence: Synthetic coding sequence
atgtcctcagatagcatggatcaaccccggaatccatgtgaaaacgaaccgctgactcctgggtatcacggtttccccgcacgggattcacagggcaatcaggagcccactaccacacctgacgcaatggtgcagcctttcaccactattcccttccctccccctcctcagaacgggataccaactgagtatggagttccacatacacaggactatgctgggcagacaggagaacacaatctcacactttatggttcgactcaggcccatggtgaacaatcatcgaacagcccttctacccagaacggatctctgacacaaacggaagggggagcccagaccgatgggcagcagtcccagactcaatccagcgaaaacagcgagtctaagagcacgccaaagcgtctgcacgtcagcaacataccctttcgttttagggatcccgatcttaggcagatgtttgggcagtttggaaagatattggatgtagaaatcatcttcaatgagcgagggtccaaggggttcggctttgtgacttttgagaattctgcggatgcggaccgtgcaagagaaaaactacacgggaccgtagtggaaggttag

SEQ ID NO: 16201 - DNA, 387 bp, Artificial Sequence
  Description of Artificial Sequence: Synthetic coding sequence
atggccccggcaaaaaaaggaggtgagaagaaaaagggaagatcagctataaatgaagtagttacaagagaatatactatcaacatacacaagagaatccacggagtgggctttaagaaacgcgctccccgggccctgaaggagattaggaagttcgccatgaaggaaatgggtactccagatgtgagaatcgacacccgactgaataaggcagtctgggcaaagggaattaggaatgtcccctatagaattagggtgcgcctgagtagaaagcgcaatgaggatgaagactctcccaacaagttatacacactggtgacttatgttccagtgacgaccttcaagatctccgtgctcaatagcgtaactgtcgcgaaatcaccctag

SEQ ID NO: 16202 - DNA, 393 bp, Artificial Sequence
  Description of Artificial Sequence: Synthetic coding sequence
atggctcccgccaagaagggcggggagaagaagaagggacgcagtgccatcaatgaggtggtgaccagggagtatacaatcaacattcataagaggattcatggcgtgggcttcaaaaagagagcgcccagggccctgaaggagatccggaaatttgctatgaaggaaatgggcactccagacgttcgtatcgatacccggctgaataaggccgtgtgggctaaggggatcagaaatgtcccttataggataagagttcggctttcccggaaaaggaatgaagatgaagacagccccaacaaattgtacacgctcgtgacatacgtgcctgtcaccaccttcaaatcgctccaaaacgatgacctctttaagaccgactgccaccaccagtag

SEQ ID NO: 16203 - DNA, 1524 bp, Artificial Sequence
  Description of Artificial Sequence: Synthetic coding sequence
atgtggcttacttcttacccatccccaaatttccctgtgtccgtactgcaaaacggggtcaaaatgaccaacgaggctcccaagggactccgggcgaacattatacgctcctatttaatggaccctatcagtgacccagagttcttcgggagctgtaagaagcctgaggagttcaagaagttgctgtatggactatgttttttccatgccctggtacaggagaggcgcaagttcggccccctgggatggaacattccatatgaattcaacgagacagaccttcgaatctcagtgcagcagctccacatgtttctgaatcagtatgaagaactgccctatgaagcgctccggtatatgactggagaatgcaattatggggggcgggtgacggacgactgggatcgaaggaccctgcgctcgattctgaataaattcttcaaccccgagctcgttgagaatagtgattacaagttcgattcctctggcatctattttgttccaccctccggcgaccacaagtcctatatcgagtacactaagacgcttcccctgacccccgccccagagatattcggaatgaacgccaacgcggatataacaaaggatcagtctgagacacagctgctttttgataatatcctgctgactcagtcacgatctgccggagctggggctaagagctccgacgaggtcgtgaacgaggttgctagcgatattctcggtaaattgcctaacaacttcgatattgaggcagcaatgcgcagatatccaaccacatacacacaaagcatgaacactgtgctggtacaggagatggggcgttttaacaagttgctcaagactattcgcgattcatgtgttaacattcagaaggctatcaagggtctggccgtgatgtctaccgatctggaagaggtggttagctcaatactgaatgtgaagattcctgagatgtggatggggaagtcgtatccctctctgaaaccactcggcagctacgtcaatgactttctggccagactcaagtttcttcagcagtggtacgaagtgggccctcctcctgttttttggctgtcgggcttcttcttcacccaggcgtttctcaccggggctcaacagaactacgcaaggaagtataccattcccatagacctcttggggttcgactacgaggttatggaggataaagagtacaaacacccaccagaggacggtgtgtttatacacggactgttccttgacggtgcatcatggaataggaagattaaaaagctcgctgaatcccatccaaagatattatacgacacagtgcccgtgatgtggctgaagccctgtaagcgcgctgatattccaaagcgtcctagctatgtggcacccctttacaaaacaagcgagagacgcggggtgctctccacaaccggacattccacaaactttgttatagcaatgacattaccgagcgaccagcctaaggaacattggataggtcggggtgtggcacttctgtgtcagttgaattcgtag

SEQ ID NO: 16204 - DNA, 1683 bp, Artificial Sequence
  Description of Artificial Sequence: Synthetic coding sequence
atggccgcaagtgcaaagcggaaacaggaagagaaacacctcaaaatgctgagggacatgactggcttaccacataatcgcaaatgcttcgattgtgatcaacgcggcccaacctacgtgaacatgacagtgggaagcttcgtgtgtacgtcctgctcaggcagcctaaggggtttgaaccctccacatagagtaaagtccattagtatgacaactttcacacagcaggagattgagtttctgcaaaaacacggcaatgaggtgtgtaagcagatatggttggggctgtttgacgatcgtagctccgccatccccgacttccgagacccacagaaggtcaaagaattcctgcaagagaaatacgagaagaagcggtggtacgtgccccctgagcaggcgaaggtggtagcctctgtgcacgcgtctataagtggaagctccgcatcatctacttcctccacacctgaagtgaaacccctgaaaagccttctgggggacagcgcgcctacccttcatttaaataagggtacaccaagccagtcccccgtggtcggccgaagtcagggacagcagcaggagaagaagcaatttgacttgctcagcgacctggggagcgatatcttcgctgctccagctccacagtctaccgcaactgcaaactttgctaacttcgcacactttaattctcatgcagcccaaaattctgccaatgccgatttcgcgaacttcgacgccttcggtcagagctcaggttcaagcaatttcggcgggtttcctaccgctagccatagccctttccagccgcagaccactggaggttctgccgcgagcgttaacgctaactttgcccacttcgacaatttcccaaaaagttctagcgctgactttggcacgttcaacacatcacagagccaccagacggcgagtgctgtctcgaaggtaagcaccaataaggccggactccaaactgcagacaaatatgcagcgctggccaacctcgacaatattttcagcgcaggccagggtggcgaccaggggagcggatttggcaccacagggaaggcgcctgtgggttcagtggtctcagtgcccagccagagctccgccagctctgataagtatgccgccctggctgaactcgacagtgtgttcagttccgccgcaacctcctccaatgcttatacctcaacctcaaatgcatcatcaaatgtgtttggcacagtccccgtggtagcgagcgcgcaaactcagccagcctcctcctcagtgcctgcgcccttcggggctactccgtccactaacccttttgtggctgcagcgggcccctccgtggcctcatccaccaatccgtttcagacaaacgcccggggtgcaaccgccgccacattcggaactgcttccatgtccatgcctaccggattcggaacccctgctccttacagcctgccgacttcgttttcaggaagtttccagcaaccagccttcccagcgcaagctgcatttccacaacagactgcctttagccagcaacccaacggatttgcagcttttggccaaactaaaccggtggttaccccgtttggccaagttgcggcagcaggcgtgtcctctaaccctttcatgaccggtgctcctacggggcagttcccaacaggaagttcctctactaacccatttttatag

SEQ ID NO: 16205 - DNA, 2403 bp, Artificial Sequence
  Description of Artificial Sequence: Synthetic coding sequence
atgagttctctcggggccagctttgtccagatcaagttcgatgaccttcaattcttcgagaattgtggcggtggaagttttggaagtgtataccgggcaaagtggatcagtcaggataaagaggttgcagttaagaagcttctcaaaatagagaaagaagctgagattctgtctgtgctgagccacagaaatatcatccagttttacggggtaatccttgagccacccaattacgggatagtgacagagtatgcctcactcggcagcctttatgattatatcaacagcaacaggagtgaagagatggatatggaccatatcatgacctgggccaccgatgtggctaaggggatgcattatttacatatggaagctcctgtaaaagtgattcacagagacttgaaatcccgcaatgtggtcattgcagctgatggggtcctgaagatttgtgattttggcgcgagcaggtttcacaaccacacaacccatatgtcactggtcgggacttttccgtggatggcgcccgaggtgatccagtccttgcctgtatccgaaacttgtgacacctactcctacggcgtagtgttgtgggagatgctgacccgggaggtgcccttcaaaggcctagagggcttacaggtggcttggttagtggtggagaagaatgagcgcctgaccattcctagttcttgtccaagaagctttgccgagttattacatcagtgctgggaggcagatgctaaaaaacggccctcttttaagcagatcatctcaatcctagaatccatgagcaacgatacctctcttcctgacaagtgtaactctttcctgcataataaagccgagtggcggtgtgagattgaggccactctagaacggctgaagaagctcgagagggatctcagtttcaaggaacaagagctgaaagaacgggagagacggttgaagatgtgggaacaaaagctcacagagcagtccaacacaccccttctgccatcatttgaaattggagcatggaccgaggatgatgtgtactgttgggttcagcagctggtccgtaagggcgattcatccgcagagatgagcgtgtacgcatccctctttaaggagaacaatatcaccgggaaaagactactcctactggaggaagaagatctcaaggatatgggaatcgtttccaaggggcacattatccattttaagagcgcaattgagaagctgacccatgactatatcaatctgttccatttccctcctctcatcaaagattccggcggcgagcccgaggagaatgaagagaagatcgtgaacttggaactggtgttcggatttcatcttaaacccgggaccggaccacaggattgcaagtggaagatgtatatggagatggacggggatgagattgcaatcacctacatcaaagacgtcaccttcaatacgaacctgcctgatgccgaaatacttaaaatgaccaaaccgccatttgtaatggagaagtggatcgtcgggattgccaagtcccaaactgtggaatgcactgtaacatacgaatctgatgttaggaccccaaagagcacaaagcatgtgcatagcatccagtggagcagaacgaagcctcaggacgaggtcaaggcagtgcagctggcgatccagacgctgtttaccaattccgacggtaaccctggcagcagaagtgatagtagtgctgattgtcagtggctggataccctgagaatgcggcaaatcgccagtaacacctccttacagcgttcccagtccaacccaattcttgggtcacccttcttctcccatttcgacggccaggactcctatgcagccgccgttaggcggccacaggttccaatcaaatatcaacagatcaccccggtaaaccagagccggtcttcgagccctacccagtacggactgacaaaaaatttctccagcctgcatttgaactccagagactccggcttctcaagcggaaatacagacaccagcagtgagcgtggaagatatagtgataggagtagaaataaatatggccggggcagcatatcactgaactcttctccaaggggtaggtacagcggcaagagccagcactcaacacctagtagaggacggtaccctgggaagttctacagagtgtctcagtcagccctgaacccccaccagagcccagatttcaagcggtccccaagggatctgcaccagcctaacacgataccgggtatgccccttcatccggaaacagactcgagagcctcagaggaagactcaaaggtgtcagagggaggctggaccaaagtagaatatcgcaagaagcctcatcgcccaagtcctgccaagactaataaagaacgggcccgcggcgatcatcggggctggaggaatttctag

SEQ ID NO: 16206 - DNA, 144 bp, Artificial Sequence
  Description of Artificial Sequence: Synthetic coding sequence
atggacgaccaacaggccctcaattccatcatgcaggatttggccgtgcttcataaggcctccagaccagctctctcgctgcaggagacacgtaaagccaaatcatcatcacccaagaaacaaaacgatgtccgcgttaaatag

SEQ ID NO: 16207 - DNA, 1272 bp, Artificial Sequence
  Description of Artificial Sequence: Synthetic coding sequence
atggtgtcctttatgaataaccagaagcagcagaaacctacactgtctgggcagcgctttaaaacgcgaaagcgcgacgagaaggagaggtttgaccctacacagttccaggattgcatcattcagggcttgaccgagaccggtacggacctggaagccgtagccaagttcctcgacgcttccggagccaagttggactacaggcgctacgctgaaacgttgttcgacatactcgtggccgggggtatgttggccccgggaggtacattggccgatgacatgatgcgtaccgatgtctgtgtatttgccgcccaggaggacctggaaactatgcaggccttcgcccaggtttttaataagctgattagacgttacaagtatcttgaaaaagggtttgaggatgaggtcaagaagctcctgctgttccttaagggattcagcgagagcgaacgcaacaaactggccatgctaaccggagtgttgctggctaacggaaccctcaatgcttcgattctgaatagcctttataacgagaacctggtgaaggaaggggtgtctgctgcctttgcggtgaaactttttaagtcatggatcaatgaaaaggatatcaatgccgtggccgcgagcttaaggaaggtgtccatggataatcgtctgatggagctgttcccggctaataagcagtctgtggaacacttcactaaatattttaccgaagccggcttaaaagagttgagtgagtacgtgagaaatcaacaaaccattggggctagaaaagaactgcagaaggaactgcaggaacagatgtcgcgaggggatcccttcaaggacataattctgtacgttaaggaggagatgaaaaaaaacaatatccctgagcctgttgttattggaatagtctggtctagcgtgatgtccaccgtggagtggaataaaaaagaggagctggtcgccgagcaagccatcaagcacttgaagcaatactctcccctgctggccgccttcacaacccagggccaatccgagctgacattgcttctgaagatccaggagtattgttatgataacattcacttcatgaaagctttccaaaagatagttgttctgttctacaaagcagaagtgcttagtgaggaaccaattttgaagtggtataaagacgctcacgtggccaaaggaaaatcagtatttcttgagcagatgaagaagtttgtcgaatggcttaagaacgcggaagaggagtccgagtctgaagccgaggagggggactag

SEQ ID NO: 16208 - DNA, 1119 bp, Artificial Sequence
  Description of Artificial Sequence: Synthetic coding sequence
atgtcaagaaggcgctttgactgtcggtctatcagcggcctgctcacaacaactccacagatccctattaagatggagaactttaacaacttctatatcctgacttctaaagagttgggcagaggtaagtttgccgtggtacggcagtgcatctccaagtctacagggcaggagtacgccgctaagttccttaagaagaggcgcagaggacaggattgcagagccgagattctgcacgaaattgctgtactggaactggctaagtcttgcccacgggttattaacttacatgaagtctacgaaaacacttctgaaataatcctgatcctcgaatatgccgccggcggcgaaatattcagtctctgcctgccagaactcgctgagatggtatctgagaacgatgtaattaggctcatcaaacagatcctggagggtgtgtattacctgcatcagaataatatagtgcacctggatctgaagcctcagaatatactgctgtcaagcatctaccctcttggcgacatcaaaatcgtagactttggcatgagcaggaaaattggacatgcctgtgaactccgcgagattatgggcactccagagtatttggccccagagatcttaaattacgatcccattacgaccgctaccgacatgtggaatatcggcattatagcctatatgctcctcacccatacatctcctttcgtgggagaagacaaccaagaaacttacctgaacatttctcaggtaaacgtagactattccgaagagacatttagcagcgtgagtcaactggctaccgacttcattcagtcgttgcttgtgaagaatccagagaagcggcccacggccgaaatatgtctgtctcatagctggttacagcagtgggacttcgagaacctgttccaccctgaggaaacatcaagctcctcccagacccaggaccactcagttagatcatcagaggataaaacatcaaagagtagctgcaacggcacctgtggcgaccgcgaagataaagaaaacattccggaggactcaagcatggtttccaaacggttccggttcgacgatagtttgcctaatcctcacgaattggtttccgacctcctgtgttag

SEQ ID NO: 16209 - DNA, 912 bp, Artificial Sequence
  Description of Artificial Sequence: Synthetic coding sequence
atgatggatgtatccggggtgggctttcccagtaaagtgccttggaagaaaatgtccgcagaggaactagagaaccagtattgtccaagtagatgggtcgtgagactcggtgctgaggaggctctcagaacatactcccagattggaattgaagcgacaactcgcgcccgagccaccaggaaatcgctgctgcacgtaccatatggcgatggggagggggaaaaagttgatatctattttccagacgagtcgtcagaagccttacctttcttcttgttttttcacggaggctactggcagtctgggtctaaagatgagtctgcctttatggtccatccactgactgcccagggtgtggccgtggtcatcgtcgcctacggcatagctcccaaaggcaccctggaccacatggtggaccaggtgacaaggtctgtggccttcgtccaaaaacgctatccaagcaacaaaggtatttacctgtgtgggcactcagccggtgcgcacctggctgccatgatgctgttggccgactggacaaagcatggtgtgacccccaacctccgtggtttcttcctggtgtcaggcgtattcgaccttgagcccatcgtctatacctctcagaacgtggccttacaacttaccctggaagacgcccagcggaactcgccccagctgaaggtggctcaggcacaacctgtcgaccccacctgcagggtgctagtggtagtcgggcagttcgatagtccggagttccaccgacagtcctgggaattctaccagacactctgtcaaggtgagtggaaggcatcattcgaggagttgcatgacgtagaccacttcgaaatcgtcgagaatctgacacagaaagacaacgtcctgacccagattatcctcaaaactatctttcagtag

SEQ ID NO: 16210 - DNA, 684 bp, Artificial Sequence
  Description of Artificial Sequence: Synthetic coding sequence
atggctctgcacgacatggaggattttacttttgacggcacgaagaggttaagcgtcaattatgtgaagggaattcttcagcctacagacacgtgcgatatttgggataaaatctggaacttccaagcgaaacccgatgacctgttaattagtacatacccgaaagccggtacgacttggacgcaggagattgtcgagctgatccaaaacgagggcgacgtggaaaagagcaagagggcccctacacatcaaaggttcccctttttggaaatgaagattcctagtttaggtagtgtatgctggggatcgtggcacgagcacgtaaagggatggtgggaggctaaggataagcaccgcattctgtatcttttctatgaggacatgaagaagaaccccaagcatgagatccagaagctagccgagtttatcgggaagaagctcgatgacaaagtgttggataaaatcgtccactatacctcttttgatgtgatgaagcaaaaccccatggcaaactactcaagtatcccggctgaaatcatggaccacagcatttccccttttatgaggaagggcgctgtgggagattggaagaaacatttcactgtggcacagaacgaaagattcgacgaggattataagaagaaaatgaccgacacgcgcctcacctttcattttcagttttag

SEQ ID NO: 16211 - DNA, 366 bp, Artificial Sequence
  Description of Artificial Sequence: Synthetic coding sequence
atggcaccagccaagaagggaggcgagaaaaaaaagggacggtccgctatcaacgaggtcgtgacgcgcgagtataccataaacattcacaaaagaatccacggagtcggtttcaagaagagggctcccagggccctcaaggaaattcgcaagttcgcgatgaaggagatggggacccccgatgttcgcatcgacactcgcctcaataaggctgtttgggccaaaggaatcagaaatgtgccttatcggatacgagtgagattgagtcgaaagcggaacgaagatgaagacagtccaaacaagttgtataccctggtgacatatgtaccagtgaccaccttcaaatcaaaattctcgattccttag

SEQ ID NO: 16212 - DNA, 267 bp, Artificial Sequence
  Description of Artificial Sequence: Synthetic coding sequence
ttgagcttccgcgcggactcagcccacgccagcatggtaaatgtgccgaagacacgtcgaacgttttgcaagaagtgcgggaagcatcaacctcacaaagtcacccagtacaaaaaggggaaggatagcctatatgctcaggggaagcggcgatacgaccgcaaacagtctggatatgggggacagaccaagcctattttccggaagaagctgcatcaaaactgcatcgagccgaaccttcctcctagggcacagcaaagcccatag

SEQ ID NO: 16213 - DNA, 582 bp, Artificial Sequence
  Description of Artificial Sequence: Synthetic coding sequence
atggactctacattagcggtgcagcaatacatacagcagaacatcagagccgactgctctaacattgacaagatcctagaaccgccggaaggacaggatgagggggtatggaaatacgaacatttacgtcaattttgtttggagctcaatgggctcgccgtgaagcttcaatctgaatgtcacccagatacatgtacacagatgacagccactgaacagtggatcttcttgtgcgcagcccacaaaacccctaaagaatgccccgcgatagactataccaggcatacccttgacggcgccgcctgtctgttaaattcaaataagtactttccttcgagagtaagcatcaaggaaagtagtgttgccaaattaggctctgtgtgtcgcagaatctatcgaatcttcagccatgcatacttccaccacagacagatcttcgatgaatacgagaacgaaactttcctatgccaccgattcacaaagtttgtaatgaaatacaacttgatgagcaaagataacctcattgttcctatactggaggaggaggttcagaatagtgtgtcaggggagtctgaagcttag

SEQ ID NO: 16214 - DNA, 4137 bp, Artificial Sequence
  Description of Artificial Sequence: Synthetic coding sequence
atgtccttggagcgcgagctccggcagttgtccaaagccaaggctaaagctcagcgcgctggtcagagacgggaggaggcggctctttgtcaccagcttggtgaattgctggcaggccacggaagatatgccgaagctctggagcagcattggcaagaactgcagctccgcgagagagccgatgatccactgggatgcgccgttgcccaccgaaaaattggggaacgtctggcagaaatggaggactaccccgccgctctgcagcatcagcaccaatatctcgagcttgcacactccctgcggaaccataccgaactccagagggcatgggcaacgatcgggagaacacacctggatatttacgatcactgccagtccagggacgctctcctccaggcacaggcagcatttgaaaagagcctcgctattgtggacgaggagctcgaaggtaccctggctcagggggaactcaatgaaatgcggactcggttataccttaacctgggactgacattcgaatcgttgcagcagaccgctctgtgtaatgattattttcggaaatcaatttttctggccgaacagaaccacctgtatgaagacctgtttagagcacgctataaccttggaactatacattggagagccggccagcattcccaggccatgcggtgcttagaaggtgcccgcgaatgtgctcacaccatgcggaagagatttatggaaagtgaatgttgtgttgtcatcgcccaggtcttgcaggatctgggggacttcctcgcagcgaaaagagccttaaagaaggcttatagactggggtcccagaagcctgttcagcgcgctgcaatctgtcaaaatctgcagcatgttctcgctgtggtgagattacagcagcagctcgaggaagctgaagggcgagaccctcagggggccatggtgatctgcgaacagctgggggatcttttctccaaggcaggtgactttcctcgtgcagcggaagcttaccagaaacagctccggttcgcagagctgcttgatcgtccgggcgctgagagagccattatccatgtgagtctggccactaccctgggggacatgaaggaccaccacggggccgtgaggcactatgaggaagaactacgattgcgatccggcaacgtgctggaggaagctaagacatggttaaacattgctttgtcgcgggaagaagccggcgatgcttacgaactgctggccccatgcttccagaaagctttaagttgcgctcagcaagcacagaggccacaactgcagcgacaagtcctacaacatctgcacacggtgcagctccgactgcagccgcaggaagccccagagacggagacgaggcttcgggaactttccgtggccgaggacgaagatgaagaagaggaggcggaggaagctgccgccaccgccgaatcggaggccctggaagcgggagaggtagagctgtctgaaggagaagacgacaccgacggcttaaccccccaactcgaggaagatgaggagctccagggccacctggggcgccgcaaggggagtaaatggaataggcgtaacgacatgggtgagactctgctccaccgggcgtgcattgaaggtcagctccgccgggttcaggatctggtgcggcaaggtcatcccctcaatcccagggattactgcgggtggacacctctccacgaggcatgcaattatggccaccttgagatcgtccggtttctgctagatcatggagccgcagtggatgaccccggggggcaagggtgcgaagggatcacaccccttcatgatgctctgaactgcggccactttgaagtggctgaattactcctagagcgcggagcaagtgtgacattgagaacccggaaaggcctcagccctctcgaaacactccagcagtgggtgaagctgtaccgccgggatctcgacctggaaacacggcagaaggctagagctatggagatgctccttcaggccgccgcctccggtcaggatcctcactcttcacaggccttccataccccatcatctctgcttttcgatccagagacgagcccccctctgtctccctgtcccgaacccccgtctaactcaaccagactccctgaggctagccaggctcatgtgagggtgtccccagggcaggctgctcccgcaatggccaggccacgcagaagccgacatggcccagccagctcctcgtcttcaagtgaaggtgaggatagcgcaggaccagcgagaccaagccaaaaaaggcctcggtgctccgctacggcacagcgggtggcggcttggactcccggcccagcctccaatagggaggctgccactgcgagtactagtagagctgcctaccaagccgccatccgcggtgtcggttcagcacagagtcgactgggcccgggtccaccgcggggacacagtaaggcgcttgccccacaagccgccttgattcctgaggaggagtgtctggcgggcgactggctggagctggacatgcccttaacacgctccaggcgacctcgcccgcgaggtactggtgataaccgaagaccctcaagtacctcaggctccgattccgaagaatcacgccctcgcgcaagagccaagcaagttcggctgacatgcatgcagtcttgctccgcacccgtgaacgcagggccttcgagcctggccagcgaaccgcccggcagccctagcaccccaagggtttccgagccatctggtgactctagtgccgcaggacagcccttggggcctgccccacctcccccgatacgagtgagggtgcaagtacaggatcacctttttttgatccccgtgccacattcaagtgacactcactcagtcgcttggctagcagaacaagcagcccagcggtattatcagacgtgtggactccttcccaggctgaccctgcgaaaagaaggagctcttcttgccccacaagacctgattcctgacgttctgcagtcaaacgacgaagtgctcgctgaggtgacctcctgggacctgcccccgctcacagaccgttatagacgtgcatgtcagtcacttggtcaaggggaacaccagcaggtgctgcaagcagtagagttgcagggattgggtttgtccttcagcgcatgttcactagcgcttgaccaggcccagttgactccactgttacgagccctgaaactgcacactgccctcagggagcttcgtctggcgggtaaccgtctgggcgacaaatgcgtggctgagctagtggccgcgcttggaacaatgccctccttagcccttcttgatctgtcttccaatcacctcggcccagaaggcctgagacagctggccatgggtctccctggccaggccacactacagtccctggaagagctcgacctgtctatgaatcccctcggagatggatgcggccagtccctggcctccctactgcacgcctgccccctcctaagcacgctcaggctccaggcatgtggcttcggcccatcgttctttctatcacatcaaaccgcccttggcagtgcgtttcaggacgctgagcacctaaagacactcagtctcagctataacgccttaggcgccccagcactagcccgcacccttcagtccttacccgctggtaccctgttgcacctggagctttcctccgtggcggcaggaaaaggagacagtgacctcatggagcctgtctttcgttatctggcaaaggaggggtgtgcactggcacatctgacactttcggcaaatcatctgggagacaaggccgtgcgggacctctgtcgatgtctctcgttgtgcccttctctgatcagcctggacctcagcgctaacccagagataagctgtgcctctcttgaagagctgctcagtacattgcaaaagcggccccagggacttagtttcctggggctgagcggctgtgcggtccaaggtccactggggctcggtctgtgggataaaattgctgcccagctcagggagctgcaactgtgctcgagacggctgtgcgcggaggatagggatgccctgagacaactgcaaccatcccgccccggaccaggggagtgcacgctcgaccacggaagcaagctgttttttcggaggctttag

SEQ ID NO: 16215 - DNA, 1218 bp, Artificial Sequence
  Description of Artificial Sequence: Synthetic coding sequence
atgaactaccagcagcagctcgccaacagcgctgcgatccgcgcagagattcagcggttcgaatctgtccaccccaatatatatagcatctacgagctgcttgagcgcgtcgaagaaccagtgctccaaaatcagattcgggaacatgtaattgctatcgaagacgcattcgtcaactcacaggaatggaccttgtcgcgcagtgtgcccgagctaaaagtaggcatcgtcggtaacctcgcaagtgggaagtccgcgctggtgcatcgttacctgactggcacttacgtgcaggaggaaagcccagaaggcggcagatttaaaaaagagatcgtcgtagacgggcagagctacttgttattgatcagagatgagggggggccaccagaagcccagttcgccatgtgggttgacgcggtgatctttgtgttttccctcgaagatgagatctcatttcagacagtgtatcactattatagccgaatggcaaactatcgtaacacctcagagattccgcttgtgctcgtgggcactcaagacgccatttctagtgctaaccctcgcgtgattgatgatgcacgcgcaagaaagcttagcaacgatcttaagcgatgcacctattatgagacctgcgcgacctatggtctgaacgtcgaacgcgtcttccaggatgtggcccaaaaaatcgtggccactagaaaaaagcagcagttaagcataggcccatgcaaaagtctgcctaactcgcccagccatagcagtgtctgcagcgcccaagtgtcagccgtgcatatctcacagaccagtaacggtggagggtccctcagcgactatagctctagcgttccttccacccccagtacatctcagaaagagctgcgcatcgacgttccccctaccgctaatacgccaactcccgtacgtaagcagtccaaacgaaggagcaacctcttcacgagcagaaagggctctgaccccgacaaggaaaagaagggattggagagcagggccgattccattggttctgggcgcgctatccctattaaacagggattacctttcttcgtgctggctttaaccgctagtacttatcttcgtcctgccggggccagggcccgccaatcatcgccctggccaggcccgagagggggacagacctcccctcactgtgccgagggtccccagtcagctcaactatccggcgccatgatgaattag

SEQ ID NO: 16216 - DNA, 1245 bp, Artificial Sequence
  Description of Artificial Sequence: Synthetic coding sequence
atggcagccgcccctccctcctattgtttcgtcgccttccccccaagagcgaaggatggcctggtggtcttcggtaagaatagcgcacgacctagggacgaggtgcaggaagtggtttacttctccgccgccgatcacgagcctgaatccaaggtggagtgcacttacatttctattgatcaagttccacggacctacgctatcatgatcagccggcctgcctggctgtggggtgcagaaatgggggccaacgagcacggcgtatgtattgccaatgaagctatcaataccagggagcccgcggccgagatagaggcactgttgggtatggacctggtacggcttggcctcgagaggggcgaaaccgccaaggaagctctcgacgttattgtatccctcttagaggagcacggccaggggggcaattactttgaagacgccaatagctgccactctttccagtctgcctacttgatcgtcgaccgcgacgaggcatgggtactagagactatcgggaaatactgggccgccgagaaggtcactgaaggagttcgctgcatatgctcccagttatctcttacgaccaaaatggacgcagagcatccagaacttcgctcctacgctcaaagtcaaggatggtggacaggagaaggcgagttcaacttctctgaagtttttagccctgtggaggaccatctggattgcggagccggcaaagacagtttggagaagcaggaggaatcaataaccgtacagaccatgatgaacactttgcgagacaaagcctcaggtgtgtgcattgacagcgaattttttctcaccactgcaagcggagttagtgtgctgccacagaatagaagctctccatgcattcactatttcaccggtaccccagatccttcaagatccattttcaagccttttatctttgtggacgatgtgaaactagtccctaagacccagagcccgtgtttcggagatgatgaccccgccaaaaaggagcctcggttccaagaaaaacctgaccgcaggcatgaactgtataaagctcacgagtgggccagagccatcatcgagagcgaccaggagcaggggaggaagctgagaagcaccatgttggaactcgaaaagcagggcctcgaagcaatggaggagatcttaacgagctccgaaccactggatcccgctgaggtcggggacctgttctatgactgtgtcgacaccgaaattaagttctttaagtag

SEQ ID NO: 16217 - DNA, 645 bp, Artificial Sequence
  Description of Artificial Sequence: Synthetic coding sequence
atgggaccacttcccaggacggtggagctcttttatgacgtcctgagcccttactcatggctgggattcgagatcctgtgccgttatcaaaacatctggaatattaatctccagctccgaccgtcactgatcactgggattatgaaggattccggcaataaaccaccagggctgttaccgcgcaaaggcctctacatggcaaatgaccttaagctgctccgccaccacctgcaaatccctatccatttcccaaaggattttttgtccgtcatgttggaaaaaggatcacttagtgccatgcgatttctaactgcagtgaacctcgaacatcccgagatgctggagaaagctagtcgtgagctgtggatgcgcgtttggagccgggccgccgaaaaggctggcatgagcgcggaacaggcacagggactactcgaaaagattgctacccccaaggtgaagaaccagctgaaagagacaacagaggccgcttgtagatatggggcctttggacttcccatcacggtcgcacatgtggacggacaaacacacatgcttttcggctccgatagaatggaactgctggcccacctcctgggggaaaagtggatgggtcctatccctccagcagttaacgcacgtctttag

SEQ ID NO: 16218 - DNA, 4206 bp, Artificial Sequence
  Description of Artificial Sequence: Synthetic coding sequence
atggctgacaccgatctgttcatggaatgtgaggaagaggaactcgaaccctggcagaagatcagcgacgtcatcgaagattctgtagtagaggactacaactctgtcgataaaactaccactgttagcgtttcccagcaacccgtctctgcccccgtgccaattgccgcccatgcgtctgtggcaggacacctgagcacgagcaccacggtttcctcgtcaggggctcagaatagcgattcaactaaaaaaactctggtgaccctgatcgccaacaacaatgcaggaaacccccttgtgcagcaaggcgggcaacctctaatacttacccagaacccagcccccggattagggactatggtcacccagcctgtgttaaggcctgtgcaggtaatgcaaaacgccaatcacgtaacctcttctccagtggcctctcagccaattttcattacaacacagggcttcccagtgaggaacgtcaggcccgtgcagaacgcaatgaaccaggttggcattgtcttgaacgttcagcagggtcagaccgtacgccccatcacgttggttccagccccaggaacacagttcgtcaagccaaccgttggggtcccacaggtatttagtcagatgacgccagttaggcctggatccacaatgccagtccggccaacaacaaatacattcaccacagtcatcccggccactttgacaatccgatccacagtgccccaaagtcagagtcagcaaactaagagtacaccatcgactagtactacgcccacagcgacccaacccaccagtcttggccaacttgcagtccaatcgccaggacaatctaaccagaccaccaatccaaagctggtcagtatagcatcattcgtgactgtgaaaagacctggtgtcacaggggagaactcaaacgaggtggccaagctggtcaacacgttgaacaccatcccgagcctgggtcagagtcccggtcccgtggtggtctctaataacagtagcgcgcacggcagccagcggaccagtggtcctgagtctagcatgaaggtgactagctccatacccgtgtttgacctccaagatggcggacgcaagatttgccctagatgtaatgcccagttccgcgtgactgaagccttgagaggccacatgtgttactgttgtcccgagatggtcgagtatcagaaaaaaggcaagtcgttggatagcgaaccatctgtaccctccgcggccaaaccaccatcccctgaaaagacagccccagtagccagtaccccgtccagcaccccaattccggctttgagtcccccgacaaaggtgccggaacctaacgagaatgtgggcgacgcggtccagactaagctgattatgctggtggatgacttttattatggacgggacggcggcaaggtggcgcagctgacgaacttccccaaagtggcaacctccttcaggtgccctcactgcaccaaacgattaaaaaacaatatcagattcatgaatcatatgaagcaccacgtcgagctggaccagcagaatggtgaggtggacggccacacaatctgccaacattgctacaggcagttttccacgccatttcagctacaatgtcacctggagaacgtgcactctccatatgagtctaccactaagtgcaagatctgcgagtgggcctttgagagtgaaccactgttcttgcaacatatgaaagatacccacaaacccggcgagatgccctacgtgtgccaagtgtgtcagtaccggtcctccttatattccgaggtcgatgttcacttcagaatgatacacgaagatacacgtcatcttttatgcccctattgcctgaaagtcttcaagaacggaaacgcatttcaacagcactacatgcggcaccagaagcgcaatgtttaccactgtaacaagtgccgcttacaattcctctttgcaaaggacaaaattgagcataagttgcagcaccacaagacattcagaaagccaaaacaattggagggacttaagcccggcacaaaggttaccatccgcgcaagcaggggacagcctcgaaccgtgcccgttagtagtaacgacacgccgccaagcgcccttcaggaagctgctcctctgacatcctccatggatcctctccccgttttcctttacccacccgtgcagaggtctatccagaaacgtgccgtgaggaagatgtccgtcatggggagacagacttgcctcgagtgctccttcgagattccggacttccccaatcattttcccacctacgtacattgctctctatgccgatattccacctgttgttccagggcctacgccaatcacatgattaacaatcatgtccccaggaagagccctaagtacctggccctgttcaagaactcagttagcggcatcaaactggcctgcactagctgtactttcgtgacaagcgtgggtgacgccatggctaaacacctagtattcaatccgtcccatcggagctcttctatcctgccccgcgggttaacttggatcgcccacagcagacatgggcagactcgggacagagtgcacgatcgcaacgtgaaaaatatgtatccgccaccaagctttccaacaaacaaagcggcaacagtgaagtctgcaggcgccacacctgcagaacctgaggaactccttacacccttagccccagctcttccaagccctgcctccaccgctacacctcccccgacacccacccaccctcaggccctcgctttacccccattagctacagagggagctgagtgcctcaatgtagacgaccaagacgagggctcacccgtgactcaggagccggagctggctagcggcggggggggcagcggcggagttggaaaaaaggagcagctctctgtgaaaaaactcagggtggtactcttcgccctgtgttgtaatactgagcaggcagctgagcattttagaaatccccagcgccggatacggaggtggctgaggcggtttcaggccagccaaggcgaaaatcttgaaggaaaatatctttcatttgaagccgaggagaaacttgccgaatgggtgctgactcagcgtgagcaacagctcccagtgaacgaggaaacattgttccagaaggccaccaagattgggagatccttggaggggggctttaagatttcttacgagtgggcggttcggttcatgctacggcaccacctgacgccccatgccaggagggcagtggcccatactctgcctaaggatgtggcggagaacgctggactgtttatcgactttgttcagcgccagattcacaaccaggacctgccgctgagtatgattgtcgctatcgacgagattagtctcttcctggatacagaagttctgtcttctgacgaccggaaagagaatgctctccaaaccgtcggcactggagagccttggtgcgatgtggtcttggcaattctggctgatggaaccgtcctgcccaccctcgttttctatcgtggccagatggaccagcctgccaacatgccagactcaattctcctggaagccaaggaaagcggctattccgatgacgaaatcatggagttatggtcgactagagtgtggcagaagcacactgcgtgccaacggagtaagggtatgttggttatggactgtcacagaacccatctgtctgaagaagtactggccatgctgtctgcctcaagtaccctgcctgccgttgttccagccggatgctcctccaaaattcagcctctagatgtgtgcatcaagagaactgtgaagaatttcctgcacaaaaagtggaaagaacaggcacgggaaatggccgatacagcttgcgacagtgatgtcctgcttcagctggtgctggtgtggctgggagaggtactcggtgtcattggagattgtcctgagctcgtacaacgttcattcttggttgcctctgtcctgccaggccctgatggaaacattaactcgccaacacggaatgccgacatgcaggaggaactcattgctagtcttgaagagcagcttaagctctcaggggagcactcagaatctagtacccctcggccacgctccagtcctgaagagaccatcgaacccgagagtctgcatcagctcttcgaaggagaaagcgagacagagtctttttacggctttgaagaagcagatctggacttaatggagatttag

SEQ ID NO: 16219 - DNA, 1398 bp, Artificial Sequence
  Description of Artificial Sequence: Synthetic coding sequence
atggaaccctcttccctggaacttcccgccgataccgtccaaagaatcgcagccgaacttaaatgccacccgactgatgaacgcgtggcgctgcacctggacgaagaagataaactccgccacttccgggagtgtttttacattcccaagattcaagaccttccccctgtggatttgtccttagtgaacaaagacgagaatgccatctattttctaggaaattccctagggcttcaaccaaagatggtgaagacctatctcgaggaagaactggataagtgggccaagattgcagcctacggccatgaagtcggaaaacgcccatggataactggagacgaaagtatcgtgggcctaatgaaagacatcgttggagctaacgaaaaagagattgccttgatgaatgctctgacagtgaacctgcatctactgatgctgagtttctttaagcccacacccaagaggtataaaattctgctggaagccaaggctttccctagtgatcactatgccattgagtcccaactgcaactgcatggtctgaacattgaagaatcaatgcggatgattaagccccgcgaaggagaggaaaccttacgcatagaggatattcttgaggtgattgagaaggagggggattctatcgccgtcatccttttctcaggcgttcatttctatactggccagcatttcaacattcctgctattactaaggctgggcaggccaagggctgctacgtcgggtttgatctcgcacatgccgtgggtaatgtggaactgtacctgcacgattggggcgtagactttgcttgctggtgttcttataaatatctcaatgcaggagcgggcggaatagcaggggctttcattcatgaaaagcacgctcacacaattaagcctgcccttgttgggtggttcggacacgagttgagcacccggtttaagatggataacaaattacagctgatcccaggcgtgtgcggttttcgcatctctaatccccccatactgctagtgtgtagcctgcatgcatcactggaaatttttaaacaggctactatgaaagcactccgtaaaaaatcagtgctgctgacaggctatctggaataccttatcaaacacaattatgggaaagacaaggcagctaccaagaagcctgtggtgaacatcattactcccagccatgtagaggagagggggtgccagctcaccataacgtttagcgtcccgaataaggacgtctttcaggaattagagaagcggggcgtcgtgtgcgacaaacggaaccccaacggcataagggtcgcaccagtgcccctgtacaactcattccatgacgtgtataaatttaccaatttgctcacaagcatactcgatagcgctgaaaccaagaactag

SEQ ID NO: 16220 - DNA, 3210 bp, Artificial Sequence
  Description of Artificial Sequence: Synthetic coding sequence
atgtatttactggacggcagcggagagccagcctcgcctcccgctgacgccatgcccagagggaccccccctcggaagacagtctataggattagcgtgactatggtccgaaaggaacagcttgccgccccgggcagcggtggacctgatccacgcccggttaggcggcccagacccgctcggtcccccgacgcacctggaagattagaggaagaggctgaggaggctgaaggcgccgaggaaccagaggggccgaggccgcgggcttgggacttccggaccttccgcacacggagcacaggtcaactcgaactcggacgactgcggccgtgcgcccgcggactagaacctgctgacctggcaggatccgccccagccgaggaagaaggccgtggcagcccagcatcaggctcccccgacgtggaaggtgccagagctgccccactccggcgttctcttagttttcgccattggtccgggcccgaggctccacagggacggacactcggcggcggccgccgccatagctcgtccggtagccttgcttgggccccgtgtgacgaggctgcagccgggaccactcttgaacccgcaaccgccactcaaccagcctcagaaaaacgcaacacattggacgtgggcgaggtgctttctaagaacgatgcgttgtccgacctggagaggtgggagagaagcaaatctaaaaacagaaccctagataactcagatctgcaacggctggagagggcccgggctgccgcaggcgccggagcagcctcagaacaccggctgctgaggttcttttccggaatattcgcccgtagggatggcggaccaggtgggggcccgagcccacggtccggggcttctagaccacgggggtacttctccctgcgcagggcgccagccgaagcccattcatcttctgctgagagcatcgatggaagccctaggagggatgcatttgtgaattcgcaggagtggacgctgagccgcagtgtgcccgagctgaaagttggaatcgtcggaaatctcgcctccggcaaatcagcactcgtccatcgctaccttaccgggacttatgttcaggaagagagccctgaagggggtagatttaagaaggaaattgtcgtcgacggccagagctatctcctcctgattcgagacgagggcggcccacccgaggctcagttcgcaatgtgggtggacgcagtgatcttcgtctttagtctagaggacgagatttcttttcaaacagtttatcattactacagtcggatggctaactaccggaacacaagcgagatacctctggtgctggttggcacgcaggatgcaatttctagcgcaaatcctcgagttatcgacgacgctcgggcacgcaaactaagcaacgatcttaaacggtgcacatattacgaaacctgcgctacctacgggctgaatgtggagcgcgtttttcaggatgtggcacagaaaatcgtggcaacacgcaagaaacaacagctctctatcgggccatgtaaaagcctgccgaactccccatctcacagctcggtgtgctccgcacaggtgagtgcagtgcacatatctcaaactagcaacggtgggggatccctgtctgattactcttctagtgtcccctctaccccaagtacatcccagaaggaattgcgcatcgatgtccccccaactgccaacactcccactcccgtcaggaaacaatccaagaggagatctaacctcttcacgtcccgaaaagggagcgaccccgacaaggagaaaaaggggcttgagagccgggctgattcaatcgggtccgggcgggcgattcccatcaagcagggcatgctcctcaagcgctctggaaaatcacttaataaagagtggaagaaaaaatatgtcacactctgtgacaacggagtcctgacataccaccctagtctgcatgattacatgcagaatgtccacgggaaagaaatcgatctgctgagaacgacagttaaagtgcctggcaaacgacccccccgtgccacctccgcatgcgcccctatcagttcaccaaaaaccaatggtctgtcgaaagacatgtcctccctacatatctcaccgaacagtgacacaggtctcggggactcagtctgttcctccccttcaatcagcagtactacttcaccgaaactcgaccccccaccatctcctcatgccaatagaaaaaaacaccggaggaagaaatccacatcaaattttaaggccgatgggctatcaggcactgccgaggagcaggaagagaacttcgagtttattattgtctccttgactggacaaacatggcatttcgaagccactacgtacgaggagcgcgatgcatgggtccaggctattgagtcccagatattggcctctctccagtcttgcgagagctctaagaacaagagccgtctgacatctcaatctgaagccatggcgctgcagtctatcagaaatatgagggggaactcccactgcgtcgattgtgaaacccagaatcccaactgggcgtcactgaaccttggggccttgatgtgtatcgagtgcagtgggattcataggaatctgggcacccatttgagccgggtgcgatccctggaccttgacgactggcctgttgaactgatcaaagtgatgtcctctattgggaacgaactggctaattctgtttgggaagagagctctcaagggagaacaaagccatctgtcgactctacaagggaggaaaaagaacggtggattcgtgctaagtacgagcagaagttattcctagcaccactaccctgcacggagctctcgctaggacagcatctattgagagcaactgctgacgaggacttacggactgctattctgttgttagcgcacggctccagagatgaggtgaacgaaacctgtggagagggtgatggacgtacagcacttcaccttgcttgccgcaagggaaatgttgtgttggcacagctcctgatctggtatggcgtggatgtgaccgcacgggacgctcacggtaacactgctctcgcgtacgcccggcaggctagctctcaggaatgcattgacgtgcttctccaatacgggtgccccgacgagaggtttgtgctgatggctacccccaacttgagtaggaggaataacaatcggaataactcatcaggacgagttcccaccattatttag

SEQ ID NO: 16221 - DNA, 1260 bp, Artificial Sequence
  Description of Artificial Sequence: Synthetic coding sequence
atgaataatcagaagcagcagaagccaaccctgtctggccaacgctttaaaacccgaaagagggatgagaaagagagattcgatcccacccagttccaagattgcatcatccaggggctgacagagactggaaccgatctcgaagccgtggcaaagtttttagatgcgtctggtgcgaagttagactaccggcgttacgcagagactctgttcgacatactggtggctggcggtatgctggcgcctggggggacactggccgatgatatgatgagaactgatgtctgtgtttttgccgcacaggaagacctggaaaccatgcaagcatttgctcaggtctttaataaactgattcgccgctacaagtacctggagaagggattcgaggatgaagtgaaaaagctgcttctgttcctcaagggtttttcggagtccgaaaggaacaaactagccatgctaaccggtgtactattagcaaacggcacgcttaacgcctccatcttgaactcactgtataacgagaacctcgttaaagagggcgtctccgccgccttcgccgtgaaactttttaagtcgtggatcaatgagaaggacatcaatgctgtggccgcttcactccgcaaagtttctatggacaatcggctcatggagttgttcccagctaataagcaatctgtagaacactttaccaagtatttcaccgaagccggcctgaaggagctgtccgagtacgttagaaatcagcagacaatcggagcgcggaaggaactccagaaagagctgcaggagcagatgtccaggggtgaccccttcaaggatattatcttgtacgtgaaggaggaaatgaaaaaaaacaacatccctgaaccagtggtgattgggatcgtgtggtcatccgtcatgtccactgtggagtggaacaaaaaggaggagcttgtcgccgagcaggccattaaacacttaaaacagtactctcccctcctggccgcttttacaactcaaggccagtctgagttgacgctgttgctgaaaatccaggagtattgctacgacaatatacatttcatgaaggcttttcagaaaatcgtagtactcttctacaaggccgaggttctgtcagaggagccaatcttgaaatggtacaaagatgcgcacgtggctaagggtaaaagcgtgtttttggagcagatgaaaaagtttgtcgagtggctgaaaaacgccgaggaggagtcggagtcagaggccgaagagggggattag

SEQ ID NO: 16222 - DNA, 2769 bp, Artificial Sequence
  Description of Artificial Sequence: Synthetic coding sequence
atgattaccagtgccgcaggaatcatatccctgctagatgaggatgagccccaactcaaggaatttgcactgcacaagctgaacgcggtggttaatgatttttgggctgagatcagcgagtctgtcgataagatcgaggtgttgtacgaagacgaaggtttccggtcgcgtcagttcgcggccctcgtggcctccaaagtgttctaccacctaggtgcctttgaagagtcacttaactatgctcttggagctggcgaccttttcaatgtgaacgacaactccgagtatgtcgagacaattatcgcaaaatgcattgaccactacacaaaacagtgcgtggagaacgcggacctccccgaaggagagaagaagccgatcgaccagagactcgagggcatcgtcaataaaatgttccagagatgtctggatgatcacaagtataaacaggccattggcatcgcactcgaaaccagaagactggacgttttcgagaaaactatattggaatcgaatgacgttcctggcatgctagcgtactcactcaagttgtgcatgtccctaatgcagaataagcagtttagaaacaaggttctccgggtgctggtgaagatttacatgaatctagagaagccagattttatcaacgtgtgccagtgtctaatctttctggacgatccacaggctgtgtctgacatattagaaaaactggttaaggaagacaatcttctcatggcttaccaaatttgcttcgacctgtacgagtcagccagccagcaattcttatcctccgtgatacagaacctgcgcaccgttggcacaccgatagctagtgtgcctggctcaactaataccggtacagtgcccgggtccgagaaagattcagactccatggagaccgaggaaaagacatcaagtgccttcgtaggcaagactcctgaggccagtccggagccgaaggaccaaactctgaagatgatcaaaattctgagtggcgagatggcaatcgagttacatttacaattcctcattcgcaacaacaatactgacctgatgattctaaagaacacgaaggacgccgttcgtaactccgtctgtcataccgctactgtaatcgctaacagctttatgcattgcggaactaccagcgaccagttcctcagagacaacttggaatggctagcaagggctactaactgggcaaaatttactgctacggcttccttgggcgttatccacaagggacatgagaaggaagctcttcagctgatggccacctacctgcccaaggacaccagtcccggatcagcctatcaggaagggggcggactctacgcccttggtctcatacacgccaaccacggcggagacattattgactacctgttgaaccagctcaaaaatgcgtctaatgacattgtgagacacggtggcagcttaggcctcggccttgcggccatgggcaccgcacggcaggacgtgtacgacctgcttaaaaccaatctttaccaggacgatgctgtcactggggaagccgccggcctggctcttggtctggtgatgctgggcagtaagaatgcgcaggccattgaggatatggtgggctacgcccaggaaacccaacatgagaagatcttgaggggactagccgttggaatcgctctagtaatgtacgggagaatggaggaagcagatgctcttatcgaatccctgtgcagagataaagacccgatcttacgccggtcgggtatgtacacggtggcgatggcttattgcggcagcgggaataataaggctatcaggcgactgctccatgtggccgtatcagatgttaacgacgatgtgcggagggcagctgttgagtctctcggattcatactgtttcggacaccagagcagtgcccctcagtggtatccctgctgagcgagtcatacaacccacacgttcgctacggcgccgccatggctctgggaatctgttgtgccggtactgggaataaagaggcgattaacctgctggagcccatgacgaacgacccagtcaactacgttcggcagggagccttaatagctagcgccctgattatgattcagcaaacagagatcacatgcccgaaggtgaaccagttcaggcagttatacagcaaagtgattaatgacaaacacgacgatgtgatggcaaagttcggtgcaattcttgcccagggaatcctggatgccggcggccacaatgtgacaataagtttgcagtcgaggactggacatacccacatgccttccgtggttggagtcctggtattcacccaattttggttttggttcccgctgagccacttcctctctctagcctacactcccacttgtgtcataggtctcaataaagatttgaaagtttccacggcagtattgtcgatcacagccaaagcaaaaaagaaagaaaaagagaaagagaagaaggaagaggaaaaaatggaggttgacgaagctgaaaaaaaggaggaaaaagagaagaagaaagagcctgagcccaatttccaactcctagacaatcccgctagagtgatgccagcacagcttaaagtattaaccatgccagaaacctgtcggtaccaaccttttaaacccctgtccataggcggcatcataatactgaaagataccagcgaggatatcgaggaattggttgagcctgtagcggcccacggtccaaaaatcgaggaggaagagcaggagcccgaaccgcctgagcccttcgaatatatcgacgattag

SEQ ID NO: 16223 - DNA, 363 bp, Artificial Sequence
  Description of Artificial Sequence: Synthetic coding sequence
atggctcctgcgaaaaagggaggagagaaaaaaaagggccgttctgcgataaacgaggtagtgacccgtgagtacaccattaacatccataaacggattcatggtgttggctttaagaagagggccccccgggctctgaaggaaatcagaaaatttgctatgaaagagatgggaacgccagatgtgagaattgatacccggttgaataaagctgtgtgggccaaagggattcggaacgtaccatatcgcatccgagttagactgagtaggaaaaggaatgaagatgaggattctcctaacaaactgtacactttagtgacctatgttcccgtaaccactttcaaaaattgtcatcaccagtag

SEQ ID NO: 16224 - DNA, 378 bp, Artificial Sequence
  Description of Artificial Sequence: Synthetic coding sequence
atgtcaagcacactcgggaaactttcgaatcaggtggaagaaacactcccactgctgaaaaaggttcccgcaaactatttccacatatgctctgctatcctgatggggttctcattgagcaaatccgcgacccaggtctccgcaattcatatggattcaaaggtcgacgaccaccttattcgcggcaccgaaaagtctcgactggaaccagcgacgcagctgtttcaaaataccaagaaaatccggctggaggataccaaccaggagaattttactaggatcgaggggaccggcactgggtccttgtccggaaaggccttggggagcgttgtctatgtcaaagaatcggacgggctagaaatgacagacgtcgaatag

SEQ ID NO: 16225 - DNA, 1500 bp, Artificial Sequence
  Description of Artificial Sequence: Synthetic coding sequence
atgagcacaccaagtgggatctctacatggctctctctgcccgtctctacaccagccagcatcacatcgatacgtgtgacccagaaatcatcgggcccctgggctttctcaagctgcacttacgtatcggggccaggtgtgtgcatttcaagtctgtcttgcagcagggtgggtagctcaagctttcggggtggactcgggggaggatatggaggtgccagcggcatgggaggcataattgccataatggttaatcaatcattgctgtctcctctgaacctcgaagtggatccgaatattcaagccgtctgcactcaagagaaggaacaaatcaaaaccctgaacaacaagtttgcatcgttcattgacaaagtgtggtttttggagcagcagaacaaggtgctcgagaccaaatggagtctgctccagcagcagaagatggccagatccaacatggataatatgcttgagagttatataaacaatctgcgtcggcagctcgaaactctgggacaagaaaaactgaagttagaagctgaattaggcaacatgcagggccttggcgaagactttaagaataagtacgaagatgaaattaataaacacactgaagtcgagaatgaatttgtgctgatcaagaaggacgtagacgaagcctatatgaacaaggccgagctggaaagcctcctcgaagggctcacagatgaaattaattttttgcgccaactttacgaggaggagattcgcgagctccagtcccagatcagtgatatgtctatggttctgagtatggattattcctgctccagagacatggattcaataatccctgaggtgaaggtgcaatatgaggagattgctaattgctcaagggccgaggctgaaagtatgtaccagattaagtacgaagagctacaaaccctggctggcaaatacggtgacgatctgtcacgcaccaagactgagataagtgaaatgaatcggaatataagctggctccaagcagagaccgagggcctgaagggtcaacgcgcgtctctggaggcggccatcacagatgcggagcagcggggggagctcgccgtaaaagacgcaaatgctaaactgtccgaactggaggctgctctccagagagctaagcaggacatgatgggccagctgcgcgagtaccaggagttgatgaacgttggcctgactctggacattgaaatagccacttaccggaaactactggaaggagaggaaagccggctcgagtctggaatgcagaatgttagcatacatacaaagactacaagctcatatgccgggggactctcttccgcctacggagggctgacatctccgggcatcatctatcgattgggctcctcgttcggatctgccgccgggtctagctcttttagtaggacctcatcaacaagagctgtagtggtcaggaagatagagactcacgacgggaaacttgagagcgaatcatccgacgtgctgtccaaatag

SEQ ID NO: 16226 - DNA, 504 bp, Artificial Sequence
  Description of Artificial Sequence: Synthetic coding sequence
atgtatatgggcatgatgtgtacggccaaaaaatgcggaatacgctttcagccacccgccattattctgatatacgagagcgagatcaaaggaaagatcagacagcgcatcatgccagttcgaaacttttctaaattctccgattgtacccgcgcggcagagcaacttaaaaacaacccaaggcacaagagctatctggaacaggtctctcttcgccagcttgaaaaactgttttccttcctgcggggctatttgagcgggcaaagcctagctgaaaccatggaacagattcagcgagaaacgaccattgatcctgaggaagacctcaacaaactcgatgacaaagagttggcaaagcgaaagtcaatcatggacgagctgtttgagaagaaccagaaaaagaaagacgatccgaatttcgtttacgacattgaggtcgagttcccgcaggacgatcagctgcagagctgcggctgggatacggagtccgcagatgaattctag

SEQ ID NO: 16227 - DNA, 378 bp, Artificial Sequence
  Description of Artificial Sequence: Synthetic coding sequence
atggcccctgcgaaaaaagggggggagaagaaaaaggggagatccgctattaacgaagtcgttaccagggaatacaccattaatattcacaagagaatccatggcgttggcttcaagaaacgagctcctcgggccctgaaggagatccgcaagtttgcaatgaaagagatgggtacccccgacgtccgcatcgatacccgcctcaataaagccgtttgggctaaggggatccgcaatgtcccctaccgtattcgagtcaggttgagccggaagcggaacgaggacgaagattccccaaataagctgtataccctcgtgacatacgttccggtgaccaccttcaagaaccttcagaccgtaaatgtggatgagaattag

SEQ ID NO: 16228 - DNA, 1005 bp, Artificial Sequence
  Description of Artificial Sequence: Synthetic coding sequence
atgacccggtctttatttaaagggaacttttggagcgccgatattctctctaccatcgggtatgacaatattattcagcacttaaataatgggagaaagaattgcaaagagttcgaagattttctgaaagagcgcgcagccattgaagaaaggtacggaaaggacttattaaatctgagccgcaagaagccgtgtggtcagtcagagataaacacattaaaacgggcgctggaggtcttcaagcagcaggttgataatgtggcacaatgtcacatccaactcgctcaatcattacgcgaagaagcgaggaagatggaggaatttcgtgagaagcaaaagcttcaaagaaaaaaaactgagttaattatggatgcgattcacaagcaaaagtcactgcaatttaagaagaccatggatgccaaaaaaaactacgagcagaagtgtagggataaagatgaggcggagcaggccgtatcacgttcagccaaccttgtcaatcccaagcagcaggaaaagctgtttgtgaagttagccacctcaaagacagcggtcgaggactcggataaagcctatatgctgcacatcggaactttggataaggtgcgtgaagagtggcagtccgaacatatcaaagcgtgcgaggcctttgaggctcaggagtgtgagcggatcaatttcttccgcaacgccttgtggctccacgtgaaccaattgagccagcagtgcgtaacctcagatgagatgtatgaacaggtgagaaagagcctcgagatgtgctccatccagcgtgacatcgagtacttcgtgaatcaacgcaaaacagggcagatcccgcctgctcctattatgtatgaaaacttttattcatcacagaagaatgccgtgcccgcgggaaaggctactgggcccaacctcgcccggcggggtccgctgccaatacccaaatcaagcccagatgatcctaactacagtctggtcgatgactactcactcctgtatcagtag

SEQ ID NO: 16229 - DNA, 597 bp, Artificial Sequence
  Description of Artificial Sequence: Synthetic coding sequence
atgaagaaggtgaggctgaaagagctggagtctaggctccagcaagtggatgggtttgaaaaacccaagctccttctggaacagtacccaacccgaccacacatagccgcttgtatgctgtacacaattcacaacacatacgatgatattgaaaataaggtagtcgctgatctgggctgcggctgcggtgtactgagtattggtacggcgatgttgggggccgggctgtgcgtgggctttgacattgacgaggatgctctcgagatattcaatagaaatgccgaggaatttgagctgaccaatatagacatggtgcagtgcgacgtgtgcctgctgagtaaccgaatgtccaaatcattcgataccgtgattatgaaccctccgtttggcacaaagaacaataaaggaacggacatggcctttctgaaaactgcactggaaatggcccgaacggccgtttattccctgcataagagctctactcgggagcacgtccaaaagaaggcggcagagtggaaaatcaaaatcgacattatcgctgagctccgctacgatttgccagctagttataagttccataaaaagaagtctgtttag

SEQ ID NO: 16230 - DNA, 1125 bp, Artificial Sequence
  Description of Artificial Sequence: Synthetic coding sequence
atgcttgccccggggtgcgaacttgatcccgaccaggaagtggtccgtacgcggccagaggatgtacccgctagtccttctactagtaccatgatcgtcagcgtcttaaggcctccctcacacgcatcctgcactgcctgcgggactgtgacctttcatatagtcgagcgtatggcgagcgtcataccggctagcaataggtctatgcgatccgaccgtaacacttatgtcgggaagagatttgtacacgtgaagaacccctatcttgacttaatggacgaagatatcctgtatcacctcgacctaggaactaagactcataatttgccagctatgttcggagacgtcaaattcgtttgcgtgggggggagtcctaatcggatgaaagcgtttgctctctttatgcacaaggagttgggattcgaagaagcagaagaagatattaaagatatttgcgcagggactgacagatattgtatgtacaaaacagggcccgttctggctatctctcacggaatggggataccctctatcagtatcatgcttcacgagctcatcaagctgctgcaccatgcaaggtgctgtgacgtcaccatcattcgtattggcacatccggaggtatcggaattgccccaggtaccgttgtgattactgacattgccgttgatagcttcttcaagccaagattcgagcaggtgattttggacaacattgtcacacggtccaccgaattggacaaggaattgtcggaggagttatttaattgtagtaaggaaattccaaatttccccacgcttgtagggcacacaatgtgtacatatgatttctatgaaggccagggcagacttgacggcgcgctgtgttccttcagtagggaaaaaaagctggattacttgaagagggccttcaaggcaggagttcgaaacatcgaaatggagagcaccgtgtttgctgcaatgtgcggcctctgtggtctgaaagcggcagtggtatgcgttacgctactcgataggctcgactgcgatcaaataaatctcccacatgacgtactggtggagtaccagcagaggccccagcttctgatcagcaattttattaggaggcgcctgggcctctgcgattag

SEQ ID NO: 16231 - DNA, 4149 bp, Artificial Sequence
  Description of Artificial Sequence: Synthetic coding sequence
atgttacggaaacttacaatcgagcagatcaatgattggtttactattggtaagactgtcacgaatgtcgagttgctgggggctcctccagctttccctgcaggcgccgctagggaggaggtgcagcgacaggatgtggcccctggcgcaggtcccgctgcccaggcccccgcactcgctcaggcacctgcccgtccagccgccgccttcgagcgttcactcagtcagcgctcttcagaggtagagtatataaacaagtatcgccagctggaggcccaggagctcgacgtgtgccgtagtgttcagcctacttctgggcctggcccaagacccagcctggccaagctcagcagcgttacatgcattcccggaactacttataagtaccccgacctacccatctccagatataaagaggaggtagtgagcctgattgagtctaatagtgttgtgataattcacggagccactgggagcggaaaatccactcaattgccccaatacattctggatcattatgtacagcggagcgcctactgttctatcgtcgtcacacagcctagaaagattggcgctagcagcattgcccggtggataagtaaagagagggcttggaccttgggcggcgttgtcggctatcaggtgggactcgagaagatagccaccgaggatacaaggttgatttatatgactacgggcgtgctgcttcagaagatcgtgagtgcgaaatctctgatggaattcacccacatcatcatcgatgaggtgcatgaaaggacggaagagatggatttcttgctactggttgtgcggaagctgctgcgaacaaattcaaggtttgttaaggttgtattgatgtcagcaacaatctcatgtaaggagttcgcagattattttgccgtaccagtgcaaaataagatgaaccctgcctacatctttgaagtagagggtaaaccacattcggtggaggagtattaccttaatgacttagagcacatccaccactccaagctttcaccccatctgttggaggaacccgttattactaaagacatctacgaggttgccgtttccctgatccagatgtttgatgatttggatatgaaggagagcgggaacaaagcatggtcaggtgcccagttcgtcctggagcgctcctccgtgttggtgtttctgccagggttgggcgaaatcaactatatgcacgagttactgacttctctagtccacaaacgcctccaggtgtatccactgcactcatcagtcgccctggaagaacagaataacgtgtttcttagcccggtcccaggatatagaaaaattatattgtctaccaacatcgccgaaagctcagtgacagttcccgacgtcaagtacgtgattgacttctgcctgaccagaactctcgtttgtgacgaggacaccaactatcagtccttgcgcctgtcgtgggccagcaaaactagttgcaatcagcgaaagggcagggcagggcgcgtgagccgtggatattgctaccgtctggtgcataaggatttttgggataactcaatccccgaccatgtagtgccagagatgctcaggtgcccccttgggtctacaatcctgaaggtcaagctcctggatatgggggagccgagggcattactagctaccgcactcagtccacccgggctcagtgatattgagagaacaattctgctgctcaaggaggtgggggccctggcggtgagtgggcagagagaggatgagaacccacatgacggggagctcactttcctcggccgggtccttgctcagctccccgtgaatcagcagttaggcaagcttattgtgctagggcatgtcttcggctgccttgacgagtgcctgataattgccgccgctttaagtctcaaaaacttcttcgccatgccctttcgccagcatctagatggctaccgcaataaggtgaacttttcaggttcatcgaagagtgattgtatcgcactggttgaggctttcaagacatggaaagcctgcaggcagactggggaattgagataccccaaggatgagctgaattggggacgcctgaactatattcagattaagagaatacgagaagtcgcagagctctacgaagagttaaaaacccggatctcgcagttcaatatgcatgtcgactcccggcggccagtgatggatcaggagtacatatataagcagcggttcattttacaggtggtgttggctggagctttctaccccaactatttcacgttcggccagccagacgaggaaatggccgttcgcgaactcgctggtaaggacccaaaaacaactgtggttctgaaacatatacccccttacggtttcctatattacaagcagctccagagtttgttccggcaatgcggacaggtgaaaagcatcgtgttcgacggcgctaaggccttcgtggagttcagcaggaaccctacagagagattcaagactctgcctgctgtctacatggccattaagatgtctcaactgaaggtgtctctggagctgtcagttcattccgccgaggagatcgagggcaaggtacagggcatgaacgtctcaaagctgcgcaatactagggtaaacgtcgatttccagaaacagaccgtcgaccccatgcaggtctcgtttaacacgtcagatcggtctcagacagtaacggatctgctgctcactattgatgtgacagaggttgttgaagtgggacatttttggggctatcgcatcgacgaaaataactccgagatactgaagaagctgaccgctgagatcaaccagcttacgctggtccctctccccacacatcctcaccctgacctggtgtgtctcgcgccctttgcggatttcgataaacagagatattttcgcgcccaggttctgtacgtcagtgggaattctgcagaggtgttcttcgtggattacggcaataaatcgcacgttgaccttcacttactgatggagatcccctgtcagttccttgagctgccttttcaggctctcgaatttaaaatctgtaagatgaggccgtccgctaagtcactcgtctgtggaaagcactggagtgacggagccagccagtggttcgcttccctcgtcagcggatgcactctgttggttaaggttttctctgtcgtgcactccgttttgcatgtggacgtttaccagtactctggggttcaggacgcgattaacatcagagatgtgctcattcagcaaggctacgctgagctcacagaggagtcgtatgaatctaagcagagtcacgaggtgctcaagggtttgtttagcaagtcagtagaaaacatgaccgacggctcagtgccgtttccgatgaaggacgacgagaagtatcttatccggatcctcctcgaaagtttcagtacgaacaaactgggtacacctaattgtaaggcggagcttcacggacctttcaacccctatgagctgaagtgtcatagtctcacaagaatctccaaattccggtgcgtctggatcgaaaaggaaagcataaactctgtcatcattagtgatgcccctgaggatctccaccagcgcatgctggtggctgctagcctgagcattaatgctactggctctaccatgcttcttcgtgagacatcccttatgccccacatacctggcctacctgcgctgctgtcaatgttgtttgcccccgtgattgaactgcgaatcgatcagaacgggaaatattacaccggggtgctgtgcggcctggggtggaatccagctacaggagcgtcaatcctccctgagcacgatatggaactagcctttgacgtgcagttctctgtggaagatgtggttgaggtcaacatactgcgagcagccatcaacaagctcgtatgcgacggtcccaatggctgtaagtgtctaggtcccgagcgtgtggcccaattgcaggatatagcccgtcagaagctcctggggctgttttgtcagtcaaagcctcgcgagaagatagtaccgaagtggcacgagaagccctacgagtggaatcaagtggatccaaagctagtgatggagcaagccgacagggaaagttccagggggaagaatactttcctttaccagctgcataagttggtggtgctcgggacttag

SEQ ID NO: 16232 - DNA, 357 bp, Artificial Sequence
  Description of Artificial Sequence: Synthetic coding sequence
atggacgtcttcctgatgatccgtcgacacaaaacaactatttttacggacgccaaggaatctagtactgtgtttgagctgaaaaggattgtagagggaatccttaaacggcctcccgatgaacagcggttatataaagacgaccagctgctcgatgatggcaagacactgggtgaatgtggcttcacctcccagaccgcccgccctcaggcacccgcaaccgtaggtctggcctttcgcgccgacgacactttcgaggcactctgtattgagcctttcagtagcccgcctgagctgccagacgtgatgaagcctcaggactctgggtcctcagccaacgagcaagctgtccagtag

SEQ ID NO: 16233 - DNA, 3228 bp, Artificial Sequence
  Description of Artificial Sequence: Synthetic coding sequence
atggttgtagaggtcgattccatgccagccgcctcctcagtcaagaagcccttcggtttacggtccaaaatgggaaaatggtgctgccgatgttttccatgctgcagggaaagtggaaaatccaacgtggggacttccggtgaccacgatgatagtgctatgaagaccttaaggtccaagatgggaaaatggtgtcgccactgtttcccatgttgccggggaagcggcaagtcaaacgtcggcgcaagcggggaccatgatgactctgccatgaagacactgagaaataagatgggaaaatggtgttgccattgtttcccatgttgccggggctcctcaaaatcaaaagtgggagcatggggagactacgacgacagtgcgttcatggaaccacgataccacgtgaggggggaagacttggacaagctccaccgggccgcctggtggggcaaagtccccagaaaagacctgattgtgatgctgagagacactgacgtcaataaacaggataagcagaaaagaaccgcactccacctggcttccgccaatggaaactctgaggttgttaaactcctgttagaccggcgttgccagcttaacgttttggacaataaaaaacgtactgccctgatcaaggccgtgcagtgccaggaggatgaatgcgcacttatgttgctagagcatggaacagatccaaacatacccgacgagtatggaaacacgacactccattatgcaatatacaacgaggacaagttgatggctaaggctcttctcctgtacggcgccgacattgagagcaagaataaacacggcctgaccccactcctgcttggagtgcacgagcagaaacagcaagtcgtgaaattcttgatcaaaaagaaagccaacctgaacgctctagatagatacggcaggacagctttgattttggccgtgtgctgtggatcagcaagcattgtttccctcttgcttgagcaaaatatcgatgtcagctcccaagacttgagcggccagactgctcgcgagtacgccgtaagctctcatcaccacgtaatctgccagctgctatccgattataaagagaaacagatgcttaaaatatcatctgaaaacagtaatccagagcaggacctcaagctgacgagcgaagaggagagtcagagatttaagggaagtgagaacagccaacccgaaaagatgagccaagaacccgaaattaacaaggacggcgaccgtgaggtggaggaggagatgaaaaagcacgaaagcaacaatgtgggcttgttagaaaatctcacaaatggcgtaacagcaggcaatggcgacaatgggctgattccccagcggaagtcccgcacgccagagaatcaacagttcccagacaatgagtccgaagagtatcacagaatctgtgaactcctctccgactataaggagaagcaaatgcccaagtatagttccgagaactctaacccagagcaagacctgaaattaacttccgaagaggagtcgcaacgactgaagggcagcgagaacgggcaaccagagaagcggagccaggaaccggagattaataaagatggtgaccgcgagctcgaaaacttcatggccattgaggagatgaagaaacaccgttccactcacgttggattccctgaaaatctgaccaacggggctacagccggtaacggagatgatggattaatcccgccaagaaaatcccggaccccagagtctcagcagtttcctgacactgagaatgaggaatatcatagcgacgaacagaacgacacacagaaacagttctgcgaggagcaaaacaccgggatactccatgacgaaattctgattcacgaggagaaacagatagaggtagttgagaaaatgaactcagaactgtctttgtcctgcaaaaaagagaaggacattttacatgaaaactccaccctccgggaagaaatcgccatgttgaggcttgaactggatacaatgaagcatcagtcccagctgagagaaaagaaatacttggaggacattgagtcagtgaaaaaacgaaatgacaatcttctcaaagccctccaattgaatgaacttaccatggacgacgatactgcggtgctggtgatcgacaacggatctggcatgtgcaaggctggtttcgctggtgacgacgcgcccagagcagtgttcccctctatagtgggccggcccagacaacagggtatgatgggcggaatgcatcaaaaggagagctatgtgggcaaagaggcccaaagtaaaagagggattttaacactgaaataccctatggagcatgggattattactaactgggacgatatggagaaaatctggcaccatacattctacaacgagttgagagttgcccccgaggagcaccccgtgctgcttaccgaggcaaccctgaatccaaaggctaacagagaaaaaatgacccagataatgtttgaaacttttaacactccagccatgtacgtcgccatacaggcagttttatccttatacacgagcggaaggacgaccggcattgtgatggactccggagatggcgtaacacatacagtccccatttacgaaggcaacgcgctaccccatgcgacccttcggttggatctcgccggaagagaactaccagactacctcatgaagattctgacagaacacggttacagattcaccacaatggctgagagagagatcgttcgggacatcaaagagaaactgtgctacgttgcattggactttgagcaagagatggcaaccgtggcttctagcagctcgttagagaagtcttatgagctgcctgatggtcaagtgattactatcggcaacgaaaggtttcggtgcccagaagcgctgtttcagccctgttttctcggcatggaatcatgtggtattcacgaaactactttcaatagcatcatgaaatcggacgtggacattcgaaaggatctgtatactaatactgtgttgtcaggggggaccactatgtaccctggtatggcacaccggatgcagaaggaaatcgctgcactggccccttcaatgatgaaaattaggattatcgcacccccgaagagaaaatactctgtttgggtcggggggagcatcctggcctcactatccaccttccagcagatgtggatctctaaacaggagtatgatgagagcggaccgtctatagtccatcgcaagtgtctctag

SEQ ID NO: 16234 - DNA, 381 bp, Artificial Sequence
  Description of Artificial Sequence: Synthetic coding sequence
atgacagcaacagaacaatggatattcctgtgcgcagctcataaaacccccaaggagtgtcctgccatcgattacaccagacatacactggatggagccgcttgtctccttaactccaataagtatttccctagccgcgtttctattaaagaatcctcagtggcaaagttagggtccgtatgccggcgcatctatagaatcttcagccatgcctatttccaccaccgtcagatatttgatgagtatgagaacgagacttttctttgtcatagattcacaaaatttgtcatgaaatacaatctgatgagcaaggacaacctgatcgttcctatcctggaagaggaagtgcagaatagcgtgagcggcgaaagcgaggcttag

SEQ ID NO: 16235 - DNA, 2811 bp, Artificial Sequence
  Description of Artificial Sequence: Synthetic coding sequence
atggagcctgacatcattcggatgtacagctcctccccccccccacttgacaatggcgcggaggatgatgatgacgacgagtttggcgaattcggtgggttttccgaagtgtctcctagcggcgtcggctttgtcgactttgataccccagactacacccggcccaaagaggaatttgtgcccagtaaccactttatgcccatccatgaattttctgaaaacgtggacagcttgacatcctttaagtccatcaagaacgggaacgataaggatattacagctgagttaagtgcccctgtgaaaggccaatcagacgttctgttgagcactacgtctaaggaaatcattagttccgagatgcttgcaacaagcattgacggaatggagagaccaggcaacctgaataaagttgttgaacagcgacagaatgtggggacactggagtctttcagccctggggactttaggacaaatatgaatgtggttcaccagaataagcagctggagagctgcaacggcgagaagcctccttgccttgagattctgaccaacggattcgctgtcctagagaccgtgaatcctcagggcactgatgatttggacaatgtggcggactctaaaggccgtaagcccctcagcacgcactctaccgagtacaatctggattccgtcccaagccccgcagaggaattcgcagatttcgcaaccttttccaagaaagagaggatccagctggaggagatcgaatgcgcagtgctgaacgaccgcgaggctcttacaatcagggagaacaacaaaatcaatagggttaatgagctgaacagcgtcaaggaagttgctctcggcagaagccttgacaacaagggagatactgacggtgaggatcaagtttgtgtaagcgagatcagcattgttacaaatcgcggcttcagcgttgagaaacagggcttgcccactctgcaacaggatgagttcttgcaaagcggtgtgcagtctaaagcttggagtttggtggatagcgccgacaactccgaagccatccgaagagaacagtgtaagacagaggagaaattagacctgctcacctcaaaatgtgcgcatctgtgtatggatagtgtgaaaacaagcgatgacgaggttgggtctcccaaagaggagtctcgcaaatttactaattttcagagccccaatattgaccccactgaggaaaatgatctagacgacagcctttccgtgaaaaatggcgatagctctaacgattttgtaacatgtaacgatattaatgaagatgacttcggggactttggtgactttggtagcgcatccggctcgacccctccttttgttactggaacccaggatagcatgtctgacgccacatttgaggaaagcagtgagcacttcccgcatttctctgaaccgggcgatgacttcggcgagtttggcgatattaacgcagtgagttgtcaagaggaaaccatactgacaaagtcagatctcaaacagacgtccgacaatcttagcgaggagtgccaactagccagaaagtcatcaggaaccgggaccgagccagtcgccaaactgaagaatggacaggaaggcgagataggccattttgattccgtgccaaatattcaggatgattgtaacggatttcaggatagcgacgacttcgctgatttttcttctgcaggaccaagtcaagttgtggactggaatgccttcgaagacgaacagaaggattcgtgttcttgggctgcctttggagaccagcaggcaacagagtcacaccaccgcaaagaggcctggcagagccacaggacggatgagaatatcgacactcccgggacccccaaaacgcactctgtcccctccgctaccagcaagggagcagtcgctagtgggcatctccaagagtcagccaccagcgtgcagacagcactgctgaaccggctggagcggatctttgaggcttgcttccccagcatactggtacctgatgcagaggaggaagtcaccagtctgaaacacttgctggagacttctactcttccgatcaaaacaagagaagccttacccgaatcgggtgaactgctggacgtgtggaccgagttacaggatatccacgacgctcacggccttagataccaatggggagggtcgcactcaaataaaaaactgctctcatctctaggaatcgataccaggaatattttgttcactggcaacaaaaagcagcccgtcatcgttcccatgtacgcagcagggttgggtatgctggaaccaacaaaggagccccttaaacccttgtccgcggcagaaaaaatagcctccatcggacaaaccgcgactatgtcccctgacatgaacacatgcacttctgatcagtttcaggaaagtctgccacctgtacagtttgattggagcagcagtgggctgacaaatccactggacgcaagcggagggtcaaccctgctcaacttagacttttttggaccagtcgatgacagctcttccagcagctcaactactattccaggcgtagaccctgagttatatgagctgactacctctaaactggaaatttctacttcgtcactgaaagtcacggacgccttcgctagactaatgtcaaccgtcgagaaaacctccacatcgacccgaaaacctaaacgcgaggagcaccttagcgaagaagctattaaggtcattgcgggtctgcctgatcttacattcatgcacgccaaagtgctcatgtttccagctacactgacccctagcactagtagccaagaaaaggccgacggctag

SEQ ID NO: 16236 - DNA, 1860 bp, Artificial Sequence
  Description of Artificial Sequence: Synthetic coding sequence
atggacgatcagcaagccctgaactcaataatgcaggatctagcggtgctccataaggcttcgaggcccgctttgtcgttgcaggagacaagaaaggctaagagttcttcacctaagaaacagaatgatgtgcgtgttaaattcgagcatcgtggtgagaagcggatccttcaattccccagaccagttaaactggaagacctaaggagcaaggccaagattgctttcggacagagcatggacttacattacaccaataacgagctggtgatccctctcactacccaagatgatctggataaagctgtggagttactggaccggagtatccacatgaaaagtctgaagatattgctggtcattaacgggtccacgcaggcaaccaatctggagccccttccgagcctcgaggacctggataacaccgtgtttggagccgagcgtaagaagcgcttgagcataattgggcccacctctcgcgacaggtcgtctcctcctcccggctacatacccgatgaactgcaccaagtagcgcgcaatgggtcctttacatctatcaacagcgaaggcgaattcatccctgaatccatggatcagatgctggacccactgtcgctttccagcccagagaatagcgggtccggctcctgcccgtcgcttgacagcccccttgacggagagagctatcccaagtctcgcatgcctagggcccaaagttatcccgacaaccatcaggagttcagtgattacgacaatcctatcttcgaaaagttcggaaaaggcggtacatacccaaggcgataccatgtgagctatcatcaccaggagtacaacgatgggcgcaagaccttccccagggctcggaggacacaggggacatcgctgcggtccccagtgagcttcagcccaactgatcatagtctctcaactagctcaggatcatccatcttcacgcccgagtacgacgactctaggatcaggaggaggggatccgatatcgataatcctaccttgactgtgatggacatttcgccgccatcccgttcgcctagggctcctaccaactggaggctgggaaagctcctgggccagggggccttcggtcgcgtctatctctgctatgacgtcgacacaggccgtgagctggcagtgaaacaggtgcagtttgatccagacagtcccgaaacctctaaggaggttaatgctcttgagtgtgagatccagttgctgaagaacctcctacatgagagaattgtccagtattacggttgcttgcgcgatccacaagagaagacgctgtctatcttcatggagtacatgcctggaggttcaattaaggaccaactgaaagcatacggggcactgactgaaaatgttactcggaagtataccaggcagattctcgaaggagtgcattatctgcattcaaatatgattgttcacagagatattaaaggcgctaatattcttcgagactccaccggcaacgtaaaattaggagactttggggccagcaaaagattgcagaccatatgtttgtccgggactggcatgaaatcagtgaccggcacaccttactggatgtcccccgaggtgatctcaggcgagggctatggaagaaaggctgatatttggagtgtggcttgcacagtggtggaaatgctgactgaaaaacctccatgggctgagtttgaagccatggctgcaatcttcaagattgccacgcagccaactaaccccaagctgccaccccatgtctctgattacactagggatttcttaaagcgaatattcgtggaggctaaactgcgacctagtgctgatgaactcctccggcacatgtttgtccattaccactag

SEQ ID NO: 16237 - DNA, 513 bp, Artificial Sequence
  Description of Artificial Sequence: Synthetic coding sequence
atgacgaggggaaaccagcgcgagctggcacggcaaaagaatatgaaaaaacaaagcgatagcgtgaaaggaaaacgcagggacgacggcctgtcagcggcagcacgcaagcagcgcgttggggtccaacagcctaatgcagagctgtctccaatccacttccacctgatcctgtgcgccttacacccgcccgcatcttgtcctttctgccctctcgtcccgccatcagctccatcttctctcccaccaggcacgcgacgcagctgctcgcggtccagaaaacggcaaactcgaagaaggagaaatccgagctcattcgtcgcctcctgtcctacccttctcccattcgcctgcgtccccggcgccagccctaccaccttggcgtttcctccggttgttctaactgggcccagcactgatggaatcccattcgctctgagcctgcagcgtgttcctttcgtactcccttccccgcaagtggcgagcctaccactggggcacagtaggggttag

SEQ ID NO: 16238 - DNA, 630 bp, Artificial Sequence
  Description of Artificial Sequence: Synthetic coding sequence
atgaagaaagttaggctgaaggagcttgaaagtaggcttcagcaggtggatggcttcgaaaaacccaaactcctgcttgagcagtatccaacgaggccacacatagcagcttgcatgttgtatactattcataatacttacgacgatatagagaataaagtggtggctgacctgggctgcggatgcggcgtgctgtccatcggcactgctatgctgggtgccgggctttgcgtcggcttcgatattgatgaggacgcactagagatttttaaccgcaatgctgaagaatttgagctgacaaacattgacatggtccagtgtgacgtctgccttcttagtaatagaatgagcaagagctttgatacagtgataatgaacccgccatttgggacaaaaaacaataagggcaccgatatggctttcttgaaaaccgcgctggaaatggctcggacagccgtctattcactccacaagtcatctaccagggagcacgtccagaagaaggctgccgagtggaagattaaaatcgacattattgcagaactgcggtacgaccttccggcctcctacaaatttcacaaaaagaaaagcgttgatatcgaggtagacttgattagatttagtttctag

SEQ ID NO: 16239 - DNA, 1755 bp, Artificial Sequence
  Description of Artificial Sequence: Synthetic coding sequence
atggctgctagcgctaaacgcaaacaggaggagaaacatctcaagatgctgcgagatatgacaggcctacctcataacagaaagtgtttcgactgcgatcagcggggccccacttacgtgaacatgacagttgggtcgtttgtgtgtacgtcctgttctggaagccttcgaggtctgaaccctccacatcgagttaaatcaatctcaatgactacctttacacaacaggagatagaatttttgcaaaaacacggcaacgaagtatgcaaacagatttggctcggcctttttgatgatcgcagttcggctatacctgattttcgggacccgcagaaggtcaaggagttcttacaagaaaaatacgagaaaaagagatggtatgttccacctgaacaagcaaaagtggtggcctcggtgcacgctagcattagcggtagctccgcaagctcaacctcttcgacacccgaggtgaagccactgaaaagccttctcggggactcagccccaactttacacttaaacaaaggcactcctagccaatcccctgttgttgggcgctcacagggacagcagcaagagaagaaacaatttgacctgttaagcgacttaggtagcgacattttcgcagccccagcaccacagtcaacggctaccgccaacttcgcaaattttgctcattttaactctcacgccgcccagaattctgcaaacgcagattttgccaactttgatgctttcggccagtcctcaggctcttcaaattttgggggattccccaccgcatcccacagtccttttcagccacagaccactgcttttaggatgctgtcctccagctgctccttcggggaatttacctcggcgtttcctctacaggctactcactctggttctgcagcttcggttaatgcgaactttgcccattttgacaacttcccaaaatcctcatccgctgattttgggactttcaacacatcccagtcccatcagaccgcctctgcagtgagcaaggtgagtacaaataaagccggcttgcagactgccgataaatatgctgcgttggcaaacctggataacattttctctgccgggcagggaggagaccagggctctggattcggaactaccggaaaagcaccggtcggctcagtggtctctgttccttcccagagtagtgcaagtagcgacaagtatgccgcattagcagaattggattccgtgttctcaagcgctgccacctcttctaacgcttacacctccacctctaatgcctcttcaaatgtgttcgggaccgttcctgtggttgctagtgcccagacacaacccgcctcttccagcgttccagctccattcggggcaaccccttctactaatccttttgtcgccgccgctgggccgtcagtggccagttcgaccaacccttttcagaccaatgcaagaggcgcgaccgcagccacctttggcactgcttccatgagtatgcccactggatttggaactcctgccccatactcactacctaccagtttttctggaagcttccagcagcccgcctttcccgcacaggctgcattcccacagcaaacggccttttcccagcagccaaatggcttcgcagcctttgggcagacaaagccggttgtcacaccattcgggcaggtcgccgccgcaggagtaagctctaatcctttcatgacgggtgcaccaactgggcagttccccactggcagctcttcaaccaatccattcttgtag

SEQ ID NO: 16240 - DNA, 795 bp, Artificial Sequence
  Description of Artificial Sequence: Synthetic coding sequence
atggcgggagagcagaagccaagctctaatcttttggaacagttcatcctgctggcaaaaggaactagcgggtcggccctgaccgccctcatttctcaggtgctagaggcgcccggcgtgtacgttttcggggaactccttgagctggcaaacgtccaggagctggcagaaggcgccaatgccgcttacctgcagctccttaatcttttcgcctacggcacctatcctgactacatcgccaacaaggagtctttgcctgaactgtccaccgctcagcagaacaaacttaagcaccttacaatagttagccttgcaagccggatgaagtgcatcccctacagcgttcttcttaaagatctggaaatgagaaatctgagagaattggaggacctgatcattgaggctgtttacactgacataattcaaggcaagcttgaccaaagaaatcaacttctagaagtcgatttttgcattggaagggatattcgcaagaaagatataaacaatattgtcaagacactgcatgagtggtgcgacggctgtgaggcggtcttgttgggcatagagcagcaggtattacgcgctaaccagtacaaggagaaccacaataggacacagcaacaggtcgaggctgaagtgaccaatatcaagaagacgttgaaggcaacagccagctcttccgcacaggaaatggagcagcagctcgctgagcgcgagtgccccccacacgcggagcaaagacaacctacgaaaaaaatgtcaaaggtgaaggggctggtgtcgagtagacactag

SEQ ID NO: 16241 - DNA, 1506 bp, Artificial Sequence
  Description of Artificial Sequence: Synthetic coding sequence
atgagcagcgaacaggacaagtcggccagcaaggagaagagtaagaaacctgtgcggttccttccccagctctcaatggagaaattagcaagcaaagaaaaattcaaggcgcctgcccgcgccctgccccagctgagcatggtgtctactaagcctcactggcagcaggcagcgccaagctttcatctgagcgtcaaacaagatgatgaatcccccgagccctttagcgtgaagaatgagcaaagtcatgcagagtatatggagagatttggaaaaaaaggcaaattgccacaccaggttgacgatagttatgttggtccctctacctctaaaagcaaaggcaagtcccctcacaaagaacgcgagaactttaggtctactctagtcaacgtgattatgcagcaagacgccgatctagacagtgccgtgccagatgggtccacaatccctaaacctaccgcttcagcgattgaaaaggacattttgcgttactactactatatacaccacggaatcgacactgatcatgtggctcccatggaggacagttggcttgagcatgtgcttgacctggtaccccagcatctgaaggtgtttactgactcaattgtcacactcagtgacgagatgcgtgaggattatcttctctcagttcgtaaatccatagttgacttcgtgctcaaagacccacgagaaaagggcgacgacaaaaagaccgacgaactaccagcacaccgcgccgagatggaaatcctcccgaaaccttggcggaagagcttcctcgctgccagctcatacatcagagatcatctgaacgccatgaatcctacaatgctcgctgtgctggatctgtggcacaccaatttcaagaaactccggcttgtagacatcaaagagttccataactgccaggatgcgctggagctgagtagcttccagaacatcatcatgagacacatggatagcgctaaggagacattgctaaaaatgtggttccccgaggttcagaacatttactaccagggcaacaaaaagaagcaactgcctactggggacagctctgccaagcttgagtcattttttaattgcgcagcagcattgatgaccctgcagttgcaagatctcacactggtctccatgcaggatttcaccgatctcatagcacagccccctgatagtgtgcgtgcctttgagcatccaggctttattatgagactgattctcgacaacgatacgattaaattcgagcccgagctgtccgattacatcgatatctttctgaatgtgtatgacgtcatgataaaggccgtaagcttcgtgcctcgtgtggaaacaaaactctacagtaaatggcggaacaaagctaaaccaggccacttttatttttcacatatccaaagatccgtcaccttccagcattctgaggtgtcgtccccacaaaatagccactttaaaatcgtctccccattcagtgttctggggttcacgtggaggtgccagctttag

SEQ ID NO: 16242 - DNA, 855 bp, Artificial Sequence
  Description of Artificial Sequence: Synthetic coding sequence
atgaccgatgttcccgccacatttacccaggctgaatgtaacggcgataagccgccagagaacgggcaacaaactattacaaagatcagtgaggaactgacagacgtggattctcccctgcctcattaccgggtcgagccgtctctagagggcgccttaactaaagggtcccaggaggagcgaaggaaactgcaaggaaacatgcttcttaattcttccatggaggataagatgttgaaggagaatcccgaggaaaagctgtttattgtgcacaaagccattaccgacttgtctctgcaggaaacatctgcggacgaaatgaccttccgggagggacaccagtgggaaaagatacccctcagcggatctaaccaggagattcgccgtcaaaaggaacgcattacagaacagcctctgaaggaggaggaagatgaggaccggaagaacaaaggccatcaggcggccgagatcgagtggttgggcttcagaaaaccaagccaggcggacatgctgcactcaaagcatgacgaagaacaaaaagtgtgggatgaggagattgacgacgacgatgatgacaactgtaataacgatgaggacgaggtacgggtgatcgagtttaagaagaagcatgaggaagtttcacaattcaaggaagagggcgacgctagtgaagacagtcccctgtcgagcgccagctctcaagctgtgacccccgacgaacaaccaactttagggaagaagtctgatattagtcgtaatgcatattcacggtacaatacaattagctacaggaagattagaaaaggcaatactaaacagagaatcgacgagttcgaaagtatgatgcacttatag

SEQ ID NO: 16243 - DNA, 735 bp, Artificial Sequence
  Description of Artificial Sequence: Synthetic coding sequence
atgaaaaaagtacggctgaaggaacttgaaagtagactgcagcaagtggacggcttcgaaaagccaaagcttctgctggagcaatatccaacaaggccccatattgccgcgtgcatgctctatacaattcacaatacctacgatgatatcgaaaacaaagtggtagctgaccttgggtgtggatgcggagtgctttctatcggtacggccatgctaggtgcgggtctctgcgttggcttcgacattgatgaggatgcactggaaattttcaataggaacgccgaggaattcgaattaaccaatatagatatggtccagtgcgatgtatgcctgctgtccaatagaatgagcaaatcatttgataccgtgatcatgaatcccccttttggaacaaaaaacaataaaggcaccgatatggcatttctcaagacagctctggaaatggctcgtacagccgtttattcactccataagtcctccacgagggagcatgtccagaagaaagccgccgagtggaaaattaaaattgatattatcgcagagctgagatatgacttgccagcctcatataagtttcataagaagaagtccgtgagcctcctcatcttagccgggctccacagtgtgctgaaaagcttccttggtcgcatgtggtggttcatgccagtgataccagctactcgtgaggccgaggccagagaatccctggagctgaggaggcagcgccttcagtag

SEQ ID NO: 16244 - DNA, 885 bp, Artificial Sequence
  Description of Artificial Sequence: Synthetic coding sequence
atgaataaccaaaagcagcaaaagcctaccttgagtgggcaacgctttaagactagaaaacgcgatgagaaggaacggttcgatcctactcagtttcaggattgtattatccaaggattgacggagaccggaaccgacctggaggctgtggctaagtttctggatgcatccggagccaagcttgactaccggagatatgccgagaccctctttgacattttggtggctggtggcatgttagctccaggcggtactctcgccgacgatatgatgcgcaccgacgtgtgcgtttttgccgcacaggaagatcttgagactatgcaagcgttcgcgcaggtgttcaacaaactgatccgcaggtacaaatacttggagaagggatttgaggacgaggtgaagaagctgctcttattcttaaaagggttttcggaatccgagaggaacaagctcgctatgttaacaggggttttactggcgaacggcactctgaacgcctctatcttgaatagcctttataacgaaaatttggtcaaagagggcgtatcagctgcgtttgctgtgaagctttttaagtcctggataaatgagaaggatatcaacgcagtcgcagcttcactgcggaaggtgagcatggacaacagactgatggaattatttccagccaacaagcagagcgttgagcactttactaagtactttacggaagccggtcttaaggaattgtccgagtacgtgcgcaaccagcagactatcggagccaggaaggaactccagaaagaattacaggagcagatgagtaggggtgatccatttaaggacatcatcctatatgtgaaagaagaaatgaagaaaaacaatatccccgagcccgtggtgatcggctag

SEQ ID NO: 16245 - DNA, 1374 bp, Artificial Sequence
  Description of Artificial Sequence: Synthetic coding sequence
atgaatcagccttgtaactctatggaacccagagttatggatgacgatatgctcaagctcgctgtgggcgaccaggggccccaagaggaagcggggcagctcgctaaacaggaagggatcctctttaaagatgtgctaagcctgcagttggactttcggaacattctgcgcatagacaatctttggcagttcgagaacttacgaaaactgcagcttgacaataacataattgagaagatcgagggcctcgagaacctggcccatctagtatggctcgacctttcttttaacaatattgagacgatcgaaggtttggacaccttggtgaacctcgaggacctttctctctttaacaatcggattagcaagatcgactctttggatgcccttgttaaactgcaagtgctcagccttggaaacaaccgaattgacaatatgatgaatatcatatatctgcgcagattcaaatgcctgcggacgctgtctttgtccaggaatcccatttcagaggccgaggactataaaatgttcatttgcgcgtatctgcccgacctcatgtacctagactataggcggattgacgaccacacgaagaaactggccgaggccaagcaccagtattctattgacgagcttaagcaccaggagaatttgatgcaggctcagctggaagacgaacaagcacagcgcgaggagctggaaaaacacaagactgcctttgtggagcatctgaatgggagttttttgtttgatagtatgtatgctgaggattccgagggtaataaccttagttatcttcctggcgtgggcgagttgctcgagacctacaaggacaagtttgtaataatctgtgtcaatatttttgagtatggcctcaaacagcaggaaaagaggaaaactgaactagacactttttctgaatgtgtgcgcgaggctattcaagagaatcaagagcaggggaagaggaaaatcgccaaatttgaagagaaacatctgagtagcctgtccgcgatccgggaagagctggaattacctaatattgagaaaatgatcctggagtgctccgccgacatctcagagctgttcgatgcactgatgacactggaaatgcaattggtagagcaactcgaagagaccatcaatatgtttgagagaaacattgtagatatggttggattatttatcgagaacgtccagagtcttatggcccaatgccgtgatctggaaaaccaccatcatgagaagttgctggagatttctatctctactctggagaagattgtcgaaggagacctagatgaagacctgcccaacgatctgagggctggtcgcttccagaaattcaattacgttgaggcatctggcacgttctag

SEQ ID NO: 16246 - DNA, 1638 bp, Artificial Sequence
  Description of Artificial Sequence: Synthetic coding sequence
atgtcatcctccggctaccctcctaaccagggggcttttagcacagagcagtctcgctaccctccgcactccgtgcagtacactttccctaatactagacaccagcaggagttcgcggtccccgattacaggagcagccacctcgaagtgagccaggcatcacagttactccagcagcagcagcaacagcagctgaggcgacgtccatcgctcttgtccgagttccatccgggcagcgatagaccccaggaaagaagaacctcttacgagcctttccaccctggcccttcccccgtcgatcacgattctcttgaaagcaagagacctaggctcgagcaggtcagtgacagtcacttccagagagttagcgcagcagtgttgcccttggtgcatcctctgccagaaggtctgcgcgcatccgccgatgctaagaaggacccagccttcggtgggaaacacgaggccccctcctcccccattagcggtcagccgtgtggagacgatcagaatgctagccccagtaagctctccaaggaagagctgatacagagcatggaccgcgtcgatcgggaaattgctaaggtggaacaacagatcctgaaactgaaaaaaaagcagcagcagctggaggaagaggccgccaagcccccagagccagaaaaacctgtttcaccgccgccagtggagcagaagcacagatcgatagttcaaatcatctacgacgagaaccggaaaaaagccgaagaagctcataaaattttcgagggcctcggcccaaaggtggagctccccctgtataatcagccgagcgatacaaaagtctaccatgaaaatattaagaccaatcaagtcatgcggaaaaaactaatcctgttctttaagaggaggaaccacgctaggaagcagcgcgagcagaaaatttgtcagcgatacgaccagctaatggaggcatgggagaagaaagttgatcggatagaaaacaaccccaggcgcaaagccaaggaatcaaagactcgggagtattacgagaaacagttcccggagatccgaaaacagagagagcaacaggaaaggtttcagcgtgtgggccaaagaggagctggtcttagtgccacgatcgcgaggtcggagcacgagatttcagagattatcgacgggctcagcgagcaagaaaacaatgaaaagcagatgcggcagctcagcgttatcccacctatgatgttcgacgccgaacagagaagggtaaagtttatcaatatgaacgggctcatggaggacccaatgaaagtatataaagaccgacaattcatgaacgtttggactgaccatgagaaggagatttttaaagataagttcattcagcacccaaaaaacttcggactgatcgcatcgtacctggaacgtaaatcagtccccgactgcgtgctgtactattacctgaccaaaaagaacgaaaattacaaggccctcgtgcgcaggaattatggtaaacgtagaggacgaaatcagcagcagatcgcccgcccctctcaagaagaaaaggtggaggagaaggaagaggataaagccgagaagacagagaagaaagaggaggagaaaaaggatgaggaggagaaagacgagaaggaggattcttag

SEQ ID NO: 16247 - DNA, 480 bp, Artificial Sequence
  Description of Artificial Sequence: Synthetic coding sequence
atgactcactgttgctcaccctgttgccaaccgacctgctgcagaacaacttgctggcagccaacaactgtgactacctgcagctccactccctgttgtcagccctcctgctgcgtgagtagctgttgtcagccttgttgccaccccacttgctgccaaaacacatgctgtcgcactacctgttgccaacccatttgcgtaacatcctgctgtcagccctcttgctgtagcacaccctgctgtcagccaacttgttgtgggtcatcatgcgggcagtcctcctcatgtgcccccgtatattgccgacgcacttgctatcaccctacatccgtctgccttcccgggtgcctcaatcagtcatgcgggtctaactgctgtcagccgtgctgtagacctgcttgttgcgagacaacgtgttgccgcaccacatgcttccagcctacatgcgtgtacagttgttgccagccttcttgttgttag

SEQ ID NO: 16248 - DNA, 1071 bp, Artificial Sequence
  Description of Artificial Sequence: Synthetic coding sequence
atggagggacacgatcctaaagaaccagagcagctgagaaagctgttcatcggaggattgtccttcgaaactacggatgactccctgcgagagcattttgagaaatggggcaccctaaccgattgtgtagtcatgcgagatccgcaaactaaacggtcgaggggattcgggttcgtcacatattcctgtgtggaagaggtggacgccgcaatgtgcgccaggccacacaaagtggacgggcgggtcgtggagccaaagcgcgccgtttctcgggaggactccgtgaagccaggcgctcatctcaccgtaaagaagatcttcgtgggaggcatcaaggaggatactgaagagtataacctacgggactactttgagaagtacggcaagatcgagactatagaggtgatggaagaccgtcaaagcgggaaaaagcgtggctttgccttcgtgactttcgacgaccatgacacagtggacaaaattgtggtacagaaatatcatacaataaacggacataactgcgaagtaaagaaggcgctttctaaacaggagatgcagagcgcaggctcccagcggggaaggggtggagggtctggaaatttcatgggcagaggcggtaacttcggcgggggtggcggcaactttggaagggggggtaactttggcggacgcggtggctacggcggtggaggaggaggtagcaggggcagttacggcggcggggacggcggttataacgggttcggcggcgatgggggaaactatggaggggggcctggatattcaagccggggtggctacggcggcggaggacccggctatgggaatcagggcggaggttacggcggcgggggggggtacgacggttataacgagggaggcaacttcggtggcggaaactacgggggcggtgggaactacaacgacttcgggaattactcgggtcagcagcagagcaactatggacctatgaaaggaggttcgttcggaggcaggtcaagcggatcgccctacggaggtggttacgggtccggcggtggttccggcggatatggttcgcgccggttctag

SEQ ID NO: 16249 - DNA, 186 bp, Artificial Sequence
  Description of Artificial Sequence: Synthetic coding sequence
atgccattcttcgggaatacctttagcccaaaaaaaaccccaccgcgcaagtccgcttcactctccaacctgcactccttggatcgatcaaccagggaagtggagctcgggttggaatatggttctcccaccatgaatctcgctgggcagtcactgaaatttgagaatggccaatggatcgcttag

SEQ ID NO: 16250 - DNA, 981 bp, Artificial Sequence
  Description of Artificial Sequence: Synthetic coding sequence
atgccacacctccccctggcctcatttcgccccccattctgggggctgcgccattcaaggggcttgcctcggtttcattcagtgtccacccagtccgagccacatggatcccccatctctcggaggaatagggaggctaagcaaaagcgcctgcgggaaaagcaggccacgctggaagctgaaattgccggagaaagcaagtctccagccgagtccatcaaggcttggcggcccaaggagctcgtgttgtatgagatacccaccaaaccaggagagaaaaaggacgtcagtggccctcttccaccggcctactctcctaggtacgttgaggcagcatggtacccttggtgggttagggagggcttctttaaaccagaataccaggcccgcctgcctcaggccactggcgaaactttcagcatgtgcatacctccccccaacgtaaccggaagcttgcacattggccacgctctaaccgtcgcgatccaagacgctctggtgcggtggcaccgtatgcgtggcgatcaggttctctgggttcccggatccgaccatgcaggtatcgctactcaggcagtggtcgagaagcagctttggaaggagagaggtgtgagacgccatgaactctcccgcgaggcattcttgcgggaagtgtggcagtggaaggaagcaaagggtggcgagatatgcgaacagttaagagcccttggagcctccctggactgggaccgcgagtgtttcacgatggatgtcggtagctccgtggctgttaccgaggcttttgtgcgcttgtacaaggcagggctcttatataggaaccatcaactagtgaactggtcttgtgcactcagatctgctataagcgacattgaagtagagaatcgccctctgcctggacatacacagctgagattgccaggctgccccacccctgtgtcttttggtctgctgttctccgtggcattccccgtcgacggatag

SEQ ID NO: 16251 - DNA, 2031 bp, Artificial Sequence
  Description of Artificial Sequence: Synthetic coding sequence
atgatccctccacaggaggcttctgcccggagacgtgagatcgaggataaactcaagcaggaagaggagaccctatccttcattcgggattctctggagaaatccgatcagttgaccaaaaatatggtctccatccttagctccttcgaatcaaggcttatgaagttagaaaatagtataatcccagttcacaagcagactgagaatttacagagactgcaggagaatgtcgagaaaacattatcctgtctcgatcacgttattagttattaccacgtggcttctgacaccgagaaaatcatccgcgagggacctaccggtagactggaggagtacctgggatccatggccaaaattcagaaagcagtcgaatatttccaggacaactcgcctgactcccccgagctcaacaaggtgaaactgctgttcgagcgcggtaaagaggcactggaatccgagtttcgaagtctcatgacacgtcactcaaaggtagtcagcccggtcctgatcctggacctgattagcggtgacgatgatttagaagctcaggaagatgtcaccttggaacatttgccagagagcgtactccaggacgtaattagaatctctcggtggttggtggaatatggccgaaatcaagacttcatgaacgtgtattatcaaatccgatcctcgcaattggaccgcagcattaaagggcttaaagagcacttccataagagttcctcatcaagcggcgtaccttattcaccagccattcccaacaagaggaaagacacccccactaagaaacccgtcaagcggcctgggcacgaacacgacttcagggtgaaacacctgtccgaagctctcaatgacaaacatggccctttggccggccgagatgatatgctcgacgtggagaccgacgcctatatccactgtgtgtcagcttttgtgaagcttgcgcagtccgaatatcagctgcttgctgatatcatcccagaacatcaccagaaaaagacgtttgactctttgatacaggacgctttggacggcctgatgctagaaggagagaatatagtgtcagccgctcgcaaagctatcgtgcgacatgacttctctactgtactgaccgtttttccaattctgcggcacctgaaacagaccaaaccagagtttgatcaggtcctacaaggaactgccgcctctacgaaaaacaaactgcccggactgattacatctatggaaaccatcggcgcaaaggctttagaggactttgccgataatattaagaacgatcccgacaaagagtataatatgcccaaggatgggacggtgcatgagttaactagcaacgcaatcttgtttctccaacagcttttagatttccaagaaactgctggagccatgctcgctagccaggaaacatcctccagcgccacctcttatagtagtgagttttcaaagcgcttactctcaacatacatttgcaaggtgctgggaaacctgcagcttaatctgttgtccaagagtaaggtctatgaggacccagccctgagcgccatcttcctgcataacaattacaactacatcctgaaatccctcgaaaagtcagaactgatccagctggttgcagttacgcagaagaccgccgaacgcagttatcgggaacacatcgaacagcagatacaaacctatcagcgctcttggcttaaagttaccgactacatcgccgaaaaaaacttgccagtgttccaacctggagtaaaactaagggacaaggaacggcagattatcaaggaacgatttaaaggattcaacgatggcttagaggagctgtgtaaaatccagaaggcttgggcaattccagacaccgagcagcgcgaccgcattcggcaggcccaaaaaaccattgttaaggaaacttacggagcctttcttcaaaaatttgggtcagttcctttcacaaagaaccccgaaaagtatatcaagtacggggttgaacaagtcggtgacatgattgaccgactcttcgataccagcgcctag

SEQ ID NO: 16252 - DNA, 459 bp, Artificial Sequence
  Description of Artificial Sequence: Synthetic coding sequence
atgacagacgtcccagccacctttacccaggccgaatgcaatggcgataagcccccagagaacggccagcagaccattacaaagatctcagaggagctcactgatgtcgactccccgttgcctcattacagagtagaaccatccttagaaggtgctctgactaaaggctctcaggaggagcgacggaagctccaagggaacatgctgctcaactcatctatggaggacaaaatgttaaaggaaaatcccgaagagaagttgtttattgtgcataaggcaattacagacctttccctgcaggagacttccgccgacgagatgacttttagagaaggacaccagtgggaaaaaattcccctctctggaagcaatcaggagatccgacgtcaaaaagagagaattactgagcaacctttgaaagaggaggaggatgaagaccggaagaataaagggcactag

SEQ ID NO: 16253 - DNA, 768 bp, Artificial Sequence
  Description of Artificial Sequence: Synthetic coding sequence
atgtggcctttcccgagccgatcactgtttccaccccccacccaagcgtggttgcagacggtcagctctgaccccgaagcccagggatggggtgcctggaatgaaactaaagagatcctggggccagagggaggggaaggaaaagaggaaaaagaagaggaggaagacgcggaagaagaccaggatggcgacgcggggttcctgttaagcttgctggagcaggaaaacctagcagaatgccctttgccagatcaggaactcgaagcaattaagatgaaggtgtgcgctatggagcaggccgaggggacacctaggccgccaggggtccagcaacaggcggaagaagaagagggtacagccgccggccagctgctctcacctgaaaccgtgggctgccccctgtccgggactcccgaggaaaaggtggaggcagaccatagaagcgtttatgtcggtaacgttgactacggtggatcagcggaagagttggaggctcacttttcaagatgtggcgaggtacaccgcgtgaccattctgtgcgataaattttcaggccatcctaaagggtgctgtcggaaggagccaacatcactgggctcagcgccgcaaaccgccggagccttcgaggacacccaggcacctgggggccacccctctccaactgccgccagccgcgccggaccgggcagtgaccacaaaggcaggactgggccggttgaaaatagccaccatggctttcacaggatcaaagggaaaaccaggttttag

SEQ ID NO: 16254 - DNA, 3561 bp, Artificial Sequence
  Description of Artificial Sequence: Synthetic coding sequence
atggaaaaagcaaccgtccccgtagctgccgcaaccgccgccgaaggagagggtagtccacctgctgtagctgccgtggccgggccgcccgctgctgctgaagtggggggcggcgtaggagggtcgagtcgggcacgttcagcatcttccccacgcggtatggtacgagtgtgtgatctcttgttgaaaaagaaacccccccagcagcagcaccacaaagccaaacgaaaccgcacttgtcgccccccgagctcttccgagtcctccagcgactccgacaactctgggggtggcggcggcgggggcggaggaggtggcggcggcggggggacctccagcaataattccgaggaggaggaggatgacgacgacgaggaggaagaagtgagcgaagtggaaagcttcattctggaccaagacgatctcgagaaccctatgctagagacagcgtccaaactgttgctgtcaggaacggccgacggcgccgatctccggacagtcgatcctgagactcaggctcgtctggaggccctgctagaggcggcaggaattgggaaactgtcgaccgctgatgggaaggcgttcgccgatcctgaagtgttacggcgcctcacaagcagcgtgtcatgcgctctggatgaagcagccgccgcgctgacaaggatgcgggcagaatccactgctaatgcaggccagagcgacaaccgctccctggccgaggcatgctcagaaggcgatgtcaatgctgttcggaaactgctaatcgaggggagatcagtgaacgagcatacggaggagggcgagtctctgctgtgcctggcctgctcggctggctactatgagctggcccaggttctgctggcaatgcacgctaacgtggaagacaggggaatcaaaggtgacatcacacccttgatggccgctgcgaacggcggccacgtgaagatcgtaaagctgctgcttgcccacaaagccgacgtcaatgcccaaagctcaactggtaatacagccctcacttacgcttgcgcaggtggatatgttgatgtagttaaggtgctgcttgaaagcggggccagtattgaggaccacaatgaaaacggtcacacccctctgatggaggccggttccgcagggcatgtcgaagtagcccgtctactgctggagaacggcgctggaattaacacccacagcaatgagtttaaggaaagtgctcttacactggcttgctataagggtcacctggagatggtgagatttctattggaagccggcgcggaccaggaacacaaaacagatgaaatgcacacagctcttatggaggcatgcatggacggccacgtcgaagtcgcaaggctccttctggacagcggagcccaagttaatatgcccgctgatagtttcgagtccccactgacgcttgccgcgtgtggcgggcacgtagagctggccgccctcctaatcgagcggggtgccagtctggaagaggtcaatgacgagggatacacccccctgatggaagcggccagggaaggtcatgaagagatggtcgcattgttattgggccagggcgccaatatcaatgcccagacggaggaaactcaagaaaccgcactcaccttggcatgttgtggtggttttctggaggtcgccgattttctcatcaaggccggggccgatatcgaactgggttgcagtacgcctctgatggaggccgcccaggagggccatctcgagcttgtgaagtatctgctcgctgccggcgccaacgtacatgcaaccacagcaacaggagataccgccttgacctacgcgtgcgagaacggccatactgatgtagctgacgtcctgcttcaggcgggtgcggacctggaacacgagagcgaaggtggacggacaccacttatgaaggctgctagagctggacacgtgtgcactgtccagttcttgatcagtaaaggggcaaacgtgaataggacgacagcaaataatgatcacacagttctgtcactggcctgtgctgggggtcacttggctgtggtagagctcctgctcgcccacggcgccgaccctacccacaggttaaaggacggcagtacaatgctgattgaagccgccaaaggcggacacacttcagtggtttgttacttattagactaccccaacaacctcctgtccgcccctccacccgacgtcactcaactgactcccccatctcacgacttgaaccgggccccacgggtgcccgtgcaagcgcttcccatggtcgtgccgccacaggagccagataagccaccagccaacgtggcaaccacactcccaatccggaataaagcggccagcaagcaaaagtccagttcacatcttcctgctaatagtcaagacgtccagggatatattaccaatcaatctcctgaaagcatcgttgaggaagcccagggcaagcttaccgagctagagcagcgaatcaaggaagcaatcgaaaaaaacgcccagcttcagtccctggagcttgcccacgccgaccagttgaccaaggagaagatcgaggagcttaacaagacgagagaagaacaaatccagaagaagcaaaagatcttggaagagctccaaaaagtggaaagagaacttcagctgaaaacccaacagcagctaaagaaacagtacctcgaggttaaagcgcagcgcatccagttgcaacagcaacagcagcaatcttgtcagcaccttgggctgctcacgcccgtcggagtgggagagcaactaagtgagggcgactacgctagactgcagcaggtggaccccgtgctgctgaaggatgagcctcagcagaccgccgcccaaatggggttcgctcccatccagccgttggcaatgccacaagccctaccgctggcagcaggacccttaccacccggctctattgccaatttaacggaattacaaggcgtgattgtgggacagccagttctgggacaagcccaactcgcagggctcgggcaggggattcttactgaaacccagcagggcctgatggtcgcaagcccagctcagaccttgaacgatacattggatgacatcatggcagctgtcagtggacgagctagtgcaatgtcaaatacgcctactcatagtattgcagcctccatctcccagcctcaaacccccacacctagtccaataatttctcccagtgctatgctccccatctatccagccatagatatcgacgcccagactgagtcaaatcatgacaccgctttgacactggcttgcgccggcggtcatgaagagctcgtgcaaactcttctggagcgcggggctagtattgagcacagagataagaaagggtttacgcccctcatactggccgctacggctggccatgtgggagttgtggagatcctcctggacaatggtgcagatatcgaggctcagtctgagagaaccaaggatacacccctcagcctggcatgcagcggaggacggcaggaagtagtggaattactactggctaggggagcaaacaaatccaccggaatgttcctgataacgcatctgtag

SEQ ID NO: 16255 - DNA, 2682 bp, Artificial Sequence
  Description of Artificial Sequence: Synthetic coding sequence
atggccgccacagttgagggccctgagctggaggccgctgctgctgccggggatgcttctgaggacagcgatgccggaagcagggctttgcctttcttgggcggcaaccggttgtccctcgacctgtaccctggtggttgccagcagctgctgcacctctgcgttcagcagcctctgcagcttcttcaggtggagtttctgcgcctctcgactcacgaggatcctcaactgcttgaggccacactcgctcagcttccccagagtctgagctgcctgcggtctctcgtcctcaaaggtgggcaaaggcgggataccctcggcgcctgtttaagaggcgctctcactaatctgccagcgggactaagcggactggcccacttagctcatctcgacttgagctttaacagtttagaaaccttgccagcttgtgtgcttcagatgagggggctgggtgccctcttgctttcacataattgcttaagtgagctccctgaagctctaggcgccctgcccgccctcacatttctgaccgtaactcacaatcgcctgcagaccctgccccccgcattgggggccctgtccacactgcagcggttggatctgagccaaaacttactagacaccttaccacccgagatcgggggcctggggagtttactcgaactcaatttggcttctaatagattacagtctctgcccgcaagcctggctggtttaagatctctgcggctcctggtgctgcatagcaatcttctggccagcgtgcctgcggacttagctagactgcctctgctaacacggttggatctgcgcgataatcaacttagagacctgccgcctgaattgctagatgctcctttcgtgcggttacaggggaaccctctgggagaggcatcgcccgacgccccgtccagtcccgtggccgcactgatacctgagatgcccagattgttcctgacttcagatcttgactcctttcctgtaactcctcagggctgttccgtcacccttgcctgtggcgttcgcctgcagttccctgcgggcgccactgctacgccgatcacgattaggtatagactcctgttgcctgaaccaggtctggtgcccctgggaccccatgacgctctgctgtctcacgtgctggagctccaaccccatggggttgcctttcagcaggatgtcggtctctggctgctgttcactccccctcaggcacgcagatgcagggaagtcgtcgtcagaacaagaaatgacaactcatggggagacttggagacttatctggaggaagaggctccacagcggttgtgggcccattgccaggtgccgcacttctcctggttcttggtggttagccggccagtgagtaatgcttgccttgtaccacctgaagggacattgctgtgtagcagcggacaccctggcgtcaaggttatctttccccctggcgctacggaagagcctagacgggtgtcaatgcaggtcgttcgtatggctggcagggagttgcaggccctcctaggtgaacccgaagctgctgtttcccccttactgtgtctgagtcagtccggcccccctagctttctgcaaccagtgaccgtgcaacttccgctgccgtcgggcattactggcctctccttagaccgctccaggctgcatttattgtactgggccccacccgccgccacatgggacgacattacggcacaggttgttctagaattgacccatctgtatgcacgttttcaggtcacccacttttcctggtattggctgtggtacacaaccaagaactgtgtcggtggtctggctagaaaggcctgggaacgtctgcggttgcatcgggttaacctcattgccctccagcgaaggagggatccagaacaggtgctcctccagtgcctcccccgcaacaaagtggatgccactctaagacggttgctggaaagatataggggccctgaacccagcgatactgtagagatgttcgagggtgaggagttttttgcggcttttgaacggggcatcgatgtcgatgcagacagacccgattgcgtggaaggcagaatctgttttgtgttctatagccatctcaaaaatgtcaaagaagtctcattctataggggggcagtccccgtacgcgttcctgaggaggccgaggctgcgaggcagcggaagggcgcagacgccctgtggatggcgaccctccctatcaagttacctcgtcttaggggaagcgaggggccacgaagaggtgctggtctgagtttagcaccgttgaatctcggggatgctgagactggcttcctgacccagtctaatttattgtcagtggcaggccggctcggtcttgattggcccgccgtcgccttgcacctcggtgtgagctatcgcgaggtgcagagaatcaggcacgaatttcgggacgatttggatgagcagattcgccacatgctgttttcatgggcagaacgacaagccggccaacccggcgctgtaggtctgctggtgcaggccttggaacagtccgataggcaggatgtggcggaagaggtgcgagctgtactcgagttgggaagaaggaagtaccaagatagtatcaggcgaatgggcctggccccgaaggatccggctctgcctgggtcatctgccccacaacctccagagcccgcccaagcttag

SEQ ID NO: 16256 - DNA, 1482 bp, Artificial Sequence
  Description of Artificial Sequence: Synthetic coding sequence
atggacttcctgctagggaaccccttttcttcccctgtcgggcagaggatcgagaaggccactgacgggtccctgcaatctgaggactgggccttgaatatggagatctgcgatattatcaacgagactgaagagggtccaaaggacgcattaagagccgtgaaaaagcggatagtgggcaataagaacttccatgaagttatgcttgctcttacagtcttagaaacctgcgtaaagaattgtggacaccgctttcacgtgctggtagcatcacaggatttcgtggagagtgtgctagttcgaacgattctccctaaaaacaatccacccacaatcgtccacgataaggtgttgaatctgatccaatcctgggccgacgcgttccgatccagtcccgacctaacaggcgttgttactatctacgaggatctgcgacgcaagggactggagtttccaatgacagacctcgatatgctgtccccgattcatacccctcagcgaaccgtattcaattcagagacgcagagcggacaggattcagtgggaactgatagtagccaacaggaagatagtggtcagcacgcggcccctttaccagccccgccaatcttgagcggagatactccaatagctccaaccccagaacagattggaaaactgaggagtgagcttgaaatggtgagcgggaatgtgagggttatgtccgaaatgctcacggaacttgtccctactcaagcagagcctgctgacctggagcttctgcaggaactgaaccggacttgccgcgctatgcagcagcgcgtgctcgaactgattccccagatcgcaaacgagcagctcactgaggaactgctcatcgttaatgacaacctgaacaacgtttttctgcggcatgagaggtttgaaaggttccgtaccggacagacaaccaaagcccccagcgaggcagaacccgctgccgacctgatcgatatgggtccggaccccgccgctaccgggaacctgtcctcccagctcgctggcatgaacctgggttcctcctctgtccgcgctggacttcagagcttggaggcctctgggagattggaagacgaattcgatatgttcgctctgaccagaggttcctctctggccgatcaaaggaaggaggtgaaatacgaagcaccccaagccactgacgggctggcaggcgccctcgatgctcgccagcagagcaccggagctatccccgtcacgcaggcgtgtcttatggaggacattgaacagtggctgtccacggatgtaggaaatgacgccgaggagcccaaaggcgtaacgagcgaaggaaagtttgacaagttcctggaggaacgcgcaaaggcagccgacaggctgcctaatttgtcctcaccctccgccgagggtccaccagggcccccctctggacccgctcctcgcaagaagactcaggaaaaggacgacgacatgctgtttgctctctag

SEQ ID NO: 16257 - DNA, 663 bp, Artificial Sequence
  Description of Artificial Sequence: Synthetic coding sequence
atgaattctcagcctcagaccagaagccccccatcacgaaccgttcctatacattgcacagataactggaagcgtcgaaaggtacttgagcagacgcctgtttatcgttccctagccggacgtggttggattaaatactgcatctttttccagaggccccagatccagcctcctcgggctaccattcctaattcctctcccagtatcaggcctggggcccaaacgcctaccgccgtgtaccaggcaaatcaacacattatgatggtaaaccacctgcccatgccatacccagtaccccagggcccacagtactgcatcccccagtatcggcactccggtcccccctatgtcgggccaccacagcagtatcctgtacagccccctggacctggtcctttttacccaggccctggaccaggcgacttccccaatgcatatggaacacctttctacccttcgcagcctgtatatcagagtgctcccattatagtcccaacgcaacagcagccaccgcccgcgaaaagagagaagaaaaccatccgtatacgggacccgaaccagggcggcaaggacatcaccgaggaaatcatgtctggaggaggtagtcgcaatccaacgccccctattgggcgacccacatccaccccaactcccccccaatag

SEQ ID NO: 16258 - DNA, 414 bp, Artificial Sequence
  Description of Artificial Sequence: Synthetic coding sequence
atgtctttgtttgggacaacttcgggttttggaacctcaggcaccagcatgttcgggagtgccacaaccgacaaccacaatccaatgaaagacattgaagtaactagcagtcctgacgatagcataggctgtctgtccttcagccccccaacattgccagggaattttcttatcgctggttcctgggccaatgacgttagatgctgggaggtgcaggactctggccagacaattcctaaagcccaacaaatgcatacaggtccggtcctggatgtgtgctggtccgatgatggaagtaaggtatttacggcctcctgcgataaaacagctaagatgtgggacctcagttcaaaccaggcgatacaaattgcccaacacgacgcacccgtcaaaaccatccattggatcaaatag

SEQ ID NO: 16259 - DNA, 7809 bp, Artificial Sequence
  Description of Artificial Sequence: Synthetic coding sequence
atgaagaggaaggtggttaacacccataagttacgactgagccctaacgaagaggcgttcattttaaaggaagactacgaaaggagaaggaaattacgactgttgcaggttcgagagcaggagagggacatcgcactgcagataagagaagacattaagcaacgtaggaatcagcagttcacaagactcgccgaggaactaagagccgagtgggaggaatcccagacccagaaaatccagaatctggaaaaattatacctcgccagcctgcggagtatgggagaaggtcatagacaggcaaaagaaaacgagccggacctagacgcgttagcacagagggctgccgaacggaagagaaaagcggacctcagacacaaagaagctttaaaggttcaaaagaatcagaaagagatcctgttgaagcagaagacgtggcacattaaagcgcggaaggaggccttactagtggaaaaagaacgttcagccaagattaccagtctccccccaccaccacctaccttatttgagaacatcgaggttaagaggatctcggccgtgaagacgaattctagtacgtaccaccacctacatacttttgtcaaccgggagaccgacactaaacggcctgatgcacggctggctgccgaagaagaagcaaaacgtctcgaggagctccagaaacaggctgctcaagaaagaatggaacgcttcgaaaaagcccacgtgagagggttccaggctatgaagaagattcacttggctcagaaccaggaaaagctaatgaaggagttgaaacagttgcagcaggaagatttggctcgtcgccgccagacagtcgcacagatgccgccacagctggtggagctaccctacaagaggagtgagatgaaagaggactggcaacgtgaactggagtttgccttcgaggacatgtacaacgccgatcggaaggtgaagggtaatctgattttgcacttggagcccgagccacttcccaccgttaccaatcagattcaggacgaggaactagacctttcaatggagcaggaaaatttgggtgctgcagaggatctgccggtgacagaggccgagatctgctcatctgagacagatgttcctctggttatgaaaacacagcagattcccagtaaggttttatttaaaaagctactaaataaaattaggtcacaaaaatctttgtggaccatcaagagtatgtcagaggacgagtctgagatgataactactgtcagtgaaatagaaagcaaggccccaaccgtggagtcaggcactatcgccagtaaagaacgaacgctcagtagcgggcaagaacaggtggtggagtctgacactctgacaatagagtccggtcctctggccagtgaagataaaccactcagttgtggaactaatagcggtaaagagcaagagatcaacgagaccttaccaataacaaccgtagctcagtcatccgtgttgctgcacccacaagaggctgcggctaggatccggatgtctgcccgccagaagcagataatggaaatcgaagaacagaagcagaagcaactggagctgctggaacagatcgaacaacagaaacttcgtctggaaactgactgctttcgcgctcagcttgaggaggagaaaagaaaaaaaactcagcctaccggcgttggcatcgcccctgcctcgtgtcccgttatctcagatgaagattcgcaccgacagatgattcgtaattaccagcatcagctgctgcaacagaaccgactccacaggcagtccgtagagaccgccaggaagcaattactcgagtaccaaaccatgcttaaaggaagatgtccttccgtctctgccccttctttaatcactgactccgttatttcagtacctagttggaagagtgaacgacccacggcaataagtgagcactgggaccaaggacagaggctgaaactcagtcccaacaagtaccagcccatccagcctatacagaccagcaaactagagcaggaccacttccaggtggcacgccaaaatcactttccacagagacaggttgagactactgagacgctgagggcctcagacattctgaccaatcaggccctggagtcacaggagcacttgcgtcaattttcccagaccgagactcagcagcgcgactataagttagtccctaaggacagcgagactctatcgcgggctctctcgcacgatcgccagcttatctctcaggatgccaggaaaatctccgagacatttggggccaccacctttcagtcactggaatcacagcagctgttctctgagaacagcgagaacatcagttaccaccttacagagcccagctcattcgtcccactggttccacagcatagcttttcttcactgcccgtgaaggtagagtctggcaaaatacaggaaccatttagcgcaatgtcaaaatccacagtgtcaaccagccactccatcatcagccagatgcacgatcggcccctactccctagcgagaatataaccgcacagcagggcaacatgaaagcgcttcaggagcagctggatttacaaaaaaaggtccttcaggccacccaggaggcccaggagcaactgttactgtgcaagcaaaaggaagtcgagcagcagaccgggctcagcgtgtttctacccctggtgacacctgactcgagtgcattattaccatccgccaaagccgaccttggacggatccaggagtcttcacctaccaagaataacattgctgttagctcagaccaccatgtgatatctcagctgcaggacaagagactctccctgtcacaaccaatattaagccagcagaataactttaagtttttgcaggagcaattgaacatacagaaagactctttacaagctcgcagagaagcacaggaagtgctgtatgtgcacaagcaaagcgagctggacagaagggtgtgctcagagcaggcagagccatccttcccttttcaggtcgcacagcataccttcacaagcttgcctagcgctgatacaaagtcagggaaaatccaggaacagcattccagtaaatctgagaaaggactggtgtcttgccagtctgatataccaatatcccaagacggctctctcagttttctgcaacaatttcttcccctgcacgactcgcttaagctactgcaggagcagttaacaaagcagagagacacgttgcaggcccggcacgaggcgcaggtggagctgctgctccataggcagagagatctaggagatagcaagtctggtctagtgtcgagtagctcaagtcccgtggtggttcaacacagcgttgcgtctcaggctagcgctaaggcagagcctcggaggatccaggaactgtatctgagtgaaaaggaaaatgtcggaccatcttgccacctgatcataccaacatttcaggataagtctctgagctttccccagcattcgctcgcacaacaggaaaatttaacaatcctgcaggaacaatcccagattcagcgggttatactgggggctaaagagggcacccaggagtttgtacatacggagagtgaacttgaaaaacggatctctagtgagcagactggtacatcctcctcgttgagccaggtggatgagtcagagagattccaggaatgcatatcaatcaaaagcgattctacgatcccactatcccacccaaagattcccaggtgccaggagaggctgctcagagtgtcacaacatatgttaccactgcaggacaacctcgaggaacaccaagcctggctggacaccgaaaaagaagccttccactttagtcagaagactcaggagaacacctcttcggagcagacaggatccagcagctttatcccccagcttgttcaactgtcctttaccagtcttgcttccgccgaatctggaactatactagaacccttatttaccgagtcagaatctaaaatcttctcatcgcatcttcagattcctcagttgcaagaccgtctgctgagaatttcccaactgatccagcctcagcaagataatcttaaagctttacaggagcagttggcaacccagcgcgaggccataattctggcacggcaggaagctagagaagaactccttctgcatcaaagcgagtgggaggggagaatttcgcctgagcaggtggacacttcttctctgccactggttccgcagcattccttcgctagcttgcccttgaacgaatctgaacgcaaccaagagccatgcagtattaactccgacaatatcgtctcatcgggacattcggaaatacctactcttcccgacgggctactgggactgagtcatctggtcctacctcagcaagataacctgattgccttggaggagcacctgcatgctcagactgatttcctacctagcatcgaaaaaacacagaaagagctagtcctgagtaaaccctgtaagttcgaagagaaagtgtccagcgaacatttcatccaatcccatcacggcgacctgcaggctctgcagcagcagttggatacacagaagaaggcaatccgctccatccaggaggtgcaggaggaattgctgctccagaggttatcggaactggagaagagagtgagctcagagcaagtttgtagttccagctttgtgagccaggtgcctgtggccgattctgagaggacccagaagagctttcccacaaaaagcaacgacaccctgccaagctcgcacagagagatccctcggttacaagataggctcttgagccttagcaagccgattctgccccagcaggataatatgactgcacagttggacgcgcaacgcgaagtgatgtattcatatgaaaaaccccaggaggaactgagtcttaacaaacagcgcaagcttaataaaagcgagtctgccgagcacacaataccttcgctgttcctgccgaaggaaaccgagcacagcttcattcctctgcccttcgctgaggcgaagcccaagagcacgtgcgagctatatagcagccagaacgagcacgccgcccctccatctaatcccgtgatcccgggatttcaggaccgacttctgtccttttcacaatcagtgctgacacagcaggacaacttgggcctccagaaacagctggatctgcagcgagaggtcttacattacagccagaaagctcaggagaaactccttgtgcagcgacagactgcccttcagcaacagatccaaaagcatgaggaaaccctgaaggacttttttaaggactcccagataagtaagccaacagtggagaacgacttgaaaacacagaagatggggcaactgcgcgactggttccccaacactcaggacctggccggcaatgaccaggaaaacattcgtcatgctgaccgcaataattcagacgataatcatctggcctccgaagatacaagtgccaaacagagcggtgaacaccttgaaaaggacttgggacggcggtcttccaaaccccctgtcgccaaagtcaagtgcggcctcgacttaaatcagcatgagctctcagccattcaggaggtggaaagtcctgcaattggaaggacctcgatccttggtaaaccaggcatctatgaagaccgggacccactgcgagtgagtatatcgcgggaacagtccttctttggcagtccgctggcacacgatccattctcttgtcttcagcttgtcggccaggagaatgtatgcggtgacgattacgatgaagctgtcaagctaaaggaaagcgtggtggagaatcacgccgtgctgtcttatgccgtagaggaggaacacgcctacttggggccgaccgttaagcctgacgacaaagcgaaaacacttagctacgaacctctgagttcggccacagtttcgaccggcagtttactgagctacgagaacaccgatctctctctgactgatcctgagtccttctcagaacacatggacgatagtaaacaggagtccaccacaagcaaagaagaggagacaaacatcatatccagtattgttccatccacccaggacatttatcaaaggcagaattcctcggatgtacataagagtctgctccccgcagtagacgaaaccacgtgtgggcacacccatttccaacagatgatcgacaagtatataaacgaagctaatctgattccagaaaagaccgatttacaggaactcgaacatatcttccccaatctgcaccaccagctgtttaaacctctagaacctcacccggatttcgatttgtcctccagctcatcaggcattagccccgataacagagacttttaccagcgctccgactcttccagcgagtcacactgcgctacaggcctgagtaaatctaccgtgtatttcaccgccttaaggagaacctccatgcattccagcctcaacacctctcccaaccagcagcctgataccaatcttgcccatgtcggagcccactcatttgcaacagagaatatcattggtggctctgagcagtgttttgaacagcttcaacccgagtactcgagccaggaagaatcccagcacgcagatctgccgtcaattttttcaatcgaggccagggattcgagccaggggatgaagaaccagaattatccctcagaagagcacactgagattctccagaacaaaaagaaaatcgttcattttcagctttccattgggaatctgagcagcgtgtactcttcttcagacgaggctaatgtatttgatcaactgaacgtccagcattctactccctgtggcagcaattcttcggagtgcagtaccaaacaccagctcgaatcaaggaaagagagtatgggatttgaagagcttagcaaacgaggagtcgtgaccatgcttcagtctcaagggctcattgaggataataagaacgagacctgccgggtgctggacattaatcctcaggtggaggaaacagactctagactgtgcgtgagaacggtggagatgggaacttccatacaagctccatatagcctaaccactcaaaacgagaagtactttgagaactcagctgaaaccgatattcccaaaatcaccaagaaactctctcagctgggcgagtctgagctctttgcgtcttcagggtcgttttccctccaaagtagtatccccgtgtgggaaaccgaaaccggccatgggataatggaagagcccgagttaacactgatctcgaccacagacacatccatagctgagatggatttcgctaacctgaccctggaggagaagagcgaaaatgaggctaagtgcttcttccaagtttccgagtttctccctctggtttccgctactgaagccagcgattaccccgctgtgagcgaactcagcatcgaaaaaccccgaacagcctctacagcggagacacctcgccgacttacacccgtgccgggatccctgcaggaggcattcataaaacgcaaaaagtcatttatggagaggagtcaccagaggcagaaggagataagaaataaaatccatgtgtcagaaaatagtcagatcaagactgtgaaagagaagccaagtatctcgagctcagtgtcccggctgaagggcgtgaacaaggtccgcgccagtttccccgaggaccggaagaccactcaggctctccgacaccaaagaggtctgaggctttataatcagctcgctgaagtgaaacagcagaaagaggagaagacaaagcaggaagcttacgcccagaacagagcaagagccaaagagttccacaagaagactctggagaaattgcgtgcaaagaatacctgctag

SEQ ID NO: 16260 - DNA, 1602 bp, Artificial Sequence
  Description of Artificial Sequence: Synthetic coding sequence
tctgcaccttccgtaggaaatgatatgggcaacgacgatgccattggaggaaacgtttcaaaatatattgttctgcctacagggtactgcggacagcccaaaaagggccaccttatcttcgacgcgtgtttcgaatccggcaacctggggagagtggaccaagtctcagaattcgagtacgatctatttatccgtcccgatacttgcaacccacgctttcgcgtctggttcaacttcactgtagagaacgtcaaagaatcccagagggtgatctttaatattgtgaatttcagcaagacaaagagcctgtatcgcgacggcatggcaccgatggtcaaatcaactagtcgccccaaatggcagcggctcccaccaaaaaacgtgtattactaccgatgtccagatcacaggaagaactatgtgatgtcatttgccttctgttttgacagggaagaagacatctaccagttcgcttactgctatccttacacttataccagattccagcattacctggactctcttcagaaacgaaatatggactactttttccgtgaacaactgggtcaatccgtccaacagcgaaagcttgacctgctcaccatcacctcccctgataatctgcgcgagggcgcagagcagaaagtcgtgttcatcacaggaagagttcatcctggcgaaacccccagttctttcgtttgccaggggataattgactttctggtgagtcagcaccccatcgcttgcgtgctgagggagtaccttgtcttcaagatagctcctatgctgaaccccgatggagtttacttagggaattatcgatgcagcctgatgggattcgacctcaatcgccactggctggacccctctccttgggttcatcccactctccatggtgtgaaacagctcatagtgcagatgtacaacgatcctaagactagtctggagttctatatcgacatccatgcccactccacaatgatgaacggattcatgtacggaaacatcttcgaggatgaagagcggttccagcgtcaggcaatctttccgaagctgctctgtcagaatgccgaggattttagctactcttccacgagcttcaatagggatgcagtgaaagccgggaccggccgcaggttcctcggaggactgttagatcacacatcttattgttatacacttgaagtgtccttttatagttacataatctctggcacaaccgccgcagtcccctataccgaagaggcatacatgaaactgggaagaaacgtggcacggaccttcctggactactaccgcttgaaccctgttgtagagaaggtcgccatcccgatgcctcgcctgagaaataaagagatcgaggtgcagaggcggaaggagaaaagccctccttataagcacccccttctcagaggacctgcgtcaaactatcccaattctaagggggataagaagagcagtgtcaaccacaaagacccaagcacaccctttaagacccggagcccaggcagatcttatggcgaccgatccatgcacttcttgttgggtaacgagattaaccatagcagtctggctagtaaggatctctggatcaacgcttag

SEQ ID NO: 16261 - DNA, 1509 bp, Artificial Sequence
  Description of Artificial Sequence: Synthetic coding sequence
atgcccgaaattagggtcacacctctgggcgcctgtcctgtgctatcttggaatctcgtgcttcctccagggcgcgggtccagggcacctagctctaccgacactaggaccggctttcatgtgttacctcacggcgtggacgacgagttggaaataaaagcctactacgctggacacgtccttggagccgctatgttccagattaaagtggggtcagaaagcgtggtttacaccggggactacaatatgacccctgacaggcatctgggtgcggcctggattgataagtgcagaccaaatctactgattaccgaatctacttacgccacaaccattcgagactcaaaaagatgtagggagcgcgattttctgaaaaaggtgcacgaaacagtggagcgtggaggtaaggtcctgattcctgtgttcgcattaggtcgggctcaagagctctgcatcctgctagagactttctgggagcggatgaacctcaaagtgccaatctactttagcacaggactcactgaaaaagcaaaccattactacaagctcttcatcccgtggactaatcagaaaattcggaagaccttcgtccagcgaaacatgttcgagttcaagcatattaaagccttcgaccgggccttcgccgacaaccccggcccaatggtcgttttcgccacaccggggatgctccatgccggacagtctctgcaaatttttcggaagtgggcaggcaacgaaaaaaatatggtgattatgcccggctactgcgtccaagggacggttggacataagattttgagcggccaaagaaagttggaaatggagggcaggcaggtgctcgaggtgaagatgcaggttgaatacatgtcatttagcgctcacgcagacgccaagggtatcatgcaactcgttggtcaggccgagccagaatccgtgcttctggtgcacggcgaggctaaaaaaatggagtttctgaaacaaaagatcgaacaggagttgagagtcaactgttatatgccagccaacggcgagaccgtgaccttgccaacctccccctcgatacccgtcgggatttctctcggactcctcaagagagaaatggcacaaggcctcctcccagaagcaaagaaacctcgtcttctgcatggaactttgatcatgaaagatagcaatttcaggctagtgtcatcagagcaggctctaaaagagttggggctggctgagcaccagttacggttcacgtgcagggtccatctgcacgacactcggaaggagcaagagactgccctgagagtttattctcaccttaaatccgtgctaaaagaccactgcgtgcagcatttacctgatggcagcgtcacagtagagagtgtgctgctgcaagccgcagccccgagtgaagatcccgggacaaaagtgttgcttgtaagttggacgtaccaggacgaggagcttggctcatttctgacgagcctgctgaagaagggcctgccacaggctcccagctag

SEQ ID NO: 16262 - DNA, 1371 bp, Artificial Sequence
  Description of Artificial Sequence: Synthetic coding sequence
atggccgactctctggagtctacgccgctgcctagccctgaggacagactcgccaaactccaccccagcaaggaattgcttgagtattatcaaaagaagatggctgagtgcgaagctgagaacgaagacctgcttaaaaagctcgagctttacaaggaggcatgcgaggggcaacacaagctggaatgtgacctacaacagagggaggaagagatcgcggagctgcagaaggctttgagcgatatgcaggtctgcctgtttcaggagagggaacacgttttgcgcctttattcggagaatgatagactcaggataagagaactggaggataaaaaaaagatccagaatttgcttgctctcgttggcaccgatgctggggaggttacatatttctgtaaggagcctccccataaagtaacaattttacagaaaaccatccaggcggtgggggagtgcgaacagtctgagagtagtgcgttcaaagccgaccctaaaatctccaagagacgccccagccgggagcggaaggaatctagcgagcactatcagcgtgacatacagacgctaatcctccaagtggaagccctgcaggcccagttaggcgagcaaaccaaactgtccagggaacagatcgaaggtctgatcgaagaccgccgaattcacctcgaagaaattcaggttcagcatcagaggaatcagaataaaattaaagaactcaccaaaaatctccaccacactcaagagcttctgtacgagtcaaccaaagacttcctccagctgcgttccgaaaaccagaacaaagaaaagtcatggatgttggagaaggataacctcatgtccaaaatcaagcagtaccgtgtgcagtgcaaaaagaaggaggataagataggcaaagtgctgcccgtgatgcatgaatcacatcacgcccagagtgaatacattaaatccttaaaggataagttagtgcaggaaaaaaaactctcaaacatgtaccaagagcaatgcatcagtctcgaggaggaacttgctcggatccgggaggaggagggcatgcggagggagatctttaaggatcggaccaacaagatgggcaagcggctgcagattatgactaaaagatacgaagccttggaacgacggcggatccttgaagtggagggattcaagacagatatcaaggtcctgcggcaaaaactgaaagatcttgaacaaatgctgtacaaggcaacagtaaacgcccgtgcaaatcaggatcttgccctcctttgtgaagtcagagactcaaatcgaagggcccacaagatacaaggggagctgaagaatctcaagagtaaagtctttggcttggaaaatgagttacgactctgctag

SEQ ID NO: 16263 - DNA, 270 bp, Artificial Sequence
  Description of Artificial Sequence: Synthetic coding sequence
atgagcgagcaaggggatctcaaccaggcaatagcagaggaggggggaacagaacaggaaacagctacacctgagaatggcattgtgaagtctgaaagtttggacgaggaggaaaagctcgagctacagcgcaggttggaggcccagaatcaagagaggcgaaagagtaaatctggggccggcaaggggaagctgactcgctcattagccgtatgcgaggaaagctccgcccgcccgggcggagagtcgctccaagatcagacgctgtag

SEQ ID NO: 16264 - DNA, 453 bp, Artificial Sequence
  Description of Artificial Sequence: Synthetic coding sequence
atgcaccccgaggactcggtcgtgtcctcgaaggtgctggggtgctcccacttcccagtagccagcaggcctgctggcagtcacgacccccagccaggtcaccgcggcagagtgttgggacctgccagggctcccggttgggttagatacgctgagagggtcctggggcgccccatcacggcacatctgtgcacagccaaaagtccacagcaagtgatgggttccctggtaaaagactactttgccagacagcagaacctaagtcctgaaaagatttttcacgtgatagtggctccgtgctatgataaaaagttagaggccttacaagagagcttaccacctgccttgcacggcagtcggggtgctgactgcgtgttaacttccggagagattgcacagatcatggaacagggcgatctatccgttcgggatgctgctgtcgataccctgtag

SEQ ID NO: 16265 - DNA, 534 bp, Artificial Sequence
  Description of Artificial Sequence: Synthetic coding sequence
atgggctgttgcggctgcagcaggggatgtggtagcgggtgtggtggatgtggatcttcatgtggcggttgtgggtctggctgcggggggtgcgggtcaggccgcggcggttgcggttctgggtgcggcggttgtagctcatcgtgtggcgggtgcggctctcgctgctacgtgccagtgtgctgctgtaagccagtctgttcttgggttccagcgtgctcgtgcactagttgtggttcctgtggggggtctaaggggggctgcggctcctgcggcggctcaaagggggggtgcggatcatgcggggggagcaaaggcgggtgcgggtcttgtggatgtagccaaagttcttgttgtaaaccgtgttgctgcagctccggctgcggctcctcctgttgccaatcttcttgctgtaagccttgctgctgccagagtagttgctgcgtacctgtatgctgtcagtccagttgctgcaagccatgttgctgtcaatcaaattgttgcgtgcctgtctgttgtcagtgtaaaatctag

SEQ ID NO: 16266 - DNA, 294 bp, Artificial Sequence
  Description of Artificial Sequence: Synthetic coding sequence
atgcccgccgagctgtggctaacctcttatggagtccgggaagtggaccaagtgaaacgcctcacaggaccaggattgagtgaagggcccgagccctcgataagcgtgatggtcacagggggtccctggcccacccgcctttctcgcacctgtcttcactatttgggggaatttggcgaggaccagatctatgaagctcaccagcaaggccgtggcgcactcgaggcactgctgtgcgggggaccacagggcgcgtgttccgagaaggtatcagctaccagggaggaattatag

SEQ ID NO: 16267 - DNA, 264 bp, Artificial Sequence
  Description of Artificial Sequence: Synthetic coding sequence
atggaaaatcaacttgcaaagtccacagaggagcgtaccttccaatatcaggattcactgccaagtctccccgttccttccctggaagaaagcctgaagaaatatcttgagtccgttaaacccttcgctaatcaagaggagtacaagaaaaccgaggagatagttcagaagtttcagagtgggattggtgaaaaattgcaccagaagctgttggagcgagctaagggcaagaggaactgggttttcgtggttatcattgaatag

SEQ ID NO: 16268 - DNA, 1881 bp, Artificial Sequence
  Description of Artificial Sequence: Synthetic coding sequence
atgtgcagcacccttaagaaatgcgggacttaccggacggaggtcgcagaatgtcacgaccatgggtcaaccttccaggggagaaagaagggaggtagctccttccgagacaatttcgataagagatcgtgtcattacgagcacggcggatatgagagacccccatctcactgccaggaaaatgacgggagtgtcgagatgagagacgttcacaaagaccagcagctgagacataccccctatagcatacgctgtgagagaaggatgaagtggcattccgaagatgagattagaatcaccacctggagaaacaggaagccgcctgaacgcaaaatgtcccagaatactcaagacgggtacacacggaattggtttaaagtgaccattccatacggcatcaagtatgacaaagcatggttgatgaactctattcagtcacattgttctgataggtttaccccagtagacttccattatgtgcgaaacagggcttgttttttcgtccaggacgcaagtgcagcctccgctctgaaggacgtctcttataagatttacgatgacgaaaatcagaaaatatgcatattcgtgaatcacagcactgccccctacagcgttaagaataagctcaaaccaggacagatggagatgcttaagttgacaatgaacaaacgttataacgtcagccagcaagccctcgaccttcaaaatctcagattcgatcctgatctgatggggcgagatatcgatattatacttaaccggagaaactgcatggcagcaactctgaagatcatcgaacgcaatttcccagaattgctgtctcttaatctgtgtaacaacaagctgtaccagctggacgggctgtccgatataacagagaaagcccctaaagttaagacattgaacctgtctaagaataaactcgagagcgcctgggaactggggaaagtcaagggactgaaactggaggagctgtggctagaggggaaccccctgtgctctacctttagcgaccagtccgcgtacgtctccgccatccgggactgctttcccaaactcctcaggctcgacggccgcgagcttagcgcccctgtaattgttgatatcgattcatccgagacaatgaaaccttgcaaggagaatttcactgggagcgaaacattaaagcatttggtactacagtttctccagcagtactattcaatttacgattccggagataggcagggactgttaggggcctatcatgatgaggcatgcttttctttggcaatcccttttgaccctaaggattcggccccgtccagcctatgcaagtacttcgaggattcacggaacatgaagaccctgaaggatccttatctgaaaggtgaactgctccgcaggacaaaaagagatattgtggactcgctaagtgccctccccaaaacccagcacgacctaagtagcatcctcgtagatgtatggtgccagactgagaggatgctgtgctttagtgtgaacggtgtatttaaagaagttgagggccaatcccaaggtagcgttctcgcgtttacacgtacttttatcgcaacccccggttcctcttcctccctctgtatcgtaaacgacgagcttttcgtacgagatgcctctcctcaggaaactcagtctgctttcagtattccagtgtctaccctgtcctcctcatccgagcctagcctgagccaagagcagcaagaaatggtccaagccttctcggcccagagtggcatgaaattagaatggtctcaaaagtgcctgcaggacaatgaatggaactacaccagggcaggtcaggcttttacgatgctccagacagaaggcaagattccggcagaggctttcaagcaaatcagctag

SEQ ID NO: 16269 - DNA, 2940 bp, Artificial Sequence
  Description of Artificial Sequence: Synthetic coding sequence
atgctgtgttggggcaacgctagctttggtcagttaggcttaggggggattgacgaagagatagtactggaacccagaaagagcgacttcttcataaataagagggtacgcgacgttggatgtgggctgcgacacaccgttttcgttctggacgatggcaccgtctacacctgtggatgcaatgacttggggcagctggggcatgagaaatcaagaaagaagccagagcaagtggttgctctagatgcccaaaatatcgtcgctgtgagttgcggggaggcacacacgctggccttaaatgacaaaggacaggtgtacgcttggggtcttgattccgacgggcaactgggccttgtaggatccgaagagtgtatcagggtcccgcgcaacataaagtcacttagtgacattcagattgtgcaagtcgcctgtggttattaccactctctcgctctttccaaggcctccgaggtcttctgctggggacagaataaatatggtcagttaggactcgggacagactgtaagaagcagacctccccacagcttttgaagtccctacttgggatacccttcatgcaggtcgccgctggcggtgcccactccttcgttctgactctgtccggggctattttcgggtggggcagaaacaagtttgggcaactgggtctcaacgacgaaaatgaccggtatgtgcctaacctgttgaagagtctccgcagtcagaagattgtgtatatttgctgcggtgaggatcacactgctgctctgacaaaggagggaggagtcttcactttcggagcaggaggctatggtcaacttggtcacaatagcacctctcacgagatcaacccgcgcaaagtgtttgagcttatggggtcaattgtcaccgaaatcgcctgcgggagacagcacacttcggccttcgtgccttcttccggccgcatatactccttcggtctcgggggaaacggccaattgggcaccgggtcaacaagtaaccggaagtcaccattcaccgtcaagggaaactggtacccttataatgggcagtgtttaccagacatcgattccgaggagtacttctgcgttaaaagaatattctcgggcggggatcagtcattctctcattattcctcaccccagaactgcgggcctcccgatgactttcgctgccctaaccccacaaagcagatttggacagtgaacgaagccttaatccagaaatggctgtcatacccatccggaaggtttcccgtggaaatcgccaatgaaatcgacggaaccttcagctcttccgggtgccttaatgggtcgttccttgccgtgagcaacgatgaccattacagaactggcaccaggttttctggggtggatatgaacgccgctcggctgctgttccacaagctgatccagccagatcaccctcagattagccagcaggtggcagcctctctggagaagaatctaatacccaagctaacctcttctctgcccgatgtggaagctctgcgcttctacctgactttacccgagtgtcctctgatgtctgactctaacaactttacaacgatagccatcccattcggcactgccctcgtgaatctcgaaaaagccccacttaaggtgctggaaaactggtggagcgtcctggaacctccactgttcctcaaaatagtggaactgtttaaggaagtagtggttcatctcctgaagctctataaaatcgggatcccgccctccgagaggaggatattcaactcatttctacatacggctctgaaggtgttggagattcttcatagagtgaacgaaaaaatgggccaaattattcagtacgataagttttatatccacgaagtgcaggaacttattgatattcgcaacgattatatcaattgggtgcagcagcaagcatacggaatggacgtgaatcatggccttacggagctcgcggatatcccagtgacaatctgcacctacccatttgttttcgatgctcaagcgaagaccaccctgctccaaaccgacgcagtgctccaaatgcagatggccatagaccaagcccaccggcagaatgtttcctcattgttcctccctgtaatcgagagcgttaacccgtgtctgattttggtcgttcgaagagagaatatcgtcggcgatgcaatggaagtgcttaggaagactaagaatattgattacaagaaaccacttaaggtgatcttcgtgggggaagacgcggtggacgccggcggagtccggaaggagttcttccttctcataatgagagagctacttgaccccaagtacggtatgtttcgatattatgaggattcaagactgatttggtttagcgataaaatcaccgtcgagaacttcggagccacggaagtgaaggagctcgtgctgaacggggcggacactgccgtcaataaacagaaccggcaggagtttgtggacgcctatgttgattacatcttcaacaaatctgtcgcttctcttttcgacgcgttccacgctggctttcacaaagtgtgtggaggaaaagtcctgctcctgttccagccgaatgagctccaggctatggtaataggcaacacaaactacgactggaaagaactagaaaaaaatacagaatacaagggggagtactgggccgagcatcctaccatcaaaatattctgggaggtcttccatgaactccctttagagaaaaagaagcagtttttgctgttcctgaccggttccgatagaattcctatcctggggatgaagagtctgaagctcgtcatacaaagcacgggcggaggagaagaatatctgccagtgagccacacctgctttaatctcctggatcttccaaagtacactgagaaggaaacattgcggagcaaactgattcaggccattgatcataatgagggcttctcactgatctag

SEQ ID NO: 16270 - DNA, 1020 bp, Artificial Sequence
  Description of Artificial Sequence: Synthetic coding sequence
atgaaaatctttgtggggaatgtggatggtgctgataccaccccagaagaacttgctgccctctttgcgccttacggcactgtgatgtcttgcgccgtgatgaagcagtttgccttcgtccatatgcgcgagaacgccggcgccctgagagctattgaggccttgcacgggcacgagctccgcccggggcgtgctctagtcgtggaaatgagtaggccgcgccctttgaatacttggaaaattttcgtcgggaatgtcagcgctgcttgtactagccaggagttgcggagcctgttcgagagacgtggcagagtcattgaatgtgacgtagtcaagggcaagcggatgcacgtgcagctgtccacctcgagactgcgcactgcgcctgggatgggagaccagtcaggctgttacaggtgcggaaaggagggccactggagtaaagagtgtcctatcgataggagtgggagagtggcagatttgaccgaacagtataacgagcagtatggcgcagtcaggaccccttacacaatgagctatggggacagcctttattacaataatgcctatggcgctttagatgcctactacaaacgatgccgcgccgctcggagctacgaagcagttgctgctgctgcagcctcagtttataattacgccgaacagaccctgtctcaactgccacaggtgcagaatacagctatggcatctcacttgacctctaccagtctggatccgtatgatcgacacttgctacctacctctggcgctgcagccaccgctgcagctgctgctgcggccgctgcagccgtgactgccgcaagtacctcttattacggccgagatagatctcccctgagaagggccaccgctcccgtgccgacagtgggcgaagggtacggttatggacacgagagcgagctgtcccaagcatctgcagcagcgcggaactctctatacgacatggcacgctatgaacgtgaacaatatgctgatcgagcccggtacagcgccttttag

SEQ ID NO: 16271 - DNA, 390 bp, Artificial Sequence
  Description of Artificial Sequence: Synthetic coding sequence
atggcagagctgattcagaaaaagctgcaaggtgaagtggaaaaatatcagcagctgcagaaagacctttctaagtctatgtccggacggcaaaaattagaggctcagttaaccgagaacaacatcgtgaaggaggaattggctttgctggatggctctaacgtggtattcaagctgctgggaccggtactggtcaaacaggagctgggcgaagccagggctaccgtggggaaacgtctggattacataacagcagagatcaaacggtatgaatcacagctgagggatttggaacgacaaagcgagcaacagcgtgagacattggctcagctgcaacaggagttccaacgggcccaagcagctaaggcaggcgcaccagggaaagcctag

SEQ ID NO: 16272 - DNA, 1695 bp, Artificial Sequence
  Description of Artificial Sequence: Synthetic coding sequence
atgagctatcctgctgatgactacgaatctgaggcagcgtatgatccctatgcctacccctctgactatgacatgcacactggggaccctaaacaggacttggcctacgagagacaatatgaacagcagacctatcaagtgatcccagaggtgatcaagaacttcatccagtacttccataaaacagtgagcgatctgatagaccagaaagtgtacgaactgcaggcttcccgggtatcatccgatgttattgatcaaaaggtgtatgagattcaggacatttacgaaaattcctggactaaacttaccgagcgattcttcaaaaatacaccatggcctgaggccgaggcaatcgcaccccaggttggaaatgatgccgttttcctgatcctgtacaaggaactgtattatagacatatttatgcaaaggtctcaggaggaccctcccttgaacagcgcttcgagtcttactataactattgcaatctgtttaactacatcctcaacgctgatggtcccgctccacttgagttgccaaaccaatggctctgggatattattgatgagtttatttaccaattccagtccttctcacagtacaggtgcaagactgcgaaaaagagcgaagaggaaatagacttccttagatcaaaccctaaaatttggaatgtacactcagtgctgaacgtgctacattccctggtggacaaatccaacattaaccgccaactcgaggtgtacacttctggaggagaccccgaaagcgtggcgggagagtacggcagacactccctctataagatgttgggatatttttctctcgtggggcttctccggctccactccctgctgggggactactatcaggcgattaaggttttagagaatattgaactgaacaagaaatccatgtacagccgggttccagagtgccaggttacaacatattactacgtaggctttgcgtacctgatgatgcggagataccaggacgctatacgggtgtttgcaaacattcttctgtacatccaacgaactaaaagtatgttccagaggaccacatataaatatgaaatgatcaacaaacagaatgaacagatgcacgcccttctggcaattgctctgactatgtacccaatgcgcatagatgagtccattcatttacagcttagagagaagtacggagataagatgctacgaatgcaaaagggtgatccacaggtttatgaggaactgttctcatacagttgcccaaaattcctgtctcctgtggtgccaaattatgataatgttcaccccaactaccacaaagagccattcctacagcagctgaaggtttttagcgatgaggtccaacagcaggcgcagctgagcaccatccgaagctttcttaagctatacactactatgcccgtcgcaaaactggctggctttctggatcttaccgagcaggaattccggattcaactgttggtgttcaagcacaagatgaaaaatctagtttggacgtctggcatcagtgctctggacggtgaatttcaatccgcatcagaggttgatttttatattgacaaggacatgatccacatcgcggacactaaagttgcacgtagatatggtgatttctttataagacaaatccacaaatttgaagagcttaaccggacgctgaagaaaatgggccagaggccatag

SEQ ID NO: 16273 - DNA, 789 bp, Artificial Sequence
  Description of Artificial Sequence: Synthetic coding sequence
atggccctgagcctgggatggaaggcccaccgcaatcactgcggtttactcctccaggcacttaggtccagtggcctgttgctgtttccttgcggacagtgtccctggcggggcgccggtagcttcttggatcctgaaatcaaggccttcctggaggagaacacggaagtgaccagctctggtagcctgacaccagagatccagctccgcctgctgaccccacgctgcaagttttggtgggaacgcgccgatctctggccccacagtgacccttattgggccatttattggcctggcgggcaggccctatcccgctatctgttggataatcctgacgtagttcgcgggaaaagcgttctcgatctgggctctggctgcggagcaactgcgattgcagctaagatgagcggggcatcacgcattcttgccaacgacatcgatcccattgccggcatggccataaccctaaattgcgagttgaatcggctaaatccctttcccattttgatccagaacatacttaacttagagcaggacaaatgggatctggttgtcttaggagacatgttttacgacgaggacctcgcggactccctgcaccaatggctgaaaaaatgcttctggacatacaggacccgagtccttatcggagatccaggaaggcctcagtttagtgggcactccatccagcatcacctccacaaagtggtggaatactcactactggagagtacaagacaagagaatagcggactcacaacctctaccgtgtggggatttcagccttag

SEQ ID NO: 16274 - DNA, 1626 bp, Artificial Sequence
  Description of Artificial Sequence: Synthetic coding sequence
atgtcttcgtgtgttagtagccagccatcgtctaaccgtgctgccccccaggatgagttggggggcaggggaagctcatcttctgagtcccagaagccctgtgaagcacttaggggtctgtcctccctcagcattcatctaggcatggaaagctttatagtggttaccgagtgtgagccaggatgcgctgtagatctgggcctagctcgtgataggcctctggaagctgacggccaggaagtccccctagatacatctggcagccaagccaggccacatctgtcggggcgcaaactgtcactccaggaacgcagccaagggggattagctgccggagggagcctcgatatgaatggtcgctgtatctgtccgtctcttccttattcccctgtttcctcaccgcagtcttctccaagacttccccgtcggcctacagttgaatcacatcatgttagtataaccggaatgcaggactgcgtgcagctgaaccaatacacccttaaggacgagatcggcaaaggatcctacggtgtggtgaaattagcttacaacgaaaatgacaacacctattatgccatgaaagtgctgtcaaagaaaaagctgatccgacaggccggcttccctcggagacctcctcctcgtgggaccaggccagccccgggtggctgtattcaaccgaggggcccaattgaacaggtttaccaggaaattgccattttgaagaaacttgaccatcctaacgttgttaaattggtcgaggttctggatgaccccaacgaagatcatttgtacatggttttcgagctagttaatcaaggtccagtcatggaggtccccaccctgaaaccgctatcagaagaccaggctagattctactttcaagatttgattaagggaattgagtatctgcattatcagaagatcattcaccgcgacatcaaacccagcaatttgctggttggagaagacggacacatcaagatcgccgatttcggggtgtccaatgaattcaagggcagtgatgctctgttatcaaacacggtgggcacaccagcattcatggccccagagtcattgtccgagaccaggaagattttttccggaaaggcattagatgtgtgggccatgggcgtcacactgtactgtttcgttttcggccaatgcccttttatggacgagcgaatcatgtgtctgcacagtaagatcaagtcccaagctctcgagtttccagatcagcctgatatcgcagaggacttaaaggacctgatcacgcggatgctggataagaatcccgagtctagaattgttgtgccagagatcaagctacacccttgggtgacacggcatggtgctgagccgctgccgagtgaggacgagaactgtacactcgtggaagttacagaggaggaggtcgagaatagcgtaaagcacataccctccctggctaccgtaatcctcgttaaaacgatgattcggaagcggtccttcggaaatccattcgagggctccaggcgggaagagagaagcttgtcagctcccggaaaccttctgaccaaacagggcagcgaggataatttgcagggtaccgacccaccccctgtaggcgaagaggaagtacttctatag

SEQ ID NO: 16275 - DNA, 303 bp, Artificial Sequence
  Description of Artificial Sequence: Synthetic coding sequence
atgtccaccataggttccttcgaggggtttcaagctgttagcctcaagcaagaaggtgacgatcagcctagcgaaacagaccacctgtctatggaggaggaggacccaatgccgcggcagattagcagacagtcctccgtcacagagagcaccctctaccccaacccttatcatcaaccttatatctccaggaagtacttcgccacacgccctggggccatcgaaactgccatggaagacctcaagggacatgtggccgagacctccggcgaaacaatacaggggttttggctcctaacttag

SEQ ID NO: 16276 - DNA, 1425 bp, Artificial Sequence
  Description of Artificial Sequence: Synthetic coding sequence
atggagcggtctggccagcgcgtcacgacttgggattgtgatcagggtaaacactctgattcagactatcgggaagacggcatggatctgggctccgatgctggaagcagctcatcgtcaagccgcgcgagttcacagagtaactccaccaaagtgacaccctgttctgagtgcaaatcaagctccagtcccggagggtccctggatctggtaagcgccctcgaggattatgaggagcctttccccgtttaccagaagaaagtgattgacgaatgggcccctgaggaagacggtgaggaggaggaagaagaggacgaaagagaccaacgcggatatagagacgatcggagccctgccagggagcccggagacgtctcagcgaggacccgcagtggtggaggtggcggccgttccgcgacaacggcaatgcccccaccggtgcctaacggaaaccttcatcagcatgatccccaggatctcagacataacggcaacgtcgtggtggccgggagacccagctgcagcagaggtcccaggcgggccatccagaagcctcagcctgcaggtggcaggagatctggcagggggcccgcagccgggggactctgcttgcagcctcccgatggaggaacttgcgttcccgaggagccccccgtgccacccatggattgggaagccctggaaaaacatcttgctgggttacagttccgggagcaggaagctcagaaaaacgagcgggaatcaattagacagaagctggccctggggtccttctttgacgatgggccaggaatttacaccagttgctcgaagagtgggaaaccctcactctcctcacgcctgcagagtgggatgaatctccagatatgcttcgtgaacgactccggaagcgataaagattctgacgccgacgactcaaagaccgagacatcactggacacacccctgtcaccaatgagtaaacagagtagcagctactccgatcgtgatactacggaagaggagtcagagtcactggacgacatggactttctgacccgacaaaagaagttgcaggccgaggcaaaaatggctttagctatggccaaacccatggccaagatgcaggtggaggtggaaaagcagaatcgtaagaagtcgcctgtggccgacctactgccacacatgccacacatatcggagtgcctgatgaagcggtccttaaagcccacagatctgcgagacatgacaatcggtcagctgcaggtgattgttaatgacctgcacagccagatagagtccttgaatgaggagctggtccagctgctgctgatccgagacgaattacataccgagcaggacgctatgctggtggacattgaggacctgacacgccacgccgagagccagcaaaagcacatggcggagaagatgcccgcgaagtag

SEQ ID NO: 16277 - DNA, 690 bp, Artificial Sequence
  Description of Artificial Sequence: Synthetic coding sequence
atgcagcagagggtcttagagctgatacctcagatagccaatgaacaactgaccgaagaattgctcatcgtcaacgacaaccttaataacgtctttcttagacacgagcggtttgagcgatttaggacgggccagactaccaaagcacccagcgaggccgaaccagccgctgacctcatcgatatgggaccagaccctgcggctactggcaacctttcttctcagcttgccggcatgaacttgggaagttcatccgttagggccggactccagagccttgaggcttcaggccggttagaggatgagtttgatatgtttgctctgaccagaggcagttcactggcggaccagcgcaaggaggttaagtatgaagcaccacaagccactgatgggctggccggggcattagatgctcgacagcaatcaacaggcgcaattcctgttacacaagcatgtctcatggaagacatagaacagtggctctccaccgacgtgggcaacgacgcagaggaacccaaaggtgtaacctccgaggagtttgacaaattcctcgaagaaagggcaaaggccgccgatcgcttgcccaatctctcttcgcctagcgccgagggccctccgggacccccttccgggcccgcgccacggaaaaagacccaggagaaagacgacgacatgctatttgccttgtag

SEQ ID NO: 16278 - DNA, 1650 bp, Artificial Sequence
  Description of Artificial Sequence: Synthetic coding sequence
atgtcgagggtagccaagtacaggagacaggtgtcagaagatccggacatagactccctgcttgagacgttatccccagaagaaatggaggaactggaaaaggagctcgacgtggttgaccccgacggctccgttcccgtgggcctgaggcagagaaaccagactgagaaacaatccaccggcgtgtacaatcgggaagccatgctgaatttttgcgaaaaggaaaccaagaagctgatgcagcgggaaatgtcaatggatgaatcaaagcaggttgagaccaaaaccgatgccaaggaggaaaagatcatcagagggattgataaaggacgcgtgcgggctgcagtggataaaaaagaagccggaaaggacggacggggagaagagcgggcagtggcaactaagaaggaagaggagaagaaaggctcggatcgtaacacaggcctctcccgggacaaagataaaaagagggaagagatgaaagaggtggcaaagaaagaagacgacgagaaggtaaaaggagagagacgtaacacagacaccaggaaggaaggcgaaaagatgaaacgagctgggggaaacacagatatgaagaaggaggacgagaaagtaaagcgtggaaccggtaacacggacaccaagaaagacgatgagaaggtgaagaaaaatgagccgctccacgaaaaagaagcaaaggacgattcgaagacaaagacccccgagaagcagacaccttctggccctaccaaaccttcggaggggcccgcgaaggtggaagaagaggcggctccatctatttttgatgagcccttggaacgcgtcaaaaataatgatcccgaaatgacagaggtgaatgtgaacaatagcgactgcattaccaatgagattttggtgaggttcaccgaggcccttgagttcaatactgtcgtcaagctgttcgcactggcaaacacccgagctgacgatcacgtagcatttgccatagccattatgctaaaggctaataagaccatcacttctctgaacctggactctaatcacattacgggaaagggaatcttagctatctttagagccctcttgcagaataataccctgaccgagctgagatttcacaaccaacggcatatttgcggcggtaaaactgagatggagatcgctaaactgcttaaagaaaataccaccctgctgaaactgggttaccattttgagttggctggtccacgaatgactgtcaccaatttgttgtctcggaacatggacaaacagcgacaaaagagactgcaggagcaaagacaggcccaggaggcaaaaggggagaagaaggatctgttggaggtcccaaaggctggcgcagtggccaagggctctccgaagccgtctccccagccttctccgaagccatcccccaagaattcccccaaaaagggtggagcaccagccgctccccctccacctcccccaccattagctccaccactcattatggagaacctaaaaaactctctctcgccagcgacacagcggaaaatgggcgataaggtcctccccgctcaggaaaaaaatagtcgcgaccagcttctcgccgccatccgctcatctaatctgaaacaactgaaaaaggtggaggtgccaaagttgctgcagtag

SEQ ID NO: 16279 - DNA, 231 bp, Artificial Sequence
  Description of Artificial Sequence: Synthetic coding sequence
atgagcgcttcttgtgatggctgcgtcggtagcagacctccggtgcatcttgcttctgggtatagtctggccgacctgctagttctggaaatgggtatggggacccagtgctggacggaggatcaacgccgctggagtagtctctggccatggtcacatcttagttccgatcctagcctcccaaacgtgcaagttacacgcctaaccttgctctctgagcaggctccatag

SEQ ID NO: 16280 - DNA, 1416 bp, Artificial Sequence
  Description of Artificial Sequence: Synthetic coding sequence
atggctaactcttttgcggctcgcatcttcacaacattatctgatctgcagactaatatggctaatctcaaagtgatcggtatagtcattggcaagacagatgtgaaaggtttcccagaccgtaagaatattggcagcgaaaggtacacattctcttttacaattcgggatagccccgcccatttcgtgaatgcagcaagctggggaaatgaagactatattaaatctctctccgattcgtttagggtgggagactgcgtgatcatcgagaatcctctcatccagaggaaagagatcgagagggaagagaaattctccccggccacaccttcaaactgcaagctcctgcttagcgaaaaccacagtacagtgaaggtgtgttcctcttacgaagttgacaccaagttactttcacttattcacctgcccgtgaaggagtcgcatgactactattccttgggcgatatagtggcaaacgggcactctctaaatggcaggataattaacgtgctggctgcagtcaaaagtgttggggagcccaagtatttcactacctcagatcggagaaaaggacagaggtgtgaagtgagactgtatgacgagaccgagtcgagcttcgcaatgacctgttgggacaacgaatccattctgctcgctcagtcatggatgccgcgggagaccgtaatatttgcaagcgacgtgcgaatcaacttcgataagttccgtaactgcatgactgctacagttataagcaaaactattattacaactaatcccgatattccagaagccaatatactgctcaattttattagggaaaataaggaaaccaacgttttggacgatgaaatcgacagttattttaaagagtctatcaacctgtcaactatcgttgatgtgtacaccgtggagcaattgaaagggaaagctctgaaaaatgagggaaaggccgatcccagttacggaatcctgtatgcctatatcagtacccttaatatagacgacgaaacgaccaaagtagtgcgcaatcggtgttcgagctgtggctacattgtcaacgaggcttctaatatgtgcaccacatgcaataagaacagcctggatttcaagtctgtcttccttagctttcatgtcttgatcgatctgaccgatcacacgggaacactccactcttgctccctgacggggtctgttgccgaagaaactcttggatgtacagtgcacgagtttcttgccatgactgacgaacagaagacggccctgaagtggcaatttctccttgagaggtcaaaaatttatttgaaattcgtattatctcaccgggctagatcgggtctgaaaatcagtgtgctcagctgcaagctggccgacccgacagaggcatcacgaaacctgtccggccaaaagcacgtatag

SEQ ID NO: 16281 - DNA, 747 bp, Artificial Sequence
  Description of Artificial Sequence: Synthetic coding sequence
atggctacctccgccccactgagatccctggaagaagaagtgacctgttccatttgcctcgactatctgagggatccggttactattgactgcgggcacgtgttttgtcgctcctgtactacagacgtaaggccaataagtggatctcggcccgtgtgtccactatgtaagaagcccttcaaaaaggagaacatcaggccggtctggcagctcgcctcgctggtggagaacatcgaaaggctgaaggtggacaaagggagacagccgggggaggtgacccgagagcaacaggacgccaagctatgtgaacgacatcgggagaagctgcactactactgcgaagacgatggaaagttactgtgcgttatgtgccgtgagagccgcgagcatcgtcctcacaccgccgtactcatggagaaggccgctcagccccaccgcgagaaaattcttaatcatctgagcaccctgcgccgtgaccgggataagattcagggttttcaagcgaaaggtgaagccgacattctggcagctctgaagaagctgcaagaccagcgtcagtacatcgttgccgagtttgaacaaggtcatcagttcctgcgggagcgggaagagcacctgctagaacagctggcgaagctggagcaggagctgacagaaggacgggaaaagttcaagtcacgcggagtgggcgaactggcccgcctggcccttgtcataagcgagctggagggcaaggctcagcaatag

SEQ ID NO: 16282 - DNA, 2646 bp, Artificial Sequence
  Description of Artificial Sequence: Synthetic coding sequence
atgttttggaagttcgacttgcacacatcctctcatctcgacacactgctcgaaagggaggatttgtccttgcccgagctgctggatgaggaggatgtactgcaagaatgcaaagtcgtgaatagaaagttgcttgacttccttttgcagccgccacacttacaggcaatggtggcatgggtgacacaagagccacctgacagcggagaggagcggctaaggtacaagtacccgagtgtggcctgcgaaatcctcaccagcgacgttccacaaatcaacgatgccctgggtgctgatgagagcctgctgaacaggttgtacggcttcctgcaaagcaccggatcgctgaatccattattggcttctttcttttctaaagttatgggaattctgattaataggaaaactgaccagctggtgagttttcttcgcaagaaagatgattttgtggacctgctgctgcagcacatcggtacaagcgccattatggatctcttgctgcgcctactcacttgcgttgagaggcctcaactccgtcaggatgtggtaaactggctgaatgaggagaaaattgtccaacgactgatcgagcagatccatccgagtaaggatgaaaatcagcacagcaacgcttcacaatctctgtgtgatattattcgtctgtcccgagagcaaatgatacaggtgcaggattcaccagagcccgatcagctcctggctaccctggagaaacaggagacaatagagcagctcctctccaacatgttcgagggtgagcagtcccagtccgtcattgtgagcggaatacaggttctgctgacattattggaaccacgcaggccccggagcgaatctgttaccgttaatagtttctttagttctgtagacggccaactggaactgctggcccagggggccctcgagtcaactgttagctccgtgggagcattacacgcgctgaggccaaggcttagctgcttccatcagctgttgttagagcctccaaaactcgaaccgctccagatgacttgggggatgctagctccacctttaggaaacactcgcctccatgtggtaaagctgctagcctccgccctgagtgcaaacgacgccgcattgacccatgagctcctggctcttgatgttccgaacaccatgctggatctcttctttcattacgtttttaataacttcctgcacgcccaggtcgagggatgcgtctccacaatgttaagcctcggacctcccccagacagctctccagaaacacccatccagaatccggtggtcaaacacctacttcagcagtgtaggctggtcgaaagaattttgacaagctgggaagagaacgaccgggtccaatgcgcgggcggccctcggaagggatacatgggccacttgacccgcgtggccggcgcactggtgcagaatacggaaaaaggtcccaatgctgagcagttacgccagctgctgaaggaacttccatcagaacagcaggaacagtgggaagccttcgtaagcggcccactggccgaaacgaacaagaaaaatatggtggacttagtgaatacccaccatctccactcatcgagtgacgatgaggacgacagacttaaggaattcaattttcccgaggaggccgtgcttcagcaggccttcatggacttccagatgcagagaatgacttccgcttttattgatcatttcggattcaacgacgaagagttcggtgaacaggaggagtcagtgaatgcaccttttgataagacggctaatattacattctcgcttaacgccgacgacgaaaacccaaacgccaacttgctggaaatttgctataaggatagaattcagcagttcgacgatgatgaggaggaagaagatgaggaagaggctcaaggatctggtgagtcagatggcgaggatggcgcttggcagggaagccagctcgcccgaggggctaggttgggccaacctcccggagtgcgtagtgggggctccacggactcagaggatgaagaagaagaagacgaggaggaggaggaagatgaagagggcatcgggtgcgcagcaaggggtggcgccactcccctgtcatacccatcccccggtccacagcctccgggaccgagctggaccgccacatttgaccccgtgcccacagacgctcctacatctcccagagtatctggcgaagaggagctccacaccgggccccccgctccacaaggcccgctcagcgtgccccagggactgccaacacagtccctcgcttcccctcccgcacgagatgcacttcagcttagatcccaggatcctacacctccttccgctccacaggaggctacagaagggtcaaaggtcacagaaccatctgctccttgtcaggctctggtgtccatcggcgacctccaggcaacctttcacggaatcagatctgcccctagttcaagtgattctgcaacacgggatccatccacctcagtcccagccagcggggcgcaccagcctccccagaccaccgagggcgagaagagtcctgagcccctgggattgccacaaagccagtccgcacaggccttgacccctccacctattcccaatgggtcggctccagaaggccccgcatctccaggatcccagtag

SEQ ID NO: 16283 - DNA, 354 bp, Artificial Sequence
  Description of Artificial Sequence: Synthetic coding sequence
atgaaattccagtataaagaggtgcatcccttcgaatatcgtaaaaaggagggcgagaagataagaaaaaaataccccgatagggtgcccctgattgtagagaaggcgccgaaagcacgggttcccgacctggacagacggaaatatctcgttccaagcgacttgaccgacggccagttctaccttctgattcgcaaaaggatccacctgcggcctgaagacgcactgtttttcttcgttaacaataccatccctcccacgtctgccacaatggggcagctgtacgaagacagccatgaggaagacgattttctatacgtggcctattcaaatgagagtgtttatggaaaatag

SEQ ID NO: 16284 - DNA, 1089 bp, Artificial Sequence
  Description of Artificial Sequence: Synthetic coding sequence
atgcgcgagatcgtgcatctgcaggcaggccagtgtggcaaccagattggagcaaagttttgggaggtcatcagtgatgagcacggcatcgacccgacgggtacataccacggagacagcgacctgcagctcgaacgtataaacgtctactataatgaggccactggagggaactatgtcccaagagccgtcttggttgatctagaacctggcaccatggactcagtacgttccggaccattcggccagatatttcgtccagacaatttcgtcttcggccaatctggagccggaaataattgggctaagggccattacaccgagggcgcagaactggtggatgctgtgttagatgtcgtgcgcaaggaggctgagtcctgtgactgtctccagggattccaactgaccacgcctacctatggtgatcttaaccatttagtttcagcgacaatgagcggtgtcacgacgtgtcttcggtttccgggacagctgaacgcagatctgcgaaagttggctgtaaacatggttccgttccctcgcttacatttcttcatgcctggcttcgcccccttaacttcaaggggctcccaacagtatagggccctgacagttcccgagctgacgcagcagatgttcgatgccaaaaatatgatggccgcatgcgatccccgccacggacgctacctcactgtcgcagctgtgtttagagggcggatgtccatgaaggaagtcgacgaacaaatgctgtcagtccagagcaagaattcttcttatttcgtggaatggatccctaataacgtcaaaaccgccgtgtgcgacatcccccccagggggctgaagatggccgcgacattcatcgggaacagcaccgcgatacaagagctgttcaagcgaatctcggaacagtttacagccatgtttcggagaaaggcctttttgcactggtataccggcgaggggatggacgagatggagtttacagaggcagagagcaacatgaacgatcttgtgtctgagtaccaacagtatcaggacgccaccgccgaagaaggcgaatttgaggaggaagccgaagaagaggtcgcctag

SEQ ID NO: 16285 - DNA, 654 bp, Artificial Sequence
  Description of Artificial Sequence: Synthetic coding sequence
atggaggaaaccatgaagctcgcaacaatggaggatacagtggagtattgtttgtttctaatccccgacgagagtcgggactcagacaaacataaggaaattctccagaagtacatcgaacgcatcatcacgcggttcgcacccatgctcgtgccttatatttggcagaatcagccctttaatctaaagtacaagcctgggaaaggaggagtgcctgctcatatgttcggggtgaccaaattcggcgataatatcgaggacgaatggttcattgtttacgtgattaaacagattaccaaggagtttcctgagctggtggcaagcaccaatcgagtgttcttctgccacggcgagttatgcataatcccggcacctaggaaaagcggcgctgagtcatggctgccgacaacccctccaaccattccccaggcactgaacattattactgctcattccgaaaaaatcctggcttcagaatctatcagagccgctgttaataggagaatcagaggttatcccgagaaaatccaggcatccctccaccgagcccactgctttctccctgccggcatagtggctgttctcaagcagcggccgagactggtggctgccgccgtccaagccttctaccttagagatccaatcgatctgtag

SEQ ID NO: 16286 - DNA, 1188 bp, Artificial Sequence
  Description of Artificial Sequence: Synthetic coding sequence
atggccagcgcagccagcgttacatcactggcggacgaggtcaattgcccaatctgtcaagggacccttcgggagccagtcacgatcgattgtggtcacaacttctgccgagcctgtctcactcggtattgcgagatccctggtcctgacctcgaagaatccccaacatgccctctctgtaaagagcctttccgcccaggcagcttccgacctaattggcagctggctaacgtggtagagaacatcgagcggttgcagctcgtatccacactcggattgggagaggaagatgtctgccaagaacacggggagaagatctattttttctgtgaagacgacgagatgcagctttgcgtcgtctgcagggaggctggagaacacgctacacacacaatgcggttcctcgaggacgccgccgcgccatatagagaacagatccacaaatgtctgaaatgtctgcgtaaggagagagaagaaatacaagagatccagtccagagagaacaaacgcatgcaggtgctactgacacaggtttccacaaaaagacagcaagtgatctctgaattcgctcaccttcgtaagttcctggaagagcagcagtccatcctactcgcacagctggagagtcaagacggagacatcctgaggcagagggacgagttcgaccttctggtcgcaggcgagatctgccgattctccgccttaatcgaggaactggaagagaagaacgagagaccagctcgagagctgttaaccgatattagaagcaccctcattcgctgtgagacacgtaagtgccggaaacccgtagctgtatctccagaactgggccaacggatccgtgacttccctcagcaagcactgcccctgcaaagagaaatgaagatgttcctggaaaagctgtgcttcgaactggattacgaaccagcccatataagtctcgatcctcagacctcacaccctaagcttttgctatctgaggaccaccagagggcccagttctcctataagtggcagaatagccccgacaacccccagcgtttcgatagggcaacctgtgtgctcgcccacaccggcattaccggaggaaggcacacatgggtctggatggccagggtgcccggcgattcaggatgctgccaattttgcagcccaccaagcgtcttaggaacagaggtggccgcatag

SEQ ID NO: 16287 - DNA, 102 bp, Artificial Sequence
  Description of Artificial Sequence: Synthetic coding sequence
atgagcatcagcagcgacgaggtgaattttttggtgtataggtatctacaggagagcggcttcagccatagcgctttcacttttggcatcgagtcacactag

SEQ ID NO: 16288 - DNA, 1242 bp, Artificial Sequence
  Description of Artificial Sequence: Synthetic coding sequence
atgttcgcttctgacctgctccgcgccctggattgctgccctggcgcagggtcttccgggctgttgccacaattaggcccgcggcagctgttggccttcaccgtcaattgcctgggtaaccacagatatcttggattttttgaagatctcgagcaaaggcataaggcccaagttctggtggaggacatttcagatatcctggaagaacacgccgagaaacattttcacccctatatagcctactgctctaatgaggtgtaccagcagagaacgctgcagaaactcattagctcgaatgctgcctttagagaggccctgcgcgagatcgaacgccgcccagcgtgcggaggtctacccatgctgtcttttttgatcctccccatgcaaagagtgacacggctgccccttctgatggacaccctgtgcctgaaaactcaggggcactctgaacgctacaaggcagcctcacgtgcattaaaagcaatcagcaaactggttaggcaatgcaacgagggagctcaccgaatggaacgtatggagcaaatgtatacattgcacacgcagctcgacttctccaaagtgaagagcctccctctcatttcagcctcgaggtggctcctgaaacggggggaattgtttctcgtggaggagactggtctctttagaaaaatcgctagccggcccacatgctacctcttcctcttcaatgatgtcctggtcgtcacgaagaaaaaaagcgaggaatcatatatggttcaggactacgctcagatgaatcatatacaggtcgagaaaatcgagccaagtgaacttccccttccaggcggcggtaacaggagctcttccgtgccacacccttttcaagttactcttttaagaaatagcgagggccgacaagagcagctccttctctcttccgactcagccagtgacagagcccgatggatcgttgccctcacccatagtgagaggcagtggcaaggtctgtcctccaaaggagatcttccacaagttgagattaccaaggccttctttgctaagcaggccgacgaggtgaccttacagcaggcagacgttgtgctagtgcttcagcaggaagacggatggctgtatggagagaggctgcgcgacggagaaacaggatggtttcccgaagacttcgctagatttatcacctcccgggtcgccgtagagggtaatgtgcggaggatggagcggctgagggtagagacagacgtctag

SEQ ID NO: 16289 - DNA, 1890 bp, Artificial Sequence
  Description of Artificial Sequence: Synthetic coding sequence
atggaagagtcgcctctttcccgcgccccttcccgcggcggcgtgaattttctcaatgtagcgcgcacatatattcctaatactaaggtcgagtgtcattatactcttccaccagggaccatgccctcagccagtgattggataggaatctttaaggtcgaagccgcttgcgtacgggattaccacacttttgtttggagctcagtgccagaatcaacgactgatggctcccccatccacacctcagtgcaattccaggcatgcaaccagctcgatgaaagccaacaggagcgaaatgatctgatgcagctgaaactccaacttgaaggtcaagtgacagaactgcgctccagagttcaggagctggagagagcgctggcgactgccaggcaagagcacactgaactcatggagcagtacaagggtatctccagaagtcatggtgaaattaccgaggagcgcgacattctaagcaggcagcagggggaccacgtagcgagaatcctcgaactggaggatgatatacaaacaattagcgagaaggtattgactaaggaagttgagctcgaccgcttgagagatacagtaaaggccctgactagagagcaggaaaaactgctaggccaactcaaagaggtgcaagctgataaggaacagtctgaggctgaacttcaggtggcacagcaagaaaaccaccatctgaatttggatctgaaagaggctaagtcttggcaggaagagcagagcgcccaggcccaaagactgaaagataaagtggcccagatgaaggatacacttgggcaggcccagcagagagtggctgaattggagcctctcaaggagcagcttcggggagcccaggagcttgctgccagcagtcagcagaaagcaacactgttaggcgaggagcttgccagcgcagcagctgcgagggataggaccattgcagaactgcacaggtcacgactggaggtcgctgaggttaacgggaggttggctgagcttgggctgcatctcaaggaggaaaagtgccagtggagtaaggagcgggccgggttgttgcaatccgtcgaagccgaaaaagacaagatcctcaaactatccgccgagatcctgagactggagaaggcagtccaggaagaaagaactcagaaccaggtattcaaaactgaattggcacgcgaaaaggacagttcactggtgcagctctccgagagtaaaagggaactgacagagttgagatccgccctgagggtgctgcagaaagagaaagagcagctccaagaggaaaaacaggagctgctagagtatatgcggaaactggaggcaaggctcgaaaaggtggccgatgaaaaatggaacgaggacgctaccacggaggacgaggaggcagcagtggggctgtcatgccctgcagcattgactgattcagaagatgaatcccctgaggacatgagattgcctccctacggcctgtgtgaaagaggagatcctggatccagtccagctggtcccagagaagcctcccctctggtggtcatctcgcagcccgcacctattagccctcacctcagcggccccgctgaagatagtagctcggattctgaggctgaggacgaaaagagtgtgctcatggccgctgtccagtctgggggggaggaagcaaaccttttgctcccggaactaggatccgcattctatgacatggccagcggcttcactgtcggcacgctctctgagaccagtaccggcggacctgcgactcctacatggaaggagtgccctatatgcaaggagcggttcccagcagagagcgataaggacgccttggaagaccatatggatggccactttttcttctcgacccaagatccttttacgttcgaatag

SEQ ID NO: 16290 - DNA, 2451 bp, Artificial Sequence
  Description of Artificial Sequence: Synthetic coding sequence
atgccattaagcagcccaaatgcagctgcaaccgcctccgacatggacaagaactccggctctaactcatcctccgcaagctccggttcatcaaaggggcaacaaccaccccgctccgcttccgccgggccagccggggaaagcaaacctaagtccgatggcaagaactccagcggctccaaacggtataaccgcaaacgagagctcagttacccaaaaaacgagtcatttaataatcaaagccgccgctcttctagccagaagtcgaagacgttcaacaaaatgcccccccagagaggcggcgggtcctccaagctgttcagctcatccttcaatggtggaagacgagacgaagtggctgaagcccagagggccgagttttcccccgcccagttctcaggtccaaagaagattaatcttaaccacctcctgaactttacctttgagccaagagggcagacgggtcacttcgagggcagcggacatggcagttggggcaagcgaaataagtggggacataaacctttcaacaaggagctgtttctgcaagcaaactgtcagttcgtcgttagcgaagaccaggattacactgcgcactttgccgatcctgatacactggtaaattgggactttgttgagcaggtgcggatctgttcacacgaagttccaagctgtcctatctgcttgtatccccctactgccgcgaagataactaggtgcggtcacattttctgctgggcctgcatactgcactacctgagcctctctgagaaaacttggtccaagtgccccatctgctactcttccgtgcacaagaaggatctgaagtccgtggtggctaccgaatcacatcagtacgtggtaggtgacacgatcaccatgcagcttatgaagagagaaaaaggggtattggtcgccctgccaaaatctaaatggatgaacgtggatcatcctatccacctgggcgatgagcagcatagccagtactctaaattgctgctcgctagcaaagagcaagtgctgcacagagtggtccttgaggagaaagtggccctggaacaacagctagctgaggagaagcacaccccagaaagttgctttatcgaggcagcaatccaggaactgaagactcgtgaggaggctctgtctggcttagcaggctcgcggagggaagtgacaggagttgtcgctgcgttggagcagttggtactgatggccccattggctaaagaatccgtgtttcagccccgaaagtctctgctacagcagggcgtgttggagtatctctccgcctttgacgaagaaaccacagaagtgtgctcactggacactccctctcgtcctctggccttgcccctagtggaagaagaagaggcggtttctgaacctgaaccagaggggctcccggaggcttgtgacgacctcgagcttgcagacgacaacttaaaggaggggactatatgcaccgagagctctcagcaggagcccatcactaagagtggctttaccagacttagctcaagtccatgttattacttttatcaggccgaggacgggcagcacatgtttctacatcccgtgaatgtgagatgcctggtgcgcgagtatggcagcctggagaggtctcctgaaaagataagcgccactgtggtggaaatcgctggatactctatgtccgaggatgttcggcagcgccacaggtacctcagccacttgccccttacctgtgaattctcaatttgcgaacttgctttgcagcccccagtcgtgagcaaggaaactttggaaatgttttcggacgacatcgagaaacgcaagcgacagcgccagaagaaggcccgggaagagcgtcgtagggaacggagaattgagatagaagagaacaagaagcagggcaaatatcctgaggtgcatatcccgctggagaacctgcagcagttccccgccttcaactcatatacctgtagcagtgacagtgccctggggcctactagcaccgaaggccatggggccctctccatcagccccttatccagaagccctggctcacacgccgacttcctgctgacgcccctatctccgactgctagccaaggcagtccgtctttttgtgtgggatctctggaagaggacagtccgtttccctcatttgcccagatgttgcgcgtagggaaagccaaagctgacgtgtggccaaagacagcacctaaaaaggacgagaattcactagtgcctcctgcccctgttgattcagacggcgagagtgacaacagcgatagagtccccgtgccgtcattccaaaattctttctcccaagccatcgaggccgctttcatgaagctggatacccctgcaacctcagaccctcttagcgaagaaaaggggggtaaaaaacgcaagaagcagaaacaaaagctgctgttctctactagcgtagttcacacaaaatag

SEQ ID NO: 16291 - DNA, 429 bp, Artificial Sequence
  Description of Artificial Sequence: Synthetic coding sequence
atggcctccccaggtaaggacaactatcgcatgaagtcttacaagaacaaggcactgaatccgcaagaaatgcggagacgtcgcgaagaggagggaatccaattaagaaagcagaaaagagaagagcaactttttaagcgccgcaatgtgtatcttcctcgcaacgatgagtctatgctcgaaagtcccatccaggatcctgacatatcaagtacagtcccgatcccagaagaagaggtggttaccacggacatggtccaaatgatcttttccaacaatgctgatcagcagctcacagctactcagaagttccgcaaactgctgtcaaaagagccgaatcctccgatagaccaggtaatccagaaacctggggtggtgcagcggttcgtcaagtttctggaaaggaacgagaattgtacgctccagtag

SEQ ID NO: 16292 - DNA, 297 bp, Artificial Sequence
  Description of Artificial Sequence: Synthetic coding sequence
atgagcgaacagggcgacctaaatcaggctatagccgaagaagggggtacagaacaggagaccgccacaccagaaaacggcatcgtgaagtcagaatctctggacgaagaggagaaattggaactgcagcggcggctggaagcacagaaccaagagagaaggaagtcaaaaagcggagctggaaaagggaagctgacacggtcacttgcagtctgtgaggagtcatcagcgcgacccggcggagaaagtctccaggatcaagagagcatccatctacagttatcatcatttagttag

SEQ ID NO: 16293 - DNA, 1917 bp, Artificial Sequence
  Description of Artificial Sequence: Synthetic coding sequence
atggagaacctgcaaactaatttttcactcgtgcagggctcaactaaaaagctcaatggaatgggagacgacggcagcccccctgccaagaagatgataacagacatccacgccaatggcaagaccattaacaaggtacctactgtaaaaaaggaacaccttgatgactatggtgaagcacctgtcgagacagatggagagcacgtgaaaaggacatgcacttcagtccctgagacgctgcacctcaacccatcacttaagcatactctcgctcaattccacctgtcctcgcagtcgtcgttgggaggaccggcggcattcagtgcaagacacagccaggaaagcatgtctccaaccgtgtttttgcccctccctagcccacaagtcctgccagggcctctgctcatacctagcgatagctctactgagctcacccaaactgtactggaaggagagtcaatttcttgctttcaggtgggaggtgaaaaaagattgtgtctgcctcaagtacttaatagcgttctcagagaatttactttgcaacaaatcaacacagtgtgcgacgaactatacatatattgcagtaggtgtacctccgatcagcttcacattttaaaggtgttagggatcttgcctttcaacgccccaagctgtgggctgattacattaacggatgctcaaagactgtgcaatgctcttttacggcccaggacgtttcctcagaatggttctgttctgccagctaagtcatctctggcacaacttaaggaaacagggtcagctttcgaggtagagcacgagtgtctcggaaaatgtcaaggcctcttcgcccctcaattctatgtgcagccggatgccccgtgcatccagtgcctggaatgttgcggcatgtttgcgccccagacctttgtgatgcactcccacaggagccctgataaacgaacttgccactggggctttgaatctgcaaaatggcactgctacctccacgtcaatcaaaagtatctgggaacaccagaggaaaagaaactgaaaatcattctcgaggaaatgaaggaaaaattctccatgagaagtggtaaacgcaatcagagcaagacagacgcacctagcggaatggagctccagagttggtatcctgtaatcaagcaggagggagaccatgtatcccagacacactcatttctacaccccagctattacctgtatatgtgcgacaaggtggtcgcaccaaacgtgtcattgacgtcagctgtgtctcagtctaaagaactgactaagacagaggcaaatgcctcaatttctaataactctacctccaaacgcaagagtgagtcggctacgtgtaacctcgttagggacatcaataaagtgggtataggactcgtggctgctgccagctctccactcctggtcaaagatgtaatttgtgaagatgacaaagggaagatcatggaagaagtgatgcgcacatatttgaagcagcaggagaagctaaatttgatcctccagaagaagcaacagctgcagatggaagtcaaaatgttatcaagcagtaagtctatgaaggagttgacagaagaacagcaaaacctgcagaaagaactcgaatccctgcagaatgaacacgcccaaagaatggaggagttttacgtcgaacagaaggatcttgagaagaagttggagcaaataatgaaacagaagtgtacatgtgatagcaacctggagaaagacaaagaagctgaatatgcaggccagctggctgaactgcgccaacggttggaccacgcagaagctgatcgacaagaactccaggatgaattgcgccaggagcgcgaagctcggcagaagctcgagatgatgatcaaagagctcaaactgcaaattctgaaatcatcaaaaacagctaaagaatag

SEQ ID NO: 16294 - DNA, 1530 bp, Artificial Sequence
  Description of Artificial Sequence: Synthetic coding sequence
atgaagagaggcaggctccccagcagtagtgaggatagcgacgacaacggcagcctgagtaccacatggtcccagaacagcagaagtcagcaccgaaggtcttcttgttctcgacacgaagaccgtaaaccttccgaggtcttccgcacagatctcattacagccatgaagctccacgactcttaccagttgaatcctgacgaatactatgtcctagcagatccatggaggcaggagtgggagaaaggggtccaggtccccgtctctccaggaaccatccctcagcccgttgcgcgggtggtgagcgaggagaaaagtctcatgttcatcagaccaaagaagtatattgtatcctccggctcggagccccctgagctggggtacgtcgatattaggaccttggctgattctgtgtgtcggtacgatttaaacgacatggatgctgcgtggcttgagctgactaatgaagaattcaaagaaatgggcatgccagaattggatgagtacactatggaacgagttctggaagagtttgagcagcgctgctacgataacatgaatcacgcaatcgaaaccgaagagggccttggcatagagtacgatgaggacgtggtgtgcgacgtctgccagtccccggacggcgaggatggtaatgagatggtgttctgcgacaaatgcaatatatgcgttcaccaggcatgttatgggattctgaaggtgccggaaggctcatggctctgtcggacatgtgcactgggagtgcagcctaagtgcctgctgtgcccgaaaaagggcggggcgatgaaaccaacccggtccgggactaagtgggtgcacgtgagctgtgctctgtggatccctgaagtaagcatcggatctcccgaaaagatggaaccaattaccaaggtctctcatattccctcatcaagatgggcactggtgtgcagcctctgtaatgaaaagttcggcgcctcgatccagtgcagtgtgaagaattgccggacagccttccatgtgacgtgcgcttttgaccgcggcctcgagatgaagacaattctcgccgaaaacgatgaggtgaagttcaagagttactgccctaaacacagctcacaccgtaagcccgaggagtccctcgggaagggggctgcacaggagaacggcgctcctgaatgcagtcctcggaacccgctggaaccattcgcgtctctcgaacagaatcgggaggaggcccacagagtcagcgtgcggaagcaaaaactgcagcagctggaggatgaattttacacgtttgttaacctgttagacgtggcccgggctttaagactgcctgaggaggtggttgactttctttatcagtactggaagctgaagaggaaggtcaattttaacaaaccgctgattacaccaaagaaggatgaggaggataacttggcaaagagagagcaggatgtcctgttccgccggctccagctcttcacgcacctgagacaggacctggagagggttatgatcgacactgatacactgtag

SEQ ID NO: 16295 - DNA, 354 bp, Artificial Sequence
  Description of Artificial Sequence: Synthetic coding sequence
atggccttttcaggtcgggcaaggccatgcattatccccgaaaatgaggaaatacctcgggcagccctgaatacggtgcacgaggccaacgggaccgaggacgaacgggctgtatcaaagttgcagcgcagacatagcgacgtgaaggtatataaggaattttgcgatttttacgctaaattcaatatggcaaatgccctcgctagcgctacgtgcgagcggtgcaaaggcggtttcgcgccagcagaaacaatagtcaactctaatggcgaactgtaccatgagcagtgttttgtttgtgcccagtgctttcaacagtttccagaaggactgttttatgaggagagaacttag

SEQ ID NO: 16296 - DNA, 1110 bp, Artificial Sequence
  Description of Artificial Sequence: Synthetic coding sequence
atgaaagatacacaagatatacaggaagcatccaaagccatgcagaacaaggtgcacgagcaggaggacaagaatgaaaaacaaaagcagagggaggacaagttgggcgtgtatagcctggtacacttctctcccaagatgctaggcagtgtagccaccaccctgcctctttccagctctaatagttctggaatgccccttggttattatctttctagtcctcaaatcagccgggtcacgatctcaaccacggggcagttgacgtccaaagcgacggtcggatcttgttctcgcgtggagaactcactcgacgcctcaccattcagcgtcccaaagaaacaggacgagagtccaatgattggtgatggagaggactatttcctgtctctgttcggggatagcaagaaactgaccgctcacagtaattacacccagaagactctgaagtattttagcatgatacttgaagaggttgggcaattcacctctagctctctgggcgatgtggagatcgccgaagtgaacgtgaagggactgtttgtgaaactcatcaatagcagcctcgataaagagatggctattggcgatcacattctccagcagaacgtcaatgggcagactatctccctgtacagattcctccccaacatagtaatgcaggccaatagcacagtcaccgctattgcctggtatacgcctattcactggaagcaggcttgggagaagctggacgccgacgtggagtttaacagatgttctgtggtgagccccacattccggaagagagtgttccagtggaccgcctccacagctacaataacaaaggaaaagcaagaccagccaaagaaggatatcagtaactaccaggtggagcaggcccaggtgctcctgaagcgcgagaaagagattcctcctaccgtgtttccaaatagatcaccttggtgccagaacccttacgtgtctgcacacccatactgccctctcatagaaccacacaacacaagcacagccggagggagactagatcggcagccaagaactaggtctaccagacctaaccgggcatcagggtccaagaaaaagaagacctctgagtcccagaaacaatag

SEQ ID NO: 16297 - DNA, 681 bp, Artificial Sequence
  Description of Artificial Sequence: Synthetic coding sequence
atggaccagagccgcgtcctcctgtgggtgaaagccgaacctttcattgtgggggccttgcaagtaccgccgcccagtaagttttctctgcactacctgagaaagatctccacttatgtacagatcagggccactgaaggcgcttatcctcgcctctactggtcgacctggagacatattgcatgtggcaagcttcagctcgccaaggacctggcctggctctactttgagatctttgactcgctgtctatgaaaacccccgaggagcgactggaatggtcagaagtactgtccaattgcatgagcgaagaggaggtggaaaagcagaggaaccaactgagtgtagacacattgcaattcctgctcttcctgtacatccagcagctgaacaaagtttcccttcggacttccctgattggtgaggagtggcctagtccacgtaataagagtcagagtccggatctcacagaaaaatccaactgtcataacaaaaactggaacgactactcacatcaagcttttgtttatgatcacctgtcagatctcctcgagttattgctggatcccaagcagcttacggcttcgttccactccacacatagtagcctcgtcagcagagaggcggtggttgctctgagctttctgatcgaggggaccatctccagggctaggaagatttag

SEQ ID NO: 16298 - DNA, 747 bp, Artificial Sequence
  Description of Artificial Sequence: Synthetic coding sequence
atgaatgaccggctgggggaggatgaatctctgctcatgaagctgtactccttcctgttgaacgatagccctctaaatccactactcgcgtcttttttttccaaggtgttaagcattctcatcagccgtaaacccgaacaaatcgtggattttctcaagaagaagcacgacttcgttgacctaataatcaagcatattggcacgtcagcaatcatggatctgctactgcgattattgacatgtatcgaaccaccccagcctcgccaggacgtactgaattggctcaacgaggagaagatcatccaaagactggtcgaaattgttcatccatcccaggaggaagatcggcactccaatgcctcccagtccctttgcgagattgtgcggctttcccgtgaccaaatgctgcaaattcaaaactctacagaacctgacttgctgctggcttcaggactgcccgaccttaacggtgtgggcccccggggactactggtcgacaacatgctgtggtctcgcctggtggtgtcattcgcaagccacggccagggcctggcgccactggtcgcccacgtggcctctgtagtctggacgtggtggctccttcacccaaccgttgcttccgttgtctggacttggtggctgttgcatcccacccaggggaactctgttctgctccatccaacagattgttgggagagggctagcggtacatttctatggggtataattctcttctgtctgagctag

SEQ ID NO: 16299 - DNA, 1869 bp, Artificial Sequence
  Description of Artificial Sequence: Synthetic coding sequence
atggccatggcgccctcaccaagcctcgtgcaggtgtataccagcccggcggccgtcgccgtgtgggagtggcaggacggcctgggaacctggcacccctacagcgcaaccgtttgtagttttatcgaacagcagttcgtacagcaaaaggggcagaggttcgggctgggctccctggctcatagcattcctcttgggcaagctgacccatctctagctccatacatcatcgaccttcccagctggacccaatttcgccaggacactggaacaatgcgcgccgtgaggcggcacctgttcccacaacattctgcccccggcaggggggtcgtctgggagtggctgtctgacgatgggtcctggaccgcttatgaagcctccgtctgtgactacttggagcagcaagtcgcccgaggtaatcaactggtggatttggctcctctaggctacaattacacagtaaattacaccactcatacccagacaaacaaaacatcgtctttttgtaggtcggtgcgaagacaggcaggcccaccctaccccgtcaccacgattatagccccccccggacacactggggtggcctgtagctgtcatcagtgcctgagtggatcccgaacagggcctgtctccgggcgctatcgtcactcaatgactaatctgcccgcttatccagtaccccagcaccccccccacagaacagcttctgtgtttgggactcaccaggccttcgcgccttacaacaagcctagtctgtccggggccaggagcgccccacggctcaatactacgaacgcctggggtgcagctccgccttctctggggagtcagcctctgtaccgaagctccctttctcatctgggcccacagcatctaccacctgggtcgagcacatctggagcagtgagcgcctccctgcccagcggaccctcgagctcccccggctctgttcctgcaacagtccctatgcagatgcctaaaccatcccgggttcagcaggctctggctgggatgacgtccgtgctgatgtccgccatcggattaccagtctgcctttcacgagcgccgcagcccacttcccctccagcttccagactagcttccaagtctcatggatcagtgaagagacttagaaaaatgtccgtgaagggtgctactcccaaacccgagcctgaaccagaacaggtgatcaagaattataccgaggaactgaaagtgccaccagatgaagattgcattatctgcatggaaaaactcagtaccgcatccggctatagcgacgtgacagactccaaggcaataggcagcctggccgtcggccacctgacgaagtgtagccatgctttccacctgttgtgtctcctggccatgtattgtaacgggaacaaagatgggtccctccagtgcccctcgtgcaaaactatctatggagagaaaaccgggacccagccacagggcaagatggaagtgcttaggttccagatgagcctgccaggacatgaagactgcgggacgatcctgattgtatattcaattccacacggcatccaggggcctgaacatccaaatcctggcaaaccctttaccgcacgggggttccctaggcagtgctacctccccgacaatgcccagggccggaaggtgctagagcttctaaaggtggcttggaaacgccgtttgatatttaccgtgggcactagcagtactacgggggagacagacacagtggtctggaatgaaatccatcataaaactgaaatggaccgaaacatcacagggcatggctatcctgacccaaactacctgcagaacgtcctggccgaacttgccgctcagggtgtgaccgaagattgtctcgagcaacaatag

SEQ ID NO: 16300 - DNA, 4008 bp, Artificial Sequence
  Description of Artificial Sequence: Synthetic coding sequence
atggaagagattcccgtaaaagtggccgtgcgcatccgtccgttactgtgtaaagaagcccttcacaaccatcaggtgtgcgtgcgcgtgattcctaacagccaacaagtcattataggtagggatcgtgtgttcacattcgactttgtttttgggaaaaatagtacccaggatgaagtctataacacgtgtataaagcctctcgtgctctccctgatcgagggttataatgccactgtcttcgcctatggacagaccggctcgggcaagacgtacactatcggaggaggccacatagcatctgtcgttgaagggcagaaaggaatcatccccagggccattcaagagatatttcagtcaatatccgagcacccaagcatcgacttcaatgtcaaagtcagctacattgaagtatataaagaggacctgcgtgacctgcttgaattggagacatcaatgaaagatctgcacattcgggaagacgaaaaaggcaataccgtgatagtgggggcgaaggaatgccacgtggagtccgctggcgaagtgatgagtctgctcgagatggggaatgcagcccgtcacaccggaactacccagatgaacgagcactccagccggagtcacgccatcttcaccattagtatttgccaggttcacaaaaacatggaagcggcagaagatggcagctggtactctccacgccacatagtttccaagttccatttcgtggacctagccggtagcgagagagtgaccaagaccggaaatactggcgagcgctttaaggaatcaatccaaatcaattcggggctacttgcccttggaaatgtcatatctgcattaggggacccgcgaaggaagtccagccacattccgtacagggacgccaagatcaccagacttctgaaagacagcctgggcggatcggcaaagaccgtgatgatcacatgtgtaagcccttcctccagtaattttgacgagagcttaaatagcctcaagtacgccaaccgggctcgaaatataagaaacaaaccaaccgttaatttctcgcccgagagcgataggattgacgagatggagttcgaaattaagttgctgcgcgaagcactgcaatcgcagcaagccggggtctcacaaacaactcagatcaaccgcgaggggtcgcccgacacaaataggatacactccctggaggagcaggtcgctcaacttcagggtgaatgtctgggctaccagtgctgcgtggaggaggctttcacttttctggtggacttaaaggacactgtgagactgaatgaaaagcagcagcataaactgcaggagtggttcaatatgatccaagaggtgcgcaaggccgtgcttactagcttccgcggcatcgggggtacagcctcactggaagagggcccacaacacgtgacagtgttgcagttgaagcgcgaactgaagaaatgccagtgtgtgttagccgcagatgaagtggtcttcaatcagaaagaactggaggtgaaagaattaaagaaccaggtccagatgatggtgcaggaaaacaaggggcatgctgtatctctgaaggaagctcagaaggtgaatagactgcagaacgagaaaataattgagcagcagctgcttgtcgatcaactgtccgaggaactgacaaagctcaacctgtcagttacatctagcgcaaaggaaaattgtggcgacgggcccgacgccaggatacctgaacggcgcccctatacagttcctttcgatactcatcttggccactatatctacattccttctcgccaggacagtagaaaggttcatactagtcctcctatgtacagtctggatagaattttcgccggctttagaaccagaagccagatgttactggggcacatcgaagaacaggacaaagttcttcattgtcagtttagcgacaacagtgacgacgaagaaagtgagggccaggagaaatccggcacaagatgtagaagccgaagctggatccagaaacctgattcagtctgctcccttgtggagctgagcgacactcaggacgagacccagaagtcagatctggaaaatgaggacctcaagatcgactgtctccaagagagccaggaacttaatctccagaaactgaagaactcagagcggattctgaccgaagctaaacagaagatgcgcgagttaacaatcaacatcaaaatgaaggaggatcttataaaagagcttataaagacaggaaatgatgctaaatcggtgtccaaacagtattcactcaaagtgaccaagctggagcatgacgccgaacaggccaaggttgagctcatagaaacgcagaaacaactccaagagctggagaacaaggatttaagtgacgtcgccatgaaagtgaaacttcagaaggaatttcgtaagaagatggacgcggctaagctccgagtgcaggaaattcagctgaagaccggtcaggaagaaggactgaagcccaaggctgaggatctggacgcctgtaacttgaagcggcgcaaaggaagcttcggcagcatagaccacctgcagaagctggatgaacagaagaagtggcttgacgaagaagtggagaaagtgctgaaccaaaggcaagaactggaagagctcgaggcggacttgaagaaaagggaagctatcgtgtccaaaaaggaggccctactccaggagaagagccacctggaaaataagaagctacggtcaagccaagctttgaacactgactcattaaagatcagcaccagactgaatcttctcgaacaagagctgagcgaaaaaaatgtgcagctgcaaacctcaactgctgaggaaaaaaccaagatatctgagcaggtagaagtgctgcagaaagaaaaagaccagctgcagaaacgacgacacaacgtcgatgaaaagcttaaaaacggacgcgtgcttagcccagaagaagagcacgttttattccagttggaggaggggatcgaagccctggaggctgcaatcgagtatcgaaatgagtccatccagaataggcagaaaagtctcagagcaagctttcacaatctctccagaggagaagccaatgtgctggagaagctggcttgtctaagccccgtggagatcagaactatccttttcaggtacttcaacaaggtagttaacctgcgggaggctgagcgaaagcaacaactgtacaatgaggagatgaaaatgaaggtcctggagcgagataatatggtccgcgaattagagagcgctctggatcacctgaaactccagtgcgatcgccgcctcactttgcaacagaaggaacatgaacagaagatgcagttgctgctacaccactttaaagaacaagacggggaaggtataatggaaaccttcaagacctatgaggataaaatccagcagctagagaaagatttgtatttttacaagaagacatcccgggatcacaaaaagaaactcaaggagttggtcggtgaggctatcaggaggcagctggcaccaagtgagtatcaggaggccggcgacggggtgctcaagcccgagggaggcggaatgctttccgaagagctgaagtgggccagccgccctgagtccatgaagctgtctgggagggaacgagaaatggactcatccgcgagcagcctgcgtacacaacctaatccgcagaagctatgggaggatatccctgagctcccgccaatccactcctcactggctccaccctccggacatatgcttggaaatgagaacaagactgagacagacgacaaccagtttaccaagtcacactccagactgtctagtcagattcaagttgttgggaatgtaggtagactgcatggcgtcactccagtcaaactctgtcggaaggagctgaggcaaatctctgctcttgagcttagtcttcgcagatcctcactgggcgtcgggatcggatcgatggctgccgactccattgaggtgagccgaaagcctcgtgacctgaagacctag

SEQ ID NO: 16301 - DNA, 2745 bp, Artificial Sequence
  Description of Artificial Sequence: Synthetic coding sequence
atggaagaacgtattaccactctggagaaacggtacctggcagcacagcgcgaggcaacaagcatccacgatttgaacgacaaactggaaaacgagttagctaataaggagtcactccacaggcagtgcgaggagaaggcaagacacctgcaggaattgctcgaggtggccgaacagaagctgcagcagactatgcgtaaagccgaaacgctacccgaggttgaagcagaattagctcagaggatcgccgcattaacaaaggcggaagagcggcacggcaacattgaggagcacctgagacagctggaaggccaactggaggagaagaaccaggagctcgcacgtgtgaggcagcgggagaaaatgaacgaagaccataacaaacggctgtctgacacagttgacagacttctgtccgagagcaacgagagactgcaactccacctgaaggagaggatggccgccctggaggaaaaaaacaccctgatccaagagttggagtcgtctcagcggcagattgaggaacaacatcatcacaaagggcgtttatcagaggagattgagaaattaagacaagaggtggaccagctgaaggggcgcggaggaccgtttgtggacggagtacacagtcggagtcacatgggcagtgcggcagacgtcagattcagcctgggcaccaccacacatgcgccacccggtgtccaccgccggtattcagccttgagagaggagtcagcaaaggattgggagacttcccctctgccggggatgctggctccagctgctggcccagcttttgactctgatccggaaatcagcgacgtggacgaagacgagcccggtggactggtcggctccgcagacgtcgtcagcccctctggccatagtgacgctcaaacactggccatgatgcttcaggagcagttagatgcgatcaatgaggagatccgcatgatacaggaagaaaaagagtcaactgagctccgcgccgaagaaattgagacccgggttacctcagggtctatggaagccctgaacctcaaacagttgaggaaaaggggctctattccaaccagcctcacagcgttgagtctggcctcagcctcgccgcctctgagcggcaggagtacccccaagctcactagcaggtctgcagcccaagatcttgatcgaatgggcgtcatgaccctgcccagtgacctacgcaagcataggcgtaagctgttgtccccagtgagccgggaagaaaatcgcgaagataaggcaaccataaagtgtgagacctctcccccttcgtcacctaggacgctacgacttgagaagctgggccaccccgctttaagccaggaggagggcaagtccgccctagaggatcagggttctaatcctagctccagcaattcctctcaggattcccttcacaagggcgccaaaaggaagggcattaaatcttcaatcgggagactattcggcaagaaagagaagggacggctaatccaactttctcgagacggagccactgggcacgttctgttgaccgactcagagttctccatgcaggaaccgatggtccctgccaagttgggaacacaggccgagaaagatagaaggctcaagaagaagcaccaattgttggaagatgcacgtagaaagggtatgcctttcgcacaatgggacgggcccaccgtggtgagttggcttgaactatgggttggtatgcccgcctggtatgtggccgcttgtagggcaaacgttaaaagcggcgccattatgtcagctctttccgacactgaaattcagagggaaattggaatctctaacgcgttgcataggctcaagctaaggttggccatccaggagatggtttccctgacttcacccagtgcccccccgacgtcacgaacaagttcagggaacgtctgggtaacccacgaagagatggagaccttggaaacttcaacaaaaaccgattctgaagagggatcttgggcacagacattagcatatggcgacatgaaccatgaatggatagggaacgaatggctcccttcactgggccttccacagtacagaagttacttcatggagtgcctcgtggacgctcgcatgctcgaccacttgaccaagaaggacttacgagtgcatttgaaaatggttgacagcttccaccgaaccagcttgcaatatggcatcatgtgcctcaagcggctgaactatgaccggaaggaactcgaaaagcggcgcgaggagagccaacatgaaatcaaggacgtgctggtgtggactaacgaccaggtggtgcactgggtgcagagcattgggcttagagactacgctggaaatctacatgagtctggtgtccacggggcactgctggccttggatgagaattttgaccataacacactggccttgatactgcagatccctacccaaaatacacaggccaggcaagtcatggagcgagaatttaacaatctgcttgcgctcggtacagaccggaagcttgacgatggcgacgacaaggtcttccggcgggctccctcatggcggaagcgattccgccctcgcgagcatcacggcaggggcggcatgctaagcgcctcggccgagacccttcctgccgggttccgggtgtccaccctggggacattgcagccaccacctgccccgcccaaaaaaattatgccagaagcgcattcccattacctgtacggccacatgctctccgctttccgggattag

SEQ ID NO: 16302 - DNA, 1494 bp, Artificial Sequence
  Description of Artificial Sequence: Synthetic coding sequence
gatgtgggcggcgacagaccttgggactcaggcaatacgcaacttccgcccagaaatcctgtgaaagccaatgcaatgttcggtgctggtgacgaagatgatactgatttcctttctccctctgggggcgcgcgattagcctcgctattcggacttgaccaggccgccgcaggccatgggaatgaattttttcagtacaccgcgcctaagcaacccaagaaggggcaggggacagctgctaccggtaaccaggccacccccaaaactgcaccagcaaccatgtctacacctacgatactggtggcgactgctgttcatgcgtatcgatacacgaatggccagtacgtgaagcagggcaagttcggcgcagccgtcttgggcaatcacacagcacgtgaatacagaattctcctgtacatatcccaacagcagccggtgacagtcgctcgcattcacgtgaactttgagctgatggtgcggcctaacaactattccactttctacgacgatcagcgtcagaactggtcgattatgtttgaaagcgagaaggcagcagtcgagttcaataagcaagtttgcatcgctaagtgtaacagcacaagctccctggacgcagtgctcagtcaagatctgattgtggccgacggccctgccgtagaggtcggagattccctcgaggtggcctacaccggctggttattccagaaccacgttctcggtcaggtttttgacagcacagccaacaaagacaaactactgagactgaagctgggctcaggaaaagttatcaaggggtgggaggacgggatgctgggaatgaagaaaggaggcaagcgacttctgatagtgcccccagcatgtgctgtgggctccgagggagtaattgggtggacgcaggctacagatagcatacttgtgttcgaagtcgaggtgcgtagagtgaaattcgcccgcgactctggcagcgatggtcacagcgtaagtagtcgcgatagcgctgccccttcccccattccgggggccgataacctgtccgccgatccagtcgtaagcccacccacctcaattccatttaagtctggagagcccgcattgcggacaaagtctaacagcctcagcgagcaactggcgattaatacctctccagatgctgtcaaagctaagctcatttctaggatggctaagatgggacagcccatgctaccaatcctccccccccaactggacagtaacgatagtgaaattgaggatgtgaacaccctgcagggcgggggccagcctgtagtcacccccagcgttcaacctagccttcatcctgcccacccagcactgccccagatgactagtcaggccccccagccctcagttactgggctgcaggccccgtctgcagcactgatgcaggtatcatccctagattcccactccgccgtttccggaaacgcccaatcgttccaggttaccttttacaacagaattaattacattctctag

SEQ ID NO: 16303 - DNA, 462 bp, Artificial Sequence
  Description of Artificial Sequence: Synthetic coding sequence
atgaatctcgccgaaatttgtgacaacgcaaaaaagggacgcgagtacgctctgctgggcaactacgatagcagcatggtttactaccagggggttatgcagcagattcagcgccactgccagagcgtgcgggaccccgcaataaagggaaagtggcaacaggttagacaagagcttcttgaggaatatgaacaagtgaaaagtatagttagtaccctggagagcttcaagatagataagccccctgattttccagtcagttgtcaggatgaacctttccgagacccggctgtgtggccaccacccgtgccagccgaacatagagctccaccgcagatccgcaggcctaatcgcgaagttcgcccccttaggaaagaaatggccggagtgggcgcccgcggccctgtgggaagggctcatcccatcagtaaatccgagaagccatccacatcacgagactag

SEQ ID NO: 16304 - DNA, 627 bp, Artificial Sequence
  Description of Artificial Sequence: Synthetic coding sequence
atgttccaggttccagactctgagggaggaagagccggatcccgggctatgaaaccacccggcggagagagcagtaatctcttcgggtcacccgaggaggcaacaccaagcagccggccaaacagaatggctagcaacattttcggtcccacggaggagcctcaaaatatcccaaaaagaactaacccaccaggtggcaaaggcagtggcatcttcgatgagtcaacgcctgtgcagaccagacagcacctgaaccctcccggagggaagacttcagacatcttcggttctcctgtaaccgctacctctaggctggcccatccaaataagcccacgcgaaactcccgagatcgggtagcgatgttttcgttcccgtttgcccagatgagcggagtcggaagaggtctggtgctctgcgagcccggttgctccgcgtcaccaggtcgtcatgatagctgtctggaaacaagggcgtttcagatggccggcagatgcctttgcggggacgagatgggacacccatggcccagcctgatgtgcagtcccggccttcgaggcacagggcgtggagttagagtgggtcggtggggacgcgcatggagtctggatcaacaacccgcaagttag

SEQ ID NO: 16305 - DNA, 591 bp, Artificial Sequence
  Description of Artificial Sequence: Synthetic coding sequence
atgcccttttctaaagagaagtacatcctggacagtagcccagagaagttgcacaaagagttggaggaggagctgaagctgtctagcacagatctacggtcacacgcatggtaccacgggcgaatcccccgagaagtgtctgagacgctggtccaaagaaatggcgacttcttgataagggactcactgactagcctcggggactatgttctcacttgtcgatggagaaaccaggcactgcattttaagataaacaaggtggtggtgaaggcgggagaatcatacacacatattcagtacctgtttgagcaggagtctttcgatcatgtgcccgctctcgtgaggtaccacgtcggctcaaggaaggcagtgagtgaacagtcaggagccatcatatactgccctgtcaaccggacattccctctccggtatttggaagcctcctatggattaggccagggctctagcaaaccagccagtcctgtatccccaagtggccccaagggtagtcatatgaagagacgaagcgttacaatgacggacggcctgacagccgacaaagtcacaaggagcgacggttgtcctacttag

SEQ ID NO: 16306 - DNA, 1986 bp, Artificial Sequence
  Description of Artificial Sequence: Synthetic coding sequence
atgcaggctaatggtgccgggggggggggagggggagggggaggcggagggggaggcggaggaggaggaggcggacagggccaaaccccagaactcgcgtgcctatctgcccagaatggagaatcttcaccctcatcttccagcagcgccggagatctggcacacgcaaacgggctgttgccctctgctccctccgcagcctctaataactcaaatagcctgaatgtaaacaacggggtgcctgggggcgcggccgccgcttccagtgcaaccgttgctgccgccagcgcaaccaccgctgcatcttcttcactcgcgacgcccgaactggggtcctcactcaagaagaagaaacgcctctctcagagtgacgaggacgtcataagattgataggacagcacctgaacggactcggcctgaatcagacagtcgacctattaatgcaggaatccgggtgtcgcctggagcatcccagcgcgaccaaattcaggaatcatgtgatggaaggcgactgggataaggcggaaaacgatctgaatgagctgaagcctctcgtgcactcaccacacgccatagtcgttaggggagctctcgagatcagccaaaccctgctgggcatcattgttaggatgaaatttttgctcttgcagcagaagtatctggagtacctggaagacgggaaagtgctcgaggctctgcaggttctgcggtgtgaactgacacccctgaagtacaatacggagcgaatccatgtcctctcagggtacctgatgtgctctcacgccgaggatctgagggcaaaagccgaatgggaaggtaagggcaccgcgtccagaagtaaactgctggataaactccaaacttatcttcctccatccgtaatgctccccccgcggagactgcaaaccctgctccgacaagccgtcgaacttcagcgcgaccgctgtttataccataacactaaattggacaataatctcgactcggttagcctactgatagaccacgtctgttcacgcaggcagttcccgtgctacacccagcagatccttacagagcattgcaatgaggtatggttttgcaaattttccaatgacggaactaagttagccacgggctctaaagacactaccgtgataatctggcaggtggaccccgatactcatttgttgaagctcctcaagactctggaagggcacgcctatggcgtatcatatattgcctggagtcctgacgacaattacctggtggcatgcgggcccgatgattgttctgaactgtggctctggaacgttcagacaggagaactgagaacaaaaatgagccagtcccacgaggacagcttgactagcgtcgcctggaatcctgacggcaaacgatttgtgacaggtggacaaagaggccagttctaccagtgcgatctcgatggcaacttgcttgattcttgggagggagtgagagtccaatgtttgtggtgcctgagcgatggaaagactgtgttagccagcgatacgcaccaacggattaggggctacaattttgaagatttgacagatcggaacatcgtccaggaagaccatccaattatgtcgttcacgattagcaaaaacggccgcctcgcgcttctcaatgtggccacacaaggagtccacttatgggatctccaggatcgtgttctggtacgtaagtaccagggggtcacccagggcttttacaccattcatagctgtttcggcggtcataatgaagattttatcgctagtggatccgaggatcacaaggtctacatatggcataaacgatcagaactcccaattgcagaactgactgggcatactagaactgtgaactgtgtctcatggaacccgcagattccgtccatgatggcaagcgctagcgatgacggcacagtgagaatctggggccctgcaccatttatcgaccatcagaacattgaggaagagtgcagctctatggatagttag

SEQ ID NO: 16307 - DNA, 1113 bp, Artificial Sequence
  Description of Artificial Sequence: Synthetic coding sequence
atggagaagaagaaaatggtgactcagggtaaccaggagcccactaccacacctgacgccatggttcagcccttcacgactattcccttccctcctccccctcaaaacggtattcccactgaatacggggtgccacacacccaggactacgccggccagacaggcgagcacaacctgaccctttacggcagcacccaggcgcacggcgaacagtcctccaacagtccatccacgcagaacgggagtctcaccaccgaggggggcgctcagaccgatgggcagcagagtcagacgcaatcttccgagaactcagaatctaagtccactcccaaaagactgcatgtctcaaatatcccttttcgctttcgggatcctgatctgagacagatgtttggacagtttgggaagatcctggatgtcgaaattatctttaacgagagagggagcaaaggattcggttttgttactttcgagaattccgctgacgcagacagggctagagagaagcttcatgggaccgtggtggagggtcgaaagatagaagtaaacaatgcgacagccagagtcatgaccaacaaaaagatggtgaccccctatgccaacgggtggaagctgtccccagtggtgggcgcagtgtacggacccgaactctacgccgccagttcttttcaggcagacgtgagtttaggcaacgatgcagcggtacctttgtccggacgagggggaattaacacatatatccccctgatttcgcttcctcttgtgccggggttcccttaccctaccgccgccaccacagctgccgcgttccgaggagcacatctgcggggtcggggccgcactgtgtacggggccgtgcgggccgtgccacccaccgcaatcccagcttatccaggggtggacatgcagcccacagacatgcactccctccttctccagcctcaacctccgctccttcagccactgcagcctcttactgtcactgtgatggcaggctgcacccagccaacccctaccatgcctcttcccctgccgctggcgatggagctggctttgtggagggtgtatacagaagtcgctaccgcggatctgccgcccacagaagtcacctag

SEQ ID NO: 16308 - DNA, 348 bp, Artificial Sequence
  Description of Artificial Sequence: Synthetic coding sequence
atgccgcacctccctctcgcctctttccgaccccccttctggggactgcgtcattctcggggactgcccaggtttcacagtgtgtcgacccaatctgagcctcatgggtctccaatctccaggcgcaatagggaagctaagcagaagcgtctgcgggagaagcaagcaactctcgaggcggagattgccggagagagcaagagcccagccgagagtattaaagcatggcgcccaaaggagcttgtgttgtacgagattcccacaaaacctggcgagaagaaagatgtgagtggccctcttcccccagcctattctcctcgctatgtggaagccgcctggtatccctag

SEQ ID NO: 16309 - DNA, 3039 bp, Artificial Sequence
  Description of Artificial Sequence: Synthetic coding sequence
atgttgctaaagtccatcttcattgtgtatatctttttttactcaatcagcgagctctcactggactctacacttcatgccgtcaacctgcattgtaacaacatcagcaaaatcgaggcgatcgaccacatctggaatctccagcacctagacctgagttccaaccaaatcagccggatcgagggactcaatacattgaccaagctttgcacccttaacctcagttgcaacctcatcactaaagtggaaggcctggaggagctcatcaatcttacgagactgaacgtgtcctacaaccacatcgacgacctatccggcctgatacctctccatggaatcaagcacaaacttcgctacattgacctccattctaatcgcatcgacagcatccaccacctactacaatgcatggtaggacttcattttctgaccaacctgatcctcgaaaaggacggggatgataaccctgtgtgtcgcctgccaggctatcgagccgtgattttacagactttgccgcagcttcgtattttagactgtaaaaacatctttggggagcccgtgaatcttacggagatcaactcctcccagctgcagtgtttagaggggctgcttgacaacttagtatcttctgattccccattaaatattagcgaagacgaaatcattgacaggatgccggtaatcacagctcctatcgatgagctcgttcctctggaacagttcgcttccactccatcagacgccgtgttaacgtcatttatgtccgtctgccagtccagcgaacctgagaagaacaaccatgaaaacgatctgcagaacgaaatcaaattgcagaaactcgatgaccagatcctgcagctcctgaacgagacatctaatagcatagataatgtactggagaaagaccccagacccaaacgagacacagatatcaccagtgaatctgattacggtaaccggaaggaatgcaatcgtaaggtgccacgccggtcaaaaattccttacgatgccaagaccatccagacaattaagcaccacaataagaactacaatagctttgtgagctgtaatcggaagatgaaacccccttatctgaaagagctgtatgtcagtagtagtttagcaaattgtcctatgttacaagaatctgaaaagcctaagaccgaaattattaaagtggaccagagccactccgaggacaatacctatcagtcgctcgtggaacagttggaccaagagagggaaaagagatggagggcagaacaggccgaaaataagctcatggactatatcgacgaattgcacaagcacgcgaatgaaaaagaagatatacatagcctcgccctgctgactaccgataggctcaaggagatcatctttagagagaggaacagtaaggggcagctggaggtcatggtccacaagctgcaaaatgaaattaaaaagctgacagtcgaactgatgaaagcgaaagaccagcaggaggatcacctgaagcacctgcgaacgctggagaagaccctggaaaaaatggaacgccaaaaacgacaacagcaagctgcacagattcgcctgatccaggaggtggagctgaaggcctcagctgcggaccgcgaaatctatctgcttaggacttcactgcaccgagagcgggaacaggcccagcagctccaccagctgctggctttaaaggagcaggagcaccgcaaggagctggaaacaagggaatttttcaccgatgctgacttccaggacgccctcgcgaaagagatcgcgaaggaagagaagaagcacgagcaaatgattaaggagtatcaggaaaagatagacgtgctctcgcagcagtacatggacctggagaacgagtttaggattgctctaaccgtggaggcccgacgcttccaagacgttaaggacggattcgaaaatgttgcaacggagctcgcgaagagcaagcacgctctaatctgggctcaaagaaaggaaaatgaatcatcatcgcttatcaaggatctgacatgtatggtgaaggaacaaaaaactaagctggcagaggtgtccaaattaaagcaagagactgctgctaatcttcaaaaccagattaacaccctggagatacttattgaagatgataaacaaaagtccattcagatcgaactgttgaagcatgagaaggtgcagctgatttccgaactcgccgccaaggagagcctgattttcgggctccgcaccgaacggaaggtttggggacacgaactcgcccagcagggatctagtctggcacagaaccggggaaagctcgaagcccagattgaatctcttagccgcgagaacgagtgcctgcggaaaacaaacgagagcgattctgacgcccttaggatcaagtgcaaaattatcgacgaccagacagagacaatcagaaaactaaaggattgtctccaggaaaaggacgagcacattaaaagactgcaagagaaaatcaccgagatcgagaaatgtacgcaggagcagctggatgagaagtcctcacagctcgatgaggtgctagagaaactcgagagacacaatgaaaggaaagagaagctaaagcaacagctgaaaggcaaagaggttgagctggaggagataaggaaggcatactcaaccctcaaccggaaatggcacgacaaaggtgaacttctttgtcacctcgagacgcaggtcaaggaggtcaaggagaagtttgagaacaaagaaaagaaattaaaggctgaacgcgacaagagcattgaattgcagaagaatgcgatggagaaactgcactccatggacgacgcctttaagcgccaggtggacgcaattgtggaggctcatcaagcagagatcgcgcaactggccaatgaaaaacaaaagtgtatagactctgcaaatctgaaagtgcaccaaatagagaaggagatgcgagagttgctagaggaaacgtgcaagaataaaaagaccatggaggcaaagatcaagcagctggctttcgccctgaacgaaatccagcaggatatgtag

SEQ ID NO: 16310 - DNA, 4665 bp, Artificial Sequence
  Description of Artificial Sequence: Synthetic coding sequence
atgtctgcgacgtcttggtttctggtctcttcctcgggagcacggcaccgcctgcctcgggagctcatattcgtgggccgagaggaatgcgaactgatgctgcaatctaggagcgtcgacaagcaacacgcagtaatcaactacgaccaggacagagatgaacactgggttaaggacctcgggtcgctcaatgggacgtttgttaacgacatgaggatacccgaccagaagtatgtgaccttaaagctgaacgacgtcatccgttttgggtacgactccaatatgtatgtgctcgagagagtacagcatagggtccccgaagaggctctcaagcacgaaaaatacacctcccagctccaggtgtctgtcaaggggctggcaccaaagcggtccgaggccttacctgagcacactccttactgtgaggcctcaaacccacgccctgaaaagggcgaccgccggcccggcacagaggctgcctcataccgtacacctttgtacggtcaaccctcatggtggggagaagatgatgggtctaccctgccagacgcccagaggcaaggggaaccttatccagagcggcccaaggggccggttcagcaagatggcgagcttcatggttttagagcacctgcagaaccgcaaggctgcagtttcaggagagaaccttcctatttcgaaatcccaactaaagaaacgccacagccatcccagccccccgaggtgcccgcgcatgagatgccaaccaaagatgcggaggccggagggggtggggccgcgcctgtggtccaatctcacgcatcttttactatagagtttgacgactgttctcccggaaagatgaaaatcaaagaccacattaccaagttcagccttcggcagcgccggcctcctggtaaagaggccacaccaggagagatggtcagcgctgagacaaaggtggccgactggctagtgcaaaacgatccatccctgctccatagagtggggcccggcgatgacagacatagtactaagagtgacctgcccgtgcatacgcgaactctgaagggacacaagcacgaagatggaacgcaaagcgactcagaagaccctttagcaaaggccgcctcagccgccggcgttccgctagaggcctctggcgagcaagtccgcctgcaaagacagataaaacgggatccgcaggagctgctacataatcagcaggcatttgttatcgagtttttcgacgaagacacccctcggaagaagcgctctcagagtttcacccattcccccagcggggacccgaaagctgataagaggcgaggtcccacccctgcagatcgcgaccgaccatctgtacctgcaccagttcaggcgggcggtcggagttctggtccacaacgagcgggctctttgaagagagaaaagaccgaagaacggttaggaagcccgtccccagcatcaaggactcctgcccgtccatttgggtcagtgggccgcagaagccgactggcccaagattttatggcgcaatgcctacgggagagctctccagccgcgcgcccgagtcctgaaaaggtccctccagtgctgcccgctccgttgacacctcacggtacaagtcccgtgggccctcccacgcctccaccagccccgaccgaccctcagctgaccaaggccagaaagcaagaagaggatgacagcctctccgacgctggcacatacaccattgaaactgaggcccaggacaccgaggtggaagaagcgagaaaaatgatcgatcaggtgttcggagtgctcgaatcccccgagcttagcagagccagttcagctaccttccggcccgtcatcagaggcgatcgggatgagagcgatgacggcggcgtggcgcaaagaatggcactgctgcaggaatttgcttcccggccactgggtgccgccccacaagccgagcaccagggactcccggtgcctgggagccccggcgggcagaagtgggtgtcccggtgggcatcgctggccgatagctacagcgatcccggcttgactgaggacggattgggacgaagggggggggagcctgagggatcgttacctgttcgtatgaggagacggctgccgcagctccctagtgagagggcagattcacccgcgggacctgagtcgtccaggcgatccgggcctggtccccccgaattggattccgaacaaccctcccggctgttcggccaggaagagctggatcctgattctctcagtgacgctagcggttccgatggcgggcgcggccctgaaccaggagtggagccccaggactcaaggcgtcggagtcctcaggagggccccacatggagccgcggcaggcgaagccccagagcccccggtgaaccgaccccagcgtcattcttcatcggagatcagaacggggatgctgtactgagtcgcaaacccctagccgcacctggggatggtgagggactaggccagacagcccagccatcacctcctgcaagggatggagtgtacgttagtgcaaacggaagaatggtgatccagctgagaccaggccgatcgccagagccggatggccctgcccctgcattcctacgacaggaatccttcacaaaagaacccgccagcgggccccctgccccgggaaagcctcctcacataagcagtcacccactgctgcaagacttggctgccacacgcgccgcaaggatggattttcatagccaggatacgcaccttatccttaaggagactgagaccgcactcgcagccttggaggcgcgtctgctgtctaactccgtagacgcagagtgcgagggaggtagtacgcctcggcctcccgaggacgcccttagtggcgactcagacgtggacacagcgagcaccgtttccttaagaagcggaaaatccggcccgtcccctaccaccccccaaccgctgcgcgcccaaaaagagatgtctccctcacctcccgctgcccaggatcccggcgggactgctctggtttctgcacgtgaacagagcagtgagcgacagcaccaccctcttggcccgaccgacatggggagaggagaaccagtgcggcggtctgcaatcaggaggggacatcggccacggggatccctggattggccctccgaagaaaggggccccgtgctggcccacctgcctagcagcgacgtgatggcgtcaaatcatgagacaccagaggctaccggcgccgggcgcctcgggtctcgtagaaagcctgccgctcctcctccctctccagcagcaagagaggagcagtccagatcgtctgcctcaagccaaaaaggacctcaggcacttacacgctccaattctctgagcactccacgccccacccgggctagccggctgcgaagagcacgtttgggcgacgcaagcgacacagaggccgccgacggcgagcggggcagcctgggcaaccctgagcctgtagggcgccctgctgccgagcaggccaagaagctgtctagactagatatcttagctatgcctagaaagagggcaggaagcttcacaggaacgtctgatcctgaagccgctcctgcacgtacctccttctctggcaggtccgtggaattgtgctgcgctagcagaaagccaacaatggcagaggcgcgggccgtttccaggaaagccgcaaacaccgctaccacgaccgggcccaggcagcctttcagtagggcccgcagcggtagcgccagatacacctcaacaacacagacgcctcgggcaggtagcagcagccgagcccgctcccgcgcgcctggacccagggacactgacgatgacgaagaagaacctgacccttacggattcattgtccagaccgccgagattgctgaaattgcccgactttcccagacactcgtgaaggacgtggctatcctggcgcaggagattcatgatgtcgccggagatggtgacaccttaggctcttcagaacccgctcacagcgctagccttagcaacatgccgagtacacccgcttccactatttctgcccgtgaggagttggtgcagcggatccctgaggccagcttgaacttccagaaggtgcccccgggcagtcttaactcccgcgacttcgatcaaaacatgaatgactcatgcgaggatgccctcgccaacaaaactcggccaagaaatcgcgaagaggtgattttcgataacttaatgcttaatccggttagccagctttcgcaagccattcgtgaaaacactgaacaccttgcggagaagatgaaaattctctttcaaaatactggcagggcgtgggaagatttagaggcccggattaatgcagagaacgaggtcccaatcctgaaaaccagcaacaaggaaatcagttccatccttaaagagctgagaagagtccagaaacagctggaggtcatcaacgcaatcgtggatccctcaggctcgctggacttgctaaccgggaacagaagtcttgcctccagtgcgcaacccgggctgggcaaagggcgagtcgcagcccagagtccaccgtcccccgcctctgccgaggctctcttgcctgcacttcctttaaggaactttcctcagagggccagctgtggcccccctagcttgccagacccgacattcctgcctgacgccgaacggttcctgatctag

SEQ ID NO: 16311 - DNA, 696 bp, Artificial Sequence
  Description of Artificial Sequence: Synthetic coding sequence
ataatcctcctcctagtaccctccgaggaaactgatgagaacgaccttattctcgaagtgacagcaggggtcgggggagggttgcggcatgctagcgcctctatcggcggaagtgaagcttacagacacatgaagttcgaggggggagtgcacagagtccaacgggtgcccaaaacagaaaagcaagggcgggttcataccagcaccatgacggtggcaattctgccacagccaaccgagattaatctggtgatcaacccaaaagacctgaggattgacacgaaacgcgcatcgggagccggcggccaacatgtaaacacgaccgactcggcggttaggatagttcatttacccacaggggtggtgtctgaatgccagcaggaacgctcccaactgaagaacaaggaattggccatgaccaagctgcgtgctaagttgtactcgatgcatctggaagaggagatcaataagcgccagaatgccagaaagatccaaattggcagtaaggggaggtccgagaagattaggacgtacaatttcccccagaatagggtgaccgatcatcgcatcaacaaaaccctgcatgatctcgaaacatttatgcagggcgactacctgcttgatgagttggttcagtccctgaaagagtacgcggactacgagagcttggtggagataataagccagaaagtctag

SEQ ID NO: 16312 - DNA, 483 bp, Artificial Sequence
  Description of Artificial Sequence: Synthetic coding sequence
atggaggcagagcggccccaggaggaggaagatggcgagcaaggcccacctcaggatgaagagggctggccgccgcccaattccacgacacgcccctggagaagcgcgccgccctcacctcccccgccgggaacgaggcacaccgcacttgggcccaggtcagccagcctcctcagtcttcaaactgagctgctactcgacctcgtagccgaggcacagtcccggcggctagaggaacaacgggccaccttttacacacctcaaaatccttctagtcttgctcccgcgcccttgagacctctggaggacagagagcagctttatagcactattctgtcccatcagtgccagcggatggaggcccagcgatcagaaccacccttaccccctggtggtcaagaacttttggagctgcttctgcgggtgcaaggtgggggaaggatggaggaacagcgtagtcgcccccccactcacacatgctag

SEQ ID NO: 16313 - DNA, 423 bp, Artificial Sequence
  Description of Artificial Sequence: Synthetic coding sequence
atgcagtttggtgagttgcttgcagctgtgcgcaaagcacaagccaatgtcatgttattccttgaagagaaggaacaagccgcgctctcacaggctaacggcatcaaggcacacttagaatacagatctgccgaaatggaaaagagcaaacaggaactggagactatggctgcaatctctaatactgtgcagtttttggagatgtgcatgaccagtcggtcaacacggacccagcataccagcatctccggttgtcgacggagaactgctcggagtccaactcctcgacccggctctatccccacaagaacctcccctgccggctcatgtaccggaggtagatgctgcccctcacgcgtgtgtacttgtaccggaactatcctgcgatggcgcagttcaggtcaggctccaatgctagcttag

SEQ ID NO: 16314 - DNA, 819 bp, Artificial Sequence
  Description of Artificial Sequence: Synthetic coding sequence
atggccagctccaatacagtgctaatgcggctcgtagcctctgcctacagcatcgcccaaaaggccggcatgatcgttcggcgagtaatagccgagggagacctgggcattgtcgagaaaacttgtgctactgacctgcaaactaaagcagatcgtctcgctcagatgtccatctgtagttcactggcacgcaagtttccaaagttgaccatcattggcgaagaactggtcgtgtgggtggaccctctagatggaacgaaagaatacaccgaagggcttcttgataatgtcacggtccttatcgggatagcatatgaagggaaagctatcgctggagtgatcaaccaaccttattacaattatgaggcagggcccgacgccgtgctcgggcgtactatctggggtgtgttaggcctgggcgctttcggattccagcttaaggaagttcccgcgggaaagcatatcatcacaacgacacgcagccattctaataagctggtgaccgactgcgttgctgccatgaatcccgacgctgtcctcagggtcggaggagctggaaacaagattatccagctgattgaggggaaagccagtgcgtacgttttcgcctccccaggctgcaagaagtgggatacatgtgctcccgaggtaattctgcacgctgtcggcgggaagctgactgacatccacgggaatgttcttcagtatcacaaggatgtgaaacacatgaactctgccggcgtcctggcaacactgcgcaactatgactattatgcctcgcgagtgcctgaaagcatcaagaacgccctggtcccttag

SEQ ID NO: 16315 - DNA, 606 bp, Artificial Sequence
  Description of Artificial Sequence: Synthetic coding sequence
atggaaagtaaccacaagagtggggacggtctgagcggtacccaaaaggaggccgctctgcgagccctcgtgcagcggaccggttattctttggtccaggagaatggccagcgtaaatatgggggacctccacccgggtgggatgccgcaccccctgaacgcggatgtgagatctttataggtaagttgcctagagaccttttcgaggacgagttaatcccattgtgcgaaaaaatagggaagatatacgagatgaggatgatgatggactttaatggaaacaatagaggctatgccttcgttacattctctaacaaagttgaagccaagaatgccataaaacagctaaacaactacgagatccgcaatggccgacttctgggggtttgtgctagtgttgacaactgcagactgttcgttggaggcatacctaaaacaaagaaacgggaagagatcctgtctgaaatgaagaaagtcaccgagggcgttgtggacgttattgtgtatccgtccgcagccgacaagaccaagaaccggggctttgccttcgttgaatatgagtctcacagagccgcggctatggccagacggaaacttctgccatag

SEQ ID NO: 16316 - DNA, 1905 bp, Artificial Sequence
  Description of Artificial Sequence: Synthetic coding sequence
atggctctgtccaagcgcgaactggatgaactaaagccatggatcgagaagaccgtgaagcgcgtgttgggcttctcagagccaactgtcgttacggctgcactgaattgcgtggggaagggcatggataaaaagaaagctgcagatcacctaaaacctttcttggacgattcgacactgcggtttgtagataagcttttcgaggccgtggaggagggacgatcctcacgacactccaagtctagcagtgacaggtctcgaaagcgggagttgaaaataaagcagatgatggaagccgcaacgcgccaaattgaagagagaaagaagcagctctcctttatctcaccccccaccccccagcctaaaacgccttcctctagccaaccagagagattaccaatcggcaataccatccaaccatcccaggcggctacattcatgaacgatgccattgagaaggctcgtaaagcggctgagctgcaggctcgaatacaggcacagctggcactcaagccaggtctgataggcaacgcgaatatggtcgggttggccaatcttcatgctatggggattgcaccgcctaaagtcgagctgaaggaccaaacaaaacctactcccctgattcttgatgagcaggggcgcacagtggacgcaaccggcaaggaaatcgagttgacccaccgaatgcccaccctcaaggccaacattcgggctgtgaaaagggaacagttcaagcaacagctaaaggaaaaacccagtgaggatatggaatcgaacactttcttcgatcccagggtcagcatcgcgcctagccagcgacagcgcaggacattcaaatttcatgataagggcaaatttgaaaaaattgcacagcggctcagaaccaaagcccagttggaaaagctccaggccgaaatttcccaggcagctcgcaagactggtattcatacgtccacgcgactggcgctcatcgcaccaaagaaggaactcaaggagggcgatattccggagatcgaatggtgggacagctatataattcctaacggatttgacctgactgaggaaaatcccaagagagaggactacttcggcatcaccaacctcgtggaacaccctgcacaactgaatcctcctgtcgataacgatacgcccgttactctcggagtgtatctcacgaagaaagagcagaaaaagctgcgtcgtcagactcgccgcgaggctcagaaggagctgcaggaaaaggtgcgcctcggtctaatgcctcctcctgagcccaaggtgagaattagcaacctgatgagagtattaggcacagaggctgtccaagatcccaccaaagtagaggctcacgtgcgcgcccagatggcaaagcgtcagaaagcgcacgaagaggccaacgcagcccggaaactgaccgctgaacagcgaaaagttaaaaaaatcaagaaactaaaggaagacatctcacagggcgttcacataagtgtgtacagagtaaggaacttatccaaccccgccaagaaattcaagatagaagccaatgcaggccagctgtatcttacgggcgtcgtggtgctgcacaaggacgtcaacgtagtagtagtcgaaggcggcccgaaggctcagaagaaatttaaaagattaatgctccatcgaattaaatgggacgagcagacaagtaatactaagggggatgatgatgaggagtccgatgaggaagcggtgaaaaaaaccaataaatgtgttctggtctgggaaggcaccgcgaaagatcggagctttggagaaatgaaattcaaacagtgccctactgaaaatatggctagagaacactttaaaaaacacggagcagaacattattgggacctcgctttgtccgagtcagtcctcgagagtactgactag

SEQ ID NO: 16317 - DNA, 3192 bp, Artificial Sequence
  Description of Artificial Sequence: Synthetic coding sequence
atgccacatctgcctctagcatctttccgccccccattctggggcctgcgccacagtcgcgggctgccccggttccacagcgtgagcacccagagtgagccacacggctctcccatctcccggcgcaacagggaagccaagcagaaaagactccgcgaaaaacaggccactcttgaagctgagatcgccggtgagtctaaatcaccagccgaaagcatcaaagcttggaggccgaaagagctggttctctacgagattccaaccaaaccaggtgagaaaaaggacgttagcgggcctctacctccagcctattctccacgatacgtggaggcggcctggtatccctggtgggtgagagaggggtttttcaaacctgaatatcaggcccggctcccccaagcaactggggagacctttagtatgtgtatcccacctcctaacgtcaccggttccctccacattgggcacgcgctgacagtcgcgatccaggatgccttagtgcgatggcataggatgcggggcgatcaggttctatgggtgcctggtagcgaccacgcaggaattgccacacaagctgtcgtggaaaagcagctttggaaagagaggggagtgagacggcacgaactgtccagagaggccttcctgagagaggtgtggcagtggaaagaggctaagggaggggagatctgtgagcagctgagggccctaggggcttctcttgactgggacagagaatgttttactatggacgtgggcagttcagtcgccgtaactgaagcatttgttcgcctctacaaagcgggtcttctttatcgaaatcaccagctggtaaattggagctgcgctctgcgtagtgccatctccgatatcgaggtggagaataggcccctgcctggacacacccagctacgactgcccgggtgccccacacctgtctcttttggattactgttttcagtggcgtttcccgtcgatggggagcctgatgctgaggtcgtcgtgggtacaactcgccccgagaccctgcctggtgacgtggcagtggctgtccatccagatgattctagatacactcatctacacggccgacagcttcggcatcctcttatgggacaacccctacccctgattactgactacgcagtccagccccatgtgggtaccggcgcagtcaaagtgactcctgcccactccccagccgatgctgagatgggggctagacacgggctaagtcctcttaacgtgatcgccgaggacgggactatgactagtctctgtggcgactggcttcagggcctgcacagattcgtggccagggagaagattatgtctgtgctctctgagtggggactgttcagagggttacaaaatcatcccatggtactgcccatctgctccaggtcaggcgacgtgatcgaatatctactgaagaaccagtggtttgttcggtgtcaggagatgggtgcccgggccgctaaggctgtggagagcggagctttggaactgagtccctcattccaccagaagaactggcagcattggttcagtcatatcggagactggtgcgtatccaggcaactgtggtgggggcaccaaatcccagcatatctggtggtggaggaccatgctcaaggcgaggaagactgttgggtcgtgggacgttctgaagccgaggctagggaagtcgcggcggagctaaccggacgcccaggtgccgagctgacactggagcgggaccccgacgtgctggacacttggttctcatcggcactttttccattttccgcgttgggatggccccaggaaacaccagacctggcgaggttttacccgttgtccctcctcgagaccggatccgacctcctgctgttctgggtcggacgaatggtgatgttaggaacccagctgactggtcagcttccattctctaaagtgctgttacaccccatggtgcgcgaccggcaaggcagaaagatgagcaaatctttgggaaacgttctggacccccgcgatatcatctctggcgtggaaatgcaggtgctccaggaaaaattacgctccggcaatctggaccctgctgaactggccatcgtagccgcagcccaaaagaaggacttcccacacggcatccccgaatgcggcaccgacgcgttacgttttaccctctgttcccacggtgtgcaggcaggagatctgcacctttctgtgtctgaggttcagagctgccgccatttttgtaataagatctggaatgcccttcgattcatcctgaatgctcttggtgaaaagttcgtgccgcagcccgcagaagagttgtccccctcttcccctatggacgcttggattctctcgagactggcgttggccgcacaggagtgcgaacgcggtttcttaaccagggaattaagccttgtgacccatgccttgcaccacttctggctccataatctgtgcgatgtctatctggaagccgtcaaacccgtgctctggcattcccctcgccctctgggaccgccccaggtgttattctcgtgcgctgacctgggcctgaggctcctcgctccccttatgccatttctcgctgaggaattatggcaacgcctgccccctcgccctggctgtcctcccgccccctctatcagtgtcgcgccttaccctagtgcatgtagtctggaacactggcggcagccagagttggagcggaggttttcccgcgtgcaggaagtagttcaggtgcttcgggctttgagggccacgtatcaactgactaaggcccggccacgtgtcctgctgcagagcagcgaacctggtgaccagggtctttttgaagccttccttgagcctctaggaactctgggctattgcggagcagttggtctgctaccgccaggcgcagctgccccatccgggtgggcacaggcccccttgtctgacacggcccaggtttatatggagttgcagggtctggtagatccacaaatccagcttccactgctagcggctcgaaggtacaagttacagaaacaactggattccttgacggcccgtaccccctccgagggtgaagctggtactcagcgtcagcagaagttgtcctctctacagctggagctcagcaagctagacaaagctgcgagccaccttcgccagctcatggatgagccaccagccccaggatctccagaactctag

SEQ ID NO: 16318 - DNA, 2118 bp, Artificial Sequence
  Description of Artificial Sequence: Synthetic coding sequence
atgatcgacagcgtgaagttgcgacgcgatagtgcagctgacttttttagtcactatgaatatctgtgtgccctacagaatagtgtgcccctgccagccgtgagagcctgtcttcgtgaaggcgtcctcgactttaatgcagatcggctgcggggggttgattgggccccattactgtctaccctaaagataaataaggatctcccactggtgtcaatcaaatccttctttcagccctggctgggcgacacgggatctgacatgaacaagttttgcagatctcgcgttcctgccatacggtacaaggatgttactttccagttgtgtaaagccctcaagggttgcctgtcaatcagcagcgttttaaaaaacctggagctgaacgggctcatactcagggaacgggacctaactatcctggctaaaggcctgaataaaagtgcatctctggttcacctctcactcgcaaattgcccaatcggcgacggaggcctggaaatcatatgccagggcataaagagcagcatcacccttaaaacagtgaacttcaccggatgtaacctgacctggcagggtgcagatcatatggccaaaatactgaagtaccaaacgatgagacgtcatgaagaaacctgggcagagagtctgcgttaccggagaccagaccttgattgtatggctggactgcgaagaatcacactgaactgcaacaccctcatcggggaccttggggcatgcgcattcgccgactcactatcagaggacctgtggctccgtgccctcgacctgcaacagtgcggcctgacaaatgagggtgctaaagcactactggaagctcttgagacgaataccaccctggttgtcctggacattagaaaaaacccactgattgaccactctatgatgaaggccgttataaagaaggttcttcagaacggccggtccgctaaatcagaataccaatggatcacatctccctctgttaaggagcctagtaagactgcgaagcagaagagaaggaccatcattttgggatccggacacaagggcaaggccacaatccgcatcgggctggcgacaaaaaagcctgtttcaagcggtcgtaagcacagtttggggaaggaatattatgcaccagctcctctgccgccaggagttagtggttttctgccatggagaacagctgagagagccaaacgtcacaggggattccccttgatcaaaacgagggacatttgtaaccagctgcaacaaccggggttccccgtgaccgtgaccgtagaatcaccctcatcaagtgaggtcgaagaggtcgacgactcctctgaaagcgtgcacgaggttcccgagaaaacgagtattgagcaggaagcattacaggagaagctcgaagagtgtctgaaacagttaaaagaggagcgggtaattcgcctgaaagtggataagcgcgtcagtgaactggagcatgagaatgcccaactcagaaacatcaacttttcactgtcagaggcgctacatgcccagagcttaactaacatgatcctggacgatgagggggtgctgggctctatcgaaaattcttttcaaaaattccacgcgtttctcgaccttttgaaggacgccggccttggccagctggccactatggcggggatagatcagagcgatttccagctcctgggacaccctcaaatgacctccaccgtctctaaccctccgaaggaagagaagaaagccctggaggacgaaaagcctgagcctaagcaaaatgctctggggcaaatgcaaaatatccaggtttctatatgcatgcagagcgcctacaatgagggaacactgatgaagttccagaagatcaccggagacgcccgaatcccgcttcctttagacagctttcctgtaccggttagcaccccagaaggactgggaacctccagtaataatttgggtgtccctgctactgaacagcgacaagagtccttcgaaggcttcatcgccagaatgtgctcaccttccccagacgccactagcggaacagggagtcaacggaaggaagaagagttgtcacggaactccaggagcagtagtgagaagaagacaaaaacgggaagtcattag

SEQ ID NO: 16319 - DNA, 1287 bp, Artificial Sequence
  Description of Artificial Sequence: Synthetic coding sequence
atggcctggcagtcccggaagggtggccattttcgagaagtggctatgcaatggaaggtgacgctcactagcaggtgggggttattgagacattgtcaggtgctggctggcctgctgcatctgggcaacatccaattcgcagcctcagaggatgaggcccagccatgtcagcccatggatgacgcaaagtactctgtgaggactgccgcgagccttttgggcttaccagaggacgtgctgttagagatggtccagatacgcacaatccgggctggccgtcagcagcaggtctttcgcaagccatgcgcccgagcagagtgcgatacccgacgcgactgcctagccaagctgatctatgccagactgttcgactggctggtctccgtcattaatagcagcatttgtgccgacacagatagctggactacatttattgggctgctggacgtctacggttttgagtcattccccgacaatagtttagaacagctttgcatcaattatgcaaatgaaaagttacagcaacacttcgtggctcactatttgagggctcagcaggaggagtacgcagttgaaggcctggagtggtcattcataaattaccaagacaaccagccatgcctggatctaatcgagggctcgccgatcagtatttgttccttgattaatgaagaatgccgtctgaatcgaccgagttctgccgcgcagcttcaaacacgcattgagacagcgcttgcaggctctccttgcttggggcacaataaacttagtagagagccgtcatttattgtcgttcactacgcgggacccgtccggtatcacacagcagggctggtggagaaaaataaggaccctattccaccggaactagacggtgtggaggagaagcatttcagccaagcaccctgtagtctgagcacctcccctctgcaaactagattgctcgaagctattatacgtctttggcccctcggcctagtcttggctaatactgctatgggggtcggctcttttcagaggaaactggtagtctgggcttgccttcaactgcctagaggcagtccaagcagctacactgtccagactgcccaggatcaggcaggtgtgacatccattcgtgcgctgccacagggatccataaagtttcactgtagaaagtccccactgagatacgcagatatctgcccagaaccctctccatacagtattaccggcttcaatcagatcctgctcgaacgccacaggctgatacatgtgacgtcgagcgcattcaccggacttggttag

SEQ ID NO: 16320 - DNA, 927 bp, Artificial Sequence
  Description of Artificial Sequence: Synthetic coding sequence
atgaatccaatcgtagttgtacatggcggaggggcgggtcccatctcaaaggatcggaaggagagagttcatcaaggcatggtcagggcagcgacagttggatatggaattctgagagagggggggagcgcggtcgacgctgtggaaggcgcagtggttgcactcgaggacgaccccgaatttaacgctggatgcggttctgtgttaaacactaacggggaagtagaaatggacgctagcataatggatggcaaggatctctctgcaggagcggtgtctgccgtgcagtgtattgctaacccaattaagttggccaggctcgtgatggagaagacccctcactgctttttgacggaccagggggctgcgcagttcgccgcagccatgggtgttcccgagatacctggagaaaagctggtgacagagcggaacaagaagcggcttgagaaagaaaaacatgagaaaggcgcgcaaaaaaccgactgccagaagaatctggggacagtaggcgcagtagccctagactgcaaggggaatgtggcatatgcaacatcaaccggtgggatcgtcaacaaaatggtggggcgggtcggcgactcgccttgcctgggtgctggcggatacgcagataatgatatcggcgctgtgtccacaacgggtcacggcgagagtatacttaaggtgaatctcgctagactgacccttttccacatagagcaaggcaagacagtggaggaagccgccgacctgtcccttgggtatatgaagtctagagtgaaagggctaggaggactgattgtggtgtccaagaccggggactgggtggcgaagtggacatcaacctcaatgccatgggctgccgccaaggatggcaagctgcattttgggatcgatccagacgacacaaccattaccgatctgccttag

SEQ ID NO: 16321 - DNA, 429 bp, Artificial Sequence
  Description of Artificial Sequence: Synthetic coding sequence
atgagcctgcatgggaaacggaaggaaatttacaagtacgaggccccttggacagtttacgctatgaattggagtgttaggccggacaaacgctttcggttagctttaggctcctttgtggaggagtataataataaagtcgtcatactggatgtgcgagtgccttgtacacctgttgcccgcctcaacaaccaccgagcctgcgttaatgggattgcctgggccccacacagctcctgtcatatttgcaccgctgccgatgaccatcaagccctgatatgggacatccaacagatgccccgagctatcgaagatcccattttggcctacactgccgagggcgagattaataacgtgcagtgggcctctacacagcctgactggattgccatctgctacaataactgcctggaaattctgcgagtgtag

SEQ ID NO: 16322 - DNA, 1233 bp, Artificial Sequence
  Description of Artificial Sequence: Synthetic coding sequence
atggccgcacccagcccttcaggaggtggaggcagcggcggaggatccgggagcggaacacctggccccgtgggctccccagctcccgggcaccctgccgtctcctctatgcagggattccagataaacttctgcgaaaaggcccagtcaaagcgaaaagccctcaagctaaactttgctaatcccccattcaagagcaccgccagatttactctgaaccctaatcctaccggtgtccagaatccacacatcgagagactccggactcacagcatagaaagtagtggaaagttaaagatttcacccgagcaacactgggattttaccgcagaagacctcaaggaccttggtgaaattggacggggcgcatacggcagtgtgaacaagatggtccataagccttctgggcaaattatggccgtgaagcgaatacgctcaactgtggatgagaaggagcaaaaacaactgttgatggatttagacgtggtgatgcgcagtagcgattgtccttacattgtgcagttctacggggcgctcttcagagagggcgactgttggatctgcatggagctaatgtctacttcctttgataaattttataaatacgtctacagcgtgctagatgacgtcatccccgaggagattctggggaagattacactggctacagttaaggccctcaaccacttgaaagaaaacctaaaaattatccacagggacattaagccttccaacattctactggatcgaagtggaaacattaaactttgcgatttcggcatatctggacagttggttgactctattgcaaaaactagggatgctggatgccggccatatatggcccccgagagaattgatccatctgcatcccgccagggctacgacgtgaggtcagacgtctggtccctcgggatcacactgtatgaactggctaccggtcgcttcccctaccccaagtggaacagcgtttttgatcaattgacccaggttgtcaagggagatccaccccagctgagcaacagcgaagaacgtgagttctctcccagttttatcaacttcgttaacctttgcttgacaaaggacgagtcaaagcgtcctaagtataaggagctgttgaagcacccatttatcctgatgtatgaggagagggcagtagaagtggcgtgctacgtatgtaagattctggatcagatgcctgccacaccatcaagcccgatgtacgtggattag

SEQ ID NO: 16323 - DNA, 687 bp, Artificial Sequence
  Description of Artificial Sequence: Synthetic coding sequence
atgcagctagctgtagtctctgaagaacaggaccagaacttgaatcgtttaatctgctggatccttatgcagttcatctatatctcttccgactacgtattcgacggcactaatccaccgtatcgggaagaggacattcctgcacccttgaacctttatggcaaaactaaattggatggagaaaaggccgtgctcgagaacaaccttggagcagctgtcctccgcattccaatcctgtacggggaggtggaaaagctggaggaatccgccgtgaccgtcatgttcgacaaggttcagttcagtaacaagtccgcaaatatggaccactggcagcaaagattccctacacacgtaaaagacgtggcaacagtttgccgacagctcgctgaaaaaaggatgctcgatccatccataaagggtacctttcactggtctgggaacgaacagatgactaagtatgaaatggcttgcgctattgctgatgccttcaatctgcctagctcgcatctgcgtcctatcacggacagtccagtgttaggcgctcagcggccacgtaatgcccagctcgactgctctaagctggagactctcggaattgggcagagaacccctttcaggattggtattaaagagtccctgtggccttttttaattgacaaacgatggcggcagacagtgtttcattag

SEQ ID NO: 16324 - DNA, 1101 bp, Artificial Sequence
  Description of Artificial Sequence: Synthetic coding sequence
atgagcgccgccaatccggagacacctaatagcacgatctcacgagaagcgtctacccaatctagcagtgcagctgcctcccagggatgggtcctgcccgagggaaagattgtccctaatacagtgttcgtaggcggcattgatgcacgaatggacgaaaccgaaattggatcatgctttggcaggtacggatccgtaaaagaagtaaagatcattacaaatcgaaccggcgtctccaagggatacgggttcgtaagcttcgtgaacgatgtcgatgtccagaagatagttggatcccagatccactttcatggcaagaaattaaagttggggcctgcgatccgcaaacagaagctctgtgcacggcacgtccagccccgccccctggttgtaaatccgcccccgcccccacagtttcagaacgtgtggcgaaaccctaacacagaaacatacctgcagcctcagatcacgcccaatccagtcacccagcatgtccaggcttatagtgcttacccccacagtccggggcaggtcatcactggctgtcaactactggtgtataactaccaggagtaccccacttaccctgatagcgcatttcaggttaccaccggttatcagttgcccgtctataattatcagcctttccctgcttacccgagttctccctttcaggtcacagccgggtatcagttacccgtgtataactatcaggcttttcctgcctatccttcaagcccatttcaagtaacaaccggataccagctgccagtatataactatcaggcctttccagcttatcctagttcacccttccaggtcactaccggatatcagcttcctgtgtataactatcaagccttccccgcctacccatcatcaccattccaggtcactaccggttaccagctgcctgtatataactatcaggcttttccggcataccccaacagtgcggtgcaggtgacgaccggctaccaattccatgtgtacaattatcaaatgcctcctcaatgccccgtgggagagcagcgcaggaacctctggactgaggcttacaagtggtggtacttagtgtgcctgatccagaggagggactag

SEQ ID NO: 16325 - DNA, 306 bp, Artificial Sequence
  Description of Artificial Sequence: Synthetic coding sequence
atggctagcgcaggcacgcaacattactccatcggattgagacagaaaaactccttcaaacaaagcgggcctagcggaacggtaccagccacacctcctgaaaagccaagcgagggacgggtttggcctcaagcccatcaacaggtaaagcccatctggaagcttgagaagaagcaggtcgagacgctcagcgcaggcctcggacctggactgctgggtgtccctccgcagcctgcatactttttttgcccttcaactctctgtagcagcggaacgacagccgtaatcgcaggtcactcgagctag

SEQ ID NO: 16326 - DNA, 2121 bp, Artificial Sequence
  Description of Artificial Sequence: Synthetic coding sequence
atgatagattcagtgaaactccgccgggattctgccgctgacttctttagccactacgagtacctgtgtgctctgcagaattctgtccctttgccagctgttcgggcttgcctccgggagggggttctggactttaatgccgaccgacttcggggcgtggattgggctccgttgcttagcaccctaaaaattaacaaggatctgccactggtctccatcaagtcattctttcagccctggttgggggatacagggtcagatatgaataagttctgtcgctctcgagtgccagccatccgttacaaggacgttaccttccagctctgtaaggccctgaagggctgcttatcaataagctcagtgcttaaaaatctggaactcaacgggctcatcctcagggagagggatctgaccatcctggccaagggacttaataaaagcgcttctctggtgcacctttctctggcgaactgtccaatcggagacgggggcctagagattatttgccaggggatcaaaagttcaatcacccttaagacagttaacttcaccggctgcaacctaacttggcagggggccgatcacatggccaagattctcaagtatcagactatgcgcaggcacgaggagacttgggcggagagtttacgatatcgaaggcccgacctggactgtatggcaggcctccgccggataacgttgaactgtaatactctgattggggatctgggagcctgtgccttcgctgacagtctgagcgaggacttgtggctgagggcattggacctgcagcagtgcggacttacaaacgagggagccaaagccctcctggaagctcttgagacaaataccacactggtagtgcttgatatccgcaaaaatccattgatcgaccatagcatgatgaaggccgtgattaagaaggtcctgcaaaatgggcgatccgccaaatccgaatatcagtggattacatcgcccagcgtcaaagaaccttccaagacagccaaacagaagcgaagaacaattattctcggctccgggcacaaggggaaggctacaattaggatcgtaggtttggccaccaaaaagccggtgagtagtggtaggaaacacagtctcggaaaggagtactatgctcccgcaccactccccccaggagtgagtgggtttctgccgtggcgtactgccgaacgggccaaacggcaccggggttttcccctaattaaaactcgggacatttgtaaccagctgcagcaaccaggctttccggtaacggtgacagtggaaagcccttcgtcttctgaggtggaagaggtcgacgacagtagcgagagtgtgcacgaagtccctgagaagacatctatagagcaagaggctctccaggagaagctggaagaatgtttaaaacagcttaaagaagagcgcgtgatacgactgaaggtcgacaaaagagtgagtgagcttgaacatgagaacgcgcagcttcggaacatcaattttagtctgtcagaggcgcttcatgcccaatcgctaacgaatatgatcctggacgatgagggtgtattaggaagcatcgagaatagtttccagaagtttcacgcttttttagacctcctcaaagatgcaggactcggccaattggccacgatggccggtattgaccagtcagactttcaacttcttggccacccccagatgacttcaaccgtgagcaatccccccaaagaggaaaagaaagctctggaggatgagaagccagagcctaaacagaatgctctcggccagatgcagaacatccaattccaaaagatcactggagatgccaggattcctctcccactcgactcctttccggtgccagtgagcaccccagaaggtctcggaaccagctctaataacttaggcgtccctgcgacagaacagcgacaggagagtttcgaaggatttattgcgaggatgtgtagcccaagtcctgatgccacttctggtaccggcagccagcggaaggaagaggaactgtcaaggaactcaaggtccagttccgagaaaaaaacaaaaacgggagagtacaccaagaaacatagcgacaaacagcaccccgggaaggatctgcacagttag

SEQ ID NO: 16327 - DNA, 1932 bp, Artificial Sequence
  Description of Artificial Sequence: Synthetic coding sequence
atggcttgtcaacagtcccgatatcactcattttcaagcgcctccaggctgcaaccaaggccaagtggtgtgaccatagacgaaagtttcttaacggaagacaagtctacacagaacaggaagctgctacagaaacgacgtactttagaactgcctgccgcacccttgtctcactgtcaggcccccgtgctgggaggtaccgggaaattacctacacagggcgccccaccggccggaccaggccataggttccatcctggcacaaaagcagccgctcatcagcgcgagaagataagagccctcgaaccccttaaggcaaagctcgtgactgttaacgaggattgtaatgagcggattctcgccatgagagctgaggaaaagtatgagatcagccttcttaaaaaggagaaaatgaacctgctgaaacttatcgacaagaaaaacgaagaaaagattagtctgcaatctgaagttaccaagctgcggaagaacctcgccgaggaataccttcactacctgtctgagagagatgcctgcaagatactgatcgcagatttgaatgaactgcgttatcagcgcgaagacatgtccttggcccagagccccggtatctggggagaggacccagtgaaattgacccttgcactgaagatgaccagacaagacctcacccgaacccagatggagctgaataacatgaaagcgaactttggtgacgtggtcccccgccgggatttcgagatgcaggaaaagaccaataaggatttacaggagcagcttgacacactcagggcgtcttacgaggaggtgagaaaagagcatgagattctgatgcagctgcacatgagcaccttgaaagaacgggatcagtttttcagcgaattgcaggaaatccagcgtacaagtacgccccggccagattggacaaaatgtaaagatgtagtggctggaggccctgaaaggtggcagatgctggcagagggtaagaacagtgaccagttggtcgacgttctgttagaggagattggatccggattgttacgggagaaggactttttcccaggccttgggtacggagaggccatccccgcattcctgaggtttgatggacttgtcgagaacaagaagccatccaagaaagacgtggtgaacctacttaaggacgcctggaaagaacgtcttgcagaagaacagaaagagacattccctgactttttctttaattttctggagcaccggttcggcccctccgacgctatggcctgggcctacaccattttcgaaaatattaaaatctttcattccaacgaggtgatgtctcagttctatgcagtgctcatggggaagaggtccgagaatgtctatgtgactcagaaggagacggttgcgcaactgcttaaagagatgactaacgccgacagtcagaatgagggcctgcttaccatggaacagttcaatacagtgctcaagagcaccttcccattgaaaaccgaggagcagatacaggagctcatggaggccgggggttggcatccctctagttccaacgccgacctgctgaactaccgttcactctttatggaagatgaggaaggacagagcgagccattcgtccagaaactctgggaacagtacatggacgaaaaggatgagtacttgcagcagcttaagcaggaactgggtatcgaattgcacgaagaggttactctgcctaagctccgaggaggcttgatgacaatcgacccaagcctggacaagcagaccgtgaatacttacatgtcacaggcttttcagctgcctgagtccgaaatgccggaggaaggcgacgagaaagaagaagccgttgtggaaatactgcagacagctttggagcggctacaggtgattgatatccggcgtgtggggccacgcgagcctgagccagcctcatag

SEQ ID NO: 16328 - DNA, 474 bp, Artificial Sequence
  Description of Artificial Sequence: Synthetic coding sequence
atggccaccagcgccccactccggtcactggaagaggaggtcacctgtagtatttgtttagattacctgagggatcctgtgacaattgattgcggtcatgtgttttgccgatcctgtactacagatgtcaggccgatctctggctccagacctgtctgtccgctgtgcaagaaaccattcaagaaggaaaacattagaccggtctggcagcttgccagcctggtggaaaacattgagcgattaaaagttgataagggccgacagcctggggaggtcacacgagagcagcaggacgctaaactttgtgaacggcacagggagaaactacattactattgtgaagatgacggcaagcttttatgcgtcatgtgccgcgagtctcgcgaacacagacctcacacggccgtgcttatggagaaggctgctcagccccacagagaaaagatcctcaatcatctgtcaaccttacgctag

SEQ ID NO: 16329 - DNA, 939 bp, Artificial Sequence
  Description of Artificial Sequence: Synthetic coding sequence
atggcccagccctaccctcctgctcagtatccccctccaccacagaacggcatcccagctgagtacgctcctccccctcctcaccccacacaggattattcaggccagacccctgttcctaccgagcacggtatgacgctctacactcctgcccaaacacacccagagcagcctggctctgaggctagcactcaacctatagcaggtactcagaccgtaccccagacagacgaagctgctcaaacggattcccagccactacacccatctgacccaacagagaagcagcagcctaagcggttgcacgtgagtaacattccattcagattccgagacccagacctgcgtcagatgttcgggcaatttggaaagatacttgatgtggagattattttcaatgaacgaggctcgaaagggttcgggtttgtgacgtttgagacctccagtgatgctgatcgcgcaagggaaaagctgaatggcacaatcgtggaaggccgcaaaatagaagtgaataacgccacagccagagtgatgacgaacaaaaagactggcaatccttacactaacggttggaagctgaatcccgtggtcggcgccgtatacggtccagaattttacgccgtcacgggctttccttacccaacaacagggactgcagtcgcttatagaggtgctcatcttcggggccgcggaagagcagtatataatacgtttagggccgctccccccccgcccccgattcccacttatggcgccgttgtgtaccaggacggattctatggcgcggagatatacggcggctatgccgcgtacagatacgcccaacctgcggccgccgcagcagcttacagcgattcatatggccgggtctatgcggcggccgacccctaccatcatacaataggcccagctgccacttattctattggaacaatgtag

SEQ ID NO: 16330 - DNA, 300 bp, Artificial Sequence
  Description of Artificial Sequence: Synthetic coding sequence
atggcttctcttctacaagaccagctcactaccgaccaggatctgctcctgatgcaggagggaatgcccatgcggaaggtcaggtccaaatcctggaagaagttgcgctatttccggttacagaacgatgggatgaccgtctggcacgcgagacaagccaggggatcggcgaaaccctctttttccatcagtgatgtggagacaattcggaacggccacgattccgagctgcttcgcagcctagctgaggagttgcccctcgagcaggggttcaccatcgttttccacggtaggcggtag

SEQ ID NO: 16331 - DNA, 1620 bp, Artificial Sequence
  Description of Artificial Sequence: Synthetic coding sequence
atggccacctcagctccccttcgctctctagaggaggaagtgacttgttctatttgtctagattatctcagagatcctgtaactattgattgtggtcatgtgttctgcaggtcatgcacgaccgatgtcagacctattagcgggagccgccccgtgtgcccactctgcaaaaagccttttaaaaaggagaatatcagacctgtgtggcaactagctagccttgtcgaaaacatcgagcggctcaaggtcgacaaaggccgccaacccggcgaagtgacaagagaacaacaagacgccaagttgtgcgagcggcatcgggagaaactgcactattactgtgaggatgatggcaaactgctttgtgtgatgtgtagagagtctcgggagcaccgccctcacaccgcagtgctgatggagaaagcagcacagcctcatcgagagaagattttaaatcatctctctaccttgcgtagagatcgagacaaaattcagggcttccaagcaaagggggaagcagacatcttagccgccttgaaaaaactgcaagaccagcgacagtacatagtagccgaatttgaacagggacatcagttcctgagagagcgtgaagaacacctacttgaacaactggcgaagctcgagcaggaactgaccgaaggcagggagaagttcaagagccgaggcgttggagaacttgccaggttggccctggtaattagcgagctcgagggcaaggcacagcagccggcggctgaacttatgcaggacacgcgagatttcttgaataggtatcctaggaaaaaattttgggtgggaaaacctatcgcaagggtagtgaaaaagaaaaccggcgagttttctgataagctcttgagcctccagagaggcctgagggaattccaggggaagctgctaagggatctcgaatacaaaacagtcagcgtgaccctggatccgcagagtgcgagtggctacctacagctatctgaggattggaagtgtgtcacctacaccagcttgtataaaagcgcctaccttcatcctcagcagttcgattgtgagcccggcgtcttagggtccaagggatttacctggggcaaagtctattgggaggtcgaggtggaacgggaggggtggtcagaggacgaagaagagggggatgaagaggaagagggcgaagaggaggaagaggaagaggaggcagggtacggcgatgggtatgatgattgggaaacagacgaagacgaggagtctttaggcgatgaggaggaagaggaggaggaggaagaagaagaggtgctcgagagctgcatggtgggtgtggccagagacagtgtgaagagaaaaggcgatctttcccttcgccctgaagatggcgtatgggccctccgcctaagctccagcggcatctgggcaaatacatcaccagaggcagaactttttcctgccttgaggccccgacgagtgggcatcgccctggactacgaaggtggcactgtgacattcaccaatgctgagtcacaggagctgatttacacctttaccgcgacattcacgagacgactggtgcccttcctatggctgaagtggccaggcaccagactcttgctgcggccatag

SEQ ID NO: 16332 - DNA, 480 bp, Artificial Sequence
  Description of Artificial Sequence: Synthetic coding sequence
atggctactagcgccccactgagatcactggaggaggaggttacgtgctcaatctgtctggactaccttagagatcccgtaaccatagactgcgggcacgttttttgcaggtcgtgcacgaccgacgtcaggcccatctctgggtctagacctgtgtgtccactgtgcaaaaagccattcaagaaggagaacatacgccccgtgtggcagcttgagaagattctcaaccatcttagtacgctaaggcgggacagagataagattcaggggtttcaagctaaaggggaggctgacattctggctgccctcaaaaagctgcaggatcagcggcagtacatagtcgccgagtttgaacagggtcaccagtttcttcgcgaacgcgaggaacatttacttgaacaactggccaagcttgaacaggagctgacagagggtcgggagaagtttaagtcaagaggtgtgggcgaattagccagatag

SEQ ID NO: 16333 - DNA, 579 bp, Artificial Sequence
  Description of Artificial Sequence: Synthetic coding sequence
atgggaaaaggctgcaaagtggtagtctgtggactgctgtcagttggaaaaaccgcaattcttgaacagctgctgtacgggaaccatactatcggaatggaggactgtgaaaccatggaggatgtgtacatggccagtgtcgagaccgaccgtggggttaaggaacagctgcacctctatgatacccgaggcctgcaggaaggagtagagcttcctaagcactacttttccttcgcagatggcttcgtgcttgtgtacagcgtgaacaatctggaatccttccagagggtggagttactgaaaaaagagattgataaattcaaagataagaaggaggtggccatcgtcgttttaggaaacaagatcgacttgtcagagcagcggcaggtggatgccgaggtagcacagcagtgggctaaatcggaaaaggtgagactgtgggaggtgacagtgacagacaggaagacgctaatcgagccattcacattactcgcatcaaaactaagtcaaccccaaagcaagagctcattcccccttcctggacgcaagaataagggtaacagtaatagcgagaattag

SEQ ID NO: 16334 - DNA, 309 bp, Artificial Sequence
  Description of Artificial Sequence: Synthetic coding sequence
atgcataatcgaagtcagggatttttttttagctcctgtcatccacagaaccatgttagttacggctgtcagagtcccagcttcattttttgtcgatgtcagtcgctgaatttcgtgagtcgaacctgttacccactgtcctactttagctacgggaatcagacaattggctctattagcaatagctttcggagcctgaactacgtgtcacacagttttcagcctatctcttttatgcatagctcttttcagccagcttgtagtgactttgtcggatggcagtcaccctttctcaggagaacctgctag

SEQ ID NO: 16335 - DNA, 723 bp, Artificial Sequence
  Description of Artificial Sequence: Synthetic coding sequence
atggatttagtgaggctggggctggagcgtggtgaaactgctaaggaagccctcgatgtgatcgtgtccctcctggaagagcatggccagggaggtaattatttcgaagatgctaactcttgccactcttttcagtctgcctacctgattgtggaccgcgacgaggcttgggtgcttgagactatcggaaagtattgggccgccgagaaagtgaccgagtcaatcactgtgcagactatgatgaatacactgcgggacaaggcttctggggtttgtatcgacagcgagttttttttaactacggcttccggtgtttctgtgctaccacagaaccgatcttccccttgcatacactattttactggcacacccgacccgtcccgttctatctttaagccctttattttcgtggatgatgttaaacttgtgcccaaaacgcagagcccttgctttggggatgatgatcccgccaagaaggagccaagatttcaggaaaagcccgatagacggcacgaattgtataaagctcacgagtgggcccgtgctattatagaatccgatcaggagcagggcaggaagcttcgatctacaatgcttgaactagaaaagcaggggttagaggcaatggaagaaattctgacttcgtctgaacccctagatccagccgaggtgggggatttattttatgactgcgtagataccgagatcaaattcttcaagtag

SEQ ID NO: 16336 - DNA, 900 bp, Artificial Sequence
  Description of Artificial Sequence: Synthetic coding sequence
tgaagagaagaggacatttatcaatttgcttactgttatccatacacatacacgcgctttcagcactatctggactccctgcaaaagcggaatatggactactttttccgcgagcagctggggcagtccgtccaacagagaaagctcgatcttctgaccatcacttcaccagacaacctgagggagggggccgagcagaaagtggtgttcatcacgggcagggtgcaccccggcgagacccccagcagcttcgtgtgtcagggcattattgactttctagtgtcccaacatccaatcgcatgcgtgttgcgtgagtaccttgtcttcaagatagctcccatgttaaatccagatggagtgtatctcgggaactatagatgcagcctgatgggtttcgaccttaataggcactggctcgaccctagcccctgggtccacccaacccttcacggagtaaagcagttgatcgttcaaatgtataacgatcccaagacatcactcgagttctacatcgatattcatgcccactccacaatgatgaacggtttcatgtatggaaatattttcgaagacgaagagcgcttccaacgccaagctattttcccaaagctactttgccagaacgccgaggacttctcctactcaagtacttcttttaatcgggatgcagtaaaggccggaaccggcaggcgcttcctgggcggcctcctggaccacactagttactgctacacacttgaagtgtctttctactcttatattatcagcggaaccaccgctgccgtcccgtatacagaagaggcttgcatcctgagccctcacccagccctagggcagccttcctcctcacgcgagtacccgtcactgactggacaggaattgggaccccagctgcgctag

SEQ ID NO: 16337 - DNA, 1041 bp, Artificial Sequence
  Description of Artificial Sequence: Synthetic coding sequence
atggccgccgctgagcccgcttcctccggtcagcaagcccccgcggggcagggccaggggcaacggccaccaccccaacctccccaggcccaggcgccgcagccacccccacccccacagctggggggggctgggggtgggtctagcagacatgagaagagcctgggcctccttaccactaaattcgtgagtctgcttcaggaggccaaggatggagtgctagatttgaaagctgcggccgatactttagcagttcggcagaagcggcgtatctatgacattacaaatgtactcgagggaatcgacttaatcgaaaagaaatccaaaaattccattcaatggaaaggggtcggtgccggctgtaacaccaaggaggtcattgaccgtctgcgatacctcaaggccgagattgaagacctggagctgaaggagagggaactggaccagcagaaactatggctgcagcagtccataaaaaacgtgatggatgattcaatcaataacaggttctcctacgttacacacgaagatatttgcaattgctttaacggcgacacccttttggccattcaggcccccagcgggactcagctggaagttcctattcctgagatggggcaaaatggccagaagaagtaccagattaatctcaagtcgcattctggcccaatccatgtcttactgatcaacaaggaatctagctcaagtaagcctgttgtctttccagtgcccccgccggacgatctgactcagcctagctctcaaagcttaacacctgttactccccaaaagtcgtccatggcaacacagaacttaccagagcaacacgtctccgaaaggagccaggccctccagcagacatccgcaaccgacataagcagcgccggctcgatcagcggagatataatcgatgagcttatgtctagcgacgtgtttcccctgctgcgtctgagcccaactcccgccgatgactacaattttaatctggatgacaacgagggtgtgtgcgatctcttcgatgtgcagatccttaattattag

SEQ ID NO: 16338 - DNA, 396 bp, Artificial Sequence
  Description of Artificial Sequence: Synthetic coding sequence
atgagcaaacgttacttacagaaggcaactaagggaaagttgctgatcataatctttattgtcaccttatggggtaaagtggtatctagcgcgaaccatcacaaggcacaccacgttaagaccggtacgtgtgaagtcgttgctctccatagatgctgcaacaagaataagatagaggagcggtcacagactgtgaagtgttcctgttttccagggcaggttgctgggacgaccagggccgccccctcttgcgtggatgcttccattgtcgagcaaaagtggtggtgccatatgcagccgtgtctggagggagaggagtgcaaagtcctccctgacagaaagggctggtcctgttcttccggtaataaagtgaaaactacccgagtgacccactag

SEQ ID NO: 16339 - DNA, 306 bp, Artificial Sequence
  Description of Artificial Sequence: Synthetic coding sequence
atgccattcttcgggaataccttctcccctaagaaaacccctccccggaagtcggctagtttatctaatctccactctctggataggagcactagagaggtcgagctgggactggaatacggatctccaactatgaaccttgccggtcagtcccttaagttcgaaaatggccaatggatcgccgagaccggggtatcaggaggtgtggatcgtcgggaagtacagagacttaggagaagaaaccagcagctcgaggaagagaacaatctgctccgtctaaaggtcgacatacttctagatatgtag

SEQ ID NO: 16340 - DNA, 393 bp, Artificial Sequence
  Description of Artificial Sequence: Synthetic coding sequence
atggacattagcaagggccttccaggcatgcagggcggtcttcacatttggatttctgaaaataggaaaatggtacccgtgccggagggagcttatggaaacttctttgaagagcactgttatgtcatccttcacgttccacaaagccctaaggccacccagggcgcttcctcagacttgcactattgggtgggcaaacaggccggtgccgaagcccagggcgcggcagaggcttttcagcagagacttcaggacgaactcggtggacagactgtactccatagagaagctcagggccacgagtccgattgtttttgcagctactttcggcccgggattatttatcgtaaagggggactggcttctgacctgaagcacgtcgagaccaactag

SEQ ID NO: 16341 - DNA, 51 bp, Artificial Sequence
  Description of Artificial Sequence: Synthetic coding sequence
atgtgtacttctgaaaccttccaggccctggacacctttgaggcgagatag

SEQ ID NO: 16342 - DNA, 5553 bp, Artificial Sequence
  Description of Artificial Sequence: Synthetic coding sequence
atggagtctaatttcaaccaggagggggtcccccgtccctcatacgtctttagtgcagacccaatcgccagaccctctgagatcaacttcgacgggattaagctcgacttgtcgcacgagttttctttggttgctcctaatactgaggcgaactccttcgagagcaaagattatctccaggtatgccttaggataaggccatttacacagagtgagaaggagctcgaatctgaagggtgtgtccacattctggacagccagactgtggttctcaaggagccccaatgcattttagggcggctctcggagaagagttcaggccaaatggcccagaaattctccttctctaaagttttcgggccagcaacaacccagaaggaattcttccagggatgtattatgcagcctgtgaaagaccttctgaaaggccaatcccggcttatatttacatacggactgaccaatagtggcaagacgtacactttccagggtacagaagaaaatatcgggatcctgccccgtaccctgaatgtgctattcgactcactccaggaaaggctatacaccaaaatgaatttaaagccacaccgatctcgcgaatatctgaggttatcatcagagcaagagaaggaggagatcgcatctaaaagcgccctgctgcgccagatcaaagaggtcactgttcataacgactcagatgacactctgtatggctctctgaccaactcactgaacatcagcgagtttgaagagtccatcaaggattacgagcaggccaatctgaacatggcaaattccattaaattcagtgtgtgggtgagcttttttgaaatctacaatgaatacatatatgatttgtttgtccccgtgtcctctaaatttcaaaagcgtaaaatgctgagactcagccaggatgtcaaagggtacagcttcatcaaagatctccagtggatccaggtttccgattccaaggaggcctacagactcttgaaattagggattaagcaccaatctgtggctttcaccaaattaaacaacgcgtcttctcgcagtcacagcatattcaccgttaagatcttgcagattgaagattctgaaatgtccagagtcatccgtgtcagcgagctgagcctgtgtgaccttgccggctctgaaagaaccatgaagactcagaacgaaggggaaagacttcgagaaaccgggaatattaacacctctctgctaaccctaggaaagtgtattaacgtgctaaagaactcggaaaaatctaagtttcagcagcacgtgcctttcagagaaagtaagcttacccactactttcagtccttctttaatgggaagggcaagatctgtatgatcgtcaacattagccaatgctatctggcctacgatgaaacactcaatgtgcttaagttttctgctattgcccagaaagtgtgcgtgcctgatacactgaattcatcccaagaaaaactctttgggcccgtcaaaagctcccaggacgtttctctggactcgaatagcaactccaaaatcctgaatgtgaagagagcaaccatctcttgggagaacagtctcgaggatctcatggaggatgaagacctggtggaagagttagagaatgccgaagagacgcaaaacgtcgaaacaaagctcctcgatgaggacctggataagacactggaagaaaataaagccttcatttctcatgaggagaagcggaagctgcttgatctcatcgaggacttaaaaaaaaagttaattaatgagaagaaggaaaagctgaccctcgaatttaaaataagagaggaagttacccaggagttcacgcagtactgggcccagcgcgaagccgattttaaagaaactctcttacaggagcgtgagattctggaagagaatgccgagcggagactggcaatcttcaaggatctggtgggaaagtgtgatacccgagaagaagccgccaaagacatttgtgcaaccaaggtggaaaccgaagagacgcacaattatgtcggatttgaggatattatcgactcccttcaggacaacgtagccgacattaagaagcaggccgagatcgcccacctgtacatagcatcccttcccgacccccaggaagccaccgcctgtttagagctgaagttcaaccaaatcaaagctgagctagcaaaaaccaaaggggaactgattaaaacaaaggaagagctgaaaaagcgcgaaaatgagagcgactccctgatccaagaattagagacctctaataaaaaaataataactcaaaaccagcgcattaaggaacttataaacatcatcgatcaaaaggaggacacaatcaacgaattccagaatttgaagtctcatatggaaaacacctttaaatgcaatgacaaagcagacacctctagcctcatcatcaacaacaagctgatttgtaacgagacagtggaggtgcctaaagattctaagtctaaaatttgttccgagaggaagcgagttaatgaaaatgagctccagcaagacgaacctccagccaagaagggaaccaccagcgccgcgagttcaagacgcctgcggaagcttatttccaaacccgtcaataggacccgccagacagagggacactcactggtctcgatccatgtgtcttcagccattaccgaagaccaaaaaaagagtgaggaggttcgaccaaacattgcagagatagaggatattcgggtattgcaggaaaacaatgaggggctccgcgcattcctgctaactatcgaaaacgaactcaaaaacgaaaaagaagagaaggcggagctcaacaaacagattgtacattttcaacaagagctgtctctttctgagaaaaagaaccttaccttgtctaaagaagtgcagcagattcagtcaaattacgatatcgctatcgccgagctgcacgtccagaagtccaaaaaccaggaacaggaagaaaaaatcatgaaactctccaatgagattgagactgcaacacggtccataaccaataacgtgtctcagatcaagctgatgcatacaaaaatcgatgaactgaggactcttgatagcgtgagtcagatcagcaatatcgatttactgaacctaagagacctgtctaacgggagtgaagaagacaatctaccaaacactcagcttgacctccttggcaatgattatctggtcagtaagcaagtaaaggagtatcgcattcaggaacccaatagagagaactcttttcactctagtatcgaggccatttgggaggaatgtaaagagatcgtcaaggcgagctccaagaagagccatcagatcgaagagctagagcagcagatcgagaagctccaggccgaggtcaagggatacaaagatgagaacaatagactgaaggagaaagagcataagaatcaggatgacctgcttaaagaaaaggagacactgatccagcagctcaaagaagagctgcaagagaaaaatgtgactctggacgtacagattcaacacgtcgtggagggcaaaagggctctgtcagagctcacccagggggtgacctgctataaggcaaagatcaaagagctcgagactattttggagacacagaaggttgagtgcagccattccgccaaactagaacaagacattttggagaaggagtccatcatcctgaagcttgaacgcaatttaaaagagtttcaggagcacctacaagatagtgtgaaaaacaccaaggacctgaatgtcaaagaactgaagttgaaggaagagattacgcaactgacaaacaacctccaggacatgaagcacttgctacagttgaaagaagaggaggaggagacgaatcgccaagagacggaaaaattgaaagaggagctgtctgctagctccgcacgaacccagaacttgaaggctgatctgcagcggaaggaggaggattacgctgacctcaaagagaaactgactgatgctaaaaagcagatcaagcaggtgcagaaagaggtaagtgtaatgagagacgaggataagcttctgagaatcaaaattaacgaactggagaaaaaaaagaaccaatgttcccaagaactggacatgaaacagcgcaccattcagcaactgaaagagcagttgaacaaccaaaaggtcgaggaggccattcaacagtatgagcgcgcgtgtaaggacctgaacgtcaaggagaaaatcatagaggacatgcgaatgacgctggaagaacaggaacagacacaggtagagcaagaccaggtgttggaggccaaactggaggaggtcgaaagactggctactgaactagagaagtggaaagagaagtgtaacgatctggagacaaaaaataaccagcggtctaacaaggagcatgaaaataataccgatgttttagggaagctgacaaacctccaggatgagctgcaggagagcgagcaaaagtataacgccgacagaaaaaagtggctggaagaaaaaatgatgttaatcactcaagcgaaagaggcagaaaatatccgcaacaaggaaatgaagaagtacgccgaggaccgggagaggtttttcaaacagcagaatgagatggagattctgaccgcccagctcaccgaaaaggatagcgacctgcagaagtggcgggaagagcgagatcagttggtagcagccttggagatccagctgaaagccctgatctcttctaatgtgcagaaagataacgagatagagcaactgaaacgcataatctcagaaacgtccaagatcgagacacagataatggatataaagcctaagagaatcagttcggccgatcctgacaagctgcagactgagccactctctacatctttcgaaatttcccgcaacaagattgaggatggttcagtggtactggacagctgtgaagtttcaacagagaatgaccagagcacaaggtttcctaagcctgagcttgagatacagttcacaccattacagccgaacaaaatggccgttaagcatcctggatgtaccacacccgtcaccgtcaagatccctaaggctcggaaacgcaaatcgaatgagatggaggaggatcttgtcaagtgtgagaataaaaagaatgccaccccacggaccaacctcaagtttccaatatccgacgataggaactcatctgtgaagaaggaacagaaggtggctatcaggccctcgagtaaaaaaacatactctcttcggagtcaagcttcgatcatcggtgttaacctggctacaaagaaaaaggaggggactctgcagaagttcggagattttctacaacatagtccaagtatcctccagtctaaggcgaagaagatcattgagaccatgtcttctagcaaactgagtaacgttgaagcctccaaagaaaacgtctcacagccgaaaagagctaagaggaagttatacacctctgaaatttccagccctatagacatctctggccaagttattctgatggatcaaaagatgaaggaaagtgaccaccagattatcaaacgccggttgcgaacaaagaccgccaagtag

SEQ ID NO: 16343 - DNA, 1527 bp, Artificial Sequence
  Description of Artificial Sequence: Synthetic coding sequence
atgaggtgccctaaatcggcggtcacaatgagaaacgaggaactgcttttgtctaatgggactgccaacaagatgaacggcgccctggatcactcagatcagccagatccggacgctatcaagatgttcgtgggtcaaatcccacgcagctggtccgagaaggagctgaaggaattgtttgaaccctatggcgcggtctatcagatcaacgtgctgcgcgaccgctctcagaacccgcctcagagtaaagggtgttgttttgtgactttctacactcgaaaggctgccctggaggctcagaacgcgctccataacataaaaaccctgcccggcatgcaccaccctattcagatgaagcccgcagattctgaaaagtccaatgccgtcgaggataggaaactttttattggcatggtgagtaagaagtgcaacgagaacgatattagggtaatgttctctccgttcgggcaaatagaggagtgcaggatcctgagggggcctgatgggctgtctcggggatgcgctttcgttaccttcagtactagagctatggcccagaacgcaatcaaggctatgcaccagtctcaaaccatggaggggtgctccagtcccatcgtggtgaaatttgctgacactcaaaaggacaaggaacaaagaagactccagcagcagctagcccagcagatgcagcagctgaatacagctacctggggtaacctaactggcctcggagggctgaccccccagtatctagccctgctgcaacaggcgactagttctagcaatctgggtgcattcagcgggattcagcagatggcaggcatgaatgccctccagctgcaaaatctggccactcttgctgctgccgcggctgcagcccagacttctgccaccagcaccaacgctaatccgctgagtaccacgtcgtccgcgctgggagccttgacctcccccgtagctgcatcaactcctaattctaccgcaggcgccgcaatgaattccctgacctctcttggcactctgcagggcttagcaggagcaaccgtggggctgaataacatcaacgcgctggcaggcatggcagcacttaacggcgggctgggcgcgaccgggttgacaaatggaaccgccggaaccatggatgctcttacccaggcatatagcgggattcagcagtacgcagccgcggctctgcctacattatattcacagtcgctcttgcagcagcagtctgcggcgggcagtcaaaaggagggcccagaaggtgccaacctgttcatttatcacttgcctcaggagttcggggatcaagatattctccaaatgtttatgccctttgggaatgtcatttcagctaaagtattcatcgataagcagacaaacctatccaagtgcttcggctttgtatcctacgacaatcctgtctcagcgcaggctgcaattcaagcaatgaatggattccagatcgggatgaaacggcttaaggtacaactcaagaggtccaagaatgattctaaaccatactag

SEQ ID NO: 16344 - DNA, 975 bp, Artificial Sequence
  Description of Artificial Sequence: Synthetic coding sequence
atgtttattgggggactctcatggcagactagccctgactccctgagagattacttttccaagttcggggagatccgggagtgcatggtaatgagagatcccacaactaagcgttctaggggattcggattcgtgaccttcgcagatccagcgtccgtcgacaaggtattagggcaaccccaccatgaactggacagcaaaaccatcgatcctaaggtggcctttcctcggcgggcccagccaaagatggtgaccaggaccaagaagatcttcgttggggggctgtccgccaacaccgtggtcgaggatgtgaaacagtacttcgaacaattcgggaaggttgaagatgccatgttgatgtttgataagacgaccaatagacaccgcggcttcggattcgtgacctttgaaaatgaggatgtggtggagaaagtgtgcgaaatacacttccatgagattaacaacaaaatggtggagtgcaagaaggctcagcccaaagaagtgatgtttccgccaggtactaggggacgcgcccgcgggttaccatatactatggatgcctttatgctagggatgggaatgttgggatacccaaactttgttgctacatatggccgcgggtaccctggattcgccccatcatatggatatcagttccctgggttccccgccgcagcgtatggacccgtggccgcagctgccgtagcggccgcccgcggtagcgttctgaattcatactccgctcagccaaattttggcgccccagcgtcacccgccggaagtaacccagcgagaccgggtggattccccggggccaattcccccggtccagtggccgacctgtatgggcccgcttcacaagacagcggcgtgggaaactatatctcagccgcctccccgcagcccgggagtggtttcggtcatggaatagcaggccccctgattgccacggcattcaccaatgggtaccattag

SEQ ID NO: 16345 - DNA, 333 bp, Artificial Sequence
  Description of Artificial Sequence: Synthetic coding sequence
taacacaagccatgctacggcgcactgttcgggccgaggggagtaaacatcggtggggtgggtagctacctatataatcccccaacaccctcccccggctgtactacccccctaagtccatcctcttttagcccacctcgaccacgtactgggctccctcaagggaagaagacggaaaaagtcatgagcctgggaaggaactggcaccggccatgtctgcggtgccaacgttgtcacaaaacacttactgccggcagccatgctgaacatgatggagttccgtactgccacgtgccgtgctacgggtatctgtttgggcccaaagccttatag

SEQ ID NO: 16346 - DNA, 411 bp, Artificial Sequence
  Description of Artificial Sequence: Synthetic coding sequence
atgaccgaggattcccagcgcaattttagatccgtgtattatgagaaggtagggtttagaggagtggaggaaaagaaatccctggaaattcttcttaaggacgacaggctggacaccgaaaaactgtgcaccttctctcaacggtttcccctcccctctatgtatagggcgttggtgtggaaagtcctgctgggaatcctgccacctcatcacgaaagccacgctaaagtgatgatgtacagaaaggaacagtatttagacgtactccacgctttgaaggtggtgcgcttcgtctccgatgctactccccaggcagaggtttacctacgtatgtaccaactagagtctgggaagttgccccgctccccttccttcccactcgaaccagatgatgaggtcttcctcgcctag

SEQ ID NO: 16347 - DNA, 1686 bp, Artificial Sequence
  Description of Artificial Sequence: Synthetic coding sequence
atggcctctcagttctgtctgccagaatcaccgtgtctctctcctccacccctcagcccacttgccctggcccctagttctgcgattcgggatcaaaggacagccacaaaatgggtggcaatgatccctcagaaaaatcagactgcctccggggacagcttggacgtacgggtgccatccaagccttgcctgatgaaacagaagaaaagcccttgtttatgggaaatccagaagctccaggaacagcgagagaagcgccgacggcttcaacaagagatccgcgctaggagagcactcgatgtgaatacaagaaaccctaattatgaaatcatgcatatgattgaggaatatcgtaggcatttggactctagcaaaatttcggtactcgagccacctcaggagcacaggatttgtgtttgtgtgcgcaaacggccgctcaaccagagggagaccaccctgaaagatcatgcgttcgacgataaggcctcaaacgagctagtgtaccagtttactgcccagcccttagtggagagcatattcagaaaaggcatggccacatgcttcgcttacggtcagacaggatccggaaaaacctacacaatgggaggcgacttctccggcacagctcaggactgtagcaaggggatttatgcgttagtagctcaggatgtttttctcctgctgcgtaattcgacatatgaaaaactggatctaaaagtgtatggcacattctttgagatttatggaggaaaggtgtatgacctgcttaactggaagaagaagctgcaagtcttagaagatggtaaccagcagatccaggtagtcgggctccaggagaaggaggtgtgttgcgtcgaagaggtgctgaatctcgtggaaatcgggaattcatgtagaacaagccgacaaactcccgtgaacgcccactcatcacgctcccatgccgtatttcagataatcctgaagagtggaagaatcatgcatggtaagtttagcttggttgacctggcgggcaacgaacggggtgccgacactacaaaggcatcccggaaaaggcagttagagggggccgagatcaacaaatctctgctcgcgctcaaagagtgcatactcgcacttggtcagaataagccgcatacaccttttcgggcatctaaactgaccctggtcctgcgggatagctttatcgggcagaattcctcaacctgtatgattgccacaatctcgcccggaatgacctcttgcgaaaatacactgaatacattgcgttacgccaatcgggtcaagaaacttaacgtagacgttcgtccctatcatcggggacattatccaattggtcatgaggcacctaggatgttaaagagccatattggcaactcagagatgtctcttcagcgtgatgagtttatcaagatcccatatgtgcagtcggaagagcaaaaagagattgaagaggtagagacccttccgacgttattggggaaggatacaaccatctccggcaaaggcagcagccagtggcttgaaaatattcaggagagggccgggggcgtgcaccatgatatcgatttttgcattgcacgctctctctcgatactggagcagaagattgacgcactgacagaaatccaaaaaaagctcaaactgctgctggctgacctccacgttaagtctaaagtggagtag

SEQ ID NO: 16348 - DNA, 375 bp, Artificial Sequence
  Description of Artificial Sequence: Synthetic coding sequence
tgatcagcctgcatcggtaactgtagcaccgctctggaagaattgaccgatgacatgaccgaggactttctacctgtgttgcgcgaatatatcctctactccgactccatgaaaagcgttctgaaaaagcgtgaccaggttcaggctgagtacgaggccaagctggaggctgtggccttgcggaaggaggatcggcctaaagtgcccgcggacgttgagaagtgccaggaccgaatggaatgctttaacgccgacctgaaggccgacatggaacgctggcagaataacaagcggcaggactttcggcaactgttgatgggcatggccgataagaacatacagtattacgagaagagcattgcggacttgaagtag

SEQ ID NO: 16349 - DNA, 747 bp, Artificial Sequence
  Description of Artificial Sequence: Synthetic coding sequence
atggctacttccgctcccctgcggagcctggaagaggaggtaacttgcagtatttgccttgactacctgagagatcctgtgacgatcgactgcggtcacgtattttgtagaagctgtactacggacgttcgtccaatctctgggtctcgcccggtatgcccactgtgcaaaaaacctttcaagaaggagaatatcaggccggtatggcagttagcttcactggtcgagaacatagagcggctgaaagtggataagggtcgacagccaggcgaagttacccgggagcagcaggatgcaaaactgtgcgagaggcaccgtgagaaactgcactactactgcgaggacgatggtaagttgctgtgtgtcatgtgcagggagagccgcgaacaccgcccgcacaccgccgttctcatggagaaggctgcccagcctcaccgagagaagatcctgaatcacctgtcaacattgcgccgcgacagggacaagattcagggattccaggcgaagggagaggccgacattcttgccgccctcaaaaagctacaggaccaacgtcaatacatcgtggccgagttcgagcaagggcatcagttcctgcgggagagagaagagcatctgcttgagcaactcgcaaaactcgagcaagaactgactgaggggagggaaaaattcaagagccggggcgtcggcgaactcgcacggctggcacttgttatatctgaactcgaagggaaggcacagcagtag

SEQ ID NO: 16350 - DNA, 1125 bp, Artificial Sequence
  Description of Artificial Sequence: Synthetic coding sequence
atggacttcaatatgaagaaattggcctctgatgccggaatcttttttactagagcggtccagtttactgaggagaagtttggtcaggcggagaagaccgagctagatgcacactttgagaacttgctggctagagccgattcaacaaagaattggacggaaaagattcttcgccagacggaagtcttgctgcagccaaacccttctgcaagggtggaagagttcttgtacgagaaattagacagaaaagtgccgtctagagtaactaatggcgagcttttggctcagtacatggccgacgcggcaagcgagctggggcccactactccgtatggtaaaacgctcatcaaggtggccgaagccgaaaagcagctcggagccgccgaaagggacttcatccacaccgccagcatatcctttctcacccctttgaggaattttttggagggagattggaaaacaatctccaaagagcgtaggttgctgcagaacaggcggctggacctagatgcctgcaaggccagactgaagaaagctaaggcagctgaggcgaaggcgactctgtggaatgacgaggtggacaaagctgaacaagagctgcgcgtggcccagactgagtttgatcggcaggcagaagtcacccgcttgttactcgagggcatctcctctacgcatgtgaatcacctgcgttgcttacacgaatttgtcaagtcccagactacttactatgcacagtgctatcgacacatgcttgacctgcaaaagcagctgggtcgcttccctgggacattcgtgggcactacagaaccagcttcccctccactctcctctacctctccaaccaccgctgctgccacaatgccagtagtaccatctgttgcgtccttggctcctccaggagaggcctccctgtgcctggaggaagtcgcgcctccggccagtggtaccaggaaggcaagggtcttatacgattatgaggccgccgacagctccgagctagcccttttggctgatgaactaattacagtatatagtttgcccgggatggacccagattggctgattggagaacgcggcaacaaaaagggaaaagtgcccgtcacatacctggaacttctgagctag

SEQ ID NO: 16351 - DNA, 1188 bp, Artificial Sequence
  Description of Artificial Sequence: Synthetic coding sequence
atggctagcgctgcctctgttacctctttggccgacgaggtgaattgtccaatatgtcaaggcacactgcgcgagccggtcaccattgattgcggacataatttttgccgcgcctgtctgactcgatactgtgagataccaggtccagacctggaggaaagccccacttgcccactctgcaaagagccgttcaggcccggatcattcagaccaaactggcagttagccaatgtagtagaaaacatcgaaagactccagctagtgtcaaccctggggttgggggaggaagacgtgtgccaagaacacggcgaaaagatttattttttctgcgaagacgatgagatgcagttgtgcgttgtctgccgcgaggcaggagagcacgcaacccacactatgcgattcctggaggatgcagcggcgccctaccgtgagcaaatccataaatgcctcaaatgtctgcgcaaggaacgggaggaaattcaggaaatccagtctcgtgagaacaaaaggatgcaggttctgctgactcaggttagcaccaaacggcaacaagtcatctccgagtttgcccacctccgcaagttcctggaagaacagcagtcaattctgctggcgcagctcgagagccaggatggcgatattttgcgccagagagatgaattcgatctcctggtggcaggggagatttgcaggttcagcgctctaatcgaggagctcgaagagaaaaatgaaaggccagcaagagagctgttgactgatatcaggtcgaccctgatacgatgtgagacacgaaagtgtaggaagcctgtcgccgtgagtccggagctggggcaacggatccgcgattttcctcagcaagccttgcctctgcaaagggaaatgaagatgtttcttgagaaattatgttttgagctggactatgaaccagcccacataagcctggacccgcaaacctcacacccaaaactgcttcttagtgaggatcatcaacgagctcagttctcctacaaatggcagaatagtcctgacaaccctcagcgattcgaccgggcaacatgcgtgttggcacatacgggtattacgggtggccgacatacttgggtatggatggctcgggtgcccggtgattcaggctgttgtcaattctgctcgccacctagtgtgctgggaacggaggtggctgcgtag

SEQ ID NO: 16352 - DNA, 1131 bp, Artificial Sequence
  Description of Artificial Sequence: Synthetic coding sequence
atggaaaagaaaaagatggtgactcaaggcaatcaggagcccaccacaacaccagatgccatggtccagccttttactaccattcccttccctcctccaccccagaacggtatcccgacggagtatggcgtgccccacacccaagactacgccgggcagacaggggagcacaatctgacactctacggctctactcaagcacatggtgagcaatccagcaactcccccagcactcaaaacggttcactaaccaccgagggaggtgcacagactgatggtcagcagtcacagacacagagttcagaaaattccgaatcaaagtccactcccaagcggctgcacgtgagtaacataccatttcgttttagagatccagatctcagacagatgttcggccagttcggcaaaatcctggatgtagagattatcttcaatgagagaggaagtaaaggctttggatttgtaacattcgagaattctgcggatgccgatagagctagagagaaactgcacggtactgtcgttgaaggtcggaagatagaggtaaataatgctaccgcccgggtgatgacgaataaaaagatggttacaccctacgccaatggctggaagctgagtcccgtggtgggtgcagtgtatggacccgagctctacgctgcctcaagttttcaggccgacgtgagcttaggcaatgatgcggccgtgcctctgtctgggcgcggcgggatcaacacttatatacctttgatcattcccgggttcccttaccccaccgctgccacgaccgctgccgctttccgcggggcccatttgagagggcgcggaaggactgtatatggagctgtgcgtgccgtgccacctactgcaattccagcgtaccccggtgtggtttatcaggatggattttacggagcagatttgtatgggggctatgccgcttatagatacgcccaacccgctaccgctaccgcagctactgccgctgctgctgctgccgctgcatatagtgacgggtatggacgggtctacacagcagacccctatcatgctctagcccctgcagcttcatatggcgtgggcgccgttgcctccttatacagagggggctactctaggttcgctccctactag

SEQ ID NO: 16353 - DNA, 1638 bp, Artificial Sequence
  Description of Artificial Sequence: Synthetic coding sequence
atggggactccctggcggcctccctcccggcgcccttggcggtggcctacaggctgtacaaggaagacatgtggccccccaacctggtccctcgagcgaaccaggagctggctgtctggcagggagcactcagtattcaccggagtggctattgtccactgtagctcaaaggaccatcagctagacacaagggtgtccgagttctacgaagagacaaaggtcaaattctctgaactctcagaggaactgctgtgggagtacgtgcactctggagagcctatggataaggcagggggatatggtatccaagctttgggcggtatgttggtggaaagtgtgcacggtgactttctcaatgtcgtcgggttccccttgaatcacttctgcaagcagctcgtgaaactctattatcccccgcgccccgaagatctgagaagatcagtaaaacatgattcaattccagcggcagacaccttcgaagacctgagtgatgtcgaaggcggtggctctgaaccaacgcaaagagacgctgggtctagagatgagaaggcagaagccggagaggcagggcaggcaaccgctgaggctgagtgccatcgtaccagggaaaccctgcctcctttcccaacaagattgttggagcttatcgaaggattcatgctctccaaaggcctcttaacagcctgcaagctgaaagtattcgatctccttaaagacgaggccccccaaaaggcggctgacatcgcgagtaaagtggatgcatccgcctgcggaatggagagacttttagatatctgcgctgctatggggctcctggagaagacagagcaagggtatagtaacactgaaacagccaatgtttatctcgcttctgacggggaatatagccttcacggcttcatcatgcataacaatgatttaacgtggaacctgtttacttacctggagttcgcgatccgcgagggtacgaatcagcaccatcgcgctctgggaaagaaagccgaggatctgtttcaagatgcctactaccaaagcccggaaactcggctccggtttatgcgggcaatgcacgggatgaccaagctgactgcctgtcaggtggccactgcgtttaacctttctcgctttagctcagcatgcgatgtaggcgggtgtacaggtgctctcgcacgggagcttgcccgtgaatatccaagaatgcaggtcactgttttcgatctgcccgatattatcgagctggcggcgcatttccagccgcctggaccccaggctgtgcaaatccactttgcagccggcgattttttccgcgacccattaccaagtgctgaactctatgtcctctgtaggattcttcacgattggcccgatgacaaagtgcataagctgcttagtcgggtggcagagagctgcaaacccggggccggattgctcctcgtggagacactgctggatgaagagaaaagggtagcacagcgagcactgatgcagtcactcaatatgctcgtgcagacagaaggaaaggagcgctccctgggcgagtatcaatgcttgctggagttacacggttttcatcaggtgcaggtggtgcacctcggaggggtcctcgacgccatcctggccacaaaagtggctccctag

SEQ ID NO: 16354 - DNA, 621 bp, Artificial Sequence
  Description of Artificial Sequence: Synthetic coding sequence
atgagccaaactagccttaagcagaagaagaatgagccggggatgcgctccagtaaggaatcactggaagccgaaaagcggaaagagtctgataagacaggggtgaggttatccaatcagatgcggagggctgtgaatccaaatcacagtcttcgatgctgcccttttcaagggcatagctcatgtagacgatgcctgtgtgccgccgaagggacagccctggggccatgccatactatcagaatctatatccatatgtgtttactgtgggaacaggggcagcagattacgatgatgagggtgtcgagagaccacacaaccgatagtggtggggaaccccagaccacatggggctctcaggagagctccctgcggaagacagacagcagaggataccttgttagaagccagtggagtaggatctccaggtcacctagcactaaagccccatctatcgacgaaccccgatcccgaaacacctctgccaagttaccttcgtccagtacaagttcaagaacccccagcacaagcccttccttgcatgattccagccctcccccactgtcagggcaaccaagtttgcagccgcccgcctcccctcaactgcctagaagcctgtag

SEQ ID NO: 16355 - DNA, 414 bp, Artificial Sequence
  Description of Artificial Sequence: Synthetic coding sequence
atggcaccaggaacccccaagagcctgttactttccgcatcgattaagcgggaaggcgagagccccacggccagtccgcactcaagtgctacagacgacctgcatcattcagaccgctatcagactttcctccgagtcagggccaataggcagaccagactgaatgcccgcattggcaagatgaaaagaaggaaacaggacgaaggtcaggtctgtccactctgcaataggcccctggccggttctgaacaagagatgtcccggcacgttgagcactgtctgtctaagcgagagggatcttgtatggcagaggacgacgccgtcgatattgaacatgaaaacaacaacaggttcgaggaatatgagtggtgcggtcaaaaacgcattagggctaccaccctcttggagggttag

SEQ ID NO: 16356 - DNA, 570 bp, Artificial Sequence
  Description of Artificial Sequence: Synthetic coding sequence
atgatcccaatttgccctgttgtgtccttcacctatgttccatcccgcctcggcgaggacgcaaaaatggctaccggcaattacttcggcttcacccactcaggagctgctgccgccgccgcagccgcgcagtactcgcagcagcctgcttcaggcgtcgcctattcccatccgaccacggtggcttcctacacagtgcaccaggcccccgtcgccgcacacactgtcacagcggcttacgcaccagcggccgcaacagtggcggtagcgaggcccgcgcccgttgcagtggctgctgctgccacagccgcagcttatggggggtaccctaccgcacacacagctacagactacgggtacacacaacggcagcaggaagccccaccccctccaccacccgccacaacccagaattaccaggatagctactcttacgtccgatcaacagcccccgcagtggcgtatgatagcaagcagtactatcagcagccagcagccactgaagctggaagctcttccagctgttgctgttgctgtaattcatgcctggatagggatcatctgtattag

SEQ ID NO: 16357 - DNA, 387 bp, Artificial Sequence
  Description of Artificial Sequence: Synthetic coding sequence
atggacgccgatagcgacgtggcactcgatattttgattacaaatgtagtgtgtgtcttccggaccagatgtcaccttaaccttcgaaagattgccttagaaggtgcaaatgtgatctacaagcgggatgtggggaaagtgctcatgaagctcagaaaaccacggataacggccacaatctggagctcaggcaaaatcatctgcacgggcgccaccagcgaagaggaagctaagttcggagccagacgactagctcggagtctccagaagctggggtttcaggtgatatttacagattttaaagtggtaaacgtgttggccgtctgcaacatgcctttcgaaatccgcctgcctgagtttactaagaacaacagaccccacgcttag

SEQ ID NO: 16358 - DNA, 381 bp, Artificial Sequence
  Description of Artificial Sequence: Synthetic coding sequence
atgtggacagcccggggaccattcaggagggaccgatggtctagcgaggacgaggaggccgccgggccttcacaggccttgtcccctctgcttagtgacactcgtaagattgtctctgagggtgaactcgatcagcttgcccaaatacgccccttaatattcaacttccatgaacagactgccatcaaagattgcctgaagatcttggaagaaaagactgccgcttacgacatcatgcaagagttcatggctttggagttgaaaaacctacctggagagttcaactcaggcaatcagccaagtaatcgcgaaaagaacaggtaccgtgatatactgcccttccagcaccacggctattccggccctaacgaacgaacctag

SEQ ID NO: 16359 - DNA, 912 bp, Artificial Sequence
  Description of Artificial Sequence: Synthetic coding sequence
gaggatgagtacatccagtcccacaacttcgactcggccatgaaggttacttctcagggtcaaccttcccccgtcgagcctcgaggcccattctatttctgcagacttctgctcgacgatcttgggatgaactcctgggacagaaggaagaatttccatctcctcaaaaagaatagcaaactcctgcgtgagctgaagaacctcgacagcaggcagtgccgcgagactcataagatagccgtgttctatatcgcagagggacaggaggataagtgctcaatcctgtcaaatgagcgaggatctcaggcgtacgaagatttcgtcgcaggcctcggatgggaggtggacctcagcacccactgcggtttcatggggggtcttcagcgaaatgggagcaccggacagacagctccttattacgccaccagcaccgtggaggttatcttccatgtcagcactcggatgcccagcgatagtgatgattcactcactaaaaaactccgccaccttggaaacgatgaagtgcatattgtctggagtgagcattcccgtgactatcggcgaggaattatcccgacggcgtttggcgatgtctctatcattatctaccccatgaaaaaccatatgttcttcatcgccattacaaagaagcctgaagtaccttttttcggacccctttttgatggtgccattgtaagcgggaagctgttgcccagtcttgtttgtgccacctgtatcaatgcctccagagccgtcaaatgtcttatccccttataccaatcgttttatgaggagagggctctgtatctagaggccatcattcaaaaccaccgggaggtgatgacctttgaagactttgcagctcaggtatttagtccatccccttcctactcactgagcggcactgattag

SEQ ID NO: 16360 - DNA, 2883 bp, Artificial Sequence
  Description of Artificial Sequence: Synthetic coding sequence
atggaggtacaggtgagtcaggccagccttggctttgagctcacctcagtcgaaaagtctctccgagaatggtcacggctgtctagggaagtcattgcatggctatgtcctagcagtcctaatttcatcttgaacttccccccccctccatctgcaagcagcgtttcgatggtgcagctgttttctagtcccttcggttaccagtcacccagcgggcattcagaggaggagagagaaggcaacatgaagtccgccaagccacaggtaaaccattcacagcatggcgaaagccagcgggctttaagcccactgcaaagcactctgagcagtgctgcaagcccatcccaggcttacgagacatatattgaaaatggcctgatatgtctgaagcataagattcggaacattgagaaaaagaaactgaagctggaggattacaaggaccggttgaaaagcggggagcatctgaacccggatcaactagaagctgtggaaaaatacgaagaagtacttcacaacttagagtttgcgaaagaactgcaaaagaccttcagcggcctgtcattagatctccttaaggcccaaaagaaagcccagcggagagaacacatgttgaaactcgaagcagagaagaagaaactgaggactatcctacaagtgcagtatgttttacagaacctgacccaggagcacgtacagaaggacttcaagggcgggctgaacggggcggtgtacctgccttctaaggagctggactacctgataaaattttctaagcttacgtgtcccgagaggaatgaatctctctctgtggaggatcagatggagcagtcctccctttatttctgggatctcctggaaggaagtgaaaaggctgtggttgggacgacatacaagcacctcaaagacttacttagtaagctactgaattccggttacttcgagtctatccctgtccccaaaaacgccaaagagaaagaggtcccgctcgaggaagagatgctcatacaatctgagaaaaagactcagttaagcaagaccgagagcgtgaaagagtccgaaagccttatggagttcgcacaaccagaaattcaaccacaagagttcctgaaccggcgatacatgaccgaagttgactatagtaacaagcagggggaggagcaaccgtgggaagccgattatgccaggaagcctaacctgcctaaaaggtgggacatgctcaccgaacctgatgggcaggagaagaagcaggaatcttttaagagctgggaggcatcaggaaaacatcaggaggtcagcaagcctgcggtttcgctagaacagagaaagcaggacacgtccaaactgcgttctaccctgcccgaggagcagaagaaacaggaaattagcaaatcaaaaccttcaccgagtcaatggaaacaagacacccccaaatctaaagcaggctacgtccaagaagagcagaagaagcaggagacccctaaactctggcctgtgcagttacaaaaggaacaggatcccaagaagcagacacctaagagctggactcctagtatgcagtctgaacagaacactacgaagtcctggacaacccctatgtgcgaagagcaggacagtaaacagcctgaaacacccaagtcatgggagaacaatgtcgaatctcagaaacactcgctgaccagccagtctcagatcagtcccaaaagttggggtgttgctaccgctagcctgatccctaatgatcaactactgccacgcaaactgaacacagaacctaaagacgtacccaagcctgttcatcagccagtggggtcatcgtccacactgcctaaggatccagtactccggaaagagaagttgcaggatctcatgacccagatccagggaacttgtaactttatgcaagagtccgtgctggactttgacaaacctagttccgccatccctactagtcaacccccaagcgcgactcccggaagtcccgtggcgagtaaggagcaaaacttgagcagccaatctgattttctgcaggaaccactgcaggcgacctcgagtccagtgacatgttcttccaacgcttgcctggtgacaacagatcaggcttccagcggctctgaaaccgaatttatgacaagtgagacccccgaggccgcaattccccctgggaaacagcctagttcccttgccagccccaaccccccaatggccaaggggtccgagcagggctttcaaagtccacccgcatcttcctccagcgtcacaatcaacactgcccccttccaagcaatgcagaccgtgttcaacgtgaatgccccgctgcccccccggaaggagcaggagattaaggagagcccctatagcccgggttataaccagtcctttaccacagcctcgactcaaacaccaccccagtgccagctcccgtctattcatgtggagcagacagtgcactcccaagagactgccaattaccaccccgatggcacaatccaggtttccaacggatccctggctttttacccagcacaaactaatgtgttcccaaggcctactcagccctttgttaactctcggggctcagtccggggatgtacaagaggagggagactcatcacaaactcctaccgcagcccaggagggtacaaaggctttgacacttaccggggactgccttctatctccaacgggaactactctcagcttcagttccaagcccgtgagtattctggcgccccgtactcccagcgtgacaacttccagcagtgctacaaaagaggtggtacatctgggggcccgagagcaaattccagggctaactgttttattatgcgcaatagcctgctgctcattaagcagcaggggggagtcattttgttgaggtag

SEQ ID NO: 16361 - DNA, 1746 bp, Artificial Sequence
  Description of Artificial Sequence: Synthetic coding sequence
aataataacggaacttacgatggcattgcctatttcgagtgcaaagagaagcacggcatttttgcccccccccagaagattagccatattcccgagaattttgatgactatgtagacattaacgaggatgaagattgctactccgacgagagataccagtgttacaatcaggagcagaacgacactgaggggcctaaggaccgtgagaaagatgtttctgaatacttttacgagaagtctctgccctccgtgaacgacattgaggcctctgtgaaccgatcccgttctctgaagatcgagacagataacgtgcaggatatctcaggagtcctggaggcccatgtgcaccagcagagttccgtggactcccagatttcctcaaaggagaacaaggacttgatcagcgacgccacagagaaggtcagcatcgctgccgaggacgacaccctggataacacgttttccgaagaactcgaaaagcagcagcagttcacagaagaggaagacaacctgtatgccgaagcctccgaaaagttatgtacccccctcttggatctgttgacccgcgaaaaaaatcagctagaggctcagctgaagagcagtctcaatgaggaaaaaaagagcaagcagcagttagaaaaaatatccttgttgactgactcgctgcttaaggtgttcgtcaaggataccgtgaaccagctccagcagatcaagaaaactcgggacgaaaagatacagctgagtaaccaggagctcctgggggatgaccagaagaaagtgacccctcaggatttgtcccagaatgtggaggaacaaagtccgtctatatctggttgtttcttgtcatctgagctggaagatgaaaaggaagagataagttcccctgacatgtgcccccgcccagagtctccggtgtttggagcctccggtcaagaggaacttgccaaacgactcgccgagctagagctttcccgcgagtttctctcggccctaggtgacgatcaggattggtttgatgaagatttcggtttgtcctctagccataaaatacagaaaaataaagctgaggagaccatcgtgcctctaatggctgagcctaaaagagtcacacagcagccatgcgaaaccctcctggctgtgccccataccgccgaggaagtggaaattcttgtgcacaacgctgcagaagagctctggaaatggaaagagcttggtcatgatttgcactccatttcaatccccactaagctgctggggtgcgccagtaaggggcttgatatcgagagtacaagcaagcgagtttacaaacaggccgtgtttgacctaaccaaagaaattttcgaagagatctttgcagaagatcctaatctcaatcaaccagtgtggatgaaaccctgcaggataaattcctcctacttcaggcgagtgaaaaaccccaataacctggatgagattaagagttttatcgccagtgaagtgttaaaattgttctccctcaagaaggaaccgaaccataaaacagattggcagaaaatgatgaaatttgggagaaaaaaacgggatcgggtggatcacatcctagtacaggagctgcatgaagaggaggcacagtgggtcaactacgacgaagacgagctctgcgttaagatgcagctcgctgatggcatttttgagaccctgatcaaagacactattgacgtgctgaatcagatctctgaaaagcagggacggatgctactcgtgtag

SEQ ID NO: 16362 - DNA, 345 bp, Artificial Sequence
  Description of Artificial Sequence: Synthetic coding sequence
atgtggagccttaccgcatctgaaggcgaaagcacgactgcccatttttttttgggagcaggtgatgagggattaggcactcgcgggatcggcatgcggcctgaggaatcagacagcgaattgctagaagatgaggaggatgaggttcccccagaaccacagatcatcgtggggatctgcgcaatgactaaaaagtccaagtctaagcctatgactcagattttagaacgactctgccggttcgattacctcactgtcgtgattttgggggaagatgtgatccttaatgaaccagtagagaattggcccagctgccattgtttgatttcttttcactctaagtag

SEQ ID NO: 16363 - DNA, 918 bp, Artificial Sequence
  Description of Artificial Sequence: Synthetic coding sequence
atggaggctgaaagctttccctgtctgctgcgtcccttctttaaggaaagatcatgcgcactgagaccggcattccatactgccaagtgtgaaaagctgcagaaagagaaggaggagctcgagcgcagatttgaggcggaaatggcaagactgcaagaagagcacggcgatcaactgctctccattcgctgtcagcatcaagaacaggtggaggatctcactgcctctcacgatgctgctctattggaaatggagaacaaccatacggtggctataaccatcttgcaagacgatcacgatcataaagtccaggaacttatgagcacacatgagctggaaaaaaaagagttagaagaaaattttgaaaaactcaggctgtcactgcaggatcaagttgacaccctcacgttccagtcccaatcgctccgcgatagggcacggcggtttgaggaagcactgcgtaagaatactgaagagcaactcgagattgccctggcaccctatcagcacctggaagaggacatgaagtccttaaagcaggtgcttgaaatgaaaaaccagcagatccacgagcaggaaaaaaaaatcctggagttggagaaattagccgagaaaaacatcatcctggaggagaagatccaggtcttgcagcaacagaacgaggatcttaaggcccgcatcgaccagaatactgtggtaaccagacagctaagtgaggagaatgccaatctgcaggagtacgtggaaaaagaaacacaggagaaaaaaagattaagccgaaccaacgaagaactgttgtggaagcttcagaccggggatccaacatcgccaatcaagttatctcctacctcaccagtgtatcgaggatccagcagtggcccaagctcaccggccagagtgtctaccacgccccggtag

SEQ ID NO: 16364 - DNA, 2319 bp, Artificial Sequence
  Description of Artificial Sequence: Synthetic coding sequence
atgcaggagctcgaggaactaaggaagcagctgggcagtgttgccacaggttccacactgcagcagagtctggagttaaagagaaagatgctgcgggataaacagaacaaaaaaaactccgggcagcacttgcccatctttccggcctgggtctatgagcgccctgctcttatcggggacttccttattggagccggaatatccactgacactgccctaccaataggcaccctgccactggctagtcaagagagcgccgtggtagaggatttgctgtatgtacttgtgggcgttgacggcagatacgtgtctgcccagccactcgccggccggcaatctcggacttttctggtagatcccaatctggatctttccatccgcgagttggtacaccgcatactacctgtggctgcatcctatagcgcagtgactagatttattgaagaaaagagttcctttgaatacgggcaggtgaatcacgcactggccgcagccatgcgaaccctcgtcaaggaacacctcattctggtcagtcagctggagcagctgcatcgccagggcctcctctctctgcaaaaactatggttttatatacagcctgctatgcggaccatggacattctggcaagcctggcgaccagcgtggacaaaggagagtgtttgggcggatcaacacttagcctcctgcacgaccggagcttcagctacacaggtgactctcaggcccaagaactgtgcctttaccttacaaaagcagcctccgccccatattttgaagtgctggaaaagtggatatatcgtggcattatccacgatccatattcagaatttatggtcgaggaacatgagttgcgtaaagagaggatccaggaggattacaacgacaagtactgggaccaacgatataccattgtccagcaacaaataccatccttcctgcagaaaatggcggacaaaattctgagcactggaaagtacctgaacgttgtaagagagtgcgggcatgacgtgacgtgccctgtagctaaagagatcatttacacactgaaggaaagggcttacgtcgagcaaatagagaaggcctttaattatgccagcaaggttctactggactttctaatggaagagaaggagctcgtggcccatctgcgctccatcaagcgctactttcttatggatcagggggatttttttgtgcacttcatggacctcgcggaagaggaactgcgcaagcctgttgaggacatcactcctcccaggttggaggcgctgctcgagctcgcgttgcgtatgtcaaccgctaacaccgacccctttaaagacgacctgaagattgatcttatgccacacgacctaattacccaacttctgcgtgtgctggcaatcgagactaagcaggagaaagcaatggctcatgctgatcctactgagctggccctgagcgggctggaggccttctctttcgactacatcgtgaagtggccccttagtcttatcatcaacaggaaggccctcacacgctaccagatgttgttccggcatatgttttattgcaagcatgttgaaaggcaactatgttcagtgtggatatcaaataaaactgctaaacagcacagccttcactccgcacagtggttcgcgggcgccttcactcttcggcaacgcatgctcaatttcgtgcagaacatccaatactatatgatgtttgaggttatggagcccacatggcacatcttggagaaaaacttgaagtctgcctccaacattgacgacgtgctgggccatcacaccggatttctagatacttgcctgaaagactgcatgctgacgaatcccgagctgctgaaggtgttttctaagttgatgtctgtatgtgtaatgtttaccaactgtatgcagaagttcacccaatctatgaagctggacggagagctcggcggtcagacgttggagcacagtactgtcttgggactccccgctggagccgaggagcgtgcgcggaaagaattggctaggaagcacctagcagagcacgcggacaccgttcagctggtatctggcttcgaagctaccatcaacaaattcgataagaacttttctgcccacctgctggatttgctggccaggctgtcgatatattctacaagcgactgtgagcacggcatggctagcgtgatttcccgattggacttcaacggcttctataccgagcgcttagaacgcctttccgcggaaagatcccaaaaggccaccccacaggtccctgtgctgcgtggaccgccagctccagcgcccagagtcgccgtgactgcccagtag

SEQ ID NO: 16365 - DNA, 1203 bp, Artificial Sequence
  Description of Artificial Sequence: Synthetic coding sequence
atggatttcaatatgaaaaagcttgcttcagacgccggtatctttttcacccgggcagtgcagtttactgaagagaaattcggtcaagctgagaagactgaactggatgcccatttcgaaaatctgctggccagagcagacagcacaaagaattggacagagaaaattctgcgtcagaccgaagtgctcctccaacccaatccttctgcgcgagtggaagagtttttatatgagaagcttgaccggaaagtgcctagtcgcgtgacgaacggcgagctcctggcccagtatatggccgacgcagcgagcgagctcggcccaacgaccccctacggtaaaaccctgatcaaggtggccgaagcagagaagcagctaggcgctgcagaaagagacttcatccacactgcttcaattagttttctcactccgctccgtaatttcctggagggcgattggaagactataagcaaggagaggagactgttgcagaacagacgcctggatctagatgcatgcaaggctcggctgaagaaggctaaggccgccgaggcaaaagccaccactgtaccagatttccaggagacccgacctaggaattacatactctccgcctccgcctctgccctatggaatgacgaggttgacaaggcagagcaggagctcagagtcgcccagaccgagttcgacaggcaggcggaggtgacaaggctcttgctggagggcataagttcaactcacgtgaaccacctgcggtgtcttcacgagtttgtgaaatcccagaccacttattacgctcagtgttataggcacatgctggatctacaaaagcagctgggcagctcacaaggagcaattttccccggtactttcgtgggaacaaccgaaccagcttcccctcctctgagcagtacaagtccaacgaccgccgccgctacgatgccagtggtccctagtgtggcttccctggcccccccaggcgaggcatcgctctgccttgaggaggtagctccaccagcatccggtactagaaaagcccgtgtgctctacgactacgaagccgctgatagttccgagcttgctctgctggctgatgagttaatcaccgtgtatagcttgcctggcatggatccggattggttaatcggcgaaaggggcaacaagaaaggcaaggtgcctgtcacatatttggagttgctctcctag

SEQ ID NO: 16366 - DNA, 1827 bp, Artificial Sequence
  Description of Artificial Sequence: Synthetic coding sequence
atgccattttggccgattcgatgtctcaagcgctctcggcggatgcctcgtgggggggccggagaacgggagaaggttcctgctaacccagaggctctcctgctcatggcgtccagccagcgggacatggaggactgggttcaggcaattaggagagtgatttgggcacctttgggaggaggcattttcggacagcgacttgaagagacagtgcaccacgaaagaaagtatggtcccagattagcacctctgcttgttgagcagtgtgtagactttatacgtgagagaggacttaccgaagagggactgttccggatgcccggccaggccaaccttgtgcgcgatctacaggattcattcgactgtggggagaagccgctcttcgacagcaccacggatgtgcacaccgtcgctagcctcttgaagctctacctacgggagttgccagagccagttgttcccttcgctagatacgaggattttctgagctgtgctcagttgctaacaaaggacgagggagagggaaccctggaactggcaaagcaagtcagcaacctcccgcaagctaactataatctcttgcgctatatttgtaaattcttggatgaggtgcaggcatacagtaatgtgaacaagatgtcagtccagaatcttgctaccgtttttggaccaaacatattacgtcctcaggtagaggacccagtcacaatcatggaaggtacaagtctggtgcagcacctcatgacagttttaatcaggaagcacagccagctttttacggccccggttccagaggggccaacatcgccacgaggcggtctccagtgtgcagtgggctggggttctgaagaagtgactcgagatagtcagggcgagcctggtggccccgggctaccagcgcaccgaacatcaagcctggatggggcagcagtggccgtgctgtccagaactgctcccacgggtcctggctctcggtgctcacccgggaaaaaggtccaaacactgccctcctggaaaagtagctttaggcagccgaggagcctttctggatctcccaagggcggggggagtagcttagaggtcccaattatctcttccggaggcaattggcttatgaacggtcttagcagtttacgtggccaccgcagagcctccagcggggatcgtctcaaagactccggctccgttcaaagactgagtacctatgacaatgtccctgccccgggcttggtgcccggcattccatcagtcgctagtatggcctggtccggcgcttctagcagcgaatcgtcagtcggcggatctctttcgagttgtacggcctgcagagcctctgactcatccgctaggagctctctccacacggactgggctttggaaccatctcccctgccctcttctagcgaagaccctaagagcttggatttggatcactcgatggacgaggctggcgccggggccagcaactcagagcctagcgagccagatagcccgacgcgggaacatgctaggcgctccgaggcattgcagggactggtcacagaactgcgtgcggaactgtgcagacagagaaccgaatacgaaagatctgtgaagaggattgaggaggggtccgctgacctgaggaaacgaatgagccggttagaagaggagcttgatcaggagaagaaaaagtacattatgctggagataaagttgagaaactccgaacgggccagggaggacgctgaacggagaaatcagctgctgcagcgggaaatggaagagttcttttccaccctgggctccctgaccgtcggcgccaaaggcgccagggcacctaaatag

SEQ ID NO: 16367 - DNA, 708 bp, Artificial Sequence
  Description of Artificial Sequence: Synthetic coding sequence
atgttctcggaagagtgtattatggacgttattggctgtctcgagtacgacccggcactgtcccagcctcgaaaacacagggaattcctgacaaaaacagctaaatttaaggaggtaatccctattagtgaccccgaacttaaacagaagattcaccagacttaccgggtgcagtacatccaagatatggtgctccctaccccaagcgtgttcgaagaaaacatgttatcaaccctgcattcattcatcttttttaataaagtcgagatcgtgggcatgctgcaggaagatgaaaagttcctgactgacctgtttgctcagctgacggatgaggcaaccgatgaagagaaacgccaggagctggtaaacttcttaaaggaattttgcgcgttcagccagacacttcagccgcagaatcgagacgcctttttcaaaaccctgagcaatatgggcattctgcctgccttagaagttattctgggcatggacgacacccaggtgcggtccgccgcaacagatatattttcttatttagtggagtacaacccttcaatggttagagaattcgtgatgcaggaagctcagcagaatgatgacgtcagcaaaaagctcacagagcagaaaataacatctaaagtgaatattatttgcacgaactccaagtacctatacataggatcctacaattgcttctactattctttctag

SEQ ID NO: 16368 - DNA, 3513 bp, Artificial Sequence
  Description of Artificial Sequence: Synthetic coding sequence
gtatacaagggacgacatgtgaaaacgggccagctggccgctatcaaggttatggacgtgactgaagacgaggaagaagagatcaaactcgagattaacatgctcaaaaagtactctcaccatcgcaatatcgctacgtattatggcgcattcatcaagaaatcccccccggggcacgacgatcagctctggctggtcatggagttttgcggggcaggaagcatcacagacctagtgaaaaatactaagggaaacacactgaaagaggactggatcgcgtatatcagcagggagattctgagggggctggctcacctgcacatccaccacgtcattcaccgtgacattaagggtcaaaatgttctgctgacggagaatgcagaagtgaagctggtggattttggggtcagtgcacaattagataggaccgtgggcaggcgtaatacctttatcggaaccccctattggatggcccccgaggtcatcgcatgcgatgagaatcctgatgccacctatgactatcgcagcgacctgtggtcctgcggaattactgccatcgagatggcagaaggggcccctcccttgtgtgatatgcatccaatgcgtgctctgttcctgatccccagaaacccaccccctcgtctcaagagcaagaagtggtccaaaaagttcttcagtttcattgagggttgtctggtgaagaattatatgcagcgcccatccactgagcagctgcttaaacatcctttcatccgagaccagccaaacgaaagacaggttcgtattcaactgaaggatcatatcgataggaccagaaaaaagcggggagagaaggacgagactgagtacgagtacagtggctccgaagaggaagaagaggaagtgcctgaacaggagggggaaccttccagcatcgtgaacgtgcccggagaatccactcttaggcgcgatttcctgagacttcagcaggaaaacaaggaaagaagcgaggcgctcaggagacagcagctgcttcaagaacaacagctgcgggagcaggaagagtataagcgacagttactggccgagcggcagaagcgcattgaacagcaaaaggagcagagacggcggcttgaagaacagcaaaggcgtgagcgagaggcccgcagacagcaggagcgtgagcagaggaggcgagagcaagaggagaagcggcggctggaagagcttgaacgtaggcgaaaagaagaagaagagcggaggcgcgccgaagaggagaaacggagggtggaaagggagcaggagtacattcgccggcaactcgaggaggagcagcgacacctcgaagttctccaacagcagctcctgcaagaacaggccatgcttctgcatgaccacaggcgcccccacccccagcactctcagcaaccgcctccaccacaacaagaaaggagtaaaccatcctttcatgcacctgagccaaaagcccactatgagccagcagatcgagcgagggaagtagaagaccgctttaggaaaaccaatcactcttctcctgaggcgcagtctaaacagaccgggagagtgctggagcctcctgtcccatcccggtccgagtccttctcaaacgggaacagtgagagtgtgcatcctgctctgcagcggcctgctgaaccacaagtgcccgtgaggacaacatccaggtcacccgtgctttctcggcgggattctccccttcagggaagcggccagcaaaactcacaggccgggcaacgcaatagcacatccatagagcctcgcctactatgggaacgagtggagaagcttgtgccccgccccgggtctggctcctctagcggtagtagtaacagcggctcacaaccaggctctcatccagggagtcagtctgggagcggcgaacggtttcgagtgcgctctagttcgaagtctgaggggtcaccaagccagcgcctcgaaaacgctgtaaaaaaaccggaggataaaaaagaggtgtttagaccgttaaaacctgccgacctgaccgcccttgccaaggagctgcgcgctgtggaggacgtgcggcctccgcacaaggtgacagactactccagctcgtcggaggagtctgggaccacggacgaggaggacgacgacgtggagcaggaaggtgcggacgaaagcacatccggccccgaagacaccagagctgccagttctctcaatctgagcaatggagagaccgagagtgttaagacaatgattgttcatgatgatgtggagtcggagcctgctatgacaccctccaaggaggggactctaattgttaggcagactcagtctgcatcctccaccctccagaaacataagagcagttcaagcttcactccattcatcgacccgcggctcctccaaattagccctagcagcgggaccactgttaccagtgtcgtgggcttctcttgtgatgggatgaggccagaggccattcgccaggaccccacccgcaaagggagtgtcgtcaacgtgaatcccacaaataccagaccacagtcagacacaccagaaattagaaaatacaaaaagagattcaatagcgaaatcctctgtgcagctttgtggggagttaacctcctggttggtacagagtcgggcctcatgcttctggatcgctcgggtcagggaaaggtgtaccctctgattaacagaaggaggttccaacagatggatgttttggaaggcctgaacgtcctcgtaacaatctctggtaagaaagataaattaagagtgtactacttatcttggctgaggaacaagatattgcataacgatcccgaggtcgagaagaaacagggatggactactgtaggtgatctagaaggctgcgtgcactataaagttgtgaagtatgagaggatcaaatttttggttattgcactgaaaagttcagtggaagtgtatgcctgggcccccaagccgtaccacaaattcatggcttttaagtcattcggagaactcgtgcataagccactcctcgtggacttaaccgtggaagaaggtcagcgtcttaaggtaatttacggtagctgcgccggcttccacgctgtggatgttgacagtggatctgtgtacgacatatacctgccgactcatattcaatgttcaatcaaaccacatgcgatcatcatcttgcccaacacagacggcatggagttgctggtgtgctatgaggacgaaggagtttacgtcaatacctatggcagaatcactaaagatgtcgtcctccagtggggagaaatgcctacctctgttgcttatatacggagcaaccaaactatgggttggggcgaaaaagccatagagatccggagcgtcgaaaccggacacctcgacggtgtcttcatgcacaagcgtgcgcaacggcttaagtttctctgcgagcgcaacgacaaggtgttttttgcctcggtgcgtagtggcggatcgagtcaggtgtattttatgacgcttggaaggacgagtcttctctcttggtag

SEQ ID NO: 16369 - DNA, 1476 bp, Artificial Sequence
  Description of Artificial Sequence: Synthetic coding sequence
gtgataatacaccgggtgctagaaaagcaggaagtggaagttttctaccccgattttggcaatataggaattgtgcagaagagtagcctgcggttcctgaaatgctgttataccaagttgcctgctcaggctataccatgctcactcgcatgggtccgccccgtggaggagcattggacctcaaaggccattctgcaatttcaaaagttatgcggactgaagcctctagtgggcgtggtagatgagtacgttgatggtatattgaatatttttctgtgtgatactagttctaacgaggatgtctactttcatcacgtgcttcggacagaaggccatgccatcgtttgccgcgaaaatatcagttctaaaggatttagcgaactgaatccgctggccctctacacaacctcctcaggcggccccgaagacattgtactgacagaactcggctatccgtcccagcagcactacttcaatgaagacaggaaaattagcccgcaatccaaagaatccgagctcagaattctccaggatatcaatgacgagaaatctttatctcacctcaagtctgagagtaaggagcccctcaaagattccgaattcgagagcctcaaaacatgcaataaatcttttgaggaggatcctaaatggagcaatcctgagccaaacgacctaaaggaggagaacgaggatgagataccgaccggaatgccctgcctggaatccgttactataggggacgatatttgggatgaaaactggttacccctgcaggctaagatgggcaagggcggcgacgccgcaagccacttgtttactgctagtctcggcggaaaaaaccagtactccagttgtaaagagatgccgcagaaggattggtgcttctctactcccaaggacacatgggacgactcttggcaaccttctggactcgtgaacggtaccaaggtggaggtgcataagcctgaggtcctgggggcacaggagaaaaacactggaaccaaccggactcaaaaacagcttgacattaatggtagtagcgattcctctaccctcccgaaacttgaggagttctgtacatccctgacccagagcgaacagagcgctgacgggtcacagagcgaaccaaataacagccagacccagcccaaacagatccagctcagcacagcggcaccttgcagtactacagccgtagatgactcagcggagaaacccagcggtagtgtcgaaagcagcccggaaatcttaaagaatgaagatttctcctcaagccgggccattacgctgtataaagataaacgccaggagtccgttgatcagctgtcattaattctctcatatgaatgccagatttcccaaaagctgtacattccgaggagcactgctaccgccgctctgggggcggccgcccgcctggctacaagtcgtagtctgctgcattggtatcctagtgtcaaaaggatggaagcctag

SEQ ID NO: 16370 - DNA, 426 bp, Artificial Sequence
  Description of Artificial Sequence: Synthetic coding sequence
atgcctaccacctccaggccggcgctggacgtgaaaggcggaacctctcctgccaaggaggatgcaaatcaggagatgagttctgtggcctacagtaatcttgctgttaaagaccgaaaggccgtcgcaatactccattaccccggcgtagccagtaacgggaccaaggcctcaggggcccccacgtccagctccggctcccctatcggttctcccactacaacacccccgacaaagccaccatcctttaaccttcaccccgccccccacctgctcgcatcaatgcacctccagaaactgaattcacaatatcagggcatggcagccgctacccccggccagcctggggaagccggtcccctgcaaaattgggactttggggcccaagcagggggggcagagtctttatcaccctccgcaggttag

SEQ ID NO: 16371 - DNA, 1188 bp, Artificial Sequence
  Description of Artificial Sequence: Synthetic coding sequence
atggcgagcgctgcatccgtcaccagtctggctgatgaggtgaactgtcccatctgccagggaacactccgggagccagtgacaatagattgtggccataatttttgtcgggcttgccttactagatactgcgagatcccaggccccgatctcgaggaaagccctacttgcccattatgcaaggagcccttccgacccgggagctttagacccaactggcaactggctaatgtggtggagaacatcgagagactgcagctggttagtaccttgggtctcggagaagaggatgtctgccaggaacacggcgagaagatttatttcttctgcgaggacgatgaaatgcagctatgcgtcgtctgcagggaagccggtgaacacgccacacatactatgcgctttctagaagacgcggctgcgccttatagggagcagatccacaaatgcctcaagtgcctgagaaaggagcgcgaagagattcaggaaatacagagccgcgagaacaagcggatgcaagtgcttctgactcaggtctctactaagagacagcaagtcatatcggaattcgctcacctacgaaaatttctcgaggagcaacagtctatcttgctggcccagctcgaaagccaagatggtgacatcctgcgccagcgggacgagtttgacctgttggtagctggggagatctgccggttttcggcccttatcgaggagctggaggaaaagaatgaaaggcccgcacgtgaattactcactgatatccgcagcactttaatcaggtgcgaaacgcgcaagtgccgcaaaccagtggctgtgtctcctgagctgggacagcgaattcgtgacttccctcagcaagcgctgccacttcagagagagatgaaaatgttcctagagaagctttgttttgagcttgactacgaacccgcccacatctccctggatccgcagacatcacatccgaagcttttgctcagtgaagatcaccaacgtgcgcagttttcttacaagtggcaaaatagcccggacaacccacagcgatttgatagagccacctgcgtgctcgcccacaccgggatcactggaggccgccacacgtgggtgtggatggcccgcgtgcccggagactcaggatgttgtcagttttgcagccctccatccgtcctgggcacagaggtagcagcttag

SEQ ID NO: 16372 - DNA, 1344 bp, Artificial Sequence
  Description of Artificial Sequence: Synthetic coding sequence
atggcaaccgactcctgggcactggcggtggacgagcaggaggccgccgtgaagagtatgaccaacttgcagatcaaggaggagaaggtaaaggccgacacaaatggaattatcaaaacaagcacgacagcagaaaaaacagacgaagaggagaaagaggacagagccgcccagagccttttgaacaagttaatcaggtcaaatctcgtagataatacgaaccaggtggaggtgctgcagcgcgacccaaactcacctctgtactcggtgaagtccttcgaagaactgcggctgccacaaaatctgatcgctcagtcacaatctggaactggtaagacagctgcattcgtgctggccatgctgtcgagagtcgaaccatccgaccggtacccacagtgtctttgcttgtcacccacctacgagctggccctccagaccggtaaggtgattgaacagatgggaaaattttatccagaactgaagcttgcttacgctgtgcgcggtaataagctggaacgagggcagaaaattagtgaacagattgtcatagggactcccggcactgttttggactggtgttcaaaactcaagtttatcgacccaaagaaaataaaggtcttcgtcctggatgaggccgatgtcatgatcgccacgcagggacatcaggaccagagcattaggatccagaggatgcttccacggaactgccagatgctcttgttctcggcgaccttcgaagatagcgtttggaagtttgcccagaaagtggttccagaccctaatgtgattaaactgaaaagggaggaagagacgctagatacaatcaaacagtactacgtcctatgtagctctcgggacgaaaagtttcaggcattgtgcaatctctacggggcaattaccatcgcgcaggccatgatcttctgccacacccgtaaaactgcatcatggttggccgctgaactgtccaaggaaggccaccaagtggcactgctgtcaggggagatgatggtggagcaaagggcagctgtaattgagcggtttagggaaggcaaggaaaaggttctcgttaccaccaacgtttgcgctcgcgggatcgatgtcgagcaggtcagtgtagtgatcaatttcgacctgcccgtggataaagatggcaaccctgacaatgaaacatatcttcatcgaatcggaagaacaggcaggtttggaaagcgcgggttggccgttaatatggtggatagcaagcatagcatgaatatcctgaatagaattcaagagcattttaacaaaaaaatcgaaaggctcgacactgacgacctcgatgagattgagaagatagccaactag

SEQ ID NO: 16373 - DNA, 630 bp, Artificial Sequence
  Description of Artificial Sequence: Synthetic coding sequence
atggcttcttctgatcttgagcagctgtgtagccacgtaaatgagaaaatcgggaatattaagaagacgctctctcttcgcaattgtggccaggagccaacactgaaaactgtcttaaataaaatcggagatgaaatcatcgttattaacgaactgctcaataagcttgagctggagatccaataccaggaacagactaacaactcacttaaagaactgtgcgagtcgctggaggaggattataaagatatagagcacctaaaagagaacgtcccaagccacctgcctcaggttactgtgacccaaagctggtacatgaaaagtcgccttacctacaaccagatcaacgatgttatcaaagagataaacaaggcagtgatcagcaaatataaaatcctgcatcaacccaagaaatccatgaactccgtgacgcgtaatctgtatcacagattcatagacgaagagacgaaagacacaaagggccgttatttcatcgtcgaagcagacatcaaggaatttaccacccttaaagctgataagaagttccatgtcctcctgaatatcttaagacattgccgccgtctcagtgaggtgcgaggaggcgggctaactcgctacgttattacttag

SEQ ID NO: 16374 - DNA, 1125 bp, Artificial Sequence
  Description of Artificial Sequence: Synthetic coding sequence
atggacagcgtgcgatctggcccattcggacagctgtttaggccagataattttattttcggccagacaggtgccgggaacaactgggcaaagggtcactatactgagggtgcagaactggtggatgcagtgcttgacgttgtgcggaaagaatgcgagcattgtgattgccttcagggttttcagcttacgcactcactgggcggcggtacgggaagcggaatgggcacactgctgattagcaaaatcagggaagagttcccggataggataatgaacacgttttcagtgatgcctagccctaaggtgtctgacaccgtggtagagccctataatgctactctgtcggtacatcagcttgtggaaaacaccgacgagacctactgtattgacaatgaagctctgtacgacatttgcttcagaacactgaaactaactacgcccacatatggagaccttaaccaccttgttagcgccacaatgtcaggcgtgactacttccctccgttttcccggacagttgaatgcagacttgagaaagctcgctgtgaatatggttccattccctcggctccatttctttatgccgggcttcgcacctctcacctcacgtggtagccagcagtaccgggctctcactgttcccgagctcacccagcagatgtttgatgctcggaatatgatggccgcctgcgatccacgccacgggagatacctgacagtagctaccgtcttccgcggccctatgtccatgaaggaagttgacgagcaaatgctagctatccagtctaagaacagcagctactttgttgagtggatccctaataatgtgaaagtagcagtctgtgacataccgccgcgcggactcaaaatggcttccacgttcattggcaattcgactgccattcaggagctgttcaaaaggatctcagagcaattcagcgcgatgttccgtagaaaagcttttctgcactggttcaccggagaggggatggacgaaatggaatttacggaagctgaatcaaatatgaacgatctggtgtccgaataccagcagtatcaagatgctaccgcgaacgatggcgaggaagcctttgaggatgaagaggaggagatcgatgggtag

SEQ ID NO: 16375 - DNA, 2289 bp, Artificial Sequence
  Description of Artificial Sequence: Synthetic coding sequence
atggccagcctgcttcaggatcagctgacgaccgaccaagatctactgctaatgcaggagggcatgccaatgcggaaggtacgctctaaaagctggaagaaactgcgatatttcaggctgcagaacgacgggatgacagtgtggcacgcccggcaagcccgtggcagtgcaaagccaagtttcagtatctctgacgtcgagacaattcgtaatgggcacgactctgagctcctgcgcagccttgctgaagagcttcctctcgagcagggatttaccatcgtgtttcacgggcgtcgctccaatttggatttgatggctaattccgttgaggaggctcaaatctggatgcgtggtttgcagctattggtggatctggtgacatctatggatcaccaggagagacttgaccaatggctctctgactggttccagagaggcgacaagaaccaagacggcaagatgagttttcaggaagtgcagagattgctgcatctgatgaacgtagagatggaccaggaatacgcgttttctctctttcaagccgccgacacgtcccaatccgggactcttgagggcgaagagtttgtccagttttataaggccttgacaaagcgcgcggaggttcaagaactgtttgagtcattctcagcagatggacagaagctgacattactggagttcttggatttccttcaagaagaacagaaagagagggattgcacatcagagctcgcgttggaattaatcgatcgctatgagccctctgattccggcaaactccgccacgtgctcagtatggacggttttttgtcttacctatgctcaaaagacggagacatcttcaatcctgcctgcctgcctatctaccaagacatgactcagcccctgaaccactacttcatctgcagttctcataatacctacctggtcggggaccagctttgtggtcagtcgagtgtagaggggtacatccgggctttgaagagagggtgcagatgtgtggaggtggacgtgtgggacggaccctctggggaaccggtggtctaccacggccataccctaacctcacgcattttgttcaaagatgtcgtggccaccgttgcgcaatacgccttccagacttctgactatcccgtaatcttatctcttgaaacgcattgctcttgggagcagcagcagacaatggcaagacatttgactgaaatactgggtgagcagctgcttagcaccacactggatggagtgcttccaacgcaactgccttcaccagaggaactaagaagaaagatactggtgaagggcaagaagctgacacttgaggaggatcttgaatacgaggaagaggaggccgagcccgaactcgaagaatccgagctcgctctagagagccagtttgaaactgagcccgagccacaagagcagaacctgcaaaataaggacaaaaaaaaaaaatcaaaaccgattctgtgtcccgccctatcctccctggtaatctatctgaagtctgtttctttcaggtcatttactcacagcaaagaacattatcacttttacgaaatcagtagcttctccgaaacgaaggccaaacggcttatcaaggaagccggcaatgagttcgtccaacacaacacctggcagctttcaagggtatacccatctggcctccgcactgactccagcaactacaatccccaggagctatggaatgcgggctgccagatggtcgccatgaacatgcaaacagctggcttggaaatggatatatgtgacggacacttccgccaaaatggcggatgtgggtacgtcctcaaacccgacttcctgcgggacatacagtcttcgttccaccctgagaaacccatttcaccattcaaggctcagaccctgctcattcaggttattagcggacagcaactgcctaaggttgacaagacaaaagaggggtcaatcgttgatcccctcgttaaagtgcagatttttggggtgagactggatacagccagacaagaaaccaattacgtggagaataatggcttcaatccctattgggggcagacactgtgctttcgggtgcttgtgcctgaactggccatgctcagatttgtggttatggactatgattggaagtctcggaacgatttcatcggccaatataccctgccctggacatgtatgcagcagggatatcgtcacattcatctgcttagtaaagatgggattagcctgcgccccgcatctatatttgtgtatatttgcatccaagaagggcttgagggggatgagtcctag

SEQ ID NO: 16376 - DNA, 1461 bp, Artificial Sequence
  Description of Artificial Sequence: Synthetic coding sequence
atggcggaattacaaatgctcctggaggaggaaattccgggaggaagaagagcgttgttcgacagttacactaacctagaacgggtggccgactattgtgaaaacaattatatccaaagcgccgacaaacagagggcactggaggagaccaaagcgtacacgacgcaaagcctcgcctccgtggcatatctcattaatactctggccaacaatgtactgcaaatgctggacatccaggctagtcaactgcgaagaatggaatcatcgatcaatcatatttcccagactgtggatattcacaaggaaaaggtggctaggcgagagatcgggattttgactaccaacaaaaacaccagccggactcataaaatcatcgcccctgccaacctcgagagacctgtaaggtatattcggaaacccatcgactacacaattttggatgatatcggtcatggagtcaagtggcttctcaggttcaaagtgtcaacacagaatatgaaaatgggggggctcccacggacaaccccccctacacagaaacccccgtcaccgccaatgtcaggtaagggcactttgggcagacactccccataccgaaccctggagcctgtgagacctcccgtggtgcccaacgactatgtgccaagcccaacccgcaatatggcgccctcccagcagagccctgttcggaccgcttcagttaatcaaaggaaccgcacctattcctcctcagggagttctggaggatcgcatccaagttcgaggtcctcctctagggagaactcaggttcgggctctgtcggcgtgccaattgctgtgcctacaccttcaccaccaagcgtgttccccgcgcctgccgggtcagctgggacaccgccacttcctgctactagcgcatcagctcccgctccactggtccccgcaaccgttcctagttcgacggccccagatgctgctgcaggtggcgcccagacactcgcggatggctttacgtcgcccacaccacccgtggtgtccagcacgcctcccacagggcaccccgttcaattttactcgatgaacaggccggctagtcggcatacaccaccgactattgggggatcgctgccataccgaagaccccccagtataacttcacagacttccctgcaaaaccagatgaatggaggtcccttctactcccagaacccagtttcggatacccctcctccgcctccaccggttgaagagccagttttcgacgagagccctcctccacccccccctccagaagattacgaagaagaggaagcagcggtagtagaatactccgacccatatgccgaagaggacccgccctgggccccaagatcctacctggagaaggtggtggcgatttatgattacaccaaagataaggaagacgaactgagtttccaggagggggccatcatctatgtaattaagaagaatgacgattag

SEQ ID NO: 16377 - DNA, 2145 bp, Artificial Sequence
  Description of Artificial Sequence: Synthetic coding sequence
atgttaagccccaagattagacaggcacgaagagcaaggtctaaatccttggtcatgggagagcaatctaggagcccaggacgcatgccttgtccgcaccgccttggacctgtgctcaaggcgggctggttaaaaaaacagcggagtataatgaagaattggcagcagcggtggttcgtcctgcggggcgaccagttattttattacaaagataaagacgaaatcaagccacagggcttcatcagtctgcaaggcacacaagtaaccgagttgccacccggccccgaggacccgggaaaacacctctttgaaattagtcccggcggggctggagagcgcgagaaggtcccagccaatcctgaggccttacttctgatggcctcaagccaacgagacatggaagactgggtgcaggccattcgccgcgtaatctgggctccgctgggcggaggaacagcgcgtaggagccatgcacatcctcttgaaccgttgccaccaggtatcttcggccaaaggctggaagaaaccgtacatcacgagcgcaaatacggccctcgcctcgctcccctgctggtagagcagtgcgtggactttattagagagaggggactgaccgaagagggactttttcggatgcccggacaggccaacctagtccgggaccttcaggactcttttgattgtggggagaaaccgctttttgactcaacaacagatgtacacacagttgctagtttgctgaagctctatctgagggagctgccagagccagtggtgccttttgcaaggtacgaggatttcctgagttgtgcccagctgctgaccaaagatgaaggggagggtaccctggaactggcaaagcaggtcagcaatttgccacaggcaaattacaatctactgcgctacatctgcaagttcctggatgaggttcaggcctacagcaacgtaaacaaaatgtcagttcagaatctcgcaacagtcttcggccctaatattctcagacctcaagtagaagaccccgtgactatcatggagggcacaagcctggtgcagcacttaatgaccgttcttatcaggaaacactctcagctcttcactgctccagtgccagaaggcccaactagtccgcgggggggccttcaatgcgccgtggggtgggggagtgaggaggtcacccgggactctcagggggagccagggggccccggcttacccgcacacaggacctccagcctagacggagcagccgttgccgtactatcccgcacggcgccgactggtcctggcagtcgatgtagtcctggtaaaaaggtgcagactctgcctagttggaagtccagcttccgtcagccccgatcgctgagcggatcacccaaggggggaggttcctctcttgaagtgccaattatctcatccggcgggaattggctgatgaatggcctgagttccttacgcggccaccgtagggcctcatcaggagaccgcttgaaggattccggctccgtgcagagattgtccacatatgataatgtacccgccccgggcctggtgccaggcattccgagcgttgccagtatggcgtggtccggggccagtagctccgaaagctcagttggagggagcttgtcctcgtgcactgcctgtcgcgcctcagactcctccgcccggagcagcctgcatactgactgggccctcgagccctctcctctcccatccagctcagaggatcctaaaagtctggacctggatcactcaatggatgaggcaggcgcgggcgcctccaattctgaaccaagtgagcctgatagtccaacgcgtgagcatgcgcggaggtctgaagcgcttcaggggctagtgaccgaactacgcgccgaattatgtaggcaacggactgagtatgaaagatcagtgaagcggattgaggagggttctgcggatctcaggaagaggatgtctcggctcgaagaagagcttgaccaggaaaagaaaaagtatataatgctggaaatcaaactccgcaactccgagagggcccgcgaggacgccgagcgtcgcaatcagctcctgcagcgcgagatggaagaattcttttccaccttgggatctctgacagtcggtgctaagggcgcaagagctcccaagtag

SEQ ID NO: 16378 - DNA, 381 bp, Artificial Sequence
  Description of Artificial Sequence: Synthetic coding sequence
atgtggactgcccgtggccctttccggagggatcggtggtcaagcgaagatgaagaggcagccggaccttctcaagcactgtccccattgctgtcagatacgaggaagatcgtgagtgagggcgagctcgaccagctggcacagattagaccccttattttcaatttccatgagcagacggccattaaggattgcctaaagatcctggaggagaagaccgcagcttatgatattatgcaggaatttatggctctagaactaaagaacctgccaggtgaatttaattctgggaaccagccttccaatcgtgagaagaacagataccgcgacatattaccattccagcaccatgggtacagcggcccaaatgaacgcacgtag

SEQ ID NO: 16379 - DNA, 2442 bp, Artificial Sequence
  Description of Artificial Sequence: Synthetic coding sequence
atgtcagagcaaggcgacctgaatcaggctattgcggaggaaggtgggactgaacaggaaacggccacaccagaaaacgggatcgtgaagtctgagagtctggacgaggaagaaaaactggagctgcagaggcgtttagaagctcagaaccaggaacgccggaagtccaaatccggagctgggaaagggaagctgaccagatcccttgccgtgtgcgaggaatccagcgcccgtccaggcggagaaagcttgcaagaccaggaatctatacatctgcaattatcttccttttcttctttacaggaggaggataaatcgagaaaggatgattccgagagggaaaaggaaaaagataagaacaaggataaaacgtcagaaaaacccaaaattcgcatgctatccaaggattgctctcaggagtatactgattctacgggcattgatctccatgagtttcttatcaacacattgaagaacaacagtcgtgacagaatgatcctgctgaaaatggagcaggagatcatcgactttatcgccgacaataataatcactataagaagttcccacagatgtccagttaccagagaatgctggtacaccgggtagctgcatatttcggcctagaccacaacgttgaccagactgggaagagcgtgatcatcaacaagacctcttcaacccgaattccggagcagcgcttctgcgaacatttgaaagatgagaagggtgaggagtcgcaaaaacgcttcatcctgaaaagagataatagttcaatcgacaaggaagacaaccagagcgtgtgttcacaggagtctctgtttgtggaaaactctcgactgctggaggattcaaacatctgcaacgagacatataaaaaacggcaactctttagaggaaaccgggatgggtctgggcggacctcagggagtcgacagagctcttccgagaatgaacttaagtggtccgatcaccagagggcctggagcagtactgactccgacagttcaaaccgtaatttaaagcctgcgatgacaaagacggcctccttcggtggcatcacagtgctgacaagaggggacagtacctcgtccacacgtagtaccgggaaactgagtaaggccgggtcagagtcctctagttcggcaggatcctcaggctccctcagccggacgcacccccccctccagtctactcctttggtcagcggcgtcgcagcgggatctccagggtgtgttccttatcccgaaaacggcatcggaggccaggtggccccttcttctaccagctacatcctcctcccgctagaggccgccacaggtattcccccaggctctattctgctgaacccacataccggtcagccttttgtcaaccctgatggcacacctgcaatttacaaccctccgacttctcagcagccgttgcggtccgccatggtgggccagtctcaacagcagccacctcagcagcagccgtccccacagccacaacaacaggtgcaaccaccgcagccccagatggccggacctttggtgacacagagtgtacaggggctccaggcttcctctcagagtgtgcaatatcctgcggtgtctttccccccccagcacctgctacccgtctccccaacccagcactttccaatgagagacgacgtagcaacacaatttggtcagatgacattatcaaggcaaagttctggcgaaacgcctgagccccccagtggacctgtctacccctcatctctcatgccccagcccgctcagcagcctagttatgtgatcgccagtacaggccagcaactcccgacgggaggcttttccggcagtggcccccccatctcacagcaggtgctccagccaccaccaagcccacaggggttcgtgcagcagccccccccagctcagatgccagtctattactaccctagcggtcagtatccaacctccacaacacagcagtatagacccatggctcctgtgcaatataatgctcagagaagccagcaaatgcctcaggcagcccaacaagccggataccagcccgtactttcgggccagcaggggttccagggtctgattggcgtccagcaaccacctcagtcacaaaatgtgattaataatcagcagggtacccctgtccagtccgtaatggtgtcctatcctactatgtccagctaccaggtgccgatgacccagggcagtcaaggcctccctcaacagtcataccagcaacctataatgctgccaaatcaggctggtcaggggagcctgcccgcaactgggatgccggtgtactgtaacgtgacccccccaacaccccagaacaatttaagactgatcggaccacactgtccttctagtaccgtcccagtgatgtcggcatcttgtcgcaccaattgcgcaagcatgtcaaatgcaggttggcaagtaaagttttag

SEQ ID NO: 16380 - DNA, 1467 bp, Artificial Sequence
  Description of Artificial Sequence: Synthetic coding sequence
atgaatggggcattagaccacagtgaccagccagaccctgatgctattaaaatgttcgtaggacagatcccaagaagctggtccgagaaagagctgaaagaactgtttgagccatacggggcggtataccaaatcaacgtattacgggacaggagtcagaatccgcctcagagcaaaggctgctgtttcgtgaccttttatacacgcaaggccgccctggaagcccagaacgccctgcacaacattaaaaccttgccaggtatgcatcatcctatccaaatgaagcctgccgactcagagaaatctaacgccgttgaggatcgcaaactgttcatcggaatggtttccaaaaagtgtaacgaaaacgatatccgcgtcatgttttcgccctttgggcagatcgaagagtgtaggatactgaggggtcccgatggcttaagccgagggtgtgcctttgtgactttctctacgagggccatggctcagaacgcaattaaggcaatgcatcagtcgcagacaatggaaggatgctcgtctcctatagtggtgaaattcgcagatacacagaaggacaaagaacaaagacgactacagcagcagctcgcccaacagatgcaacagctgaatactgctacgtggggaaacctgacaggtttaggcggcctgacgccgcagtatctagcactgctgcaacaggcaaccagtagcagcaatctcggggcattctcaggcatccagcaaatggctggtatgaacgctctgcagctacaaaatttggccactctggccgctgcagcagcagctgctcagacctcagcaacaagtactaacgctaatcccttatccaccacatcctcagccttaggagccttaacctctccagtggctgcctcaacgcccaatagtacggctggggctgcaatgaactcattaacctcactgggtaccttgcaaggattggccggcgcaaccgtggggctgaataacattaatgcactcgcagggaccattaactccatggcggctctgaacggagggctcggagccacgggcctaacgaacggtactgccggtaccatggacgctcttacacaggcgtattctggcatccagcagtatgcagctgccgctctgccaaccctgtactcgcaatctttactgcagcaacagagtgccgctggtagtcagaaggagggacccgaaggagccaaccttttcatttaccatctacctcaagaattcggggatcaggatattctgcagatgttcatgccttttgggaacgtgatcagtgccaaggtgtttatcgacaaacagacaaacctgagcaagtgcttcgggttcgtttcttatgacaatcccgtctctgcacaagctgcaatccaggccatgaatggctttcagattggaatgaaacggttgaaggtgcagctcaagagaagcaaaaacgatagtaaaccttactag

SEQ ID NO: 16381 - DNA, 474 bp, Artificial Sequence
  Description of Artificial Sequence: Synthetic coding sequence
atggcgacgtccgccccgctgagatctttagaagaagaggtgacttgctctatctgcctggactacttgagagacccggtcaccattgattgtggacacgtgttctgtagatcatgcacaaccgatgtcaggcccatctcagggtcacggccagtgtgtccactgtgcaaaaagccctttaaaaaagaaaacatcagacccgtgtggcagcttgcctcactggttgaaaatattgaacgcttgaaggtcgacaaaggcagacagcccggagaagttacacgtgagcaacaagatgccaaactgtgcgagaggcatcgcgagaagttgcactactactgtgaggacgatggcaagctgctttgcgtgatgtgtagagaatcccgcgagcaccggccccacaccgcagttctgatggaaaaggcagctcagccccaccgggaaaagatactcaatcatcttagcacgctccggtag

SEQ ID NO: 16382 - DNA, 303 bp, Artificial Sequence
  Description of Artificial Sequence: Synthetic coding sequence
atggcttccgaagacatcgcaaagctcgcagaaaccctggccaagactcaagtggctgggggacagctgtcattcaagggaaagtcactcaagctgaacactgcggaggatgctaaagacgtgatcaaggaaattgaagacttcgattcactggaagccttaagactggagggtaacaccgtaggggtggaggccgcaagagtgattgccaaggccttagaaaagaaaagcgaactgaaacgttgccactggagtgatatgttcacagggcgcctgcgtaccgagatcccaccagcgctttag

SEQ ID NO: 16383 - DNA, 459 bp, Artificial Sequence
  Description of Artificial Sequence: Synthetic coding sequence
atgtcagtgacctatgatgatagtgtgggcgtggaagtgtcttcggattcgttttgggaggtcggcaactataaacggaccgttaaaagaatcgatgacggacaccgcctgtgctccgacctgatgaattgtttgcacgagcgcgctagaatcgaaaaggcatatgctcaacaactaacagagtgggcgagacgatggagacaactcgtggaaaaagggccacagtatggaactgtggaaaaagcgtggatggcattcatgagcgaggcagaaagagtatctgagctgcatctggaggtaaaggcatcactgatgaacgatgatttcgagaaaatcaagaattggcagaaggaggccttccacaaacaaatgatgggcggctttaaagaaacaaaagaagctgaggatggatttcgcaaagctcagaaaccttgggctaaaaaactaaaagaggtgtag

SEQ ID NO: 16384 - DNA, 543 bp, Artificial Sequence
  Description of Artificial Sequence: Synthetic coding sequence
atgtttgcatcagatctcctcagagcactcgattgctgtccaggggccggatcatctggcttattgccccagttggggcccaggcagcttctggcttttaccgttaattgtctggggaatcaccggtatctcggattctttgaggatctggaacaacgtcataaagcccaggttctcgtggaggacatttctgacatcctggaggagcatgcagagaagcacttccacccctacattgcatactgttctaatgaggtgtatcaacagcgcaccctccagaagctgatctctagtaacgccgcattccgcgaagccttgcgtgagatcgaacgccgccctgcctgtggaggattacccatgttaagtttcctcatcctgccaatgcagagggtgacccgtctgcccctcctcatggacacgctctgcctgaagacccagggacactcagagcggtacaaggctgcatcccgtgccctaaaggccataagtaaactggtacggcagtgtaatgagggtgcccataggatggaacgcatggagtag

SEQ ID NO: 16385 - DNA, 2487 bp, Artificial Sequence
  Description of Artificial Sequence: Synthetic coding sequence
atggacagtgaggctttccagtctgcccgggattttctggacatgaatttccaaagcctggctatgaaacacatggacctcaagcaaatggaactggacacagcggcggcaaaggtcgacgagctgacaaaacagctggagagtctttggagtgatagcccagcgcctcccgggccccaagctggaccccccagtcgcccacctcgctattcctcaagcagtatacctgagccctttgggtcaagggggtctcccaggaaagcagccacagatggtgccgatactccgtttgggagatccgagagtgccccaaccctgcacccttatagcccattgagtcctaaaggtaggccgtcatccccgaggacgcctctgtacctgcaacccgatgcctatggctctctcgacagggccacgtccccgcgccccagggccttcgatggtgccggatcaagtctgggccgcgccccatccccccgacccggacccgggccactgcgccagcagggcccaccaacgccatttgatttcctgggaagagccggttcgccacgaggatctccactggctgagggtcctcaggcctttttccctgaacggggcccttccccaaggccgcccgccacagcttatgacgctccagcttccgctttcggctcaagcttgctcggctccggggggtctgcctttgcgccaccactccgggctcaggatgacttgacccttcgacgcagacctcccaaggcttggaatgaatcagatcttgatgtggcctatgaaaaaaagccaagtcaaacagcttcgtatgagagactggacgtcttcgcccgtcccgcatctccctctttgcagctgctgccttggagagaatctagcctggatgggctcggtgggacaggcaaggacaatctgactagcgccactctgcccagaaactataaagtcagccctcttgcatctgaccgccgcagcgacgcgggttcctatcgccgcagtctagggtcagcaggcccctcagggactctgcccagatcctggcagcctgtctctcggatccccatgcctccctcttccccccagccacgaggggcccccagacagcgtcccatacccttgtctatgatattcaaactgcaaaatgccttctgggaacacggagcctctcgcgccatgctgcctggatcaccactcttcacccgtgcgcctccccccaagctgcagccacagcctcagcctcagcctcagcctcaatcccaacctcagcctcaactaccccctcagccccagacacaaccgcagactcctacccctgcacctcagcacccacaacaaacctggccgccagtgaacgagggtcctcccaaacccccaaccgagcttgaaccagagcctgagatcgaggggctgctgaccccagtgttggaggctggggacgtagatgagggcccagtggctagaccattgagccccacacggcttcagccggcactgcctcctgaggcccaatcagtccccgagctggaggaggttgctagagtgctggccgagatcccccgtccgctaaaaagacgcggctctatggagcaagcccccgccgttgccctaccccccacccataaaaaacaataccagcagattatttctcgtttattccatagacacggcggaccaggccctgggggccctgagccagaattgtctcccatcacagagggatcagaggcccgagccggaccaccggcgccagctcctcctgcacccattccaccccccgccccctctcagagtagcccacctgagcaaccccagtccatggagatgcggagcgtcctgcgcaaggccggatcccctaggaaggctcgaagggctcgactgaatccactggtactgttgctggatgccgccttaacgggcgagctggaggtagtccaacaggcggtgaaagaaatgaatgatcctagccagcctaacgaggaaggtattacggcccttcacaacgcgatctgcggggcaaactattcgatagtggatttcctgatcactgctggggccaacgtgaactctcccgatagtcatggctggactcctctgcactgtgctgccagctgcaatgacacggttatctgtatggccctggtgcagcacggggcagcaatatttgctactaccttgagtgatggtgctacggccttcgaaaagtgcgatccttacagggaaggctatgcagattgtgcgacgtatctcgccgatgtcgagcaatcaatggggctgatgaattctggtgcggtgtatgcgctgtgggattactccgcggagtttggagacgaacttagtttcagagaaggcgaatccgtgacagtcctacggcgggatggtcccgaggagactgattggtggtgggccgctctgcatggacaggaagggtacgttccccgcaattatttcgggctttttccccgcgtcaaaccgcagcgcagcaaggtgtag

SEQ ID NO: 16386 - DNA, 4455 bp, Artificial Sequence
  Description of Artificial Sequence: Synthetic coding sequence
atgagaatacccgatcagaaatatgtgacgctcaagctgaatgatgtcatccggtttgggtacgattcgaatatgtatgtcctggagagggtccagcatcgtgtgcccgaagaagcccttaaacatgagaagtacacttcacagctgcaggtgtcggtgaaaggcctggcgcccaaacgctccgaggctctgccggagcacacaccctattgcgaagccagcaatccaagaccagagaagggggatagaaggccgggtacagaggctgccagctaccgaacgcccctttacggacagccctcatggtggggtgaggacgacgggagcacactcccagacgcgcagagacagggtgagccctaccctgaacgaccaaagggccctgtgcagcaggatggcgagctgcatggattcagagcccccgccgagcctcaaggatgcagctttcgccgcgaacctagctacttcgagatccctaccaaagagacgcctcagccctcccagcctcctgaggtgcccgcgcacgagatgcccacaaaggatgcagaagcgggtgggggtggtgccgcgcctgtggtgcagtcccatgcctcttttacaatcgaattcgatgactgttctcccggaaagatgaaaatcaaggaccacattactaagttttccctccgacagagacgcccaccaggtaaggaggccactcctggagaaatggtaagcgcagaaacgaaagtggcggattggctggtccagaacgatcctagcctgctgcaccgagttggccctggggacgatcggcacagtactaaatctgacctgccagtgcacacgaggaccctgaagggccataagcacgaagatggaacccagtcagactccgaggatccactggccaaggcggcgtcagcagccggcgtcccacttgaggcgtccggagaacaggttagacttcaaagacagatcaagcgcgacccacaggaactgctgcacaaccaacaagcctttgttattgagtttttcgatgaagacacacccagaaagaaacggagtcagagtttcacccactctccaagcggagatcctaaggccgacaaaaggcgggggcctactccagcagatcgagatcgacctagtgtgccagcccccgttcaagccggaggaagatcaagcgggccgcagcgagccggctcgttgaagcgggagaaaacggaggaacgactgggctccccctcacccgccagtcggactcccgcacggccctttggcagcgtggggcggcggagccgcctggcacaggacttcatggctcaatgcctccgcgagtctagcccagccgcacgtcccagtccagagaaggtgccgcccgtgctgcccgcccctttaacgccacacgggacatcgccagtggggcccccaacaccccccccagcccctaccgaccctcagctgactaaagccaggaagcaggaggaagacgattccctcagtgatgcgggcacatacacaatagaaaccgaggcacaagatactgaggtggaggaagcgcgaaagatgatagatcaagtgttcggagtcctcgaaagccctgagctgtcacgggctagctcagctacattccgcccggtgattcgaggagatagggatgagagtgacgatgggggggtagcccagcgcatggccctgttacaggagtttgcgagccgtcctctaggggccgctccacaggccgaacaccaggggctgcctgtccctggctctcctggcggccagaagtgggtctcaaggtgggcctccttggctgacagctactcagatccaggattgaccgaagacggccttgggagaaggggtggtgaacccgaagggagcctccccgtccgaatgaggagaagattaccacagttgccatctgagcgggcagacagcccagccggacctgagtccagtcgacgtagcggcccagggccacctgaactcgattccgaacagccctcgcgcttgttcggccaagaggaactagatcctgatagcctgagcgacgctagcggcagcgatggtggtagagggcctgagccaggagttgaacctcaggacagtcgccgccgcagtccccaggaggggcctacctggtcccgtggccggcggtcaccacgggcaccgggtgagcccactcccgccagcttcttcataggcgaccagaatggcgacgctgttctctcaagaaaaccactggccgccccgggagatggggaaggtctgggtcaaacggcgcagccgagcccacccgctcgcgacggggtgtatgtgagtgcaaacggccgtatggtgatacaactgagaccgggccgctcacctgaacccgacggccctgcccccgcctttctgcgacaggaaagcttcacaaaggagcccgcgtccggccccccagcacctggcaaacctccacacatttcatctcaccctctcctgcaagacctggccgccactcgagcagctagaatggactttcattcacaggatacacatctgattctgaaggagacagaaaccgcgttagctgccttggaagccaggctcctgtctaatagtgtggatgcagagtgtgagggaggcagcacccctcgaccccctgaggatgcgctgtctggcgacagcgatgtcgatactgccagtaccgtttccctgcggtcaggaaagagtggaccctcacctaccacacctcagcccctgcgagcacagaaagagatgtctccctcccctccagccgcacaggatcctggagggaccgctctggtcagcgcaagagagcagtcctcggagcggcagcaccaccccctagggcccaccgacatgggtcgaggagaaccagtgagacggtcggccattagacgcgggcaccgcccccgcggctccctggattggcccagcgaagagaggggacccgtcctcgcgcacctgccttcctccgatgtgatggccagcaaccacgaaacccctgaggctaccggcgctggaagattaggctccagaagaaagcccgccgccccaccgccctcacctgccgcaagagaagagcagtcccggagtagtgcctcaagccagaaaggcccacaggcactcactagatccaattcactcagcacaccacgccctacccgggcctcacggttgaggcgagcgaggttgggggacgcctccgacaccgaggctgccgatggcgagagaggctctttagggaatcctgagcccgtgggccgccccgcggccgagcaggccaagaagctgagcaggctggatattctggctatgcctcgcaaaagagcgggaagcttcacgggcacctcagatcccgaagcagcccccgctcgcacctcattctccggccgttccgtggagctctgttgtgcttccaggaaaccaaccatggctgaggccagagctgtgagtcgcaaggccgccaatacagcaaccacaaccggacctaggcagcccttttcgcgagcgaggagcgggagcgccaggtatacctccacaacccagactccccgcgccggcagcagctctagagcccgctctagagcacccgggcctcgagatactgatgacgacgaagaagagccggatccatacggattcattgtccaaaccgcagaaatagcagagatagcaaggctgtcacagaccctggtgaaggatgtggcaatcctcgcccaagaaatacatgatgtggcaggcgatggggacacactgggaagctccgagccagcacactcagcaagcttgtctaacatgcccagtactcctgctagtactatctccgccagagaggaactagttcagagaattcctgaggcctccctaaacttccagaaggtgccacctggatcactgaacagtcgcgatttcgatcaaaacatgaatgactcctgtgaggacgcactggccaacaaaacccggccccggaatagagaagaggtaatatttgacaacctgatgctgaatcccgtttcacagctctcacaggctatccgggagaacaccgagcatttagcggaaaaaatgaaaatcctctttcagaataccggcagagcctgggaggacctggaagctcggattaacgccgagaacgaagtccctatcttaaaaaccagtaataaagagatctcgtctattttgaaggagctgcggagggtgcagaaacagctggaggttatcaacgccatcgtggatcccagcggctcattggacctcctcaccggaaatcgttccttagcctcctcggcacaacccgggctgggtaagggaagggtggcagcacagtcaccccccagtcctgccagtgctgaagcattgctgcccgccttgccgttaagaaattttccacagagggcttcctgcgggcccccttcactcccggaccccactttcctccctgacgccgaacgcttcctgatttag

SEQ ID NO: 16387 - DNA, 150 bp, Artificial Sequence
  Description of Artificial Sequence: Synthetic coding sequence
atgtaccctaatccgctgatatactgtacctgctgggatccctggaacctgggacctcgcaagctgataaagaccccgcaactgcctaggaagaacagcactggtagctctaagctgacaccacttgtgcccgcccctaagaaccactag

SEQ ID NO: 16388 - DNA, 948 bp, Artificial Sequence
  Description of Artificial Sequence: Synthetic coding sequence
atggccttccctgaacccaaaccaagacccccggagctcccccagaaaagacttaagactttagattgcggtcaaggcgctgtgagggcggttcgttttaatgttgatgggaactattgtctgacatgcggttcggataagacgctgaagctgtggaaccccctacgtggtaccctgcttcggacgtatagcggtcatgggtacgaagtgctcgacgccgcagggagcttcgataattcatcactgtgttctggtggcggtgataaggcagttgtcctatgggatgtcgcaagcggccaggttgtgagaaagttcaggggccacgcagggaaggtgaatacagtgcagttcaatgaagaggctactgtcatcctgtccggatcgatcgacagcagtattagatgctgggattgtcgaagccggaggccagagcccgttcagacgcttgatgaggctagggatggagtgagctcagtcaaggtgtcagatcacgagattcttgcagggagcgtagacggtagagtgcggagatatgacttgcgaatgggtcagctgttctctgactacgtgggcagcccgataacctgtacatgctttagtagagatggacagtgtacactcgtgtcgtctttggactccacactgcggttactggacaaagacacaggtgagctgctgggagagtataagggacacaagaatcaggaatacaaactggactgctgcctgtccgagagggatactcacgttgtgtcctgcagtgaggacggaaaggttttcttctgggatctggtggaaggcgcactagcattggcacttcccgtgggatcgggagttgtacagtctctggcatatcaccccaccgagccctgtcttcttacagccatgggaggcagtgtgcagtgttggagggaggaagcctacgaggctgaggatggtgcaggttag

SEQ ID NO: 16389 - DNA, 3015 bp, Artificial Sequence
  Description of Artificial Sequence: Synthetic coding sequence
atgaaggccacgaccccactccaaacagtggaccggcccaaagactggtacaaaactatgtttaagcagatacatatggtgcataagccaggattatacaaccccccatacagcgcccaaagtcatccagccgccaagactcaaacatatcggcctttgagcaagtctcatagcgacaattcgcctaacgcgtttaaagatgcctcctcacccgtgccacctcctcacgtaccacctcccgtgccgcccttacggccacgtgaccgctcttccacagaaaagcacgattgggaccctccggatagaaaagtcgatacccggaagtttcgtagtgagccgcggtcaatttttgagtatgagcctggaaagagcagtattctacagcacgagaggcccgcctccctgtaccagagctctattgacaggtccttggagagaccaatgtcttctgcctccatggcctccgatttccgcaagcgccggaaatcagagccagccgttggacctcctagagggctgggagatcagagcgcctcacggaccagccctgggcgcgtcgatttgcccggctctagcacaacactgacaaagagtttcacaagctcaagtcccagcagccccagtagagctaagggcggagacgactcaaagatctgcccttccctgtgctcttatagtggcctgaacggcaatccttcttcagaacttgattactgttctacctatcgccaacatctggatgttccccgcgattctccccgagctatcagcttcaagaacggttggcagatggccaggcagaacgccgagatctggtcctctactgaggagaccgtcagccctaagataaagtcacggtcttgcgatgacctcctgaacgacgattgtgactccttccctgaccctaaggtcaaatcggagagcatggggtccctcctctgtgaagaggacagcaaggagtcttgcccgatggcgtggggtagcccctatgttccggaggtccgcagcaatggcagaagtcggatccgacaccgatccgcgaggaacgcaccagggttccttaaaatgtacaagaaaatgcatcgcatcaataggaaggaccttatgaattcagaggttatctgttctgtgaagtccagaatattgcagtacgagtcggaacagcagcataaagatctgctgcgggcttggtcccaatgcagcaccgaagaggtgcctcgtgacatggtgcctactcgcatatcggagttcgaaaagctgattcagaaaagtaagtctatgccaaacctaggcgatgatatgctatccccggtgactctggaaccccctcaaaacggactgtgcccgaagcgtaggttcagcatcgaatacctgttggaggaagagaaccaaagtggccctcctgccaggggtagaagaggttgccagtccaacgcactggtccccatacatatcgaggtgacaagtgatgagcaaccccgagcacacgttgagttctctgactccgatcaggacggtgtggtgtctgaccactccgactatatccatctggagggctcatcattctgcagcgagtcggacttcgatcacttctctttcacgtctagcgagtcattttatgggtcttctcaccaccatcatcatcaccaccaccaccaccaccgtcacctgatttcatcgtgcaaggggaggtgccccgcatcctacaccagattcactacaatgctaaaacacgagcgggctcgccatgagaacaccgaggagccacggcggcaagagatggaccccggcctgagtaaactcgccttccttgtcagcccagtgccttttcggcggaagaagaacagcgcccctaaaaagcagaccgagaaggcgaaatgcaaggcaagcgtgttcgaagccctcgacagcgccttgaaagatatttgtgatcagatcaaggcagaaaaaaaaaggggcagtttgccagataatagtatcctccatcgactaatttccgaactcttgcccgatgttcctgaaagaaattcatctttacgtgcccttagacggtcccctctacaccaacctctacatcctcttccgccagatggagctattcactgccccccttaccagaatgactgcgggaggatgcccaggagtgcatcattccaagatgtggacaccgctaactcttcctgtcaccaccaggacagagggggcgctttacaggatcgagaaagtcctcgaagctacagttctacccttacagacatgggacgcagcgccccccgggagcggaggggtactcctgagaaagagaagttgcctgccaaggcagtgtacgacttcaaagcccagacaagtaaagagctgtccttcaagaagggagacacggtgtatatactgcgcaaaattgaccagaattggtacgagggagagcaccatggccgggtgggcattttcccaatttcctatgtggaaaaattgactccgcccgaaaaggcacaaccggcaagacctcccccacctgctcagcccggtgagataggcgaggccatcgccaagtacaactttaacgccgataccaatgttgagctgagtctgaggaaaggcgatagggtcatcctcttaaagagggtggaccagaactggtatgagggaaaaatcccaggtactaataggcagggcatttttcccgtgagttatgtcgaggtagtcaaaaaaaacactaagggtgcagaggactatcctgatccacccatcccccatagttacagctccgaccgtatccactctctcagctcaaacaagccccaaagacctgtctttacccatgagaacatccagggcggaggggaaccctttcaggccctctacaactacaccccacggaatgaggacgaactggagttgagagaatccgatgtcatcgacgttatggagaaatgtgacgatggatggtttgtcggaacgagcagaaggactaagttttttggcactttcccagggaattacgtcaagagactgtag

SEQ ID NO: 16390 - DNA, 981 bp, Artificial Sequence
  Description of Artificial Sequence: Synthetic coding sequence
atggctgcagctgctgccgctgccgcagccactaatggtaccggggggtcatcagggatggaggtcgacgccgcggtccccagcgtgatggcctgcggggtgactgggagcgtttcagtggcccttcacccactggtcatcttgaatatcagcgatcactggataagaatgaggtcccaggaaggccgccctgtccaggtgataggcgccctgataggtaaacaggaggggcggaacatcgaggtgatgaattcttttgaactgctctcacacactgtggaggagaaaatcattatcgataaggaatattattacacgaaggaggagcagtttaagcaggtatttaaggaattggaattcctcggatggtatacaaccgggggacctcccgatccctctgacattcacgtgcacaagcaagtgtgcgagatcatagaatccccgctgttcctcaagttgaacccaatgacaaaacataccgacctgcccgttagtgtgttcgaatcagtgattgacataattaacggcgaggcgactatgctgtttgctgaattaacttacaccttagctacggaggaggccgagaggattggagtggatcacgtggctcgaatgaccgccaccggaagcggagagaactctaccgttgccgagcacctgatagcacagcactccgctatcaagatgctacattccagagtgaaactgattctggagtatgtgaaggcttcagaagccggtgaggtcccattcaatcacgaaattctgagggaggcttatgccctttgtcactgcctccccgtactgtcgaccgacaaattcaaaacagatttttatgatcaatgcaacgatgtggggctgatggcctaccttgggacaattacaaaaacatgcaataccatgaaccagttcgtgaataaatttaatgtactttacgacagacaggggatcggacggcgcatgagaggattgttcttttag

SEQ ID NO: 16391 - DNA, 780 bp, Artificial Sequence
  Description of Artificial Sequence: Synthetic coding sequence
taatttacagctcaggctccctcagggcggggggcagcagtggggtctggtacacgactggcaagtctccggctcctcacggagctggagtctcctgcttggtggccattttccagcaaactgtggaaaacccccccagagactaaaccacgagaggatgtgtccatgacaagctgtgaaccttttggcaaagagggtattttgatcaaaatccctgcggtgattagtcatcggacagagagccatgtcaagcccgggcgcttgaccgttctcgtctccggactcgagatccacgacagttcctccttactgatgcataggtttgagcgcgaagatgtcgacgatatcaaagtgcatagtccttacgaaatcagcattcgccagagattcatcgggaaacccgacatggcatatcgtctcatttcagccaagatgcccgaggtgatccccatattagaagtgcaatttagcaagaagatggaattgctggaagatgctctggtgctgcggtcagcccggacatcctctccagcagaaaaaagctgcagcgtgtggcacgcagcaagtggcctcatggggcggactctacaccgggaaccccccgccggggaccaggagggcacagccctccatctgcaaacgagcctccctgctttatccgaagctgatacccaggagctgacccagggtttccggcctatgtcactctccacccagaccgttctagttatgctttgcagtgaatccgctggcgctctttggagacagagactgagctag

SEQ ID NO: 16392 - DNA, 1038 bp, Artificial Sequence
  Description of Artificial Sequence: Synthetic coding sequence
atggccgccgctgagcccgcttccagcgggcaacaggccccagcggggcagggacagggacagcgcccccctccccagcctccgcaggcacaggccccccagccacctcctccaccacagttaggcggggccgggggcggaagctcccgccacgagaaaagcctgggtctgttgactacaaaattcgtgagtctgctgcaggaggcaaaggacggcgttttggacctcaaagccgccgccgacacgctggccgtaagacagaagaggcgaatctatgatatcactaatgtcctagagggaatcgatctcattgagaagaagtctaagaactcaatccagtggaagggtgtcggcgccggatgcaatactaaagaggttatagaccgccttcgctacttgaaagccgaaatagaagatctggagctgaaagagagggagctcgaccagcagaaactgtggcttcagcagtcaataaaaaatgtgatggacgattccattaacaaccggttttcatatgtgacccacgaggatatctgtaactgttttaatggtgatacactgctcgccatacaagctccttcaggaacccagcttgaagtgcctatacccgagatgggccagaatggtcagaagaaataccagattaatctgaagagccactcagggccaattcatgtgctgctcatcaacaaagagtcatcttcctctaagcctgtggtctttccagtgcctcccccagacgatctgactcagccaagtagccagtccctgactccagtgaccccgcagaaaagcagcatggccacacagaacttgcctgagcagcacgtgtccgaacgcagtcaggctctgcagcaaacctccgctacagacataagctccgggtccataagcggtgacatcatcgacgagctcatgtcttcggacgtattccctctgctccggctgagtccaacccccgctgatgattataactttaatcttgacgacaatgagggcgtgtgcgacctgtttgatgtgcagatcttgaactactag

SEQ ID NO: 16393 - DNA, 96 bp, Artificial Sequence
  Description of Artificial Sequence: Synthetic coding sequence
atgaccgtaccatggcggccaggcaagcgccgtatcacctacaaggaggaggaagatcttactcttcagcccagatcttgcctgcagtgctcttag

SEQ ID NO: 16394 - DNA, 489 bp, Artificial Sequence
  Description of Artificial Sequence: Synthetic coding sequence
atgaataatcagaaacagcagaagcctacactgtccggacagagattcaaaacacgtaaacgcgatgaaaaagagagattcgaccctactcaatttcaagactgcatcattcagggacttacggaaaccggaactgacctggaggccgtagctaagtttttggatgcctcaggcgccaagcttgactatagacgttacgcggaaaccctgtttgatatacttgtggccggaggcatgctcgcccccggcggcactctggcagacgacatgatgaggaccgatgtctgtgtgtttgcagcccaagaagacttagaaaccatgcaagcgtttgcacaagtcttcaacaagctgatcagacgatacaaatatctcgagaaagggttcgaagacgaagtgaaaaaattactgttgttcctcaaaggcttctcagagtctgagcggaacaagctagccatgcttacaggggtgcttctggctaatgggacctag

SEQ ID NO: 16395 - DNA, 270 bp, Artificial Sequence
  Description of Artificial Sequence: Synthetic coding sequence
atggcagcggcaactggagatcccggattgagcaaactgcagttcgcccccttttcatctgcactcgacgtgggattctggcatgagctgacccaaaaaaagttgaacgaatacaggctggatgaggcaccaaaggatattaagggatactattacaacggggatagtgcaggtttaccagcccggttgacactcgagtttagcgctttcgatatgtcggctcccactcccgcaagatgttgtccggccatcggaaccctttacaattag

SEQ ID NO: 16396 - DNA, 2025 bp, Artificial Sequence
  Description of Artificial Sequence: Synthetic coding sequence
atgcaaacatcaagctccaggagtgtgcatctctcagaatggcaaaagaattactttgctatcacgtcaggcatctgcactgggcctaaagcggacgcttatagggcacagattctgcggatacaatatgcatgggctaattccgagatcagccaggtctgcgcaacaaaactcttcaagaaatatgctgaaaaatattctgccattatcgactccgacaacgtcgaaagcgggctgaataactacgccgagaatattttgacactcgccggatcacagcaaactgatagcgacaaatggcagagcggtctgtcaatcaacaacgtcttcaagatgtctagcgtccagaagatgatgcaggctggaaagaaatttaaggacagtctgctcgagcctgcacttgcaagcgtcgtgatacacaaagaggctaccgtgttcgatctccctaaattttctgtgtgcggctcttcccaggaaagtgattccctcccaaatagtgcacacgatcgggatcgaacacaggatttccccgaaagtaacaggctcaaattgttgcagaatgcgcagccaccaatggtgactaataccgcacggacatgccctacattcagcgcacccgtgggggaatcagccaccgccaaattccacgttacccccttatttggaaatgtcaaaaaagagaaccactcgagcgccaaggagaacatcggtctgaatgtgttcctcagcaaccagtcctgtttccctgccgcctgtgagaatccccaacgcaagtccttttacgggtccggtacgatcgacgctcttagtaacccgatcctaaataaggcttgctccaagactgaggataatggacctaaggaggacagctcactgccgacatttaagactgccaaagagcaactttgggtcgatcagcagaagaagtaccatcaaccccagcgggccagcgggagttcatatgggggggtcaagaagtctctgggagctagtaggagcagaggcatccttggaaagttcgtccctccaattcccaagcaggacgggggagaacagaacggtggtatgcagtgtaaaccctacggcgctggccctaccgagccagctcacccagttgatgagcggttgaaaaatctggaacccaagatgattgagttgataatgaacgagattatggaccacggtccacctgttaattgggaagatattgcaggcgtggagtttgccaaggccaccattaaagagatagtggtctggcccatgctgcgcccagatatctttactggtttaaggggaccccctaaggggatacttctgttcggccccccagggactggcaaaactttaatcggtaagtgcatcgcttctcagtccggggcaaccttcttctcaatatctgcgagctctctgacttcgaagtgggttggcgagggcgagaaaatggtgagggccctcttcgcagtggctcggtgtcagcagccggccgtgatctttattgatgagattgacagtctgctgtcacagagaggagacggggagcatgagtctagtcggcgaattaagactgaatttctggtccagctggacggcgctaccaccagttcagaagatcggattctcgtggtcggagctactaaccggccccaagagatcgatgaagccgctcggcgaagactggtgaagcggctctacatcccactccctgaggcttcggccagaaaacagatagtgattaacttgatgtcaaaggagcagtgttgtctgtccgaggaggagatcgagcaaattgtgcaacagtccgacgctttttctggggcggatatgacccagctctgtcgggaagcttccttgggacctattaggagccttcagacggcggatattgctacaattactccagatcaagtcagaccaatcgcctatatcgactttgaaaatgcgtttcgcactgtgagaccatcagtatctcccaaggacctagagctttacgaaaactggaataaaacttttgggtgtgggaaatag

SEQ ID NO: 16397 - DNA, 1923 bp, Artificial Sequence
  Description of Artificial Sequence: Synthetic coding sequence
atggaaaaccagctggccaagagcaccgaggagcgcacatttcaataccaggactctttgccatccctccctgtaccaagtcttgaagagtccctgaagaaatatctcgagtctgttacgagaacctgctatcaaatccgtggattagatcctgacgcaaagcgggggtttcttgatctgactagagagggcatacaagtgaagcccttcgcgaaccaggaggaatataaaaaaactgaggagatcgtgcaaaagtttcagtctggaattggggagaagttacaccagaaactgctggagagagcaaaaggtaagagaaactggctcgaagaatggtggttgaacgttgcttatttagacgttcgcatcccatctcaacttaacgtgaacttcgcgggaccagctgctcatttcgaacattactggccacccaaggaaggtacccagctagagagggggagcattactctgtggcacaacctgaattattggcagcttctcagaaaagagaaggtccccgtgcacaaagtgggcaataccccactggacatgaaccaattcagaatgctgttcagtacatgcaaagtgcctggaatcacccgcgacagtataatgaactatttccgaacagagtccgaaggtaggtctcctaaccatattgtcgttctgtgccgaggaagagctttcgtctttgacgtaatccatgaggggtgtcttgtgacacctcctgaactcctccgccagctgacttatatccacaagaaatgccattccgaacccgacggcccgggcatcgctgcactgaccagtgaagagcggacaagatgggccaaagcgagagaatacctaattggcctggaccccgaaaatttggcgctgctggagaagattcagagctcattgcttgtgtatagcatggaagacagttcaccccacgtcaccccagaggattatagcgaaatcatcgccgccatcttgataggcgaccctaccgtccgctggggtgataaatcttacaacttgattagttttagtaatggcgtgttcggctgcaattgcgatcacgccccctttgacgcaatgattatggttaacatcagttattatgtggatgaaaaaatttttcagaacgaaggaagatggaaagggagcgagaaagtacgggacatccccctgcctgaggagttgatctttattgtggatgagaaggtgttaaacgatattaatcaggcaaaggcgcagtatctcagggaagcaagcgatctgcagatcgccgcatatgcattcaccagcttcggtaaaaagcttacaaaaaataaaatgctccacccagacacctttattcagttggcgctgcagcttgcatattaccgactgcacggccacccagggtgctgctacgagaccgcaatgaccagacacttctaccacggtcggaccgagactatgcgatcatgcaccgtcgaggctgtgcgctggtgccagtccatgcaggaccccagcgtgaacttgcgagaacgtcagcaaaagatgctgcaggcatttgcaaagcacaataaaatgatgaaggactgttctgccggtaaaggctttgataggcatttgttaggcctgctcctgattgcaaaagaggaaggtctcccagtgcctgaattgttcacagatcccctgttcagtaaaagcggaggggggggaaacttcgtgctgagcaccagtctcgtggggtatctgcgggtgcagggggtcgtggtgccaatggttcataacgggtacggattcttctatcatatccgcgatgaccgattcgtggtagcctgttctgcctggaaatcttgcccggagaccgatgccgaaaagctcgtgcagcttaccttctgtgcctttcacgacatgatccagttgatgaactcaactcatctctag

SEQ ID NO: 16398 - DNA, 474 bp, Artificial Sequence
  Description of Artificial Sequence: Synthetic coding sequence
atggccacctccgcccctttacggagcctggaagaagaagtcacttgcagcatttgcctggactatctgagggacccagttacaatcgactgcggacacgtgttctgtagatcttgtaccacagacgtccgtccgatctctgggtctcggcctgtgtgccctttatgtaaaaagcctttcaaaaaggagaatataaggccagtgtggcaacttgcttccctcgtggagaatatcgagcggctaaaggtggacaaaggccggcagcctggcgaagtgaccagagaacagcaagacgcaaagctgtgtgagcgtcaccgggaaaagctacactattactgtgaagacgacggaaaactcctgtgtgtcatgtgcagggagtctcgcgagcacaggccacatacagcagttttaatggaaaaggccgctcaaccacaccgcgaaaagattttgaaccatctgagcacactacgatag

SEQ ID NO: 16399 - DNA, 432 bp, Artificial Sequence
  Description of Artificial Sequence: Synthetic coding sequence
tgaacaagacatttcaaagagtccattaagtttattcacgaatgtcgcttgcggggtgaatcgtgcctcgtccattgtctggcaggagtttctaggtctgtgacattagttattgcgtatattatgaccgtgaccgattttggatgggaagacgctttacacacggtgagagcaggtcggtcctgcgcaaacccgaacgttggattccagcggcagctgcaggagtttgaaaaacacgaggtgcatcaatatcggcagtggctcaaagaagagtatggcgaaagcccgcttcaggatgctgaagaagctaaaaacattttaggtaaatacaaagagcagggtcgcaccgaaccacagcctggagcacgtaggtggtcatccttccctgcactggcccctctgacatacgacaattacactaccgagacgtag

SEQ ID NO: 16400 - DNA, 495 bp, Artificial Sequence
  Description of Artificial Sequence: Synthetic coding sequence
atggtaaacagtgtaatcttctttgacattactgtggatggaaagccacttggcaggatctctatcaaacagtttgctgacaaaattcctaaaaccgctgaaaacttccgagcgctgtccaccggagagaaaggttttagatataaaggatcttgctttcaccggataatccccggcttcatgtgccaaggaggggactttactcaccccaatgggacaggtgataaaagtatctacggcgaaaaattcgacgatgaaaatttgattcggaagcacacaggctccggaatcctcagtatggcgaatgccggacccaataccaacggttctcagttcttcatatgtaccgcgaaaaccgagtggcttgatggtaagcatgtggctttcgggaaagtgaaggagcgcgtgaacattgttgaggctatggaacatttcgggtatcggaactccaagacaagcaaaaaaataaccatagcagactgcggtcagttctag

SEQ ID NO: 16401 - DNA, 468 bp, Artificial Sequence
  Description of Artificial Sequence: Synthetic coding sequence
atgtctgagggtgagtcacaaactgtcctgtcctctggctcagacccaaaggttgagtcaagctcatctgcccccggccttacatccgtgtctccaccagtgacctccacaacttcagcggccagcccagaagaggaggaggagtccgaagacgagtccgagatcctggaagagtctccttgcggacggtggcagaagcgccgcgaagaggtcaaccagcggaacgtcccaggtatcgactccgcttacctcgccatggacacagaggagggcgtggaggtagtgtggaatgaagtgcaattctcggaacgaaaaaactacaagctgcaagaggaaaaagtaagggcggtgtttgataatcttatccagctagagcatctgaatattgttaagttccacaaatattgggcagatattaaagaaaacaaggctcgggtgatttttatcactgaatacatgagctcgtag

SEQ ID NO: 16402 - DNA, 837 bp, Artificial Sequence
  Description of Artificial Sequence: Synthetic coding sequence
atgtggccgttccccagccggtccctctttcccccaccaactcaggcctggctgcagactgtcagctccgatcctgaggcccaaggctggggcgcctggaatgaaacgaaagagatactgggacctgaaggcggggagggtaaagaggaaaaagaggaagaggaagatgccgaggaagatcaggatggtgacgcaggttttctgctaagcctgctagaacaggaaaatctggcggagtgtccgctgcccgaccaggagttggaagctatcaagatgaaggtttgtgcaatggagcaggctgagggcacccccaggccacccggggtgcaacagcaagcagaagaggaagaggggactgccgcaggacaattgctgtctcctgaaaccgtcgggtgccccctgtccggtactccagaggagaaggtggaagctgatcatcgcagcgtgtatgtaggtaacgtagattatgggggaagtgctgaagagctggaggcccacttcagcaggtgcggggaagtacacagagttacaatactgtgcgataagttttcgggacatcctaaagggtacgcctacatcgagtttgccactaagggctctgtgcaggccgccgtcgagttagaccagagcctttttcggggtcgggtgatcaaggtgttgccaaaacgcaccaatttccccgggatcagcagcactgatagaggaggcctgagaggccacccgggatcccgcggcgcaccttttccacatagcggcctgcaggggcggccacggctgcgaccccagggccagaacagagctaggggtaaattttccccttggttcagtccttactag

SEQ ID NO: 16403 - DNA, 132 bp, Artificial Sequence
  Description of Artificial Sequence: Synthetic coding sequence
atgtctgaacaaggcgatctcaatcaggcaattgctgaagaaggagggaccgagcaggagacagccactcctgaaaatggtattgtcaaatctgagtcattggacgaagaagagaaactcgaattgcaatag

SEQ ID NO: 16404 - DNA, 390 bp, Artificial Sequence
  Description of Artificial Sequence: Synthetic coding sequence
atggccgatgaagagctagaggccctcagacgacagcggttggccgagctgcaagctaagcacggcgatcccggggacgctgcccagcaagaggctaagcacagagaggccgagatgcggaattcaattctggctcaggtgctggaccagagcgccagggcacggttgagcaatttggctctcgtcaaaccagagaaaactaaggccgtcgagaattatctcattcaaatggccaggtatggacagctgtcagaaaaggtgagtcttgactctttggaagaactatattgttacctcttgtaccagaatatggctagtaaaggtcagctgcacctacactggattaccgagtttcttctgaccttgagaaggaattgttggagagagtag

SEQ ID NO: 16405 - DNA, 2286 bp, Artificial Sequence
  Description of Artificial Sequence: Synthetic coding sequence
atgcgtaagcaggaggtgaggacaggacgcgaagctggacagggccatgggacagggtcgcccgctgaacaggtaaaggctttaatggatttgcttgccggaaagggatcccagggctcgcaggccccccaggcactggataggaccccagacgcaccgctgggtccatgttccaatgactctcgtatccaacgccaccgcaaggccctgctctcaaaggtcggaggcggcccggaactgggaggaccatggcaccgcctagctagcctgctcctcgtcgaagggctcacagacctccagctgcgcgaacacgatttcactcaggtggaggctacacgaggaggaggccatcccgctcggaccgtcgctttagaccgcctctttctgcctctgagtagggtctctgtccccccccgagtcagcattactatcggagtggccgggatggggaagactaccctggttcggcatttcgtgagactgtgggcccacggtcaagtcgggaaggattttagcctggtgctgcctttaactttccgggacctgaacacccacgagaaactgtgcgctgatcgcttaatctgctcagtatttccccatgtgggcgagccaagtcttgcagttgcagtacccgcccgagccctcctgatcctggacggtctcgatgagtgtcggacgcctctcgatttttccaacaccgtggcctgcaccgaccctaagaaggaaattcccgtggatcatcttatcactaatattatacggggaaatctgttccccgaagtttcaatctggatcactagtagaccaagcgcgtccggtcagattcctggcggtctcgtagatcggatgaccgagatccgcggcttcaatgaagaagaaatcaaggtctgcctggaacagatgttccccgaggatcaagctctgctgggatggatgctaagccaagtgcaggctgaccgcgcactctatctgatgtgtactgtgcccgcattttgccgactaaccggcatggctctgggccatttgtggcggagcagaacaggaccccaggatgctgagttatggcctccacgcacactgtgtgagttgtatagttggtactttagaatggccctttccggcgagggacaggaaaaaggcaaggcatccccacgcatcgagcaggtagctcacggaggacgcaaaatggtcgggactcttggcaggcttgccttccacgggctcttaaagaagaaatatgtgttttacgagcaagacatgaaggcattcggagtggaccttgccttgctgcaaggagctccatgttcatgcttcttacagcgcgaggaaactcttgccagcagtgttgcgtattgctttacacacctgagcctccaagaatttgtggcggcagcctactattacggtgctagccgacgcgctatcttcgacctgtttactgagagcggagtatcatggccccgcttaggattcctgactcatttcagatcagcagctcagcgcgccatgcaggcagaggacggtcggcttgacgtcttcctgcgattcctgagcggcctcctgagcccacgcgttaacgctttgctggcaggcagtcttctggctcagggggagcaccaggcctaccgtactcaggtcgctgaattacttcagggctgcctgcgtccagacgcagccgtgtgcgctagagccatcaatgtcctgcactgcttgcacgagttgcagcacactgaactcgcaagaagtgttgaggaagcaatggagagcggtgcactggcgcgtttgaccggacctgctcaccgggcagcactcgcttatctcctgcaggtttctgacgcttgtgcacaggaggcaaacctgagcttaagcctgtcccagggtgtgttgcagagtctgctgccgcagctcctctattgtcggaaactgaggctggataccaatcagttccaggacccagtcatggagcttctgggcagtgtgctgagcgggaaagactgcagaatccagaagatcagccttgctgaaaaccaaatctctaacaaaggagctaaagccctggctaggtcccttctggtgaatcggagcctgacctcactggacctccgcgggaattccattggcccgcagggcgcaaaggctctcgccgacgctcttaagatcaatcggactttaacttctctccgggtaaagttcatgtatcacaaaatcgattgtttcagaagagtaccagaggctgatgcatgtaatccatcaacgctcggagggcagggcaggtggattacatag

SEQ ID NO: 16406 - DNA, 474 bp, Artificial Sequence
  Description of Artificial Sequence: Synthetic coding sequence
atggccacgtcggcacctttgcgctcactagaagaagaggtgacatgtagcatttgcctcgattatttgcgcgatccggtcacaattgactgtgggcacgtgttttgcaggtcctgtaccacagacgtgcgacccatcagtgggagcaggccagtgtgccctctgtgcaagaaaccctttaagaaggagaacatacggcctgtctggcaattggcatcacttgtggagaatatcgagcggcttaaagtcgacaaaggacgacagcccggagaagtgaccagagaacagcaagacgctaagctctgcgagagacaccgcgaaaagcttcactattattgcgaggatgatggcaagctcctttgtgtgatgtgccgggagtcaagggagcatagaccccacaccgcagtcctcatggagaaggccgcccagccacatcgggagaagattttgaatcatctgtcaactctcaggtag

SEQ ID NO: 16407 - DNA, 1473 bp, Artificial Sequence
  Description of Artificial Sequence: Synthetic coding sequence
atgacgattggaaggatggagaacgtggaggtatttacagcggaagggaaaggaaggggcctaaaggctaccaaggagttttgggctgccgatatcatcttcgccgaacgggcctactcagccgtcgtgtttgacagccttgtgaatttcgtctgccacacttgttttaagcgtcaggaaaaactgcacagatgtgggcagtgtaagttcgcgcactattgtgatcgcacctgtcagaaagacgcatggctgaaccataaaaacgaatgtagtgctatcaaacgctacggtaaggtgccaaacgagaacatccgtcttgccgcacgtattatgtggagagtggagagggaaggcactggcctgactgaaggctgcttggtgagcgtggacgacctacaaaatcatgtggagcacttcggtgaggaggaacagaaggatctgcgggtggatgtggatacgttcttgcagtactggccaccgcagtcccagcagtttagtatgcagtacatatcacacatctttggtgtcattaactgcaacgggtttactttaagtgaccaacgaggcctgcaagcggtgggagtgggcatctttccaaatctaggccttgttaatcacgattgctggcccaactgcacagtcatctttaacaatgggaaccatgaggccgtaaagagcatgttccacacacagatgcgcattgaactcagggccttaggaaaaatctcggagggagaggaattaacggtaagttacatcgattttctgaacgttagtgaggagcgcaaaaggcagctgaaaaaacagtactattttgattgcacttgtgaacattgccaaaaaaagttgaaggatgacttgtttctgggggtgaaagataatccaaaaccaagtcaggaagtcgtcaaagagatgatccagttctctaaagacacgttagaaaagatagataaagccagatctgaaggtctgtaccacgaggttgtcaagctatgcagggagtgcctggaaaagcaggagcccgtatttgctgatacaaacatctatatgcttcggatgctgtccattgtcagcgaagtcctgtcttatctgcaggctttcgaggaggcttccttctatgcgcggcgcatggtggatggatatatgaagctgtatcaccccaataacgcccagctgggcatggctgttatgcgagccggactaactaactggcatgccggcaacattgaggtcgggcatggcatgatttgcaaggcgtacgcgattctcttggttacccacggcccatctcatccgatcacaaaagatctcgaggcaatgagagttcagaccgaaatggagctacggatgtttcgacagaatgagttcatgtactataaaatgagggaggccgccctgaataaccagcccatgcaggttatggccgagcccagcaacgaacccagtccagcgctttttcacaagaaacaatag

SEQ ID NO: 16408 - DNA, 1491 bp, Artificial Sequence
  Description of Artificial Sequence: Synthetic coding sequence
atgtgggggagatttctcgcccctgaagcctccggcagagacagtcccgggggcgcgaggagcttccccgccgggcccgactattcaagtgcctggcttcccgcaaacgagtcactgtggcaggccaccacggtgccgtccaaccatcggaacaaccacataaggcgacacagcatcgccagcgactctggcgacactggtattggcacatcttgcagtgacagcgtggaagatcattcgaccagcagcgggactctgtctttcaagccctcccaaagtctcattacccttcctaccgctcatgttatgccaagtaattcctccgccagcatttcaaagctgcgcgagtccctcacacctgacggaagcaagtggtccactagcctgatgcaaacactgggaaaccactcgaggggtgaacaagattcgtccctggatatgaaggacttccgccccctccgcaagtggtcctccctaagcaagttgactgcccccgacaactgcggacaggggggcaccgtctgcagggaggagagccggaatggcctcgagaagatcggtaaagcaaaggctttgacttcccagttgcggaccattgggccgtcttgtctacatgattccatggagatgctgagattagaggataaggagattaacaaaaaaaggtccagcaccctggactgcaaatataagttcgaatcttgcagcaaggaagactttagggcctcctcatcaacacttcgccggcaacccgtcgatatgacatattcagcactgcctgaatccaaacctataatgacctcttccgaggcctttgagccacctaagtacctcatgctgggccaacaggccgtcggcggtgtgcccatccagccgtcagtcaggactcaaatgtggctcactgagcaactgaggactaatccgctggagggccgcaatacagaagattcctattcactggcaccttggcagcagcagcaaatcgaagacttccgccaagggtcagagacccccatgcaggtgttgacaggtagctctcgccagtcctattccccgggttaccaggatttttccaagtgggagtccatgctcaaaatcaaagaaggcctcctgcgacagaaggagatagtcattgatagacagaagcagcagattactcatctccacgaacgcatccgagacaatgaactgagggctcaacacgctatgctaggtcactatgtaaattgcgaggactcctacgtggcaagcctccagccccagtatgagaatacatcgcttcagactccattttcggaagagagcgtaagtcacagtcagcaaggagaattcgagcagaaattggcctccacagagaaagaagttctgcagctgaatgaattcctgaaacaacgtctgtccctgttttcggaggaaaagaaaaaactcgaagaaaaggtcgggttcagtaataaggtagaattgggacagcagcatttcctgtccatatag

SEQ ID NO: 16409 - DNA, 1083 bp, Artificial Sequence
  Description of Artificial Sequence: Synthetic coding sequence
atggcagagcttcagcaactgcaggaattcgagatcccaaccggccgcgaggctctgagaggaaatcatagtgcgctgcttagagtggctgactactgtgaagacaattacgtgcaggcaactgacaaaaggaaagcattggaagagacaatggcgtttactactcaggctctggcgagcgttgcgtaccaggtgggtaatttggcggggcatacattgagaatgcttgatctgcagggcgcagctcttcggcaggtggaggcccgaatggtcaatatgcatatggaaaaggttgcaaggcgcgagatcgggacactggccaccgtgcagagattgccccccggacaaaaagtcattgccccagagaacctgcctccccttacaccttactgccgcagacccctgaatttcggctgtttagacgatatcggacacggcattaaggatctgagtacacagctttcgaggacaggcacactgagcaggaaaagtataaaagcaccagccacgccagcttcagccacgctcggtcgtcccccgagaatccccgagcctgttcacctcccagtcgtgcctgacggacggcttagcgctgcgagcagtgccttctcactggcgagtgccggaagtgccgaaggcgttggaggagccccaacgcccaaaggccaagccgcgcctcctgcgcctccactgcctagctccctggacccacccccccctccagctgctgtggaagtttttcaacggcctcctacactggaagaactcagtcctcccccacctgacgaggagctgcctctcccgctggacctaccccctcctcctccactggatggcgatgaactggggctccctcccccccccccaggctttggacccgacgagccaagctgggtgcccgcatcatacctggagaaggtagtcaccctctacccctatacgtctcagaaagacaatgaactatccttctccgaaggcaccgtgatttgtgtaactcgacgatatagtgatggatggtgcgaaggcgtctcttcagaaggaacaggttttttccccggcaactatgtggagccctcctgctag

SEQ ID NO: 16410 - DNA, 201 bp, Artificial Sequence
  Description of Artificial Sequence: Synthetic coding sequence
atgttgcgctgtggccagatgatcttcgctcaagcgctagtttgccgccatctgggcagggattggcgttggacgcagcgcaaaaggcagcccgattcttacttttctgtcctgaatgcattcattgaccgcaaggacagctattatagcattcaccagattgctcagatgggggtgggggaggggaaaagtatcgggtag

SEQ ID NO: 16411 - DNA, 1476 bp, Artificial Sequence
  Description of Artificial Sequence: Synthetic coding sequence
atggaacagcctcccgcccctaaaagtaagctgaaaaaactctcggaagactccttgaccaaacagcccgaggaagtgttcgatgtgctggagaaactcggcgaaggaagttacggctctgtgtttaaagctattcacaaggaaagtggccaggtggtggcaatcaagcaggttcccgtggagtctgatctgcaagagatcattaaggagatttcaataatgcaacagtgtgactcgccctacgtggtgaagtattacgggagttatttcaaaaacaccgacctgtggatcgtgatggagtattgtggtgccggctcggtctccgacataattagactgagaaataagacactgatcgaggacgagatcgccaccattttaaaatccaccctcaagggcctcgagtatctgcatttcatgagaaaaattcaccgcgacatcaaggccggcaacattctgctcaacacagaagggcacgcaaagctggctgattttggggtggctgggcaattaacggacaccatggctaaacggaataccgtgataggcacgcccttttggatggcacctgaagtcattcaggagatcgggtataattgcgtggccgatatttggagtctgggcatcacatcaatcgaaatggccgaaggcaagcctccctacgcagacatacatcctatgcgcgccatttttatgatcccgactaatcccccgccaacgtttagaaaacccgaactgtggtctgatgacttcacagactttgttaagaaatgtcttgtgaagaacccggagcagagggctacggcgacccagttgctccagcatccttttatcaagaacgcaaaaccagtgtctattctgcgagacctcatcaccgaggcaatggaaatcaaagccaagaggcacgaggaacagcagcgggaattagaggaagaggaggaaaatagtgatgaagatgagttggatagtcacactatggtgaaaacttctgttgagagtgtcgggaccatgagagccacaagcaccatgtctgagggcgcccagacaatgatcgagcacaacagtactatgctcgagtctgacctgggtactatggtaataaactctgaggatgaggaggaggaagatggaaccatgaagcgaaacgccacctcacctcaagtccaacggccatcattcatggattacttcgataagcaggactttaaaaataagagtcatgagaactgcaatcagaatatgcacgagccctttcctatgtcaaagaacgtctttcccgataattggaaagtgccccaggacggcgacttcgactttctgaagaatttgtccctggaggagttgcaaatgcggctgaaggcgctcgaccctatgatggaacgcgagatcgaagagctaagacaacgctacacagccaagcgccaaccaattcttgacgccatggacgcaaaaaaaagacgccaacagaatttctag

SEQ ID NO: 16412 - DNA, 126 bp, Artificial Sequence
  Description of Artificial Sequence: Synthetic coding sequence
atgagtagcaagggtagttccaccgatggaaggactgacttagcaaatggtagtctctcaagttcacccgaggagatgtccggggcggaggagggtcgggaaacctcctcaggcattgaggtatag

SEQ ID NO: 16413 - DNA, 945 bp, Artificial Sequence
  Description of Artificial Sequence: Synthetic coding sequence
atgccaaacgtagcggagaccgagcggtctaacgatagcggaaatggggaacacaagtctgaacgcaagtcacccgaagagaacctgcaaggagcagtgaaaagcttctgcacgtctgcttcaggagccccccttggtcctaaaggcgacgggcactatccctggtcctgcccggtcacccatactcgggagaaaatctatgccatctgctctgactatgcctttctgaaccaggcaactagtatttacaagaccccaaacccatctagatcgccatgcctgcccgacagcacatctctctcagccggaaacaatagtagccggtacatcggtatcccgacatccacaagcgaaattatttataatgaagaaaattctttggagaaccttagcaactctcttggaaaactgccactggcttgggagatagacaagagcgagttcgacggagtgactacaaattccaagcataaaagcggcaacgctaaaaagcaggtgtcgaagagaaagacctctgataagaagggcaggtaccagaaggagtgcccacagcattcccctctcgaggacatcaagcaaaggaaggtcttggaccttcgcaggtggtattgcattagccgtccccagtataagaccagctgcggcatcagctccctgatctcctgctggaatttcctatattccacaatgggtgcaggtaatctgccaccgattactcaggaagaggcgctgcacatcctcggcttccagcctccgttcgaagacataagattcggcccctttacaggcaacactacgctgatgagatggtttcgtcagattaatgaccactttcatgttaagggatgctcatacgtgctttataagccacacggaaagaataaaacggccggcgaaacagctggggatttaagtcaccacaggaagctgaatatcggctcttag

SEQ ID NO: 16414 - DNA, 1500 bp, Artificial Sequence
  Description of Artificial Sequence: Synthetic coding sequence
atgccagaaatccgtgtcaccccccttggagcaggccaggatgtgggcagatcctgtattctcgtgtcaattgcaggtaagaacgtgatgctcgattgtggaatgcatatgggatttaacgatgacgttgacgacgagctggaaattaaggcgtattacgcagggcacgtgctgggcgcagccatgtttcaaatcaaggtcggtagcgaatccgtcgtgtacacaggcgattataacatgactcccgatcgtcacctgggggccgcctggatcgacaagtgccggcctaaccttctgattacagagtcaacttatgccaccactatcagagattcaaaacgatgccgggaaagagactttctcaagaaagttcatgagaccgtagagcgcgggggaaaggtgcttattcctgtgtttgcactgggccgcgcccaggagctgtgtattcttctagaaacattctgggaacggatgaatttaaaagttccaatctacttcagcactgggttgactgaaaaggctaaccattactacaagctctttattccttggacaaatcagaagatcagaaaaaccttcgtccagaggaatatgttcgagtttaagcatatcaaagccttcgatagggcctttgcagataatccaggtcctatggtggtgttcgccaccccagggatgctgcacgccggccagtccctgcagatctttagaaaatgggcagggaatgagaagaacatggtgatcatgccaggctattgtgtgcagggcaccgtgggtcacaagatactcagcggacagcgcaagctggagatggaggggaggcaagtgctcgaagttaagatgcaggtagaatacatgtccttcagtgcgcatgcagatgccaagggtattatgcagcttgttgggcaggcagaacccgaaagcgtccttttagtacatggtgaggctaaaaagatggaattcctcaagcagaaaatcgagcaagaacttagagtgaattgctacatgcccgcaaacggggaaactgttaccttgccaacctccccatccatccctgtgggtattagcctcgggctcctgaagagggaaatggctcaaggattgctccccgaggcaaaaaaaccccgactccttcacgggacgctgatcatgaaggacagcaacttcaggttggtgtcctcagaacaggccctaaaagagctggggctggctgaacatcaactacgattcacctgccgggtccacctgcacgacactcgcaaagagcaggagaccgcccttcgcgtgtacagtcacttgaaatccgtactgaaggaccactgcgttcagcacctgcccgacgggagtgtaacagtcgaatccgtcctgctgcaggcagctgcaccctctgaagacccaggtaccaaagtcctactggtttcatggacttaccaggacgaagaactcggctcttttctcacttctctgctaaagaagggattgcctcaagcacctagttag

SEQ ID NO: 16415 - DNA, 396 bp, Artificial Sequence
  Description of Artificial Sequence: Synthetic coding sequence
ggcaccatttcctgttctactggaaccttgcagagaagaaatctcggtcctgagcgccaaacgggactgctgctgctgggaatgaaggaaaaccaggagctcaaaacgattcaagccaacctgtccaggcaacgggtggagcatcaatgcctgagttcagaggagttgaaacagcggtttcccaacatccgcctgcccaggggcgaggtggggctcctagataactctgggggtgtcatctatgcttataaagcactaagagccctacaagacgccatccgccagctaggtggcatcgtcagagatggggaaaaagtagtcgagatcaatcctggacttctggtgacagtaaaaacgacgagtaggtcgtatcaggcgaagtctctggttatatag

SEQ ID NO: 16416 - DNA, 687 bp, Artificial Sequence
  Description of Artificial Sequence: Synthetic coding sequence
atgagcagggagaggggctctcgatctgaggaacccggggccggcaatcgagaaagcggcagtagagaacccgggcttgccgccgcagctatgtctaccgtagaccttgcgcgggtgggggcctgcatcctgaagcacgcagtgactggcgaagcagtcgaattacggtctctctggagggagcacgcttgcgttgttgcaggcctccgtcgctttgggtgcgtcgtctgccggtggatcgctcaggatctgtcttcgttggccggtttactggatcagcacggcgtgcgactggttggagtgggccctgaagctctgggcctccaagagtttttggacggggattacttcgcaggagaactgtatctggatgaaagcaagcagctgtacaaagaactcggcttcaagagatataattctcttagcatcctgcccgctgctctgggcaagccagtgagggatgttgcggcgaaggccaaggctgttggtatccaaggaaacctatctggggatttactgcagagcgggggcttgctagtagtcagtaaaggtggagataaggtgctgctgcactttgtccagaaaagccctggtgattacgttccaaaagagcatatcctccaggtattgggcatcagtgccgaggtatgcgccagtgatcctccacagtgtgaccgcgaggtgtag

SEQ ID NO: 16417 - DNA, 654 bp, Artificial Sequence
  Description of Artificial Sequence: Synthetic coding sequence
atgaatttctcagaagtattcaagttgagttctctgttgtgtaaattcagcccagatggtaaatacctggcatcttgcgtacagtaccgtttggtcgtgcgtgatgtgaatacacttcagatcctccagctttacacttgcctggatcagatccagcatattgagtggagcgccgatagcctgttcattctgtgcgcaatgtataaacgcggattagtccaagtatggtccctcgaacaaccagagtggcactgcaagatagacgaggggtcagcagggctcgtggcttcttgttggtctcctgatgggaggcacatactgaatacaactgaatttcatctacgtataactgtgtggtctctttgcaccaagagtgtctcatacatcaagtaccccaaggcttgtctgcagggcatcacgttcacccgggacggacgctacatggcactggcagaaaggcgggactgcaaggattacgtgagcattttcgtgtgctcggattggcagttgctgaggtacaaaattttgctttactcattggacgggagattgctctccacgtattccgcctacgagtggtctctggggatcaagtccgtcgcttggagcccatcctcccaattccttgctgtcggatcttatgatggcaagtag

SEQ ID NO: 16418 - DNA, 483 bp, Artificial Sequence
  Description of Artificial Sequence: Synthetic coding sequence
atggaggccgagaggccacaggaagaggaggatggcgaacagggtcctccccaggacgaagagggatggcctccacccaattccactacccggccctggaggagcgcgccccccagtccacctcccccggggactcggcataccgctcttggccctcgcagcgccagccttctgtcactccagacagagctactcctcgacttagttgccgaagcccagagtcggcggctcgaagaacagcgagccaccttttataccccacagaatccgtcatcgctagctccagcccccttgcgtcctctggaagaccgtgagcagctgtactcaacaattctgtcacatcagtgtcagaggatggaggcccagcggagtgaaccccccctgcctcccggaggccaggaactacttgagctgctgctcagagtgcaagggggtggaaggatggaagaacagaggtctcgcccccccactcacacatgttag

SEQ ID NO: 16419 - DNA, 951 bp, Artificial Sequence
  Description of Artificial Sequence: Synthetic coding sequence
atggaagagaacaacctccagtgtagttctgttgtggatggtaattttgaggaggttccaagagaaacagctattcagttcaagccgccactttacaggcagcgctaccagttcgtcaagaatttagtggaccagcacgagccaaaaaaggttgccgacctgggctgtggcgacacatccctgctcaggcttctgaaagtgaacccgtgcattgagttgctagtgggcgtcgacataaatgaggataaactcagatggaggggggacagtctggcgccttttctgggagattttcttaagcctcgagatctgaacctgacaattacactttatcacgggtcggtcgtcgagcgggattctagactgcttgggttcgatctcatcacttgcatcgaattaatagaacatttggactccggcgatctcgctcggttccctgaggtggttttcggctatctgtcacctagcatgatagtgataagtactccaaactccgagttcaacccgctgttcccgagcgttacgctgagggacagtgaccacaagttcgaatggacaagaatggagtttcagacatgggcactgtacgtggccaatagatatgattattctgtggagtttaccggtgtcggagaacctcccgctggagcggaaaatgtcgggtactgcacccagatcggtatcttccgaaaaaacggtggcaaagctacagaatcttgtctttctgagcagcatgatcagcatgtgtataaagcggtctttaccactagctaccccagtctccagcaggaacgcttttttaagctggtcttagtgaacgaagtgagtcaacaggtggaatccttacgggtgtcacacctgcctcgccgaaaggagcaggctggcgagcgaggggacaagcccaaggacatcggaggcagcaaggctcctgtgccctgtttcggaccatag

SEQ ID NO: 16420 - DNA, 1056 bp, Artificial Sequence
  Description of Artificial Sequence: Synthetic coding sequence
atgtggacccccagaccagccctccacgtgcacgtgattctctactccccgatccatcggtgttatgcccgtgcagacccgactatgggacgaatctgggtggacgccgctgtgccttgtcttgaggagtgcgggttcctcctgcacttccgcgatggatgttatcacctggaaacgtccacacatcacttcctcagccacgtcgaccggctattctcccaaccatcttcccagacagcatttcacatgcaggtaagaccgggaggcttggtagcattgtgcgatggcgaaggagggatgctgtacccacaggggacccatctgttactgggcatggggtgcaaccctatgcgcggtgaagaatggtttattctccagcattgtccgacctgggtttcgcttaggtccaagaccggaagatttatcagtgtcatttacgatggcgaggtccgtgcagcatcggagcgactgaatcggatgagcctcttccagtttgagtgtgactctgagtctcctacagtgcaacttcgctctgccaacgggtactatttgtcccagcgtaggcacagggctgtgatggccgacggccatccacttgaatctgataccttctttcggatgcactggaactgcggccggatcattttgcagagctgccgggggagattcctggggatagcaccaaattcacttttgatggcgaatgtgatccttcccggcccaaacgaggagtttggcattttgtttgcgaatcgctccttcctcgttctgcggggaaggtatggctacgtggggtcatctagtggccacgacctgatccagtgcaatcaggatcagcccgacaggattcatctgttgccctgccggccgggcatataccactttcaggggggaattctgcttgtgaacaatatcctttggcatctgtccccactgggacaggtgtgccctcagctcctgtacagggcttccggggaacagcttacccactgcactggcccccagtggttactccatgccagccggccaaagtggcatcctgtgggcagacaatag

SEQ ID NO: 16421 - DNA, 333 bp, Artificial Sequence
  Description of Artificial Sequence: Synthetic coding sequence
atgcaaatatcaagcgagaaggaggaggacgataacgagaagaggcaggaccccggtgataattgggaggaggggggggggggtggaggtggcatggagaaaagcagtggcccgtggaacaaaacagcccccgtacaggcccctcctgcgcccgtgatagtcacagaaacccctgaacctgcaatgaccagtggcgtttaccggccccctggggccaggctgactacaacgaggaaaaccccccagggccctcctgagatctattctgacacccagtttccaagcctgcaaagtaccgcaaaacacgtggagtcacgaaaatatctgaagtag

SEQ ID NO: 16422 - DNA, 972 bp, Artificial Sequence
  Description of Artificial Sequence: Synthetic coding sequence
atggagggtcacgatcccaaggaaccagagcaactacgcaaactgttcattggggggctgtcctttgaaacgaccgatgattccctccgcgaacattttgaaaagtgggggacactcaccgactgcgtcgttatgagagatcctcagaccaagcggtccagggggttcggttttgtgacctacagctgcgttgaggaagtagacgcggcgatgtgtgctcgtccccacaaagtcgatggtagagttgtggaaccgaagcgcgccgtctctcgcgaagattctgtgaaaccaggagcgcacttaacagttaagaagatcttcgttggcggaattaaggaggatactgaggaatataacctcagagattatttcgagaagtacggaaaaattgagaccatcgaagtcatggaggatagacagtccggtaagaagaggggctttgccttcgtcaccttcgacgaccacgacaccgtggataaaatcgtcgtgcagaaataccatacaataaacggccataattgtgaggttaagaaggctctcagcaagcaggagatgcagtccgccggctcacagaggggaagagggggggggtcaggaaatttcatgggcagaggcgggaatttcggaggcgggggagggaacttcgggaggggcggcggaaattatggggggggacccggctactcgagccgagggggatatggagggggcggtcctggctacggaaaccagggcggtgggtacggcggtggggggggatacgacgggtacaatgagggaggcaacttcggcggcggcaattacggagggggggggaactataatgatttcggaaattactctggacagcaacagtctaactacgggcctatgaagggcggatccttcggcggtaggtcatccggttcaccgtatggcggaggctacggaagtgggggcggaagtggcggttacggtagccgacgcttctag

SEQ ID NO: 16423 - DNA, 291 bp, Artificial Sequence
  Description of Artificial Sequence: Synthetic coding sequence
aatattcagctggtcgcagacggatgttgtaatctccagaaacagattcagataactcagctgtttggtgtacccgtggtggtggccctcaacgtgtttaaaacggacacccgcgccgagattgaccttgtctgcgaactcgccaaaagagctggggcttttgatgctgttccgtgctaccactggagcgtgggtggtaagggcagtgtcgatctggcaagggcggttagagaagctgccagtaaacgctcacggttccagttcttatatgatgtgcagcccttctcatag

SEQ ID NO: 16424 - DNA, 483 bp, Artificial Sequence
  Description of Artificial Sequence: Synthetic coding sequence
atgaccgatgttccagctacttttacgcaggccgagtgtaacggggacaagcctcccgagaacggccagcagaccatcactaaaatttcagaagagctgactgacgttgatagcccacttcctcactatcgtgtggagccaagcctcgaaggcgctctgacaaaaggctcccaggaggagaggagaaagttacagggaaacatgctactgaatagcagtatggaagacaagatgctaaaggaaaacccagaggagaagctgttcatagtgcataaagcgattaccgatcttagcttgcaagaaacgtctgcggatgagatgaccttccgtgaggggcaccagtgggagaaaatcccactgagcggctcaaatcaggaaatccggaggcagaaggagcgcatcaccgaacaacctcttaaagaagaggaagatgaggatcgtaagaacaagggccatcaagccgccgagatcgaatggctttag

SEQ ID NO: 16425 - DNA, 480 bp, Artificial Sequence
  Description of Artificial Sequence: Synthetic coding sequence
atggctacaagtgcaccattgcgtagcctggaggaggaagtgacatgcagtatctgccttgattatctgagggatcctgtaacgatagactgcgggcatgttttctgcaggtcttgtacgactgatgtgaggcccattagcggttcaaggccagtctgcccactgtgtaagaagcccttcaagaaggagaacatcagacccgtgtggcagctggaaaagatccttaatcacctatctacactaaggagagatcgggataaaatccagggctttcaggctaaaggcgaagccgacatattggctgcactcaaaaagctgcaggatcaaagacagtacatcgtggccgagtttgaacagggacatcagttccttagagagcgggaggaacacctgcttgagcagctggcgaagctggaacaggaactgacggagggacgtgagaagtttaaaagcagaggggtaggcgaactagccaggtag

SEQ ID NO: 16426 - DNA, 432 bp, Artificial Sequence
  Description of Artificial Sequence: Synthetic coding sequence
atggacagctctcagcaaaagacattccgaggacacgatgccccagtactgtctcttagctttgacccaaaagatatttttcttgcttccgcgtcctgtgacgggagtgttagagtctggcaaatttcggatcagacatgtgctatttcatggcctctgctgcagaagtgtaatgatgtcattaacgccaagagtatctgtaggcttgcttggcagccgaaatctggcaaactcctggccatcccggtggaaaagtccgtaaagctgtacaggagagaaagctggagtcatcagtttgatctctcggataacttcatttcacagacccttaacattgtgacctggtctccttgcggtcagtacctggcagccggatcaatcaacgggcttatcatcgtctggaacgtggaaaccaaggactgtatggagtag

SEQ ID NO: 16427 - DNA, 2109 bp, Artificial Sequence
  Description of Artificial Sequence: Synthetic coding sequence
atgaccgagagatgctctctgtggagcgctctgagcgctgcggcctgttgtttttacagaggcagtttcgtacaggtccaattctcgaaagaaaagtacatcctggacagctcacctgagaagctacataaagaactggaagaggagttgaaactgtcctctactgatttacgaagccacgcatggtaccatggaagaattccaagagaagtgagcgagacgttggtgcagagaaatggcgatttcctcatcagggacagcctcactagtctgggtgactacgttcttacctgtaggtggcgcaatcaggcccttcacttcaaaatcaacaaagtggtggtgaaagcaggggagtcatacacacatatacaatacctcttcgaacaggagtcattcgatcacgtgcccgcgctggtgaggtatcatgtcggctctcgcaaagctgtctccgagcagagcggggccattatttactgccctgtgaacaggaccttccccttgaggtacctcgaagcctcctatggtttgggacaaggctcgagtaagccggccagtccagtctctcctagcggacccaagggcagccatatgaaacgccggtctgtcacaatgactgatgggctgacagccgacaaagtgaccaggagtgatggctgtcccactagcacatccctgccccggcccagggatagcattcgctcttgcgcactgtctatggaccagatacccgatcttcactctcccatgtctccgatctcggaaagtcctagctctccagcatacagtaccgtaacacgggtacatgcagcgcctgctgccccctcggcaacagctctgcccgccagccctgtagctaggcgttcctcggagccacaactctgtcccggcagcgctcccaaaacgcacggcgagagtgataagggcccccatacatctccatcacatactttagggaaagcctctcccagtcccagtctgagctcctactctgatcctgactcggggcactactgccagttacagcccccagtgcgcggatcccgcgaatgggcagcaacggagacttcgtctcagcaggccaggtcctacggagagaggttgaaggaactttccgagaacggggccccggaaggcgactggggaaagacctttacagtaccgatagtcgaggtcacctcaagtttcaaccccgccaccttccaaagtctcctgataccgcgagacaaccgcccgttagaggtcggtctgttgcgcaaagtgaaagaactacttgcagaagtcgacgcgaggaccctagccaggcacgtgacgaaagtcgactgcttggtggctagaatcctgggagtgaccaaggagatgcaaactttaatgggggtacggtggggaatggaacttctcaccctcccacatggccgccagctgcgactggatctgttggagcgctttcatacaatgtccatcatgctagctgtggacattctggggtgcactgggagcgcggaagagcgcgccgcgctcttacataagacaattcaactagctgccgaactcagaggtaccatggggaatatgtttagctttgctgctgtcatgggcgcactggacatggctcagatctctaggctggaacaaacctgggtgactcttagacagagacacactgagggggcaatcctgtacgagaagaaactcaaaccattcctgaagtcactgaacgagggtaaggaggggcctccactgtcaaacacaacattcccccacgtcttgcccctgatcactttgctggaatgtgattctgccccacccgaggggccggagccatggggcagcactgagcacggcgtggaggtagtccttgcccacctggaggccgccaggacagtggcccaccacggcggactgtaccatactaatgccgaggtgaagctgcagggattccaggcacggcctgagttactcgaggtgttttcaacggaattccaaatgagactgctgtggggaagccaaggcgcttcctcctcgcaagctaggagatacgaaaaattcgataaagttttaacggccctgtcacataagttggagcctgccgtccgaagctcggaattgtag

SEQ ID NO: 16428 - DNA, 585 bp, Artificial Sequence
  Description of Artificial Sequence: Synthetic coding sequence
atgaccgaggattctcagcggaattttcggtccgtgtactacgaaaaagtcggcttccgtggggtggaggaaaaaaagtcgttagaaatcctgctgaaagacgatcgactaggaattctacccccacaccacgagtcgcacgccaaagtcatgatgtaccgtaaggagcaatacttggatgtgctgcatgctctgaaagtggtccgctttgtgtcagacgctacaccacaggcggaagtgtatttacgcatgtaccagttggagtcaggtaaactgcctagaagcccctcgttccccctggagcccgatgacgaggttttcctagcaattgccaaagcgatggaggaaatggttgaagactcagttgattgttactggatcacacggagatttgtgaaccagctcaacactaagtaccgagattccctgccccaactgcctaaggccttcgagcagtatctgaatctggaggatggcagattgctgacccatcttagaatgtgttctgccgcccctaaattaccttacgatttgtggttcaagcgctgctttgctgggtgccttcccgaatcaagcttacagtag

SEQ ID NO: 16429 - DNA, 2334 bp, Artificial Sequence
  Description of Artificial Sequence: Synthetic coding sequence
atggagccgaaggaggccactggcaaggagaacatggtgactaaaaagaagaatcttgcctttcttagaagtcgcttgtacatgctggagcgccgcaaaacggacactgttgtcgaaagctccgtttcaggagatcacagcgggacattgcgcagatcacagtctgacagaacggaatataaccagaagctccaggagaaaatgaccccccagggggagtgtagcgtagccgagaccctaacaccagaagaagaacaccacatgaaacgcatgatggccaagagagagaaaattatcaaggaattaatccagacggaaaaagactatctgaatgatcttgagctctgcgttcgggaggtagtgcagccgctccgtaataaaaagacggatcgcctcgacgtggatagtttatttagcaacatagagtctgtgcatcaaatttccgccaagctgctgtcccttttagaggaggccacaactgatgtggagcctgccatgcaggttattggggaagtctttttgcaaattaaaggccctctggaggatatttacaaaatctactgttaccaccacgacgaggctcactctatactagagtcttacgagaaggaagaggaactcaaggagcatctcagccactgtattcagagtctaaagaaaatctatatgcaagagggtaagccaaatctgctcgacatgggttcactcatgattaaacctatacagagggttatgaaataccccttgttgctgtgtgagctcaggaattcaacccccccaagccaccctgattatagggccctagatgacgctttcgcggctgtaaaagacatcaatgttaacataaacgagctgaaacgccgcaaggacttagtgctgaagtataagaaaaacgacgaagatgagtcgctgaaggataaactcagtaaactaaacatccacagcatctcaaaaaagagtaagcgagtaaccaaccacctgaagattttgacgcggggcgaatcccaggtcaaagacaacacgtttaatcgagaagaaaaacttttccgcgctctcgagaagaccgtgcgtttatgcgtcaagaatatatctctctgcctgcagcacatccaggacgctatgccgctcgcacttcagtccgtcatggacttacaggaaattagttacaacaaggacgatgaaatggactactctgagacgctatctaatgcgctgaacagctgccatgattttgccagccacctccagagactcatcctgactcccttgtcagcgctcctcagccttttccctgggccccacaagctgattcagaagcggtatgataaattactcgattgtaatagctaccttcaaagaagtacaggcgaggagtcggacctcgcaaaaaaggaatacgaagccttaaacgcccagctggtggaagaattgcaggcctttaaccaggccgctaggaagattttgctgaattgtctctgcagttttattaccctccttcgcgacctgatgctcgtcgcccagcaggcctactctaccttggttcccatgccattgctcgttagctcaatcagcgagatccagaaccaggtgctagaagagattcagaacctgaactgtgtgaaggagaattccgctactttcatcgagcgaaagctgagctttgaaaagaaaaagccggtgcagatactcccggagatgccgcatcagaccgatatccatcggagcaaattattgagcacatactccgcagaggagctttaccaagctaaacgtaaatgcaacgccacccaagaatatgacattaacctcctggagggagatttggttgctgtcatcgaacagaaagatccgctgggctccacaagtaggtggctggtcgatacaggtaatgtgaaagggtatgtatattcgtcatttttgaagccttataatcccgccaaaatgcagaaggttgatgctgagaaccgcttttgcgatgatgatttcgagaatattagcctgtttgtttcttctagacctgccagtgatagcgtgactggcacaagtgagagctctatcggggatagtagcagcagcctgtccggcacgtgtgggaagttcgagaccaatggcactgatgtggactcgttccaggaggttgatgagcagattttctacgcagtccacgcatttcaagctcggtctgaccatgaactgtccttgcaggagtaccagagagtgcatattctccgcttctgtgacctcagcgggaacaaggagtggtggctggccgaggcccaggggcagaaaggctatgtgcccgcaaactaccttggaaagatgacctatgcttag

SEQ ID NO: 16430 - DNA, 543 bp, Artificial Sequence
  Description of Artificial Sequence: Synthetic coding sequence
tgatctcagcctaaatcttttgagaatagtcccggagacttaggcaactcttcgctgcccaccgcaggatataagcgcgcccagacctctgggatagaagaagagactgtgaaggagaaaaagcggaaggggaataaacagtcaaaacacggcccagggcgacccaagggcaacaaaaaccaggagaacgtgtcacacctctccgttagttctgcatccccaacctcctctgtagctagcgctgccggcagtataacctcatcctccctgcagaagagccctactttactgagaaacggatcccttcaaagcttgagcgttggaagcagtcccgtcggatccgagatctccatgcaatataggcatgatggagcgtgtcctaccacttctatttacaacagtaacgatgtggctgtgtcttttcctaatgtggtctcaggaagcggtagtagcactccagtgagttcctcccacctgccacagcagtcttcgggccatctgcagcaggtcggcgccctcagccccagcgcggtctcgtcatag

SEQ ID NO: 16431 - DNA, 384 bp, Artificial Sequence
  Description of Artificial Sequence: Synthetic coding sequence
atgaccaccaaaaacctcgagacaaaggtaactgtgaccagcagtcctatccggggggccggagatggaatggagaccgaggaaccccctaaatcggttgaggtcacttctggggtccaatccaggaagcatcacagcctccagtccccatggaaaaaggcagtaccgtcagagagtcccggagttctgcagctgggcaagatgcttactgagaaggcaatggaagtgaaggcagttaggatcctagtgcccaaggctgccatcacacacgatattcccaacaaaaataccaaggtcaagtctctgggccatcataagggcgaatttcttggccagagtgaaggtgtgattgaaccaaataaggaactcagcgaagtgaagtag

SEQ ID NO: 16432 - DNA, 1683 bp, Artificial Sequence
  Description of Artificial Sequence: Synthetic coding sequence
atgagcgagcactccaggaatagtgaccaggaagagctgcttgacgaagagataaatgaagacgagatcctggccaatctgagtgctgaggagctaaaggagcttcagtcagagatggaagtgatggcccccgatccctctctgccagtgggtatgatccagaaggaccagactgataaacctccgaccggcaactttaaccacaagtcactcgttgactatatgtactgggaaaaggcctcccgtagaatgttggaggaagagcgggttcctgtaaccttcgtgaaaagtgaggagaaaacccaggaggaacatgaggaaatagaaaaaaggaacaaaaacatggctcaataccttaaggaaaaattgaataatgaaatagtcgcaaacaaaagagagtcaaagggctccagtaacatccaagaaacagatgaggaagacgaggaggaagaggatgatgacgacgatgatgaaggggaggatgacggggaagaaagcgaagaaaccaatcgtgaggaggaaggcaaggctaaggaacagatcaggaactgcgaaaataactgccagcaagtgacagacaaggcatttaaagagcagagggaccgcccagaagcccaggagcaaagcgaaaaaaagatctccaaacttgacccaaagaaacttgcacttgatacctcatttctgaaggttagtacccgccccagcggtaaccagaccgacctcgatggctccctgcgcagagtcagaaagaacgatccagacatgaaagagctgaaccttaataatatcgagaatattcctaaggagatgctgctcgactttgtgaacgccatgaagaaaaataagcacattaaaaccttttctttggcaaatgtgggagcagatgagaacgtcgcctttgcacttgccaatatgctacgagaaaaccggagtattacaacgctgaatatcgagagcaattttatcaccggcaagggtattgtagccatcatgcgctgtttgcagttcaatgaaacactgaccgagttacgtttccataatcagcggcatatgcttggccaccacgcggagatggagatcgccaggctgctgaaagcgaacaatacacttcttaagatgggataccactttgaacttcccggcccaagaatggtggtgaccaatctgctgacccggaaccaagataaacagaggcagaagaggcaggaggaacagaagcagcagcagctgaaagaacagaagaaactcatcgctatgttagagaacggcctgggcttgccacccgggatgtgggagctactcggtgggccgaagcctgatagcaggatgcaggagttcttccaaccaccaccacccaggccgccaaatccccagaacgtcccattcagccagaggagcgagatgatgaaaaagcccagtcaggcccctaaatatcgcacggaccctgactccttcagggtcgtaaaattgaaaaggattcagcgcaagtcaagaatgccagaagctcgcgaaccacccgagaaaaccaatcttaaggacgttattaaaaccctgaagcccgtcccccggaatcgtcccccgccccttgtggagattacccctcgggaccaacttctgaatgacatccgacattcctccgtagcatacctgaagcctgtccagcttccaaaggagctggcctag

SEQ ID NO: 16433 - DNA, 51 bp, Artificial Sequence
  Description of Artificial Sequence: Synthetic coding sequence
atgtgcacatccgagacctttcaggctctggacaccttcgaggctagatag

SEQ ID NO: 16434 - DNA, 513 bp, Artificial Sequence
  Description of Artificial Sequence: Synthetic coding sequence
atgcccattctcctcttcctcatcgatacctctgccagcatgaaccagaggtcgcatctcggcacaacatatttggatacagccaaaggcgccgtggaaactttcatgaagctacgcgcccgagacccagcctcccgtggcgatagatacatgttagttacgtttgaagagcccccatatgctattaaagctggatggaaggaaaaccatgccactttcatgaacgaactgaaaaatctgcaggccgagggactgacaacgcttggtcagtccctccggactgcctttgatctgttgaatcttaatcgcttggtgaccggtatagacaattacggtcagggacgcaatccattttttttagaaccagcaatcattataaccataaccgatgggtcaaagctaaccacaacaagcggcgtgcaggacgaagcagtgcacatcctttgcgtgttgcaggagtgcctgatctccgtgtggtctccatggtgccgtaaatataaagtgggctggtag

SEQ ID NO: 16435 - DNA, 204 bp, Artificial Sequence
  Description of Artificial Sequence: Synthetic coding sequence
atgagtcggcgtaggttcgactgtagatccatttcagggctgttaacaactaccccccaaatacccatcaagatggaaaatttcaacaatttctatatcctgacatccaaagagctgggaaggggtaaattcgctgtggtgaggcagtgtatttctaagagcactgggcaggaatacgccgccaaatttctgaagaagcgctag

SEQ ID NO: 16436 - DNA, 1107 bp, Artificial Sequence
  Description of Artificial Sequence: Synthetic coding sequence
atgctcagcaagcgggggtgccacgcaagaatctacgcagactttccaatccgcagacttatcagccagcgcagctctcttgaaacactggaagatattgaggagaacgctccactccggcgctgcagaacattaagcggatcccccaggcctaagaactttaaaaaaatacacttcatcaaaaatatgcgccagcacgatacccgaaacgggcgtatcgtgttgatttcgggccggagaagcttttgctcgatttttagcgttttgccatacagagatagcactcaggtgggggacctcaagctggatggaggtagacagagcaccggcgctgtttcccttaaagagatcataggtctggaaggcgtcgagctaggtgcggatggcaagactgtttcatacacgcagttcttactccctaccaatgccttcggcgccaggagaaacacgatcgactccacctcctcattttcgcagtttcgcaacttgtcgcatcgaagccttagcataggccgggcttccggcacacagggcagcctcgacactggaagtgacctcggggatttcatggattatgaccccaatctgcttgacgatccacaatggccttgcgggaagcataaacgagtacttatcttccccagctatatgactacagtgatagactacgtcaagccaagcgacctaaaaaaggacatgaacgaaactttcaaggaaaagttcccccacatcaaactgactctttctaaaatcaggtctctgaagagagaaatgagaaagctcgcccaggaagattgtgggctagaggagccaactgtcgccatggcatttgtttattttgaaaagctcgcactcaagggcaagctgaataaacagaaccgtaaactttgcgctggggcatgcgtgttgcttgcggccaaaatcggttccgatctgaaaaagcacgaggtcaagcacttgattgataaactcgaagagaagtttaggttgaacagacgcgagctgatcgctttcgaattccccgtgttggtcgcccttgagtttgccctccatctcccagaacacgaggtgatgccccattacagacgcttggtccagagcagctag

SEQ ID NO: 16437 - DNA, 795 bp, Artificial Sequence
  Description of Artificial Sequence: Synthetic coding sequence
atgacagatgtgccggctaccttcactcaggcggaatgtaacggcgataagcctcctgagaacggccagcaaaccatcactaagatttctgaggagctaacagatgtcgatagtcctctgcctcactaccgcgtagaaccatctctggaaggcgcgctcacaaagggctcccaggaggaaagacgaaagttgcagggaaacatgttgttaaatagtagcatggaggataaaatgcttaaggagacatctgctgacgagatgacattcagggaaggccatcagtgggaaaagatacccctaagtgggagtaaccaagaaataagaaggcaaaaggaaaggataaccgagcagcctctcaaggaagaagaggacgaggatcggaaaaataaaggccatcaggctgcagagatcgagtggctcggattcagaaagcccagccaggctgacatgctgcactctaaacatgatgaagagcaaaaggtgtgggacgaggaaatcgatgacgacgacgacgataattgtaacaacgatgaggatgaggttcgagtaatcgagttcaagaaaaagcacgaagaggtttctcaatttaaggaggaaggtgacgcatccgaagattcccccttgtctagtgccagctctcaggcagtgaccccagatgagcaacccacccttggaaagaaatccgatatttcccgcaacgcctattcacgatataacacaatcagttacaggaagatcaggaaaggaaacacaaaacagcgcatcgatgaatttgagagtatgatgcacttgtag

SEQ ID NO: 16438 - DNA, 4302 bp, Artificial Sequence
  Description of Artificial Sequence: Synthetic coding sequence
atgtggagcctaaccgcaagcgaaggagagagcactaccgcccattttttcctgggcgccggtgacgagggtttggggacaagaggcatcgggatgcgcccagaagaaagtgactccgagctgcttgaagatgaggaggacgaggtgccgccagagcctcagatcatcgtggggatctgcgcaatgacaaaaaaatccaaatcaaagcctatgacccagatactcgaaagactatgccgtttcgactatcttactgtggtaatcttgggggaggacgtcattctgaatgaacccgtggagaactggcccagctgtcactgcctgatcagttttcactccaagggctttccactcgataaggccgtcgcctattcaaagttgcgaaacccctttttgatcaacgacttggctatgcagtactatatccaggaccgccgggaggtttacagaatccttcaggaggagggtattgacctgcctaggtatgctgttctgaatcgcgatcccgctcggccagaggagtgcaacctgatcgagggtgaagaccaggttgaggtcaatggagctgttttcccaaagcctttcgtagagaaacctgtatcagccgaagaccacaacgtgtacatctattacccgagcagcgccggaggtggatcccagcgactgtttcgcaaaattggtagcagatctagtgtttattcgcccgagtcatccgtgcggaaaacagggtcctacatctacgaagaatttatgcccacagacggcaccgatgtgaaggtgtacactgtgggacccgattacgcacacgcagaggcacggaaatctccagccctggacgggaaggtggaacgtgactcagaaggcaaagagattagatacccagtgatgctaaccgccatggagaagttggttgctagaaaggtctgtgtggctttcaagcagactgtgtgtgggtttgacctgctgcgcgcaaacgggcactctttcgtgtgcgacgttaatggtttttccttcgtcaaaaacagtatgaagtattacgatgattgcgccaagatcctagggaatacaattatgagagagctcgctccacagttccagataccctggtcaatcccaacggaggctgaggatataccaattgtccctacaactagcggcactatgatggagctcagatgtgtaatcgcgattatccggcatggtgataggacccctaaacaaaagatgaagatggaagtgaaacacccccgattcttcgctctcttcgagaagcacgggggatataagaccggcaagctaaagctgaaacggcctgagcagctacaggaggtgctggatattactagactcctcctggccgaattagaaaaagagcccggcggagagattgaggagaagactggaaaattagagcaactgaagtctgtgcttgaaatgtacggtcacttctcagggataaaccgcaaggttcagctgacctactacccacatggggtgaaggcgagcaacgagggccaggacccacagcgggaaacgctggcccccagcctgctgttggttctgaagtgggggggcgaacttacccccgccggacgcgtgcaggccgaggaactcgggcgcgctttccgctgcatgtatccgggaggccagggggactacgccggctttccagggtgcggccttttacgtttacactccacgttccgccacgatctgaaaatctatgccagtgatgaagggcgagttcagatgactgccgcagctttcgcgaagggcttgttggccctggagggtgagttgaccccaatacttgtgcaaatggttaagagcgccaatatgaatggcctgctggacagtgatggcgacagtctgtcctcctgtcagcatagggtgaaagccaggttacaccacatcttgcagcaagacgcccccttcggccctgaggactatgaccaactcgcccctacccggtccacgtctttactcaactcaatgacaattatccagaacccagtaaaggtttgcgatcaggtgttcgccctcattgagaacctgacccaccagataagagagcggatgcaagaccctagatccgttgatctgcaattgtaccattctgagacactggaactcatgctgcaaaggtggtccaagcttgagcgggattttagacagaagtccggtagatacgatatttccaagatacccgatatctacgactgtgttaaatacgacgtgcagcacaacggttctctcggcctgcaaggaaccgctgagctcctcagactttcaaaggccttagcagatgtcgtcatcccccaagagtatggcattagccgggaggagaagttagaaattgctgttggtttctgcctgccactgctgcggaaaatattgctagacctacagcgtacccatgaagacgagtccgtgaataagctgcatccactgtgttaccttcgctactcccgcggtgtattgtcacccggtcgccatgtgaggacacgactgtatttcaccagcgaaagccacgtgcatagtttgttatctgtgttcagatatgggggacttctcgacgaaactcaagatgcccagtggcagagagcccttgattacctatccgccattagtgagttaaactacatgacacagattgtcatcatgctatacgaggacaacacacaggaccctctgagtgaggagcgtttccacgtagagctacatttctcacccggggtgaagggcgtagaagaagaaggcagtgcgcctgcaggatgtggcttccgccctgcgtcttccgagaacgaagagatgaagaccaaccagggctcaatggagaacctttgtccgggaaaagcatcggacgagccagacagggctctgcagacctcgcctcagccgccagagggtccaggcctgccccgacggagccctctgattcgcaacaggaaagctggctcaatggaggtcttgtccgagacttcttctagcaggcccggtggctatcggctgttctcctcttcaagacccccaactgagatgaagcagagtgggcttggttctcagtgcaccggactgttctctaccactgtgctcggaggctcatcctctgccccaaacttgcaggattacgccagatcccatggcaaaaagctgcctccagcctcgctgaaacatcgggatgagctcctattcgtgccggctgtaaagcgattctctgtgtcctttgccaaacatcccactaacggtttcgagggatgtagtatggtccccaccatttacccccttgaaacccttcacaacgcactctcactgagacaggtaagcgaatttctgtctcgggtgtgtcagaggcatactgatgcgcaggcccaagcctctgcggctctcttcgactctatgcactcttcacaagcatcagacaatccgttctccccaccacgtacattacacagtcctcctctgcaactgcaacagagaagcgagaagcctccctggtactcttcggggccgtcctctaccgtcagctccgcagggccatcaagcccaacaacagtcgacggcaattcacagtttgggttttctgaccagccatctctcaattcacacgtggccgaggagcaccagggcctaggtctccttcaggaaacccccgggtccggggcgcaggagctcagtatagagggcgagcaggagctgtttgagcccaaccagtctccccaggtgcccccaatggaaacttctcagccttacgaggaagttagccagccctgtcaagaagttccagatattagtcagccctgccaggatatttctgaagctctgtcacagccctgccaaaaggtgcccgacatctcccagcaatgccaggaaaaccacgacaatggaaatcacacatgccaggaagtcccccacatttctcagccttgccagaagtcgtcacagctgtgtcaaaaggtgtcggaagaggtgtgccagctttgcctcgagaactctgaagaggttagtcagccatgccagggagtatcagtagaggtcggcaagctggtacacaaatttcacgtcggtgtcggcagcctcgtgcaggaaactttagtcgaagtcggcagtcctgcagaggagatccccgaggaagtgatacagccatatcaggagttctccgtagaagtcggcagattggcccaggaaacttctgcgattaacctcctgtcccaggggattcctgagatcgacaaaccatctcaagaatttcctgaggagatcgatttacaggctcaggaagtgccggaggagatcaactag

SEQ ID NO: 16439 - DNA, 810 bp, Artificial Sequence
  Description of Artificial Sequence: Synthetic coding sequence
atgtttccagcactcgagacccacctgaaacaaaccatccctgatccatacgaggacttcatgtatagacacctgcagtattatggctattttaaagcccaacgggggagcttacctaactccgctacacaccagcatgtgcgcaaaaataatcctcaatgtctgcttaatggatctcttggcgagaaagatgacctcattcccgacacattacaaaaggagaaactactgtattcccacatgctatccttaccacatttacggtccagacagctcctttacgatgagctggatgaagtcaatcccaggcttagagagcctcaggaactattctcgattctctcgactaagcgtcccctgcaggcccccaggtggcctatcgaatgtgaggtcatcaaggagaacatccaccacatcgagtgggcgcctccacagccagagtacttctaccagcccaaggggaatgaaaaggtccctgaaatcgtgggagaaaagaaggggacagtcgtgtatcagttagattccgtgcctatcgaggggtcatatttcacctcctcacgagtgggcgggaaacggggcattgtgaaagagttagctgtgaccttgcagggccctgaggacaacacattactcttcgagtctagattcgaatccggtaaccttcagaaggccgtcagggtggacccaatgagtatgaactctccctgtgagcttacttcgaccctgacaaacactctgtctggattcatttttgtgttccgtacgcccgagaagatgctccctatcgctagtcctctgagtacttgctag

SEQ ID NO: 16440 - DNA, 975 bp, Artificial Sequence
  Description of Artificial Sequence: Synthetic coding sequence
atgccattacaggtcagtgattactcatggcagcagacaaaaaccgccgtttttctcagcctgccactgaaaggagtatgtgtgcgtgatacagacgtgttttgcaccgaaaattatcttaaagttaacttccctcccttcctgttcgaggcgtttctatatgctccgatcgatgacgagtctagtaaggccaagatcggcaatgatactattgttttcaccctgtacaaaaaggaggcagctatgtgggaaaccctgagcgtaactggtgtagacaaggaaatgatgcagaggattcgtgagaagagtattctgcaggcacaagagagggctaaggaagcaacagaagccaaggctgcggcgaaaagggaggaccaaaaatacgcgctgtcagtgatgatgaaaattgaagaggaggagcgaaaaaaaattgaggatatgaaagagaacgagcgtataaaggcaaccaaagcgctggaagcttggaaggaataccaaaggaaagcggaggagcagaagaaaattcaacgggaggagaaactctgccagaaggagaagcaaattaaagaagaacgcaagaagatcaaatataagagcttgactcgcaacctagcctcgcggaatctggcccccaaaggcaggaatagcgagaacattttcaccgagaaacttaaagaagacagcatacctgcaccaaggagcgtgggtagtataaaaatcaatttcacccctagggtcttcccaactgcgctgagggagagtcaagtggccgaagaggaggaatggttacacaagcaggccgaggcgagacgcgccatgaacactgacattgctgagttgtgtgatctcaaagaagaagagaaaaatcccgagtggctgaaagataagggaaaacctgaaaggtgcctgaaaatacctgtgacagtcatccacctagtggtaggactcagcagcgttatgcgcggccagatctag

SEQ ID NO: 16441 - DNA, 162 bp, Artificial Sequence
  Description of Artificial Sequence: Synthetic coding sequence
atgcagacctcatcaagccggagcgtgcatctctctgagtggcagaaaaattattttgcaattacgtcagggatctgtaccggtccgaaggcagacgcatacagggcccagattctgcgcatacagtacgcctgggccaattcggaaatctcacaggtttag

SEQ ID NO: 16442 - DNA, 2079 bp, Artificial Sequence
  Description of Artificial Sequence: Synthetic coding sequence
atggtgaccacccttggacccaagatggccgcagagtgggggggcggtgtgggctactccggatccggccctgggcgcagccggtggaggtggagcgggagtgtctgggttcgctctgtgctcctgttactgggcggactcagagcgtctgcaacatccacccctgtgtctctcggcagtagcccaccctgcagacaccacgtgccaagtgacactgaggtgatcaataaggtgcatttgaaagccaatcacgtcgtgaagagggacgtggacgagcatctgcgcataaaaacagtttacgataagagtgtcgaagaactgttaccagagaaaaagaacctggttaagaataaactgttcccccaggccatctcatatctggagaagacattccaggtgaggcgccccgccggcacaatcttactctctcgccagtgtgccacaaatcaatatctaagaaaggagaatgatccccaccggtactgcactggtgaatgcgccgctcacactaagtgtggtccagtcatcgtgcctgaggagcacctgcagcagtgtcgcgtgtatagaggtggtaagtggccacacggcgccgtaggcgttcctgatcaggaaggtatctcagatgccgacttcgtgctgtacgtgggcgcgctcgccaccgagcggtgctcgcatgaaaacatcatctcatatgctgcatactgtcagcaagaagccaacatggataggccaattgctgggtatgctaatttatgtcccaatatgatttcaactcagccacaagagttcgtgggcatgctgtccaccgtgaagcatgaggtgattcatgcactgggatttagcgccggactcttcgcattctaccatgacaaggacggcaacccactcacctcccgctttgccgacggtctgcctccctttaattactcactcggactctaccagtggtctgacaaggtggtgagaaaagtggagcggctctgggatgtgcgtgataataagattgtgagacacacggtctatctgctggtaacccctcgcgtggtcgaggaggcgcgcaagcactttgactgtcctgtgttagaaggcatggagttggagaatcagggcggggtggggactgagctgaatcattgggaaaagcgcttacttgagaacgaagccatgactggcagtcatacacagaaccgggtattgtctaggatcacacttgccctgatggaagatacaggctggtataaagcaaactacagcatggctgagaaacttgattggggtcggggtatgggctgcgacttcgtgcgcaaaagctgcaagttttggattgaccagcagagacagaagcgacagatgctatccccctattgcgacactctgcgcagcaaccctctacaattaacctgcaggcaggaccagagagctgtggcggtgtgcaatcttcaaaagtttcccaagccattaccacaggagtatcagtacttcgacgagctgtcaggaattcctgccgaagacctgccctactacggcggaagcgttgaaatagcagattactgcccgttctcccaggagttcagctggcacctgagcggcgagtaccagcgaagtagcgattgccggatactagagaaccagcccgaaatttttaagaactatggggcggagaagtatggtcctcactcagtttgtcttatccagaagagtgccttcgttatggagaaatgtgaacgaaaactgagctaccctgactgggggtctgggtgttatcaggtctcctgctcaccgcagggtctgaaagtgtgggtgcaagatacttcatacctgtgcagtcgggccggacaagtgttacccgttagtatccagatgaatggctggatccacgacgggaacttattgtgtccatcttgctgggatttctgtgaactttgtcccccagaaaccgacccacctgcaaccaacctgactcgcgctctgcccctagatctgtgctcatgcagttcatctctcgtcgtaactctgtggctgctgttaggcaatctcttccctctgttggccggattcctcctctgcatttggcattag

SEQ ID NO: 16443 - DNA, 3021 bp, Artificial Sequence
  Description of Artificial Sequence: Synthetic coding sequence
atggatagtagtcagcagaaaactttcagaggacacgacgccccagtccttagcctcagcttcgatcccaaggatatctttctggcctctgcttcatgcgatggatccgtgagggtttggcagatcagtgatcagacatgtgccatcagctggccactcctgcaaaaatgcaatgacgtgataaacgcgaaaagcatttgccgtctggcgtggcagcctaaatcgggcaaactgttagccatccccgttgagaaaagtgttaaactttaccgccgggagtcttggtctcaccagtttgacttgtcggacaatttcataagccagaccctaaatattgttacgtggtcaccttgtggtcagtacctggccgccggctccatcaatggactgataattgtatggaatgtggagacaaaagattgcatggagcgcgtcaagcatgagaaagggtacgccatctgtggactggcgtggcaccccacctgtgggcgcataagctacaccgatgctgagggaaatctggggctgcttgaaaacgtctgcgatccctccggaaagaccagctcttctaaagtgtcatcacgcgtagagaaggactacaacgatctgtttgatggcgatgacatgtctaacgccggggactttttgaatgacaatgcggtcgagatccctagtttcagtaaggggataatcaatgatgacgaggatgacgaggaccttatgatggcgtcagggcggccgcgtcagaggtcccatattctggaagacgacgagaactcggtggatatctcaatgctgaagaccggatcttcgctgctgaaggaagaagaggaggatggccaggaaggctctatacacaatctcccccttgtcacttcgcagagacccttttacgatggacccatgccaacgccgagacagaaacctttccagtctggttctacccccctccacctgactcatcggtttatggtgtggaactcaattggaatcattaggtgctacaacgatgagcaagataatgctatcgacgtcgagttccatgacactagcatccaccacgcaacgcatctctcgaataccttgaattacactattgccgacctgtcacatgaggctatattgctcgcatgcgaaagtaccgatgagctggcttctaagctgcactgcctgcacttttcgagttgggacagtagcaaagagtggatcatcgatcttccccagaacgaagacatcgaggcaatctgcctcggacaaggctgggccgcagccgcaacaagtgcccttctgctccggttgtttaccattggcggcgtgcaaaaagaagttttcagcctggccgggcccgttgtgtccatggcaggacacggcgaacagctgttcatcgtctatcacaggggaacaggattcgacggagaccagtgcttgggggtccagctgttggaacttggaaagaaaaagaaacaaattttacatggcgatccactgcccctgaccagaaagtcgtacttggcttggattggcttcagcgccgagggcactccctgctacgtggatagtgagggtattgtgcggatgttaaatagagggctggggaatacttggactccgatctgcaatacaagagaacactgtaagggtaagtcagatcattattgggtggtagggattcacgaaaacccccagcaactccgctgtatcccatgcaaggggtcccggttcccccccacccttccgagaccagccgtcgctattctaagcttcaagttgccgtactgtcagatcgccacagaaaagggtcagatggaagagcagttctggcgatctgtgattttccacaaccacctcgactacctggcaaaaaacggatacgagtacgaagaaagcaccaagaaccaagccacaaaagagcagcaagagctgctgatgaaaatgctggcccttagttgcaaactggagcgggagtttagatgcgtcgaactggctgatctcatgacacaaaacgccgtgaatctcgctatcaagtacgctagtcgctccaggaaattgatcctggcccagaagctgagcgagctcgcagtggaaaaagcagctgagctgaccgcaactcaagtggaggaggaggaagaggaagaagattttcgaaagaagttaaacgccggctactctaacaccgctacggagtggagtcaaccccggtttcgtaaccaggtagaagaggacgctgaagattccggcgaagcggatgatgaggagaagccagaaatccacaagcctgggcaaaacagcttcagtaaatccactaattccagcgatgtgtccgccaaatcaggcgccgtgacattttcaagccagggtagggtaaatcccttcaaggtctccgccagctccaaagagccagccatgagcatgaactccgcgaggtcaacaaatatcctggacaacatggggaagagttcgaagaaatcgaccgccttatcaaggactacgaacaatgagaaaagtccaatcattaaaccactgataccaaaacccaaaccaaagcaggcatccgcagccagctactttcagaagcgtaactcccagaccaacaaaacagaagaagtgaaagaggaaaacctcaagaacgttttatctgaaacaccggcaatttgcccgcctcaaaacaccgaaaatcagcggcccaagacagggtttcagatgtggctggaagagaaccggagcaacatcttgtccgacaatccagatttcagtgacgaggcggacattattaaggagggcatgatcaggtttagggtactgagtacagaggagcgaaaagtctgggccaacaaagctaagggcgaaactgcgtccgaggggacagaggcaaagaaaagaaaacgggtggtggacgagagcgacgaaactgaaaatcaagaggaaaaggcgaaggaaaatttaaatctgtctaagaaacagaaaccactggatttttctacaaaccagaaattgtcagcattcgcctttaaacaggagtag

SEQ ID NO: 16444 - DNA, 540 bp, Artificial Sequence
  Description of Artificial Sequence: Synthetic coding sequence
atgactgaagatagccagcgcaattttcgcagtgtgtattatgaaaaggttggttttagaggtgtggaggagaaaaagtctctggagatactgttgaaagacgatcgcttggacaccgaaaagctgtgcacgttcagtcagagatttcctttgccgagcatgtatcgagcgctggtctggaaggtcctgctagggatcctgcctccccatcacgagagtcatgccaaagtgatgatgtatagaaaggaacaatatctcgacgtgctgcacgccctgaaggtcgtgcggttcgtgtctgatgccacaccccaggccgaggtgtacctcaggatgtaccagctggaaagcggcaaacttccacgttcacccagtttcccacttgaacctgatgacgaagtttttctggctatcgctaaagcgatggaggagatggtggaggattccgttgattgctactggatcactagacggttcgtcaaccagctgaacaccaagtatagagatagcctgccccaactggagggcattaatgtgggctag

SEQ ID NO: 16445 - DNA, 3189 bp, Artificial Sequence
  Description of Artificial Sequence: Synthetic coding sequence
atgatatctaaaggcgggtctgaggcgcttttacagacactcgtggatactgcacgaaccgcacccccggattatgacatcctgctcccgctcttccggttgcttgcaaaagtgggactgagagataaaaaaataggccgaaaagccctggagctggaagcactggacgttaccctgatcttggcgcgtaaaaacctatcacacggccaaaatctgttacactgtttgtgggccctgagagtatttgcgagttctgtgtccatgggggccatgctgggtatcaatggcgccatggagttgctcttcaaggttatcactccatacacacgaaagcgaactcaggccattcgtgctgccacagaagtgctcgctgctctccttaaatctaaaagcaacggtagaagggccgtaaaccgcggttatgtcacatccttgctgggtttgcaccaggattggcacagtcacgacacagcaaatgcctacgtgcagatacggaggggcttgcttctgtgtttgagacatatagcagcactcaggtccggacgtgaagcatttctcgctgcccaggggatggagatcctgttttcaactacccagaactgtctcgacgacaaatccatggaacccgttatttctgtcgtgctacagatactcaggcaatgctacccgacatcccccttacccctcgtgacggcttccagcgcatatgcctttcccgtacccggctgcattacgacggagccaccccatgacctcccagaagaggacttcgaggacgatggagacgacgaggttgacaaagattcagacacagaagacggcaaggtcgaggacgacgacctggaaacagacgtcaataagctgtcatctaaaccaggcttagaccggccggaggaggaactgatgcaatacgaggtgatgtgtctggaattgtcatactcattcgaggaattgcagagtaagctgggcgatgacctgaatagtgagaagacccaatatgccaaccaccatcacattcctgcagctgccagctccaaacagcattgctatagcaaggatcagtcatcctgtggtcaggagcgcgagtacgcagttcagacttcattactctgtcgagtgaaaactggcagatccacagttcacttaggatccaagaagaacccgggagtaaacctgtaccaaaacgtccaatcaaatagtctgagaagagacagtagcgaaagtgagatccctgacatccaagcatcaccgaaggcggatgcttgggacgttgacgccatattttgccctaggatgtccgccagcttcagtaactctaccaggaccagggaggtggtcaaagtaatcgacaaactattacaaacccacctgaagagggtgccatttcacgacccctatctgtatatggccaaggctcggaggacgagctcagtggtggattttaaaatgatggctttcccagatgtgtggggccactgtcccccccccacaacgcaacccatgcttgagaggaaatgtggcgtgcagagaattaggattttcgaagatatccggcgtttaatacaaccatccgacgtcataaacaaggtcgtgttttctctcgatgagccctggcctctgcaggacaatgccagcaattgcctgcgatttttttccaagtttgagagtggaaatctacgcaaggccatccaagtgagggagttcgagtacgatctgctcgttaatgccgacgtcaacagcactcagcatcagcagtggttttacttcaaagtgtctgggatgcaagctgctataccatatcattttaacattatcaactgtgaaaagccgaacagccagttcaattacggcatgcagccgactctctactcagtgaaagaggcactgctggggaagcctacctggatccgtaccggacatgaaatttgttattataagaaccactatagacagagcactgccgtggcaggcggggccagcggaaagtgctactacactctgacttttgccgttaccttccctcactctgaggatgtatgctatcttgcttatcactacccttatacatatacagctctgatgacccatctggacatccttgagaaatcagtgaacctcaaagaggtgtacttccgacaggatgtattatgtcagactctgggtggtaatccctgtcctttagtcactataactgctatgcccgaaagcaactctgatgagcacttagagcagttccggcacaggccttatcaggtcatcaccgctagagtgcatccaggcgagtccaacgctagctgggtgatgaagggcacactcgagtttctggtgagtagcgatcctgtggcgaggctgttgcgcgagaatttcatatttaaaatcatacccatgcttaaccctgacggtgttataaatgggaatcatagatgttccctgtctggagaggacttgaatcgccagtggctctcacccagcgcccatttgcagcccactatttaccacgccaagggtttgctttaccacctcagcagtatcggtcgctcgccagtagtcttctgcgatttccatggtcacagtcagaagaagaatgtcttcttatatggctgtagtattaaggaaactttgtggcaagccgcatgtaccgtaggaacgagtacaatcctggaggaggtgaattataggacactgcctaaaattttagataagttggctccagcattcaccatgagttcttgctcgttcctggtggagaaatcgcgagcctctactgcacgcgtggtggtgtggagagaaatgggcgtgtcccgctcttacaccatggagtcctcctactgcggttgtaatcaggggccctaccaatgcacgcagcgcttgcttgaacggacgaaaaacgaacgtgcccaccccgttgatgggcttcaaggactgcagtttgggacacgagaactagaggaaatgggagccatgttctgtctgggcctgctgatcctagaactcaagagcgcctcctgcagtcaccaactcctggcacaggccgccactctgctcagcgctgaagaagacgcactggaccaacacctgcagcgactgaagtccagcaatttcctgcccaaacacatttggttcgcttaccacttctttgcgataaccaacttcttcaagatgaatctgttgctccacgtgtctccctag

SEQ ID NO: 16446 - DNA, 738 bp, Artificial Sequence
  Description of Artificial Sequence: Synthetic coding sequence
atggcggctgcgcctcctagttactgttttgtcgcattcccaccgcgggcaaaagatggcctggttgttttcggaaagaattcagcccgcccccgggacgaggtgcaggaagttgtgtatttttctgcagccgaccatgagcctgaatcaaaggtagagtgcacatacatcagcattgaccaggtcccacgaacctacgctataatgatctcgcggcccgcgtggttgtggggagccgagatgggagcgaatgagcatggtgtatgcatcgctaacgaggccatcaatacccgagagcccgcagcagaaatcgaggccctactgggaatggatcttgtaaggctgggtctggagaggggtgaaactgccaaggaggcactcgacgtgatcgtgtctctccttgaagaacatggccagggaggcaattatttcgaggatgcgaactcttgtcatagcttccagtcggcatatctcatcgttgacagggatgaggcctgggttctggaaactattgggaaatactgggcagcagagaaagtgacagagggagtgagatgcatctgttctcagctgagtctgacgaccaaaatggacgccgagcacccggaactccggtcgtacgcccagtcccagggctggtggacaggagaaggagaattcaatttttctgaagtttttagtcccgtggaggaccacctagattgcggagcagggaaagacagcctggaaaaacagtag

SEQ ID NO: 16447 - DNA, 99 bp, Artificial Sequence
  Description of Artificial Sequence: Synthetic coding sequence
atgtcggagcagggagatttaaaccaggcgatcgccgaggaaggaggaaccgaacaggaaacagcaacccctgaaaacgggatcgtcaagagtgagtag

SEQ ID NO: 16448 - DNA, 132 bp, Artificial Sequence
  Description of Artificial Sequence: Synthetic coding sequence
tgagtacttgggagcccgaaaccagaggagatccctctgacttggatccagcccggtactaccgtgcttaactgttcacatgatttcctgtccgaatccctaatcatcatcaggcgaatggccattttctag

SEQ ID NO: 16449 - DNA, 339 bp, Artificial Sequence
  Description of Artificial Sequence: Synthetic coding sequence
atgtttgctaagcttaagaagaagattgctgaagaaacagctgtcgcccagagaccggggggagccacacgcatccctaggtccgtctcaaaggaaagtgtcgcatccatgggggccgacagcggtgacgattttgccagcgatgggtctagttcgcgcgaggacctgagtagccaactcctgaggcggaacgagcagattcgtaagctagaagcccgcctgagtgactacgcagagcaggtgagaaacctgcagaagattaaagaaaagcttgagattgctctggaaaagcaccaggattcatcaatgaggaagttccaggaacaaaatgagacctag

SEQ ID NO: 16450 - DNA, 579 bp, Artificial Sequence
  Description of Artificial Sequence: Synthetic coding sequence
atgggaaagggatgcaaagtggttgtgtgtggcctcttgtccgtgggtaaaacagccatcttagaacagctgctgtacggcaaccacaccatagggatggaggactgcgaaactatggaggatgtgtacatggcctcagtcgagacggataggggtgtgaaggagcagttacacctatacgatacccggggactccaggaaggggttgaacttcctaagcactacttttcttttgctgatggattcgttttggtatactctgtaaacaacctggagagcttccagagggtggaactgcttaagaaggagatcgacaagttcaaagataaaaaggaagttgcgattgtggtgttaggcaacaagattgatttgtctgaacaacggcaagtggatgccgaagtcgctcaacagtgggctaaaagcgaaaaggttcggctttgggaggtgacagttactgaccgcaagacactcattgagccttttactctcctcgcaagtaagttatcccaaccacagtcaaagtcttcattccctctccctggaagaaaaaacaaaggcaactctaattccgaaaactag

SEQ ID NO: 16451 - DNA, 1458 bp, Artificial Sequence
  Description of Artificial Sequence: Synthetic coding sequence
atggcccctcgtcttcagctggaaaaagccgcctggcgctgggcggagacagttagacctgaagaggtctcccaggagcatattgagactgcctatcggatttggctggagccttgcatcagaggggtgtgtagaagaaattgcaaaggaaatccaaattgtttggtgggaatcggagaacatatctggcttggagaaatcgacgagaattcattccataacatcgacgatccaaattgtgagcgtagaaagaagaattccttcgtgggcctcacaaacttaggggccacatgctacgtaaacactttcctgcaggtatggttcctgaaccttgagcttaggcaggcactgtatctgtgcccttcgacatgtagcgactacatgctgggcgatggaatacaggaagaaaaggactacgagccccagacgatctgtgaacacctccaatacttgtttgccctgctacagaactcaaatcgtagatacattgatccttctggatttgtgaaagctctcgggctggataccggccagcagcaggacgctcaggaattctcgaaacttttcatgtccttacttgaggacacactctctaaacaaaagaaccccgatgtaagaaacatcgtacagcagcagttttgcggggagtacgcgtacgtgaccgtttgcaaccagtgtgggcgggagtcaaagcttctatccaagttttatgagctggaactcaatatccagggtcacaagcagcttacagactgcataagcgagtttctgaaagaggagaagctcgaaggggataatagatatttctgcgagaattgccagtcaaagcagaacgcaacacgtaagatccggctgctgtccctcccatgtactctcaacctccagcttatgaggttcgtctttgataggcagacagggcacaagaagaagcttaacacctacataggcttttctgagatcctcgacatggaaccctacgttgagcacaagggaggctcatacgtctacgagctttctgccgtcctcattcaccggggcgtaagtgcttactctggccactacatcgcccacgtgaaagatcctcagtctggcgaatggtataaatttaacgatgaggatattgagaagatggagggaaagaagttgcagctgggtatcgaagaagacctggcagagccaagtaaatcccagacccgcaaacccaagtgtggtaagggcactcactgttcacggaatgcgtacatgctggtctaccgcttacaaacgcaggaaaaacccaatacaacggtccaggttcccgcctttctccaggagcttgttgacagagacaatagtaagttcgaagagtggtgtattgagatggccgagatgagaaagcagagcgtcgacaaaggcaaagccaaacacgaggaagttaaggagctgtatcagcgcctccccgccggtgccggtttatag

SEQ ID NO: 16452 - DNA, 1119 bp, Artificial Sequence
  Description of Artificial Sequence: Synthetic coding sequence
atggacgtattatcccctctgtcattcatcaaggtgagtcacgtgcgcatgcaagggattctgctgctagtattcgcaaaatatcagcatctcccttatatccaaattctcagcacaaagagcacacctacaggtctgttcggatattgggggaataaaggtggagtgaacatatgcctgaaactatatggatattatgtgtctattatcaactgccatctgccgccacatattagtaacaattaccagcggttggaacacttcgacagaatcttggaaatgcaaaattgtgagggccgcgacattcctaacatcttagatcacgacttgataatctggttcggggatatgaattttcgtattgaagacttcgggctgcactttgtgcgggaaagcatcaagaacagatgctatggtggcctgtgggagaaggatcagctgagtatcgcaaagaagcatgaccctctcttgcgcgagttccaggaaggccggcttctgttccctcctacatacaagtttgatcggaattcaaatgactacgataccagcgaaaagaagcgaaaaccagcatggacagatagaatcctgtggaggctgaagcggcagccatgcgccggaccagacaccccaattccgcccgcaagccacttttccctgtccctccgggggtattcatctcacatgacttacggcatttctgatcacaagccggtgagcggaacttttgacctggaattgaagcccctggtgagcgcgccactcatagtcctcatgcccgaggatttatggacagtggagaacgacatgatggtgagttactcctcaaccagtgactttccttcgtcaccgtgggattggattggcctgtataaagtggggttaagagacgtaaatgattatgtgtcctacgcctgggtaggcgacagcaaggtgagctgtagtgataatttgaaccaggtgtatattgatatttcaaatatccccacaacagaggacgaattcctcctgtgctattacagtaacagtttgcgttctgtggttgggatcagccgcccctttcaaatccccccaggctcactgagggaggaccccctaggcgaggctcaacctcagatttag

SEQ ID NO: 16453 - DNA, 1548 bp, Artificial Sequence
  Description of Artificial Sequence: Synthetic coding sequence
atgtcagaaggcgagtcgcagacatcagtgagccctcccgtcacttccaccaccagcgccgccagccctgaagaagaggaagaatctgaagatgagtcggagattctggaagaatccccttgcggcaggtggcagaagcgacgagaagaggtaaaccagagaaacgtcccagggattgactccgcctacctggcaatggataccgaagagggggttgaagttgtctggaatgaggtccaattctcagagagaaaaaactacaagctccaggaagagaaggtgcgagctgtgtttgataatctgattcagcttgagcacctgaatattgtcaagtttcataagtactgggccgatatcaaggagaacaaggcgcgggtcatcttcatcacagaatatatgtcaagcggctctctgaaacaattcctgaagaaaacgaaaaagaaccacaaaaccatgaacgaaaaggcgtggaaaaggtggtgcacacaaatcctgagcgctttgagctacctgcactcttgtgatccccctatcatccacggaaatcttacctgtgatactattttcattcagcataacgggctaataaagattgggtctgttgccccagatacaatcaacaatcatgtgaaaacttgcagagaggaacaaaagaacctgcactttttcgcgccagaatacggtgaggttaccaacgtgacgactgccgtggacatctactcatttggaatgtgcgccctggaaatggccgtattagagatacagggcaacggagaaagctcgtacgttcctcaggaggctatatcgtctgccatccaactgttggaggacccactgcagcgggaattcattcagaagtgtctgcagagcgaacctgcacggcggcctacagcgagagagttactgtttcacccagccttgttcgaggttccatccttgaaattgctggctgcacactgtatcgtaggccatcagcacatgatccccgaaaacgctttggaggaaattactaagaatatggacactagcgctgtcctagccgagatccccgctggccccggccgtgaaccagttcaaaccctgtactcccaatcaccagccctggaactcgacaagttcctggaagacgtccgaaatggtatctatccgctgaccgcgtttggtctacccagaccacagcagccccagcaggaggaggttacaagccctgttgtgcctccaagtgttaagaccccaaccccagaaccggctgaggtggagacacgcaaggttgtcctgatgcagtgtaacattgaaagcgtggaagaaggagtgaagcaccacttgaccctgttgttgaagctcgaggacaagttgaatcgacaccttagttgcgacttgatgcctaatgagaatatccctgagctggcagccgagctcgttcaattaggtttcatctccgaagccgaccagagtagactgacaagcttgctggaggaaaccctgaataaatttaactttgcccgcaatagtactttgaatagtgccgccgtgactgtatcaagctag

SEQ ID NO: 16454 - DNA, 435 bp, Artificial Sequence
  Description of Artificial Sequence: Synthetic coding sequence
atgtcgtcacctctggcgtcattgtcaaagacccgcaaggtcccattgccttcagaaccgatgaacccaggccggagaggtatccgtatttacggggacgaggacgaggtagacatgctgagcgacggctgtggcagtgaggaaaaaatcagcgtgccctcctgctacggcggcattggtgcaccagtttccaggcaagtgcccgcatctcatgattccgagcttatggcattcatgacccgcaagctgtgggatttggagcagcaggtaaaagcacagaccgacgagatcctcagcaaagaccagaaaatcgccgcgctcgaggacctggtccagacactgaggcctcacccagctgaagctaccctccagcggcaggaggaactcgaaaccatgtgcgtgcagttacagcggcaggtgcgagagatggaatag

SEQ ID NO: 16455 - DNA, 1047 bp, Artificial Sequence
  Description of Artificial Sequence: Synthetic coding sequence
atgcccgcccctccatgcgctagctgccacgctgcaagagctgctctgcgacggcccttgtcaggacaggcgctctgcggcgcttgcttttgtgctgcctttgaagcagaggtgttgcatacagtcctggcaggaagattgcttcctcctggcgctgttgtggctgtgggagcgagcggcggaaaggactctactgtgctagctcacgtcctccgcgcgctagcgcctcggcttggtattagtttgcagcttgtcgctgtggacgaaggcataggaggatatagggatgccgcgttggcagctgtccgacggcaggccgctaggtgggagctgccactgacagtcgtggcttatgaagacctctttggaggatggacgatggacgctgtcgcccgctcgactgcgggctccgggcgctctcgaagctgctgtactttctgcggcgtgctgaggcgccgagccctagaggagggggcacgcagagtgggggcgacgcacatcgtcaccggacataatgcagatgatatggccgagaccgtgctgatgaatttccttcggggtgacgcaggtcgactagcgcggggcggtggtctcggatcccctggggaggggggggcactccctcgatgtaggcctcttcagtttgcaagtcagaaagaggttgtgctctatgcccattttcggagactggattacttcagcgaggaatgcgtgtatgcccccgaagcctttcgaggtcatgcgagagatctcctcaagcggctcgaggccgccaggcctagcgctgtactggacctcgtccattctgctgagcgtctcgcactggctccagccgcacggccccccaggccaggcgcctgctcccggtgcggtgctctcgcaagccgcgcgctctgccaggcctgcgccctcctggacggtctcaaccggggccggccgagactggcgatagggaagggtaggcggggcctcgacgaggaggcgacccccgggacccctggcgatccagcaagaccccctgcttctaaagccgtaccgaccttttag

SEQ ID NO: 16456 - DNA, 321 bp, Artificial Sequence
  Description of Artificial Sequence: Synthetic coding sequence
atgccagaggatcaggtgggaaaactcgaagcaaccgaaaatacaatctccgcaatggcagccgcggcagctgagcaacagcaattttacctactcttgggcaatctgttgtcaccagacaatgtggtgaggaaacaagccgaagagacctatgagaacattcctggccagagcaagatcaccttcctgctccaggccattcggaacactactgccgctgaggaagcaaggcagatggctgctgtcctgcttaggaggctcctcagctccgcatttgacgaggtatacccagcattgccatctgacgtccaaacggcttag

SEQ ID NO: 16457 - DNA, 198 bp, Artificial Sequence
  Description of Artificial Sequence: Synthetic coding sequence
atggagctcagatgtggcggactgctcttctcttcccgtttcgactccggcaatctggcgcatgtggagaaggttgagagccttagctccgacggagagggagtggggggaggggccagcgctctgacctccggtattgctagctctccggactatgaatttaacgtgtggaccagaccagactgcgcagaaacttag

SEQ ID NO: 16458 - DNA, 1371 bp, Artificial Sequence
  Description of Artificial Sequence: Synthetic coding sequence
atggctgactccttggaatccacacctctgcctagtcctgaagatagactggccaagctgcatcctagcaaggaattgctggagtattaccaaaaaaagatggcggagtgtgaagcagagaatgaggatttgctgaagaagctcgaattgtacaaggaagcctgtgagggacagcataagttggagtgcgacctgcagcagagggaagaggaaatcgccgaactgcagaaagccctctctgacatgcaggtgtgcttgtttcaagaacgcgaacatgtattgaggctatactccgagaacgataggttgaggatcagagagctggaggacaagaaaaagattcaaaacctgttggctctggtaggtacagatgcaggcgaggtgacctatttctgtaaggagccaccccacaaagtgacgatactgcagaagacgatacaggccgttggcgagtgtgagcagtctgagagctctgcattcaaggcagaccccaaaatttctaagagacggccgtctagggaaaggaaggagtcctccgagcattaccagcgggacatacagaccctcatcctgcaggtggaggctctccaggcccagctcggtgagcagactaaattgagtcgtgaacagatcgagggcttgatcgaagatcggcgaatacatctggaggaaattcaggtccaacatcaacgaaaccagaataaaatcaaagaactgacaaaaaacctgcaccatacccaagagttactgtatgagtcaaccaaagacttcctacagcttaggagcgagaaccagaacaaagagaaatcgtggatgctcgaaaaggacaacctcatgagtaagatcaagcagtatagggtgcaatgcaagaaaaaagaggacaaaattggtaaggtcctccctgtcatgcacgagagccaccacgcgcagagtgagtacattaaatccctcaaggacaagcttgtgcaggagaaaaagctgtctaacatgtaccaggaacaatgtattagcttggaagaggagttggcccgcatcagagaggaagagggcatgcggcgggagatcttcaaggacagaaccaacaaaatgggaaagaggctgcagattatgacaaagcgatatgaagcgttagagcgccggcggatcttagaggtggagggctttaaaactgatataaaggttttgcgccaaaagcttaaggacctggaacaaatgctttataaagctacagtgaacgcgcgggccaaccaggacttggccttactgtgcgaagtgagagactcaaacagacgtgcgcataagatccagggagagctcaagaatctgaagagtaaagtgttcggcctggaaaacgaactgcggctctgttag

SEQ ID NO: 16459 - DNA, 1275 bp, Artificial Sequence
  Description of Artificial Sequence: Synthetic coding sequence
atggaccagccgtcaggtagaagtttcatgcaggttctctgcgaaaaatacagtccggagaactttccctatcgccggggtccaggcatgggggttcacgttccggctactccccaagggtctcctatgaaggaccggctcaacttgccaagcgtgttggttctcaacagttgcggaatcacttgcgcgggagacgaaaaggagatcgccgccttttgcgcccacgtgtctgaattggacttaagtgacaataaactggaagactggcatgaggtcagcaagattgttagtaacgttccacagctggagtttttgaacttgtcttctaaccctctgaatctctcggtcctggagaggacatgtgccggatccttctccggggtgaggaaactggtgctgaataactctaaagcgtcctgggaaaccgttcatatgattctacaggaactcccagacctcgaggagttgtttctgtgcctgaacgactacgaaacagtctcttgcccctccatatgctgtcattctttgaaactactgcacataaccgacaacaacctgcaggattggactgagatcaggaaacttggggtcatgtttccctctctggatactctcgtgctcgcgaacaatcatctcaatgccattgaggaaccagacgacagtttggcccgcctgtttcctaacttgaggtctattagcctgcataaatcaggactgcagagctgggaagacatcgacaagcttaacagcttccctaagctggaggaggtgagacttcttggcatcccgctgcttcagccatatactacagaagagaggcgaaaattggtaattgctcgattgccctctgtgagtaaactgaatggttccgtggtgaccgatggagagagagaagattcagagcgtttttttatcagatactatgtcgatgtgccccaggaagaggtgccctttcggtaccatgagctgattacaaagtacgggaaactggaaccactggcagaggtggatcttaggcctcagtcctccgctaaggtggaggttcactttaacgatcaggtggaggagatgagcattcgtctggaccaaaccgtggcagagctgaagaaacaattgaaaaccctcgttcaacttcctacttccaacatgttactttattatttcgatcacgaggccccctttggccccgaagagatgaagtattcctctagagcattacattcctttggcattcgagatggtgacaaaatctatgtggaatccaaaactaagtag

SEQ ID NO: 16460 - DNA, 264 bp, Artificial Sequence
  Description of Artificial Sequence: Synthetic coding sequence
atgtcaatttcctcggacgaagtgaattttctagtgtatagatatctgcaggaatctggcttcagccactcagcctttaccttcgggattgagagccatatttctcagagcaatatcaatggcgccctcgtccctcccgccgcactgatcagtataattcagaaaggtctgcaatacgtcgaggccgaggtttccataaacgaagacggcaccctctttgacgggaggcccatagaatctctgtctctcattgatgccgtttag

SEQ ID NO: 16461 - DNA, 360 bp, Artificial Sequence
  Description of Artificial Sequence: Synthetic coding sequence
atggtacggacaaaaacatggactctgaagaagcattttgtaggctaccctaccaattcagatttcgagctgaaaaccgccgagctccctcctctgaagaatggcgaggtgctgttggaggccttgtttctaacggttgatccctacatgcgggtcgtcgaatccaagaatgtggccctgccaaagggcaccatcgtgcttgcctcgccagggtggacaacccactcaatatctgatgggaaggacctagagaagctgctgactgagtggccagacaccatccccctgtcgctagcacttgggaccgtggggatgccaggcctgacagcttattttggattgttagagatctgtggatag

SEQ ID NO: 16462 - DNA, 23907 bp, Artificial Sequence
  Description of Artificial Sequence: Synthetic coding sequence
atggatcagccacagttctccggcgccccaagatttctcacccgtcccaaggcattcgtggtttccgtcggcaaagacgcaacactgagctgtcagatcgtaggcaacccaactcctcaggtatcatgggagaaagaccagcagcccgtcgccgccggggcaagattccggctggcccaggacggggacctgtatcgacttacgattttggacctggcgctgggagatagtggccagtacgtatgtcgggcccgcaacgctataggggaagcatttgcggccgtgggcctacaggtggatgcggaagctgcttgcgcagaacaagcccctcacttccttcttcgtccgacgtccatcagagtgcgcgagggcagtgaagctacatttagatgtcgcgtaggggggtccccccgccccgccgtctcctggtctaaggacggtagaagactgggagagccggacggcccaagagtccgggtggaagagttgggggaggcgagtgcactgcgcataagggccgcccgaccaagggacggggggacgtacgaagttcgggcagagaaccccctgggagccgcgtcagcggccgcagcactggtagtggatagtgatgcagccgacacagcatccaggccgggcacctccacggctgccttactggcacatcttcagaggaggcgtgaagcaatgcgggctgagggggcccctgcatctcctccaagtacgggcacgaggacctgcaccgtgactgagggtaaacatgcaagactttcttgttacgtgaccggggaaccaaagccagagacggtttggaaaaaagatggacaactggttaccgaggggcgacgccatgtcgtgtatgaggatgcccaggaaaacttcgtgttaaaaatcctgttctgcaagcaatctgaccgaggattatacacgtgtactgccagcaacttggtgggacagacatattcctccgtcctcgtcgttgtccgagaacccgccgtgcctttcaaaaaacgtctgcaggatttggaggtccgggagaaggaatcagctactttcctgtgcgaggtgccacagccttccacagaggccgcgtggtttaaagaggaaacccgactgtgggcaagcgccaagtatggtatcgaggaggagggaaccgagaggagactgaccgtccgaaatgtcagcgcagatgacgatgccgtctatatttgcgagaccccagagggcagccgaacagttgcagaactggctgttcaggggaatctcctccggaaactaccccgaaaaacagctgtacgagtgggagacaccgccatgttttgcgtcgaactcgcggtgccagtgggtcctgtacactggttaagaaatcaggaagaagttgtcgcagggggtcgcgtcgctatttccgccgagggcactcgtcacaccctgacaatctctcaatgttgtttggaagacgtaggacaggtggccttcatggctggcgactgccaaacctctacccaattctgcgtttcagcccctcgcaaaccacctctgcaaccacccgttgacccagttgtcaaagcacgtatggaatcatctgtgatcctctcctggtccccccccccacacggagaaagacctgtgaccatcgacggctacctcgtcgaaaagaaaaagttgggcacttacacatggatcagatgtcacgaagcagaatgggtagcaacgcccgaactgaccgtggcggatgtggccgaagagggcaacttccagtttcgagtgtctgccttgaatagctttgggcagtctccttatctcgagttccctggcacagtgcacctggccccaaagttggctgtaagaacacccttgaaagcagttcaagcggtcgagggcggagaggttacattcagtgtggacctcacggtggcttctgccggcgagtggtttcttgatggacaagccctcaaggcctcctccgtgtacgagatccactgcgaccgcaccagacatacacttaccatccgtgaggtacctgccagcctgcatggggcccagctgaagttcgtagccaacggcatcgagtcatctattcgcatggaggtgagggcagcccccggcctaacagcaaataagccaccggccgccgccgccagagaggtgctggcccgtctgcacgaggaagcccagctgttagccgagcttagcgatcaggctgctgctgttacatggctgaaagatgggcggacactgtctcccggcccgaagtacgaggtgcaggcaagcgcggggagacgcgtgctgcttgtccgggacgtggcccgcgacgacgcagggctatacgagtgcgtgtctcgaggaggaaggatcgcataccaactctccgtgcagggattagctcgctttctgcataaggacatggccggatcctgcgtggatgcagtcgccggcgggccagcgcaattcgagtgtgaaacaagtgaggcacacgttcatgtgcactggtacaaagatggtatggagcttggacactccggggagaggtttctacaggaagatgtgggtacgaggcaccgactggtggccgctacagtgacaagacaggatgaaggcacgtatagctgcagagtgggagaggacagcgtcgacttccgcttgagagtgtcggaacccaaagtcgtttttgctaaagagcagcttgcccgtcgaaaattacaagctgaagccggtgcctccgcaactctgagctgtgaagttgcacaggcacaaaccgaagtgacctggtataaagacggcaaaaagctgtcctcatccagcaaggtgtgtatggaggcaacagggtgtacccggcgcttagtggtgcagcaggccggacaggctgatgctggcgaatactcttgcgaagcgggagggcagcggctctcttttcaccttgacgtcaaagaacctaaagtcgtttttgcgaaggatcaggtggcacattccgaggttcaggccgaagcgggggcgagcgccactctctcatgtgaggtggcccaggcccagacggaggtcatgtggtacaaggatgggaagaagctgtcaagtagtcttaaagttcacgttgaagccaagggctgtagaagaagactggtcgtccagcaggccggtaaaacagacgccggcgactattcttgcgaggctcggggacaaagagtgtcttttcgtctgcacattaccgagcccaaaatgatgttcgccaaggagcagtccgtgcacaacgaagtgcaagccgaggctggcgcgagcgctatgctttcatgcgaagtggcccaggcccagaccgaggtcacgtggtacaaggacgggaagaaattgtcttctagttccaaggttgggatggaggtgaaaggctgtacacgtcggctcgtgttgccacaggcaggcaaagctgatgctggggaatattcctgcgaagcaggggggcagagggttagcttccatctgcatattactgaacccaaaggagttttcgccaaggagcagagcgttcataacgaggtccaggccgaagccgggaccactgccatgctcagttgtgaagtggcacagcctcagaccgaggtgacttggtacaaagacgggaaaaagctgagtagctcgtctaaagtgagaatggaagtcaagggctgtactagacgactggttgtgcagcaggtcggcaaagccgacgcgggtgagtactcctgcgaggccggcgggcagagggtgagcttccagttacatataactgagccaaaggctgtgttcgcgaaggaacagctggtgcataacgaggttcggactgaagcaggcgctagcgcgacattgtcctgtgaggtggctcaggcccagaccgaagtgacttggtacaaggatggaaaaaaactatcatcgtcctccaaggtgcgtatcgaagcggcagggtgtatgcggcaactggtcgttcagcaggcagggcaggccgacgccggagaatacacgtgtgaggccgggggccagcgtctgtcatttcacttagacgtcagcgagccaaaagcagtgtttgccaaggagcagcttgcccacagaaaagtccaggccgaggccggggcaattgcgactctgtcttgcgaggttgcacaagcccagaccgaagtgacttggtacaaagacgggaaaaagctgagcagttccagtaaagttagaatggaggcagtgggatgcacccgacgcctagtcgtgcagcaggcatgtcaggccgacacaggagaatacagctgcgaggcaggcggccaaaggctctcgttcagcctcgacgtcgccgagcccaaggtggtgtttgcgaaggagcagcctgtgcatagagaagttcaggcccaggctggcgcctccactacactgagctgcgaagtagcacaggcccaaacagaagtgatgtggtataaggacggcaaaaagcttagtttttctagtaaggtgcggatggaggccgtgggttgtacaaggagactggtagtccaacaagcaggacaggctgtggccggggagtattcgtgcgaagccggctcacagaggctgagctttcatctccacgtggcagagcccaaggctgtattcgccaaggagcaaccagcgagtagagaagtgcaggccgaggccgggacgagcgctaccctatcttgtgaggtcgctcaagctcagactgaagtaacttggtacaaagatggaaagaagctatcctcgtctagcaaggtgcggatggaagctgtgggctgtacccgtcgcctagtcgtgcaggaggcaggacaagcagatgcgggcgagtactcttgcaaggctggcgaccagagactgtcattccacttacacgtggcagagccaaaggtggtcttcgcgaaggaacagcctgcccatcgcgaggtccaggccgaggctggcgcctcggctacactgagctgtgaggttgcgcaggcccagactgaagttacctggtacaaggacggcaagaaattgtcttcctcctccaaagtcagggtggaggcagttggctgtacccggagactcgttgtccagcaggcggggcaggctgaagctggggagtacagctgcgaggctggcggccagcagctgagttttagactgcaggtcgcagagttagaacctcagatctccgaacgcccctgtcggagggaaccactcgtggtgaaggaacatgaggatatcattctcactgcaacattagctaccccgtccgcagcgacagttacttggttaaaggacggggtggaaatccgaaggagcaagcgccatgagactgcctcccagggagatactcataccttaaccgtgcatggtgcccaagtgctagacagcgccatatatagctgccgcgttggagcagaaggccaggacttcccggtgcaggtggaggaagtcgcggcaaaattctgtaggttgcttgaacctgtgtgcggggaattaggaggcactgtaacccttgcctgtgagctcagcccagcctgtgccgaggtcgtttggcggtgtggtaatacccaacttagagtgggaaaacggttccagatggtcgccgagggacctgtacggtcgttgaccgtgctagggctgagagcggaagatgcaggggagtacgtgtgtgagagcagagacgatcacacaagcgctcagctgacggtctctgtgccacgggtggtgaaattcatgtcaggactgtccactgtggtcgcagaggaagggggtgaggcaacattccaatgtgtggtctctccgtcagatgtggctgtcgtttggtttagggacggggctctactccagccttctgagaagttcgcaatctcacagtctggagcgtcccatagcctgactatttcggacttagtcctggaggacgcagggcagattactgttgaagctgagggtgctagctcttctgccgccttaagggtaagagaggctccggtgctgttcaagaagaaactagaacctcagacggtggaagaaagatcaagtgtgaccctggaagtagagttaacccgcccatggcccgaactaagatggacccggaatgcgaccgccctggcccccgggaagaatgttgagattcacgctgaaggtgcacgccacaggctggtgttgcacaatgtgggattcgctgacagggggttttttggttgcgagacacccgacgacaagacccaggcaaagctgacagtggagatgaggcaggtgcggctggtcagagggctgcaagcagtcgaagccagagagcagggaacggccaccatggaagttcagttgtcgcatgcagatgtcgacggttcctggaccagagacggtctgcggtttcaacaggggcctacgtgtcatctagccgtgcgaggccctatgcatacactcaccctgagtgggctcaggcctgaggacagcggccttatggtatttaaagccgaaggcgtccacacttccgcgaggctggtggtaaccgagctgcctgtgagttttagccgcccccttcaggacgtggtcacgacagagaaggaaaaggtgaccttagagtgcgagctcagccggcctaatgttgacgtaaggtggctgaaagacggtgttgaactgagagccggaaaaactatggcaattgccgcacagggggcttgtagaagtttaaccatttacaggtgtgagttcgccgatcagggagtctatgtctgcgatgctcacgatgcccaatccagcgcctctgtgaaagtgcagggcagaacctacacgctaatttacaggagggtattggccgaggatgccggcgagatccagttcgttgcagagaacgcagagtctcgggcgcagctgagggtcaaggaactccccgtgaccctggttcggccactgagggataagatagcaatggagaagcatagaggggtcttggagtgtcaggtctctcgagcaagtgctcaagtgcgttggttcaaaggttctcaggaactgcaaccagggcctaagtatgaattagtaagcgatggactgtatcggaaactgattatatccgacgttcacgccgaagatgaggatacatacacctgcgatgctggcgacgtaaaaacttccgcgcagttctttgtggaggaacaatccatcacaatagtcaggggcttgcaggatgtcacggtgatggaaccagcacctgcgtggtttgagtgcgaaacctcaatccctagcgtaagaccccctaaatggctgttgggcaaaaccgttctccaggccgggggtaatgttggtcttgagcaggaaggcacggtacatcggctaatgcttaggagaacttgttccacaatgactggccctgtgcacttcactgtggggaagtctcggtcatccgccagactggtggttagcgacatcccggtcgtgctgacacgcccactggaacccaaaactggcagagagttacagtccgttgtgctgtcatgtgactttaggcctgccccaaaagccgtgcagtggtacaaggatgacaccccactatctccttccgagaaatttaagatgtctctcgaagggcagatggccgagctgcggatccttagactcatgcctgcagatgccggggtttataggtgtcaagccggctcagcccatagctcaacagaggtcaccgtagaagccagagaagtgaccgttacaggtccactgcaggacgccgaagccacagaagagggctgggcgtcattttcctgcgagcttagccacgaggacgaggaggtggaatggtctctcaatggtatgcccctgtataacgattctttccacgaaatttctcacaaaggccgcaggcacacattagtgctgaaaagcatacaacgggccgacgctggcattgtccgtgcaagctcgcttaaggtctccactagcgcgcgccttgaggttagagtcaagcctgttgtttttctaaaggcccttgatgacctctccgccgaggaacgaggaacactggccttacaatgtgaggtgagcgatcctgaagcgcacgttgtttggaggaaggatggagtgcagctaggtcctagcgacaagtacgacttcctccacacagccggaacccgcggactggtggttcacgacgtgtctcccgaggacgccgggctgtatacttgccacgtcggcagcgaggagacacgggcaagagtgcgcgtccacgacctacacgttggaataaccaagcgcctgaaaaccatggaagttctggagggggagtcctgcagctttgagtgcgtcctgtcacacgagagcgcgtcagatcctgcgatgtggacggtcggagggaagactgtcggaagctcatccaggtttcaggctacccggcaaggaagaaagtatatcctggtcgtgcgagaggccgcaccgtctgacgctggggaagttgtgtttagtgttcgggggctgaccagcaaggcaagcctgattgtgcgggaaaggcctgcagcgatcatcaaacccctggaggatcagtgggtggcacctggggaggatgtggaactgcgatgtgaactgtcacgggccggaaccccggtccattggctaaaagatagaaaagccatccgcaagtcacaaaagtacgatgtggtttgcgagggcacaatggccatgctggtcattaggggagcttcactgaaagatgccggcgagtatacatgcgaagttgaagcctctaaatctactgcatctctgcatgtggaggagaaggctaactgcttcacagaggagcttaccaatctccaggttgaggagaaggggactgccgtcttcacctgtaaaaccgagcatcccgcggctaccgtgacgtggagaaagggtctattggagctccgagccagcggtaaacatcaacccagccaagagggtttaaccctgagattaaccatctccgccctggaaaaagcagatagtgacacatacacctgcgacattgggcaggctcagtcacgcgcccagttgctggtgcaggggagacgtgtgcatattatcgaagacctcgaagacgtggatgttcaagaaggaagcagcgccacctttagatgccgtatttcacccgcaaactacgagccggtgcattggtttctcgataaaacccctctccatgccaacgagctgaacgaaatcgacgcccagcctggaggctaccacgttctgactttaaggcagctcgctctcaaggattccggcaccatttattttgaggcaggcgaccaacgggctagtgcagcacttagagtgacagaaaaaccatcagtgttttctagggagcttacagatgctacaataacagagggtgaagatctaactctagtctgcgaaacgagtacatgtgacatccccgtctgctggacgaaggacggcaagacacttcgggggtctgccagatgccagttgagccacgaaggacaccgcgctcagctgctgatcacaggagccactcttcaggatagtggacgctataaatgtgaggctggcggtgcttgctctagctcgatagtacgtgtgcatgctcgaccagtcagatttcaggaggccttgaaggatttggaggtgctcgaaggaggagccgccactttgaggtgtgtgctaagctccgttgccgcccccgtcaagtggtgttacggcaataacgttctccggcctggcgacaaatactctcttcgccaggagggtgccatgctggagctggtcgtgcggaatttgagaccccaggactctggccgctacagttgcagcttcggagatcagaccaccagtgccacactgactgtgaccgcgctgccagctcagttcattggaaagcttagaaataaggaagccactgagggggcaaccgctactctccggtgcgaactctccaaagcagccccggtcgagtggaggaaaggatcagagacactccgcgacggagatagatactgtcttcggcaggacggggccatgtgcgaactccagatccgagggcttgccatggtggatgcagcagaatacagttgcgtgtgtggcgaagaaagaacctcagcttccttgaccataagaccgatgcctgcacactttatcggtagacttaggcaccaggagtctattgagggcgctactgccactttgagatgcgagctaagcaaggccgctcccgtcgagtggcggaaaggacgcgagtctctgagagatggcgatcggcactctcttaggcaggacggagccgtctgcgagttacagatttgtggactcgcagttgctgatgcaggagaatacagttgcgtgtgtggggaggagaggacctctgccactctgactgttaaagccttgccagctaagttcacagaagggttgcgtaacgaggaggctgtggagggggccactgccatgttgtggtgtgaactttccaaggtcgccccagtagaatggcggaagggcccagagaacctgcgggacggggatcggtacattttgcggcaggaggggaccagatgcgagctgcagatctgtggcctggctatggctgatgctggggagtacctttgtgtctgcggccaagagcggacgtctgccaccctcactatccgtgccctccctgcgcgcttcattgaagatgtgaagaaccaggaggcacgagaaggcgcaacagctgtgttgcagtgcgagctcaacagcgcagcacccgtagaatggcgcaagggatccgaaaccttaagggacggagatcgctacagcttaagacaggacgggaccaaatgcgagctgcagatcaggggattagccatggctgacaccggagaatacagctgtgtgtgcgggcaggagagaacttcggcaatgcttaccgtccgcgctctcccaattaagtttacagaaggtctaagaaatgaggaggcaactgagggagcgacagctgttctgagatgcgaattatccaaaatggctccggtggaatggtggaaaggccacgaaaccctgagagacggtgacaggcattctctccggcaagacggcgcaagatgcgagctgcagataagggggctggttgctgaggacgctggtgagtacctttgcatgtgtggcaaagaaaggaccagtgccatgctgacagtcagagctatgccttcaaagttcattgaagggctcaggaatgaggaagccaccgagggggacacagccaccttatggtgcgagttaagcaaagcagccccggtggagtggaggaagggacatgaaacactcagggatggagatcggcactctctccggcaagacggctctagatgtgaactacagatcagaggacttgcggtggttgatgctggggagtacagctgcgtgtgcggtcaggaacgaacgtcagcgaccctgaccgtgagggcgcttccagccagattcatagaggacgtgaagaatcaggaagcgagggaaggggcaactgccgtcctgcaatgcgagctgagcaaggctgctcccgtcgagtggaggaaaggttctgagaccctccgcggaggcgatcggtattcacttcgccaggacggtacaaggtgcgagctgcagattcacgggctgtcagtggcagacacaggagagtacagttgcgtgtgcggacaggagcggacctctgctactctaactgtcagagccccccagcccgtcttccgggaacccctccaatctctccaagccgaggaaggtagcactgctactcttcaatgcgaactttcagagcctacggccaccgtggtatggtcaaagggcggactacaactccaggcaaatggccgccgcgaaccgagactccagggttgcacagcggaattagttctccaggacctccaaagggaggatactggcgaatacacctgcacgtgtggatcgcaggctacaagcgccaccctgaccgtgaccgccgcccctgtgaggtttctgcgggagttacagcaccaggaagtcgatgaagggggcacagctcacctctgttgtgaactgagccgggcgggggccagcgtggagtggaggaagggcagccttcagctctttccttgcgcgaaatatcaaatggttcaggatggagcagcagccgaactcctggttagaggcgttgaacaggaggatgcgggggattacacatgcgacacgggtcacacccagtcaatggcaagtttaagcgtacgcgtgccccgacccaagttcaagacccggttgcagagcttggagcaggaaaccggcgacattgctaggctgtgttgccagctctcagatgcggagtctggagctgtcgtgcagtggctaaaggagggggtagagctgcacgcaggcccaaaatacgagatgcgctcccagggcgccacacgggagctcctgatccatcagttagaggccaaggatacaggcgagtatgcttgcgtgacaggcggtcaaaagacagccgctagtctgcgagtgaccgagcctgaagtgacaatagtgagggggctggtagacgcagaagtcactgccgatgaagatgtcgaattcagctgtgaggtgtctcgggccggcgcaacaggagtacaatggtgtttgcaggggctgcccttgcagtcgaacgaggtgacagaagttgctgttagggacgggcggatccatacactgagacttaaaggcgtaacaccagaggacgccggtaccgtgtcctttcacctaggaaaccacgcctcatccgctcagctcaccgtgcgggctcccgaagtgaccatccttgagcctctgcaagatgtccagttatcagagggccaagatgcctcatttcagtgcagactctcaagggctagcggtcaggaggccaggtgggcgctgggcggcgtgccgctgcaggctaacgaaatgaacgacattacagtggaacagggtacactccacctgctgaccttgcacaaggtgaccctggaggacgcaggcacagtgagcttccacgtaggcacttgcagttccgaagcacagttaaaggttactgctaagaataccgttgtcaggggtctggagaacgtcgaggctcttgaaggaggggaagcgctgtttgaatgccagctgagccaaccggaggtggccgcccacacttggctgctcgatgatgagcccgtgcatacgtctgaaaacgcagaggtggtgttttttgaaaacggactgaggcatctgcttctcctaaagaacctgcggccacaggactcctgccgagtgacctttctagctggcgacatggttacatcagctttcctgaccgtacgcgggtggaggttagagatcctcgaaccgttgaaaaacgctgccgtgagggctggagctcaggcctgcttcacctgtactctttcggaggcagtgcctgtgggcgaagcctcttggtacattaacggggctgccgtgcagccagacgacagtgattggaccgtgacagccgatgggtcccaccatgccctgttgttaagatctgcccagcctcaccacgcaggcgaggtgaccttcgcatgtagagacgccgtggctagcgccagacttacagtcctggggctccccgatccaccagaggatgccgaggtggtggccaggagtagccacacagttaccctttcgtgggcagctcccatgagtgatggcgggggtggactctgtggttacagagtcgaggtgaaggaaggcgccacaggtcaatggcgactttgtcatgagctggtccccggccctgaatgcgtcgtggacggattagctcccggtgaaacataccggtttcgggtcgctgccgtgggacctgtgggcgctggagaaccagtgcaccttccacagaccgtgcgtttggccgagcctcctaagccggtgcccccacaaccgtccgcaccagaatccaggcaggtcgccgccggggaggacgtgtcccttgaattggaggtcgtcgctgaggccggggaggtaatttggcataaaggcatggagcgaatccagcccgggggccgattcgaagtggtatcccagggaagacagcagatgctcgtcatcaaggggttcacagccgaggatcagggggagtaccactgcggtctggcccagggaagcatttgccctgcagcggccacattccaggtcgctctttctcccgcctcagtcgatgaagccccccagccgtctctgcccccagaggccgctcaggaaggtgatttgcacctgctatgggaagctctcgcacgaaaacggaggatgagcagagagcctacactagactcaatcagtgagctgccggaggaggatggccgcagtcagcgcttacctcaggaggcagaggaagtcgcccccgacctgtccgaaggctactccaccgccgatgaactggcgagaacaggcgacgcagacttatcacatacctcttccgacgacgagtcgcgcgccggaacgccatcacttgttacctatctgaaaaaggccggaagaccggggacttctccactggcttcaaaggtgggcgccccagcagctccgtctgtaaagccacagcaacagcaagaaccacttgccgccgtccgtcctccgctgggcgacctcagcacaaaggatcttggggacccatccatggataaggccgctgtcaaaattcaggccgcgtttaaaggatataaagtgcggaaagaaatgaaacagcaggagggacccatgttcagtcataccttcggtgatactgaggctcaggtcggcgacgcactgcggttagaatgcgtagttgcttcaaaggctgatgtgcgagcacggtggcttaaggatggggtcgaactcaccgatggccgacaccatcatatagatcagctgggagatgggacttgttcactgctgatcaccgggcttgaccgtgctgacgcgggctgctatacttgccaagtgagcaacaaatttgggcaggtgacacatagcgcctgcgtagtggtttctggcagcgaaagtgaagcagagagcagtagcggaggcgagcttgatgatgccttcaggcgtgcggccagacggctgcaccgcctcttcaggaccaaatctccagctgaagtgtccgacgaggagctgtttttgtccgcagatgagggtcctgccgagcctgaggagccggctgattggcaaacctatcgagaagatgagcacttcatctgtatcagatttgaggcccttacggaggcgagacaggcagtgacacgcttccaggagatgtttgctaccctcggtattggtgtggagatcaagctggtggaacagggccctcgaagggtggagatgtgtatctcaaaagaaactccagctcccgttgtccccccagaacccttgccttcattgttgaccagcgatgccgcccctgtgttcttgacggagctgcagaaccaagaggttcaggatggctacccagtcagcttcgattgcgtggtgactggccagcctatgccaagtgtgaggtggtttaaggacggcaagcttctggaagaagacgatcattatatgattaatgaagaccaacaaggcggtcaccagttgattatcacagctgttgtgccagcagacatgggggtatataggtgcctggccgagaacagcatgggggtgagctcaaccaaggctgagcttcgtgtagacttaacaagtaccgactacgatacagctgcagatgctactgaaagtagcagttatttcagcgcacaagggtacctctcatctagggaacaggaagggaccgaatctaccacggatgaaggccaactaccacaggtggtggaggagctgagggacctccaagtggccccagggaccagacttgccaagtttcagctaaaggtgaaaggttatccagctccacgcctgtattggtttaaggacggccagccactgactgctagcgcccatatccgcatgacagataaaaagatattgcatactctcgagatcatttcggtcacacgcgaagattccggtcagtatgctgcctacatcagcaacgcaatgggcgcggcttactcctctgcgcgcctactggtgcgtggtccggatgagcccgaggagaagcccgcatcagatgttcacgaacagttggtgcctcctagaatgctggagcggttcacccctaagaaggtgaaaaaaggctcctcaatcactttctccgtgaaggtggagggtcgtcctgtacctaccgtgcattggctccgcgaagaagccgaacgcggcgtcttgtggatcggcccagacactcccggatacactgtcgcttcctctgcgcagcagcatagcctggtgttactcgacgtcggtaggcagcaccagggtacatatacttgcatcgcatcaaatgctgccgggcaggcactgtgtagtgcctcattgcacgtaagcggtctgcccaaagtggaggaacaggaaaaagtcaaagaagcgttgatatccactttcctgcagggtacaacacaagctataagtgcccaaggcctggaaacggccagttttgccgaccttggcgggcagaggaaagaggagccactcgccgctaaagaagccttgggtcatttgtccctggcagaggtgggtactgaggagttcctacagaagctgacgtctcagatcacagagatggtctctgccaagattacacaggcgaagctgcaggtacccgggggtgattcagacgaggatagcaaaacccctagcgctagtcctcgccatggccggtccaggccatcaagttctatacaggaatcgagttccgaaagcgaggacggtgacgccaggggcgagatctttgatatatacgtagtgacagcagattacctacctctcggcgccgaacaagacgctatcacactgcgcgagggacagtacgttgaagtgctcgatgccgcccacccgctgcgatggctcgtcagaactaagccgactaagtctagcccttccaggcagggctgggtgtccccggcgtaccttgatagacgcctgaaactctctccagagtggggagccgctgaagccccagagttccctggggaggctgtgtcggaagatgagtacaaggccagactttcttccgtgatccaggaattactaagcagcgagcaagcatttgtcgaagagttgcagtttctgcagtcgcaccatctccagcatctcgagagatgcccccacgtgcctatcgctgtggccgggcagaaagctgttatttttcgaaatgttcgggatatcggcaggtttcactcgtccttcctacaggagcttcagcagtgtgatacagatgacgatgttgccatgtgcttcatcaagaaccaggctgcctttgagcagtacctcgagttcctcgttggtagggtgcaagccgagtccgttgtagtgtccacagctattcaggagttctacaaaaagtacgcggaagaagcattactcgccggagatccaagtcagccaccgcctccccctctgcagcattacctggagcagcctgtggaacgcgtgcaacgataccaagctctgttaaaggaactgattagaaataaggctaggaataggcaaaattgtgccttgttggagcaggcctatgctgttgtgtcagccctcccacagcgagccgaaaataaactccatgtgagcttaatggagaattaccccggaacactgcaggccctgggagaacccattaggcagggacacttcattgtctgggaaggagcccctggagcccgcatgccatggaaaggacacaaccgtcacgtgttcttgttcagaaatcatctggtcatatgcaagccccgtcgggacagccgaaccgacaccgtgtcatacgtcttcagaaacatgatgaagctctcaagcatagatctgaatgatcaggtggagggggatgacagagcgttcgaagtctggcaggagagagaagattctgttcggaaatatctactccaggctcgcacagcaatcattaagtctagctgggtcaaggagatttgcggcatccaacagaggctagcgctgcctgtgtggcgtcctccagacttcgaggaagaactggctgattgtaccgctgagctcggggagacggtcaaactggcttgcagagtcacaggcaccccaaagcccgtgatctcctggtacaaagacggtaaggccgtgcaagttgatccccatcacattctgatcgaagacccagacggatcctgtgcccttatcctggatagtctgacgggcgtggactcgggccagtatatgtgtttcgcagccagtgccgctgggaactgttccaccctcggcaaaatcctggtccaggtcccacctcgcttcgttaataaagtccgtgcgtctccgtttgtcgagggcgaagatgctcagttcacatgtaccatagaaggtgctccatatccccagatccgttggtataaagatggcgccttactcactactgggaacaagtttcagacactgtccgaacctcggagcggactgctagtcctggtgattagggcggcgtctaaggaagatctggggctgtacgagtgcgaattagtcaaccggctggggagtgctagggcctcagcggagctgcggattcaaagccccatgctgcaggctcaggaacagtgccatcgagagcaactggtcgcagccgtggaggacacaacactggaacgcgctgatcaggaggtaacatccgtcctgaagaggctgctcgggcctaaagccccaggcccctcaaccggggatctcacggggcccggaccctgtcctaggggagcgccagctctccaggaaactggctcacagcctccagtcaccggaactagcgaggcgccggccgtgccaccccgagtaccacagcccctgctacacgaaggccccgaacaggaaccggaggccatcgctcgagctcaagaatggactgtccctataaggatggagggtgctgcctggcccggcgccgggaccggggaattactctgggatgtacacagccacgtcgtccgggagaccacacagagaacgtacacgtaccaggccatcgacacacacaccgcacgccctccatcaatgcaggtgactatcgaagacgtgcaagctcagaccggcgggacagctcagttcgaggctattatcgagggtgatccccagccttctgttacttggtacaaggattccgtgcagttggtggacagcacccggctgtcacagcagcaggaaggaaccacctattcccttgtgctgcgccatgtagcaagcaaggatgcgggagtctacacgtgtctcgcgcagaatacgggcggccaggtgctgtgtaaagccgagctgctggtgctggggggagacaatgagccggattccgagaagcagagccatagacgcaaactgcactcgttctatgaagtgaaagaggagataggccggggcgtgtttggtttcgtaaagagggtccaacacaaggggaacaagattctgtgtgcagctaagtttattcccttgcgctctagaacccgggcacaggcctatagagaacgggacatcttggctgccctctcccatccactggtaacaggactgctcgaccaatttgagacacgaaagacgttgattcttatcctggaactgtgttctagcgaggagctcctggacaggctgtaccgcaagggagtcgtaactgaagccgaggtgaaggtgtatatccaacagctggttgaggggctccactacctccatagccatggcgttctgcacctcgacatcaaaccctcaaacatcctcatggtccatccagcgcgagaagacatcaagatttgtgattttgggttcgcacagaacatcactcctgccgaactgcagttttcacaatatggttcccccgaattcgtgtcgcctgaaatcatccaacagaacccagtttctgaggccagcgacatttgggcaatgggcgtaattagttacctttctctcacctgtagcagtccgttcgccggcgagtctgacagagccacattgttgaatgtgctggaaggaagagtgagctggagttctcctatggcagctcatttgagcgaagacgcaaaagactttataaaagccactctgcaacgagccccacaggcacgccctagcgctgcccagtgcttaagtcacccgtggttccttaagtccatgcctgccgaggaagcgcattttatcaacacgaagcagctgaaatttttactggccaggtctaggtggcaacggagtcttatgtcctacaagtcaatcctggttatgagatccatacccgaactgctgagaggaccgcccgacagcccaagtctcggtgtggccaggcacctgtgccgcgacactggaggatctagttccagctcttcttcctcagacaatgaactggccccattcgcacgggccaagtctcttcctccctcccccgtgacccactcccctctcctgcacccaagaggattcctgagaccatcagcctcactccctgaggaagcagaggcaagcgaaagaagcacggaagcgccagcccccccagcttcgcctgaaggtgccggacctcccgccgcccagggatgcgtgcctcgccattccgtgatacgatctttgttttatcaccaggcaggggagtcgcccgagcacggtgccctggccccaggatctcggcgccatcccgcccggcggcgccatctcctgaaaggaggttatattgctggagccctcccggggctgagagaaccgctaatggagcaccgggtattagaggaggaagcggctcgtgaggagcaagcaacgctcctcgctaaagcgccatcatttgaaacagcattacgcctgcccgcttccggtacacacttggccccgggccactcacatagtctagaacatgacagcccatctacccctaggccaagttccgaggcatgtggggaagctcagcgcttgccgtcggcaccttctggcggcgcaccaatccgggatatggggcacccccagggatcgaagcagctcccatccactggtgggcaccccggtacagcacagcccgagaggccctcaccggactcgccgtggggccaacctgcacccttctgtcaccctaagcagggaagcgcaccccaggagggttgcagcccccaccctgctgtggctccttgccctcctggcagctttccaccgggctcctgtaaggaagcccccctggtcccatcctcaccgtttctagggcagcctcaggcgccacccgcccccgctaaggctagtccgcctcttgactcaaagatgggccctggggacatctcacttcccggccgccccaagcctgggccctgctcaagccccggctccgcctcccaagcttcatctagccaggtctcgagtcttcgcgtcggatccagccaggtaggcacagagcctggaccctctctggatgcagagggctggactcaagaggcagaggacctgagcgactctactccgaccctccagagaccacaggagcaggcgactatgaggaaattttctctgggcggtcgaggcggctacgccggagtggccggttatggcacatttgcatttggcggtgatgctggcgggatgctggggcagggtcccatgtgggctaggatcgcttgggcggtatcacaaagcgaagaagaggaacaagaagaagccagagcagaaagccagtccgaagagcagcaggaagccagagccgagagtcctcttccacaagtttcggctcgacctgtccccgaggtcggccgcgcccctacccggtcctccccagagcccaccccttgggaagatattggccaggtgtctctggtgcagattagggacctttcaggagatgcagaagccgccgatacaatttccctagacatatccgaagtggatcctgcatacctgaacctctctgatctttatgacattaaatatcttcccttcgaattcatgatcttccgaaaagttcctaaatctgctcagcccgagcccccttctcccatggccgaggaagagctggcggagtttcccgaacccacctggccttggcccggcgagctcggaccacacgctggacttgaaatcacagaagagtccgaggatgtcgacgcactgctggccgaagccgcggtgggccgcaaacgaaagtggtctagccccagcagatcattgtttcatttccctgggaggcacctgcccttggacgaacccgccgaactcggcttacgcgaacgcgtcaaagcaagtgttgaacacatttcccgaatcctgaagggccggccagaaggattggagaaagagggcccaccgaggaagaaacccggcttggcctcctttcggctttctggcctgaagtcttgggacagggcacccacttttctccgagagctcagtgacgaaacagtggttcttggacaatctgtgacactggcttgtcaagtatctgcccagcccgccgcacaggctacgtggagcaaagacggcgccccactggaatccagttccagagtcctgattagcgccacacttaaaaattttcaactgttgactatcctcgtcgtggtcgccgaagaccttggggtctatacctgcagcgttagcaacgccctcggtacagtgactaccactggcgttctacgaaaagccgaacgtcccagtagctcaccctgccctgacatcggcgaggtatacgcagacggggtgctgcttgtgtggaaaccagtggaaagttacggcccagtgacctacatagtgcagtgtagcttagaaggtggtagctggaccacactggcgtccgatatatttgactgctgttatctcacgtctaagctaagcagaggcggaacttatacattcaggacagcttgcgtgtctaaggccggaatgggaccctattcatccccttcagagcaggtgctccttggggggccttctcatctggccagtgaggaggaaagccaaggccggagcgcccagccgttaccgtccacaaagacattcgccttccagacacagattcagaggggcaggttctccgttgtccgacaatgctgggagaaggcctcaggtcgagcccttgctgccaagatcatcccttaccatcctaaagacaaaaccgctgtcctacgtgaatatgaggccttgaaagggctgaggcacccccatctcgcacagctccatgccgcctatctgagcccgagacacctggtccttatattagaactctgttctggccccgagctgttgccgtgcctggcggagagagccagctacagtgagtcggaagtgaaggactacctctggcaaatgctttccgccactcagtaccttcacaatcagcacatcctgcatctggaccttaggagcgagaatatgattatcaccgagtataatttgctgaaggtggtagacttgggtaatgcacagtctctgtcacaggaaaaagtgctcccctccgataagtttaaagactacttagaaaccatggctcctgaactgctggagggtcagggcgccgtgcctcagacggacatatgggcgatcggggtcacagctttcatcatgctctccgccgaatatcctgtgagttccgagggtgctcgcgacttacagcgcggtctcaggaagggcctggttaggctctctcgttgttatgctggcctatctggcggagccgtggccttcctcaggagcacgctctgcgcccaaccctgggggaggccctgcgcttcctcctgcctacagtgcccatggctgacggaagagggacccgcctgttcccgcccggcccccgtgactttccccactgccagattaagagtattcgtgcgtaaccgagaaaagcggcgagctcttctgtacaaacgccacaacctcgcacaagtgcgctag

SEQ ID NO: 16463 - DNA, 750 bp, Artificial Sequence
  Description of Artificial Sequence: Synthetic coding sequence
atgacagaggactcccagagaaactttcggtccgtgtactacgaaaaggtgggctttagaggagtcgaagagaagaagtccctggagatccttctgaaagacgataggctcgatactgaaaaattgtgtactttctcacaacgcttccccctcccatccatgtacagagcactcgtctggaaggtgctgttgggcatcttgccgccgcaccacgaatcccacgccaaggttatgatgtaccgaaaggagcagtacttggatgtcttacacgcattaaaggtggtcagattcgttagcgacgctacaccccaggcggaggtatatctgaggatgtaccagctggagtcaggcaaactcccaaggtctccttctttccctctcgagccagacgacgaagtttttctggcgatcgcaaaagcaatggaagaaatggtggaagactccgtagactgttactggatcacccgaaggttcgttaaccaactgaatactaagtacagagactccctcccacagctccctaaggcctttgaacagtacctgaacttggaggatggacgcttgcttacacacctgagaatgtgttctgccgcccccaagctaccctacgacctgtggtttaaacggtgttttgccggctgtttaccagagagcagcttgcagagggtgtgggacaaggtggtgtctgggagctgcaagatcctggtttttgtggctgtcgagatcttactgacattcaagatcaagtag

SEQ ID NO: 16464 - DNA, 417 bp, Artificial Sequence
  Description of Artificial Sequence: Synthetic coding sequence
atgtcctccttgggggcctcttttgtgcagattaagtttgacgacctccagttcttcgaaaactgcggcggcggtagctttggcagtgtttacagagcaaaatggatttcacaggacaaggaggtggccgtgaaaaagctgctcaagatcgaaaaagaagcggaaattctctctgtgctgtcccatagaaacatcatccaattttatggcgtaatcttagagcctcctaattatggaattgtgacagagtatgcaagtctgggctcactatacgactatattaacagcaacagaagcgaggaaatggacatggaccacattatgacctgggcgaccgatgtcgccaagggcatgcactatctccacatggaggcccctgtgaaagtcattcacagggacctcaagtctcgcaattag

SEQ ID NO: 16465 - DNA, 1122 bp, Artificial Sequence
  Description of Artificial Sequence: Synthetic coding sequence
atggcgtcctcatccgttcctccggccacagtgagtgccgccaccgctgggcccggcccagggtttgggttcgccagtaagacaaagaagaaacatttcgtccagcagaaggtgaaggtgtttcgcgctgcagaccctctggtgggcgtatttttgtggggcgtggcacattcaataaacgagctgtcccaggttcccccacctgtcatgctgttacctgatgacttcaaggccagctccaaaatcaaggtgaacaaccacctttttcaccgggagaatctgccatcccattttaaatttaaagaatattgccctcaggtgttccggaaccttcgagatcgattcggcatagacgatcaggactatctctacattgtgaagtgtcatggcaacaccttgcttccacagttcctaggaatgtaccgagtgagcgtcgacaacgaagactcctacatgctggtaatgagaaacatgtttagccaccgccttcctgtacatcgaaagtacgacctgaaagggagcctggtcagccgcgaggcgtccgataaagagaaggtaaaggagcttccaaccctgaaggacatggattttctcaataaaaaccagaaagtgtacatcggagaagaggagaagaagatctttcttgaaaaacttaagcgcgatgtcgaattcctggtgcagctaaagatcatggattattctttgctgctggggatacatgacattatccgaggctctgaacctgaagaggaagcgccagtccgcgaggatgaatcggaggttgatggcgattgtagcctgaccggtcctcccgccttggtgggttcctatggtactagcccagaagggattggggggtatatccacagccacaggcccttgggacctggggaattcgagagtttcattgatgtatacgctatccgttccgctgaaggggctccccagaaagaggtatactttatgggtctcattgatatccttactcagtacgatgctaagaagaaggctgctcacgcagcaaagacagtgaaacatggggctggcgctgaaatctccacagttcacccagaacagtacgctaagaggttcctggatttcattacaaatatcttcgcttag

SEQ ID NO: 16466 - DNA, 549 bp, Artificial Sequence
  Description of Artificial Sequence: Synthetic coding sequence
atggaggagatcccagcccaggaggccgcaggcagccctagagtacagtttcaatccctcgaaacccagagcgagtgccttagcccagagccacaatttgttcaggataccgacatggagcagggactgaccgggggcttcccgatcagcaaaccagatgggatcagccaactggagcaggatctgcaggtgttcgacctggaaactaagacccgagaagtgcttcgagatgactgttcagatggagagacgcgggaggagaacaagctcctgataccaaagcagaagatcagtgaagaagtacattcatataaagtgagagtgggacgactaaagcacgacattacacaggtgcccgaaaccagggaagtgtataaatctgaggatcgcttagagcggctccaagaaattctgaggaaatttttatacctggagcgggaattccgccagattactatcagcaaagaaacttttacttccgagaaaaacaatgagtgccacgaaccagagaagtcattctctttggactccaccattgacgccgactag

SEQ ID NO: 16467 - DNA, 2253 bp, Artificial Sequence
  Description of Artificial Sequence: Synthetic coding sequence
atgagtcttggaaaggcgtacggtgtagaatcacatgtcttatcgccggccgagaccaagacactttatcctctcatgaacgtggatgacctgtatggtactttgtacgtcccgcacgacggcaccatggacccggccgggacttgcaccacacttgcacgcgcagccagcgcaagaggcgctcaggtgatagaaaactgccctgttactggcatcagagtttggactgatgacttcggcgtgagacgcgtagccggtgtcgaaactcagcatggctccattcaaaccccctgtgtcgtgaactgtgccggcgtttgggcatccgctgtgggaaggatggctggcgtaaaagtgccgctggtggcaatgcaccatgcttatgtggtcacggagcggattgaaggcattcagaacatgcctaacgttcgcgatcacgacgcctccgtttatttacgactccagggtgacgctctgtcagttggcggctacgaggccaatcctatcttctgggaagaagtatctgataaatttgcattcggattgtttgacttggactgggaggtgttcacccagcacatagagggggccatcaatagggtccccgtgctggagaaaacgggaataaagagtacagtttgtggccccgaatccttcacacctgaccataagccactcatgggagaggcacccgagctccgggggtttttcctgggctgcggtttcaattccgccggaatgatgctgggaggaggttgcggccaggagctggctcactggatcatacacggacgtccggaaaaggatatgcatggctatgatattcggcggttccaccactcgctgactgaccatccgaggtggatcagagaaaggagccacgagtcctacgccaagaattattccgttgtgtttcctcacgacgagcccctggctggacgaaatatgcgcagagatcccctccacgaggagctgctggggcagggatgcgtttttcaggagcgccacggctgggaaaggccagggtggtttcatcccaggggccccgctcctgtgctggagtacgattactacggcgcctatggctccagggcacacgaggactacgcctacaggcggctgctggctgacgagtatacctttgcattccccccccaccacgacaccattaagaaggagtgtctggcctgcagaggtgcagccgcagtttttgacatgagttattttgggaaattttacctggtcggcttggatgcaagaaaggccgctgattggcttttcagcgcggatgttagcagacctcccggatctacagtgtacacctgcatgctgaaccaccgaggtgggacagagagcgatctcacagttagccgtcttgctccgagccatcaggcgtcccctcttgcccctgctttcgagggggacggctattatctggcgatggggggcgccgtggctcagcacaactggtcccatatcactaccgtgctgcaggatcagaaatcacagtgtcaactcatcgactcgagcgaggacctgggaatgatctccatccagggccctgctagcagggcgatcctgcaggaggtgctagacgcagatctctctaacgaagcatttccattttcgacacacaagttgttgcgagcagccggacatctcgtgagggcaatgagacttagcttcgtgggggaactcggttgggagctgcacatcccaaaagctagttgcgtgcccgtgtatagagccgtaatggccgcgggggccaaacacgggttaatcaacgccggttacagagcgatagactccctgagtatcgagaagggctacaggcattggcacgccgatctccgtcctgatgattccccgttagaagctggattggccttcacttgtaaactgaaatctcccgtcccttttctaggtcgagaggccctggagcagcagcgggcagcaggactccgccgccgtcttgtgtgctttactatggaagacaaggtccctatgttcggcttagaggccatttggcgaaacggtcaggtggtgggtcacgtgcggagagccgactttggctttgccatcgacaaaactatagcgtacggctatatacatgacccgtccgggggacctgtgagcctggactttgtgaagagtggcgactacgcgctggagcgtatgggagtcacctatggcgctcaggctcacctgaaaagccccttcgatccaaacaacaagcgagttaaaggcatttactag

SEQ ID NO: 16468 - DNA, 459 bp, Artificial Sequence
  Description of Artificial Sequence: Synthetic coding sequence
atgtctgttacatatgacgatagcgtcggagttgaggtttcctcagattccttctgggaggtgggcaattataagagaaccgtaaagagaattgacgatggacatcgtctgtgcagcgatctgatgaactgtctccacgaacgagcgcgtatcgaaaaggcctatgctcagcaactgacagaatgggcaaggcgctggaggcagttagtggaaaagggaccccagtacggaaccgtagagaaggcttggatggcctttatgtcagaagctgagcgagtgtccgagttacacctggaagtcaaagcttcgcttatgaacgatgatttcgaaaaaatcaagaattggcagaaggaggcgttccataaacagatgatgggggggttcaaggaaaccaaagaggccgaagacggttttagaaaagctcagaaaccttgggccaagaaactgaaggaggtgtag

SEQ ID NO: 16469 - DNA, 1620 bp, Artificial Sequence
  Description of Artificial Sequence: Synthetic coding sequence
atggctacaagcgcacccctcaggagtctggaagaggaggtgacatgctcaatctgcctggactaccttcgcgacccagtaacgatcgactgtgggcacgtgttctgcaggtcttgcaccacagacgttcggcccatatctggatcaagacctgtatgtcccttgtgtaagaaacctttcaaaaaagagaatatcaggcccgtatggcagctcgccagtctggtcgagaacattgaaagactgaaggtcgataagggcagacagccaggcgaggtgacacgggagcagcaggatgcgaagctatgtgagcggcatcgggaaaaactgcattattattgcgaggacgatgggaaactcctgtgcgtgatgtgccgggagagtcgagagcaccgcccccacacagccgttctcatggagaaagcagcacaaccgcatagagagaaaatacttaatcatcttagtactctgcggagagacagagacaaaattcaaggcttccaggctaaaggggaagccgatattctggctgcactgaaaaaactgcaagaccagcgacagtatatcgtagctgaattcgaacaggggcaccaattcctgcgcgagcgcgaggagcacctcctggaacaactggcaaagctggaacaagaactgactgagggacgagagaagttcaaatcacggggcgttggcgagctcgcaagacttgccctggtgatttcagaactggagggcaaggctcagcagcccgccgcggaattgatgcaggatacaagggattttctcaatcgctacccgagaaagaagttctgggtgggcaaaccaattgctagggttgttaaaaaaaaaacaggtgagttcagcgacaagctgctttccttacagagaggccttcgcgaatttcagggcaaattgcttcgtgacttggagtacaagacagtgtctgtgacattggatcctcaatcagctagcggctatctgcaattgtcagaggactggaaatgcgtaacttacacgtctctgtacaagagcgcctatctgcatccccagcagttcgattgcgagcccggggttctagggagcaagggcttcacgtggggcaaggtgtattgggaggttgaggtggagagagaaggatggtcagaggatgaggaagagggagatgaagaggaggaaggcgaagaggaagaagaggaggaggaagctggatatggcgatggatacgacgattgggaaaccgatgaagacgaagaatcgcttggcgacgaggaagaggaggaagaagaagaagaggaagaggtgttggagagctgtatggtcggtgtggccagagactccgttaaaagaaagggagacctgtctctgaggcctgaggatggggtctgggccctgaggttgagctcttccggaatttgggccaataccagccctgaggccgagcttttccccgccctcaggccccgcagggtcgggattgctcttgattatgagggcgggacagtaactttcacgaatgccgagagccaagagttgatctatacgttcacggcaaccttcacaagaaggctggtgccttttctgtggctgaaatggcctgggacccggttgcttctgcgaccatag

SEQ ID NO: 16470 - DNA, 1266 bp, Artificial Sequence
  Description of Artificial Sequence: Synthetic coding sequence
atgatggaagacaataagcagctggcgctcaggatcgatggggccgtgcagtccgcttctcaagaggttacaaatctaagagccgagctaacggctacaaaccggcgcctggctgaactctccggagggggcggacccgggcctggaccaggcgcggctgctagcgctagcgctgcaggtgattctgctgctacaaacatggaaaatcctcagcttggagcgcaggtccttctgcgcgaggaggtctctaggctgcaggaggaggtgcacctgctgagacagatgaaggaaatgctcgcaaaagacttggaagagtcccagggcgggaaatcctcagaagttctttcagccactgagctgagggtgcagcttgcccagaaagagcaggagctggcaagagctaaagaagctctccaggcaatgaaggcagatcgcaaacggctgaaaggtgagaagacagacctagtttcacagatgcagcagctgtatgccaccctagaatctagggaagaacaattgagggatttcatacgcaattacgagcagcatcgaaaagagagcgaggatgctgttaaggcactggcgaaggaaaaagacctcttggagagggagaagtgggagctgcgcaggcaagctaaagaggccaccgaccacgcaacggccttgagaagccagctggatctaaaagacaatcggatgaaggagctggaagccgagctcgctatggcaaaacagagtctggcgacattgactaaagacgtccctaaacgccattctctggcaatgcccggcgagactgtgctgaatggaaaccaggaatgggtggttcaggccgacctgccactcacggccgccattagacagtcacaacagacactgtatcattcacatccaccgcatcccgccgatcgacaggccgtccgcgtgtccccttgccactcaagacagcctagcgtgatctccgatgctagtgctgccgagggcgaccgaagttcaacgcctagtgacatcaattcccccagacaccggactcacagtctttgcaacggcgattcaccaggacccgtgcagaagaatcttcataaccctatcgtacaatcccttgaggatctggaggaccaaaaacggaagaaaaagaaagagaaaatgggatttgggagcatctcaagagtgtttgcacgagggaagcagaggaagagcttggaccctggtttatttgatggaacagctcctgattattatatcgaagaggacgcagattggtag

SEQ ID NO: 16471 - DNA, 492 bp, Artificial Sequence
  Description of Artificial Sequence: Synthetic coding sequence
atggtaggcggtgggggagtcgggggcgggctcctggaaaatgcaaacccattaatttaccagcggtctggggagagacccgtgaccgcaggagaggaagacgaacaggtgcctgattcaatcgatgcacgtgagatctttgacttgattcgatcgataaacgacccggaacacccactcacactggaagagctgaacgtggtagaacaggtccgggtacaggtgtctgatcccgagtcgacagtggccgtggctttcaccccaaccatcccccactgctctatggccacattaatcggtctgagcatcaaagtcaagctgcttcgttcactgccccagagattcaagatggatgtgcatatcaccccagggacacacgcaagcgaacacgcagtaaacaaacagctcgctgacaaggaacgggtcgctgccgccttagagaatactcacctcttagaagtggtcaatcagtgtctcagcgccagaagctag

SEQ ID NO: 16472 - DNA, 207 bp, Artificial Sequence
  Description of Artificial Sequence: Synthetic coding sequence
atgtcaatctcgagcgatgaggtgaacttcttggtgtatcgatacctccaggagagcgggttctctcactctgcatttaccttcggaatcgagtcacatatcagccagagcaatattaacggggctctcgtaccaccagcggccctgataagcataatccagaaagggttgcagtacgttgaggctgaggtttccattaacgagtag

SEQ ID NO: 16473 - DNA, 534 bp, Artificial Sequence
  Description of Artificial Sequence: Synthetic coding sequence
atgtctagcaatgaatgcttcaagtgcggacgctccgggcattgggcccgggagtgccccactggaggtggacgcggccggggcatgcgtagtcgggggaggggcggatttacgtctgacagggggtttcagttcgtaagtagtagcttaccagatatttgttatcgctgtggggaatcggggcacctggccaaagactgtgatctgcaggaggacgcctgctataactgcggacgcggtggccatatcgcaaaagattgtaaggagcccaaacgggagagagaacaatgttgctacaactgcgggaaacccggccatctggcgagggattgcgatcatgctgacgaacagaagtgctacagttgcggtgagtttggccatatccagaaagattgcaccaaggtcaaatgctacagatgcggcgaaaccggccacgtggccataaactgcagtaagacctcagaggtgaattgttatcgttgtggggagtccggccatttagcacgggaatgcactatcgaggcaactgcttag

SEQ ID NO: 16474 - DNA, 429 bp, Artificial Sequence
  Description of Artificial Sequence: Synthetic coding sequence
atgacgcagctgcggcaagtccttgaatcccgcctccagagaccactgcccgaagacttggcacgtctttggcccgtggtaattctctgtcagctcgctaaccagctaaggcctcgctccgtgccattcatccatgtgccgagccccgccgtgccaaagctctccgcgttaaaggccagaaagaacgttgagagctttctggaggcgtgtcgcaagatgggcgttcctgaggctgacctgtgtagcccctcagatttgctgcaggggacggctcgtgggttacgaaccgccctggaggcagtcaagcgtgtgggcgggaaagccctcccccctctttggcctcccagtgggctggggggcttcgtcgtgttctatgtcgttctcatgctgttgctctatgtgacatacaccagacttcttgggagttag

SEQ ID NO: 16475 - DNA, 1296 bp, Artificial Sequence
  Description of Artificial Sequence: Synthetic coding sequence
atggaagacctcaaaggccctaccgtaagtagctttctgagcggaatgaaaacagagctttatcccggtgtaacagccattgacatgatgtacaaagaaggcctccatggtgtggataacggcattctgattttcgataaggttagaatcccccgcgagaatctcctggacaaattcggaagcgtcgcccctgatggtcagtaccactccccaattcggaacaagtcggcccggttcaatgcaatgctggctgccctgaccccgtcaagattggctgtcgcctttcaggcgatgggagccatgaaactcgggctgacaatcgctattagatactcccactccagaagacagttcggaccaaagaccaaggaggaagtcaagattatagaacaccagacccagaccctaaggctgatgccacatctggccacagctttggcccttaccttcgtgagtcgctatgcaggtgcactactcgacgaagacgtttttcagggaaaagaactggtgaactccagaagtttgcaagccctggtggcaggacttaaggcttacagcacatgggagaatatacgttgtctgcaagattgccgggagtgcacagggggcatggtggttggccgtgagctcctggcccagtacactaaacagtacgaggagaagccgctgtttggcttacttcagaactgggccgagtccgtgggggacaagctgaggacttctttcctagccttcaatatggacacggtcgatgatctggcattcctcctgaaagccgtcaaatttcgggaaagagtgctgcagcgcggactggtggcacgaatctactacaaagtcaaaacaaaaaaagaggacttttttcatgcttggaacagttgcctccatcacgtggcaagtctctctctcgcccatactcaccgcgtgacactggagcagtttagcctcgctgtgaagagctgccctgatcaggaggaccagacactgctcatgaaattctgcctactctacggaactaaattagtgttccaagaaagggcctggtatctcgagcataaataccttacccccatggcctctacacgcattagaaaccagctgctcgacctatgtgattcggtaaaggatgatgccaggcgcgttatcagtaccttcaatatccctcatacctatctccacgcacctatcgccgggatctcaaacccccgggctgcctgggctttctacccagctcctctgcagccacggcctcgagaggaagcgcggagtcggagacccaagctcggtgcaaagctgtag

SEQ ID NO: 16476 - DNA, 1443 bp, Artificial Sequence
  Description of Artificial Sequence: Synthetic coding sequence
atggctgagctgcagatgctgctggaagaagaaattcctggaggtaggagggccctgttcgattcttacacaaatctggaaagggtcgcagattactgcgagaacaactatatccagagcgctgataaacagagggccttggaggagacaaaggcctacaccactcagagcctggcaagtgtcgcatacctgatcaacacactcgccaacaacgttctgcagatgctcgatatccaagcctcacagctgagacgcatggaatcctctatcaaccatatcagccagacggtggacatacacaaagaaaaagtagctagacgtgagatcgggattcttaccaccaataaaaacacctcccgcactcacaagatcatcgcccctgcaaatctcgagcggcctgtgcgttacataagaaagcccatagactatactatacttgatgacatcggccatggggtgaagtggttactgcgcttcaaggtgtctacccaaaatatgaaaatgggggggctgcctcgtacgacccccccgacacagaagccgccctcccccccgatgagcggaaagggaactctcgggcgacattccccatatcgaactctcgaacccgtgcgccctccagtagtccctaacgactacgttcctagtccaaccaggaacatggcccccagccagcagtcaccggttaggacggcgtcggttaatcagagaaacagaacttatagtagtagtggaagctcggggggatctcatcctagttctcgctcctcttcaagagaaaatagcggctcaggttccgtgggtgtaccaatcgccgtccctacccctagtccgcctagtgtctttccagacgctgcagctgggggagcccagaccttggcagacgggtttacttcacctaccccccctgtggttagcagtacaccgccaactgggcaccccgtgcagttttactctatgaatagaccggctagtcgtcatacgccccctacaatcggagggtcactgccctaccgccggcccccctccataacatcgcagacatccttgcagaaccagatgaacgggggtcctttttattcacagaatcccgtgagcgatactccacctcctcctcctcctgtggaggagcccgtgtttgatgaatccccaccgcctccaccaccaccggaagattacgaggaggaagaggcagctgtggtggagtatagtgacccctacgctgaggaggaccctccttgggcccctcgctcctaccttgaaaaagtggttgcaatctatgactataccaaagacaaggaggacgaactgtcttttcaagaaggagctatcatatatgttatcaagaaaaatgatgacggttggtatgaaggagttatgaatggcgtgactggcctattccctggcaattatgtggaatctatcatgcactactctgagtag

SEQ ID NO: 16477 - DNA, 3102 bp, Artificial Sequence
  Description of Artificial Sequence: Synthetic coding sequence
atggatgaagaggagaaccattacgtgtctcagctgcgcgaggtgtattcctcctgtgacaccacagggaccgggttcttggatcggcaggagctgactcagctgtgtctcaaattgcacctggaacagcagttgccagtcctgctccaaactttgctcggtaacgaccattttgcgagggtcaactttgaagagtttaaggagggattcgtcgcggttttgtcttccaacgccggagtccgaccaagcgacgaagacagcagctctcttgaaagcgccgcgagcagcgctataccgcctaagtacgtgaacggctcgaaatggtatgggcggcgctcaagacccgagttatgcgacgccgcaactgaagctcgtcgcgtcccagagcaacagacccaggcgagccttaagagccatctgtggcgctccgcttccttagagtccgtggaatcgcccaagtccgatgaagaagctgaatcaacgaaggaggcacagaatgaactgtttgaggcccagggtcagttacagacatgggatagcgaagactttgggtctccccaaaagtcatgcagcccatctttcgatactcccgagagtcagatccgcggtgtgtgggaggaattgggggtgggctcttcaggtcacctgtccgagcaggagctggcagtggtttgccagtccgttggcttgcaaggactggagaaagaagagcttgaggaccttttcaataagttagaccaggatggagatggcaaggtttctttggaggagtttcaattaggcctgttttcgcatgagccagcactgctcttagagtcgagcactagagtgaaaccctccaaagcctggtctcactaccaggttccagaggagtccggttgccataccacgacaacgtcttctctagtctccttgtgttcttccctgcgccttttcagctcaattgacgacggtagcgggttcgctttcccagaccaggtacttgccatgtggacgcaggaaggtatacagaatgggcgtgagatcctccaaagccttgacttcagtgttgacgaaaaagtcaaccttcttgaactgacttgggcactggacaatgagctgatgacggtggactcggccgtacaacaggctgccctagcttgttaccaccaggaactctcctaccagcaaggtcaagttgagcagctcgccagggagcgtgataaggcccgacaggatcttgaacgcgccgaaaagcgaaatctcgagtttgtgaaggaaatggatgactgccactctacacttgagcaactgacagagaagaagataaaacacctggagcagggctaccgggaaagactttccctgttgcgctccgaagtggaggcagaacgagagttattctgggaacaggctcaccggcagcgggcggccttagaatgggatgtgggccggttgcaagcggaggaggccggcctgcgcgagaaactcaccctggccctgaaggaaaattctagactccagaaggagattgtggaagttgttgaaaaacttagcgatagtgaacgtctggccctcaaactccagaaggacctagaattcgtgctaaaggacaagctcgagccccagtctgcggagctcttggcgcaggaagagcggtttgccgcagtgctgaaggagtacgaactgaagtgtcgagatctccaggataggaacgacgagttacaggccgagctagagggtctctgggcgcggctcccaaagaacagacattctccgagctggagtccagacgggaggcgacgccaactgccaggtctcggcccagcagggatcagttttctaggaaatagcgcgcctgttagtatagagacagagctgatgatggagcaggtcaaggagcattatcaggatctgcggacccagttggaaaccaaagtgaactattatgagagagagatcgctgcccttaagcgcaattttgaaaaggaaagaaaagacatggaacaggcgagacgacgtgaagtctccgtcctggagggacagaaggccgatcttgaggagctgcacgagaaatcgcaggaggtcatttggggcctccaagagcagctacaggataccgctaggggacccgagcccgaacagatgggcctggcaccttgctgcacgcaggctttgtgcggtcttgctctgcgtcaccactcgcacctgcagcaaattcggctggaattccacaggctttctgaagagaatacgctcctgaagaatgatctcggccgcgtccgacaggagctggaagccgctgaaagcacccacgacgctcaaaggaaggagattgaagttctgaagaaggataaagaaaaggcctgcagtgaaatggaagtcttgaaccgccagaaccagaactacaaagatcagctgagtcaactcaacgtccgggtactacagctgggacaggaagcttctacacaccaggcgcagaatgaggagcatcgcgtgacaatccagatgcttacacagtcactagaagaagtagtgaggtccgggcaacagcaatctgatcagatacaaaaactgagagtagaactggagtgcttaaatcaggagcaccagtcactgcaactgccctggagcgagttaacccaaaccttggaggagagccaagaccaggtgcagggcgcccacctgaggctgcgccaggcacaggctcagcacttgcaggaagttagactggttccccaagaccgagtcgctgaactccacaggttgctgtccctgcagggtgagcaagctcggagacgcctggatgcccaaagagaagagcatgagaagcagctgaaggctacagaagagagggtggaggaggcagaaatgatcctgaagaacatggagatgctactccaggaaaaagttgacaaactgaaggagcagtttgagaaaaatactaagagcgacctcttgctgaaagaactctatgtagagaatgctcacctggtgcgcgccctgcaggcaaccgaggagaagcagcgcggggccgagaagcagtctagactgcttgaggaaaaagtgagggcgctgaacaaattagtatctcggattgcacccgccgcgctttctgtttag

SEQ ID NO: 16478 - DNA, 627 bp, Artificial Sequence
  Description of Artificial Sequence: Synthetic coding sequence
tgctgtggatgttcaggtggctgtggctctggctgcggagggcggggcagtggttgcggcgggtgcggctcagggtgcggtggctgtgggtcggggtgtgggggctgtggttccggttgcggaggctgcggcggctgcggctcaggatgcgcggggtgtggcggctgcaagggtgggtgcggttcatgcgggggaagcaaaaggggctgtgtgagttgtggcgtaagcaaaggcgcatgcggcagttgcggaggcagcaaaggggggtgcggtagttgcggggggtccaaggggggctgcgggagttgcggaggctcaaaaggagggtgcggatcctgtggcgggagtaagggcgggtgtgggagctatggctgcagtcagtcgagttgctgcaaaccctgttgctgttccagtggatgcggtagctcctgttgtcaatcgtcctgctgcaaaccttactgttgccagagctcatgctgtaaaccctactgttgccagtctagctgttgcaagccatgctcttgtttcagcgggtgtggaagtagttgctgccaatccagttgttacaagccgtgctgctgccagtcatcctgttgtgttccggtgtgttgccagtgtaaaatttag

SEQ ID NO: 16479 - DNA, 642 bp, Artificial Sequence
  Description of Artificial Sequence: Synthetic coding sequence
atggccggaagtcccgaactggtggttcttgaccccccctgggacaaggagctggccgccggaacggaatcccaagccctggtttccgcaaccccccgagaggactttagagtgcgctgcacttcaaagagggccgtaaccgaaatgctgcagctgtgtggcaggttcgtgcaaaagcttggcgacgcattaccagaggaaattcgagagcctgctctgagggatgctcagtggacattcgagtctgccgtgcaggagaatattagcattaacggtcaggcttggcaggaggcctccgataactgttttatggattccgacataaaggtcctggaagatcagtttgatgaaattatcgtggatattgcaaccaagcggaagcaataccctagaaagatcctagagtgcgtgatcaaaacaatcaaggcaaaacaggagatactaaagcagtatcaccccgtagtgcaccctctggatcttaagtacgatccagacccagtgctgaatggtaacgcctttaacttctctccttttaacatgatgctggccgtcgatttgtcttacatggtttttattacgtccagccctagctatggcaagttcgaaatgcagcggggcaattcaagcaaaggggaccagtag

SEQ ID NO: 16480 - DNA, 3720 bp, Artificial Sequence
  Description of Artificial Sequence: Synthetic coding sequence
atgacaatctggcagatgcaaaaacaggctcaaagggggtccccagctcgcactcatagcatgatgagtctgagtgtgcgcccacaaaggcgcctactgtctgcgagggtcaacagatcccagtcctttgcgggcgtgcttggatctcatgagagagggccacgcagttttcccgtcttctctcctcctggacccccaagaaaaccaccggcactaagcagagtctcacggatgttctctgtggcccacccagccgccaaagttccacagcctgaaaggttggacctggtgtacactgctcttaaaagaggccttaccgcctacctggaagttcatcagcaagaacaagaaaaactgcagggccagataagggaatccaaacgcaacagcagactaggttttttgtatgacctggataaacaggtgaaatccattgagcgttttctgcgccggctggagttccacgcaagcaaaatcgacgagctttatgaagcttactgcgtacaacgccgcctgagagacggggcctacaatatggtgagggcttatactaccggctccccggggtcaagggaggcacgggattccttagccgaggccactcggggccaccgtgagtatactgagtccatgtgcctcctggagtctgagcttgaagctcagctgggcgagttccatctgcggatgaagggactagccgggttcgcccgcctgtgtgtgggcgaccagtatgagatttgcatgaagtatgggcgccagcggtggaagctgagagggcggatcgaagggagcgggaagcaggtctgggattccgaggaaaccatttttctccctctgctaacagagttcctttctattaaggtaacggagcttaagggcctggcgaaccacgtagtcgtggggagcgtcagttgcgagaccaaggatctcttcgccgccctaccccaggtggtagctgtggacatcaatgatctcggcacgataaagctctctctggaagtgacatggtctccgttcgacaaagacgaccagcccagtgctgctagcagcgtcaataaagcctcaacggttactaagaggttctccacctactcgcagagcccgccggacactcctagtttgcgggaacaggctttctacaatatgctgcgtcggcaggaggaactggaaaacggcactgcctggagtctgtcttccgaatcgagcgatgattcgtcctctccgcagctgtccggaaccgcccgtcactctcctgctcccagacccttagtgcagcagccggaacctctccccattcaggtagcttttagacgcccggaaacccctagctccgggcccctcgacgaggaaggcgctgtcgctcccgtcctagccaatggacacgctccatactccagaaccctatcccatatttctgaggccagtgtggatgctgctttggccgaggccagcgtggaggcagtgggcccagaaagcctggcatggggtccaagcccccccacccaccccgcccccacacatggagagcaccccagccccgttcctccagccttggaccctggtcacagcgccacttcctccacgctcggaacgaccggttcggtgccaaccagcactgatccggcgccctccgcacatctggattcagtgcataaatccactgattccggaccttccgagctgcccgggccaacacacaccaccaccggcagtacatacagcgccatcacaaccacccatagcgccccgtctccactgacacacaccaccactggctccacacataaaccgatcatttcaactctgaccaccacaggtccaacgctgaatatcatcggcccagtgcagaccacaacgagtcctacgcacaccatgcccagccccacgcacacaacagccagtcccacccatactagcacttcacccacccataccccaacttctcctactcacaaaacgagcatgtcccctcccaccaccactagtcccaccccgagtggcatgggtttagtgcaaacagcgacttcacccactcaccctacaacgtctccaacacatcccaccactagccctattctcatcaacgttagtcccagcacgtcactggaattggcaacattgtcctctccttccaagcactctgatcctaccctgcccggaaccgacagtctgccctgtagtccgcctgtcagcaatagctacactcaagctgatcctatggcgccacgcacaccgcacccgtctccggcacattcaagccgaaagcccttgacttccccagcccctgacccaagtgagagcaccgtgcagtccctgagccctaccccctccccccctacacccgcccctcagcactcggacctgtgtctcgcaatggccgttcaaacacccgtgcccactgccgctgggggatctggtgacaggtcccttgaagaagccctaggcgcactgatggccgctttggacgattaccggggtcaatttcccgaattgcagggcttagagcaagaggtgaccaggctggagtctctgttgatgcaacggcagggactgacaagatctcgggcttctagtctctccattacagttgagcacgcgctggagagtttcagtttcctcaacgaggatgaggatgaggacaatgatgtcccaggagacaggccaccctccagtccagaagctggcgctgaggattcgatcgattcaccctcggctcgccccctttccacgggctgtcctgcccttgacgccgccctcgtccgtcatctgtaccattgttctcgcctcctgcttaaactgggcactttcgggcccttaaggtgtcaggaagcctgggcacttgaaaggcttttaagggaagcacgagtgctggaggccgtgtgcgagttttctaggcgctgggagatcccagcgagtagcgctcaggaggtcgtgcagttcagcgcatccaggccaggatttcttaccttttgggatcaatgcacggaacggctgagctgttttttgtgccccgtggagagggtattgctgaccttttgcaatcagtatggcgctagactgagtctgagacagcccggcctcgccgaagcagtgtgcgtgaagttcctagaggacgccctgggacagaaactgccgagacgcccccagcctgggccaggggaacagttgacggtgtttcagttttggagcttcgtggaaaccctggacagcccaactatggaggcctacgtcacggagaccgccgaggaagtgcttctcgtgcgtaacctcaatagcgatgatcaggcggtagtcctaaaagctttgaggttggctccggagggtaggctccgtcgtgatggtttaagagcgttgtcctcacttcttgtgcacggtaataacaaagttatggccgctgtgtctacccaactgcgctccttgtctttgggaccaacatttcgagaaagggcccttctgtgctttctcgatcagctagaggacgaagacgtgcagacccgggtggccggttgcctggccctgggatgtatcaaggccccagagggtatcgaaccgctggtgtatctttgtcaaacagataccgaagcagtccgtgaggccgcccgccagagcctgcagcagtgtggcgaggagggacagagcgcccacagacgattggaggagtccctcgacgcccttcctcgcatttttggtccaggtagcatggctagcactgccttctag

SEQ ID NO: 16481 - DNA, 732 bp, Artificial Sequence
  Description of Artificial Sequence: Synthetic coding sequence
atggtaactgactacggggcgttcatcaagatccccggttgtagaaaacaagggctcgtgcacaggacccacatgtcctcctgccgggtggacaaaccctcggagatcgtggatgtcggagacaaagtatgggtaaaactgattggcagagagatgaaaaatgatcgcatcaaggtgtccctgtctatgaaggtggtcaatcaggggactggaaaagatctggatccaaataacgtcataattgaacaggaagaacggcggagacggagtttccaggattatactggccaaaagataactcttgaagcggtgctaaacactacttgcaaaaaatgcgggtgcaaggggcgggtgaaacccttgccattccctcgcttctccccatgtggctggaccttgttttggaagaaggaggccgcccagtgtcactttgctaaggactgcttcatgcagccggggggcactaaatactctctcatacccgatgaagaggaagaaaaggaagaggctaaaagtgcagaattcgagaagccagaccccacgcgaaacccgtcccggaagcggaagaaggagaagaagaagaagaagcatagggaccgaaaatcttcagatagcgacagctctgatagtgagagcgacaccgggaagagagcaagacacacttcaaaagactctaaagcggcaaagaagaagaagaagaaaaagaagcacaaaaaaaagcacaaggagtag

SEQ ID NO: 16482 - DNA, 330 bp, Artificial Sequence
  Description of Artificial Sequence: Synthetic coding sequence
atggaagaaattcccgcacaggaagcagcgggatctcctagggttcaattccagtccctggaaacgcaatcagaatgcctgtcccctgaaccccagttcgtgcaggataccgacatggagcagggcctaaccggtggattcccaatctccaaacccgacggaatctctcagttggagcaggacctccaggtgtttgacctcgagactaagaccagggaagtgttaagagacgactgcagcgatggagaaactcgggaggagaataaactacttatcccaaaacagaagatctcagaggaggtgcacagctataaagtacgggtaggctag

SEQ ID NO: 16483 - DNA, 4134 bp, Artificial Sequence
  Description of Artificial Sequence: Synthetic coding sequence
atgtctctcgaacgtgagctgcggcagctcagcaaggccaaggctaaggcgcagcgcgccggccagaggcgtgaggaagcggctctgtgtcaccagctcggtgagctgttagctggacacggacgctacgccgaggctttggagcagcactggcaagagctgcagctaagggagagggccgatgatcctctgggttgcgccgtggcccatagaaagatcggggaacgcctcgccgaaatggaagactacccagctgcgttgcagcaccagcaccagtatctggaactagctcattctctgcgcaatcataccgagctccagcgagcgtgggcaaccatcggaaggacacacttggatatctatgaccattgccagtcccgagatgcattgctccaagcacaggctgcctttgaaaagtcactagccatcgttgatgaagaactggaagggacattagctcagggcgagctcaacgaaatgcggaccaggctctacctgaatctggggctgacattcgaatcactgcaacagaccgccctgtgtaatgattattttcgcaagagcatttttcttgctgaacaaaatcacctgtatgaggacctttttcgggcaaggtacaatttgggcacaatacactggagagctggacagcattcacaggcaatgagatgtctggagggcgccagagagtgcgcacatacaatgaggaagcgtttcatggagtctgagtgttgtgttgtgatagctcaggtgttgcaggatctgggagattttctggccgccaagcgggctctgaaaaaggcatatcggttaggatcgcagaagccagttcagcgggctgccatctgccagaatctacagcatgtgctggccgtggtccgcctgcagcagcagctggaggaggccgaggggcgagatccccaaggcgctatggttatctgcgagcagctgggggatctttttagtaaggctggtgattttcctagggcagctgaagcataccagaaacagctacgctttgccgaactgctcgacaggcctggagcagaacgagccattatccatgtgtccttggcgaccacattgggcgacatgaaggatcaccacggagcagttcgccattacgaagaggagcttcgccttcggagtggaaacgtgttagaagaggccaaaacatggctgaacattgctctgagtagggaagaggctggagatgcctacgagctccttgctccttgctttcagaaagcactgtcctgtgcccagcaagctcagcggccacagcttcaacggcaggtgctgcagcatctccacaccgtccagctgcgactgcaaccgcaggaagcccccgaaacagaaacacgcctgagagagcttagcgtggcagaggacgaggacgaagaggaggaggcggaggaggcggcagccactgcggagagtgaggccctggaggctggggaggtagaactaagtgagggcgaggatgacactgatggcctcacaccacagctggaggaggatgaggagctgcagggacacctaggccggcgaaagggctctaagtggaataggcgcaatgacatgggggagacactgctccaccgtgcctgcattgaagggcaactcagacgggtgcaggacctggtgagacagggccatccactgaatcccagggattactgtggatggactcctctgcacgaggcatgcaattatggacatcttgagattgttcgctttctgctcgatcatggagccgcggtggacgatcctggtggacagggttgtgaaggaatcacccccttgcacgatgcccttaactgtggtcactttgaggtcgcagaactgctgctggagcgcggtgcttcagtgacattgcggactagaaaggcaagcgccagatggaggcggtgctcttccgggaagctgtataggagagatcttgacctggaaacccggcagaaggctagagctatggagatgctcctgcaggccgcagccagtggtcaagatccccactcatcccaggcattccacacgccaagctcactgctcttcgatcccgaaacgtcaccgccactatctccttgtcctgaacctccgtctaattctaccaggctgcccgaagcgtcacaggctcacgtccgggtgagccccggacaagctgcaccagcaatggcaaggcctcgccgtagtcgtcacggtccagcctcctcgagctctagctcagagggggaggactctgcaggcccagcgcggccaagccaaaagcggccccggtgctcggccactgctcaacgagtggccgcctggacaccaggccctgcttctaatcgagaagcagctactgcaagcacatcaagagccgcctatcaagcggccatccgaggtgtggggtcggcccagtcacggctgggccctggtcccccacgcggacatagtaaggccctggcaccacaggctgccctcatccccgaggaggaatgcctagccggagattggctagaactggatatgcctttgacccgtagcaggagacctcgaccacgagggacaggagataatagacggccaagcagtaccagcggctcagactccgaagaatctcgcccacgggcgcgtgctaagcaggtacgcctgacttgtatgcaatcttgttctgcgccagtgaatgccggacccagctccttagcttcagagccacccggctcaccctccacacctcgagtctctgagccctctggggattctagcgctgccggacagccattgggacctgccccacctccacctatcagggtgcgtgtgcaagttcaggaccacctgtttttgattccggtccctcacagtagtgacacgcatagcgtggcatggctcgccgagcaggccgcccagagatactaccaaacgtgtgggcttttaccccggctgacgttgcgtaaggaaggcgcgctgctcgcacctcaggatctgatacctgacgtgcttcagtctaacgacgaggtattggctgaggttacgtcttgggatttgcccccgcttacagacagatataggagggcctgtcagagcctggggcagggggagcaccaacaggtgctccaagctgtagagctgcaggggctcggcctctcgttcagtgcctgttctcttgccttggaccaagcacaacttacacccctgcttagagctctgaaactgcacacagcattgagagagctccgccttgcaggaaaccggttgggcgacaagtgtgtcgccgagcttgtcgcagctttggggacaatgccaagcctggcgttgctcgatctgagcagtaaccaccttggacccgagggactccgtcagttagccatgggcctgcccggccaggccacgttgcagtctctggaggagctggatctctctatgaatccactcggggatggctgcggccaaagcctggcttctttactgcatgcctgccccctcctgtccacacttcggcttcaggcctgcggctttggtccgagctttttcctgagccaccagacggccctgggctctgcctttcaggacgccgaacatctgaaaacgctgtccctgtcctacaatgccctcggtgccccagctctggcccggacgctccagtcccttccagcggggaccctgttgcatctcgagctgagtagtgtggctgctggtaagggggatagcgacctcatggagcctgtgttccggtatcttgccaaggaaggctgtgcacttgcgcacctcactctgtccgccaaccaccttggcgataaagctgtccgcgatctgtgtcggtgccttagtctctgcccgagcctgattagcctagatctgtctgcgaaccctgagatatcatgcgcctccctggaggagttgctctccactttgcagaagcgaccccaggggctgtcttttcttggcctgagcggttgcgccgtccagggaccattaggcctgggcctgtgggataaaattgcagcccagctccgggagctacagctttgctcaagacgcctctgtgcagaagatcgggatgcactccgacaactacagccctcacgaccgggacctggggaatgcacgctggaccatggttccaagctcttcttccgaaggttatag

SEQ ID NO: 16484 - DNA, 675 bp, Artificial Sequence
  Description of Artificial Sequence: Synthetic coding sequence
atgccaacattgttcaagggtgtctggggtgtggtagagcacagtcgcgcacttggccgtttttgtcctgcctgtctaccttcaggccctcatcttcatactcagccggccctgggcacagccgaaatgactctgctgagttctcagagctctagtctggtggcgccttcaggctccgtctctgccgagaatccagagcagaggatgctggagaagagagcaaaggtgattgaagagctactgcagactgagcgagattacatacgtgatctcgagatgtgtatcgaacgcataatggtgccaatgcaacaagcccaggtacctaatatagactttgaggggctgttcggaaacatgcagatggttataaaggtctccaagcagctgctggccgcgttggagatcagcgacgcagtgggccctgttttcctcgggcatcgggatgagctcgaaggcacatacaagatctactgccaaaatcacgacgaagccatcgcgctgttggaaatttatgagaaagacgagaagatccagaaacaccttcaggactcactggcagaccttaaatcgttgtacaatgagtggggctgtacgaattacatcaatctggggtcgtttcttattaaacccgtccaacgcgtcatgcggtaccccctgctattgatggagctgtag

SEQ ID NO: 16485 - DNA, 354 bp, Artificial Sequence
  Description of Artificial Sequence: Synthetic coding sequence
gtctgtggtgactacctgctatccaggatggacgtcacctcatgtatcagctaccgcaactttgccagctgtatgggcgactcaaggcttctgaataaggttgacgcgtacatccaggaacacctgctacagatttcagaagaagaggagttcctgaagctcccgcgtttgaagctcgaagtgatgttggaggataatgtgtgtttaccctccaatgggaagttgtacacaaaggtgatcaattgggtacagagatcaatctgggaaaatggcgattcactggaggagctgatggaggaggtgtccttcaaagtgaatggaatccaacccttcctgaagattatactgttgtag

SEQ ID NO: 16486 - DNA, 285 bp, Artificial Sequence
  Description of Artificial Sequence: Synthetic coding sequence
atgctgtgctgggggtactggtccctgggacagcctgggatcagtactaacttacagggaatcgtggcggagccccaagtgtgtggtttcataagcgaccgcagcgtgaaggaggtcgcttgtgggggaaaccactccgtgttcttgctggaggacggggaagtgtatacctgtggcttgaatacaaagggacagctgggccatgagcgtgaggggaataagccagagcagattggtgctttggctgaccaacacattattcatgtggcttgtggtgaaagctag

SEQ ID NO: 16487 - DNA, 747 bp, Artificial Sequence
  Description of Artificial Sequence: Synthetic coding sequence
atggccacaagcgccccgctgcggagcctggaggaggaggttacctgctcaatttgccttgactacctccgtgacccggtgaccattgactgtggtcacgtcttctgccgtagctgcaccacagacgtaaggccaatatccggctctcggcctgtgtgtcccctctgtaaaaagccatttaaaaaagagaatatcaggcctgtctggcagctggcttcgctcgtagaaaatatcgaacgccttaaagtcgataagggccggcagccaggcgaagtgactcgcgagcaacaggacgctaaactctgtgagcgacatcgcgaaaagttacattactactgcgaagacgacggaaagctcctgtgcgtgatgtgccgggagtccagagagcacaggcctcacactgcggtattgatggaaaaagcggcacagccccaccgagaaaagatccttaaccatctctccactctgagaagggatagggacaaaatccaggggttccaggctaaaggggaggccgatatcctcgctgccttgaaaaaactgcaggatcagcgacagtatattgtggccgaattcgagcaggggcatcagttccttcgcgagcgggaggaacatctactggaacagctcgccaagctggaacaggaactgaccgagggcagggagaaattcaaatcgaggggagtgggagaactggcccgcctggcactggttatcagcgagctcgaagggaaggctcaacaatag

SEQ ID NO: 16488 - DNA, 2814 bp, Artificial Sequence
  Description of Artificial Sequence: Synthetic coding sequence
atggagccagatattatacggatgtactcctcatctcctccacccttggacaatggtgcagaagatgacgacgacgacgagtttggcgaattcggcggttttagtgaggttagcccttccggtgtgggctttgtggattttgatacaccagattatactcggccgaaggaggaattcgtgccatccaatcatttcatgcctatacacgagtttagtgagaacgtggacagtctgacgtccttcaagagcatcaagaacggcaatgacaaggacatcacggcagagcttagtgcacctgtgaagggtcagagtgacgtgctgctgagtaccaccagtaaggagattatttcatccgaaatgctggccacctctattgatgggatggaacgaccaggtaacttaaacaaggtagtagagcagagacagaacgttggcaccttggagtcatttagcccaggcgattttagaaccaatatgaacgtagtgcaccaaaacaagcagctggagtcatgcaatggggaaaaacccccttgtctggagattttgacaaatgggtttgcagtcctggagacagtcaaccctcaaggcacggacgacctggacaacgtcgccgactcaaaaggccgcaagccactctccacccattctacagaatacaacctcgacagtgtccctagcccagccgaggagtttgcagactttgccacattttccaaaaaggaacgtattcagctggaagaaattgagtgcgccgtgctcaacgacagagaagccttgactatcagggagaacaataagatcaatagggttaacgagctcaatagcgtcaaggaggtggcccttggcagaagcctcgacaacaagggggacacagacggcgaggatcaggtatgtgtatccgaaatttcaatcgtgactaacagaggcttcagcgttgagaagcagggtctgccaaccctgcagcaggatgaatttcttcagtccggtgttcaatctaaggcctggagcctggtcgattctgccgataacagtgaggccatcaggcgagagcagtgtaaaacagaagaaaaactcgacctcctgacatcaaaatgtgctcatctgtgcatggactctgtgaaaactagcgacgatgaggtcggatcaccaaaggaggagagtagaaagttcacaaacttccaaagcccgaacatagatcccaccgaggagaacgatctggacgactcactgtccgtcaagaatggtgattcaagtaatgattttgtaacctgtaacgacatcaatgaggacgactttggggactttggtgacttcgggtcggcttcgggctccaccccacccttcgttaccggcacccaggactcaatgtcagatgctacctttgaggagtcgtccgagcacttcccccacttcagcgagccaggtgacgattttggcgaattcggcgatatcaatgccgtcagctgtcaggaggagacaatcctgacgaagtcggatctgaagcagaccagcgataatctctccgaagaatgtcaactagcacgtaaatctagcgggaccgggacagagcctgtagcgaagctgaaaaacggccaggagggagaaattggccactttgactctgtccccaatattcaggatgactgcaatggcttccaggattccgatgattttgcggatttttctagcgccggtccaagccaagtggtggattggaatgctttcgaggacgagcagaaagactcgtgtagctgggccgccttcggagaccagcaggctaccgaatcccaccaccggaaagaagcatggcagtctcaccgaaccgacgaaaacattgacactccaggtacaccaaaaacgcactcggtcccctcagccaccagcaaaggcgcagtggccagcgggcatctgcaggagtctgcaacatcagtccagacggctttgctgaaccgactcgagaggatctttgaagcctgcttcccttctatattggtgccagatgctgaggaagaggttacttcactgaagcatctgctcgaaacctctactcttccaattaagaccagggaagcactgcctgaaagtggagagctcctggacgtttggacagaactgcaggatatccacgacgcacatggtctccgatatcagtgggggggatcccacagcaataagaaactcctaagcagtctggggatcgacacccggaatatattatttacggggaataaaaaacagcccgtgatcgtgccaatgtacgctgctggactgggcatgctagagcccacaaaagagccactgaagccactcagcgccgcggagaagatcgcgtcaatcggtcagacagctactatgagccctgatatgaacacttgtacctcagaccagttccaggagagcctgcctcccgtgcagttcgattggtcttcttccgggctcaccaatcctctcgacgccagtggggggtctactctgttgaacctcgacttctttggtcccgtggatgactccagctcttcttccagcacgactattccaggagtggacccagagttatacgaacttacaacgtccaaactcgagatctctacatcttctttgaaggtgacagatgcctttgcacgcctgatgtccaccgtggaaaagacatcaacttcaacctccagaaaaccaaagagagaggagcacttgtctgaggaggcaatcaaggtgatagcaggcctccctgatctgacattcatgcatgctaaagtgctgatgttcccagcaaccttgaccccatcaacatcctcccaggaaaaggccgatgggtag

SEQ ID NO: 16489 - DNA, 114 bp, Artificial Sequence
  Description of Artificial Sequence: Synthetic coding sequence
atggcctcggaagatattgccaaactcgcagagactctcgctaaaacccaggtagccggaggacaactgtcgttcaagggtaagtccctgaaactcaatacagccgaggactag

SEQ ID NO: 16490 - DNA, 309 bp, Artificial Sequence
  Description of Artificial Sequence: Synthetic coding sequence
atgcagactagctctagtaggagtgtgcatctctcggaatggcaaaaaaattactttgccattacctctgggatttgcaccggcccaaaggccgatgcgtatagagcccagatcctcagaatccaatatgcttgggccaatagcgaaatttcacaggtgtgcgcgaccaagctgtttaagaagtacgctgagaagtattctgccatcattgattcagataatgtcgagagtgggctcaacaactatgccgagaacattctgactctggcgggcagtcagcagacagactccgacaagtggcagagctag

SEQ ID NO: 16491 - DNA, 474 bp, Artificial Sequence
  Description of Artificial Sequence: Synthetic coding sequence
atggccacatccgcccccctgagatctcttgaagaagaggtcacttgttcaatatgcctggactatctacgggacccggtgaccatcgattgcgggcacgtattttgtaggagctgcacaaccgacgtacggccaatcagcggtagtagacccgtgtgcccactctgcaagaagccattcaaaaaagagaatattagacccgtgtggcaattggccagcttggttgagaatatcgaacgccttaaggttgataaaggcagacagcctggcgaagtgacaagggagcagcaagatgcaaaactgtgcgagcgtcacagagagaaactgcactactactgtgaagacgatggtaagcttttatgcgtcatgtgcagagagagtagagaacatcgtccacatactgccgtgcttatggaaaaagccgctcaaccacacagagagaagatcctaaaccacttgagtacactccggtag

SEQ ID NO: 16492 - DNA, 348 bp, Artificial Sequence
  Description of Artificial Sequence: Synthetic coding sequence
atggccggcgcccccacagtctccttgcccgagctgaggagtctgctcgcaagcgggagggcaagactctttgacgtgaggtctcgggaggaggctgctgctggcactattccgggtgccctgaatattccggtgagcgaactggagagcgcgctccaaatggagccagcggcgttccaggccctttacagtgcggagaagccaaaattagaagacgaacatctcgtgttcttctgccagatgggcaagcggggcctgcaggccacacaactggctagatctttaggctatactggcgctagaaactacgctggagcttacagggagtggttggagaaagagtcgtag

SEQ ID NO: 16493 - DNA, 4767 bp, Artificial Sequence
  Description of Artificial Sequence: Synthetic coding sequence
atgctgcctccaaagcatctaagtgcaaccaagccaaaaaagtcctgggccccgaatctgtacgaactggatagcgaccttaccaaggagccagatgttatcatcggagagggacccacagacagtgagttcttccaccagaggttccgcaacctgatctacgttgaatttgtcggcccacggaagacgctgatcaaacttagaaacctatgcctggactggttgcagccggaaacccgcaccaaggaggaaataattgagctgttagtcttggaacaatatttaaccattatacctgaaaagttgaagccttgggtgcgggccaaaaaacctgagaactgtgaaaagcttgtgacacttctcgagaactataaagaaatgtaccagccagaggatgataataacagcgatgtaacatcagatgacgacatgacacgcaataggagagagtccagtcccccccattccgttcacagtttctccgatagagactgggacagacgtgggagatctcgtgatatggagccaagagatcgatggagccataccagaaatccaaggtcacgaatgcctccacgcgacttgagcctccccgtggttgccaagacctcctttgagatggaccgcgaagacgaccgggattcgcgggcgtatgagagtagaagccaggatgctgagtcgtaccagaacgttgtggatcttgctgaagatagaaagccgcacaacactatacaggataatatggagaactaccgcaaactgctgtccctcgtgcagctggctgaggacgatggccatagccacatgacccagggccactcatctcggtccaagaggtccgcttatccttcaacatcaagaggtctgaagaccatgccggaggcaaagaagtctacgcacagacgtggtatctgcgaggacgagtcatctcacggtgtcattatggagaaattcatcaaggatgtgagccgcagctcaaagagtggcagggcccgtgaatctagcgaccgttcacagaggttcccaagaatgtccgatgataattggaaagacattagcttaaataagagggagtccgttatccaacagcgagtctacgaggggaacgcatttcggggtggctttcgattcaacagtactttagtctctcggaagcgtgtcctggagaggaaacggcggtaccactttgacacggacgggaaaggctcaattcatgaccagaaaggttgtccaaggaagaagcctttcgaatgcggcagcgagatgaggaaggctatgtccgtgagttccttgagttctctatcgtcaccctccttcacagagagccagcctattgattttggcgcaatgccctacgtctgtgatgaatgcgggcggagctttagtgtcatctccgagtttgttgagcatcaaatcatgcatacgagggaaaatttatacgagtatggagaatcatttattcattcagtggctgttagtgaggtccagaaatcccaagttggaggcaagaggttcgaatgcaaggattgcggcgagaccttcaataaaagtgctgcgttggctgagcaccgcaagattcatgcccgcggctacctggtggaatgcaagaatcaagagtgtgaagaggcctttatgccttcccccactttctccgagctgcagaaaatttatggcaaggacaagttctatgaatgtcgtgtgtgcaaagagacatttctgcactcttcagctctcatagagcaccagaaaatccactttggggatgataaggataatgaacgagagcacgagcgagagcgcgagagagaacgcggtgaaacctttaggcccagccctgctctaaacgagttccaaaaaatgtacggcaaggaaaaaatgtatgagtgcaaggtatgcggtgaaaccttcctgcatagcagttcgcttaaggaacaccagaagatccacacacgaggtaatcctttcgagaacaagggtaaagtctgcgaagagactttcattcccggccaaagcttaaaacgcagacagaagacctataataaggagaagctttgtgattttacagatgggcgagacgcctttatgcagtcaagcgaattaagtgaacatcagaagatccatagccgcaagaatctgttcgagggaagaggatacgagaagtctgtgatccacagcggaccttttactgaaagtcagaaatcacacaccatcacgcggcccctcgagagcgacgaggatgagaaggctttcaccatcagtagcaacccatacgaaaaccagaagatcccaacaaaggaaaatgtgtatgaggccaaatcttacgaacgaagtgttattcattctttggcctccgtggaggcccagaaaagccactctgtagcaggtccatccaaaccgaaagtgatggcagaaagcacaatccaatcgtttgacgccatcaaccaccagcgggtccgcgccgggggcaacacaagcgaggggagagagtatagcaggagtgtgatccatagtctggtggcttccaagccgcctcgctcacataacggaaatgaattggtcgaaagcaacgaaaagggcgagagctcaatttacatctccgacctgaacgacaaacgacagaagattcccgcccgagagaacccatgcgagggggggtctaaaaatcgcaattacgaggattccgtcattcagtcagtcttccgggctaaaccacagaagtctgtgcctggggagggctctggggagtttaaaaaggatggtgagtttagtgtgccgtccagtaatgtgcgggagtaccagaaagcccgggctaaaaaaaagtatatcgagcacaggtctaatgagacctctgtgatacactccctgccttttggagagcagacttttcgtcccagaggtatgctctatgagtgccaggagtgtggcgaatgtttcgcccatagttcggatctgacggagcaccagaaaatccatgaccgagaaaagccctccggatcacgaaactatgaatggagcgttattagaagcttggcaccaaccgacccacagacgtcctatgcccaggaacagtacgccaaggagcaagcgcggaacaaatgcaaagacttccgccagttttttgccaccagcgaggacttgaatactaaccagaaaatctacgaccaggagaaatcccatggcgaagaaagccagggagagaatactgatggagaagaaacccactcagaggagacccatggccaggagacaattgaggatcctgtgatacaaggatccgatatggaggatcctcagaaggatgacccagacgacaaaatttacgaatgcgaagattgcggactgggcttcgtggacctcacagatctgaccgaccatcagaaggtgcactcaaggaagtgtctggttgatagtagagaatatactcacagcgtcatccacactcactcgatctccgagtatcaacgtgactataccggtgagcagctctatgaatgtcccaagtgcggcgaaagctttattcactcctcatttctgtttgagcatcagcggatccacgaacaggaccagctctactctatgaaaggctgtgatgacggcttcatcgctctgctgccaatgaaaccacgaagaaatcgggccgccgaacgcaaccctgccttagcaggcagcgcaatcagatgtctactctgtggccaaggcttcattcacagctccgcccttaacgagcacatgagacttcaccgtgaagatgacctcctggaacagtcccagatggccgaggaagcaataattccagggttggctctgactgaatttcaaagatctcagaccgaggagaggttgtttgagtgtgctgtctgcggggagtcctttgttaatccagctgagctggccgatcatgtcacagtccacaaaaacgaaccctatgagtacggctcaagttatactcatacctcttttcttacagagcccctgaagggggctatccccttttacgagtgtaaggactgtggtaagtcatttatccattctacagtgctgacaaagcataaggagctgcatctggaggaagaggaggaagacgaggctgctgccgctgccgcagctgctgcccaggaagtggaagcaaatgtgcacgtgccccaggttgtcttgagaatacaggggctgaatgtggaggcagcagaacccgaggtcgaagccgccgagccagaagtagaagctgccgagcctgaagtcgaagcagccgagccaaacggggaggcagagggcccagatggcgaagccgccgaacccatcggggaggctgggcagccaaacggcgaggccgaacagccaaacggtgacgccgacgagccggatggggccgggattgaggatcccgaagagcgcgccgaggaacccgaaggtaaggctgaagaaccggaaggagacgccgacgaacctgacggggtcggaatcgaggaccctgaggaaggcgaggaccaggagattcaggttgaggagccttactatgattgccacgagtgcaccgagacatttaccagtagcaccgcttttagcgaacaccttaagactcacgctagtatgattatattcgaacctgccaacgcttttggcgaatgtagtgggtatatcgagagggcgtctaccagtactggcggggcaaatcaggcagatgagaagtatttcaagtgtgatgtctgcggtcagctctttaacgatcgcctcagcctagccagacaccagaacacacacaccggctag

SEQ ID NO: 16494 - DNA, 381 bp, Artificial Sequence
  Description of Artificial Sequence: Synthetic coding sequence
atggccgccgctacgggcgatccagggctgagtaagctgcagtttgccccgttctcaagtgcactggatgtcggcttttggcatgagctgactcagaagaagctaaacgagtaccgcctggacgaggccccaaaggacatcaagggttactactacaacggagacagcgccggcttgcccgcccggctaactttggagttctcggcttttgatatgagtgctcctactccagcccgctgttgccctgccattggcaccttatataacacaaacacacttgagtcttttaaaactgcggataaaaagctgttgttggagcaagccgctaacgagatatgggaatctattaaatctggcacagccctggaaaatcctgtgtag

SEQ ID NO: 16495 - DNA, 1434 bp, Artificial Sequence
  Description of Artificial Sequence: Synthetic coding sequence
atggctgacggccaggtcgccgagttgttactccgtagattggaggcgtctgacggcggtctggattctgcagagctcgctgcagaactcggaatggagcatcaggccgtcgtcggagctgttaagtcacttcaggctttgggggaagtgatagaagctgagcttagatccacaaagcactgggaactcaccgccgagggtgaggaaatcgctcgggaggggtctcacgaggccagagtgttccggtccatccctccagagggcctcgcccaatctgagctcatgaggctacccagcggaaaggtcggattctctaaagccatgtctaacaagtggatccgtgtcgataagtctgcggccgatggcccgcgagtgttcagggtagtcgatagcatggaagacgaggtacaaagaagactccagctcgtgcggggcggacaggccgaaaaattaggggagaaggagcgttccgagttaaggaaaaggaagcttctcgccgaagtcgggagctggcgtgataggccgttcaaaccctacaacttcttagcacacggggtgttgccagactcaggccacctgcatcctcttttaaaggtccgctcccagttccgtcagatttttcttgagatggggtttaccgagatgcccactgacaattttattgagagcagtttctggaatttcgatgcattgtttcagccccaacagcaccccgcaagggatcagcatgatactttctttttgcgtgaccccgccgaggctctgcaactgcctatggattatgtgcagcgggtgaaacggactcattcgcaagggggctacggctctcagggctataaatataattggaaattagacgaagcccgtaagaacctgctacgcactcatactacttcagcttctgctcgagcactgtacaggctggctcagaaaaagccttttacacccgtgaaatacttctcaatcgacagagtcttccgtaacgaaacactcgacgccacacatctggccgagtttcaccagattgaaggagtggtcgccgatcacggactcactttgggccacctgatgggcgttcttcgagaattctttaccaaactcggtattacccagttgcggtttaagcccgcctacaatccttacacagaaccaagcatggaggttttttcctaccaccaggggctgaagaagtgggtggaagtgggaaattcaggtgtttttcgacctgagatgttacttcccatgggactccccgagaatgtgtccgtgatcgcgtggggcctctctttggagcgccctaccatgattaagtatggcataaacaatatcagggagctcgttggccacaaggtgaaccttcagatggtgtacgactcccccctctgcaggctggacgcggagccccggccacctcctacacaggaagcggcctag

SEQ ID NO: 16496 - DNA, 3195 bp, Artificial Sequence
  Description of Artificial Sequence: Synthetic coding sequence
atgccggttcaggccgctcagtggaccgagttcctctcatgtcccatatgctataatgaatttgacgagaatgtccataaaccaatttctttaggctgctctcatactgtgtgcaaaacgtgtctgaacaagcttcataggaaggcctgcccctttgatcagaccgccattaataccgacattgatgttctgccggtcaatttcgccctcctccagctggtaggggcccaggtgcccgatcaccagtctatcaaactgtccaacttgggcgagaacaagcactatgaagtggccaaaaagtgcgtggaggacctggcgctctacctgaagcccctcagcggaggtaaaggcgtggcaagtttgaatcagtcagccttgtcccggccaatgcagcgaaaattagtcacactggtgaattgtcagttagtagaggaggagggtcgcgtgcgagcaatgcgcgcagctagaagtctgggggagaggactgtaactgagctgattctacagcatcaaaatcctcagcagttgagcgccaacttatgggcggctgtgagagcacggggttgtcagttcctaggccccgccatgcaggaggaagccctgaagctggtactactagccctggaggacggttcagccctgtcccgcaaggttctggtattgttcgtagtgcagaggctagagcctcgctttccccaggcaagcaagactagcatcggacacgtggttcagttgttgtaccgtgcaagttgtttcaaagtcacgaaacgggacgaagattcgagcttaatgcagctcaaagaagagttccgtagctacgaggccctccgtcgagaacacgacgcccagattgtccatatcgcaatggaggcaggtctcaggatctctcctgagcagtggagttcgctactgtacggggacctggcccacaagtcacatatgcaaagcattattgacaaattgcagagtcctgagtcatttgcaaagtccgtgcaagagcttacaatcgtcctccagcggacaggcgaccctgccaacctgaatcgactccgcccgcacctggagctcctcgctaacatcgatccgaatccagacgcggtaagccccacgtgggaacagctggaaaatgcaatggtggccgttaagacagtggtgcacggacttgtggatttcattcagaactactctaggaagggccacgagaccccccagcctcagcctaattccaagtacaagacttctatgtgccgggacctgaggcagcaggggggctgcccccgcggcacgaactgcacttttgcacacagtcaagaagagctcgaaaaataccggcttcgcaacaagaaaataaacgcaaccgttcgaacatttcccctgctgaataaagtgggggtcaataatactgtgacaactacagctggcaatgtaataagcgttatcggcagtaccgaaacaactggtaaaatcgtaccctctacgaacggtataagcaacgctgaaaattccgtcagtcaactgataagccgctccacagactctacactcagagcgctggagaccgttaagaaggtggggaaggtgggtgctaatggacagaacgccgctgggccatccgccgattctgttaccgaaaataaaattggctccccgcctaaaacgccagtcagtaacgtcgctgccacctcagccgggccaagtaacgtgggcaccgagcttaacagcgtgccacagaagagcagtcccttccttacaagggtacccgtgtatccaccacactcagaaaatattcagtatttccaggaccctcggacccaaattcccttcgaagtcccacagtatccccagacaggatactacccacctccacctacagttcccgcgggcgtcgcaccctgtgtgccacgcttcgtcaggtcgaataatgtgccagaatcttctctccccccagcttcaatgccatacgcagatcattacagtacctttagtcctcgtgatcggatgaacagctccccctatcagcctccacctccacagccatacgggcctgtgccacccgtccctagcggcatgtacgcgcctgtatacgactctaggcgaatctggagacctccaatgtaccagcgagatgacatcataagatcaaactccctcccgcctatggatgtcatgcattcatccgtttatcaaacctccctgagggagaggtacaattcattagatgggtactattctgtggcctgccagcccccttctgaaccaaggaccacggtgccactgccacgggagccatgtggccacctcaagacttcttgtgaagagcagattcgccgcaagcctgaccagtgggcacagtaccatacacagaaggcccctctcgtgtcctctacactccccgtggccacccagtcacctactccaccctcccctctgttcagtgtagacttcagagccgacttctctgagtcggtgagcgggactaaattcgaggaagatcacttatctcattattcaccatggtcttgtggcacaatcggctcttgtatcaacgcaatagatagcgaacccaaggatgtgattgcaaatagtaatgcagtgttaatggacttagattcaggcgatgtcaagagaagagttcacctttttgaaacccagagacgcaccaaagaagaggaccctataatcccgttcagcgacggccctatcatctctaaatggggtgccataagccgttcttctaggactggttaccataccactgatcccgtccaggctacggcctctcaagggtccgctacaaagccaatatcagtgagcgattatgtcccctacgttaacgcggttgattcacgatggtcctcttacgggaacgaggctacaagctccgcccactacgtggagcgggaccgctttatagtcacagacctgtctgggcatcgtaagcatagtagcaccggcgacttgctgtctctggagctccaacaggcaaaaagtaattccctcctgcttcagcgggaagcaaatgccttggcaatgcagcagaaatggaactcccttgacgaaggacgccacttgactctaaacctgcttagtaaggaaattgagttacggaatggcgaggttaaaaagctcaatctcagtgcctcttgtttgatgtacttgttcagtgccgcagcgtcttggctgtaccactactag

SEQ ID NO: 16497 - DNA, 1548 bp, Artificial Sequence
  Description of Artificial Sequence: Synthetic coding sequence
tgagccggaggctcgccgagtgtggtggattactttccgtctgaggacttttaccgctgtgggtattgtaagaatgagtccggcagcagatcgaacgggatgtgggcacactctatgaccgtccaggattatcaggatctgatagaccgtggctggagacgctcagggaagtacgtgtacaagccagtgatgaaccagacttgctgcccgcagtatacaattcgctgtcgacctctgcagttccagccctccaagagccacaagaaggtgttgaagaaaatgctaaagtttctagcaaagggcgaagtacccaaaggatcttgcgaagacgagcctatggacagcacaatggatgatgccgtagccggggactttgccctgataaacaagcttgacattcagtgcgacctcaaaacccttagtgacgatatcaaggaaagcctggaatctgagggtaaaaattcaaagaaagaggagccacaagaacttctgcaaagtcaagatttcgtcggggaaaagctgggctccggtgagccatcccatagcgtcaaggtgcatacagtacctaaacccggcaagggtgccgatctctccaagccgccgtgcagaaaagccaaggagattcgcaaggagagaaagcgcttgaagctcatgcagcagaaccccgcaggcgagctcgagggcttccaagcacaaggtcatcctccttcgctgtttcccccaaaggcaaagtcaaaccaaccaaagagtttggaggatctcatcttcgaatctctgccagagaatgcttcacacaaactggaagtgcgggtggttaggtctagcccacccagttcgcagtttaaagctacgctgctggaatcttaccaagtgtataagcgctatcagatggtcatccataagaacccacctgatactccgacggagtcccagttcactagatttctgtgcagtagtcccctggaggctgagaccccacctaatggacctgattgtggttatggatcttttcatcagcaatattggttggatggtaagattattgccgttggcgtgatcgatatcctccccaactgcgtgagctcagtttacctgtactatgaccctgattacagctttctgtcgctgggcgtctatagcgcactcagggaaatcgcttttaccagacagctgcacgagaaaacgtcccagctttcatattactatatgggtttttacatccattcgtgcccaaaaatgaagtataaagggcaataccggcccagcgacctgctgtgccctgaaacctacgtctgggttccgattgagcagtgtctgccctccctggagaattcaaagtattgccggttcaaccaggatcctgaggctgtggacgaggatcgatctaccgaacccgacagactgcaagtgtttcataaaagggccatcatgccttatggagtctacaaaaaacagcagaaggacccgtccgaagaggcagcagtgcttcagtacgcttcactggttggtcagaaatgctctgagaggatgttgctgtttcgaaattag

SEQ ID NO: 16498 - DNA, 225 bp, Artificial Sequence
  Description of Artificial Sequence: Synthetic coding sequence
atggccatggctcccagtccctcattagtacaggtgtacacatcccctgctgccgtggcagtttgggaatggcaggacggtctgggcacctggcacccatacagtgcaaccgtatgctcctttattgaacagcagttcgtgcaacagaaagggcaacgctttggcctgggaagcctggcacactccattccacttgggcaagcagatccaagtctcgccccctag

SEQ ID NO: 16499 - DNA, 594 bp, Artificial Sequence
  Description of Artificial Sequence: Synthetic coding sequence
atggccgctttccgggatatcgaagaagtgtcccaaggcttattgtcattacttggagcaaacagggccgaagcccagcaacggcgactcttgggcaggcatgaacaggtcgtcgagcggctgctggagactcaagatggcgctgagaagcagttgcgggagatcttgacaatggagaaggaagtggctcaatcgctgttaaatgctaaagaacaggtgcatcagggcggtgttgagttgcagcaactggaagccggcctgcaggaagcgggcgaggaggacaccaggctaaaggcctccctgctgcagctgaccagggaactggaagaactgaaggaaattgaggcagaccttgaacgccaagagaaggaggtcgacgaggacaccaccgtgacaattcccagtgccgtgtatgtagcacagctctaccaccaggtgagcaagatcgagtgggactacgaatgtgaaccaggtatggtgaagggtattcaccatggccccagtgtggcccagcccatccacctggattccacacagctgtccaggaaattcatcagcgactacttatggtcacttgttgatacagagtggtag

SEQ ID NO: 16500 - DNA, 2271 bp, Artificial Sequence
  Description of Artificial Sequence: Synthetic coding sequence
atgtccccccagaagcgcgtgaagaacgtgcaggcacagaatcgtacatctcagggatctagtagctttcaaaccaccctgagcgcatggaaggtgaagcaggatccctccaatagtaagaatataagcaaacacggacagaacaacccggtgggggactatgaacacgcagatgatcaagcagaggaagacgctctacagatggcagttggctacttcgagaaggggcccattaaagcttctcagaataaggataagacccttgagaagcatctaaagacagtggagaacgtagcgtggaagaacggcctggcctctgaggagatagatattcttctgaatatcgcactaagcggcaagtttggcaatgctgttaataccagaatcctgaagtgcatgatccctgccaccgtaatcagcgaagactctgtggtaaaggcagtcagctggctgtgtgtgggcaaatgcagcggttctactaaggtgctgttctacagatggctggtggccatgtttgacttcattgataggaaagaacagattaatttgttatacggatttttctttgcttctctgcaggacgacgctttgtgtccatatgtgtgccatctattataccttctgactaagaaggagaacgtcaagcccttcagagtcaggaaattacttgaccttcaggctaagatgggaatgcagccccacctacaagccctcctatcgctctacaagttctttgcccccgccctgatcagcgtgagtctaccagtcagaaagaagatttacttcaagaatagcgagaacttgtggaagactgctctgctggcggtgaagcaaagaaaccgcggacctagccctgaacctttgaagttaatgctgggcccggcaaatgttagacccctcaaacgaaagtggaacagcctgtcagtaatccccgtactgaactccagtagctacactaaggaatgcgggaagaaggaaatgtcgctgagtgattgtctaaaccgcagcggaagctttcccctggaacagttgcagagtttcccccagctgctgcagaatatccattgcctagagctgccaagtcagatgggcagcgtgctaaacaacagccttttattgcactatatcaactgcgtgcgggatgagcccgttcttctgcgcttttattattggctctcccaaacccttcaggaagagtgcatctggtacaaagtgaataattacgagcatggaaaagagtttaccaactttctggataccatcatccgcgctgaatgcttcctgcaggagggtttctattcctgcgaggccttcctgtacaaatccctgcccctgtgggacggactttgttgccgctcacagtttctgcaactggtgtcatggatccccttcagctctttcagtgaggttaagcccttgctctttgaccatctggcacagcttttttttacctcaacgatatactttaaatgtagcgtgctgcaatctcttaaagagttgttgcagaattggctcctctggctctcaatggacatccacatgaagcctgtgacgaactctcctttggaaacaacacttggcgggagcatgaacagcgtctctaaactcatccattacgtgggctggttatcaacgacagccatgcgactggaatccaacaatacttttctgctgcacttcattctggatttctatgagaaggtctgtgatatttatatcaactataacctgccactggtggttctgttcccaccgggcatattctatagcgccttattgagtctcgacacaagtatactcaatcagctctgcttcatcatgcacagatatcgaaaaaatcttacagccgccaagaagaatgaactcgtgcaaaagaccaaaagcgagtttaattttagctcaaaaacataccaggagttcaaccactacctaaccagtatggtgggttgcttatggaccagtaagccattcgggaagggaatttacattgatcccgagatcctcgaaaaaaccggagtggctgagtacaaaaattctctgaacgtggtgcaccacccttctttcctctcctacgcagtttctttcctgctccaggagtctccagaggaacggacggtcaacgtcagctctatccggggcaagaagtggtcttggtacctggactacttgttctctcagggactgcaaggattgaagttgtttattcgatcctccgtgcaccactccagtattcccagggcagaaggtattaactgcaacaatcaatattag

SEQ ID NO: 16501 - DNA, 1941 bp, Artificial Sequence
  Description of Artificial Sequence: Synthetic coding sequence
gcacagggctctgtgagcttcaatgacgttaccgtggactttacccaggaggaatggcagcatctggatcatgcacagaaaaccttgtacatggatgtgatgctggaaaactattgccatctgatctctgtgggatgccatatgactaaacccgacgtcatcctcaaacttgaaaggggggaagaaccgtggaccagcttcgcaggacatacctgcttggaggagaattggaaagctgaagatttccttgttaaatttaaggagcaccaagaaaagtattctagatccgtggtgtcgatcaaccacaaaaaacttgtgaaagagaagtcgaaaatctatgaaaaaacattcacgttgggcaagaatccagttaacagtaagaaccttcctcccgagtacgatacacacggccgaatcctcaagaacgtctccgaactgatcatctctaacctcaacccggcaagaaaacgtctcagtgaatataacgggtacggcaagtcacttctgagtaccaagcaagaaactacccaccctgaagtgaaatcacacaaccagagtgccagagcattttctcacaacgaggttctgatgcagtaccagaagacagaaacccctgctcagagctttggctataatgactgcgaaaagtcctttctgcagagaggaggccttatcactcattcccggccctacaagggcgaaaacccttctgtgtataacaaaaagcgcagggccactaacattgagaagaaacacacatgcaacgagtgcggcaaatcattttgccggaagtcggttctcatactccaccaaggtatccatagtgaggagaagccataccagtgtcaccagtgcgggaacgcatttcgaaggaagagctacctcatcgaccatcagagaacccacaccggggagaagccatttgtgtgtaacgaatgcggcaagtcgtttaggctcaagaccgcattgaccgaccatcaacgcactcatactggagaaaagtcatatgaatgtctgcagtgcagaaacgccttcagactgaagagtcatctcattcgacaccagaggactcacaccggagagaagccatacgagtgcaacgattgtggaaaaagttttcggcagaagaccacactcagcctccaccagaggatacataccggcgagaagccgtacatttgtaaggagtgtggcaaatcctttcaccagaaggccaatctaacagtgcaccagagaacacacactggcgagaagccttacatctgcaatgagtgcggtaagtctttttctcagaagaccacccttgccctgcacgaaaaaacccataacgaggaaaagccctatatttgttctgaatgtggtaaaagcttccggcagaagaccaccctggttgcccatcagagaacccataccggggagaagagctatgaatgtccgcattgtggtaaggctttccggatgaagagttacctcattgaccaccaccggacacacacaggggagaagccctatgaatgtaacgagtgcgggaaatcattcagccagaaaacaaaccttaatctgcatcaaaggatccatacgggtgaaaagccttacgtctgcaatgagtgtggtaaatcctttagacaaaaggccacgctgaccgtacatcagaaaattcacaccggtcagaagtcctacgaatgtccacaatgtggaaaggcgtttagccgcaagtcttatctgatccaccaccagcgaacccacactggtgaaaagccatacaaatgctcggagtgcgggaaatgcttcagacagaaaactaacctgatcgtgcaccaacggacgcatacaggtgaaaaaccttacgtctgtaacgagtgtggcaagtccttcagttataagcggaatttgatcgtgcatcaacggacccacaagggcgagaacattgagatgcagtag

SEQ ID NO: 16502 - DNA, 594 bp, Artificial Sequence
  Description of Artificial Sequence: Synthetic coding sequence
atgggaggccgtaagcgggaaaggaaggccgcagtcgaagaggacacctccctgtctgaatctgaaggaccaaggcaacctgacggggacgaggaggagagtaccgccctgtcaattaacgaagaaatgcagaggatgctgaaccagttacgggagtacgattttgaagatgattgcgactctttgacttgggaggaaactgaggagactctcctcctgtgggaggacttttccgggtatgccatggccgccgccgaggcccaaggggaacaggaagatagcttggagaaggtgattaaagatacagaatctttgttcaaaacacgagaaaaggagtatcaagagacaattgatcagattgagcttgaactcgcgacggctaagaacgacatgaatagacatcttcacgagtatatggaaatgtgttctatgaaacgaggactggatgtacagatggaaacctgccggcggctaatcacgcaatctggtgaccgtaaatcaccagctttcaccgctgtgcctctgagcgatccaccaccacggcaagctcgcctgcggacaccgatagccatgagccatcttactgctccatag

SEQ ID NO: 16503 - DNA, 423 bp, Artificial Sequence
  Description of Artificial Sequence: Synthetic coding sequence
atggccatggcacctagccctagcctggtgcaggtctatacatcacctgcagccgtggccgtgtgggagtggcaggacggattgggcacctggcacccctatagtgccacagtatgcagctttatcgagcagcagttcgttcagcaaaagggccagcggttcggactaggctctttagcgcatagcataccattggggcaggcagatcccagtctcgcaccttatattattgatctgccctcctggacccagttcagacaggacaccgggacaatgagggccgtgcggagacacctctttccccagcatagcgcacctggccgtggcgtggtgtgggagtggctttccgatgatggaagttggactgcctacgaagccagcgtctgcgactatctagagcagcaagttgcaaggggcaattag

SEQ ID NO: 16504 - DNA, 3237 bp, Artificial Sequence
  Description of Artificial Sequence: Synthetic coding sequence
gtctgcatgcatccacacaacgtccttagcgatgtggtcaattacactctatggctgatggaatgttcacatgctagcgggtgttgccacgctacaatgttttttagtatttgctttagcttcagggccgtgctcgagctcttcgaccgatatgacggtctgcggagattagttaatctgatcagtaccctagagatcttgaacctcgaagaccagggagcactcctgagtgacgatgaaattttcgcaagccgacaaacaggtaagcacacttgcatggctctgagaaagtattttgaggctcacctggctatcaagctcgaacaggtgaagcagtctctgcagagaaccgaaggtggtattctggtccacccacagcctccttataaggcctgcagttacactcacgagcagattgtggaaatgatggaattccttatcgagtacggccctgcacaactgtattgggagcccgccgaggtgtttttaaaactttcctgcgtccagctcctcttgcagctgattagcattgcctgcaattggaagacatattacgcaaggaatgataccgtgagatttgccctggatgtactcgccatccttacagtcgtacccaaaattcagctacagttggctgaatccgtggacgtgctggacgaggccgggtcgaccgtctctacggtgggcatatctataattctcggcgtagctgaaggcgagttctttatccacgatgccgagatccagaagagcgccttgcagatcatcattaattgcgtttgtggaccagataacaggatttcatctattggcaagttcatcagcggcacgcccagacggaaactgcctcaaaatccaaagtccagtgaacatactcttgcaaagatgtggaatgtcgtccagagcaataacggaatcaaggtactactcagtctgttgagcattaaaatgccaatcaccgacgccgatcaaattcgcgccctggcatgtaaggccctggttggactctcccgatcttcaactgtgcgacaaattatctctaagctgcctctattctccagttgccagatccagcagctcatgaaggagcctgtgcttcaggacaaaagatcagaccatgtgaagttctgcaagtacgccgctgaactgatagaacgcgtgtccggcaagcctctcctgattggtacagatgtgtccttggcccggctgcagaaagccgatgtggtagcccaatcaagaatttccttcccagaaaaggagcttctacttctaattcgtaatcatctgattagcaaaggcctgggcgagaccgcgacagtcttgactaaagaggccgacctgcccatgactgcagccagccattctagtgctttcacaccagtgaccgcagccgcttcgcccgtgagcctgccccgaactccacgcatagcaaacggcattgctacccgattgggatcccatgctgcagtgggtgcgtccgcgcccagtgctccaaccgcgcaccctcagcccaggcctccacagggcccattggccctgcctgggccttcatatgcggggaactctccacttattggccgaataagcttcattagggagagacctagtccctgcaatgggcgaaagatccgggtccttcgacagaagtcagatcatggggcctattcacaatccccagccataaaaaaacagcttgatcgccacctccctagtccacccacactcgattccattataacggaatatctgagagaacagcacgccaggtgcaagaatcccgtagcgacttgtcctccattctccttatttaccccccatcagtgccccgagccaaagcagagaagacaggccccaatcaatttcactagtcggctgaatagacgcgcttcctttccaaagtatggtggggtggatggcggctgcttcgataggcacctcattttttcgaggtttaggccaatttcagttttccgggaggcaaatgaggacgaatctggcttcacttgctgtgcattctcagcccgggagagatttctgatgctaggtacttgcactggccagctcaagctctacaacgtgtttagcggacaggaagaggcttcctacaattgccacaattccgctatcactcatcttgagccatctagagacggcagtctgctccttacttcagccacttggagtcaaccactctcggcgctgtggggtatgaagagcgtgttcgacatgaagcattcattcacagaagaccactacgtggagttcagcaaacactcccaagatcgagtgatcggaactaagggcgatatcgcacatatctacgatatccagaccgggaataagcttcttactttgttcaaccccgatcttgccaataattataagcgcaattgcgcaacttttaaccctaccgatgatctggttcttaacgacggggtgctgtgggacgttcggagcgcccaagcaattcataaatttgataaattcaatatgaacatatctggcgttttccatcccaatggattggaggtgataattaacacagaaatttgggacctacgtactttccatctgttgcacaccgtacccgctctggatcagtgccgggtggtgtttaaccataccggcacggtgatgtatggggcaatgctccaggccgacgacgaagatgatcttatggaggaacggatgaaatctccttttggaagctctttccgtactttcaatgcaacagattacaagcccatcgcaactattgatgtgaaacgtaatatctttgatttgtgcaccgatactaaggactgctacctggccgttattgaaaatcaaggaagcatggatgccttgaacatggatacggtctgcaggctgtacgaagtgggacgccagcgcctggccgaagatgaagacgaagaagaggaccaggaggaggaagaacaggaagaagaagatgatgacgaggatgacgacgacactgacgatttggatgaattagatactgaccagctcctcgaggcagagcttgaagaggatgataataacgagaacgcaggggaggatggagataacgatttttctccctctgacgaggagctggcaaatctgcttgaagagggggaggacggtgaggatgaagattctgatgctgatgaggaggtggagcttatcctgggtgacaccgatagtagcgacaactctgacctggaggatgacataattctctcactcaatgagtag

SEQ ID NO: 16505 - DNA, 447 bp, Artificial Sequence
  Description of Artificial Sequence: Synthetic coding sequence
atgctcagtgacggctgcggcagcgaagaaaagatctccgtgccctcgtgttacgggggcataggcgccccggtgtctaggcaggtgccagccagtcacgattcagaactgatggccttcatgacaagaaaactgtgggaccttgaacagcaagtcaaagcccagactgatgagatcctgagcaaggatcagaaaattgccgcactggaggacttggtgcaaaccttacgcccccaccctgccgaggcaaccctccagcgacaggaggaactggaaaccatgtgtgtccagcttcagagacaagttagggaaatggagcggttcctttctgattatggcctgcagtgggtgggcgagcctatggaccaggaggatagtgagtcaaagaccgtgtcagagcatggagagagggactggatgaccgcgaaaaagttttggaagccctag

SEQ ID NO: 16506 - DNA, 1755 bp, Artificial Sequence
  Description of Artificial Sequence: Synthetic coding sequence
atgtcgctgccaccagaaaaggccagcgagctgaagcaactgattcaccaacaactgtctaaaatggacgtgcacggtcggattcgcgagatcttggcagagactattcgggaggaattagcgcctgatcagcagcatcttagtaccgaggacctgataaaagcccttaggagacgagggatcatcgacgacgtcatgaaagaattaaacttcgtgacagatagcgtagagcaggagctgccctccagccctaaacagccaatctgctttgaccgtcagtctaccctgaaaaagtccgatggaacacgcatggctgactctaccactatgttatctatctctgaccccatccacatggtgctcatcaaaaccgatatatttggcgagacgactctggtggctagctacttcctggagtggagaagcgtgctgggcagcgaaaacggggtcacctccctaaccgtggagctcatgggtgtaggcacagagtcaaaagtgagtgtgggaatattgaatatcaagctagagatgtaccctccgctgaatcagacattgtcccaggaggtggtgaacacacaacttgcactggagaggcagaagaccgcagagaaggaacggctgttcctggtctatgccaaacagtggtggagagagtacctgcaaattagaccttcccacaatagtaggctggtgaagatcttcgcccaggatgagaatgggattaacagaccggtatgcagctatgtcaagcccctacgcgcgggtagactgctagacacacctagacaggccgcccgcttcgttaatgtcttaggatatgagcgggcccccgtaattggaggaggaggcaagcaggaacagtggtgcaccttgctggctttcttgtgtaggaacaaaggagactgcgaggatcatgccaacctattgtgttcactgctcctggggtatgggttggaagcgttcgtctgcgtcggtacaaaagcgaaaggcgtcccccacgcgtgggtcatgacctgcggaaccgatggtgccatcactttctgggaaagcctaaccggccatcgatatatccataaacctactaacccagatgagccccctgtggcagagcagccaaaaccactgtacccgtaccgcacaatcgggtgcgttttcaaccaccaaatgttcctgggcaactgccagccatccgacgctgttgaaacttgcgtgttcgatctaaacgacgagtctaagtggaaacctatgagcgaagaagcaatcaaaagtgtttgcgctccgggagcgaccacatctctacctccttttcctccgctgtgcgcgtcaaccattgacgctagcgtgacatctaatgaaatcgagatgcagctgaggctcctcgtgagtgagcatcggaaggatctgggtctcacgaccgtgtgggaggaccagctgtcataccttctatccccagctttggcttcatatgagtttgaaaggaccacctcgattagcgctggcaatgaggaatttcaagatgctatcagacgggccgtgccggatggacataccttcaagggcttccccatccacttcgtttacaggaacgcccgtagagctttcgcaacttgcttgcgctctccattttgcgaagagataatctgctgtcggggcgaccaagtgcgactggcagttagagtgagggtcttcacctacccagaatccgcctgtgctgtctggattatgtttgcttgtaagtatagaagtgtgttatag

SEQ ID NO: 16507 - DNA, 4515 bp, Artificial Sequence
  Description of Artificial Sequence: Synthetic coding sequence
atggtgtcagagagcgatttttccaaggacgtggcagtgcaagtgctgcctttagataaaattgaggagaataacaagcagaaagctaatgacattttcatatcacagtacaccatgggtcagaaggatgccctgagaaccgtactgaaacaaaacgtgagtctgtgtctgactgggtggtccgaccattctggcgtcatcactacccactgctcactctatttgcttcgcctgatgagatctagccacttgtcgttgccatccagctgggactatcgggctcagtctatgcccgtgtttaaggaggtaaaagtgcatctgctggaagacgcagggattgaaaaggatgccgttacgcaggagacccgcatcagccccagcggaattgattccgcgaccaccgtggctgctgccaccgccgccgccattgcaactgccgccccgctgatcaaggtccagtcagatcttgaagccaaggttaatagtgtaacggaactgttgtccaagttacaggaaacagacaaacacctccagcgggtaactgagcagcaaaccagtattcagagaaagcaggaaaagttgcattgccacgatcacgagaagcaaatgaacgtgtttatggagcaacacataaggcaccttgagaaactccagcagcagcaaattgatatccagacccacttcataagtgcagccctgaagactagtagcttccagcccgtcagtatgccatcatcaagggccgtggagaagtactctgtgaaaccagagcatcccaatctcggctcatgtaacccatctctgtataatacattcgcttctaaacaggcaccactgaaggaagtggaggacacatccttcgataagcagaagtctccgcttgaaactcccgcaccacgtagattcgcccctgtaccagttagccgagacgacgagttatctaaacgagaaaatctcctggaggagaaggagaacatggaagttagctgtcatagaggaaatgtgcgcttgctcgagcagatactgaataataacgattctctgacccggaaaagtgaaagctcgaacacaacaagtcttactagatccaagattggatggacccctgagaagacaaaccgatttcctagctgtgaagagctggagaccacaaaagtgacgatgcaaaagagcgacgatgtccttcatgacctgggacagaaagagaaggagacgaatagcatggtacaacctaaggagtctctgagtatgctcaagttgcctgatctgccccagaacagcgtgaaactgcaaactaccaacacaacgcgaagcgtccttaaggacgcagagaagattcttcgaggggtccagaacaataagaaggttttggaggaaaatctcgaggccatcatccgtgcaaaggacggagcggcaatgtattctctgattaacgcactgtccaccaaccgtgaaatgtccgaaaagataagaattaggaagaccgtcgatgagtggatcaagaccatcagtgctgaaattcaggatgagctgtcccgcaccgactacgaacagaagagattcgatcagaagaaccagagaaccaaaaaggggcagaacatgactaaagatatccgaaccaacacccaagataagaccgtgaacaagtctgtgataccacggaaacattcccagaaacaaattgaagagcactttcgcaacctacccatgaggggtatgcctgcatcttctctgcagaaagaaaggaaagaaggcctcctaaaagctaccactgtcattcaagatgaggactatatgctccaggtgtatggtaagcctgtgtaccagggacatagatctaccctcaagaaaggcccatacctgcgctttaactcgccttcccctaagtctcggcctcaaaggccgaaggtgatcgagagagtcaaagggaccaaggtcaagtctatacgaactcagaccgacttctatgcgactaagccaaaaaagatggactccaaaatgaagcattcagtgcccgtgttaccccatggcgatcagcaatatctattttcaccctcccgggaaatgccaactttttcgggcacccttgaaggacatctgatccctatggccatccttctgggacaaacccagagcaattccgacaccatgcctcccgctggagtcatagtgagtaagccgcaccccgttactgtgacgacaagcattcctccttcctcgagaaaggtggagacaggagttaagaaacctaatatcgccatagtggagatgaaatctgagaaaaaagaccccccccagctgacagtgcaggtcctgccctctgtagatatcgactccatctcaaattcaagtgccgatgttctttctcccctcagttctccaaaggaagcgtcgctccctccagtccagacctggattaaaactcctgaaatcatgaaggtggacgaagaggaggttaagttcccaggcacaaactttgatgagattatagacgtgatccaggaagaggaaaaatgcgatgaaatccccgacagcgagccaatcctggagtttaatcgcagtgtcaaggcagatagcacaaaatataatggccccccatttccgccagtcgcatctacgtttcagcccaccgccgacatcctcgataaggttattgagcgcaaagaaacactggaaaatagtctgatccaatgggttgagcaagaaataatgagcaggatcattagtggacttttccccgtgcaacagcagatcgcaccttctattagcgtgtctgtttctgagactagtgagccgctgacctctgatattgttgagggcactagctctggagcactgcaactcttcgtggatgcgggggtccccgtgaactctaacgtgatcaaacacttcgtgaatgaagccctagcagaaacaatcgcagtgatgctgggggatcgcgaagctaagaaacagggaccagtagcaacaggcgtcagcggcgacgccagcacaaatgagacctaccttcccgcccgagtgtgtaccccacttccaacacctcagcccacccccccttgcagcccctctagtccggccaaggagtgtgtgttagtaaagacgccagacagcagcccttgtgattcggatcacgacatggctttccccgtgaaggaaatttgtgccgaaaagggcgatgacatgccagctataatgttggtaaatacccccacagttacccccacaaccacccccccaccagccgctgccgtgttcactcccaccctttccgatatctctatagataaactgaaggtgagcagtccggaactgccgaagccatggggcgatggagacctccctttagaagaggaaaaccctaacagcccccaggaagagcttcatccacgggccatagttatgagcgtcgcgaaagatgaggagcctgaatccatggactttccagcccagcctcctcccccggagccagtacccttcatgccatttcccgccgggacgaaggcaccaagcccctcccagatgccgggctccgatagttctacactcgagtccaccctctctgtgacagtgaccgaaaccgaaacactggacaaacctatctcagagggagagattctgtttagctgcggacagaagcttgccccgaaaatcctcgaagatatcggcctgtacctcacaaatctcaacgattcactcagtagcaccctccacgatgccgtggaaatggaagacgatccacctagtgaaggacaggttattaggatgagccacaagaaattccatgccgacgctatcctatcctttgccaaacagaatcaggagagtgccgtcagccagcaggcggtttaccactccgaagatctggaaaatagcgttggagaactctctgagggccagaggccccagctaaccgctgcagctgagaacatcctaatgggtcactccctgtatatgcagcccccggtcacaaacacccagtctctagatcagcaatgcgatccgaagccccttagtcgccaattcgacacagtgtcaggcagcatatacgaagatagttgtgcatctcatggacctatgtcattaggtgagttagagctcgaacccaatagcaagctggttcttcctaccacattgttaaccgctcaggagaacgacgtgaacctaccagtcgctgccgaggatttttcccagtaccagcttaagcagaaccaagatgtgaagcaagtggaacacaaaccgtcccagtcctacctgagagtcagaaacaagagtgatatcgcacccagccagcagcaggtgtcacccggagacatggatcgaacgcagatcgagctgaacccctatctgacttgtgtctttagcggtgggaaggccgtcccactgtcagcttcccagatgccaccggccaagatgtccgtcatgcttcccagcgtgaatctcgaggattgctcccaatctttgagtcttagcacgatgcaagaggatatggaaagtagtggcgccgacaccttctag

SEQ ID NO: 16508 - DNA, 2271 bp, Artificial Sequence
  Description of Artificial Sequence: Synthetic coding sequence
atggtggcaccggtgctggaaacgagccatgtgttctgttgcccgaaccgcgtgcgaggcgtgctgaactggtcttcagggcccaggggactacttgccttcggaacttcctgcagcgtggttctctacgaccccctgaagagagttgtggtcactaaccttaacggccataccgcacgagtgaattgcatccagtggatatgtaagcaggacgggtcgccctccacagagttggtttccggcggctcagacaaccaggttattcactgggaaatagaggataaccagctgctgaaagctgtgcacttacaggggcacgaggggccagtctatgctgtccacgccgtctaccaaagacggactagtgatcccgccctctgcacactcattgtcagtgccgccgcggactccgccgtccgtctctggtctaaaaaagggcccgaaggaagagatttattcctggccagctgttcccaagattgtctaatcagaatttggaagttgtatattaaatctacctcgttggagacccaggatgacgacaatatacgactgaaagaaaatacgttcaccattgagaatgaaagtgtgaagatagcattcgccgtgaccttggaaaccgtcctggccggacacgagaactgggtcaatgccgttcactggcagccagttttctacaaagacggcgtacttcaacagccagtgcgtttgttgtctgcctccatggacaagacaatgatcctatgggccccggacgaagaatccggcgtgtggcttgagcaggtgcgtgtgggagaggtcgggggaaacaccttaggattctatgactgccaatttaacgaagatggctcaatgatcattgcacacgcattccatggggcactgcacctgtggaagcaaaacacggtcaatcctcgggagtggacacctgagattgtgatttctggacatttcgacggcgttcaggatctcgtttgggatcctgagggagagttcatcataacggtgggtactgaccagacgacccgcctgtttgctccgtggaagagaaaagatcagtcccaggtgacatggcatgagatcgctcgtccacagatacatgggtacgacctgaagtgtctggctatgataaacagattccaatttgtgagcggcgcagatgaaaaggttttacgggtgttcagcgctcccaggaacttcgtggagaatttttgcgcaataaccggccagtctctgaatcatgtgctctgcaaccaggactcagacctcccagagggagccacggtacccgcgctggggctgagtaataaggccgtgttccagggtgatattgcatcacagccttcagatgaggaggagctgcttacctcgactggcttcgagtatcagcaggttgccttccagccttccattcttacagaacctcccacggaggatcacctgttacaaaataccctctggcctgaggtgcagaaactatatggtcacggttatgagatcttctgtgtgacatgcaattccagtaagaccttgctggcctccgcatgtaaggcggccaagaaagaacacgctgctatcatcctatggaacacgacctcatggaagcaagtccaaaatcttgtgtttcactctcttaccgtgacccaaatggcgttttcccctaatgagaaatttctactggctgtgtcccgggatcgcacctggtcactctggaagaaacaggacacaatctcgccggaattcgagccggttttcagcctgtttgccttcaccaataagatcacctctgtacactctagaattatctggagctgtgactggagcccagattcaaagtatttctttacaggatcgcgcgacaagaaagtggttgtgtggggcgagtgtgatagcactgacgactgcattgagcataacatcggtccctgctcatcagttttggacgtgggcggcgctgtgacagctgtgtccgtgtgtcccgttctgcacccaagccagcgctacgttgtcgccgttggcttggagtgcgggaagatttgtctgtatacttggaagaagaccgaccaggtgcccgagataaatgactggacccactgcgtcgaaacctcccagagccagagtcatacactcgcaatcagaaaactctgctggaagaattgttcaggaaagacagaacagaaagaggccgaaggcgcggaatggcttcacttcgccagctgtggtgaggaccatacggtgaagatccatagagtgaataaatgcgctctctag

SEQ ID NO: 16509 - DNA, 345 bp, Artificial Sequence
  Description of Artificial Sequence: Synthetic coding sequence
atgcaagagattaaccaaaacctggccgaggaggcaggattaaatatcacacacatttgtctgccccctgacagctccgaagccgagattatcgatgagatcctgaaaattaacgaggataccagggttcatggtctcgctctccagatttcagagaatctgttctccaataaggtgttgaacgccctgaaacccgagaaggacgtagacggggtgactgatatcaatcttggtaagctggtccggggcgacgctcacgagtgtttcgtgtcgcctgttgccaaggccgtgattgagctcctggagaagagcggggtcaatttggatgggaagaaaatcctgtag

SEQ ID NO: 16510 - DNA, 747 bp, Artificial Sequence
  Description of Artificial Sequence: Synthetic coding sequence
atggccactagcgctcctctgcgatctctcgaagaggaggtgacctgctctatatgtcttgactacctccgggacccagtcactattgattgtgggcacgtgttttgtaggtcctgcacgacagatgtgaggccaattagcggttctaggccggtttgtcccttgtgcaaaaagccgttcaaaaaggaaaacatccgccctgtttggcagcttgcctctttggtggaaaatatcgagcgtcttaaggttgataaagggcgccaaccaggtgaggtcacacgagaacagcaggatgcaaagctgtgtgagagacatagggaaaagctccactactactgcgaggacgatggcaagctactctgcgtgatgtgtcgagaatctcgcgagcatcggccacacaccgctgtcctcatggaaaaggcagcccagccacatagggaaaagatcctgaaccatctgagtactctccggcgagatcgcgataagatccagggctttcaggctaaaggagaggcagatatcttagctgccctaaaaaagctgcaggatcagcgacagtatatagttgctgagttcgaacaggggcatcagtttttaagggagcgagaagagcatttgcttgagcagttggctaagctggagcaggagcttactgagggaagagaaaaattcaaatctagaggtgttggcgagctggcccgcttggcgctagttatctcagaattagagggcaaagcccagcagtag

SEQ ID NO: 16511 - DNA, 1461 bp, Artificial Sequence
  Description of Artificial Sequence: Synthetic coding sequence
atgacatgcggatcctattgcggtggtcgcgcattttcctgcataagtgcgtgtggccctaggcctgggcgatgctgtatcactgccgccccttaccggggaatcagctgctaccgcgggctgacaggtgggttcggctcccacagcgtctgcggtggatttagggcaggatcctgcggccgctcattcggatataggtccgggggcgtttgcggcccttcacccccctgcattacaacggtttcagtgaacgagtcattacttacccctctgaacctggaaatcgaccccaatgcacagtgcgtgaagcaggaagagaaggaacagattaaatcgctaaacagtcgttttgccgccttcatcgacaaggtccgctttttagagcagcagaacaagctgctggagacgaaactgcagttttaccaaaaccgcgagtgctgtcagagtaatctcgagccactgtttgagggctacattgaaactttgcgcagagaggctgaatgtgtggaggccgattccgggcggctggcgagtgaattgaaccatgttcaggaagtgttggagggatataagaaaaaatatgaagaagaggtgtctctgcgagccacagcagagaacgaattcgtggcattgaaaaaagatgtggattgcgcgtacctgcgaaagagcgatttggaagctaatgtggaagcactgatccaggagattgatttcttgagacgactgtacgaggaggagatccgtgtactgcagtcacatattagcgatacttcagtcgtggttaaacttgacaactcgcgcgacctaaatatggactgcatcatagcagagatcaaagctcagtacgacgacattgtcacgaggtcccgtgcagaggccgaatcctggtacagatccaagtgtgaagagatgaaggctacagtgatccgtcacggtgaaacgctcaggcggacaaaggaggagattaacgaactgaaccgtatgatccagaggctcaccgcggaggtcgaaaatgcaaagtgccaaaattccaagctcgaagccgccgtggcccaatcggagcagcaaggggaggctgctctgtctgacgcccgctgcaagctggcagaactggaaggtgctctacagaaagccaagcaggacatggcctgtcttattagggagtatcaggaagtgatgaattcaaagctgggattagatatcgaaatcgccacatacagacgcctcctggagggcgaggagcagaggctgtgtgagggagtcggctctgtgaatgtgtgtgtgtcttctagccgaggcggagtggtctgtggagacctctgcgcctctactacagcacctgtagtttccacccgggtgtcatcagtgccaagcaactctaacgttgtggtaggcaccactaatgcatgcgccccctcagcacgcgtcggagtctgcgggggctcatgcaaaaggtgttag

SEQ ID NO: 16512 - DNA, 1710 bp, Artificial Sequence
  Description of Artificial Sequence: Synthetic coding sequence
atggcactgttgtctgaagggctggatgaagttcctgcagcctgcttgtctccttgcggtcctcccaatcctactgagctcttctccgaatccaggcgcctggctctcgaagagctggtggccggcggtccagaggcattcgcagcctttctacgtcgcgaaagattggcacgattcctaaatcccgatgaggtccatgcgatcctgcgcgcagccgagagaccaggagaagagggagccgctgccgctgcggccgcagaagactccttcggtagctctcacgattgctcttccggaacgtactttcctgagcagtcagacctcgagcccccgttgttagagttaggctggccagccttctatcaaggggccggcgagggcggcccgtatggctgcaaggacgcactacgccagcagctccgctcagcacgggaggtgattgcggtggtcatggacgtcttcactgatattgacatctttagggatttgcaagaaatatgccgcaagcagggcgtggctgtgtacatcctcctcgatcaggcgcttctgtctcagttcttggatatgtgtatggacctgaaagtgcatcctgaacaggagaaactcatgaccgtgaggactattaccgggaacatttattacgctcgctcagggaccaagatcatcggcaaggttcacgaaaaattcaccctgatcgatggtattcgcgtggcaaccggatcttactcattcacatggaccgatggcaagcttaattcatccaatctggtcattctgtccggccaggtagttgaacacttcgatctggaatttcgcatcctgtacgctcagtcaaaacccattagtcccaagctccttagccactttcagtcatccaacaaattcgatcacctgacaaatcgaaagcctcagagcaaagaacttaccctgggcaacttgcttcgtatgaggctcgcacgtctgagctccacaccacggaaagctgatctcgatcctgagatgcctgccgagggaaaagcggagcgtaagccacatgactgtgagagcagcaccgtgtcggaggaagattattttagtagccacagggacgagttgcagtccaggaaagcaatcgacgctgcaacacagacagagccaggggaagagatgccagggctgtcggtgagtgaggttggaacccagacatctatcactacagcttgtgccggaacccagactgctgtgatcaccaggatagcttcaagtcagactaccatctggtcacggtcaaccaccacacagaccgacatggacgaaaatatcctatttccgagaggtactcaaagcacagaaggttcgcctgtttccaaaatgtccgtgtctcgcagtagtagccttaagtcttcatccagcgtgtcctctcagggctctgttgcctcttcgaccgggagcccggctagcatccgcacgacagatttccataatcccggttatcctaagtacttgggcaccccccatctagaattatatctgtctgactccctgcggaatttgaacaaagagcgtcaatttcattttgcaggaatccgttcccggctgaaccacatgctggctatgctgtcacgccgaacgctatttaccgaaaatcacctcggactgcactcggggaacttcagcagagtgaacctcttggcagtgcgggatgtggcattgtatccttcctatcagtag

SEQ ID NO: 16513 - DNA, 1224 bp, Artificial Sequence
  Description of Artificial Sequence: Synthetic coding sequence
atggttctgttctctgatagtagccttccccattggcagcagcaaccaccacagcccgcgccaccccctcccttgttccccagacagcaacaggtccaggtgaacaaaggccgagtgaactgtcaccctagatgcaggtatatcaagacgaagccctgccatcagctgtcccatcaagtctgggtgcagcagaagccgtcacacagattgctctcactgcagttgtcccctagcccgaagccttcaccgagtcctcagttgtctctcaagtttcgtctgagcctcaaattccgccccaagcagctgttccatcctatgtccttgctgaagcataatccccctacccacagtcaccctagccctaagctgcagcagtcccaacctcagtctaatgttcagggacagtcacccgtgagagttcagtccccctctcagacacggattcggccatccacaccctcccagctgtccccaggccagcagagtcaggtgcagaccacaacgtcccagccaatcccgatacagccccacacatccctgcaaattccaagtcagggccagcctcaaagccagccccaagtggtaatgaaacataacgctgtgatcgaacatctgaaacagaaaaagagtatgacaccagccgaaagagaggagaatcagagaatgatcgtttgcaaccaggtaatgaagtacattctagacaagatagataaggaagagaaacaggccgcaaaaaaacgtaaaagggaggaatccgtggagcagaaacgatccaagcagaatgctacgaagctgtcagccttgttgttcaaacataaggagcaactaagagcggagattctcaaaaagagggccctgttagataaagacctgcagatagaagtacaggaggaactaaagagggacctgaagatcaagaaggaaaaggacctgatgcagcttgcccaagcaaccgcagtcgccgccccatgcccacctgttaccccggctccgccggccccccccgcccctcccccttcccctccaccgccgcctgccgtgcaacacacagggctcttatccacccctactctgccagctgccagccaaaaaaggaagcgtgaagaagaaaaggatagcagctccaagagcaaaaagaaaaaaatgatcagtacaaccagtaaagaaacaaaaaaagacaccaaactatactgtatatgcaagacaccctatgacgaatcctag

SEQ ID NO: 16514 - DNA, 480 bp, Artificial Sequence
  Description of Artificial Sequence: Synthetic coding sequence
atggccactagtgcaccgctgagaagcttggaggaagaggtcacatgttcaatctgcttggactatctcagggaccctgtcaccatagattgcggccatgtattctgcaggtcctgtacaactgacgtgcggcccatttctggttcaagacctgtctgcccgctatgcaaaaagccatttaaaaaagaaaatattcgacctgtttggcaattggaaaagatccttaaccatctgtcaacgctcagacgtgatagggataaaatccaaggctttcaagccaaaggcgaggctgacattctggccgcacttaagaaactgcaggaccagcggcagtatatcgttgctgaatttgagcagggccaccagttcctgcgtgaacgggaagagcatttgctcgagcagctggcaaagttagagcaggaattgacagagggaagggagaaatttaaaagcagaggcgtgggggaactagcgcgttag

SEQ ID NO: 16515 - DNA, 309 bp, Artificial Sequence
  Description of Artificial Sequence: Synthetic coding sequence
atgaacgaggcagagattgtagatgttgcactagggattctgatagaatccagaaaacaggaaaaggcttgcgaacagcccgccctggcaggagccgacaaccctgagcacagtccaccctgcagcgtctcaccacacactagcagtggctcatcatctgaggaggaagactctggcaagcaagcccttgccccaggactgtcgcccagccaacggccgggggggtctagtagcgcgtgctctagatcccctgaagaggaggaagaggaagatgtgttgaaatatgtgagagagattttcttttcgtag

SEQ ID NO: 16516 - DNA, 345 bp, Artificial Sequence
  Description of Artificial Sequence: Synthetic coding sequence
atgcagttcggcgaactgcttgccgctgtgcggaaggcccaggccaacgttatgcttttcctggaggagaaggaacaggccgccctgtctcaggcaaacggcataaaggcacatctcgaataccggagcgctgaaatggaaaaaagcaaacaagagttagaaactatggcagctatttctaatacagttcagttcctggaaaggtctatgacaagcgaactcaagtgcttgcccctgttcagcgcgaacatcgggcttccaaacctgtcccctgccccagggaatagctctagcaatatgtgtatgacgagcaggtctacaagaacccagcataccagcatctag

SEQ ID NO: 16517 - DNA, 579 bp, Artificial Sequence
  Description of Artificial Sequence: Synthetic coding sequence
atggctcctaagccaggtgcagagtggagcaccgccctctcccatttggtgctgggcgtggtgtcactccatgcggctgtgtcgactgcagaggcatcgaggggggccgcggcgggtttccttctgcaagtactcgccgccactacgaccctggcccccgggttatcaacccatgaggactgcctggccggcgcttgggttgccacagtaattggactgcccctattggctttcgatttccactgggtgaatggggatcgatcatctgcgaatctcttactaggcggtgggatggttctagctgtcgccggcggccatcttggccctgaaggtcgatccgtggcgggtcaggctatgctacttgtggtcgcagtaacaatcctcatagttgctgtcttcacagccaacacctacggtatgtggggaggggccatgctcggagtcgccggactcctgtccagactggaggaggataggctgctgctgctgcctaaagaagatgtttgtcgctgggccctagctgtgggaagctgggcatactgccgagctctgcacacacagcggctccaatgggagtag

SEQ ID NO: 16518 - DNA, 888 bp, Artificial Sequence
  Description of Artificial Sequence: Synthetic coding sequence
atgaaacagtacggactcggcccaaatggaggaatcgttacatccctgaatctgtttgccactcgcttcgatcaggttatgaaattcatcgaaaaggcccaaaacatgtccaaatatgtccttatcgacactcccggccaaatcgaagtgtttacttggtctgcatcaggcaccatcatcacagaggccttggcctcttcctttccaacagtagtgatatacgtcatggataccagtcgaagcaccaaccctgtgacatttatgtccaacatgctgtatgcatgtagcattctctataaaaccaagctgccattcatagtggttatgaataagactgatatcatcgaccactcatttgctgttgaatggatgcaggatttcgaggcttttcaggatgctctgaatcaggaaacaacctacgtctctaacctaactaggagcatgagcctggtgctcgatgagttctactccagcttgcgagtggtgggagtgagtgcggtacttgggactgggctggatgagttgtttgtgcaggtaactagtgcggctgaggaatatgagcgcgagtaccgccccgaatatgaaaggctgaagaagtctctggcaaacgctgagagtcaacaacaacgggagcagctcgaacgcttgcgaaaggacatggggtcagtggcactcgacgccggaacagcaaaggactcactgagcccagtgctgcatccgagtgacctcatcctcacacgagggacgctcgatgaggaagatgaggaggccgactcagataccgacgatatcgaccatcgtgtcacagaagagagtcacgaggaacccgcctttcagaatttcatgcaggagtcgatggctcaatattggaagagaaataacaaatag

SEQ ID NO: 16519 - DNA, 1212 bp, Artificial Sequence
  Description of Artificial Sequence: Synthetic coding sequence
atgccttctgctgaggcaaagctcaagaagaataggtgcgcgaactgttttgattgtcctggatgcatgcataccctttccacacgtgcgacctccatttcgactcagcttccagacgacccagcaaagacgaccatgaagaaggcctactatttggcctgcggattctgcagatggacaagcagggatgtcggtatggcagataaaagcgttgcatcaggtggctggcaggaaccggaaaacccccatacacagcgcatgaacaaactgattgaatattaccagcagctcgcccaaaaagaaaaagtcgagagagatcgcaaaaagctggcccgacggcgcaactacatgccactggccttttccgataaatatggcctgggcactcgactccaacgtcctagggccggtgcctctattagtacgttggcggggctgtctctgaaggagggcgaagatcagaaagaaatcaaaattgaacctgcccaggctgtggatgaagtcgagccgctgcctgaagactattacaccagacctgtaaacttaaccgaggttacaaccttgcagcaaagactcttgcagcccgactttcaaccagtgtgtgcgtcacaactctacccgcgccacaaacatctgctgatcaaacgttccttgcgttgccgaaagtgcgagcacaacctgtccaaaccggagttcaacccgacctcaattaagtttaagatccagctcgtggccgttaattacatccctgaggttcgtattatgtctatacccaacttacgctatatgaaagaatcacaagttttgttgaccctgacaaaccctgtggaaaacttaacccacgtgacactgttcgagtgcgaggaaggcgatcccgacgacattaatagtactgcaaaagtggtcgtccctcctaaggaattggtgctcgccggcaaagatgccgccgccgaatacgacgaacttgccgaacctcaggactttcaagatgaccccgacattatagcattccgcaaggctaataaggtgggtatctttatcaaggtcactcctcagagagaggagggggaggtgaccgtgtgcttcaaaatgaagcacgacttcaagaatctcgcagcccctattagaccgattgaggagagtgatcagggcacagaggtgatctggctgacacagcacgtcgagctgtctctgggtccacttctgccctag

SEQ ID NO: 16520 - DNA, 1674 bp, Artificial Sequence
  Description of Artificial Sequence: Synthetic coding sequence
atggatcagtctcgagtactgctatgggtgaaggcggagccatttatcgtcggggctctccaagtaccccctccatctaaattctcactccactacttgcgcaagatttccacctacgtccagatcagagcaactgagggtgcttaccctagattgtactggtccacttggcgtcacattgcttgtggtaagctgcaactcgcgaaggacctcgcctggttgtattttgagattttcgattcactgtccatgaagacaccagaggaacgtctggagtggagcgaagtgctaagtaactgcatgagcgaggaagaggttgagaagcagcggaatcagcttagtgttgacaccctgcagttcttactgtttttgtacattcagcaactcaacaaagtgagtctccgcaccagtcttatcggcgaggagtggccctctccaagaaataagtcacaatcacctgacctcactgaaaagagcaactgccacaacaagaactggaatgactactctcaccaggctttcgtgtacgatcatctgagcgatctgctggagctcctcctggatcccaaacagctgacggcttctttccactccacacacagttccctggtcagcagagaggctgtcgtggccttatcctttctgattgaaggaaccattagtcgggcccggaagatctaccctctgcacgagctggccttatggcaaccactgcatgccgactctggattctcaaaaatttccaaaactttttcgttctataagctagagacttggctgcgttcctgtctcactggcaacccctttggtaccagtgcctgtctaaagtctggcaagaagttggcatgggcacaccaggtggagggcaccactaaaagggccaagattgcctgtaacacgcacgttgcccccagaatgcacagactggttgtaatgtcccaagtctataaacagacacttgccaagtctagtgacaccctagcaggcgcccacgtaaaaatccacagatgcaacgagtccttcatatatctcctaagtccactgagaagcgttaccatcgaaaaatgcaggaactcaattttcgtcctgggacctgtgggaactacactgcacctgcattcttgtgataatgtcaaagtaatagcagtgtgtcaccgcttgtcaatctcgagtactacagggtgcatttttcacgtgttaaccccaacccgacctctgattctatctggtaatcagaccgtaacattcgcacctttccatactcactaccccatgctggaagaccatatggctaggactggcttagcgacagttcctaactactgggataatcctatggtagtgtgcagggagaactcggacacacgggtgtttcagcttctgcctccttgcgagttttatgtgtttatcatccctttcgagatggagggcgataccactgagatcccgggaggcctgccttcagtataccagaaggctctcggtcaacgagaacagaaaattcagatttggcaaaagacggtgaaggaggcccacctaaccaaagaccagaggaagcaattccaggtattggtggagaataagttttatgaatggctgataaataccggccacagacaacagttggactctcttgtgcctcctgccgctgggtccaagcaggccgccggttag

SEQ ID NO: 16521 - DNA, 462 bp, Artificial Sequence
  Description of Artificial Sequence: Synthetic coding sequence
atggccgaacaggagcagagaaaaatcccactggtgcctgaaaatctattgaagaaaagaaaggcctatcaggccctgaaggcaactcaggctaaacaggcactgctggctaagaaggagcagaaaaagggcaaggggctccgcttcaaacgactcgaaagctttctccacgattcctggcgacagaagagagacaaggtgcgcttgagacgcctcgaggtaaaacctcacgccctggaattgcccgataagcacagccttgctttcgtcgtccggatcgaacgcatcgatggagtctcactgctcgtgcagcgcaccatagccagactaagactgaaaaagattttctctggagtgtttgtgaaggtcacgccccagaacctgaagatgctcaggattgtcgaaccctacgttacgtggggggaggtctggcgacacctgctcggaaggccccacagttag

SEQ ID NO: 16522 - DNA, 2070 bp, Artificial Sequence
  Description of Artificial Sequence: Synthetic coding sequence
atgatagactcggttaaactccggcgggattccgcagctgacttcttttcacattacgaatacctctgtgcgctgcaaaactctgtaccattacccgccgttcgggcatgcctacgagaaggcgtgctcgactttaacgctgacaggctgcggggagttgattgggccccgttactgtctactttgaaaatcaacaaagatctccccctggtctccattaagagtttttttcaaccctggttaggggacacgggaagtgacatgaacaagttctgtcgctctagggtgccggctatcagatataaggacgtgaccttccaactttgcaaagctcttaagggatgcctctccatatcatccgtgctcaaaaatctggagctcaatggacttatactgcgggagcgtgatctgactatccttgctaagggcctgaataaaagtgcttctttggtccaccttagtctagctaactgcccaattggggacggcggcttggagatcatctgtcagggcattaagagctcaataactctaaagaccgttaattttaccggctgcaatttgacctggcaaggagccgaccacatggccaaaatattaaagtaccaaactatgaggcgacacgaggagacatgggccgagtctctgcgctacaggaggcccgacctggattgtatggcgggactaagaagaatcacgttgaattgtaacactctgatcggcgaccttggcgcgtgcgccttcgccgattcacttagtgaagacctatggctcagagcacttgatctccaacagtgcggcctaacaaacgagggggccaaggctctgctcgaggccctggaaactaataccacacttgtcgtcctcgatatccggaagaaccccctgattgatcattccatgatgaaggcagtgatcaaaaaagtgctgcaaaacggaagatccgcaaaaagcgagtatcagtggattacgtcaccctctgtgaaggaacccagcaagacagccaagcagaaacggcgcactattatcctgggctccggacacaagggcaaggcaaccatcagaattggactagcgacgaagaagcccgtctctagcgggcgcaagcactcactaggcaaagaatactacgcccccgctcccctgccgccaggggtatccggattcttgccctggcgcactgcagagcgtgcaaaacggcataggggctttcctctgattaagaccagggacatatgcaaccaactccagcagccaggtttccctgtgactgtaactgtggaaagcccatcctcttccgaggtggaagaagtggacgattccagcgaatcagttcacgaagttccggagaaaaccagtattgagcaggaggctctgcaagaaaagttggaagagtgtctgaaacagctcaaggaggagagagtaataagattgaaggtcgataagagggtgagcgagcttgagcatgaaaacgcacaactacgcaatatcaacttctcactgtctgaggccctgcacgcccagagcctgactaatatgatcctcgacgacgaaggcgtcctaggatccattgaaaacagttttcagaagtttcacgcattcctggacttacttaaggacgctggcctgggccaacttgcaaccatggcaggcatagatcagtctgattttcagctcctgggccatccccagatgacttctacagtgtccaatcctcccaaggaggagaagaaggctctggaggatgaaaagccagagccgaaacaaaatgcactgggtcagatgcagaacatccagttccagaaaattactggagatgctcggattccgctccctctcgacagttttcccgtccccgtgtctacacccgaagggcttggaacatccagcaacaacctaggcgtccctgccacggagcagcgccaggaaagttttgaaggcttcattgcaaggatgtgttcacccagccctgacgcgacctccgggacaggatcccagcgcaaggaggaggaactcagtagaaatagtagatcctctagcgagaagaagacgaaaactgaatctcactag

SEQ ID NO: 16523 - DNA, 915 bp, Artificial Sequence
  Description of Artificial Sequence: Synthetic coding sequence
atgaacttcagcgaagtgttcaagctctcctcactgctgtgtaaattcagccctgacggaaagtatttggctagctgcgtccagtacaggctggtggtgcgggacgtgaacacactgcagattctgcagctgtatacatgtctggatcagatccagcatattgagtggagtgccgactcccttttcattttgtgcgccatgtataaacgaggtctggtgcaggtgtggagtttagagcagccggaatggcattgtaagattgacgaagggtcagctggccttgtagcaagctgctggagtcctgatggccgtcatatcttgaataccacagaattccacctgcggattaccgtgtggtccctctgcaccaaatctgtatcatacatcaagtatcctaaggcatgtctgcagggaattacattcactcgggacggaagatacatggctcttgcggaaaggcgggactgcaaagattacgtttcgattttcgtatgctctgattggcaactcctgaggcactttgacactgatacccaggacctcacaggcatcgagtgggccccaaacggctgcgtgttagcagtctgggacacctgcctcgaagtcagaattctcaaccacgtaacgtggaagatgatcactgagtttggtcatccagccgctatcaatgacccaaagattgtggtgtacaaagaagctgagaagagcccccagctgggcctgggatgtctctcctttccccccccccgggccggggcaggtcccctgccgagttccgagtcgaagtatgagattgcttcagtccccgttagtctacagacactgaagccagtcactgatcgcgcaaatcctaaaataggaatcgggatgctcgctttttcaccagattcttattttctcgcaacccggaattag

SEQ ID NO: 16524 - DNA, 483 bp, Artificial Sequence
  Description of Artificial Sequence: Synthetic coding sequence
atgaaggaggtggggcgtccccgggaagttcggggccgcccagggaagtctcggattcagaaagaactcgcagacatcactttggatcctcctcctaactgctcggctggccccaagggcgacaatatttacgaatggcgaagtacaatactggggccacccggctcagtgtacgaggggggcgtgttctttctggacataaccttcacccccgaataccctttcaagccccctaaagtcacctttaggacaaggatctaccactgcaacataaattctcagggtgtaatttgtctggatatcttaaaggataattggagtcctgccttgacaatttctaaggtgctcctctctatctgctctttattaactgattgtaaccccgccgacccgcttgtggggtcaattgccacacagtacatgaccaatcgagccgagcacgaccgcatggcccgccagtggacaaaaaggtacgccacatag

SEQ ID NO: 16525 - DNA, 516 bp, Artificial Sequence
  Description of Artificial Sequence: Synthetic coding sequence
atgagttcaggaaatgccaagataggccaccctgctccaaactttaaggcaaccgctgtgatgcctgatgggcagttcaaagatatttcgttaagcgattataagggcaaatacgtggtcttcttcttctaccccctagactttacttttgtctgccctacagagattattgcattctctgatcgcgccgaggagttcaaaaagcttaactgtcaggtgatcggcgcttccgtggacagtcacttctgtcacctggcctgggtaaacaccccaaaaaagcagggcggactcggccccatgaacatccccctggtctctgatcctaagagaaccatcgcccaggactacggggtgctcaaggccgacgaggggatatcttttaggggcttgtttataattgacgacaagggcatcttgcgccagatcacagtgaatgatctgccagttggccgatctgtcgatgaaacattgcgtctcgttcaagcctttcagttcaccgataaacatggggaatag

SEQ ID NO: 16526 - DNA, 603 bp, Artificial Sequence
  Description of Artificial Sequence: Synthetic coding sequence
gtgttgattttcgcgtgcctcgtgccgggctttcccgcagtaatgagttcaagggggccctgcactttggagacactaatcaatccctcgcctagtgtggccgatgtgaagatctatcctgaggaaatcactccattgctccccgcaatttccggagaaaagatagccgaagatcagacctgcttttttctgcagatcctcctgaagtacatggtcattcaagctgcgagcctggagtggaagaataaagagaatcaggacacaggcttcaaattcctttttaccctgttcaggaaatattatctacctcacctcttcccttccttcacaaaactgacaaatatctataaacccgtgttagatatcccccatctgcggccgaagcccgtttatataactaccaccagagacaatgagaacatttactcaacaaagatcccgtatatggctgctcgcgtcgtctttattaagtggatagttactttcttcttggaaaagaagtacttaaccgctacccagaacacaaagaacggggttgatgttttgcccaagatcatccaggtgtgtcacccatcgtcattttacctgttgatgctcgtctag

SEQ ID NO: 16527 - DNA, 576 bp, Artificial Sequence
  Description of Artificial Sequence: Synthetic coding sequence
atgagtagcactctcggaaaactgagcaatcaagtggaagagactctcccgctgctgaagaaaccgcttaagagggctattacaacactgatggcaggtatactgcgactagtggtacagtggccaccaggtcggcttcagaccgtgaccaagggcgtggagtctctgatttgtacagattggattcgacataagtttacacgctccagaattccagagaaggtgttccaggcttcccctgaagaccacgagaagtatggaggtgatccccaaaacccacacaagctccatattgttacccgtataaaaagcacccgtcgccgtccttactgggaaaaagatattattaaaatgctgggcttggaaaaggcccacacaccccaggtgcacaaaaatattccaagtgtgaacgctaagttgaaagttgtgaagcacctgattcgcatcaaaccgctcaaactgcctcaaggattgcctgcggaagaaaacatgagtaacacctgccttaagtcaactggggaactggtggtccagtggcatctgaagccggtggagcagaaggcccacgagagttag

SEQ ID NO: 16528 - DNA, 483 bp, Artificial Sequence
  Description of Artificial Sequence: Synthetic coding sequence
atggaggcagagaggccgcaagaggaggaggatggtgaacaggggccacctcaggatgaggagggctggccacctccaaatagcacgactagaccatggcgtagtgctccaccctcaccaccaccaccaggtactaggcatactgccctgggcccccgaagcgccagcctcctctccctgcagacggaacttctgttggatttggtagccgaagcccaaagtagacgtttggaggagcagcgcgctaccttctacacccctcaaaacccgagctcactagcgccagcccctctgcggcctctggaagatcgagaacagctgtacagtacaatcctgagccaccaatgtcagaggatggaagcacagcgatcagaacctcccttaccccctggtggccaggagttgctagagctgctgttgcgggtccaagggggcggcaggatggaggaacaacgcagccgacctccaactcatacatgctag

SEQ ID NO: 16529 - DNA, 321 bp, Artificial Sequence
  Description of Artificial Sequence: Synthetic coding sequence
accttcctcgaacaatctaagactcgtttcaacaagaattataagggcatgtcgctaagtaaaattaccactacggtggggcttaacatagggacagtagacgtggggaaggcaaggctcatgttttgggaccttgggggccaggaagagctgcagtcattatgggataaggacaagacaaagtgtggagatctcgggacgctacactcaagcaaggtgtcagcttcgtttcgcctgcgggatctggcagcagatcaccaccggactcagaaatggcagagaccggacgtaggaactgccggctggctgccgctgccatag

SEQ ID NO: 16530 - DNA, 1524 bp, Artificial Sequence
  Description of Artificial Sequence: Synthetic coding sequence
atggctgagttacaaatgctactggaggaagaaatacctggaggcaggcgcgcgctgtttgattcctataccaatcttgagcgtgtggccgattattgtgaaaacaactatattcagagcgctgacaaacagcgagcactggaggagacgaaggcatacacaacacagtctctcgctagcgtggcctaccttattaacacgttagcgaacaacgtccttcagatgctagatattcaggcctctcaactgaggcggatggagtcctccatcaatcatatttcacagaccgttgatatacataaggagaaggttgctaggcgggagattggaatcctaacaaccaacaagaacacaagtcgaactcacaaaatcattgctcccgctaacctggagcgaccggtgcggtatatccggaaacctatcgattacaccatcctcgacgacatcggccacggggtgaaggtcagtactcagaacatgaagatgggaggcctcccgaggactaccccgccgacccagaaacccccttccccccccatgtccggaaagggtaccctgggaagacatagcccgtacaggactctggaacccgtccggccaccggtggttccaaacgactacgtgccctcgcctacccggaacatggctccctctcagcaatctcctgtacgaacggctagtgtcaaccagcggaatcgtacctactcgtcctctgggagcagtggcggatcgcatccaagctccaggtctagttctagagaaaattctggctctggctctgttggcgtcccaattgccgtcccaaccccatccccaccctcggtgttccccgcaccggctggttctgcgggcactccacccctgccagcgacaagtgcctcagcccccgctcccctggtccctgctactgtcccctcaagcacggctcccgatgcggccgctggcggggcccagacactggccgatggattcacatcacccactcctccggtggtatctagcactcctccgacaggacaccccgtgcagttctactccatgaatagacccgctagtcgacacacacccccaacgatcggagggtcattgccatacagacggcccccctccattacgagccagacatcactgcagaaccagatgaatggagggccattctattcgcaaaatccggtgagcgacacccctccaccaccgcctcctgtggaagagcctgtcttcgacgaaagccctccccccccaccgcctccagaggactatgaagaagaagaggcagcagtggtggagtattcggacccgtacgccgaagaagatccaccgtgggcccccaggtcctacctggagaaggtagtggctatctacgattacacgaaggataaggaagatgagctatcgttccaggaaggtgctatcatttatgtgatcaaaaaaaatgatgacggttggtacgagggggtcatgaatggggttaccggtctcttccctgggaactacgtggaaagcatcatgcactactctgagtag

SEQ ID NO: 16531 - DNA, 303 bp, Artificial Sequence
  Description of Artificial Sequence: Synthetic coding sequence
atggcctctgccggaactcagcactactcgattggtctaagacagaaaaattccttcaaacagagcggaccaagcggcacagtgcccgcaacacccccagagaaaccctccgagggcagggtttggccacaagcccaccaacaggtgaagccgatttggaagctggagaaaaaacaggtagagacgctctctgccggtcttggaccgggtctcctgggcgtgcccccccagccagcctacttcttttgccccagtaccctgtgtagctccggcacaacagccgtgattgcggggcattcctag

SEQ ID NO: 16532 - DNA, 1212 bp, Artificial Sequence
  Description of Artificial Sequence: Synthetic coding sequence
atggcatccgcgctccggcctcctcgcgtgcccaaaccaaagggggtgctgccaagtcactactacgaaagttttcttgagaagaaggggccctgcgatcgcgattacaagaagttttgggccgggctgcagggtcttactatttacttttacaactccaaccgcgatttccagcatgttgagaaactgaaccttggagcctttgagaaacttacggatgagataccctggggaagttcccgggacccagggacccacttcagcttaatactacgggatcaggaaattaagttcaaggtcgaaaccctcgaatgtagagagatgtggaaagggtttattcttactgtggtggagctgcgggtgccaacagacctcactttgctgcctggccacctgtatatgatgagtgaggttttagctaaagaggaagcccggagggcactggaaactcccagttgttttctcaaggtttctcggctggaggcccagctgttacttgaacggtatccagagtgcggcaatctcctgctgaggccgtccggagatggagctgacggagtctctgtgacaacacggcaaatgcacaatgggacacatgtggtcagacactacaaagtgaagagagaaggcccaaagtacgtaattgacgtcgagcagcccttttcctgcacttctctcgatgccgtggtgaattattttgtgtcccatacaaagaaagcgctggtgccatttttactggacgaagactacgaaaaggttttgggctatgtggaagcagacaaggagaatggggagaatgtgtgggtggccccgagcgccccgggcccaggaccagccccatgtacaggcgggcctaaacctctttcgcctgcctccagtcaggataaactgccccccttgcctccccttccgaatcaggaagaaaattacgttacaccaatcggcgatggtcccgccgttgactatgagaaccaggatgtcgcatcctcgtcctggcctgtcattctcaaacctaagaagctcccgaaacccccagctaagctgcccaaaccacccgtgggaccgaaaccggagccaaaggtgtttaatggcggcctaggaaggaaactgcccgtgagcagcgctcagcccctcttcccaaccgcaggcctcgccgacatgactgccgaactgcagaagaaactggagaaaaggagagctcttgaacattag

SEQ ID NO: 16533 - DNA, 1551 bp, Artificial Sequence
  Description of Artificial Sequence: Synthetic coding sequence
atgttgcgccgggggtctcaagccctaagacggtttagcaccggaagagtctactttaagaataaactgaagctggccctcatcgggcagagtctcttcgggcaggaagtctattcacatcttcgtaaggaaggccacagagtggtgggcgtttttaccgtgccagacaaagatggaaaggccgacccgttggcgctagccgctgagaaggacggcacaccagtgttcaaactgcctaaatggcgtgtcaagggtaaaactatcaaagaggtggctgaagcctaccgaagcgtcggagctgagttgaacgtgcttcccttttgcactcagttcattccaatggatatcatcgactctcctaaacacggctcaattatttatcacccatccatattgcccagacaccggggtgctagcgcaattaactggacactgatcatgggtgacaagaaggccggattttccgttttttgggccgatgacggccttgacactgggccaatcctgctgcaaaggtcctgcgatgtggaaccaaatgatacggttgacgctctctataatcggttcctgtttcccgaagggataaaggcaatggtggaggccgtgcagcttatcgctgacggcaaagctcctcgaattcctcagccggaagagggggccacctatgaggggatacaaaagaaagaaaatgctgagattagttgggatcagagcgcagaggtactgcacaattggattcggggccacgataaggtgcctggagcctggacagagattaacgggcaaatggttactttctacgggtcaacactgctcaattctagtgttccaccaggcgagccccttgagataaagggtgctaaaaagccaggacttgtcacaaagaatggactcgtgctgttcggcaatgacggcaaggccttaacggtaaggaacttgcaatttgaagacggtaagatgataccagctagccagtacttctctactggggagactagcgtggtggagctcaccgctgaagaggtgaaggtggccgaaacaatcaaggtcatctgggcaggcatcctttctaatgtgccaattatagaagacagtaccgacttcttcaaatctggcgccagctccatggacgtggcacgtctggttgaggagattaggcagaagtgcgggggccttcaactgcagaacgaggatgtttacatggcaacgaaatttgagggtttcattcagaaggttgtgcgtaagctgcgtggcgaggatcaggaagtggaactggtggtggactatattagtaaagaggtgaatgagataatggtaaaaatgccatatcagtgttttattaatggacagtttaccgacgccgacgacggcaagacctatgatactatcaatcctaccgatggctctacaatctgcaaagtgtcatatgccagcctggctgacgtggataaggccgtggccgcagccaaagatgccttcgagaacggcgagtggggcaggatgaacgcacgtgaacgagggaggctgatgtatagcatgcgtatgaattag

SEQ ID NO: 16534 - DNA, 1581 bp, Artificial Sequence
  Description of Artificial Sequence: Synthetic coding sequence
atggaagaaatacctgcccaggaggctgctggcagccctagagtacagttccagtccttggagacacaatcagagtgccttagtccagagccacaattcgtgcaagacacggatatggagcagggactgacagggggattcccaatctccaagcctgatggcatatctcaactggaacaggaccttcaggtattcgacctagaaacgaaaacccgcgaagtgttaagagacgattgtagcgatggcgagactagagaagaaaacaagctactgatacccaaacagaagataagcgaggaggtgcatagttataaagtcagggtcggccggctgaagcacgacatcacacaggtgccagaaacacgcgaggtctataagtcggaagatagactcgaacggttgcaggagattctaaggaagtttctgtatctcgaacgcgagttccgacaaattaccattagtaaagaaaccttcacatctgaaaaaaataacgagtgccatgagcctgagaagtccttctctcttgacagcaccatcgatgcagaccagcgagtgctgcgcatccaaaatacagatgacaatgataagtatgatatgtctttcaaccagaactccgcttcaggtaagcatgagcacctgaacctcaccgaggattttcagtcttccgagtgcaaagaaagcctgatggatctgagtcacctgaataagtgggagagtatcccgaacaccgaaaagtcctacaagtgcgatgtgtgcggaaagattttccatcagtcctccgccttaactcgccaccagcgaattcatacaagagaaaaaccttacaagtgtaaggaatgcgaaaagagcttctcccaatcttcgagcctaagcaggcacaagcgcatacacaccagggaaaagccttataaatgtgaggcatctgataagtcttgcgaagctagcgataagagctgctccccttcctccggcataatacagcacaaaaaaatacacacacgagccaaatcctataagtgttcaagttgtgaacgagtgttttctagaagtgtccatctgactcaacaccaaaaaatccataaagaaatgccttgcaaatgcacagtgtgcgggagtgacttctgtcacactagttacttgctggaacatcagcgggttcaccatgaggagaaagcatatgagtacgacgaatacggcctagcatatataaagcaacagggtattcacttcagggagaagccatacacatgcagcgagtgcggcaaggattttcgtctgaattcacacctgatacagcatcaaagaatccacaccggcgagaaagctcatgaatgcaatgagtgcggcaaagcattttctcaaactagctgcctgatacagcatcacaagatgcacagaaaagagaaaagctatgagtgtaacgaatacgagggttccttttcacatagcagtgacctgatacttcagcaggaggtcctgacgaggcagaaggccttcgattgcgacgtctgggaaaaaaatagcagccagagggcacaccttgtgcagcatcagtccattcacaccaaagaaaactcatag

SEQ ID NO: 16535 - DNA, 603 bp, Artificial Sequence
  Description of Artificial Sequence: Synthetic coding sequence
gtgctgatttttgcttgcttggtcccaggtttccccgccgtgatgagctccaggggaccctgtacattggaaactctgattaacccatcccccagcgtcgcagatgtgaaaatctacccagaagaaataactccactgctgcctgctatcagtggagagaagattgcagaggatcagacctgcttttttctgcaaatcctgttgaagtatatggtgatccaggcggcaagcctagagtggaaaaacaaggaaaaccaggacacaggtttcaagttcctcttcaccctcttcagaaagtactatcttccgcacctttttccgagctttaccaaactgacaaatatctacaagcccgtccttgatattcctcatctccggccaaagcccgtctatatcaccaccacccgcgacaatgaaaatatatacagtaccaagatcccttacatggccgcccgagtggtcttcattaaatggatagtaaccttcttccttgaaaagaaatacctgacagccacccagaataccaagaatggagtcgacgtcctccctaagatcatccaagtttgccacccttccagcttttacctgctcatgctcgtttag

SEQ ID NO: 16536 - DNA, 540 bp, Artificial Sequence
  Description of Artificial Sequence: Synthetic coding sequence
aacatcaagccaggagaggggctgggaatgtacatcaaatccacctatgatggattgcacgtgatcaccggcaccactgagaatgtcgggtggcagctgaagaacctcgttaagaaactccgcgagaatcccacaggggtggtactcttgttgaaaaaaagaccgacaggcagtttcaacttcactcccgccccactgaaaaatctgcggtggaagccccctctggtacagacgtctcccccccccgctaccactcagagccctgagagcactatggataccagtcttaagaaggaaaaatccgccattcttgatctttatattccaccaccacccgccgtcccttattctcctagggacgagaatggatctttcgtgtatggaggctcctctaaatgcaagcaacctctcccaggcccaaaaggcagcgaatccccaaatagcttcctggatcaggagagtaggagaaggcgattcaccatcgcagactccgaccaacttcctggatactcagttgagacaaatatactccctacctag

SEQ ID NO: 16537 - DNA, 1368 bp, Artificial Sequence
  Description of Artificial Sequence: Synthetic coding sequence
atgatgggtgcaccaaacctcattgctgacagcatggagtacggcctgtcttattcagtgatctcctacttaaagaagctcagtcagcaggcaaagatagaaagcgaccgggtgatagggagtgttggaaagaaggtcgtgcaagagacaggaatcaaagtgcgcagtagaagccacggactgagtatggcttaccgcaaagactttcaacagctgctgcaggggatttcagaagacgtcccccatagattactagacttgaatatgaaagagtatacagggttccaagttgcccttcttaacaaggatcttaagccccagacttttcgcaacgcgtacgatataccgcggcgcaatctgttggaccacttgaccaggatgaggtccaacttgttaaaatccactcgccggttcttgaagggccaagatgaggaccaggtgcactctgtcccaattgcacaaatgggcaattaccaggaatatttgaaacaagtaccgagtccactccgggaactggatccagatcagccgcggcgtctgcacacatttggcaacccttttaagctcgataagaaggggatgatgattgacgaggctgacgagttcgtagccggaccgcagaacaaacataaaaggcccggtgagccaaatatgcagggaatcccaaagcgaaggcgttgcatgtctcctctattgcggggaagacaacagaatccggtggtcaacaaccacattggcggaaagggacctcccgccccgaccactcaagcacagccagatctgatcaaacctttgccgctgcataagatctcagagaccacaaacgatagtatcatacacgatgtggtggagaatcatgtagctgatcaactgagcagtgatatcactccaaatgctatggataccgagttctctgcctcaagccctgcgtccctgctggagcgtcctaccaatcatatggaggccctggggcacgaccatcttggaacgaatgaccttacagtgggcggatttttggagaatcacgaagaaccacgggataaggaacagtgtgctgaagaaaatatccctgctagttcgctgaataagggaaaaaagttgatgcattgtaggtcacacgaagaggtgaatactgagctgaaagcccagattatgaaggaaatcagaaagcccggtaggaagtatgaaagaatattcaccctcctgaagcacgtgcaagggtctctgcagactaggctaatatttcttcagaacgtcatcaaggaggcaagcagattcaaaaaaaggatgttgatcgagcagctggaaaacttcctggacgaaatacatcgcagagccaaccagattaatcatatcaactcaaattag

SEQ ID NO: 16538 - DNA, 1467 bp, Artificial Sequence
  Description of Artificial Sequence: Synthetic coding sequence
ctagattgcggacctcggctgcctgtggaggtcggcccatcactttcctcaccatccagcggatgtggcgagggttccatttcagtaggagagaatgtctccgacgtagctcctacccaaccatggtggcctaacacccctggagatagcgtgagcgaggaactaggcccgggacggagcggggatacggaggatctgagcccgaactggccactcaatagccaggaggacacagctgcccagtcatctcccggtcgcggggaggaggccgaggcgtcagcagctgaagctcagggtggagaacaggcatacttggctggactagccgggcaataccatttagaacgttatcctgattcttatgagtctatgtcagagcctccaattgcacacctgctgaggccggttttgcctcgggcattcgcctttcctgtagacccacaggtgcaatccgcagctgacgaaactgccgttcagctctctgagttacttaccttgccagtcctcatgaaaagatccatcacagcacccctagccgcccatataagccttgtcaacaaggcggcagtggattatttcttcgtcgagctgcacctagaggcccactacgaagcacttcgacatttcctccttatggaggatggtgagtttgcccaatccttgtccgacctgttgtttgaaaagttaggggccggacaaaccccaggcgagttactaaatcccctcgtgctgaacagtgttctctctaaggccctgcagtgttccttacacggggatacaccacacgcctctaacctgagcttggcgctaaaataccttcctgaagtcttcgctcccaatgcacccgacgttctgagctgtctggaactgcgctataaggtcgattggccgttgaatatcgttatcactgagggctgcgtgtccaaatacagtggcgtgttttcgtttcttttgcagcttaagctgatgatgtgggcattgaaggatgtgtgcttccatttgaagcgcaccgtcccttctgccgcagccgtgcaggcccgagatgccgcattcagagaggggcatcctggcctccacaggcagccagacccagccaggcaccttgtcagggttcaaggacaggtgggacaccgtgggcggcccggcggggacccggcctgcgccaggcgcgtgccagcccaaggtcggctgcaagccgctccagtgatgaacgtgatacacagcatcttttctctggtgcttaaattcaggagccagctcatcagtcaggcgtggggccctcctggcggtccaaggggcgcggagcacccgaattttgcattgatgcagcagtcatataatacttttaagtattactcacactttcttttcaaggtcgtcactaaactagtgaacagagggtatcagccccacctggaagattttctgttgcgaattaatttcaataactactaccaagacgcatag

SEQ ID NO: 16539 - DNA, 3819 bp, Artificial Sequence
  Description of Artificial Sequence: Synthetic coding sequence
atggccaacgattctcctgcaaagagcctcgttgatattgacctgagttcgctgagggatcccgccggaatcttcgagctcgtggaagtggtgggcaacggaacttacggacaagtctataaggggcgccatgtgaagaccggccagctggccgctattaaggtgatggacgtgaccgaggatgaagaagaagagattaaactggagattaacatgctgaaaaaatactcgcatcaccggaacattgctacctattacggggctttcattaagaagtcccctcccggacacgacgaccagctgtggttagttatggagttttgtggggcaggctctatcaccgaccttgtaaaaaatacgaagggcaacaccctgaaggaagattggatagcttacatttctcgcgaaatattgagaggactcgcgcatctgcacatccaccatgtgatacaccgtgatatcaaaggtcagaacgtgctgctgactgagaacgcagaggtcaaattagtcgatttcggagtctccgctcagctcgaccggactgtgggcaggaggaatactttcatcgggaccccatattggatggcaccagaagtcatagcctgcgacgaaaacccagatgccacctatgactatcgctctgatttgtggtcttgcggcataactgctatcgagatggctgagggcgcgccgcccctatgtgatatgcatccaatgcgcgccctttttctcattccacgtaaccctccgccgaggttgaagagcaagaagtggagtaaaaagttcttctcttttattgagggatgcctcgttaagaattacatgcagaggccttctactgagcagctcctgaaacacccttttatcagagatcagcctaatgagcggcaggtcaggatacagctgaaggaccatatagaccggactcggaaaaaacgcggggagaaggacgaaaccgagtatgagtattcaggctccgaggaggaggaagaagaggtccctgagcaggagggggagccatcgtcaattgtgaatgttcccggcgaaagcacacttcgtcgggatttcctccggttgcagcaggagaataaggagcggagtgaggctctgagacggcaacagcttctacaggagcaacaactgcgcgagcaggaggaatacaagcgtcagcttctcgctgagaggcagaaaagaatcgaacagcagaaggagcagaggagaaggctcgaagagcagcagcgacgggagcgagaagccagaagacagcaagagagggaacagcgacggcgggagcaggaggagaagcggaggctggaagaactcgagcggcggcgcaaggaagaagaagaaagacgcagggctgaagaggaaaaaagacgggttgagcgggagcaggagtacatcaggaggcagctcgaggaggaacagcgccatttagaggtgctgcagcaacagcttttgcaggaacaagccatgctactgcacgatcacaggagaccacaccctcaacattctcagcagccgcccccaccccagcaagagcgcagcaagccctccttccatgccccagagccaaaggctcactatgagcccgccgatcgggcccgcgaggtagaggacaggttccggaaaacaaatcatagctcccccgaagcccaatccaagcagacaggtagggtcctggaacccccggtgccatcgcgcagcgagagcttttccaacggcaactctgaatctgtgcaccccgccctgcaaagaccggcagagccacaggtaccagttcgaaccacaagtcggagccctgtcctgagtcgcagggacagtcctctccagggaagcgggcagcagaactctcaggccggccagagaaattctacatctattgagcccagactgttgtgggagagggtggaaaagctcgtccctcggccaggatctggaagcagctcaggaagttccaactctggctcacagcccggcagtcaccccggcagtcaatcgggctctggcgaacgatttcgggtgcgcagcagtagcaaaagtgagggaagcccctctcagaggctggaaaacgcggtcaagaaaccagaagataaaaaagaagttttcaggccactgaagcccgccgacctcaccgccctcgccaaggagctccgggcagtggaggatgtgcggccccctcacaaagtgacagattacagctccagcagcgaggaaagtggaaccaccgatgaggaggatgacgatgtggagcaggaaggcgctgacgagtcaacgtccggacctgaggatactagagcagccagctcactgaacctgtccaacggggaaacagaatccgtgaaaactatgatcgtgcatgacgatgtggaaagtgagccagctatgactcccagtaaagaggggactttgattgtcaggcagtctacagtggatcagaaacgggccagtcaccatgagtcgaacgggtttgcaggcaggatccatctgcttcccgatttgttgcagcagtcccattcttcatcaacgtccagcactagttcctctccaagttcatcacagcccaccccaacaatgagccctcagactccacaagacaagctgacagcgaacgagacacagtccgcctcctctactctccagaaacacaagtcctcctccagttttactccgtttattgatccaagactgctgcagatcagcccgtcctccgggacaactgtcacctccgtcgttgggttctcttgcgatggcatgaggcctgaagcgattcggcaggacccaacacggaaaggttcggtcgtgaatgtgaaccccaccaacacccgtccccagagtgatacccctgagattcggaagtacaagaagcgcttcaattcggagatcctgtgcgctgctttgtggggtgtgaatctgttggtggggactgagtccggtctgatgctcctggacagatccggccaaggcaaggtgtaccccctgatcaacagacgcaggtttcagcagatggatgtgctggaggggttgaacgtgctcgtgacaatctcgggaaagaaggacaagctgcgcgtatactatctatcctggctgaggaataagatcctgcacaacgatccagaagtggaaaagaagcagggctggacgacggtaggggacctggaaggctgcgtgcactataaggtggtcaagtacgagcgtattaagttccttgtaatcgcacttaagagcagcgtcgaggtttatgcctgggccccgaagccataccataagttcatggcgttcaaatcattcggtgagctggtacacaaaccacttctggtggacctaacagtggaggagggccagaggctcaaagtcatctacggatcgtgtgctggctttcacgccgtggacgtcgacagcgggagtgtgtacgacatctacttgcctacacacatccagtgctccataaagcctcatgctattattatactgcccaacaccgatggaatggagctgttggtgtgttatgaagatgaaggtgtgtatgttaatacttatggaagaattaccaaggacgttgttctgcaatggggggaaatgccaacgagcgtcgcttatattagaagcaatcagaccatgggatggggcgaaaaggccattgaaatccgaagtgtggaaacagggcacctcgacggcgtgtttatgcacaagagggcacagaggcttaaatttctgtgcgagcgtaacgacaaagtgtttttcgcctcagtgcgaagtggcgggtccagccaggtgtacttcatgactctcgggcggacgtccctgttgagttggtag

SEQ ID NO: 16540 - DNA, 363 bp, Artificial Sequence
  Description of Artificial Sequence: Synthetic coding sequence
gcacttcagatatcagagaatttattctctaataaggtactaaatgctctcaagcctgaaaaagacgtggacggggtaactgacatcaacctgggcaagctggtgcgaggcgatgcccacgaatgtttcgtttctccagtggcgaaagccgtgattgagctcttggaaaaatctgtcggggttaatctagacggcaagaagattctagtagttggggcgcatggaagtttagaggcagccctgcagtgcctctttcagagaaaagggtctatgactatgtcaatccagtggaagaccaggcagctccagagcaaaacagagtccaggagtgtgactcgcctggaatgccgacgtgtcatttag

SEQ ID NO: 16541 - DNA, 1866 bp, Artificial Sequence
  Description of Artificial Sequence: Synthetic coding sequence
atggtaagcattctgtcatctttcgagtccaggttaatgaaactagagaacagtataataccagtgcataagcagaccgaaaatctgcagcgcctccaagaaaatgtggaaaaaacactctcttgcctggaccatgtcatctcctattaccatgtcgcctccgatacagagaaaattataagagagggacctactggccgtcttgaagagtatcttgggtctatggccaagattcaaaaagctgtcgagtacttccaggacaactcaccagacagtcccgagctcaacaaagtcaaactgttgttcgagagagggaaagaggctctggagagcgaatttcgctcactcatgacaaggcactccaaggtcgtgagtcctgttctgatcttggatttaatatccggcgacgatgatctggaggctcaggaagacgttacgcttgagcacctgcccgaatcagtgctccaggatgttatcaggatctctaggtggctggtcgagtatggtaggaatcaagactttatgaatgtgtactatcaaatcagaagctctcagttggatagatcaattaaaggcctgaaagagcattttcacaaaagctcttcctcatctggggttccatatagccccgcaatacccaataagcgtaaagacactccgaccaaaaagcctgtgaagcggccaggcacgataagaaaggctcagaacttgcttaagcagtatagccaacacggacttgatggaaaaaaggggggtagtaacctgattccgctcgagggccgagacgatatgctagatgttgaaacagatgcatatatccactgtgtgtcggcttttgtgaagttggcacaatcagagtaccaactccttgccgatattattccagaacatcatcagaaaaaaacctttgatagcctaatacaggacgcactagacgggctcatgcttgaaggggagaatatcgtatctgccgccaggaaagctatcgtgcgacatgacttctcaacggtcctgacggtcttccctatactgagacacctgaagcagacaaagcccgaattcgaccaggttctacagggtacagccgcctctaccaagaacaaactccccggccttatcacatccatggagactatcggagctaaggcgcttgaagatttcgcagacaatatcaagaatgatcccgacaaggagtacaatatgccaaaagatggtacggtgcacgaactaacttcaaatgccattctcttcttgcagcagctgcttgactttcaggagacggcgggagcaatgctcgcatcgcaggggaaggtcctgggaaacttgcagctcaatcttctgtctaagagcaaggtttatgaggaccctgccttatcagccatatttcttcataataattataactatatcctgaaaagcttagaaaagagcgagctcatccaactggtcgccgtaacacagaagactgcagagagatcttaccgtgagcacatcgagcagcaaattcagacgtaccagcggtcttggctcaaggttacagactatatcgccgagaaaaacctccctgtgtttcaaccaggagttaaactgcgagacaaagagagacagatcattaaggagagattcaagggcttcaacgatggtctcgaagagctgtgtaaaattcaaaaagcttgggccatacctgatacagagcagcgagacagaattaggcaggctcagaaaaccattgtgaaggaaacatatggagcgttcctgcaaaagttcggctcggtacctttcaccaagaaccctgagaaatacatcaaatacggtgtcgagcaggtcggagacatgattgataggctattcgatacgtcagcctag

SEQ ID NO: 16542 - DNA, 1344 bp, Artificial Sequence
  Description of Artificial Sequence: Synthetic coding sequence
atggattttttattagggaatcctttcagctcccctgtggggcaacggatagagaaagcaaccgacggcagtctacaaagtgaggattgggcgctgaatatggagatctgtgatatcatcaatgaaaccgaagagggaccgaaagatgcgttacgagccgtgaaaaaacgcatagttgggaacaagaactttcacgaggtgatgttggcgctcacagtactggaaacttgtgtaaagaattgtgggcacaggttccacgtgcttgtcgcttcccaggattttgtcgaatccgtcctggtgcgaactattctccccaagaataatcccccaacaatcgtacacgacaaagtcctgaatctgattcagacagtgtttaactcagagacccagagcggtcaagattctgtcggaacggactcgtcccagcaggaggactccgggcaacacgccgccccccttcctgcgcctcccatactgtccggagatacacccattgctccaactccggaacaaattgggaaattaaggagcgaactggaaatggtgtccggaaacgtccgggtgatgtccgagatgctgactgagcttgtgccaacccaggccgagcctgccgatctagaactcctgcaggaactgaatagaacctgccgtgcaatgcagcagcgcgtattggagctgattccacaaatcgctaacgagcaactgaccgaggaacttttgattgtgaatgacaatctcaacaatgtgttccttcggcatgaacgctttgagcggttcagaaccggacagaccacgaaagcgccatctgaagccgaacccgctgcggacctcatagacatggggcccgatccagcagctaccggtaacttatcttcccaattggccggcatgaatcttggctccagctcagttcgcgccggcctccaatcactggaagcttctgggcggctggaggacgagtttgacatgtttgcccttacaagaggctcctctctggcagaccaacggaaggaagttaagtacgaagctcctcaggccacagacggcctcgccggtgccctggacgccaggcagcagagtacgggggctattcctgtgacccaggcgtgtctcatggaagacatcgaacagtggttgtccactgacgttggaaacgatgctgaggaaccgaaaggggtgacaagcgaggaatttgacaagtttcttgaggagagagcaaaagccgccgaccgacttcccaacctgtccagtccttccgccgagggtcctccaggacccccttctggccctgcgcctagaaagaaaacccaggaaaaggacgatgacatgctgttcgctctctag

SEQ ID NO: 16543 - DNA, 2103 bp, Artificial Sequence
  Description of Artificial Sequence: Synthetic coding sequence
atggcaacaatgataccacccgttaagctgaaatggctggaacatctaaactctagttggatcaccgaagactcggaatcaattgccaccagagagggcgtagctgtgctgtattctaagttggtaagcaataaggaggtcgttccgttgccccagcaggtcctgtgcctgaagggccctcaactgccggacttcgaaagagaatccctgtcctcagatgaacaagatcattaccttgacgctttactttcgtctcagctcgctctggcgaaaatggtgtgttctgattcacctttcgctggggcactccggaagagactattggttctccagcgagtgttctacgctctatctaacaagtatcatgataaaggaaaggtaaagcagcagcagcatagtcccgaatcgtcatctggcagtgcagatgtgcacagtgtctccgagcggccccgatccagtacggacgctctgatcgaaatgggagtaaggactggcctatccctattattcgcgctcctcagacagtcatggatgatgcccgtgtccggacccggactctccttgtgcaacgacgtgattcacacagccatagaggtagtgagttcgctgccacccctgtccctggctaatgaatcgaaaattccgcctatggggctggattgtctgtcacaggtgaccactttcctcaagggagttacaatccctaactcaggggcagataccttaggtcggcggctcgccagcgagctgctactggggttggccgcccaacgcggatcactccgctatcttctggaatggattgagatggccctgggagcctcggccgttgtccacaccatggaaaaaggcaagcttctttcatcacaagagggtatgatttcttttgactgttttatgaccatcctgatgcagatgcggcgatccctgatcagcgaaaatcaggacagcgccgacgtcgatccccaggaacactcattcacacgcactatcgacgaagaggcggaaatggaggagcaggctgagcgtgacagggaggagggacacccagaacccgaagacgaggaagaggagagagagcacgaagtaatgaccgctggcaaaatctttcagtgcttcttgtccgcccgagaagtcgccagatcacgagaccgcgatcggatgaattctggggctggaagtggcgccagggcagatgaccctcccccacagagtcagcaggaaaggagagtctccacagatttgcctgaaggccaggacgtgtacactgcagcctgtaacagtgtgatacatcggtgcgctctgctaattttaggtgtgagccccgtgattgatgaactccagaagaggcgcgaggagggtcagctacagcagccatccaccagtgcctcagaaggcggaggccttatgacccgttcggaatcactaaccgctgagagcagactggtacatacctcaccgaactataggctcattaagagcaggtctgaatcggacctgagccagcccgagagcgacgaagaggggtacgccttgtctggacgccgcaatgtggatttggatttggctgcttcccataggaagagaggccccatgcacagtcagcttgagagcctgagcgattcatgggcgcggctgaagcactcccgtgactggctttgtaatagtagctatagtttcgagagtgacttcgacctgaccaagagtctcggcgtgcatactctaatcgaaaatgtggtgagctttgtgagcggggacgtaggcaatgccccagggtttaaagagcccgaggaatcgatgtccacgtcaccccaagccagtatcatcgcgatggagcagcaacagctgcgcgccgaattgagactagaggctctccatcagattttggtcctcttgagtggaatggaagaaaaaggcagcataagcctagccggcagcaggctaagctctggctttcaaagttcaacactcctgacttcagtcagactacagtttcttgcgggttgtttcggcctgggcacagtgggccacacaggaggaaagggtgagtccggcaggcttcatcattaccaggacgggattcgcgccgcaagagggtattag

SEQ ID NO: 16544 - DNA, 537 bp, Artificial Sequence
  Description of Artificial Sequence: Synthetic coding sequence
atggcggatcgggccgccgcggaacgcgcgtgcaaagatcccaatccgataatcgacgggaggaaagcgaatgtgaacctggcttacttgggtgctaagccgcggattatgcagcccggcttcgcgttcggagtgcaacagctccatcctgcactcatccagagacccttcggcattcccgcacactacgtatacccccaggcatttgtgcaacctggcgtggtgatccctcatgttcaaccaactgccgctgctgcctctactaccccttatattgattacacaggcgccgcctatgcgcagtactcagcagccgccgctgccgcagcagccgcagccgcttacgaccagtacccctatgcagcctctcctgccgcggcaggctacgttaccgccggtggatacggttacgccgtgcagcagccgattacagcagctgctcccggcacagcggctgccgcagccgctgccgccgccgccgctgccgcgttcggtcagtatcagccccagcagctgcagacggatagaatgcagtag

SEQ ID NO: 16545 - DNA, 579 bp, Artificial Sequence
  Description of Artificial Sequence: Synthetic coding sequence
atgggaaaagggtgcaaggtggtggtgtgcggattactgtcagttggaaaaactgcaatcctcgagcaactcctgtacggaaatcacacaattggaatggaggattgtgagaccatggaagatgtatatatggcctccgtggaaacagatagaggagtcaaggaacagctgcatctgtatgacaccagaggcttgcaggagggagttgagcttcccaaacattacttctcttttgcagacggatttgtcttggtttatagcgtcaacaacctggagtctttccaacgggttgagctgcttaaaaaggaaatagataaatttaaggacaagaaagaggtggctatcgtggtgctcggcaataagattgatctgtcagagcagagacaagttgacgcagaagtagcccagcagtgggctaaatctgagaaagtgagattgtgggaagttacagtgaccgatagaaaaactctgatcgagccctttactcttctggcctctaagttgtctcagccacagtccaagtcgtcgttcccgctacccggccggaaaaataaaggcaattctaactctgaaaactag

SEQ ID NO: 16546 - DNA, 555 bp, Artificial Sequence
  Description of Artificial Sequence: Synthetic coding sequence
atgaatcggtcacaaccggggctgctccgaacggaccctgttcccgaggagggtgaggatgtggccgccaccatttcagcaacggagactctgagcgaggaggagcaggaagaacttaggagggagttagccaaggtggaggaagagattcagaccctctctcaggttctagcagcaaaggaaaagcatctcgccgagatcaaacgcaagctgggtattaacagccttcaagagttaaagcaaaacattgccaaagggtggcaggacgtcaccgccacttctgcttataaaaaaacctctgaaaccctgtctcaggcgggccaaaaggcctcggcggccttcagctcggtgggcagcgtcattacaaaaaaactggaggacgtcaagaattcacctactttcaaatcctttgaggagaaggtggagaatctcaaaagtaaggttggcggaaccaagccggccggcggcgactttggggaagtcttgaatagcgctgccaatgcctctgccaccacaacagagcctttgcccgagaaaactcaggagagcctctag

SEQ ID NO: 16547 - DNA, 1620 bp, Artificial Sequence
  Description of Artificial Sequence: Synthetic coding sequence
atggcgacctctgctcctctgaggagtctcgaggaggaggtgacgtgttccatctgcctggactatcttcgggatcctgtgactatcgactgtggccacgtattctgtcgctcctgtaccactgacgtccgaccgatcagtggcagcagacctgtgtgtcccctctgtaagaagcccttcaagaaggaaaatatacgtccggtatggcaactggcatctctggttgagaacatcgaacgtctcaaggttgataagggcaggcagcccggggaagtaacaagggaacagcaggacgccaaactatgcgagaggcacagagagaagcttcactactattgtgaggatgacggaaaactcctatgcgtgatgtgcagagaaagtcgagagcacagaccacatacagctgtcctgatggagaaagcagcacaacctcacagggagaaaatcctcaaccacctgagcactctgcggcgggatagagataagatccagggcttccaggcaaagggcgaagccgatattctggccgcgctcaagaaactgcaggaccaacgacaatatatcgttgcagagtttgagcaagggcaccaatttcttcgagagagagaggaacatctcctggagcaactagccaagttggagcaagaattaaccgagggacgggagaagtttaaatcgagaggggtaggcgagctggcaaggctggcactggtcattagcgaattggagggcaaagctcagcagccggctgccgagctgatgcaggatactcgggatttcctgaacaggtaccctaggaagaagttttgggttgggaaacctattgccagagtagtcaagaaaaaaactggggagttcagcgataagctcctgagcttacaacgcggcctgcgcgagtttcaaggaaagctgctccgggacctggaatataagactgtatcagtaacactcgacccccagtccgcctcaggctacttgcagctttccgaagactggaaatgtgttacctacacctcgctgtacaagagcgcctatctgcatcctcagcagtttgactgtgagccaggggtcctgggctctaagggctttacatggggcaaggtctactgggaggtcgaagtcgaacgtgaaggttggagcgaggacgaagaagaaggcgacgaagaagaagagggcgaagaggaagaggaggaagaagaggcgggctatggggacggatacgatgactgggaaacggacgaagacgaggagagcctgggagacgaagaggaagaggaggaggaggaggaggaggaagttcttgagagctgtatggtaggcgtggctagggactccgtcaagaggaaaggtgacctcagcctcagaccggaggacggagtgtgggctttgcggctgtcttcctccggcatctgggctaatacgagccctgaagccgagctgttcccagccctgcgccccagaagagtgggaatagctctggattacgaaggtgggactgtgacatttacaaacgcagaaagccaagaactgatctacaccttcacagctacctttacacggagactggtgccctttctgtggctcaaatggccagggacgcgactgctgctgcgaccatag

SEQ ID NO: 16548 - DNA, 612 bp, Artificial Sequence
  Description of Artificial Sequence: Synthetic coding sequence
atggaacctccaatggagccctctggcggggagcaggagcctggcgcagtgcgtttccttgacctgccatgggaagacgtgctcctgccacacgtgctgaacagagtgcctctgagacagcttctgcgactgcagagggtatcacgcgcctttcggagcttggtgcagctacaccttgcaggcctgagaaggttcgatgccgcccaggtggggcctcagattccgagggcagcgctggcccgccttctccgagatgcagagggcctgcaggaactggcccttgcaccctgccacgaatggctgtcggacgaggatctggtccccgtgctcgccaggaacccacaacttagaagcgtggcgctggggggatgtggacaattatcgcgccgtgccctcggggctctggcagaaggatgtcccaggctgcaaaggttgagtctggcacattgtgattgggtggacggccttgccctaaggggattggccgaccgctgccccgctctagaggagctcgatttaacggcgtgccgccagctgaaggatgaggcaatagtctacctggctcagcgcagaggggctgggttacgttcactgagcttagcagtgaattag

SEQ ID NO: 16549 - DNA, 1824 bp, Artificial Sequence
  Description of Artificial Sequence: Synthetic coding sequence
atggcccgaggccttgggaaggctagcggattccccgctggcccatccggggccgagctgcccgcctcaggcagaagacggggaccactcattagcctttttcctgcggtcctggctagcgaggccgccatgagttatcctgctgacgactatgaaagtgaagccgcctacgacccatacgcttacccatccgactatgacatgcacacaggagaccctaagcaggaccttgcctatgagcgccagtatgagcagcagacatatcaggtgattccggaggttatcaagaatttcatccaatacttccacaagaccgtgtccgacctgatcgaccagaaggtatacgagctacaggcctccagggtgagttcagacgtaattgaccagaaagtctacgaaatccaagacatctatgaaaacagctggactaaacttaccgagaggttctttaaaaataccccttggcctgaagcagaggcaatagctccacaagtcgggaatgacgctgtctttcttatcctctataaagagctttattatcgccatatctacgcgaaggtgtcaggcggcccaagcctcgaacagcgcttcgagagctactacaactattgtaatttgttcaattacattctgaatgccgacggcccagcgccattggaactccctaaccagtggctgtgggatatcatcgatgagtttatttaccagtttcagtcattctcgcagtaccgctgtaagaccgctaagaagtccgaggaagaaatagatttcctgcggtctaatccaaagatatggaatgtccacagcgttctaaatgtcctgcattctctggtcgataaaagcaatataaacaggcaactggaggtttacacatctggcggggacccagagagcgtggctggagaatatgggcggcattccttgtataagatgttggggtattttagcttggtcggcctgctgcgcctgcatagtctgctgggcgactactaccaagccatcaaagtcctcgagaatatcgagctgaataaaaagtcaatgtattcccgtgtccctgaatgtcaggtaacaacttattactacgtaggctttgcgtacctgatgatgaggagataccaggatgcgattcgtgtatttgccaacattctgctatacattcagcggaccaagtccatgttccagcgcacaacatacaagtacgagatgattaataagcagaacgaacagatgcacgctctgttagcaattgcgcttacgatgtatccaatgcgcatcgatgagagcattcatctgcaactgagggaaaagtacggagacaagatgctacggatgcagaaaggtgatccccaagtgtacgaagaactattctcatactcctgcccaaaattcctatcccctgtggttcctaactatgataacgtgcatcctaactaccacaaggagccgtttctgcagcagttaaaggttttttccgatgaagtgcagcagcaagcgcaattgagtacaatcagatctttcctgaagctgtataccactatgcccgtggcaaagctggccggctttctggatctgacggaacaggagtttcgtattcaactgttggtctttaaacacaaaatgaagaatctggtctggacctccggtatctcagctcttgacggagaatttcagtcagcctcagaagtggatttctatatcgataaggatatgattcatattgctgacactaaggtcgcacgccgctatggggatttcttcattcggcagattcataaatttgaggaacttaaccgcactctcaagaagatgggacaacgaccttag

SEQ ID NO: 16550 - DNA, 1308 bp, Artificial Sequence
  Description of Artificial Sequence: Synthetic coding sequence
atggctgcatcctcgctggagcagaaactgagcaggctcgaggccaaattgaaacaagagaaccgggaagctcgcaggaggattgatttaaatttggacatctcaccccagagaccaaggccaattatcgtgatcaccttgagcccagctccagcgccctcccagagagctgcccttcagctgcccctcgccaatgacggaggatcccggagcccctcgtccgagtcttctccacagcatccaacgcctcctgctcgacctagacacatgctgggcttgccctccactcttttcacaccgcgaagcatggaatctattgagattgaccaaaagctccaggagataatgaagcaaacaggctacctgactataggaggccaaaggtaccaagcagagatcaatgacttggagaatttgggagagatgggaagcggaacgtgcggacaggtgtggaagatgcggttccggaagactggacatgtcattgctgtcaaacagatgagacgctctggcaacaaagaggaaaataagcgcatcctgatggatcttgacgtcgtccttaagtctcacgattgcccgtacatcgtccagtgctttggtacatttataactaacactgatgtcttcatcgcgatggaactgatgggtacttgcgcggagaagttaaagaaacgcatgcagggacctataccagagcgcatcctgggcaagatgacagtggccatagtcaaagctttatactatctgaaagagaaacacggcgtcatacaccgggatgtgaaaccttcaaacatcctgctggatgagcgggggcagattaaactctgtgacttcggtatatctggccggctggtggattccaaggcaaaaacacggtctgccgggtgcgcggcctacatggctcctgagcggatcgaccctcccgacccaaccaagccagactatgacattagagctgacgtgtggagccttggcataagcctggttgaattggccaccgggcaatttccttacaaaaactgcaagaccgatttcgaggtcctcaccaaagttctccaggaggagcctccactcttaccgggacatatggggttcagcggcgactttcaatcctttgtcaaagattgtctaacaaaggaccatcgaaaaagacctaagtacaacaagctcctggaacactcatttatcaaaaggtatgaaacactggaagtagatgtagctagctggttcaaggacgtgatggccaaaactgaatcgccgcgaacctccggcgttctgagtcaaccccatctgccattcttcagatag

SEQ ID NO: 16551 - DNA, 3006 bp, Artificial Sequence
  Description of Artificial Sequence: Synthetic coding sequence
atggcctcctcccccttgccaggacctaacgatattcttctcgctagcccctccagcgcatttcagcctgacaccttaagtcagccgcgccctggacacgccaatctcaagccaaaccaggtgggacaagtgatcttatacggcattccaatcgtctcactcgtgattgacgggcaggaacgcttatgtctggcccaaatttccaacacccttctgaaaaatttctcgtataacgagattcacaataggcgggttgcccttggtattacttgtgtgcagtgtaccccagtccagctggagattctgcggcgggcaggcgctatgcccatctcctcacgaagatgtggaatgattaccaagcgtgaggccgagcgcctttgcaaaagttttctcggagagaataggccccccaagttgcctgacaacttcgctttcgatgtctcccatgagtgtgcctgggggtgtcgggggagttttattccggctcgttataactcatcccgggcaaagtgtatcaagtgcagttactgtaacatgtattttagccccaacaagtttattttccactcacaccgaactcctgatgccaagtatacacagcccgatgccgctaattttaattcatggagaaggcacctgaagctcactgataagtccccgcaggacgaactcgtattcgcctgggaggacgttaaggcaatgtttaatggcgggtctcggaaacgagcactgccccagccaggcgctcatcctgcttgccatcccctgtctagtgtgaaagccgcagcagtagcagccgccgctgcagttgctggaggaggcggtctgctgggccctcacctcttgggcgcacccccccctccacccccgcccccgcctcctctcgccgagcttgcaggcgcccctcatgcccaccataagagaccacggttcgatgatgacgacgactcgctccaagaagctgccgttgtggctgctgcctcacttagcgctgccgcggccagcctgagcgtggcggccgcttctgggggagctggtactggaggcggcggtgccggtgggggatgcgtggcgggggtgggggtcggcgctggcgcgggagccggagctggtgctggagccaaaggcccgcgttcctatccagtcatccctgtgcctagtaagggttccttcggcggcgttctgcagaagttcccagggtgcgggggccttttcccccacccctatacttttcccgctgccgccgcagcattttccctgtgccacaagaaggaagatgccggcgccgccgcggaagccctaggaggggcaggagccggcggtgcaggcgcagctcccaaagccgggctttctggacttttttggcccgctgggcggaaagatgcattttatccgccattttgcatgttttggcccccacgaacacccggaggtctccctgtccctacctatctgcagccacctccccaacctccaagcgctctgggctgtgccctcggtgaatccccagctctcctgaggcaggcatttctggatttagccgaacctgggggggctgcggggtcagcggaggctgcccctcctcctggtcaacccccacaagtggtggcgaacggccctggaagcggtcctccacctccagccggcggcgcaggaagccgcgatgcattatttgagagtccccctgggggctctggtggggattgcagtgccggatctaccccacctgcggattcagttgccgcggccggagctggcgcggcggccgccggaagcgggccagcgggctctagggtgcccgcaccgcaccatccacacttgcttgagggaaggaaggcgggcgggggtagctaccaccactcaagcgcgtttcgtccagtgggtggcaaagatgacgctgagagtttggccaagctgcacggagcgagtgccggcgcaccacactcagctcaaacgcacccacaccaccatcatcaccctcaccatcaccaccaccatcatcatcccccccagcctccttcaccactgctcctcctcccccctcaacctgacgaaccggggagcgaaagacaccatccagcgccaccaccacctccaccacctcctccgcccccgcctctggcccagcacccgcaccacagaggtctcctgtctcccggaggcaccagctgctgttacccctccgaggactcttccgaggacgaggatgacgaagaagaggaacaggaagtcgatgtggaggggcacaagccgcccgagggagaggaggaagaagagggccgtgaccccgacgatgatgaggaggaagatgaggagacagaggtattgctgggggatccgctggtgggcggtgggcgcttcttacaaggcagagggccaagtgagaagggcagtagcagagatcgcgcgccggctgtagccggcgctttccctctcgggctcaactcatccaggctgcttcaggaggacggaaaactgggcgatcccggcagcgacctgcctccaccgcccccccctcctttggcaccccaaaaggcaagtggcggtgggtccagttctccagggtctcccgtgcatcaccccagtctggaggagcagccatcatataaggactcccaaaaaactaaggagaataatcaggttatcgtatcaactaaggacgacaactcttttagtgacaagaataaagagcatagcttcttcatcaccgactcagatgcctctggcggagacttctggagggaaagaagtggggagcatacacaggagacaaattcacctcacagcctaaagaaagacgtggaaaatatggggaaagaggaacttcagaaggtcttgtttgagcagatagacctccgccggcgcttggaacaagaatttcaagtcttgaaaggtaatacaagtttcccagtgttcaataattttcaggaccaaatgaagagggaactggcctatcgggaggaaatggtgcagcagctgcagatcgtgtcctgcatcagtacgtag

SEQ ID NO: 16552 - DNA, 198 bp, Artificial Sequence
  Description of Artificial Sequence: Synthetic coding sequence
atggccatggccccctctcctagcctcgtccaggtctatacaagtccagccgctgtggcggtgtgggagtggcaagacggtctgggcacttggcatccgtacagtgcaaccgtgtgcagttttatcgagcagcaattcgtccagcagaagggtcagagatttgggctagggagtctggcacactcaatcccactgtag

SEQ ID NO: 16553 - DNA, 1041 bp, Artificial Sequence
  Description of Artificial Sequence: Synthetic coding sequence
atgatctctaggcctgcctggttgtggggcgcagagatgggagccaacgagcacggtgtgtgcattgcaaatgaggcaatcaacacaagagaacccgccgcagagattgaagccctgttggggatggatctagtcaggctgggactggaaagaggagagacagcgaaggaagctctggacgttatcgtctcactgctggaggagcatggccaaggcggtaactatttcgaagacgccaactcatgtcatagttttcagtcggcctatcttatagtcgatagagacgaggcctgggtactggagactatcggaaagtattgggccgccgagaaggtgactgagggcgttcggtgtatatgtagtcagctgagcctgactacaaagatggatgcggaacaccccgagctaagaagctacgctcaatcccagggatggtggaccggggaaggagaattcaatttctctgaggtgttcagccctgtggaagatcatctggattgcggcgctggcaaggatagtctggaaaagcaagaggagtcgataactgtgcagacaatgatgaatactctcagagacaaagcgtcaggcgtatgtattgactctgaattctttctgaccacagccagcggagtgtccgtgctccctcaaaatagaagttcaccatgtattcattactttactggaacacccgacccctcaagatccatctttaaacccttcatcttcgtcgatgacgtcaaactagtgcccaagacacagagcccttgttttggcgatgatgatccagctaaaaaggagcctaggtttcaggagaagccggaccggcgacatgagctgtacaaagcacatgagtgggcccgagccataatcgaatccgaccaggagcagggcagaaaactgagaagtaccatgttggagttggaaaaacaaggcctcgaagctatggaggagatcttgacgtccagcgaacctctagaccccgcagaggtcggcgatctgttttatgactgcgttgacacggaaattaaattctttaaatag

SEQ ID NO: 16554 - DNA, 1620 bp, Artificial Sequence
  Description of Artificial Sequence: Synthetic coding sequence
atggccacatccgccccactgagaagcctagaggaggaagttacatgctcaatctgtcttgactatctgcgggatcccgtgacaatagattgtgggcacgtattctgccgcagttgtactacggacgtgcggcccatttcaggcagtcgccctgtctgtcctctttgtaaaaagccttttaagaaggaaaatattcgcccagtttggcagctggcaagcctggttgaaaacatagaaaggctaaaagttgataaggggagacagcctggagaagtgacgcgggagcagcaggacgccaagctgtgtgaaagacatcgtgaaaagctgcattactactgcgaggatgatggcaagctgctgtgcgttatgtgtcgagagtccagagagcaccgaccacataccgcagtgttaatggagaaagcggctcagccgcaccgagaaaagatcctgaaccatttgtcgactctacgccgggaccgagacaagatccagggattccaggcaaagggcgaggccgatattctggctgccctcaagaagctccaagatcaacgccaatatattgtggcagaattcgagcaaggccatcagtttctgcgcgagagggaggagcacctgcttgaacagctggccaaacttgagcaagaattgacagagggcagggaaaaattcaaatctaggggagttggcgaattggccaggcttgctctggtgataagcgaactggaaggcaaggcccagcagccagcggcagagctgatgcaggacacacgggattttttaaatcggtacccaaggaagaaattctgggttggcaaacccattgcacgtgttgtgaaaaaaaagaccggggaattttcagataaactgttatcccttcagcggggtctgagggagttccaaggtaagctgctccgggacttagaatacaagacagttagtgttaccctggatcctcaatccgcgtcaggctacctccaactaagtgaggattggaaatgcgtcacatataccagcctgtataagagcgcatacctgcatccccagcaatttgactgcgagccaggcgtgctcggaagtaaaggtttcacctggggcaaagtttattgggaagtcgaagtcgaacgtgagggctggtccgaagacgaagaagaaggcgacgaggaggaggaaggggaggaggaggaggaggaggaggaggctggatacggagacggctacgacgattgggagactgatgaagacgaggagtctttaggcgacgaggaggaagaagaagaagaagaggaggaggaagtccttgagagctgcatggttggggtggctagggattccgtcaagagaaagggtgatctatctctaagaccagaggacggagtatgggcgcttcgcctttcatcatccggtatctgggcaaacactagccccgaggcggagttgtttcccgcgctgaggcctaggcgagtaggaatcgctctcgactatgagggcgggacagtgacttttaccaacgcagagagccaggagctgatttacactttcaccgccacatttaccagacgactggttccattcttgtggctgaagtggcctggcacacgcttgctgctacggccgtag

SEQ ID NO: 16555 - DNA, 390 bp, Artificial Sequence
  Description of Artificial Sequence: Synthetic coding sequence
atggctgagttgatacagaaaaaattgcagggcgaggtggagaaataccagcagctccagaaagacctgtctaaatctatgagtgggagacagaaactggaggctcagctgactgagaataatattgtcaaagaggagctggcattgcttgacgggagcaatgtggtgtttaaactgctgggccctgtgctggttaagcaggaattgggagaagccagagccacagttgggaaaaggcttgattatattaccgccgagatcaagcgttatgagtctcaactgagagatttggagagacagtctgagcagcagagggagactctggctcagctgcagcaggagttccagcgggcccaggccgcaaaggccggggctcccggaaaagcatag

SEQ ID NO: 16556 - DNA, 1740 bp, Artificial Sequence
  Description of Artificial Sequence: Synthetic coding sequence
atgtccgcggccaacccagagactccgaactcgaccatctctcgcgaagccagcactcagtccagtagcgccgcggcgagtcagggttgggtccttccggagggcaagatcgtccctaatactgtgttcgtcggaggcattgacgcacgaatggatgaaactgaaatcgggagctgctttggcagatacggatccgtgaaggaggtgaagatcataaccaacagaaccggcgtttctaaaggctatggattcgtgtctttcgtcaacgacgtggatgtgcagaagatcgtcgggagtcagatccactttcacgggaaaaaactcaaactgggccccgccataaggaaacagaagctttgtgcaagacacgtccagccccgaccactggtagtgaacccccccccccccccgcagttccagaacgtttggcgcaatcctaacacagagacttacctgcagccccagatcacgcctaaccccgtaacccagcatgtgcagagtgctgcgaatcccgaaacaccaaactccaccatcagccgtgaagcttcgacacaaagcagcagcgctgctgcctcccaaggttgggtcctgccggaaggcaagatcgtgcccaatacggtcttcgttggtggtatcgatgctagaatggacgaaacggagatcggatcctgcttcgggcgatatggttctgtcaaggaagtgaagatcatcactaatagaactggagtaagcaagggttatggattcgtgtcttttgtgaacgacgttgacgtccagaagattgttggttcccaaatacacttccacggcaagaaactcaaactcggacctgccatcaggaaacagaagctctgtgccaggcatgtgcagccgaggccattagtggttaaccccccgcccccacctcagttccaaaacgtgtggcgaaatccaaacaccgaaacctacttacagcctcagattactcccaacccggtgacacagcacgtccaggcttactctgcttaccctcattctcctggccaggtgataaccggttgccagctccttgtttataattaccaagaataccccacctatccggattccgctttccaggtcactactggataccagttgcccgtctataattaccaaccctttcccgcctatccccgtagtccatttcaagtcaccgccgggtatcagctaccggtgtacaactaccaagcatttccagcctatccaaactccccattccaagtggccacaggataccagttccccgtctataactatcagccattccctgcttaccccagttcaccgttccaagtaacggcgggctaccagttaccagtatacaactatcaggcgtttcccgcttatccgaactctccatttcaggtcgctacgggataccaatttcccgtttataactatcaggcattccctgcatatcctaatagccccgtacaggtgaccaccggatatcaattgccagtatacaactatcaggcattcccggcatacccaagcagcccgttccaggtcacaaccggctatcagctgcccgtttacaactaccaggccttccccgcttaccctaactctgcagtgcaggtgaccacaggctaccagtttcatgtgtacaactaccaaatgccccctcagtgtcccgtgggggaacagcgccgaaacctatggaccgaggcctataagtggtggtacctggtttgtcttatccagagacgggactag

SEQ ID NO: 16557 - DNA, 831 bp, Artificial Sequence
  Description of Artificial Sequence: Synthetic coding sequence
atgtatgcgagctggacgaaggcatgccggggcctcgaagaacttatcaatttaacccggctgaacgtgtcatacaaccacatagacgacctttccgggttaatccccttacacggtattaaacacaagctgagatatattgacttgcactctaaccggatagactcaatccaccacctcctacagtgcatggtgggtttgcacttcctcaccaacttgatcctggagaaggacggcgatgacaatccagtatgtaggctccctggttacagagctgttattctgcagaccctgcctcagctgaggatcctggattgcaaaaatattttcggcgagccagtgaatctgactgagataaattcgagtcaactgcagtgcttggagggcttattggacaatctcgtgagcagcgactctcctctcaacataagcgaagacgaaattattgaccgcatgcccgtcatcaccgctcccatcgacgaactggtccccttggaacagttcgcgagcacaccctctgacgccgtgctaacaagtttcatgagcgtctgccagagctcagagccagaaaagaataaccacgagaacgatctccagaatgagatcaaacttcagaagttggatgatcaaatcctgcagttgctcaacgagacaagcaactcgattgacaatgttctggaaaaagatccacggccaaagcgggacaccgatatcacatctgagtcggattatgggaactccaggaaaaatggagagaccaagaaggctgcagccggttccactgacaagacagatccacggggtggtactcaaagtttcagttgcaggtag

SEQ ID NO: 16558 - DNA, 1995 bp, Artificial Sequence
  Description of Artificial Sequence: Synthetic coding sequence
atgggtgatgatggctcccctccagcgaaaaaaatgattaccgacattcacgcaaatggaaagaccattaacaaggtgccaacagttaaaaaagagcaccttgatgactacggggaggctcccgtggagactgacggcgagcatgtgaagaggacttgcacatccgttcccgaaacactgcacttaaatcccagcctgaaacatactctcgctcaatttcacctgtccagccagagctcactggggggccccgccgcgtttagcgctcgccacagccaggagagtatgagcccgacagtattcttacccctaccgagcccccaagttctgccaggacctctccttatcccttccgactctagtactgagctgactcagaccgtgctggagggcgagagcataagctgctttcaggtgggaggtgaaaaacgactttgcctacctcaagtgctgaacagtgtgctccgcgagttcacgttgcagcagatcaatactgtgtgtgacgagttatatatctattgctcccggtgtacttcggatcagcttcacattctgaaggtccttggaatcctgcccttcaacgctccatcttgcggactaatcacacttacggatgcccaacgactgtgtaacgccctgctgcgcccacgcacgttcccgcagaacgggtctgtgctgcccgctaagtcctccttggcgcagctgaaagaaacgggctctgcttttgaagtcgagcatgagtgtctggggaagtgtcaagggcttttcgcgccccaattctacgtgcagcctgacgccccttgcattcagtgcttggagtgctgtggaatgttcgccccccaaacattcgtgatgcattcacacaggtccccagacaaaaggacttgccactggggcttcgaatccgctaagtggcattgttatctgcatgttaatcagaagtatctcggtacccctgaggagaagaagctaaaaattatccttgaagagatgaaggaaaagttttccatgcgatctggaaaacggaatcaatctaaaaccgacgcccctagtggtatggagctgcagtcatggtatcctgtaatcaaacaggagggcgaccacgtgtcccaaacccacagctttctgcacccctcgtactacttatacatgtgcgataaggtcgtggcccccaacgtgagcctgacttctgcagttagccagagtaaagagctcacgaagacggaagctagtaaaagcatttcccggcagtccgaaaaagctcactccagtgggaaactccagaagacagtcagctatccggatgtgtctttggaggagcaggagaagatggacctgaaaactagtagagagttgtgcagccgtcttgatgcaagtatctccaataactccacaagcaaaaggaagagcgagtccgctacttgcaatctcgtgcgcgacattaataaagtggggataggcctagttgccgctgcctcctctccactacttgtgaaggacgtgatctgcgaggacgacaaagggaaaatcatggaagaagtgatgcggacttacttgaaacaacaagagaagctcaatctgatcctgcagaagaaacagcagctgcaaatggaggtcaaaatgttatcctctagcaaatctatgaaagagttaacagaagaacaacagaaccttcagaaggagctggaatccctgcagaatgagcacgcccaacgcatggaagagttctacgtggaacagaaagatttggagaagaaactggagcaaattatgaagcaaaagtgcacctgtgattcaaacctggagaaagataaagaagctgagtacgcagggcagctcgctgagctgcgccagcgactcgaccatgctgaggcagatcggcaggaacttcaggacgagctgcggcaagagagagaagcaaggcagaaattagagatgatgataaaggaactgaaattgcaaattttgaagagctccaagactgcaaaggagtag

SEQ ID NO: 16559 - DNA, 1068 bp, Artificial Sequence
  Description of Artificial Sequence: Synthetic coding sequence
atggggcgaagggatctagtgagtggagggagcaatgagggtaacggaaaggaagattgggccatgaagactgttagtcttagatggaccaagctcccgcctgtcaagagcgccatccgcggacaagcacccgtcgtaccatatatgcgctacggccattctactgttttgatcgatgataccgtactgctgtgggggggaaggaacgataccgagggcgcttgcaacgttctttacgcatttgacgttaatacacataagtggtttaccccacgcgtgtctggcacagtccccggagcccgcgatgggcatagtgcatgtgtcctgggaaaaattatgtacatttttggggggtacgaacagcaagcagattgcttttctaacgacattcacaagttagacacttccacaatgacatggacattgatttgcacgaaaggatctcctgcccgatggagagactttcatagtgccacgatgctgggctcccacatgtatgtgttcggcggtagggcagacaggttcgggcccttccacagtaataacgagatttattgtaatcgcatcagggtgttcgatacccgaaccgaggcctggctggattgtcctcctactcccgtgctccccgaggggcgacgttcccactcagcctttggttataacggagagttatatatctttggtggatacaacgctaggcttaatcggcatttccatgacctttggaaattcaaccctgtgtcattcacttggaagaaaattgaaccgaagggaaaagggccctgtcccagacgacgccagtgctgctgtattgtgggggataaaattgtgctgtttggcggcaccagccccagccccgaagagggactgggcgatgagtttgatctgatcgaccactctgatcttcatattctagactttagcccatcgctaaaaacactgtgtaagcttgcagtgatccagtacaacttagaccaaagttgtctgcctcatgatatcaggtgggagttaaacgccatgacaactaacagtaacatctcacgaccaatcgtcagcagtcacgggtag

SEQ ID NO: 16560 - DNA, 1245 bp, Artificial Sequence
  Description of Artificial Sequence: Synthetic coding sequence
atggccgctgccccaccttcctactgcttcgtggcttttccccctagagcgaaagatggactggttgtcttcggaaaaaattctgctcgtcctcgggatgaggttcaagaagtggtctatttcagtgcagccgatcacgagccagaatccaaggtagagtgcacctatatctctattgatcaggttcctcgtacatatgccatcatgatttctcggcctgcttggttgtggggcgctgagatgggcgccaatgaacacggggtgtgcatagccaatgaggcaatcaatactcgcgaacccgcggccgagattgaggcgcttctggggatggaccttgtgcgcctcggactcgaacgcggggaaaccgctaaggaggctctggacgtaatagtttccttgttggaggagcacggtcagggtggtaattattttgaggacgccaactcctgccactcgttccagagtgcctaccttattgtcgatagggatgaagcctgggtgttagagactattggtaagtactgggctgctgaaaaagtgacagaaggtgtccgatgtatttgcagccagctctccctcaccaccaaaatggatgccgaacatccagagctcagatcgtatgcccagagccagggctggtggactggcgaaggagaattcaattttagcgaagttttctctccggtggaagatcacctcgactgtggggcgggaaaggactcactggaaaagcaagaggaaagtatcacagttcagaccatgatgaatacgctgcgggacaaagctagcggtgtctgcatcgactctgaatttttcctcacaactgcaagtggcgtcagcgttctacctcagaacaggagcagtccctgcattcactactttactggcacccccgatccttctagaagcatttttaaaccttttatcttcgtggacgacgtgaaactggtgcccaagacccaatcaccttgcttcggagatgatgacccagctaagaaagagccgagattccaggaaaaacccgacagacggcacgagctttataaagcccatgagtgggctagagctatcatcgagagtgatcaggagcaagggcggaagctccggtctaccatgctcgagctcgagaagcaggggctggaggccatggaagagatacttacaagcagcgaacctctagaccccgccgaggtgggcgacttattttacgattgtgtggatacggaaataaagttcttcaaatag

SEQ ID NO: 16561 - DNA, 1200 bp, Artificial Sequence
  Description of Artificial Sequence: Synthetic coding sequence
atggccaccggcgacttaaaaaggagcctgcgaaaccttgaacaggtcctcaggctgctgaattatcctgaggaggtagattgcgtcgggcttatcaagggggatcctgcagcatctttaccaatcatttcttacagtttcacctcttatagtccatacgtgactgaactgattatggaaagtaacgtcgaactgattgcaaagaacgaccttaggtttatcgatgccgtctataagttactgagagatcagttcaattacaagcctatcttgacgaagaaacagtttatccagtgcgggtttgccgagtggaaaatccaaatcgtgtgtgatattctgaattgtgtaatgaagaaacataaggaactgagttcactgcagaagatcccgtctcagcaaaggaagaagatctcatcaggcaagagcgagcctcctcttggaaatgagaaaatttccgccgaagccgtgggcgtggacatttctgggagatttatgacatccggaaagaaaaaagccgtagtcatccggcatctatataatgaggacaacgtcgacatctctgaggatacactgtcaccaattactgacgtcaatgaggccgtggacgtgtcggatcttaatgccaccgagattaagatgccagaggtgaaggttcccgagatcaaggccgagcaacaggatgtcaatgttaaccctgagataactgccttgcagactatgctggctgaatgtcaagaaaatctgaagaagcttacttctatagagaagcgattagattgtttggaacagaagatgaagggcaaggtgatggtggatgaaaatacgtggacgaatcttctatctcgggtgactctccttgaaactgaaatgttgttgtccaaaaagaacgatgagtttatcgaattcaacgaggtgtctgaagactacgcatcttgtagcgacatggatctcctgaacccacacaggaagtcggaagtggagcggccagcttcaatcccgctgtccagcggctactctaccgccagcagtgacagcacacctcgtgcttccaccgtaaattactgtggtctaaatgaaatctccgaaaatttccccgcttggtccgcaactagctcctgcagcagtctgtcctggctgctgcgtggacacacttcttacttaagctcccagagctttgcctggcccctctcctgcgtctag

SEQ ID NO: 16562 - DNA, 1317 bp, Artificial Sequence
  Description of Artificial Sequence: Synthetic coding sequence
tgatgtgccggagctgaaagaccaagaagacgaggacgactgtgggattcctccggcgtaccccaaagacagaaaagacctggaccttggcgtacccaaacgcaggaacagatgtctcgtgatgtttgtattcatacttggccctgcacatactatctggaacctaagcgtcgctgggtgacaggacagctgtcactaaccagtttgagccttcggttcatgactgactccaccggggagattttagtgagtttccctctcagttctattgtcgaaattaaaaaagaggcatcccatttcatattcagctccatcaccattttagagaaagggcatgccaagcactggttctcttccctgcgcccatcccgaaatgtcgttttctctatcatagagcatttttggcgagaattactgctctctcaacccggggccgtggcagacgcttctgtaccacgcactagaggcgaggaacttacaggcctcatggctggcagccaaaagaggttggaggatacggcgcgagttctgcaccatcagggccaacagctggatagtgttatgcggggccttgataagatggaaagcgatttggaagtcgccgataggttgttgacagagctcgagtcacctgcctggtggccgttctcatccaaattgtggaagacccctccagaaactaagccacgggaggacgtcagcatgacgagctgtgaaccgtttggaaaagaaggaatcctcattaagatccctgctgtcatatctcaccgcacagagtctcacgtcaaaccaggcaggctcactgttctcgtgtccggactggagattcatgactctagcagtctcctcatgcacagattcgagcgggaagatgttgatgatatcaaggtgcacagtccatatgagatatctattcgccaacggtttatcgggaagcccgatatggcctatcgcttgatcagtgctaagatgcccgaggttattcccattctggaggtgcagttcagcaagaagatggaactgctggaggatgcactcgtgctcagaagcgctcgaacctcatcgcccgcagaaaaatcctgcagtgtgtggcatgccgcaagcggcctaatgggaaggacattacatagagaacctccagccggcgaccaggagggcaccgctctccaccttcagacttctctgcccgccctgtccgaagccgatacacaggaactgactcaaggcttcaggccaatgtccctcagtacccaaactgttctcgtcatgctgtgctccgaatccgccggagctctgtggaggcagagactgtcatag

SEQ ID NO: 16563 - DNA, 711 bp, Artificial Sequence
  Description of Artificial Sequence: Synthetic coding sequence
atgacaggctacgaagcccggcttatcaccttcggtacatggatgtactcagtaaacaaagagcagctcgcgagagcagggttttatgcgatcggccaagaagataaagtacaatgtttccattgcgggggaggactggctaattggaaaccgaaagaagacccctgggaacagcatgcgaaatggtatcccggatgtaagtacctgctggaagaaaaaggccatgagtatatcaacaacattcacttgacacgttccctagagggcgcgttagtacaaacaacgaaaaagacgcccagcttaactaagagaataagtgatacgatatttccaaaccccatgctgcaggaagccatccgcatgggatttgattttaaggacgtgaagaaaattatggaagagcggatccagaccagcggtagtaattacaagactctcgaggtcctagtggccgatctggtgagcgctcaaaaggacacgaccgaaaacgagctgaatcagacttctctccagcgcgaaatttctcctgaagagcctctgaggcggctgcaggaagagaaattgtgtaagatatgtatggacaggcatatcgccgttgtgtttattccgtgcggacacttggttacctgcaagcagtgtgccgaagcagtggatagatgtccaatgtgcagtgccgtgatcgatttcaaacaaagagtgtttatgtcctag

SEQ ID NO: 16564 - DNA, 285 bp, Artificial Sequence
  Description of Artificial Sequence: Synthetic coding sequence
atgaaccctacaaatcccttttcaggacagcagccatccgctttctctgcaagtagcagtaacgttggcaccctgccttctaagcctccatttcgtttcggacaaccatccttgttcggtcagaactcgactctgagcgggaagtcaagtggtttctcccaggtgtcctcttttccggcatcttctggagtctcccactcaagttctgtccagacgctcggatttacacagacgagcagcgtcgggccattctccggcttggagcatacatctaccttcgtctag

SEQ ID NO: 16565 - DNA, 723 bp, Artificial Sequence
  Description of Artificial Sequence: Synthetic coding sequence
atggcaatagtgcagacccttcccgtacccctggaacccgcacccgaagctgccaccgcccctcaggctccagtcatggggtctgtctcctccctgatctcggggcgcccatgccctggggggcccgccccccctaggcatcacgggcctccaggacccacatttttccgccagcaggatggcctgctacgaggtggttacgaggcacaggagcctctgtgccccgccgtacctcctaggaaagctgtgccagttacaagcttcacatatatcaacgaagacttccggacggagtctcctcccagcccaagcagtgacgtagaggatgcccgcgagcagagggctcataacgcccacctgcgaggccccccacccaagctgattcccgtgagcggaaagctagaaaagaacatggaaaaaatcttgattcggccaaccgctttcaaacccgtgttgcccaaaccacggggagctcccagcttacctagcttcatggggccacgagcaacggggctatctggctctcaggggtccctcacccagttgtttggggggcccgcaagcagctcttcttccagttcaagctcttccgcagccgacaagcctctggccttcagcggatgggctagcggctgcccgagcgggacattgtccgatagcggccgcaacagcttgtcctcattacctacttatagtaccggcggtgctgagcccacaacctag

SEQ ID NO: 16566 - DNA, 1317 bp, Artificial Sequence
  Description of Artificial Sequence: Synthetic coding sequence
atgtgcccgaaaaacgcttcctattacggcaacagagctgccaccctgatgatgctggggagattccgggaggccctgggcgacgcacagcaatctgtccgccttgacgacagcttcgtgcgtggccatctgcgcgaaggcaaatgccacctttcactgggaaatgccatggccgcatgcaggagctttcagagggctctcgagcttgaccacaaaaacgcccaagctcagcaggaatttaagaatgccaacgcggtcatggaatacgagaagatcgcagaaaccgatttcgaaaaacgggacttccgcaaggtcgtcttttgtatggatcgggctctggagttcgcacctgcttgtcaccgcttcaaaatcctgaaggcggaatgcctagccatgctggggcgatatcctgaggcacaatctgttgcatccgatatcttacgaatggactctacgaacgccgacgccctctatgtgcgcggcttatgtctgtattacgaagactgcatcgagaaagccgttcagtttttcgttcaggctctgcggatggcacccgaccacgagaaagcctgtatagcatgtcggaacgccaaagccctgaaggctaagaaggaagatggaaacaaagcatttaaggaaggcaattacaaactggcatatgagctctataccgaagctctcggcatcgacccaaacaacatcaagactaacgccaagctctattgcaatagggggacagtcaatagtaagctccgaaagctggatgatgccatcgaagactgtacgaacgctgtaaaacttgacgatacctacattaaagcatatctccgccgggcccaatgttacatggatacggagcaatacgaggaagccgtgcgagactatgagaaggtataccagactgaaaagacaaaggaacataagcaattgctgaagaatgcccagctagaactgaaaaagagcaagcgaaaggattattacaaaattttgggcgtagacaaaaacgcaagcgaagatgaaatcaaaaaggcctacagaaaacgggccctcatgcaccacccagaccggcactctggggcaagcgctgaagtgcaaaaagaggaagaaaaaaaatttaaagaggtaggtgaggcattcactatcctgtccgaccccaaaaagaagaccagatacgacagcggccaggatttagacgaggaagggatgaacatgggcgactttgatcccaacaacatatttaaggcattcttcggtggtcccggtggcttcagcttcgaggccagcggcccaggcaacttttttttccagttcggctag

SEQ ID NO: 16567 - DNA, 678 bp, Artificial Sequence
  Description of Artificial Sequence: Synthetic coding sequence
atggaagaagaggagatgaacgatggatcccagatggtgcggagccaggagtctctgacattccaggatgtggccgttgactttacacgggaggagtgggaccagctctaccccgctcagaagaacctgtacagagacgtcatgttggagaattatcgtaacctcgtagccctcggctaccagctgtgtaagccggaggtgatcgcccagctggagctcgaggaagaatgggtgatcgaacgcgattcacttctggatacccatcctggtgatcagtcacacgtcatgagtgtcgtgcgttcgtcagtgcacgctaggtggattgtggggaaggtgatcggcacgaaaatgcagaagacagctaaggtcagagttactaggctagtgctcgatccatacttattgaagtacttcaacaagcgtaagacctatttcgcacatgacgcactgcagcagtgcaccgtcggcgacatcgtccttcttcgggctctcccagtgccgagagccaagcacgtcaaacacgaacttgccgaaatagtctttaaggttggtaaggtgattgacccagtgactggtaagccttgcgctggtacgacttatctggagagtccgttgtctagcgagacaacccagctgagcaaaaacctggaagaactgaatatctcatcggcacagtag

SEQ ID NO: 16568 - DNA, 753 bp, Artificial Sequence
  Description of Artificial Sequence: Synthetic coding sequence
atgaccaccaaaaacttggaaaccaaggtgaccgtcacgagttcacctattcgtggtgctggcgacggaatggagaccgaagaaccccccaaatccgtggaagttacatccggagttcagtccaggaagcatcattcattgcagtctccttggaagaaggctgtgccttctgaatctcccggggtccttcaactgggaaagatgctcaccgagaaagccatggaggtgaaggctgttaggattttagtgccaaaagccgccattactcatgatatcccgaacaagaataccaaggtgaagtccttaggccaccataaaggggaattcctgggccaaagcgaaggcgtcatcgaacctaacaaggaactgtcggaggttaaaaatgtgttagaaaagttaaagaactccgagcgtaggttactgcaggacaaggaaggtttaagtaaccagctaagggtccagaccgaggtgaatagagagttgaagaagttactggttgcgtcagttggggacgacttgcagtaccacttcgagcgtctagctcgagagaagaaccagctgattctggagaatgaggcccttggcaggaacaccgcccagctgtccgagcagctggagaggatgtctatacagtgcgatgtgtggcgatcaaaattccttgcttcccgcgtgatggcagacgaacttactaatagtagagcggcgttgcagcgtcagaacagggacgcccatggtgccatacaggacctgtag

SEQ ID NO: 16569 - DNA, 387 bp, Artificial Sequence
  Description of Artificial Sequence: Synthetic coding sequence
atgctatgttggggatactggagtctcgggcaaccagggattagcactaacctgcaagggatcgttgccgaaccccaggtgtgcgggtttataagcgatcgcagtgtcaaagaggttgcctgcggtggcaatcactctgttttcctgctggaggatggggaagtctacacatgtggactaaacaccaagggacagctgggccatgagagggaaggcaacaagccggaacaaatcggagctctggccgatcagcacatcattcacgtagcctgcggggagtcccatagccttgctttatctgatcggggtcaactgttctcttggggtgctgggtcagacggccaactgggtctcatgactacggaagattctgttgccgtgccttag

SEQ ID NO: 16570 - DNA, 1617 bp, Artificial Sequence
  Description of Artificial Sequence: Synthetic coding sequence
atggacgtggacaaagaattgggcatggagtctgtcaaagctggagctagcggcaaacccgagatgaggctgggaacacaggaggaaacttctgagggcgacgcaaatgagtctagcctccttgtgttatctagtaacgtccctctacttgccctcgagttcctggagatagcccaggccaaagagaaagccttcctacccatggtgtctcatacattccacatgaggacagaggaatctgatgcttcccaggagggagatgacctccctaagagctcggccaatacaagccaccctaagcaagacgactcacctaaaagctctgaagaaaccatacaacctaaagagggcgacatccctaaggcaccagaggaaacaatccagagcaagaaggaagatcttccaaaatcaagcgagaaggcaatacagcccaaagagagcaacatccctaaaagttctgcaaaacctatccagccgaagctggggaacattcccaaagcgagtgtcaagccttcccagcctaaagaaggcgatattcctaaagcccctgaggagaccatccagtcgaagaaggaggacctgcccaaatctagtgaagaagccattcaacctaaggagggcgatatccctaagtccagcgccaagcccatccagcctaaactgggtaatattgcgaaaactagtgttaagccttcccagcctaaagagtctgacattccaaagagcccagaggagacgattcagcccaaggagggagatatcccaaagtctagcgcaaagcctatccagcccaaactcggcaacatcccaaaggccagtgtgaaaccctctcaacctaaggaaggagacatatcgaaatccccagaagaggccatccaaccgaaggaaggagacctccccaagtcactggaagaagcgatccaaccaaaagagggtgacatccctaagtccttggaggaagccatccagcctaaggagggcgatattcctaaaagccccgaagagactattcagccaaagaagggggatattccaaagtctccagaggaagctattcagccaaaagagggggacatccctaagtcacccaagcaggctatacaacctaaggaaggagacattccaaagtctctggaggaggccatcccccctaaggaaatcgatatacccaagtcgccggaagaaacaatccagccaaaggaggacgacagtccaaaatctctggaagaagctactcctagcaaggagggtgatatcctcaagcccgaggaggagacgatggagttccccgagggggacaaggtaaaagtgattttgtctaaggaagattttgaagcgtccctgaaggaggcaggcgagcgcctagttgccgtcgacttctccgcaacctggtgtgggccatgcaggaccatccgaccgttcttccatgctcttagtgtaaagcatgaggacgtcgtctttttggaagtggacgcagataactgcgaggaggttgtgcgtgagtgcgccatcatgtgcgtgcctacattccaattttacaagaaggaggagaaagtggatgaactatgtggtgccctcaaggaaaagctggaggccgtcattgccgagctgaaatag

SEQ ID NO: 16571 - DNA, 153 bp, Artificial Sequence
  Description of Artificial Sequence: Synthetic coding sequence
atggccagcgaggaattgcagaaagacctggaggaggttaaggtgcttctcgagaaagcaacacggaagcgtgttagggacgcattaacggccgagaaaagcaaaatcgagaccgaaattaagaataaaatgcagcagaaatctcagaaatag

SEQ ID NO: 16572 - DNA, 1527 bp, Artificial Sequence
  Description of Artificial Sequence: Synthetic coding sequence
atggccacggattggttggggtcaatagtgtcaattaattgtggggacagtctcggagtgtaccagggaagggtcagcgcagtcgaccaggtgagccagacaatcagcctgacgcgtccatttcacaacggggtaaagtgcctcgtcccagaagtcacattccgggccggggatattaccgaactgaaaatcctggagattccagggcccggagataaccagcattttggagatctgcaccagactgagctcggcccttccggcgccgggtgccaagtcggaattaatcagaacggcactggcaaattcgtgaagaagccagcctccagcagttctgcacctcagaacataccaaagaggactgatgtaaagagccaagacgtagctgtttctcctcagcagcagcagtgctcaaaaagctacgttgataggcatatggagagtctgagccaatcaaagtctttccggaggaggcataattcttggagctcttctagtaggcacccaaatcaggccactccaaaaaagtccggcctcaagaatggccagatgaaaaataaagatgatgaatgcttcggagacgacatcgaagaaattccagacactgattttgactttgagggtaatctggccctttttgacaaggctgccgtgttcgaggaaatcgatacctacgaaaggcgcagtggtaccaggagcagaggcattccaaatgagagacccaccaggtatcgccatgatgaaaacatactcgagtccgagccaattgtgtataggagaatcattgtgccgcataacgtgtccaaggaattctgtacggactccggcctcgttgttccgagtattagttatgaattgcacaagaaactcctgagtgtggccgaaaaacacggcctgaccctggagcgaaggctggaaatgactggagtctgtgccagccagatggccctgaccctgctgggggggccgaaccgcctgaacccgaagaacgtccatcagagacccaccgtggctctgctctgcggaccacatgtgaagggggcacagggaatctcatgtggccgtcacctagctaatcatgatgtgcaggtgatcctgtttctgccaaacttcgtaaaaatgcttgagtccatcaccaatgaactgagcctgttctcgaagacccaaggacagcaagtatcttctctgaaggaccttcccaccagcccagtggatctcgtaatcaactgtcttgattgccccgagaatgtgttcttgagagatcagccttggtataaggcagctgtggcttgggctaatcagaatagggccccggtcttgtcaatagatccccccgtgcatgaggtcgaacaaggcatagacgcaaagtggagtctcgcgcttggattgccactgcccctgggagagcacgccggaagaatttacctctgcgacatcggcatcccacagcaggtatttcaggaggttggcataaattatcattcaccgtttggatgcaaattcgtcatccctctgcattcagcctag

SEQ ID NO: 16573 - DNA, 3846 bp, Artificial Sequence
  Description of Artificial Sequence: Synthetic coding sequence
atgacattctacagctggatcccctaccacaggcaggcgcccctgaaccaccgacgggtgtgctccgccgagggggcagggagccctggccccgcccttgatccaagatggctacctaccgaagctcatcttctcgaagcccacagactactcctccagtcagtgctttgcgaccggccaagggagtccatacaattgcactttcgcctgtcgatggcaagtcagctgcaggttttttccccgccttccgtttcttcaagcgccttttgctcagctaagaaactgaagattgaacccagcggatgggacgtgtcgggccagagtagtaacgacaagtattatacacacagtaagactctccctgcgacacaggggcaggcaaattctagccaccaagtcgctaattttaatattccagcatacgaccaaggactcctgttacccgctcccgctgtagagcacattgtggtgaccgccgcagatagttcagggagtgcagctacatccaccttccagtcctcccagactcttacccacagaagtaacgtgtccttactggagccgtatcaaaaatgcggcctaaagcggaaaagtgaagaggtggatagtaatggatcagttcagataatcgaggaacatcctcctctgatgcttcagaacaggactgttgtaggagctgctgcaacgactaccactgtcacaactaagagctcttccagttctggcgagggagattatcaattagttcagcacgagatcctgtgcagcatgaccaattcctacgaggttctcgaatttctgggccgtggcacattcggacaggtggccaagtgctggaagcgaagcactaaagaaattgtagccattaaaatcctgaaaaaccatccctcgtatgcccgtcagggacagatagaggttagcatattgagcaggttgtctagcgagaatgcggacgagtataattttgttagatcttacgagtgctttcagcacaagaaccacacgtgtctcgtattcgagatgttggagcaaaatctctacgactttctgaaacagaataagtttagccccctgccactgaaatatataagacccatcctccagcaggtcgctactgcattgatgaaacttaagagcctggggctcattcacgccgacctgaagcccgagaacataatgttagtggatcctgtgcggcagccctatcgcgtgaaggtaattgacttcgggagcgcctcccatgtttccaaggctgtgtgctcgacatacctgcagagccggtattaccgcgcacccgaaataatactcggattgccgttttgtgaagcgatcgacatgtggagtttgggctgcgtcatcgcggaactcttcctgggatggcctctttacccaggagcctccgaatacgatcagattagatatattagccaaactcagggcctccccgccgaatacctgttgagcgccggcaccaagaccacacggttcttcaacagggatcccaacctcggatatccgctgtggcgtttaaagaccccagaagagcacgagttagagacagggatcaagtctaaagaggcccgcaagtatatctttaattgtttagatgatatggctcaggttaacatgagcaccgacctcgaaggtacagatatgctagcagaaaaagccgaccgtcgggaatacatagatttattgaagaagatgctaacgattgacgctgacaaacgcatcactccactcaagaccctcaatcatcagtttgtaactatgacgcatcttctcgattttcctcacagcaaccacgtcaaaagctgtttccaaaacatggagatttgcaagagacgcgtgcatatgtacgacactgtatctcagatcaagagcccattcacaacacatgtggctcctaatacgtctacaaacctaacaatgagtttcagtaaccagcttaatacggtccacaatcaagcgtccgtgttggcctcaagctcaacagcagccgccgcaaccctgtctctggccaactcggacgtgtccttactgaattatcagtcagctctgtacccttctagtgctgctcccgtacctggagtggcccagcagggagtgagcctgcagcccggaaccacccagatctgcacacaaaccgacccctttcagcagacgttcattgtgtgccccccagcatttcagaccgggctgcaggccacgacgaagcactctggctttccggttcgtatggacaacgctgtgccaatagtgccccaagctccagccgcccagcctctgcaaattcagagtggagtactcacccagggaagctgcactccactgatggtggcgaccttacatccacaggtggccacaattactcctcagtatgccgtgccatttactctgtcatgcgctgcaggccggcctgccctggtagagcagaccgcagccgtgctgcaggcatggcccggaggaacgcaacaaatcttgctgccaagcacatggcagcaactacccggggttgctttacataatagtgtccagccaacagcaatgatccccgaggcaatgggatctggccagcagcttgcggattggaggaacgcccacagccacggcaaccagtactctacaattatgcagcagcccagcttgcttaccaaccatgtcactctagctacggcacaacccctaaatgtaggggtagcacacgttgtcagacagcaacagtcatcctctctgcctagtaaaaagaacaaacagtctgcacccgtatcgagcaaaagtagcctcgacgttctcccgagccaggtgtattcactggtcgggtcctcaccactgcggactacatccagctacaacagcctggtaccagtacaggatcagcatcagcccattattattcctgatacaccgtcccccccagtaagtgtgatcacaatcagaagtgacacagacgaggaagaggataataagtataagccttccagctcaggcttgaagcctagatctaacgtcatttcatacgtgaccgttaacgattcgccggatagcgacagctcattatcctcaccctactccacggacacattgtcggcgctgagagggaatagtgggagtgtgctggaaggccctggcagagtggtggcagatggaaccggcaccaggacaatcattgtgccgcccctcaagacgcaactaggtgactgcacagtcgccacccaggcatcagggttactcagtaataaaacaaagcctgttgcgtcagtgtccgggcagtctagtggttgttgcatcacccccactggctacagagcccaaagagggggcacgtcagccgcgcaacccctgaatctgagccagaaccagcagtcctctgccgcacctacgtcacaggagcgcagcagtaatcccgcaccccggagacagcaggccttcgtggcgcccctcagccaggccccttataccttccagcacggtagtccgttgcattccacaggacacccccacttagcccctgcgcctgctcacctgcctagtcaggctcacctgtacacctacgccgcgcccacgtctgctgcagctctcggatctacgtctagcatcgcccacctgttttctccacaaggctcctcacggcacgccgctgcatacactacccaccctagcactcttgtgcaccaggtcccagtctctgtgggacccagtctgctgaccagtgcatcagttgcccctgcccaatatcagcaccagttcgcaacccaaagttacataggatccagtaggggcagcaccatttacaccgggtaccctctgagccccaccaaaatcagccaatatagctacctgtag

SEQ ID NO: 16574 - DNA, 1071 bp, Artificial Sequence
  Description of Artificial Sequence: Synthetic coding sequence
atgacaagtgttacccggagcgaaatcatcgatgaaaaggggccagtcatgagcaaaactcatgaccaccaacttgaatctagtctgtcgcccgtggaggtttttgcaaagaccagtgccagcttggagatgaaccaaggcgtaagcgaggaaagaatccatttagggtcatcaccaaaaaaggggggcaactgcgacctaagtcaccaagagcgcttacagtccaagagccttcacctaagcccgcaagagcaatcggcatcctaccaggatcgacgacaatcatggcgtcgagctagcatgaaggagacaaatcgtagaaaaagccttcacccgattcaccaggggatcacagaactttctcgctccatcagcgtggatttggcagaaagcaaaagacttgggtgtctgctcctgtccagttttcagtttagcatccagaagctggagcccttcctgcgagacacaaaagggttctccctggaatcatttcgtgctaaagccagctctctatctgaggaactgaagcacttcgctgatgggctcgagaccgatggcacactgcagaaatgcttcgaagattcaaacggcaaagcctcagacttctccctagaggccagtgtcgccgagatgaaggagtatattacaaaattcagtctcgagcgccagacatgggaccagctcctccttcactatcagcaggaagctaaggagattttgtctagaggttccactgaggcaaaaatcacagaagtgaaggttgagcctatgacctaccttgggtcaagtcagaacgaggttctcaatacaaagccggattatcagaagatactgcagaatcagagcaaagtgtttgactgtatggagctggtcatggacgagctgcaagggtccgtcaaacagttgcaggcatttatggacgaaagtacccaatgcttccagaaggtctcagtgcagctgggcaaaaggtccatgcagcagctggacccaagcccagcccgcaaactgcttaagctccagctgcagaatccccccgccatccacgggtcgggctccgggagctgccaatag

SEQ ID NO: 16575 - DNA, 2748 bp, Artificial Sequence
  Description of Artificial Sequence: Synthetic coding sequence
atgcaaggacccgacgcccctctgctgctttccgcgcgagagctgggacctgggcggagggggtctgcctcctggtatcgacaggaaggtggcgcggtgtgtaattggctgcgaaagccacagccactcgaacctcggacatcgttccctagcgcgagaaggtccgagtttcgccccccccggcgactgccatgggcaggaccagcgtcagcccagagtgaggaaggacatgcaggtggaaggtgccaggcaggctcgccagcccctgctcgccggctgagcggtgcattcaaaaccttggtaccgggcactcatgcccagggagcttccgatactcaccccttgggacccccccatacacccgtcctggacccatcgccccaagatggctttccagtgttgtggcgggggtcctcaaaggccagccatatgaatcgtttaaggaacgcaaagatatatgtagagagagccgtcaagcagaaaaaaatttttaccatacagggctgctatcctgtcattagatgtttgttgcgacgtcgcggctgggtggaaaagaagatggtgcacagatctggacccacgctgctcccaccccagaaggatctagattcttctgcaatgggggacagcgatacaaccgaagacgaagacgaggacgaggatgaggagtttcaacccagtcagttattcgattttgatgatctgctgaagttcgacgatctggacggcacacatgccctgatggttgggctgtgtctcaatctgaggaatttaccctggtttgacgaagtcgacgctaactcttttttcccccggtgttactgtcttggcgccgaggacgataagaaagccttcattgaggacttctggttgaccgctgccagaaatgtgttgaaactggtcgtgaagagcgaatggaaatcatacccaatccaagctgtggaggaggaggcatccggtgacaagcagcctaaaaaacaggaaaaaaatccggttttggtgtcccctgaattcgtcgatgaggctctctgtgcatgtgaggaatacctgagcaacctggcccatatggacatagacaaggacctggaagctcccttataccttactcccgaaggttggtcgctgtttctgcagagatactaccaagtggtacacgaaggcgctgaacttcggcacttagatacacaggtgcaacggtgtgaggatatcctacagcagcttcaggccgttgtgccacagatcgacatggagggtgataggaacatttggatcgtgaaacccggcgcaaaatcacgtggccggggtattatgtgcatggaccacctggaggagatgctgaagcttgtgaacggtaatcctgtggtgatgaaggacgggaagtgggttgttcaaaaatatatagaacgcccactcttgattttcggcaccaaatttgatctgaggcagtggttccttgtgactgactggaatccactgacggtctggttctatcgcgacagctacatccgcttctcgacacaaccgttttcacttaaaaatctggataattccgtccacctttgcaataactcaatccagaagcacttggagaattcttgtcacagacatccccttttgccacctgacaacatgtggtcttctcagagatttcaggcccaccttcaagagatgggggcaccaaatgcatggtcaaccataatagttcctggcatgaaggacgccgtgatccacgctctgcagacatcgcaagacactgtgcagtgtagaaaggcctcattcgagctgtatggggccgattttgtgtttggtgaagacttccagccatggctcattgaaataaacgcctcccccaccatggctccaagtactgccgtgactgctcggttatgcgctggagtccaggcagacacactgcgggtggttatcgaccggatgctggaccgaaactgcgatacaggcgcatttgaactgatatacaaacagcccgctgttgaagtgcctcagtatgtgggaattagactgctagtcgaggggtttacaatcaaaaagccaatggccatgtgtcaccgcagaatgggcgtccggcccgccgtgcctcttctgacacaacgcggcagcggcgaggccaggcaccactttccatcacttcacacgaaggctcagctcccgtcacctcacgtgctgagacatcaaggccaagtgttgagaaggcaacactccaagctcgtaggaacaaaggctctctctaccacaggcaaagctcttagaactctgcctactgccaaagtttttatcagtcttccgcccaacctggattttaaagtggccccaagcattctgaaaccaaggaaagcacccgcattgctctgtctgcggggcccccagctcgaagtcccttgctgcctgtgccccttaaaaagcgagcagttcctggccccagtgggcagaagccgccctaaggccaactcccgccccgactgcgacaaaccccgcgccgaggcatgtccaatgaaacggctgagccccctaaagcctctacccctggttggcacattccagagaagaagggggctgggagacatgaagcttggcaagcctctccttcggttccccaccgcgctggtgctcgatcctacccctaataagaagaaacaggttaagtacttaggattagactccatagccgtcggaggcagccgggtcgatggagctaggccctgcacgcctggaagcactgccagggcttag

SEQ ID NO: 16576 - DNA, 2463 bp, Artificial Sequence
  Description of Artificial Sequence: Synthetic coding sequence
atgcggataagtagctgttccgatgagtcttcaaattcaaattccagccgcaagtctgataatcacagcccggccgtggtcacaacaacggtctcctccaaaaagcagccttccgtcctcgtgacgttccctaaagaggagcgcaagagcgtgtctggtaaagcatccattaagctgagtgagaccatatccgaaggtacctccaatagcctttctacttgcacaaagagtggtccttctcccttgtccagcccaaatggaaaattaacagttgcttctcctaaaagagggcagaagcgggaggagggctggaaggaagtcgtccgccgtagcaagaaggtgagcgtaccctccactgttatctctagagtgatcgggagaggtgggtgtaatatcaacgctatccgcgagtttacaggagctcacatagacattgataaacaaaaagataaaacaggggaccgcatcattactatcagaggtggcaccgaatccacacgccaggccactcagctcattaacgcattgatcaaagaccccgacaaggaaattgacgagctcattcctaaaaataggctgaagtcctctagtgctaatagcaaaattgggagtagcgctcctaccaccaccgcagccaacactagtctcatggggattaagatgaccaccgtggcactctcttctacatcacagaccgccaccgctctgactgtgcctgccatcagctccgcttcaacccacaagactatcaagaaccctgtaaacaatgtccggccaggattcccagtgtccctccctctggcatacccccccccccaattcgcccatgccctgcttgccgcccaaactttccagcagattcggccccctcggctcccaatgacccacttcggcgggacctttccccccgcccagtctacatggggtcccttcccggtgagaccattgtccccagcgagagctaccaactctcctaaacctcacatggtgccccggcatagcaatcagaactcttctggcagtcaagttaatagcgccggcagtcttaccagtagccctaccactaccacaagctcctcagcttctacagtgcctgggacctctactaacggatccccgtcctccccaagtgttcggaggcagttgtttgtcacagtggtgaaaacttctaatgccaccaccaccactgtgactacaacagcctccaataataatacagcccccacgaacgctacctaccctatgccaaccgctaaagaacattatcctgtctcttccccatcatctccgtctccacccgcccaaccagggggagtgtcccgaaattcccccttagattgtgggtcagcctcaccaaacaaggtggcaagttcttctgagcaggaggcagggagtccaccagtggtagagacaactaacactaggccacctaacagcagctcctctagcgggtcttcttctgctcactctaaccagcagcagccacccgggtctgtgtcccaggagccaaggccacctctgcagcagtcccaggtgccaccacctgaagtgcgaatgactgtgcctcccctggctaccagctccgcacctgtggcagtgccttcaaccgcaccagtaacataccctatgccgcaaacacctatgggatgtccacagcccaccccaaagatggagaccccagcaatccgccctccacctcacggcactacggcccctcataagaattctgcctccgtccaaaatagctcggtcgcagtgctgtctgtaaaccacatcaaacgcccccactcagtcccaagcagcgtgcagttaccttcaaccctgagtacacagtctgcgtgccagaatagcgtgcacccagccaacaagcctatcgcacccaacttttccgccccactgccatttgggccatttagtactttgtttgaaaactcacctaccagcgcgcacgctttttggggtggatccgttgtctcttcgcagagcaccccagagagcatgctctccgggaaaagttcatatctgccaaactcggaccccctgcatcagtcggataccagcaaggcgccaggatttaggcctcctctacagagacccgcgccgtcccccagtggaatcgtcaacatggattccccatatggctctgtcacaccctcgtcaacccacctgggcaacttcgcttctaatattagcgggggccagatgtacggacccggagcacctttgggaggagccccagctgctgccaattttaaccgacagcacttctcccctctttccctgctgaccccatgcagttctgcctctaacgactcctcagctcagagtgtatccagcggtgtgagagccccatctcccgcaccaagctctgtcccgctgggctccgagaaaccttctaacgtgagtcaggacatagtcgctagcggcccattaaaaggcttggtcgccattaagactaaatag

SEQ ID NO: 16577 - DNA, 6033 bp, Artificial Sequence
  Description of Artificial Sequence: Synthetic coding sequence
atggagaaggctactgtccctgttgccgctgctacagcagcagagggcgaaggatccccccctgccgtggccgctgtggcaggacctcccgctgcagccgaagtgggaggtggtgttggaggatctagtcgcgcccgcagcgcttcttcaccgcgcggaatggtacgggtgtgtgatctactgcttaaaaaaaaaccaccacagcagcagcaccacaaggctaaaaggaaccgcacttgtcgccctccctccagtagtgagtcctcaagcgattcagacaactcagggggtggcggcggcgggggcggtggcggcggcggcgggggcgggacttcatctaataacagcgaggaagaagaggacgatgacgatgaagaagaggaggtgtcagaggtagaatcattcatattggatcaggacgatctcgagaatccaatgttagagacagcatctaaactcctgttgtcaggcaccgcggacggcgcagatctccggactgttgaccctgagacccaggctagattggaagctcttttggaagccgctggcataggcaaactgtctaccgcagacggcaaggcttttgctgatcccgaagtactgaggcgcctaacatccagtgtttcttgtgctcttgatgaggccgcggcggcgctgactaggatgcgcgcggagagcaccgccaacgccgggcagtcagataatagatccctggccgaagcctgtagcgagggcgatgtcaatgcagtgagaaagctgctgattgaaggaagaagcgttaacgagcacacggaagagggagagagcctgctgtgtctggcctgttctgctggttactacgaactggcccaagtgcttttggccatgcacgctaatgtggaagatagaggcattaagggggacatcacccctcttatggcggcggcgaatggtggccacgtcaagatcgtcaagcttctactagcacacaaagcagatgtcaatgctcaatcatcaacaggtaatactgctcttacttacgcctgtgcaggcggctacgtcgacgtggtcaaggtgctgctggaatccggggctagcattgaggaccacaatgagaacgggcatactcctctaatggaggctggcagtgcagggcatgtggaggttgccagactgctactggaaaacggcgccggaatcaatacacactccaatgaattcaaggagtccgccctaactttagcctgctacaaaggccacctggaaatggtgcgattcttgctggaagcaggggcagaccaagagcacaaaactgatgaaatgcataccgctctgatggaggcatgtatggacggacatgtcgaagtggcccgcctgctgcttgactccggggcccaggtgaacatgccggcagatagcttcgaaagccctttgacactggctgcttgcggaggtcatgtggagctagctgctttgctgattgagaggggtgcgtcgctggaagaagtgaatgatgaggggtacaccccacttatggaggcagctcgcgaagggcacgaggagatggttgcgctgctgcttggtcagggcgctaacattaatgctcagacagaggaaactcaggagaccgcattgaccttggcctgttgcggaggattcctggaagtggctgatttccttatcaaggctggtgcagacatagagctgggctgtagcacccccctgatggaggctgcacaggagggtcacctggagctagtgaagtacctgttggcggctggcgctaacgtacatgccactaccgctacgggcgatacagctcttacatatgcctgcgaaaatggtcacacagatgttgcagacgtgctcttacaagccggggccgacctggaacatgagagcgagggcgggagaacaccccttatgaaggcagctagagcaggtcacgtgtgcacagtgcagttcttgatctcaaagggcgcgaacgtgaatagaaccacggccaacaatgaccacaccgtactgagtctcgcatgtgcaggcggacacttggctgtagtcgagctgctcctggcccacggagccgacccaacccatcggctgaaagacggaagcacaatgctgattgaggcggcaaaaggcggccacactagcgtcgtctgctacctccttgattaccccaataatttgctgtccgcccccccgcccgatgtaacacagcttacccccccatcacacgacctgaatcgagcccccagagtccctgttcaggcactgccaatggtggtgcctccacaggaacctgacaagcctcctgctaacgttgccaccaccctgcctatccgaaacaaggccgcctcaaagcagaaatctagttcccacctccccgccaactctcaggatgtacaaggctacatcaccaaccagagcccagaatcgatcgttgaagaggcccaaggtaagctcactgaactggaacagcgtattaaggaggccatagagaagaacgcacagctccagagcctcgaactcgcacacgcagatcagctcacaaaggagaagattgaagagttgaataaaacacgggaagaacagattcagaaaaagcagaaaatactcgaggaattacagaaagtggaaagggagctccagctgaaaacgcagcagcagctcaagaagcagtatctcgaagtcaaggcgcaaaggatccaactacagcagcaacagcaacagtcatgtcagcacctagggctcttgacccccgtcggcgtgggggaacaactgtctgagggcgactacgcccgactacagcaagttgaccccgtcctcctcaaggatgaaccacaacagacagctgctcaaatgggctttgcccccattcagccactggcgatgccacaagctcttccattggccgcagggccacttcccccaggaagcattgctaatctcaccgagctccaggtcctctccagcctcctgcaaccctgttttcttagtacgctgccgctgatacttatgcaccgactgagagttattatgactcgacctaaatcctcttcaaccagcgagtccggagattcggataatatgcgcatctcttcatgtagtgatgaaagctctaactcaaatagtagcaggaagagtgacaatcactcgcccgcggtcgtgacaaccaccgtgagctcgaagaaacagccgagtgttctggtaacattccccaaggaggagcggaagtctgtaagtgggaaagctagcatcaaactttctgagactatttctgaaggtacctcaaactctctctccacctgcaccaaatctggccctagtccactatcttctccgaacggaaagctgaccgtggcttccccgaagaggggccagaaacgcgaggaaggctggaaggaagtagtgcgcagaagcaaaaaggtgtctgtacctagtacggtgatatcgcgggtgattggtcgcggaggttgcaatattaacgccatccgggaattcaccggcgctcacatcgacatcgataagcaaaaggataagacgggcgaccgcattatcaccatccgcggaggaacagagtctacgcgtcaagctacccagctcattaacgctctgataaaagatcctgacaaagagatagatgagttgattcccaaaaaccgtttgaaatccagttctgccaacagtaaaatcggctcttccgcgccaacgacaacggccgccaatacttcccttatgggaattaagatgaccactgtcgcactgtcaagcacctcccaaactgctactgcactgactgtgcctgcgattagcagtgcttctactcacaagacgataaagaatccagtgaacaacgtgaggccgggctttcccgtcagcctgccactggcttatccaccacctcagttcgcccacgccctgttagctgcccagacattccaacaaatccggcccccacgcttgcccatgacccatttcggagggacctttccccctgctcagtcgacatgggggcctttccccgtgagaccattgtcgcccgccagagcaaccaattcccccaaacctcacatggtgcctagacattctaaccagaacagctccggaagccaggtcaactccgctgggtctctgaccagctcaccgacaaccacaacatcatcctcagccagtactgtgcccggcacatctaccaacggtagccccagctccccctccgttcgcaggcagcttttcgtgactgtcgtaaagaccagtaatgcaactacaaccaccgtgaccaccaccgcatctaacaataacaccgccccaaccaatgcaacgtaccccatgcctaccgccaaagaacactatcctgtctctagtccaagctcaccttcgcccccagcccaaccagggggggtaagtaggaattcaccgctcgactgtggatctgctagccctaacaaggtcgcctcatctagcgagcaggaggctgggtccccccctgtagtggagaccaccaacaccaggcctcccaatagcagctcctccagtggctcctcatccgctcatagtaaccagcagcagcctccgggatctgtgagccaggaacctaggccaccactgcaacagagccaggtgcccccgcccgaagtgcggatgaccgtccccccgctagccacctcctccgccccagtcgctgtccctagcaccgcacccgtgacttacccaatgccccagaccccgatggggtgccctcagcccaccccgaaaatggaaacccccgctattcgaccgccaccacacggcacgaccgcgccacacaaaaacagtgccagcgtacagaatagcagcgtagccgtcctgtcggttaatcacatcaagcgccctcacagtgtacctagctctgtgcagctgccctccaccctgtccacacagtccgcctgtcagaatagcgttcacccggctaataagcctatcgcacccaactttagtgcgcctcttccattcggcccattttcaacactttttgagaactcccccacttcagctcatgcattctggggtggaagcgtggtgtcatctcaatccacgcctgaatctatgctttctgggaagtcctcatacctccctaatagtgatcctttacaccagagcgataccagcaaggcccctggcttccgcccacccctgcagcgccccgccccttctccgtctggaatcgtcaatatggacagtccttacggatcggtcaccccaagcagtacccacctcgggaacttcgcctcaaacatctctggcggccagatgtacgggcctggggctcctctcggtggcgcaccagccgctgccaatttcaatcgccagcacttctcacccctgagtctgctcaccccctgctcaagcgcatccaatgattcaagcgctcagtcagtgtcaagtggtgtacgggccccatcgcctgccccatcctcagtcccgcttgggtcggagaagccttccaatgtgagccaagaccggaaggtaccagttccaattgggactgagaggtccgctagaatccgtcagactggaactagtgcaccatcagtgatcggctccaatttgagtacaagcgtgggccattctggcatctggtcttttgaaggcattggaggcaatcaggataaggtcgattggtgtaaccccggaatggggaaccccatgatccacaggccaatgtccgatcccggtgtgttttcacagcatcaggctatggaacgcgacagtactggaatagtcacacctagcgggacttttcatcagcatgttcctgcaggttatatggattttcctaaggtgggaggcatgcctttttcagtgtacggaaatgccatgatccccccggtggcccctatcccagatggcgcaggcggtcctattttcaatggcccccatgccgccgaccccagctggaactctttgatcaaaatggtctccagttccaccgagaacaatggccctcaaaccgtctggacgggtccctgggctccccacatgaactctgtccacatgaaccagctggggtag

SEQ ID NO: 16578 - DNA, 1446 bp, Artificial Sequence
  Description of Artificial Sequence: Synthetic coding sequence
atggcctccgctgcctccgtcacttcactggccgacgaggtaaactgccccatttgtcagggaacactgagggaacccgtgactattgattgcggacacaatttctgtcgcgcatgtctaaccagatattgcgagatacctgggccagatctcgaggagagtcccacctgcccattgtgtaaggaaccctttagacctggctcattccgccctaattggcagcttgctaacgtcgtggaaaacatcgagcgactccagttagtgtcgaccctgggtctgggagaggaggatgtctgccaggaacatggcgagaagatctatttcttctgcgaggatgacgagatgcagctgtgcgtggtgtgtagagaggccggagagcacgctacacatacaatgagatttttggaagacgccgccgcaccatacagagagcagatacataaatgtttgaagtgccttcggaaggagagggaggagatccaagaaatccagagcagggaaaacaagcgtatgcaggtcctgcttacccaggttagcaccaaacggcaacaagtcatctctgaatttgcccatctgcgtaaattcctcgaggaacagcagagtatcttgttagcccagctagagagccaagacggcgacatcctgcggcaacgagatgagttcgatctgttggtcgccggcgaaatttgtcgattcagcgccctgatagaggaattggaggaaaagaacgaacggccagctcgggagctacttacagacatccggagcacgttgataagatgcgagactcggaagtgtcggaaaccagtggctgtgtcgcccgaactgggccagcggatacgtgattttccccagcaggccctgcccctgcagcgcgagatgaaaatgtttctggagaagctttgttttgagttggactacgaacccgcccatatctccctggacccacagaccagccatcctaagttgctgcttagtgaggaccatcagcgggctcagttttcttataagtggcagaactctccagacaacccccagcgctttgaccgcgccacctgtgtgctcgctcacaccggcatcacgggcggcagacatacttgggtcgttagtatcgaccttgcacacgggggaagttgcacagtcggggtcgttagtgaggacgtgcaaagaaagggtgaactcaggctgcggcctgaagagggtgtgtgggccgtccggctggcctggggatttgtaagtgcactaggttccttcccaacccgtcttacattgaaggagcagcctagacaggtgagagttagcttagattacgaagtcggttgggtcaccttcacaaacgccgtaacaagagagccgatctatacatttaccgcatctttcactcgcaaggtaattcctttttttggcttgtggggtcggggaagtagcttttcccttagcagttag

SEQ ID NO: 16579 - DNA, 1566 bp, Artificial Sequence
  Description of Artificial Sequence: Synthetic coding sequence
atgccaagcccgcagctgctggtactgttcggatcgcagaccggcaccgcccaagatgtctctgaaaggctcggtagagaggcacggcgccgcaggttagggtgtagggtgcaggccttggatagttatccagttgtgaatctaattaacgaaccccttgtcatttttgtatgcgccaccacaggacagggcgacccgccagacaacatgaagaacttttggaggtttatattcaggaaaaaccttccaagcaccgctctgtgtcagatggactttgctgtcctcggacttggcgattccagctacgctaagtttaactttgtagcgaaaaaactgcatcgtaggcttttgcagcttggaggaagcgctcttctccccgtctgtttgggagacgaccagcacgagctgggacttccatcaaaattcacattgctattcctgcaggaggccccaagtacagggagtgaagggcagcgggttgcccatcctgggtctcaggagcctccatccgagtcaaaaccttttttggcccctatgatctctaatcagcgggttactgggccctcacacttccaggatgtcaggctgatagagttcgacatcctggggtccgggatctcctttgctgctggcgacgtagtccttatccaaccctccaactccgcggcacacgtccagaggttttgccaggtgctggggctagatccggaccaactttttatgttgcaaccccgggagcctgacgtctcctctccaacacggctcccacagccgtgttctatgaggcacttggtgtctcactacctggatattgcaagtgtgccacggaggtccttctttgaactgctggcttgcctgagcctacacgagctcgaacgcgaaaaattattggagttttctagcgcgcagggacaagaggaactttttgagtattgcaaccggcctcggcggaccatcctggaagttctgtgcgacttcccacacactgctgctgccatcccccctgattatctcctcgacttgatacccgtgatccggcccagggcatttagtatcgccagctcactgctgactcaccccagtaggctgcagatcctggtagccgttgtacagtttcagacccggttaaaagaacctaggcggggcttgtgctcgtcttggttggcttcacttgatcccggacagggacctgtccgcgtacctctctgggtgagacctggcagcctggcattcccagagactccggataccccagttatcatggtgggtcccgggactggcgtagcgcctttccgagccgctatccaagaaagagttgctcaggggcagaccgggaacttcctcttttttggctgcaggtggagagatcaggatttctactgggaagcagagtggcaagagctggaaaagagagattgtttaaccctcattcccgccttttctcgcgagcaggaacagaaggtatacgtgcaacataggctccgcgaattaggctctctggtgtgggagttgctcgaccgccaggccacgccgtctccctgtcagagaacttcccggaaaccatag

SEQ ID NO: 16580 - DNA, 753 bp, Artificial Sequence
  Description of Artificial Sequence: Synthetic coding sequence
tgacagccttcaccagtagagcccaggggccctttctacttttgtcgccttcttctggacgacctggggatgaatagttgggatcggaggaagaactttcacctgctcaagaagaatagtaaactgttgcgtgaactcaagaacttggactcacggcaatgccgggaaactcacaagatcgctgtcttttatattgccgagggacaggaggacaagtgctccattctgagtaacgagagaggaagccaggcttatgaggacttcgtggcagggctggggtgggaggtggacctgagcacacactgcggcttcatggggggccttcagcgtaacggcagcacaggacaaaccgcgccctattatgctaccagtacagtggaagtgattttccacgtttcaacgaggatgccttctgattctgacgactccttaacaaagaagctaaggcatctcgggaacgacgaagtgcacatagtgtggagcgaacattcgcgggattaccggcgcggcattattcctaccgcatttggcgatgtcagtattatcatttacccaatgaagaaccatatgttctttatcgctattacaaaaaaaccagaggtgccttttttcggacctctgttcgacggcgccatcgtctccggaaagttgctacctagtctcgtgtgtgccacgtgtataaatgcttcccgggcagtaaaatgtctcatacccctataccagtccctctacctgttcgctcttaacgtatag

SEQ ID NO: 16581 - DNA, 345 bp, Artificial Sequence
  Description of Artificial Sequence: Synthetic coding sequence
atggttctcatcctcggacgtcgactgaatagagaggatctgggagtgcgcgattcgccagccactaagcgcaaggtcttcgaaatggacccaaaatccttaaccggtcatgagttcttcgatttttcatctggctcttcacacgctgagaatattctgcaaattttcaacgagtttcgtgattcccggttgtttacagacgttattatctgcgtggaagggaaggagttcccgtgtcatcgggctgtgctctctgcatgttcatcctactttcgggccatgttttgcaacgaccatcgcgaatcgcgggagatgctggtggagatcaatggaatcctggcatag

SEQ ID NO: 16582 - DNA, 1830 bp, Artificial Sequence
  Description of Artificial Sequence: Synthetic coding sequence
atggccagtctctcacgagcactgagagttgccgcagcccacccacgccagtctcctacccggggtatgggtccttgtaacttatccagtgcagcaggccctactgctgagaagtccgtcccctaccagcggacgttgaaagagggacagggcacttctgtggtcgctcagggaccttcccgaccacttccgagcaccgctaatgtggtggttattgggggtggcagcctggggtgccagactctttatcacttggcaaaactgggcatgtccggggctgttctgctggaaagggaaaggctgaccagcgggacaacctggcacaccgccggattgttgtggcagctgcggccctctgacgtagaagtcgagctgttggcgcatactcgccgcgtggtgtctagagaactcgaggaggaaacgggcctgcacacaggttggatccaaaacggaggccttttcattgcctccaaccgccagagacttgacgaatacaaacgcttaatgtccctagggaaggcatacggggtggaatcccacgtgttgagtccggccgagactaaaacactgtaccccttaatgaatgtggacgatctgtacgggacattgtacgtgccccatgatggtacaatggatccagctgggacttgcacaaccctggctcgagccgccagtgccaggggtgcacaggttatagagaattgtccggttacaggaattcgggtgtggactgatgatttcggagtgaggagagttgctggggtcgagactcaacatggttctatccagactccgtgtgtagtgaactgcgcaggagtgtgggcctcagctgtgggcaggatggctggcgttaaagtccccctcgttgctatgcaccatgcctacgtggtcacagaacgaattgagggtattcagaacatgcccaacgtgcgtgatcatgatgcctccgtctacctccgactgcagggggacgccctatcggtgggaggttacgaggccaatcctatattctgggaagaagtatcagacaagtttgcattcggcctgttcgacctggactgggaggtctttactcagcacatagaaggcgcaatcaatagagttccggtgctggaaaaaactggcatcaaatcgaccgtgtgcggccccgagtctttcacccctgaccataagcccttgatgggagaggcacccgagctccgaggatttttcctcgggtgcgggttcaatagcgctggtatgatgctgggcggcggttgcggccaggagctggcacattggatcatacacggtcgccccgaaaaagacatgcacggctatgacatccgccgctttcaccacagcctcacggatcacccgcggtggatcagggagcgaagtcacgagtcttatgccaagaattacagcgtcgttttcccacacgacgagcctttggccggccgtaatatgcggagggaccccctgcatgaggaactgctgggccagggatgcgtgtttcaagaacgccatggttgggaaaggcctggttggttccacccaagggggcctgctcccgtgctcgagtacgattactacggtgcgtacggctcccgtgctcacgaggactacgcttaccggagactgctggccgatgaatacacctttgccttccctccccaccatgacactattaaaaaagagtgtctggcatgccgaggggcagcagccgtgttcgacatgagctactttggcaaattctatctggttgggcttgatgctcgtaaggctgcagattggctgttctccgcagatgttagccgccccccagggctacatcgagtgcatgtgtag

SEQ ID NO: 16583 - DNA, 129 bp, Artificial Sequence
  Description of Artificial Sequence: Synthetic coding sequence
atggataacatgagccctaggttgagagccttcttgtccgaaccgattggagagaaggacgtctgctgggtagacggaatctctcatgaactggctataaatctcgtaaccaagggcattaataaatag

SEQ ID NO: 16584 - DNA, 3120 bp, Artificial Sequence
  Description of Artificial Sequence: Synthetic coding sequence
atggttagttccgcccagatggggtttaacctccaggccctgctcgaacagctgtcacaggatgagcttagcaaattcaaatacctgatcacaacattcagcctcgcccatgaattgcagaagattccccacaaggaaatggcatctctgcaggttttcgagaaaatgcatcgcatggacctcagcgagagggcaaaggacgaggtccgagaggccgccttaaaatccttcaataagcgaaaaccactgtcattgggcataacaaggaaagagagacctcccctggacgtggatgaaatgctggagaggtttaagaccgaagcccaagcttttaccgaaacaaagggtaacgtgatatgcctaggcaaggaagtctttaaaggaaagaagcccgataaagacaatagatgtcggtacatattaaaaaccaaatttcgtgagatgtggaagagttggccgggtgacagtaaggaagtgcaggtgatggccgagcgttacaaaatgctcataccattcagcaatccacgggtcctgccaggccctttttcttacacagtcgtactatacggtcccgcagggctggggaagactactttagcacagaagttgatgctcgactgggctgaggacaacctgatccataaatttaagtatgccttttatttatcatgtcgtgaattgtcacggctgggcccatgtagcttcgcagaattggtgtttcgcgattggcccgaactgcaggacgatatcccacatatcctggcacaggctagaaagatcctttttgttatcgatgggtttgatgagcttggtgcagcgcctggagccctcattgaggacatctgcggagactgggaaaaaaaaaaaccagtgcctgtgctgctggggagcctgctaaacagagtgatgctgccgaaggccgccctgctggtgactacaagaccaagagcgcttcgagatctccggatactggccgaagagcctatctacattagggttgaggggtttcttgaggaggatcgaagagcctacttcctcagacacttcggcgatgaggaccaagctatgagagcattcgaactgatgaggtctaacgcagcactcttccaactggggagcgccccagcagtttgctggatcgtctgcactacgctgaagctccagatggaaaaaggcgaggatcccgtccctacttgtcttacacgcactggccttttcttacggttcttgtgctctcgctttcctcaaggggcccagctcaggggcgctctgcgcacactcagcttactggcggctcagggcctctgggcgcaaacctcagttctccatcgagaagacctggagagactgggtgtacaagagtctgatctgcggctctttctggatggcgacatcctcaggcaggaccgggtgagtaagggctgttactccttcatacaccttagttttcagcagttcctgacagctctgttctacactctcgagaaagaagaagaagaggaccgtgacgggcatacctgggacatcggcgacgtccaaaaattgctcagtggggtcgagcgcctgcggaaccccgatctgatccaggctgggtactactctttcggactcgcaaacgagaagcgtgccaaggaactcgaggcaacatttggctgccgaatgagcccagatatcaagcaggagctgctcaggtgtgatattagttgcaagggcggacactccacagtcactgacctgcaggagctgctcggctgtctttatgagagccaggaggaagagctggttaaggaggtgatggcccagtttaaggagataagcctgcacctaaacgcggtagacgtggtgccctccagcttctgtgttaagcattgccggaacctacagaagatgagcctgcaggtcatcaaggagaacttacccgagaacgtcacagcgagcgagtccgacgccgaggttgaaagatcccaggacgatcaacacatgctgccattttggaccgacctctgtagtatctttggttccaataaagacttaatggggctcgcgatcaatgattctttcctgtccgctagcctggtgagaatattgtgcgagcagatcgctagcgacacctgtcaccttcagagggtggtcttcaaaaatattagcccagccgatgcgcaccgtaatctgtgcttggctttgcgagggcacaagaccgtaacgtatctcactctccagggcaatgatcaggacgacatgtttccggctctctgcgaggtgctccgacaccctgagtgcaatttacgctacctgggtctggttagctgttccgctacaacacagcagtgggccgacctttcattggcgctggaagtgaaccaaagcttgacctgtgtgaacttatccgataatgaactgctcgatgagggggctaagctcctgtataccacactgagacacccaaagtgttttctgcagaggctgtctctggagaactgccacctgacagaagcaaactgcaaggacctggcagctgtgctcgtcgtgtcaagggaacttactcatttgtgtttagccaagaaccccatcggtaacaccggcgttaagtttctttgtgagggtcttcgctatcccgagtgtaagctgcagacactggttctctggaattgtgacattacttccgatggctgttgtgacctgactaagctgctccaggagaagtcctcccttctttgcctcgatcttggtcttaaccatatcggtgtgaaaggaatgaagtttctctgtgaagccttgaggaagccgttgtgcaatttacgatgcctgtggctgtggggttgcagtatccctcctttctcatgcgaagacctgtgttctgcccttagctgcaaccaaagccttgtgacactagacttgggacagaatcccctcggctccagtggtgtcaagatgctgttcgaaacactgacgtgctcctccggtaccctgcgcacgctgaggttgaaaatcgacgattttaacgacgaattaaacaaactgctagaggagatcgaggagaagaacccccagctgatcattgacacagaaaagcaccatccatgggccgaacggccttcctcacatgactttatgatttag

SEQ ID NO: 16585 - DNA, 1899 bp, Artificial Sequence
  Description of Artificial Sequence: Synthetic coding sequence
atggacactatgatgctcaatgtgaggaacctgttcgaacagctggttcggagagtagaaatcttgagcgaaggtaacgaggtccagttcatacagctggccaaagacttcgaagattttaggaagaagtggcagcgcacagatcatgagcttggcaagtataaagacctgctcatgaaagccgagacagagcgatctgctctggacgtgaaacttaaacacgccagaaatcaagtggatgttgaaattaagcggcgccagagggccgaggccgactgtgagaaacttgaaaggcaaatacagctgatccgagagatgctgatgtgcgatacaagcggatctatccaactgtccgaagagcagaaatcagcactcgctttcttgaaccgcgggcagccttcgtcctcaaatgctggtaacaaacgcttgtccaccatagacgaaagcggctctattcttagtgacatcagtttcgacaagaccgacgagtccctcgactgggacagttcactggtgaagacattcaaacttaaaaaaagggaaaagcgccgctcaacatcccggcagtttgtcgatggtccccctgggcccgtgaaaaagaccagaagcatcggaagcgcagttgatcaggggaacgagtccatcgtggctaagaccacagttaccgttcctaacgacggcgggccaatagaggctgtatctacaattgagacggttccatattggacccgaagccggaggaagaccgggacactccaaccatggaactccgacagtactctgaattcgcggcagctggaaccaaggaccgaaactgattctgtcggaacaccccaatccaatggcggaatgcggcttcacgattttgtttccaaaacagtgatcaaaccggaatcctgcgtgccatgcggcaagaggattaagtttgggaaactgagccttaagtgccgcgattgcagggtggtgtctcaccccgagtgccgcgataggtgtccattaccatgtattccgactcttatcgggacaccagtgaaaatcggagaggggatgctcgccgactttgtgtcacagaccagcccaatgattccttcaattgtggtccactgcgtcaacgagatagaacagaggggactaactgagaccggcctgtatagaatatcaggctgtgaccggacggtgaaggaattgaaagaaaagttcctgcgggtgaagacagttccgcttctctcaaaagtagacgatatccatgccatttgctctcttttgaaggacttcctaagaaacttgaaggagccactgcttacttttcgactcaaccgagcatttatggaggccgccgagataacagacgaagacaattcaatagccgctatgtaccaggccgtcggcgagttgccccaggccaaccgtgacacacttgctttcctgatgatccacctccagcgggtggcacagtcaccacacacaaaaatggatgtggccaatttagccaaggttttcggtcctacaattgtggcccacgcagtccctaatccagaccccgtcaccatgcttcaggacatcaaaagacaacctaaagttgtggagcggttgctgtccctccctcttgagtactggtcacagtttatgatggtggagcaagagaacatagatcccctgcacgtcatcgagaatagtaacgcttttagcaccccccagaccccagacattaaagtttcacttctggggcccgtgacaactccagagcatcagctgctcaaaactcccagttccagctccttatcccaaagggtgcggagtaccctgaccaaaaataccccacgatttgggagtaaatctaaaagtgctacgaatttgggaaggcaggggaatttttttgctagccccatgctgaagtag

SEQ ID NO: 16586 - DNA, 189 bp, Artificial Sequence
  Description of Artificial Sequence: Synthetic coding sequence
atgagtatctcaagtgacgaggtgaacttccttgtgtacagatatttgcaggaatccggcttctctcactccgcgtttactttcggtatcgagtcacatattagtcaaagtaatatcaacggcgccctggttcccccagccgctctgatatcaatcatacaaaagggattacaatacgtcgaggcatag

SEQ ID NO: 16587 - DNA, 417 bp, Artificial Sequence
  Description of Artificial Sequence: Synthetic coding sequence
atggagccctccgcacaacagctgcagctggcagcttctctgccagcaaacctttccaacttctgccagggaagtgaaatgccgaccacaagtcgaccagcgcttgatgtcaaaggtggcacaagcccggctaaggaagacgccaaccaggaaatgtcttctgtggcgtatagtaacctggctgtgaaggacaggaaagctgtggcgatcctgcactacccgggcgtagcgagtaatggtacaaaggcctctggagctccaacctcatccagcggaagcccaatcggtagccctaccaccactccaccgaccaagccaccctctttcaatttacaccctgctccgcatctcctggcaagtatgcatcttcagaaactgaatagtcagtaccagggaatggcggcagcaacgccctag

SEQ ID NO: 16588 - DNA, 1473 bp, Artificial Sequence
  Description of Artificial Sequence: Synthetic coding sequence
atgaacggggccctcgatcattctgatcagcctgaccccgacgccatcaagatgtttgtgggccagatcccccggtcctggtcagagaaggaactgaaggagctttttgaaccgtacggggctgtctatcagattaacgtgctgagagaccgcagtcagaaccccccacagtccaagggctgctgtttcgtgaccttctatactagaaaagccgctctcgaagctcagaatgcgctgcacaatattaagacacttccaggcatgcaccatcccatccagatgaaaccagccgacagtgaaaagagtaacgctgtcgaggatagaaagctcttcatcgggatggtgagtaagaagtgtaacgaaaacgacattagagtgatgttttccccttttggccagatcgaggagtgtcggattctgcgtggtcccgacggactgtcaaggggatgtgcattcgtgacattctcaactcgtgctatggcccagaacgcaatcaaagcgatgcaccagtcacagacgatggaaggatgcagctcccctatcgtggtaaagttcgccgatacgcagaaagacaaggagcaacggcgactacagcagcagctcgctcagcagatgcagcagctgaatacagcaacatgggggaatctgacagggcttggcgggctcacaccacaatacctggccctgctccagcaagccacgtccagctcaaatctcggagcattctcaggaatccagcagatggctggtatgaatgcgctgcagctccagaacctagctacactagctgcagctgcggccgcagcgcagacttccgctacctctaccaacgccaaccccctgagcacgacctcatcagcactcggcgcattaacatccccggttgcagccagcacccctaactccacagcaggagccgctatgaacagcctaacatcgctgggtacgcttcaaggtctggcaggagccaccgttgggttgaacaacatcaatgccctcgctgtggctcagatgctgtccggaatggcagcgctgaatggggggctaggtgccaccggcctgactaacggaacagctggcactatggacgccctgactcaggcatacagcggtattcaacagtatgcggccgcagcgctgcccactctgtactcccagtctctgttgcagcaacagtctgctgctgggtctcagaaggagggtcccgagggggcgaaccttttcatctatcatctgcctcaagaatttggagaccaagacattctacagatgtttatgcccttcggaaatgtgatatccgccaaagtgtttatcgacaagcaaacaaatctgagtaagtgcttcggattcgtcagctatgacaacccggtttctgcacaggcagcaatccaggcaatgaatggattccaaatcggtatgaaacgccttaaagtgcagttgaagcgcagcaaaaacgactctaaaccctactag

SEQ ID NO: 16589 - DNA, 357 bp, Artificial Sequence
  Description of Artificial Sequence: Synthetic coding sequence
atggcttcaagcgcacgtgagcacctgttattcgtcagacgacgcaatccgcaaatgcgatatactctcagcccagaaaacctgcagagtctagctgctcaaagctccatgcccgaaaatatgactttacagcgagctaatagcgacaccgatctggttacaagtgagtccaggtcaagtctgaccgccagcatgtacgaatacactttggggcaggcccagaacctgattatattttgggacattaaggaagaagttgatccgtccgattggatcgggttatatcacatagatgaaaacagtcccgctaatttttgggactctaaaaatcggggggtgacaggaacgcaaaagtag

SEQ ID NO: 16590 - DNA, 1620 bp, Artificial Sequence
  Description of Artificial Sequence: Synthetic coding sequence
atggcaacatccgcccctcttcgatccttggaggaagaagtgacgtgcagtatttgcctggactatctgcgcgaccccgtcaccatcgactgcggacacgttttctgccgttcatgcaccacagacgtgcgcccaatatcggggagtcggcccgtctgccccttatgcaagaagccgttcaagaaggaaaatattagaccggtttggcagctcgcatctttggtggagaacattgagagactcaaagtagacaaggggagacagcccggcgaggtgacgcgggagcagcaggacgccaagttgtgtgagcgacatagggagaaactgcactactactgcgaggacgatggaaagctactgtgcgtgatgtgtcgggaatcacgagagcatcgtccacatacggcggtcctgatggaaaaggccgcccaaccgcacagagagaaaattttgaaccacctgagtaccctgcgtcgggacagggacaaaatccagggatttcaggctaaaggagaagctgatatattggcagctcttaaaaagctgcaggatcagagacaatacattgtcgcagagttcgaacagggccaccagtttttgagagagcgggaagagcatctgctggaacagctggccaaactggaacaggaattgactgaaggcagggagaagttcaaaagccggggtgtaggggaactggcgcgactcgccctcgtcattagcgaactagaagggaaggctcagcagccggccgccgaactgatgcaagacactcgtgattttctgaacagatatcctcggaaaaagttctgggtgggaaaacctatcgcacgtgtggtgaaaaagaaaaccggagaatttagtgataagctcctttcacttcagagaggcttgcgggaatttcagggcaaactccttcgggatctcgagtataaaacagttagtgtcacacttgaccctcaatcagcctctggctatctgcaattgtctgaggactggaaatgcgtgacgtatacatctctgtacaaatccgcctatcttcatccccagcagttcgattgcgagcctggggtcctcggaagtaagggtttcacctggggcaaagtttactgggaggtggaagtggagagagagggctggagtgaagacgaagaagagggggatgaagaagaagaaggtgaagaggaagaagaagaggaggaagcaggttatggtgacgggtacgacgattgggagaccgacgaggacgaagaaagcctgggcgacgaggaggaggaggaagaggaggaggaggaggaggttctggagtcctgtatggtcggggtggcaagggacagtgtgaaaaggaagggggatctttctctgcgtcctgaggatggagtgtgggcactccgcctgtcatccagtggaatttgggccaatacctctcctgaggcagagctcttccctgctctgagacctaggcgcgtgggaattgctctcgactatgaaggcggcactgttaccttcacgaacgccgaaagtcaagaactgatttatacattcacagccactttcacccgacgcctcgtgccattcctctggctcaagtggcctggaacccggttattactgcgtccctag

SEQ ID NO: 16591 - DNA, 270 bp, Artificial Sequence
  Description of Artificial Sequence: Synthetic coding sequence
atgtctgagcagggtgaccttaaccaagcaatcgccgaggaaggcggcactgagcaggagacggccactcctgagaacggaattgtgaaatccgagagcctggatgaagaagagaaactggaactgcagcgacgcttagaagctcaaaaccaggagcggcggaaatccaagagtggggcggggaaggggaaacttacgcgcagccttgccgtctgtgaagagtcttctgcccgcccgggaggcgagagtttacaagaccagactctatag

SEQ ID NO: 16592 - DNA, 909 bp, Artificial Sequence
  Description of Artificial Sequence: Synthetic coding sequence
atggtgaccgagcaggaggtggatgctattggccagaccctggtcgatcctaaacaacccctacaagcccgctttcgggcgcttttcaccctgcggggactaggaggcccgggcgccatcgcctggataagtcaggcgttcgatgatgactcagcactcctgaaacatgagttagcatactgcctaggtcagatgcaggatgcgagagccattccgatgttggttgacgtactgcaggacacccgccaggaaccgatggtgagacacgaagcgggtgaggctctcggagctatcggagatcctgaagtgctggagattctgaaacagtattcttctgacccggtcattgaagtggccgagacctgccagctggctgtgagaaggcttgagtggctgcagcagcatggtggagaaccagccgcaggtccatacctgtcagtggaccccgccccccctgcagaggagcgagacgttgggagactgcgggaagctttgttggacgagagccggcctctctttgagcgttaccgagccatgttcgcccttcgtaacgcagggggagaggaagctgcccttgcccttgcggaggggctgcactgcgggagcgctctttttcgacatgaggtcggatatgttctggggcagttacagcatgaagcagcagtgccccagctggccgcagccctcgcacggtgcacagagaacccaatggtcagacacgaatgcgccgaggccctcggggctatagcaagaccagcttgtctggccgccttacaagcgcatgcggatgaccccgagcgcgtggtgcgtgaaagttgtgaagtggccctcgatatgtatgagcacgagaccggccgggcgtttcagtacgcagatgggctagagcagttgaggggcgcccccagttag

SEQ ID NO: 16593 - DNA, 1521 bp, Artificial Sequence
  Description of Artificial Sequence: Synthetic coding sequence
atgtcagtcttgtcaccaggcgacctgaaacctaagagaggtagcccgcaccgcggttcgcttgataggacggatgcctccacagacctggccatgcggtcatggccatcggagctcggctcgcgcacctgctctacttctgctactaccacagccccaagcaattccacgcctatcgcccgccacccaggaaggacaaaggggtataatagcgatgacaacctgtgtgagcctagtctcgaattcgaggtgcccaaccaccggcagtacgtttcccgtcccagctctctcgagagctcaagaaacacatctagtaactcctcccctctcaaccttaaggggtcaagcgaacagcttcatgggcgctcggaatcattcagcagtgaggacctgatcccctcaagagacctggccactttgccccgcgaggcatccacacccggaaggaacgctctagggaggcacgaatacccacttccccgcaatgggccgctcccccaagagggagcacagaaaagaggaactgcaccaccctacgtgggcgttagaccctgctctgctagcccttccagcgagatggtgacactggaggaattcctggaggaaagtaaccggtctagtcctacccatgatacccccagttgccgggatgacctcctgtccgactatttccgtaaagcatcggacccccccgccataggcggccagcccggtcctccggcgaaaaaagaaggcgcaaagatgcctactaacttcgttgcccctaccgtgaagatggcggctcccaccagtgagggtcgccccttgaaacctggccagtacgtcaaacctaactttcgcttaacagaagctgaggctcctccaagcgttgcgcctcgccaggcacagccaccgcagagtctctctcttggaaggccgcgacaggctccagaggctctgggggggagagagacaggtagccacacgttacagagtcctgcacccccttcctctcattcactcgcccgcgagcgaacacctctggttggaaaggccggcagcagttgccaggggcctgggccaaggtcccggccactcgacacgagaaggttttcattagcccctcctaaagaggaacgcctagcacccttgcaccagtctgccactgctcccgcgattgccaccgctggtgccggagcagctgctgccgggtcgggtagtaactcccaactgctgcacttctctcccgccgcggcacccgccgcacgcacaaaaccaaaggcccccccacgtagcggggaagttgccacgatcacccccgtacgcgctggtctctcactgagcgaaggcgacggcgtgcccggacaggggtgcagcgagggattaccagcgaagtctcccgggcgcagcccagatcttgcccctcacctgggacgtgctctcgaagattgcagcagaggatcagtatccaagtcctctccagcctccccagagcccggaggcgacccacaaaccgtctggtacgaatatggttgtgtctag

SEQ ID NO: 16594 - DNA, 678 bp, Artificial Sequence
  Description of Artificial Sequence: Synthetic coding sequence
atggcccagacagtgccaccttgtgagctgccatgcaaagaatacgacgttgctagaaacacgggtgcgtatacgtcaagcggcctggccacggccagcttcaggaccagtaagtacttactagaggaatggtttcagaattgctacgcacgctaccatcaggcttttgcagacagagatcagagcgagagacaacgtcatgagtctcagcagctggcaactgaaacacaggcacttgcacaacgtacacagcaggactctaccaggacagtcggcgaacgtttacaggacactcattcctggaagagcgaactgcaaagagagatggaagccctcgcagccgaaacaaatcttctattagcacagaagcagaggctcgagagagcactggatgctaccgaggtgcccttcagcattactaccgataatttgcagtgcagggagcgaagggagcatcccaacctggtgcgcgaccacgttgaaaccgaacttctcaaggccctgcctcctgccttgagtcagtgcctgaagaactcatgttcctcgagaaagctgtctgccagaaataagggtacgtgtcagctgatggagaccttgactgtgcatggcgaggcaaatcccggaattgagggaagacgaactcgtgcgttagcccacaaggaggtcccgagcggctag

SEQ ID NO: 16595 - DNA, 309 bp, Artificial Sequence
  Description of Artificial Sequence: Synthetic coding sequence
atggccaatgactcacctgctaagtcactcgttgatatcgacctgagcagtttacgggacccagccggtatctttgagctggtcgaggtggtggggaatggaacatacgggcaagtttacaagggccgacacgtgaagaccgggcagctcgccgccatcaaagtgatggatgtcaccgaggacgaagaagaggagataaaactggagattaacatgctaaaaaaatatagtcatcatcgaaatatcgcaacctactatggggccttcatcaaaaaatcaccgccaggccacgacgaccagctatggtag

SEQ ID NO: 16596 - DNA, 369 bp, Artificial Sequence
  Description of Artificial Sequence: Synthetic coding sequence
atggcgacgtctgcacccttgcggtccctggaggaggaagtaacctgtagcatctgtctggactacctccgggacccagtcacgatcgactgtggccacgtattctgcagatcttgcaccaccgacgtccgccccatcagtgggagtagaccagtctgcccactgtgcaagaagccattcaaaaaagagaatattagacctgtctggcaactagcaagcctcgtggagaatattgaacgcttgaaggttgataaaggtcgacaacccggcgaagttacgagggagcagcaggatgctaagctgtgtgagcggcatcgagagaagctccactactactgcgaggacgacgggaagctcctgtgtgtgtag

SEQ ID NO: 16597 - DNA, 312 bp, Artificial Sequence
  Description of Artificial Sequence: Synthetic coding sequence
atgagtggagggctgctcaaggccttgagatcagactcctacgtcgaactatcacagtacagggatcagcacttcagaggggataatgaagagcaggagaagctgctgaaaaagtcctacgctgagaatgcaatgagatacataaatggaactcgactggatgataggattatccggacagattgggatgctgggttcaaggagggcaggcaatatgggcgcggccgctctgggggtcaagtgcgagacgagtaccgccaagattatgacgccgggcgaggggggtatggaaagttggcccaaaaccagtag

SEQ ID NO: 16598 - DNA, 894 bp, Artificial Sequence
  Description of Artificial Sequence: Synthetic coding sequence
atgtggccttttccgagcaggtctctgtttccccccccgacgcaggcttggctgcagaccgtcagtagcgaccctgaggctcagggctggggcgcatggaatgaaactaaggagattcttggcccagagggtggtgagggcaaggaggagaaagaagaagaagaggatgctgaggaagaccaagacggcgatgccgggtttctgctgtcactgctggaacaggagaacctggccgagtgcccgctgcctgaccaggaactggaggctattaaaatgaaggtctgtgcaatggagcaggctgagggaactccgaggcctcccggcgtccagcagcaggcagaagaagaagagggcacggccgcgggccagctgctgtccccagagactgtgggctgccccttgagcgggactcctgaggagaaggttgaggcagatcataggagcgtgtatgttggaaatttgtgcctccaccgggtctgtcaccaagggcttagagcgggtcgaagaggcgcagggcccgaacccttgccaggccccgggcaccagggagccgccgagaagaatcagctgccttgggatcagcttcatcgaccccgaggtccaagccgcacaccacgcctgcaaggtggaacacttcccccccaacgcccaccaggtcaggcaccagcccagacgaccagggctgagcccggcccctggaagatcttaactatggtctttactgtcctgaagggacgccccgatttcgagcggggcgctggggcgtggatccgttccaaaccgttggtgctgcatccgggggccggcgctggaagtggcgctggagccagaccagaggaacgcggagttcagagctctcactggccacccctgggaggaggcatggcccaatag

SEQ ID NO: 16599 - DNA, 1059 bp, Artificial Sequence
  Description of Artificial Sequence: Synthetic coding sequence
atggacatcgataaggatttggaagctccactttacctcacaccggaagggtggtccttgtttctgcagcgctactatcaagtcgttcacgagggcgccgaactgagacacctagatacccaggtgcagaggtgcgaggacatccttcagcagctgcaggccgtggtgccacagatagacatggaaggcgatcggaacatctggatcgttaaacccggcgcaaagtcacgaggccggggtattatgtgcatggatcacctcgaggagatgctcaaattggtgaacggtaaccctgtagtgatgaaggacggcaagtgggtggtgcagaagtacatagagcgtcccctcctgattttcggaacaaaattcgaccttcggcagtggtttctcgttaccgactggaatcccctcactgtgtggttttatagggatagctacatacgcttttccacccaaccattctccctgaaaaatctcgacaacagcgtccacctgtgcaacaactccatacagaagcacctggagaattcatgtcataggcatcctctactgcctcccgacaatatgtggagttcgcagcggtttcaggcccacctacaggaaatgggtgctcccaatgcgtggtctaccatcattgtcccaggcatgaaggacgccgtcattcacgccttgcaaacaagccaggataccgtgcagtgcaggaaagcctcattcgagctctatggcgctgatttcgtcttcggcgaggactttcagccctggttgatagagatcaacgcttcaccaaccatggcaccatctacagctgtgacggcgcgactgtgtgccggcgtgcaagccgatacgctaagagtagttattgacagaatgttggatagaaactgcgacaccggagcctttgagttaatctataaacagccagtgaccacctcgccggcctccacaccaaggccttcatgtctgctgccgatgtattcagatacacgagctagatccagcgatgatagtaccgcctcttggtgggcgttacgaccctgtcgtccacaggccagaccgtag

SEQ ID NO: 16600 - DNA, 363 bp, Artificial Sequence
  Description of Artificial Sequence: Synthetic coding sequence
atggagttagacctgttcctgggcctcgatgatgtgtttcctcggttactccatggcctgctccatagagcattttccgtttttcttttcaacacagaaaataagttgttactgcagcagcggtcagatgccaagattacctttccaggctgttttactaacacgtgttgcagccatcctctgagcaatccagctgagctcgaagagagcgacgcgttgggcgtgaggagagccgcccagcggagattgaaagctgaacttggcatccccctagaggaggttacctcctctccgacccaaccatataagcttaagcccaagcacaccatcaaacggtttttaataaagtttctgaactcatag

SEQ ID NO: 16601 - DNA, 339 bp, Artificial Sequence
  Description of Artificial Sequence: Synthetic coding sequence
atggaggaaatacctgcccaggaggccgcgggttccccccgggtacaattccagtccctagaaacacagagcgagtgtctgagtccagaacctcagtttgtgcaggatacggacatggagcaaggcctgacggggggctttccaatctcaaagcctgatggtataagccaactggaacaagacctccaggttttcgatctggagaccaaaacgagggaggtgctaagagatgactgttcagatggagagacacgtgaggaaaataaacttctaatccccaagcagaagatctccgaggaagtccactcttacaaggtgagagtaggtcggctaaaatag

SEQ ID NO: 16602 - DNA, 1818 bp, Artificial Sequence
  Description of Artificial Sequence: Synthetic coding sequence
atgagcgaaatcttgaagcagaaggatactgaaccgacaaattttaaagtggcagccggaaccctagacgcatcaacaaaaatctatgcagttagagtggacgcagtacacgcagacgtgtatcgagtgttgggcggtctgggaaaggatgcaccctctcttgaggaagtggagggccacgtggccgacggatctgccactgagatgggcacaaccaagaaagcagtgaagccaaagaagaagcaccttcacagaacaatagaacagaatattaataacctcaatgttagtgaagcagacaggaaatgcgaaattgacccgatgttccagaagaccgctgctagttttgacgagtgttctactgctggggtgttcctgagcaccttacattgccaagattacaggagcgaactgctctttccatcggacgttcaaacacttagtaccggcgaacctctagaactgcccgagctgggctgtgtggagatgacagatctgaaagccccacttcaacaatgtgcggaagatcgacaaatctgtccttcactggcaggatttcagttcactcagtgggatagtgaaactcacaacgaatccgtgagcgccctcgtagacaagtttaagaaaaacgatcaggtcttcgacataaacgctgaagtggatgaaagtgattgcggtgactttcctgacggatctctgggggacgacttcgatgcaaacgacgagcctgatcacaccgctgtgggtgatcatgaggagttcaggtcttggaaggagccctgtcaagtgcagagctgtcaggaagaaatgatctctctgggggatggcgacatcagaaccatgtgtcccctactgtctatgaagcctggcgagtactcctactttagccctagaacaatgtcaatgtgggccggaccagatcattggagatttcgcccccgccggaagcaagatgcgccgagccagtctgaaaataaaaaaaaatcaactaagaaggattttgagatcgattttgaggatgatattgatttcgacgtctacttcagaaagactaaagccgcaacgatcctcaccaaatccactctcgaaaaccagaattggcgcgccacgactctgcctacagactttaactataatgtcgacaccctcgtacaactccatctgaagcccggaacaagactgctgaaaatggctcaggggcacagggtggagactgaacattatgaagaaatcgaggattatgactataataacccgaacgacacctcaaacttttgtcctggcctgcaggctgctgacagcgatgacgaagaccttgatgaccttttcgtcggccccgtgggaaacagcgatctctctccatatccctgtcatcctccaaagacggctcagcagaacggtgatacccccgaggctcaggggttggatattactacatacggggagtcaaatttagtggccgagcctcaaaaagtgaacaaaatcgaaatccattacgccaaaaccgcaaaaaaaatggacatgaagaaactgaagcaatcaatgtggtccttgctcacggccctgagcggcaaggaagcagacgccgaggccaatcatagggaagctggcaaggaagccgcattggccgaggttgcggatgaaaagatgcttagcggcctcacaaaggatctacagcgctcactgcctccggtgatggcacaaaacctgtcaatccccctggcctttgcgtgtttactgcacctggccaacgaaaagaatcttaaactggagggaacagaggatttgtctgatgtcctggtgcgacagggcgattag

SEQ ID NO: 16603 - DNA, 2253 bp, Artificial Sequence
  Description of Artificial Sequence: Synthetic coding sequence
atgtcgtcttcaccagtcaatgtcaagaagctgaaagtgtccgagctgaaggaagagctcaagaaacgcagactatctgacaaagggctgaaggcagagctcatggaaagactgcaggcggctttagacgatgaggaagccggcggacggccagctatggagcccggaaacggggatgaccagggcttccaagagggagaggacgagctcggggacgaagaggagggcgccggcgatgagaacgggcatggggagcagcaacctcagccccctgctactcagcaacagcagccccagcagcagcggggagcggctaaggaggccgccggcaaatcatcaggccctacttctctcttcgccgtgacagtggcccctcctggggcgcgtcaaggtcaacaacaggccggtggcaaaaaaaaagccgaggggggaggcgggggcggtagacctggcgcaccagctgccggcgatggcaagacggagcaaaaagggggcgacaagaaacggggtgtcaaaaggccccgcgaagaccacgggaggggttacttcgaatacattgaggagaacaaatactctcgcgccaaatcccctcaaccaccggtggaggaggaagacgaacactttgacgacaccgtcgtgtgtctggatacctacaattgcgacttgcattttaagatatctagggataggctctccgccagcagcctcacaatggaatcctttgcattcttgtgggcaggaggcagggcttcttatggggtgagcaaaggtaaagtttgcttcgaaatgaaagtgaccgagaagatccctgtgaggcatctttacaccaaagatattgatattcatgaagtccgcataggctggtccttaactacgagtggaatgctccttggcgaagaggagttttcctacggttactcgctgaaaggtattaagacatgtaactgtgagacggaagactatggtgaaaagttcgatgaaaatgacgttatcacatgcttcgccaacttcgagtctgatgaggtcgagttgagctacgccaaaaatggacaggatctgggggttgcattcaaaatctcaaaggaggttctggccgggaggcctctgtttcctcacgtgctgtgtcataactgcgccgtggaatttaatttcggtcagaaggagaagccctacttccctattcccgaggagtacacgtttattcagaatgttcctctggaggacagagtgaggggcccaaagggcccagaagaaaaaaaagactgtgaagtggtgatgatgatcggtctcccgggcgctggtaaaacaacctgggtgacgaaacatgccgcagagaaccccgggaagtacaatatccttggaacgaacaccataatggacaagatgatggtcgcagggttcaaaaagcagatggctgacactgggaaactgaataccctcctccaacgggcgccacaatgcctcggaaaattcattgagatcgccgctcgcaaaaagcgtaatttcatcctcgatcaaactaatgtgtccgccgctgcacagagacggaagatgtgcctcttcgctggcttccagagaaaggcagtggtcgtatgccccaaggacgaagactacaaacagagaactcagaaaaaggccgaggttgagggcaaggatctccccgagcatgctgtattgaaaatgaaggggaattttacacttccagaggtcgccgaatgctttgacgagatcacttacgtggagctgcagaaagaggaggctcagaaacttcttgaacagtacaaggaggagagtaaaaaggctcttccacctgagaagaaacaaaataccggttctaaaaagagtaacaagaataagtctggcaagaaccagttcaaccgcggaggcggacataggggaagaggcggcttcaacatgcgcggcggtaacttccgaggcggggcgccaggaaaccgcggcggatacaatcgacgtggcaacatgccccaaaggggaggcggggggggagggtcgggcgggatcggatatccctacccccgggctccagtctttcccggccgcggttcctatagcaatcggggaaattacaataggggggggatgcctaaccgggggaattacaaccagaactttcgcggtcgtggaaacaatcgtggatataagaatcagtctcagggctataatcagtggcaacagggacaattctgggggcagaagccgtggagccaacactaccatcaggggtattattag

SEQ ID NO: 16604 - DNA, 804 bp, Artificial Sequence
  Description of Artificial Sequence: Synthetic coding sequence
atgtgggatcagcgacttgttaaactagccctcctccagcacctgcgcgcattttatggtattaaagttaaaggagtgcgggggcagtgtgaccgacgacggcatgagaccgctgcgactgaaattggagggaaaatattcggtgtccccttcaacgcgctgcctcacagtgctgtaccagagtacgggcatatcccttctttcctggtggatgcctgcaccagtctggaagaacatattcatactgaagggctattccgcaaatctggttccgtgatccggttgaaggcgttgaaaaacaaggtggatcatggggaaggctgtctgagttccgcacctccttgcgacatcgcggggctattaaaacagttcttccgcgagcttcccgagcctatactccctgcagatctccatgaagcgctgctaaaggcacagcagttgggaaccgaagaaaagaacaaagcaatactgctactgtcatgcttgttggccgatcacacggttcacgtgctgcgatatttttttaacttccttcgcaacgtgtctcttcggtccagcgaaaacaagatggattcctccaacctggctgtaatctttgcgccaaacctgcttcagacaagcgaaggacacgaaaagatgtcctccaatgccgagaaaaaaggtgtttatcagacgctgagttggaagcgataccagccttgttgggtgttgatggtttctgtgctgttacaccattggaaagctttgaagaaagtgaacatgaaattgctcgttaatattcgggaaagagaggacaacgtttag

SEQ ID NO: 16605 - DNA, 600 bp, Artificial Sequence
  Description of Artificial Sequence: Synthetic coding sequence
atgccacataagattggtttcgtggtcgtaagttcaagtggccatgaagacggattttctgccagagaactgatgatccatgcacccactgtgtcaggttggaggtcaccgtcatacgtcagcctgtgcgacaacgagaagaccggctgcaaagctcgggaacttaaatccgtgtacgttgacgcagtcgggcagtttctgaaattgatattccaccaaaaccacgtaaacaagtataacatctacaaccaggtggcactggtagccattaacattatcggagatcccgccgacttcagcgatgaaagcaacaccgcatcacgcgaaaagcttatcgatcactatcttggtcacaacagtgaggaccccgcactggagggtacctatgcgaggaagtccgactatattagtcccctggatgacctggcttttgatatgtatcaggacccggaagtggcccagattatccggaagctggacgagcggaaaagggaagctgtccagaaggaacgctacgattatgccaagaagttaaaacaagctatcgctgacctgcaaaaggtcggagaaagactgggtcgctacgaggttgagaagtag

SEQ ID NO: 16606 - DNA, 471 bp, Artificial Sequence
  Description of Artificial Sequence: Synthetic coding sequence
atgaccgaggactctcagaggaactttagatccgtgtactatgaaaaggttgggtttcggggtgtggaagagaagaagtccctggagatcctgctgaaagacgatcggctcgacacagaaaagctatgcaccttctcccagagatttccgctcccctcaatgtatcgggccctcgtgtggaaagtgctgctggggatcctgcccccgcaccatgagtcccacgcaaaagtgatgatgtaccgcaaggaacaatacctggatgtgttacatgcactaaaagtagtgaggttcgtgtctgacgccacgcctcaggcagaggtttatttacggatgtatcagctcgaatcagggaagctccctagatctccttctttccccttggagccagatgacgaagtctttttggcaatcgcaaaagctatggaggaaatggtcgaggattcagtcgactgttactggatcacacgctag

SEQ ID NO: 16607 - DNA, 2730 bp, Artificial Sequence
  Description of Artificial Sequence: Synthetic coding sequence
atgattcggcacgcgggtgctcccgcacgcggtgatccaaccggccctgtcccagtggtgggcaagggagaggaggaggaagaggaggacgggatgcggctgtgcttgcccgccaatccaaaaaactgcttaccccacaggagaggcatttcaattttagaaaaactgatcaaaacctgtccggtctggttgcagctatcattaggacaggccgaagtagcaagaatcctacatcgagtggtggcgggcatgtttcttgtgcgcagggactcgagtagcaagcagctggtcttgtgtgtgcattttccatcactgaacgagtcaagcgctgaagtgctggaatataccataaaggaggaaaagagcattctttacctggagggatctgccctggttttcgaagacattttcaggttaatcgcattttactgcgtgagcagagatcttctgcccttcacgctgagactgccacaggcaatcctggaggcatcgtccttcaccgatttggagactattgccaatctaggtctgggtttctgggactctagtctcaacccccctcaggaacgtggcaaacccgccgaacccccccgggacagggctcccggattccccctggtgagctccttaaggccaaccgctcacgatgccaactgcgcctgtgaaattgagctctcagttggaaatgaccggttgtggtttgtgaaccccatctttattgaggactgttcttccgcgctgccaaccgaccagccacccttagggaattgtcccgctcgccctctgccaccgacatctgacgctaccagccctacatcccggtgggcacccaggagaccccctcctccgccgcctgtgctgcccctgcagccctgctctcctgcccaaccgccgccccttcccgctaaaaagaatctgccaactgctccacctcggcgccgcgtttctgaaagagtctcgcttgaggaccagtctcctggaatggccgctgagggagatcagctatccctaccacctcaaggaacctctgacggcccagaagacacgccaagggagtctaccgaacagggccaggataccgaagtgaaggcctccgatccacacagcatgcctgaattgcctagaaccgccaagcagcctcctgtacccccaccgcgcaagaaacggatctctcgacagctggcgtcgacactgccagcgcccttagagaacgctgaactgtgcactcaagccatggcgctggagacccctacgcccgggccccctcgcgagggacagagtcctgctagtcaggctggcacacagcacccccctgcacaggctaccgcccacagccagtccagcccggagttcaaggggagcctggcatccctgtctgactccctcggagtttcagtcatggcaacagatcaggattcctacagcacgtcttccacagaagaagaactggagcagttctcctccccgtccgtcaagaaaaaaccatcaatgatccttggcaaggcgaggcaccgtctgtcctttgcttctttcagcagtatgtttcatgccttcttaagtaacaaccgcaaactctataaaaaagtggtggagctggctcaggataaggggtcatactttgggtccctggtgcaggactataaagtttatagtttagaaatgatggcgcggcagacaagcagtaccgagatgctacaagagattagaacaatgatgactcagctgaaatcgtatctgctgcagagtactgaactgaaggctctggtcgatccagcacttcacagcgaagaagaactcgaagcaatcgttgaaagcgcgctgtataaatgcgtcctcaaacctctcaaagaagcgattaactcgtgcctacaccagatccattccaaagacggttctctccagcagctaaaggagaatcagctagtaatcctggctactaccacaaccgacctgggagttacaacctctgtgcctgaagtgccgatgatggaaaagatcctgcagaagtttacctccatgcataaagcatactcccctgagaaaaagataagtatactgttgaagacatgcaagctaatttatgattctatggccctggggaaccccgggaagccctacggggccgacgatttcctgcctgttttgatgtatgtgcttgcacggagtaatctgacagaaatgctgctgaacgtggagtatatgatggagcttatggaccctgcgctgcagctgggggagggcagctattatctgacaaccacatacggcgcactagaacacattaagagctatgacaagatcactgtgacccgccagctgtcagtggaggtgcaggattccatccacaggtgggaaaggcgtagaactctgaataaggctagggcatctcggagcagcgtgcaggattttatatgtgtcagttatctagaacccgaacagcaagcacggaccctggcttccagggccgatactcaagcccaagccctgtgcgcgcaatgtgccgaaaagttcgctgtcgagagaccccaggctcaccggctgtttgtgctcgtagacggccggtgtttccaactggctgatgatgccctcccacactgtataaagggatacctcctcagaagcgagcccaagagggatttccattttgtgtaccggcccttagacggtggaggcggcggagggggaggctcaccaccatgtttggtcgttcgtgagccaaattttctctag

SEQ ID NO: 16608 - DNA, 1728 bp, Artificial Sequence
  Description of Artificial Sequence: Synthetic coding sequence
atgtcaagtgatgaggaaaagtactccctaccggtagtccagaacgattcatctagaggtagtagcgtgtcatccaacctccaagaggagtacgaggaactgctccactacgctatcgtgactcctaacattgagccctgcgccagccagagctcacaccccaagggagaactggtccccgacgtccggatcagcacaatccatgatattctacattctcaggggaacaacagtgaggttcgagagacagcaatcgaggtgggcaagggatgcgatttccacatatcttcccattcaaagacggacgagtccagcccggttctctctcctagaaaaccatctcacccggtgatggactttttcagcagccacctcctggccgatagctcctctccggcgaccaactcgtctcatactgatgcccacgaaatcttggtgtcggactttttggtttctgatgaaaatctgcagaaaatggagaacgtgctcgacctatggtcatccgggttgaagaccaatataattagtgaattatccaaatggaggctgaacttcatcgactggcacagaatggagatgaggaaagagaaggaaaagcacgcagcccacttgaagcagttgtgtaatcagatcaacgaacttaaggagctgcagaagactttcgagattagcataggtcgtaaagacgaagttattagctccctttctcacgcaatcggcaaacagaaggagaagatagaactgatgcggactttctttcactggaggattgggcacgtgcgagcccgtcaggatgtgtacgagggcaagctggccgatcagtattatcagcggacgctcctcaaaaaagtgtggaaggtatggcgcagcgtggtgcagaaacagtggaaggacgtggtggaacgcgcatgtcaggcacgagcagaagaagtgtgtatccagatctctaacgactacgaagccaaggtggctatgctgtcaggggccttagaaaacgccaaggccgaaatccagaggatgcagcacgaaaaagaacactttgaggactccatgaaaaaggccttcatgcgaggcgtttgtgcactgaacctggaagccatgacaatcttccaaaataggaatgatgctggcatcgactcaaccaataacaagaaggaggagtacgggccaggggtgcaaggaaaagagcactcggcccaccttgatccatcagccccaccaatgccactgcctgtcacctcaccactcttgcctagccctcctgccgccgttggaggggccagcgcaaccgcggttccgagtgcagcatccatgaccagcactagagcggcttctgcctcttccgtacacgttcccgtgtcagcccttggtgccggaagtgcggccactgcggccagcgaagagatgtacgtgcctcgggtggtgacttccgctcagcagaaggcgggtcgcaccattaccgcccgcattaccgggcggtgtgacttcgccagcaagaaccgaatttcctcatctcttgctataatgggtgtgtccccgccaatgtctagtgtagtagtagaaaagcatcatcctgtcactgtgcagaccatccctcaggcaaccgcggctaagtacccccgcactatccaccccgaatcttctaccagtgctagcagaagtctgggcactcgaagcgcacatacccagtccttgacgagcgtacactctatcaaggtggtcgactag

SEQ ID NO: 16609 - DNA, 2091 bp, Artificial Sequence
  Description of Artificial Sequence: Synthetic coding sequence
atggcgaactacaggaatacatctgaaattccactcgtgttagttggaacacaggacgcgatttcttccgctaaccctcgcgtgatcgacgacgcaagggccagaaagctgagtaatgatctgaagcgctgcacctactacgagacttgtgccacgtacggcctaaatgtggagagggtgtttcaagacgtagcccaaaagattgtagccacacgcaagaagcagcaactgagtatcggtccttgcaagtctctgccgaattcacccagccattctagtgtttgttcagctcaggtatctgccgtccatatcagtcaaacctccaatggaggcggctccctgagcgattattcctcatcggtaccaagcactcccagtacttctcaaaaggagctacggattgatgtgccgcctactgcgaacactccaacaccggtcaggaagcaaagcaagcgcagaagtaatctctttacaagtaggaagggctctgatcctgataaggagaagaaaggcctcgagtctcgggctgatagtattggatctggcagggccatccccatcaaacagggaatgctactcaagcgctcaggtaagtccctcaacaaggaatggaaaaaaaaatatgtgacactgtgcgacaatggagtgcttacttatcatcccagcttacatgactacatgcagaacgtgcacggtaaagaaattgatctcctacgcacaaccgtgaaggtgcccggcaaacggccccctcgtgcaactagcgcctgtgcccctatttcctcccctaagacaaacgggctgtctaaagacatgtcctccctccacatttctccgaacagtggtaacgtcacttccgcctcggggtcacaaatggcctccggaatatcactggtgagcttcaattcaagacctgacggtatgcatcagagatcttatagcgttagcagcgcagatcagtggtccgaagctacggtcattgccaacagcgccatctcgtccgataccggcctgggggattccgtgtgttcatcgccctctatttcatccactacaagccccaagctggaccccccccctagtccacatgccaacagaaaaaagcaccgccgaaaaaagtccacatctaattttaaagccgatggtttatctgggacagcagaggagcaagaggagaacttcgaattcataatagttagtctgaccgggcagacttggcacttcgaagctactacctacgaggaaagagacgcatgggtccaagccatcgaatcacagatccttgcatccctgcagtcttgcgagtcctcaaaaaataaaagcagactgacgtctcagagcgaagcaatggctcttcagagtataaggaacatgcgcggaaacagccactgcgtagactgcgagacccaaaacccgaactgggctagcctgaatcttggagctttgatgtgcatcgagtgttcaggaattcataggaacctggggacccacctgtcgcgcgtacgatccctggacctggacgactggcccgtggaacttattaaggtcatgtcatctataggcaacgaactggccaactccgtatgggaagaatccagtcagggccgtacaaaaccctctgttgattctacacgagaagagaaagaaaggtggataagggcaaagtatgagcagaagctttttctggctccgttgccatgcacggagcttagcctgggccagcaccttctgagagcgaccgccgacgaggacctgcggactgctatcttattacttgctcacgggtcaagggacgaagttaatgaaacttgtggcgagggcgacggacggactgccttacatctggcctgtcggaagggaaatgtggtgctggctcaactgctgatctggtatggggtagatgtgaccgctcgggacgcgcacggcaatactgctttagcttatgcgagacaagcctctagtcaggaatgtatcgatgtactgcttcagtatggttgtcccgatgagcgttttgtacttatggcaacacccaatctgagccgcaggaacaacaatagaaataactccagcggacgggtgccaacaataatatag

SEQ ID NO: 16610 - DNA, 270 bp, Artificial Sequence
  Description of Artificial Sequence: Synthetic coding sequence
atgagtgaacaaggagacctgaatcaggcaatcgctgaagaggggggtaccgaacaggaaaccgccacgcccgagaacggaatagttaagtctgaaagcctggacgaagaggagaagctggagctgcagagaaggctcgaggcccagaatcaagaacgccgcaagagtaaaagtggagctggtaagggaaagctcacccggagcctggcggtttgtgaagagtcctctgcccgccccggtggtgaatcactccaagaccagacgttgtag

SEQ ID NO: 16611 - DNA, 1785 bp, Artificial Sequence
  Description of Artificial Sequence: Synthetic coding sequence
atgacagacacacgccgtagggtgaaagtttacacccttaatgaagataggcaatgggacgaccggggtacaggccacgtttccagtggctatgtggaaaggctcaagggaatgtcactgttggtacgcgcggagtctgacggatctctgctcctcgagagcaaaatcaatccgaatacagcttaccagaaacagcaagaggacgagaagttcctgacggatctgttcgctcagctgacggacgaagcaaccgatgaagaaaaacgacaggaactcgttaatttcctcaaggaattctgcgccttctctcagaccctgcagcctcagaatcgcgatgcctttttcaaaaccctcagtaatatgggaatcctccccgccctcgaagtgatattagggatggacgatactcaggtgaggagcgccgccaccgatatattttcttacctggtggaatacaatcccagcatggtgcgggagtttgtaatgcaggaagcccagcagaatgatgacgtttcgaagaaactcacggagcaaaagatcaccagcaaggatatcctcctcattaacctcatcatagagcacatgatctgcgacacggacccggagttggggggggctgtccagctgatggggctgctccgcacactggtggaccccgagaatatgctcgctacagccaataagactgaaaagacagagttcctcgggttcttctataaacattgcatgcacgttctgactgcccctctcctcgctaatacgactgaagacaagccgagtaaagatgactttcagacggcacagctgcttgcactcgtcctggaactgttaacgttctgtgtggagcaccacacctatcacataaagaactatattatcaataaggatattcttagacgagtgttggtgctcatggcttctaaacacgccttcctcgcactttgtgcactgaggttcaaacgtaagattatcgggctcaaagacgagttctacaatcggtatatcatgaaaagcttccttttcgagcctgtcgtgaaagctttcctgaataacggatcacggtataacctaatgaactctgcaattatcgagatgtttgagtttatacgcgtggaggacatcaagagtctgacagcgcacgtgattgaaaactattggaaggctctggaggacgtggactacgtgcagaccttcaaaggactcaagctcaggtttgaacagcagcgggagcgccaggataatcctaagttagatagcatgagatcgatattgagaaaccataggtacagacgcgacgcccggactctagaggatgaggaggaaatgtggtttaatacggacgaagacgatatggaagatggcgaggctgtcgtgagcccttccgataagacgaaaaacgacgacgatatcatggaccccatcagtaagttcatggaaaggaagaaactgaaggaatccgaagaaaaggaagtcctgttgaaaacaaatctctcagggcgccagagtcccagctttaaactctccctgagctcgggtacaaaaacgaacctcacatcacagtcctctacaactaatctacctgggtcgccaggcagcccaggtagtcctggtagccccggctccccagggagcgtgcccaagaataccagccagacagcggccattaccactaaaggtgggctagtcgggctggtcgattatcctgatgatgacgaggacgatgatgaagatgaggacaaagaagacaccctgcccctgtcaaagaaagcaaaattcgacagctag

SEQ ID NO: 16612 - DNA, 522 bp, Artificial Sequence
  Description of Artificial Sequence: Synthetic coding sequence
atgtttaccgaaggtgaagagatgtacctgcaggggtcaacagtttggcatcccgactgtaagcaaagtaccaagactgaagagaaactgagaccaactcggacctcctccgagagtatctacagccggccaggcagctccattcccgggagtcccggtcataccatctatgccaaggtggacaacgagattctggactacaaggacttggccgcgatcccgaaagtgaaggcaatctacgacatcgagcgtcctgacctcattacatacgagcccttctatacgagtggctatgatgataagcaagagaggcagtccttgggcgagtccccgaggacactgtccccgacacccagtgcggagggatatcaggacgtccgggatcggatgatccacagaagcacctcacagggctccatcaacagcccagtttacagtagacactcctacacacccaccacatcaagatccccacaacactttcatagaccggaccaaggcatcaacatctaccgcaagtag

SEQ ID NO: 16613 - DNA, 1620 bp, Artificial Sequence
  Description of Artificial Sequence: Synthetic coding sequence
atggccacatcagcacccctgcggtccttggaagaggaggtcacttgctctatctgcttggattacctgcgcgacccagtgactatagattgcgggcatgtgttctgtcggagctgtactacggacgtgagacccatctcagggtccagacctgtctgcccactctgcaagaaaccattcaaaaaagagaacattaggcccgtatggcagcttgccagcctcgtggagaatatcgagcgtctcaaagtggataagggccgccagcccggagaagtaactcgggaacagcaggatgccaaactgtgcgagagacaccgagaaaagctgcactactattgcgaggacgacggcaagttgttgtgcgtcatgtgtcgggagagcagggaacatagacctcacactgcggtactcatggaaaaggcagcccagcctcaccgcgagaagatcttgaatcatctgagcacgctgagaagagaccgagataaaatacagggatttcaagccaaaggcgaggcagacatcttggctgcacttaagaagttacaggaccagaggcagtacatcgtggccgagtttgaacagggtcaccaattcctgcgagaacgtgaggagcacctcctagagcagctggccaagctagaacaggaactgaccgagggaagagagaaattcaagagtaggggtgtgggtgaattggcccgtctcgccctggtgatttcggaattggaaggaaaggcacagcagccagcggccgagctcatgcaagataccagggacttccttaatagatatccacgtaagaagttttgggtcggtaagccgatcgccagagtagttaaaaaaaagacaggggaattttccgacaagctcctgagcctccagcgcgggctgagggaatttcagggaaagttgttgcgagacctcgaatataaaacagtctctgttaccctggatcctcagagtgcaagcggctatctccagttgagcgaggactggaagtgtgtgacctacaccagcctgtataagtctgcctacctccacccacagcagtttgactgtgagcccggagtattggggagtaagggcttcacctggggcaaagtatactgggaagtggaggttgaaagagaaggctggagcgaggacgaggaggagggtgacgaggaagaagaaggggaagaggaagaggaagaagaggaggccggatacggagatggctacgatgattgggagactgacgaggacgaggaatctttgggagatgaagaggaggaagaggaagaagaagaggaggaggtgctggagagctgcatggtgggtgtcgccagagattcagtcaagagaaaaggtgatctctccttgcggcctgaggatggagtttgggcactgcggttatcctctagtggaatatgggccaatacgagcccagaagctgagcttttccctgcactgcgcccacgtcgcgtgggaattgcattggattatgagggaggaacagttactttcactaatgccgaaagtcaggagctaatctatacattcactgccacattcacccgcaggcttgttccattcctgtggttgaaatggccagggactaggttactactccgaccttag

SEQ ID NO: 16614 - DNA, 2112 bp, Artificial Sequence
  Description of Artificial Sequence: Synthetic coding sequence
atgttccgctacgagtctctggaagactgccccctcgacgaggacgaggatgccttccaaggccttggcgaggaagacgaagagatcgaccagtttaacgatgatacctttggctccggcgccgtagacgacgattggcaggaagcacatgagaggctagcagagctggaggaaaaactgcccgtggcggtcaacgagcagacaggcaatggcgagcgtgacgagatggacctgctcggcgaccacgaagagaatttggcggagcgcctgagcaaaatggtgatcgagaatgagctcgaagatcctgccattatgagagcagtccagactagacctgtgcttcaaccacagccaggcagcctgaatagctccatttgggacggcagcgaagtgctgaggcgtattcgtgggcccctccttgcacaagagatgcctaccgtcagcgtgttagaatacgccctgccccagcgcccaccacagggccccgaagacgacagagatttgtccgaaagagccctcccacgacggtcaacaagtccaataatcggtagcccacccgtccgggctgtgccaatcgggactccccctaaacagatggccgtgccttcattcactcagcagatactgtgcccaaagcccgtccatgtccgacctcccatgccaccccgatatccagccccttacggtgaaaggatgtccccaaatcagctgtgcagcgtgccacttcagccaggcaggatgtccccgtcgcaatttgcccgggtgcctggcttcgtagggtccccgctggccgcgatgaatcctaaactgcttcagggtcgggtgggacaaatgctcccccccgcgccaggtttcagggcatttttctccgcaccccctagtgcaacacctccacctcagcagcatccacctggaccaggacctcacctgcagaacttgcggtcacaggcccccatgtttcggcccgatactactcacctgcacccccagcaccgcaggctcctgcatcagcgccagcagcagaatcgcagtcagcaccgaaatctgaacggtgccggcgaccgggggtcccatcggtcatctcatcaagaccatctgagaaaggacccttatgcaaacctcatgttgcagcgagagaaagattgggtgtctaagatccaaatgatgcagctgcaaagcactgacccatatcttgatgacttctattatcagaattacttcgagaaactggaaaagctgtcagccgcggaggaaatacagggggatggtcccaagaaagaacggacaaagcttattaccccacaggtggctaaattggagcacgcctataaacctgtgcagttcgaagggagtctcggcaagctcacggtttcaagcgtgaataaccccagaaagatgatcgacgccgttgtgacaagtcgttccgaagatgacgaaactaaggagaagcaggtgcgcgataagcggcggaaaaccctcgtcattatcgagaagacgtattcgttattgctcgatgtggaagactacgagcgccgctatctcttgtcccttgaggaggagcgcccagctctgatggacgatcggaaacacaaaatttgtagcatgtacgataatctccgaggcaaactacctggacaagaaagaccgtccgatgatcacttcgttcagattatgtgtatcaggaagggaaagaggatggtcgcgcggatactgccttttctgtcaactgagcaagccgccgatatcctcatgaccacagctagaaatcttcctttcttgataaagaaggacgcccaagacgaggtgctcccttgcctgctgtcaccattctcactgctgctgtatcatctgcccagtgtgtccatcactagccttctcagacagctgatgaacctgccctcttcagacccagccactgagtccacacagaataatcaatggactgaggtgatgttcatggctaccagggaacttctacgaatcccacaggccgcgctggctaagcccataagcatccctacgaaccttgtgtctcttttctctcggtatgtagaccgtcagaaactgaatctgctggagacgaaactgcagttggtgcagggcatcagatag

SEQ ID NO: 16615 - DNA, 957 bp, Artificial Sequence
  Description of Artificial Sequence: Synthetic coding sequence
atgtccgcacacaaccggggcaccgagttagaccttagttggatatctaaaatccaggtgaatcacccagctgtcctgcggagagcagagcagatccaggcaagacgcacggtaaagaaggaatggcaggccgcttggttattgaaggccgtgacattcatcgatcttactactctgtcaggcgatgacacttcgagcaatattcagcgattatgttacaaagcaaaatatccaatccgcgaagacttattaaaagcactcaatatgcacgacaagggtattactactgctgccgtatgcgtctatcccgcaagagtatgtgacgcggtcaaagctctgaaagctgcagggtgcaacattcctgtggcctcggtggccgccggattccctgctggccaaactcacctcaagactagattagaggaaattcgcctcgcagtggaggacggggctactgagatcgacgtcgtgattaaccggagtcttgtcctgactggccagtgggaagccctgtacgatgagattcggcagtttagaaaggcctgtggggaggcccacctcaagactatcctggccacgggggagcttgggaccctcacaaatgtttacaaagcgagcatgatcgctatgatggcaggcagcgacttcatcaagacctcaacaggaaaggaaactgtaaatgccacattcccagtggcgatcgttatgctgcgcgctatcagggacttcttctggaaaactggaaataagatcgggtttaagcccgcaggcgggatacgctctgcaaaggacagcctggcttggctgtctctggttaaagaggagctgggtgacgagtggctgaagcctgagttgtttcgaattggagcgtcaacgcttctgtccgatatcgaacgacaaatataccatcacgtgaccggcaggtacgctgcttatcacgatctgcctatgtcctag

SEQ ID NO: 16616 - DNA, 1188 bp, Artificial Sequence
  Description of Artificial Sequence: Synthetic coding sequence
atggcctcagcagctagcgttacttctctggccgacgaagtgaattgccccatctgccaggggactctacgggaaccagttacgattgactgcggtcataacttttgcagggcctgtttgacgaggtattgtgagattccagggcccgatctcgaggaatcccccacgtgtcctttgtgtaaggagccttttcgcccaggctcatttcgcccgaactggcaactggcaaacgttgtggagaacatcgagaggctgcagctggtcagcactctcgggcttggcgaggaggatgtctgccaggaacacggagagaaaatctacttcttctgcgaggacgacgagatgcagttgtgcgtggtctgcagggaagctggggaacatgcgacccacacaatgcgcttcctggaagatgccgctgcgccttacagagagcagattcataaatgcctgaaatgtctgagaaaggaacgagaagaaatacaggaaattcaatccagggaaaacaaacgaatgcaggtgctcttaacccaggtctctaccaagcgtcaacaagtcatctcggaatttgcgcatcttcgcaaattcttagaggaacaacagagcattcttttggcacagttggagtcccaggacggggacattttaaggcagagggatgaattcgacctattagtggctggtgaaatttgtagattctctgctttgatagaggaactggaagagaagaacgaaaggcccgcaagggaacttttaacagatataaggagtactctgatccgatgcgaaaccagaaagtgtcgcaagccagtggccgtgtctccagaactggggcagcggattcgggatttcccacagcaggcactgcctctccagagagaaatgaagatgttcctcgaaaagctctgctttgaactcgattatgaacccgcccatatcagcctcgacccccagacaagccatcctaagctgcttctctccgaagatcaccagcgggcccagttttcctataagtggcaaaactcaccagataatcctcagaggtttgatcgcgccacttgcgtcctggcacacacgggcatcactggcggccgccatacctgggtgtggatggccagggtccctggggacagcggctgctgccagttttgcagcccacctagtgtcctcgggaccgaggtggccgcttag

SEQ ID NO: 16617 - DNA, 3288 bp, Artificial Sequence
  Description of Artificial Sequence: Synthetic coding sequence
atggcagagggagcagccggaagggaggacccggctcctcccgatgccgctggcggggaggatgatcctcgtgtggggcccgatgccgctggcgactgtgtcactgcagcaagcggcggacggatgagggatagacgctctggtgtcgcgttacccggcgcagcggggacaccagcagattctgaagcgggtctgctggaggcagctcgcgcaacccctcgcaggagtagcatcataaaagacccatcaaaccaaaagtgtgggggcaggaagaaaacagtgagtttctcatcgatgccctcagagaagaagatcagcagcgctaacgattgcatttcattcatgcaggcaggttgcgaacttaagaaggtgcggcctaactcccgtatttataaccgattctttacattggatactgacctgcaggcacttagatgggagcccagcaaaaaggatctggaaaaggccaagctggacatcagcgccatcaaagaaatcaggctgggcaagaacaccgaaacattcagaaacaatggcctggccgatcaaatttgtgaggactgcgcattttccatactgcatggagagaattacgaatctctagaccttgtggctaacagtgctgacgtggctaacatctgggtgagcgggttgcgttacctggtctctagaagcaaacagcccttggactttatggagggcaatcagaacactccacggtttatgtggttaaaaacagtcttcgaggccgccgacgtagatggtaatggaatcatgctcgaagacacttctgtggagcttatcaaacaactcaacccaacgctcaaggaggcaaaaatcaggctgaagttcaaggagattcaaaagagtaaggaaaagttgacaacaagggtcacagaggaagagttttgcgaggcgttttgcgaattatgtacaagaccagaggtttattttttactcgtccagataagtaagaacaaggagtaccttgatgcaaacgacctgatgctcttcttagaggccgagcagggtgttacccatataacagaggatatctgcttggatatcattaggcgctatgagttaagtgaagaggggcgccaaaagggctttctcgctattgacgggtttacacagtacctcctgtcgtcagaatgtgacatttttgatccagaacagaaaaaggttgcacaggacatgacccaaccactttcccattattacataaacgctagccacaacacttatctcatcgaggaccagttccggggaccggctgatatcaacggctacatcagggctcttaaaatgggatgtcgctcagtcgaacttgacgtgagtgatggaagtgacaatgagcctattttatgcaataggaacaatatgacgacgcacgtctcctttcgcagcgtaatagaagtcatcaacaagtttgcattcgttgcatctgagtacccactgattttgtgtctcggcaaccactgttctctgcctcaacagaaggttatggcccagcagatgaaaaaggtttttggaaataaactgtacacggaagccccactaccttctgaaagttatctacccagccccgagaaattgaaacggatgataattgttaaaggaaaaaaactgccaagtgaccccgatgttctggagggagaggtaaccgacgaggacgaggaggcagaaatgtctagacggatgtctgttgactacaatggcgaacaaaaacagatcagattgtgccgggaactgagtgatctcgtcagcatatgcaagagcgtgcagtatagagacttcgaactatcaatgaagtcacaaaattattgggagatgtgcagcttttccgagaccgaagcttccaggatcgccaatgaatatccagaagacttcgtgaattataataagaaattcctcagtagaatttatccctctgccatgcggatagatagctcaaatcttaaccctcaggacttctggaactgtggctgccaaattgtcgcgatgaattttcaaactccaggcccaatgatggatctgcatactggttggtttcttcagaatgggggatgtggctatgtgcttagaccaagtattatgagagacgaagtctcctatttttctgctaatacgaaaggtatcctccctggtgtctcgccccttgctttacacattaagatcatcagcgggcaaaattttccaaagcccaagggtgcttgtgcgaagggcgacgttattgacccctacgtgtgcatcgagattcatggcattcctgccgactgttctgagcagcgaaccaaaacagtgcagcaaaattcagataatcccatattcgacgaaaccttcgagttccaggtcaatctgcctgaactcgccatgattcggttcgtcgtcctggacgatgactatatcggcgatgagttcatcggccaatacacaatccccttcgaatgcctgcagcctggataccgccatgttcctctgagaagctttgtgggtgacatcatggagcatgtgactttatttgtgcacatcgcaattacaaacagatccggcggtggcaaggctcagaaaagatcattgtccgtacgaatgggtaaaaaagtgcgcgagtatactatgctgcgaaatataggtctgaagacaatagacgatatcttcaagatcgctgtgcacccattgagggaggcaatcgatatgagggagaatatgcagaatgccatcgtatctatcaaggagctttgtggtctgccaccgatcgctagcctgaaacagtgcctgctcacactgtcatctaggctgattacttctgataataccccatccgttagtctggtgatgaaagatagttttccctacctcgaacccctcggcgccattccagatgtgcaaaaaaaaatgctaacagcgtatgatctgatgatccaggagagtcggtttcttattgagatggctgacacagtgcaggaaaagatagtgcagtgccagaaggctgggatggaatttcatgaggaactgcataacttgggagcgaaggaagggcttaaaggccgaaaattgaataaggcaaccgaaagctttgcttggaacatcacggttctgaaaggtcagggggatttgctcaaaaatgctaaaaacgaagcgattgagaatatgaaacagattcagcttgcatgtttgtcatgcgggctgtctaaggcccccagctcatctgccgaggccaagtcgaaacgttcactggaggctatcgaagaaaaggagtcctcggaagaaaatggtaagctatag

SEQ ID NO: 16618 - DNA, 543 bp, Artificial Sequence
  Description of Artificial Sequence: Synthetic coding sequence
atggagcagccgaagggtgtggattggaccgttatcatccttacctgtcagtataaagatagtgttcaggtgttccaaagggagctggaggtgcgccagaagcgggagcaaattcccgccgggacactcctgctcgcggttgaagacccagaaaagcgtgtgggaagcggcggagccacactgaatgccctcttagtggccgccgagcatttgagcgcgagggctggcttcactgggcgcgatttccctttcgatgactgtggtagggcgttcacatgcttaccagtggaaaaccccgaagcccccgtcgaggctcttgtgtgcaatctcgattgcctcttagacataatgacgtaccggctggggcccggtagtccgcccggtgtttgggtttgctcgaccgatatgctgctcagtgttccagccaaccccggtgaaccagaaaccacttgggactgcctgcccagcagtcagcctcagcaggaggcttcttccgcgctcttagcccacccagcatctggacctgcgccgctcccctactag

SEQ ID NO: 16619 - DNA, 429 bp, Artificial Sequence
  Description of Artificial Sequence: Synthetic coding sequence
atgaacgaagtggtgcacacctcccctactataggttcaaatgtcgaggaaatcgtgattaacaatacaaggttcctcatgtgggacatagggggacaagagtccctgaggtcatcttggaacacctactacactaacactgagtttgtgattgtggtggtagatagcacagatcgtgaaagaatttccgtcaccagagaggaactctataagatgctggcccacgaggatttgaggaaggccggcttactcatttttgcgaataaacaagacgtcaaagaatgcatgacggtcgcagagatcagccagttcttaaagcttacatctataaaggaccatcagtggcacattcaggcttgctgcgcactcacaggagagggcttatgccagggcctggagtggatgatgtcaagacttaaaattcgttag

SEQ ID NO: 16620 - DNA, 342 bp, Artificial Sequence
  Description of Artificial Sequence: Synthetic coding sequence
atggagggcgtcctgtacaagtggacaaattatctatccggctggcagccaagatggttccttttatgtggcggaatcctgtcttactatgattccccggaggacgcatggaagggctgtaagggaagcatccagatggccgtctgtgaaatacaggtccactcggtcgataatactagaatggacctcataatccccggggagcagtatttctatcttaaggcccgcagtgtcgcggaacgacagcggtggttggtggctctggggtccgcaaaggcatgcctcacagattcaagaacccagaaggagaaagggaatctgctcaaaacgttaaagacctag

SEQ ID NO: 16621 - DNA, 1119 bp, Artificial Sequence
  Description of Artificial Sequence: Synthetic coding sequence
atggccagcaatcataaatcaagcgcagcgcgtcccgtgagtagaggaggcgttgggctgacaggaagacccccaagcgggataagaccactgtccggaaatatccgcgtggctactgcaatgccacccggaactgctagaccgggctcaaggggatgtcccatcggaacaggtggggtgctgtcttcacagatcaaagtcgcgcatagacccgttacacaacaaggtctgacaggcatgaagaccggaacaaaggggccacagcgtcagatcctcgacaaatcatactaccttggcctgctgagatccaagatttcagagctcactactgaagtcaacaagcttcagaaaggtatcgaaatgtacaaccaggagaactccgtctacctctcctatgagaagcgggctgagaccttagccgtggagatcaaggagctccagggacaactcgccgactataacatgctggtggataagctgaatactaacaccgagatggaagaagtgatgaatgactacaacatgctgaaagcccagaacgatagagagacccagagcctggacgtgatcttcaccgaaaggcaagccaaggaaaaacagatcaggtcagtcgaagaagagatcgagcaggaaaagcaagcaaccgacgatattatcaagaacatgtccttcgagaaccaggtgaagtacctggagatgaaaacgaccaacgagaaacttctgcaggagttggacactctccagcagcagctcgactcccagaacatgaagaaggagtctttagaagccgaaatcgcccacagccaagtgaaacaagaggccgtgctgcttcatgagaaactgtacgagctcgagagtcaccgcgatcaaatgatcgctgaggacaagtctatcgggtccccaatggaagaaagagaaaaactgctgaagcagattaaggacgacaaccaggagattgcatctatggaacggcaactgacagatacaaaggaaaagattaaccagttcatagaggaaatccgacagctcgacatggatctcgaagaacaccaggaccccactaactacggatggaagattctggagaagaacaccgggtcctttaagaagcaggtgtag

SEQ ID NO: 16622 - DNA, 345 bp, Artificial Sequence
  Description of Artificial Sequence: Synthetic coding sequence
atgtggtcgttaactgcttcagaaggagagagcacaaccgcccattttttcctcggtgccggcgacgagggtctgggcacacgcggaataggcatgaggccagaagagtctgattcggaattactcgaggacgaagaggatgaggtgccccccgaaccacagatcattgttggcatttgtgctatgaccaagaaaagtaagtccaagcctatgactcaaatcctggaacggctctgccgcttcgactatcttactgtcgtcatcctgggcgaggacgtgattctcaacgaacctgttgagaactggccttcctgtcattgtctcattagttttcattctaaatag

SEQ ID NO: 16623 - DNA, 327 bp, Artificial Sequence
  Description of Artificial Sequence: Synthetic coding sequence
atggctatggccccgagcccttcgctggtgcaggtctacacctcgcctgccgctgtggccgtctgggaatggcaggacggtctgggcacctggcacccttatagcgccacagtctgctcttttatagagcaacagttcgtccagcagaaaggccagagattcggtcttggcagtcttgcacattctattccattggggcaggcagaccctagcttagccccttatataattgatctccccagctggacccagttcagacaagataccggcaccatgagagctgtgcgccgccatctcttcccccaacatagcgctccgggtcgatag

SEQ ID NO: 16624 - DNA, 549 bp, Artificial Sequence
  Description of Artificial Sequence: Synthetic coding sequence
atgcgggagtgtatcagtatccacgtgggccaagctggcgtgcagattggcaacgcgtgttgggagctgtactgcctagagcacggaattcagcccgacggccagatgccctccgacaagactatcggcggaggagatgatagctttaatacttttttttctgagaccggagccggcaaacacgtccctagggctgtcttcgtggatctggagccaactgtgatcgactggtgccccacagggtttaaggtagggattaactaccagcctcccacagtcgtgcccgggggcgatcttgcgaaggtgcagcgcgccgtgtgcatgctttcaaatacaaccgcgattgccgaagcctgggcaaggctcgatcacaaattcgacctgatgtacgcaaaacgagcatttgttcactggtatgtcggggagggcatggaggaaggggaattcagcgaggctcgcgaagatatggcagcattggaaaaggactatgaagaggtgggggttgattcagttgaaggagaaggagaggaggagggcgaggagtattag

SEQ ID NO: 16625 - DNA, 483 bp, Artificial Sequence
  Description of Artificial Sequence: Synthetic coding sequence
atggaggccgagcgtccacaggaggaagaggatggcgagcagggcccacctcaagatgaagaaggttggcccccgcctaactccacaactaggccctggaggtccgcccctccctcaccacctcccccggggactcgccacaccgccctcggacctagatccgccagtttactgtctctgcagacagaacttttgctcgatctcgtcgccgaagctcagagcagacgactggaagagcagagagccacattttatacacctcagaatccgagctcgctggccccagcccctctgcgccctctggaggatcgcgaacaactgtactctactattctttcgcatcagtgccagcgcatggaagcccaaaggtccgaaccccctctgcctcctgggggacaagaactactggaattgctattgcgtgtgcaagggggcggtagaatggaggagcagcgtagcagaccccccacccacacgtgttag

SEQ ID NO: 16626 - DNA, 3483 bp, Artificial Sequence
  Description of Artificial Sequence: Synthetic coding sequence
atggcgtgtcgtcgaagatactttgtcgagggcgaagctccaagctccgagacaggaactagtctggatagcccatccgcgtatccacaggggccattggtgccaggttcttccctgtctcccgatcactatgaacacacaagcgtgggggcatatggcctgtactcgggaccaccaggacagcagcagaggacacgcaggcccaagctgcaacactctactagcattttgagaaagcaggccgaagaggaagcgatcaagcgctcaaggtccctgtcagaaagctacgagctcagctcagacctgcaagacaagcaagttgagatgctggagcggaaatacggcgggcgtcttgtgaccaggcacgctgcccggaccatccagacagcttttcggcagtatcaaatgaacaagaacttcgagagactgcgatctagcatgagcgagaacagaatgtcaagaaggatcgtgctcagcaacatgcggatgcagttttcgtttgagggaccagagaaggttcactcttcctacttcgagggcaagcaggttagcgtcaccaacgacggatcacagcttggagcactggtttctcccgagtgtggggatctatctgaacctactacactgaaaagcccagcccccagttccgacttcgctgatgccatcactgagctcgaagacgccttctccagacaggtgaaatctctcgccgagtctattgacgacgcgctcaattgtcgcagcctgcacaccgaagaagccccagcattagacgccgcgagggcccgagacactgagccccaaaccgcactgcacggtatggaccacaggaagttggatgaaatgacagcctcatactctgatgttaccctctacatcgacgaggaagaactgtctcccccgctgccactgtcccaggcgggtgacaggccttccagtaccgagtctgacttgcggctaagagctgggggggctgccccagattattgggctctcgctcacaaggaagataaagcagatactgatactagctgtagaagtacaccgtcgcttgaacggcaagaacaacggctgagagtagaacatcttccccttctgacaattgaacccccctcggacagctccgtagatctgagcgacagatctgagcgcggaagtctgaagaggcagagcgcttacgaacgctccctcggagggcagcaggggagccctaagcatggcccccactctggggctcctaaatcactgcctagagaggaacctgaactcagaccacgccctcctcgtcccctggactcccacctcgccatcaatggctcggctaaccgacagtccaagtctgagtccgactactccgacggcgacaacgattcaataaatagtactagcaactccaacgataccatcaactgctctagcgaatctagttcccgggactcgttgagagaacagactctgagtaagcagacctaccacaaagaggcccgcaacagctgggacagccccgcgtttagcaacgacgtaattagaaaacgccactataggatagggcttaacttattcaataaaaagcccgagaagggggtgcagtacttaatagaaagggggtttgtccctgatacccccgtcggcgtggcccatttcctcctgcagcgcaaaggcctcagtagacagatgatcggggaattcctaggcaaccgccagaaacagttcaatagagacgtactcgactgtgttgtcgatgaaatggacttcagcactatggagcttgacgaagccctcaggaaattccaagcacacatacgtgtacaaggcgaggcccagaaggtggagcgcctgatagaagccttctcccagaggtattgcatttgcaatcctggagtagtgagacagtttagaaatcccgacaccatctttattctcgctttcgccatcattctactcaatactgacatgtacagccctaatgttaaaccagagcgaaaaatgaagctggaggactttattaagaaccttaggggcgtcgacgacggggaggacatcccgcgcgagatgctgatgggtatttacgaacgaattaggaaacgagaattgaagacaaacgaggatcatgtgtcacaggtacagaaggtggagaaactgatcgttgggaagaagcctatcgggtcactccacccgggcctgggatgcgtcttatcactcccacacagacgcttagtctgttactgtcggctgttcgaagtgccagaccccaacaagccccagaagttgggcctgcatcagcgagagattttcctgtttaacgatctcctggtggttacaaagatctttcagaagaagaagaattctgttacatactcctttagacagtctttttccctgtatggcatgcaagtgttgctcttcgagaaccaatactatcctaatggaatacgcctcacgtcgagcgtgcccggcgcggacatcaaggtgctgattaattttaatgctcccaatcctcaggacagaaagaagtttacagacgacttgagggagagcatagccgaagttcaagaaatggagaagcataggatcgagtccgaactggaaaagcaaaaaggtgtggtaagaccttcaatgtcccaatgctcgtctctgaagaaggaaagtggcaatgggactctgagtcgggcctgcctggacgattcctacgctagtggcgagggactgaaacgctccgctctctccagcagtctccgagatctgtccgaggctgggaagcgcggcaggaggagcagtgcagggtcattagaatccaatgtggaaggctctatcattagcagtccccacatgaggcggcgggctacaagtactagagaatgcccttcgcggccgcaccaaaccatgcctaatagttcctctctgctggggtctcttttcggttccaaaagaggtaaaccacccccccaggcccatcttccaagtgccccagctctagctaccccaccccctacagggggccccgccagcttggcggcattgtgtggatggccaccacccggcgcacctcgaggggcggcagctgggaggcatgcgcgggcttctcaccccgtactgccacacgccgaaccgtcgccagtgccaccttcacccccccctcctccaacccccgcccacccagccaggactcccgtgccacctcgccctccgtggggacccccttccctcaggggcccctgtccacggcccccagccgctgctctgggacctaggggggcccactccgctccgccctgggctgctccttgtccagctgccccgcaccagcaacaaggacagacccaaagacaccagcacaactgcgtcgacagcctgggcagggggccccggctgcctgaaactcccgcacatcataccgggcacgccaggggcagccctgcagcacaccagacaagaggaacttcagtggcaatcagtccgctgtgcccttctaggcctaattag

SEQ ID NO: 16627 - DNA, 378 bp, Artificial Sequence
  Description of Artificial Sequence: Synthetic coding sequence
atgaagaaggagcatgtgttacattgccaattttcagcttggtatccattcttccgcggagtcacaatcaagtccgttattctgcccctgcctcaaaacgtgaaggattatctgctcgacgatggcactttggtggtgagtgggagggacgacccccccacgcacagtcaacctgactccgatgatgaggccgaagagattcagtggtccgacgatgaaaataccgcaacgctgactgatgcctattggattgccatgaacagcagcctcaaatgtaaaaccctatcagacattttccttttgttcaaatcaagcgactttataacaagggacttcactcagcctttcattcactgcacagacgattccccagattag

SEQ ID NO: 16628 - DNA, 414 bp, Artificial Sequence
  Description of Artificial Sequence: Synthetic coding sequence
atgtccctgttcgggactacatcagggtttgggactagcggcacctcaatgttcgggtcagcaacgacagacaatcataaccccatgaaagatattgaagttaccagcagccccgatgattccatcggatgtttgagctttagcccccctaccttgccagggaatttcctgatcgctggatcttgggccaacgatgttagatgctgggaagtccaagattctggacagactatccctaaggcgcagcaaatgcacaccggccccgttttggatgtctgctggagtgatgacggctctaaagtgtttaccgcaagttgcgacaagacagcaaagatgtgggatctatcctccaaccaggccattcagatcgcccagcacgacgccccagtgaagacaatccactggatcaaatag

SEQ ID NO: 16629 - DNA, 3222 bp, Artificial Sequence
  Description of Artificial Sequence: Synthetic coding sequence
atggaagaacgaaagcatgagactatgaaccccgcccacgttctgttcgatagattcgtgcaggccaccacctgcaaaggcacattgaaagcgtttcaggaactctgcgaccacttggagttgaagcccaaagattatcgatcgttctatcacaaactcaagtctaagctcaactactggaaagctaaggctttatgggctaagttagataagagaggtagccataaggattacaaaaagggtaaagcttgcactaatacaaaatgcttgatcattggagccgggccttgtggcctccggactgccattgacctaagtctgcttggcgcaaaggtggtcgtgattgaaaaaagggatgcattctcacgaaacaacgtgctgcacctgtggccctttacaatccatgacctgcgcggtctgggagctaaaaaattttatggtaaattctgtgccggggctattgaccatatatctatccggcaactgcagctgatcctcttgaaagtggctttgattcttggcatcgaaattcacgtgaatgtggaattccagggtctgatccagccaccggaagatcaagaaaatgagcggatagggtggagggccctggtgcaccctaagactcatcctgtgtcagagtacgagtttgaggttattatcggtggggatgggaggagaaataccctggaggggttccgcaggaaggaattcagaggcaagttggcgatagcgataacagcgaattttataaacagaaataccaccgctgaggcaaaggtcgaggagattagcggtgtcgccttcatctttaatcagaaattcttccaggaactgcgcgaagctaccggtattgacctcgaaaatattgtctactacaaggatgacactcactattttgttatgactgcgaaaaaacaaagcttgctagataaaggggtaatcctccatgactacgcagataccgaactgcttctatcccgggaaaatgtagaccaggaggctctcctgtcatacgcacgcgaggcggcagactttagtacacagcagcagctgcctagcctcgactttgctatcaatcactacgggcagcctgacgttgcgatgttcgacttcacttgtatgtacgcaagcgagaatgcagctttggtccgggaacagaatgggcatcagttactggtggccctggtcggggactcactactggagcccttctggcctatgggcaccggaatcgcccgaggcttcctcgcggcgatggacagcgcttggatggtgcggtcatggagtctgggtacatcacctctggaagtcctcgccgaacgggagtccatttaccgactcctcccacaaacaacacctgaaaacgtgagcaagaatttctcccagtattcaattgaccccgtaacccggtatccaaacatcaatgtgaattttctgcgaccatcccaggtaaggcacctgtatgacacaggggagaccaaagacatccatttggagatggagagcctcgtgaattcccgcaccacaccaaagttaacgaggaacgagagcgtggctcgatcttcaaagctcctgggctggtgtcagcgacaaacggatggttacgccggcgtgaatgtgaccgatttgactatgagctggaagagcggtctcgctctgtgtgccattatacacagatataggccggatctgatcgacttcgactcattagatgagcagaatgtcgaaaagaataatcaactggcatttgatattgcagaaaaagagctcgggatctcaccaatcatgacaggcaaggagatggccagcgtgggtgagccagacaagctgagtatggtaatgtaccttacccagttttatgaaatgtttaaagactccctgccaagcagcgataccctggatctcaacgctgaggaaaaggctgttcttatcgctagtactcgcagccccattagcttcttgtccaaattaggccaaaccatctcgcggaagagaagccccaaggataagaaagagaaagacctagatggagctggcaagaggagaaagacctcccagtccgaagaagaggaagccccccgagggcatagaggcgagagacccacattagtgtccaccctcactgatcgccgaatggatgtggctgtagggaatcagaataaagttaaatacatggccacacaactgctagccaagtttgaggaaaatgcccctgctcagtccatcggcattaggagacagcagcgtgagaaggaatgcagccgcacatgtccgaagaaggtgatcaccctgagtccacccccgacaccgcctccttgccgggcgcatggcggccagcagacataccgggatttagacgccgataaccggggaaagcaatccccccatcacgagcgccctgaaccggaaccgcctaggcgcttctttgtggaccagtgggaactgagcttgtctcttcgctcttccgctcgtccggccagtccaagcagcgactctctcagacagaaatacattaagatgtacacaggaggcgtgagcagcctggcagaacagatcgcaaatcagctgcagcgaaaagaacagcccaaggcactgctcgacaaaaaagagcttggaagcatgaaaaaggagttcccgcagaatctcggcggttccgacacctgttatttttgtcagaaacgcgtttatgtgatggaaagactgtccgcggagggcaagtttttccaccggagttgcttcaagtgcgaatactgtgccactacccttagactgagtgcatacgcttacgacattgaggacggaaagttctactgtaagccccattactgttataggttgtctggctatgctcagcgcaaacgtcccgctgtagctccactctccggaaaggaggctaagggcccgctgcaagacggcgccaccactgacgcaaacgggcgcgccaacgccgtcgcttcttctactgaaagaaccccaggcagcctgacctcacttttcgggtgggtcgcacgccactcacttggactctgcgataaggccaaaggtatgagccaacacctgcaaagcaatatctcttcctttggccaacaggtggcacagaacccactggatagtttcttcatgtgtcagctactggcgtttggagtgcccttcctatacggactgagtgaggtgttggttcaaattaggggagagtttcattggcaagcagtagcccaatag

SEQ ID NO: 16630 - DNA, 543 bp, Artificial Sequence
  Description of Artificial Sequence: Synthetic coding sequence
atgtttttatcctgcggaagtcttcatcagcgtgggcccgagacagacgggactgtgtttcgaattcatacaaaggctgagggttttatggatgtggatatccccctggagctggtgttccacttgcccgtgaattatccgagttgccttcctggcatctccatcaacagcgagcagttgacaagagcacaatgtgttacagtcaaggaaaacctgttggagcaggctgagtccttgctgagcgaacccatggttcatgaacttgtcctgtggattcaacaaaatttgcgtcacattctgtctcaaccagagactggctccgggtctgaaaaatgcacctttagtacaagcacaacgatggacgacggcctctggatcaccctgttacatctggaccatatgcgagccaagaccaaatacgtcaagattgtagaaaaatgggcatcagatttgcgtctgactgggcggctgatgtttatgggcaagatcatcctcatccttttgcagggagaccggaacaatctgaaagtgcccaaaagttag

SEQ ID NO: 16631 - DNA, 1521 bp, Artificial Sequence
  Description of Artificial Sequence: Synthetic coding sequence
atgaaaagaagaagcgtgacaatgactgatggtttgacggcggacaaggttacaagatccgatggctgccccacctctacatctcttccgagacccagagactccatccggagctgtgccctgtccatggatcagatccctgatctccattcccctatgagcccaatttcagagagcccgtcttctccagcctactctacggttacacgtgtgcacgccgctcccgctgcaccatctgccaccgcactccccgcatcccctgtggcccgccggagttccgaaccccagctctgtccgggttcagcaccaaaaacccatggcgaatcagataaagggccccacacatcccccagtcacacgctggggaaagccagcccatcccccagtctctcttcatacagcgaccccgattctggccactattgccaattgcagccccctgtcaggggctccagagaatgggctgcaactgaaacgtctagtcagcaagctcgttcttacggggagaggttgaaggaactgtcagaaaacggggcccccgagggggactgggggaagacattcaccgtccctatagtggaagttacctcaagctttaacccagctacctttcagtctctcctgattccaagagacaaccgacccctcgaggtggggttgctacgaaaggtcaaagagctgctggcagaggtggatgccagaactctcgctcggcatgttaccaaagtggattgcctcgtggcccggatattaggcgtcacaaaggaaatgcagacgctcatgggggtgcggtgggggatggagctactgactctccctcatggtcgtcaacttaggctggacttgctcgagagatttcatactatgtctatcatgcttgctgtagatattctgggttgtaccggaagtgccgaggagagggctgctctgctacataagaccatccagctcgccgctgaactaaggggcacaatgggaaacatgttctcgttcgccgccgtgatgggagctcttgatatggcacaaatctccaggctggaacaaacatgggtcaccctgaggcagcgtcataccgagggagctattctctacgagaaaaaactgaagccctttcttaaatcattgaacgaggggaaagaaggacctcctctgagcaacacaactttcccgcacgtgcttcccttaattaccctgctggagtgcgactctgcccccccagaggggcccgagccatgggggagtaccgagcacggcgtggaggtggttctggcacatttagaagccgcccggaccgtcgcacaccacggcggactgtatcatacaaacgctgaagttaagctacagggcttccaagcccgacctgagctactcgaggtattctcaacggaattccagatgcgcctactgtggggaagccaaggggcatctagcagtcaagcccggagatatgaaaagtttgataaagtgcttacagctctctcacataagctagaacccgccgtgaggagtagcgagttatag

SEQ ID NO: 16632 - DNA, 369 bp, Artificial Sequence
  Description of Artificial Sequence: Synthetic coding sequence
atggcaacatccgcccctcttcggtcactcgaagaggaagtcacgtgttcaatttgtctagactacttgcgggatccggttacaatcgattgcggccacgtgttttgcagatcgtgtaccaccgacgtgagacccattagcggtagtaggccagtgtgccctctctgtaagaagccctttaagaaagaaaacattcgacccgtctggcagctggctagcttagttgagaacatcgagaggctgaaggtggataagggcagacagcctggcgaggtgacacgggagcagcaagatgcgaagttatgtgagcgtcatagagaaaagttgcactactattgtgaagatgatggaaagctgttgtgtgtgtag

SEQ ID NO: 16633 - DNA, 369 bp, Artificial Sequence
  Description of Artificial Sequence: Synthetic coding sequence
atgcctgagattaacacaaatcatctggacaagcagcaggtccagctgctcgcagaaatgtgcatcctaatcgatgaaaacgacaataaaatcggtgcagagactaagaaaaattgtcacctgaacgagaacatcgaaaagggcctgctgcaccgtgcattcagtgtgtttctcttcaacactgaaaacaagttactgttgcaacagaggtcagatgccaagattacctttccgggttgttttactaatacttgttgttcccaccctctgtctaaccctgccgaactggaagaaagcgatgccctcggcgttcggcgggctgctcaacggagactgaaggccgagctcggcattccccttgaagaatag

SEQ ID NO: 16634 - DNA, 408 bp, Artificial Sequence
  Description of Artificial Sequence: Synthetic coding sequence
atggctgcgctgcggccattggtaaagccgaagattgttaagaagcggacaaagaaatttatcaggcaccaatccgatcggtacgttaagattaagaggaattggagaaaaccacgggggattgataacagagtgcgcagacggtttaaaggccagatccttatgcctaatattgggtatggatctaacaagaaaactaagcatatgctgccctcaggattcagaaagtttcttgttcacaatgttaaggaattggaagtgctcttgatgtgcaataagagttactgtgctgaaatcgctcacaatgtatcatcgaagaatcgcaaagccatcgtcgagcgggccgcgcaactggccatccgggtgactaatcccaacgcccgccttagatctgaggagaacgaatag

SEQ ID NO: 16635 - DNA, 3282 bp, Artificial Sequence
  Description of Artificial Sequence: Synthetic coding sequence
atgggtacaggtgatttcatctgtatatcaatgacaggtggggctccttggggctttagactgcaaggcgggaaggagcagaaacagcctcttcaggtggccaagatacggaaccagtctaaggcttccgggagcggcctgtgcgaaggggacgaagtggtttctatcaatggcaatccctgcgccgacctcacctatcctgaggtcattaaactgatggaatcgataactgacagtcttcaaatgctcatcaaacggcctagcagtggaatatccgaggctctgatctctgagaatgaaaataaaaacctcgagcatctcacgcatggaggatatgtcgagtctacgactttgcagatacgccccgctaccaagacacagtgcactgaattcttcttggcaccagtgaagacggaagttccgctggcagagaatcaaagatctgggccagattgcgcggggagtctaaaggaggagactggccccagttaccaacgcgccccccagatgccggactcacagagaggacgggtggcagaggaactgatcctgcgcgagaaagttgaggctgtgcagcctggcccggtcgtcgagttgcagctcagcctaagccaggaaagacataagggcgcctctggccctttggttgctcttcccggggctgagaagagtaagtctcccgaccccgatcctaatctttcccacgacagaattgtgcacatcaatagcattcccactaatgaaaaggcagatccatttttgagaagctctaagataattcagatcagttctggaagggagctccgggttattcaggaaagcgaggccggagacgctggcctgcccagggtggaagtgatcctggattgcagtgatagacagaaaactgagggttgtagactgcaagctggcaaggagtgcgtggactcaccagtggaaggaggtcagagcgaagctccgcccagtttggttagcttcgcggtttcctccgaaggaacagagcagggcgaggacccccgttcagaaaaagaccacagcagaccccataaacacagagccaggcatgcgaggctgagacgaagcgaatctctcagcgaaaagcaggtaaaggaggctaagtctaagtgtaagagcatcgctctgctcctgaccgacgcgccgaatccaaattccaaaggcgtgttgatgttcaaaaagagaagaagaagggccagaaaatataccctggtgagctacgggactggggaactggagagggaggccgacgaggaggaggaaggtgacaaggaagatacttgcgaggtggccttcttaggggcctcagagtcagaggtggatgaggagctgttgtcagacgtggacgacaacactcaggtggttaacttcgactgggattctggactggtagatattgagaaaaagcttaataggggcgataagatggagatgctgccggacacaacaggcaaaggtgcgttgatgtttgctaagaggcgggagaggatggatcagatcactgcccagaaggaggaggataaagtcgggggcaccccttctagagagcaggacgctgcgcaaaccgatgggctgcgtacgactaccagttaccagcgcaaagaagaagaatcagtgcggactcagtcatctgtgtccaaatcatacatcgaagtgagccacggcctcgggcacgtgcctcagcagaatgggttctccggcacatccgaaaccgccaacatccagagaatggttccaatgaacaggacagcgaaaccttttcccgggtccgtgaatcagcctgctactccattttctccaacccgaaacatgacaagtcctatcgcggattttccagctcctccaccatatagtgcagtcacccctcccccggatgctttttcccgtggagtttctagccctattgccggaccagctcagcctcccccctggccccagccagccccatggtcacagccggccttttatgattcttccgaacgcatcgcgagtagagatgagcgtattagtgttccagctaaaagaacagggattctccaggaggcgaaaagacgaagtactactaaacctatgttcacctttaaggagcctaaagtgagtccaaacccagagctcctgtccctgttacagaactctgaaggaaagcggggaaccggggctgggggggactctggacctgaggaagattacctgtcgctgggtgccgaagcgtgtaactttatgcagagcagctccgccaagcagaaaacaccgcctcccgtggcccctaaacccgccgtcaaaagctcctccagccagcccgtgactcccgtgtcaccggtgtggtcacctggtgtagcaccaacgcagccgcccgcgttcccaaccagcaatccatctaaaggcaccgtggtgtctagcatcaaaatcgcccagccttcctaccctccggcacgccccgccagcacattgaacgtcgctggtccctttaagggaccccaggccgctgtggcgagccagaattatacccctaaacctaccgtctctacgccaacggtgaacgcggtccaaccaggcgcagttggtcctagcaacgaattgcctggaatgagcgggagaggagcgcagttatttgctaaacgacagagcaggatggaaaaatatgttgtcgacagtgataccgtgcaagctcacgccgcaagagcacaatccccgaccccctcgttgccagcctcctggaaatattcttcaaacgtgagagctcctcctcctgtggcctacaatcccatccattcaccttcataccctcttgcagccttaaagagtcagccctctgcagctcaaccttccaagatgggaaaaaagaaaggcaaaaagccattgaacgctctggatgtgatgaaacatcagccttatcagcttaacgcgtctctgtttaccttccagcccccagatgcaaaagacggtctgccacaaaagtcctctgtcaaagtcaactccgccctggctatgaagcaggccctccccccccgccccgtcaacgctgcatctcccaccaacgtgcaggccagctcagtatacagcgttcccgcatatacctcgccaccatccttcttcgccgaggccagctctccggtcagcgctagccctgttcctgtcggtatccccaccagtcccaagcaagagtctgcctcttcctcttatttcgtagcaccccgacccaaatttagcgccaaaaagtccggcgtgaccattcaggtgtggaagccatccgtggtcgaggaatag

SEQ ID NO: 16636 - DNA, 600 bp, Artificial Sequence
  Description of Artificial Sequence: Synthetic coding sequence
atggccatcgtgcaaaccttgcccgtccccctggagccagcccccgaagccgcgactgctccgcaggcacccgtgatgggttctgtcagcagccttatctccggacgcccgtgtcccggtggccctgcccctcctcgccatcacgggccacctggtccaactttttttcgtcagcaggatggattgctgcgcggtggctacgaagctcaggaacccctttgcccagccgtgccaccacggaaggctgttcccgtgactagctttacatacatcaacgaagacttcagaactgagagtcccccttcgccaagctccgacgtggaggacgcccgcgaacagcgcgctcacaacgcacacctgcgaggaccacccccgaaactgatccctgttagcggaaagctggaaaagaatatggaaaagatactgattcggcctactgccttcaaacccgtgcttcctaagcctaggggggcccccagtctgcccagctttatgggcccacgcgcaaccggactctccggctctcaggggtctctgacacagctctttggcggtccggcatcgtcaagctcgtcctcctcttcctctagcgccgcatag

SEQ ID NO: 16637 - DNA, 612 bp, Artificial Sequence
  Description of Artificial Sequence: Synthetic coding sequence
atgccctccactcccgcttccaccatctctgcccgtgaagagctggtgcaacggatccctgaggccagcctgaacttccagaaagtgccacccgggtccctgaactctcgagactttgaccagaacatgaacgatagctgtgaggatgcactagctaataaaacccgtccacggaaccgcgaggaggtaatctttgataatcttatgctcaatcctgtaagccagttgtctcaggcaatacgcgaaaacaccgagcacctggcagaaaagatgaagattttgtttcaaaacaccggcagggcctgggaggacctagaggcgcgaattaacgccgaaaacgaggtaccaattctcaaaacctcaaacaaggaaatctccagcattcttaaagaactaagacgcgtgcagaagcagctggaggttattaacgcaatcgtagacccctcaggaagtcttgacctactgctgcctaccctgtcgtcatttgtgccaccaccacccgcgtttgcctgggaactagtgcttgtttgtcgagcctcccgtcgagtccattgcactttcgtactcagatggtcctgtggctgcctttctgaaaacggttactttatctag

SEQ ID NO: 16638 - DNA, 321 bp, Artificial Sequence
  Description of Artificial Sequence: Synthetic coding sequence
tgaccaaccacctcgagacccgctctggatgtaaagggcggcactagccccgccaaagaggatgcaaaccaagaaatgtcaagcgtggcttactctaacctcgccgtcaaagacagaaaggcagtcgccatcctgcattaccctggtgtggctagcaacggtaccaagagccctgccattattgatagtgacccagtggacgaagaggtgctcatgagtttggtggtggaactcggcttagatcgcgcaaatgaactgcctgaactgtggcttgggcagaatgagttcgatttcaccgctgactttccatcctcctgctag

SEQ ID NO: 16639 - DNA, 456 bp, Artificial Sequence
  Description of Artificial Sequence: Synthetic coding sequence
atggccgctttccgagacatcgaggaggtgagccaggggttacttagtctgcttggggcaaaccgggctgaagcacagcagagacggctgctcggccgacatgagcaggtggtcgaaagattgctggagactcaagacggcgccgagaaacaactgcgagaaattttaaccatggagaaagaggtggcacagtctctgttgaacgctaaagagcaggagcgtcaggagaaggaagtggatgaggatactaccgttacaattcccagcgccgtctacgtggctcagctttatcatcaggtatcaaaaatcgagtgggattatgagtgcgagcctggcatggtcaaaggaatccatcacggtcctagtgttgcccagcctatccacctggattctactcagctgagccggaaatttatctctgactacttgtggtctctggtcgataccgagtggtag

SEQ ID NO: 16640 - DNA, 444 bp, Artificial Sequence
  Description of Artificial Sequence: Synthetic coding sequence
atgttgaggtgtggccagatgatattcgcgcaggctctggtctgtcgacacctaggccgggactggaggtggacccagcgaaaacgacaacctgacagttatttttctgtactcaatgcgttcattgatcgcaaggactcctactactcaattcaccagatcgctcagatgggagtgggggaaggcaagtccatagggcagtggtacgggcccaatactgtggcacaagttctgaagaaattagcggtctttgacacatggtcctcccttgccgtgcatatcgcaatggacaacacggtcgtgatggaagagatcaggcgactgtgcagaacatccgtcccatgtgccggcgccacagcatttcccgcggattccgatagacattgcaatggcttccccgcgggagccgaggtcactaatcgaccaagcccctggagaccctag

SEQ ID NO: 16641 - DNA, 1482 bp, Artificial Sequence
  Description of Artificial Sequence: Synthetic coding sequence
atggagaagtatgaaaatttaggcttagtcggcgaggggtcatatgggatggtgatgaagtgccggaataaagatacagggaggattgtcgccattaagaagtttctggaatctgacgatgataaaatggtgaagaagatcgctatgcgtgagatcaagctgctcaagcagctccgccatgagaacctcgtgaacttgctggaagtgtgtaagaagaagaaacgttggtatttggtcttcgaatttgtggaccataccattttagatgatttggaattattcccgaatggattggactaccaggtggtacagaagtatctttttcaaatcataaatggtattggattttgtcactcccataatataatccaccgggacatcaaacctgagaatatcctcgtttcacagagcggggtcgtgaaactgtgtgacttcggattcgctagaacccttgcagcacccggcgaagtatatacagattatgttgccacgagatggtatcgggcacctgaactcctcgtaggcgacgtcaagtacgggaaggccgtcgacgtttgggcaatcggttgcctcgtgacggaaatgtttatgggcgaaccccttttcccaggcgacagtgacattgatcagctctatcacatcatgatgtgcctaggcaacctgattccaagacaccaggagttgtttaacaagaaccccgttttcgccggggtgaggttgccagagatcaaagagcgggaacctcttgagcggcggtatccaaaactttccgaggtagtgatcgaccttgccaagaaatgtttgcacatcgatcccgacaaacggcctttctgtgcagaactgctccaccatgacttcttccagatggacggattcgcagaaagattctctcaggagcttcagcttaaggtccagaaggacgccaggaacgtcagtttatccaagaagtcacagaacaggaaaaaagaaaaagagaaggatgacagcctggtcgaagagaggaagaccctcgtggtgcaggacacaaacgccgacccaaagatcaaggattacaaattgttcaaaataaaagggtctaagatcgacggagaaaaagctgaaaagggtaacagagctagcaacgcctcctgcctgcacgattcaagaaccagtcacaacaagatcgtaccatctacttcactaaaggattgctctaatgtctccgttgaccacactaggaatccttctgtagccattccccccctgacgcataatctgagtgccgtagccccctcaattaactcaggaatgggtaccgagaccatccctattcaaggataccgcgtcgacgaaaagaccaaaaaatgtagcatcccttttgtaaaacccaatagacacagtccgagcggtatatacaatatcaacgtcactacccttgtttccgggccacccctctcagacgatagcggtgcagatctcccccaaatggaacatcaacactag

SEQ ID NO: 16642 - DNA, 6189 bp, Artificial Sequence
  Description of Artificial Sequence: Synthetic coding sequence
atggatggatgcctggacacggaaacccctacagtgtccatccaggagaatgttgacgtggcaagtcttaagcctatcagcgacagcggcatcaactttactgacgccatctggagtcccacatgcgaacgacggacgtgcgagtgccatgaatctattgaaaagaacaaggataaaactgatcttccacaatccgtggtgtatcagaacgaagaggggagatgggtgactgatctagcttactataccagctttaattcaaaacagaacctgaatgttagtctgtcagacgaaatgaacgaagactttaggtccggttccgaagccttcgatttaattgcgcaggacgaggaagagttcaacaaagaacaccagtttatccagccctctttcggctattttatcaggagtcctgagaagcgcgagcccattgccttgatccgcaaatccgacgtctcaagaggaaacctggagaaggaaatggcacatctgaaccatgacctgtactccggcgacctcaatgagcagtctcaggcgcagctcagcgaagggagcatcacgttacaggtggaagcagtggaatctacgtcccaggtggacgaaaacgatgtcaccctgacagcagataagggtaagactgaagataccttctttatgtcgaacaagccccaaaggtataaggacaagctgccagactcgggcgactctatgctcagaatcagtactatcgcatccgctatagctgaagcctccgtgaacacagatccatctcagctcgccgccatgatcaaggctctctctaataagacgagagacaagacatttcaggaggacgaaaaacagaaggactactctcacgtgcgccattttttgccaaacgacctcgagaaaagcaatggtagcaatgccctggacatggagaaatatctgaaaaagaccgaggtgtctcgttacgagtccgccctcgaaaacttctcccgagcctcaatgagcgatacctgggatctgtcccttcccaaggagcagacaacacaagacattcatccggttgatctgtccgcgacttccgtcagtgtgcgggctccagaggaaaacacagcggctatcgtatacgttgagaacggtgagagcgagaatcaggaatctttccgcactatcaactcttccaacagtgtaacaaatcgcgagaacaattcagcagtggtggacgtgaagacttgctcgatagacaataaattacaggatgtcgggaacgacgagaaagctacaagcatatcgactcccagcgatagctactctagcgtccgtaaccccaggatcacctctctgtgtctactaaaagattgcgaggaaataagagacaaccgcgaaaaccagaggcagaatgagtgtgtgtctgagatctccaatagcgagaagcacgtaactttcgagaaccaccgcattgtgtcacccaaaaatagcgatcttaaaaacacaagtcctgaacacggtggacggggttctgaggatgaacaggagtctttcaggccttccaccagcccactatcacattcgagcccttcagagatatctggaacgtcctcatccgggtgcgccctcgagtcattcggatcggccgctcagcagcagcagcctccttgtgaacaggagctttcgccacttgtgtgctctccagcgggagtgtcccgacttacttatgtgagcgaacctgagtcgtcttatcctaccactgccaccgatgatgcattggaagacaggaaaagcgacataacaagcgaattaagtaccacaatcatccagggctcccccgccgccctggaggagagggcgatggaaaagctcagagagaaggtgccattccaaaatagggggaaggggaccctctcttcgattattcagaataatagcgatacgagaaaggcaacagaaaccaccagcctatcatcaaagcccgagtacgtgaagccagactttaggtggtctaaagatccgtcgtccaagtcaggtaatctgctggagaccagcgaagtagggtggacatccaaccctgaggagctggaccccatccggctggcacttctcgggaagtctggactgagctgccaggtcggcagcgccacttctcaccctgtgtcatgtcaggaacccattgacgaagaccaacggatctcacccaaggacaagagtactgccggacgagaatttagtggtcaggtaagtcaccagaccaccagcgaaaatcagtgtactcccataccttcttccaccgtgcactctagcgtagctgacatgcagaatatgcctgcagccgtgcatgccctgctgacgcagccgtcactgtctgctgctcctttcgcgcagcggtacctcggaacactgccttctaccggatcaactaccttgccccagtgccacgctgggaatgcaacagtgtgcggattctccggtgggctcccatatccagctgtggccggcgagcccgtacagaactcagtcgctgttggaatatgcctggggagcaatatcggctccggctggatgggtacaagttctctctgcaatccatacagtaacacactgaatcaaaacctgctgagcacaaccaaaccctttccagtgccctctgtggggacaaattgtgggattgagccctgggacagcggggtcacaagcggccttgggtccgtcagagttccagaggaactaaaactaccacacgcatgctgcgtgggtatcgcttcgcagacccttctgtccgtcctaaacccaacagatagatggctccaggtaagtatcggcgtgctgtccatcagtgtgaatggggagaaggtggatctgtctacctatcggtgtctcgtgttcaaaaataaagccatcatccgcccccatgctaccgaagagattaaggtcctctttattcctagttcacccggggttttccgctgtacttttagtgtggcatcctggccctgctcaacagatgcagaaacgatcgttcaagctgaagctttggcgtcgaccgttaccctgacggctatagctgagagtcccgttattgaagtggagaccgagaagaaagatgtccttgattttggcgatctgacctacggtggttggaaggcactgccacttaaactcataaaccgcacccatgccaccgtgcccattcgcctaatcataaatgctaatgctgtggcgtggagatgtttcactttctcaaaggagtcggttcgggctcccgtggaagttgccccttgcgccgacgtggttactcgactggcaggaccttcggtggtgaatcacatgatgcctgcgtcttacgacggtcaagatcccgagttcttgatgatctgggtgttgttccactctcccaaaaaacagatctcatcctccgatattcttgactccgccgaagaattctcagctaaagtcgatattgaagtagattccccaaatcctacgccggtcctgcggtctgtgtccctcagggcccgggcaggcatcgctagaatccatgcacccagagatctccagaccatgcacttcttggctaaagttgcaagcagtcgaaaacagcatctgcctttgaaaaacgcaggcaatattgaggtgtatctggacattaaggtccccgaacagggaagtcacttttcagtggaccccaagaatttgcttttgaagccaggggaagaacacgaggttattgtgtcctttacccccaaggatcctgaagcttgcgaagagaggatcctcaagatctttgtgcagccctttggcccgcaatatgaagttgttctcaaaggagaagtcatttcctctgggagtaagcctttgagcccggggccatgccttgacataccatcgatattgtctaataaacagttcctggcatggggcggcgtcccactgggacggactcagcttcagaaacttgctctcagaaacaacagcgcctctacgacccagcatctccgactgctgatccgcggccaggaccaagactgctttcagttgcagaataccttcggtagcgagcagcggctgacatcgaattgtgagataaggattcacccaaaagaggacatcttcatcagcgtgctgtttgctccaacaaggctttcctgcatgctggcaaggttggaaattaaacagctgggcaaccgctcccagcctggaatcaagtttacaatccccttaagtgggtacgggggaactagtaatctgattctggagggcgtgaaaaagctgagcgacagctacatggtcacggtgaacggcctggtacccggtaaggagagcaaaattgttttcagcgtgaggaatactgggagcagggccgcgtttgttaaagcagttgggttcaaagactcgcagaagaaggtgcttctggatcccaaggttctgcgaatcttcccagacaagtttgtcctgaaggaacgcacacaggaaaatgtgactctgatttataatccctccgatcggggcatcaataacaagacagctactgaattgtccaccgtgtacctgtttggcggagatgagatttctcggcagcaatataggagagctctgctccacaagcccgaaatgatcaaacaaatcctgccagagcattccgttttacagaacatcaactttgtcgaggctttccaggacgaactgttggttaccgaagtgtatgacctgcctcagaggccaaatgacgtccagctgttctacggatcgatgtgcaaaatcattcttagcgttatcggcgaattcagggactgcatttcatctagggaattcctgcagcctagttcaaaggcctcccttgaaagcacctctgacttgggcgccagcggcaagcacggcggaaacgtatccttggatgtcttgcctgtgaaaggaccacagggctcccctctgctgtctagggcagcaaggcctcccttagaccagctcgcctcggaggaaccctggacggtcctgcctgaacacttgatattggtggcccctagcccttgtgatatggctaagacaggaaggtttcagattgtgaataactccgtcagattgctaaggtttgagctgtgttggcccgctcactgcctgaccgtcactccccagcacggctgcgtggcccccgagtctaaactgcagattctggttagtcccaattctagcttgagtaccaaacagtcgatgtttccgtggtcgggcctcatttacatccattgcgacgatggacagaaaaagatcgtcaaagtgcagatccgagaggatctaacccaggtcgagctcctgactcgtctgacctctaaacctttcggcattctgtcacccgtatctgagccgtccgtctctcatttggtgaaacctatgacaaagccaccatccaccaaggtcgagatcaggaataagtccatcaccttcccaactacggagcccggggaaacatctgagagctgcctggagctggaaaatcacgggaccaccgacgtaaagtggcatctgagcagcctggcccccccatacgtcaaaggggtggatgagagtggggatgtgtttagagccacctatgccgcgttccggtgcagccctatcagcggtttgttggagtcacatggaattcagaaggttagcatcaccttcctaccgagagggaggggagattacgcccagttctgggatgtagagtgtcaccctctgaaagagcctcatatgaagcacactttaaggttccagctgtctggccagtctatagaggcagaaaacgagccggaaaatgcttgcctgtccaccgactccctcattaaaattgaccacctcgttaagcctagaagacaggctgtgtcagaggcctcagccagaatccccgaacagcttgatgtgaccgcgcgaggagtctacgcaccagaggacgtatacaggtttaggccaacgtcagtgggggagagtcgcacccttaaagtcaatctccgaaataactcgttcattactcattccctgaagttcctgtctcctagggaacctttctacgtcaaacactcgaagtactcccttcgcgcacagcactacattaatatgccagtccaattcaagcctaagagcgcagggaaattcgaggcactgctggtgatccagaccgacgagggcaagagcattgccattcggttaatcggcgaagcccttggcaagaattag

SEQ ID NO: 16643 - DNA, 1545 bp, Artificial Sequence
  Description of Artificial Sequence: Synthetic coding sequence
atgtctatctcttcagacgaggtcaatttcctcgtgtacaggtatcttcaagagagcggttttagtcattccgcattcacatttgggatcgaatcccacatctcccagagtaatatcaacggcgcgttagtgccccccgcagcactgatctctattattcaaaaaggtctgcagtatgttgaggccgaggtgtctatcaacgaagatggcacgctgtttgacggacgccccattgaaagcctgtcactaatagatgccgttatgcctgatgtggtgcaaacccggcagcaagcgtacagggataagctggctcagcagcaggccgcagcggccgcagccgctgcagccgctgcatcgcagcaggggagtgccaagaatggcgagaacacggctaacggcgaagaaaacggcgctcatactatagcaaataatcacaccgacatgatggaggttgatggagatgtcgaaatccctcccaacaaagccgtggtactccgcgggcatgagtcagaagtcttcatttgcgcatggaaccctgtctcagatctactagcctccggcagtggcgacagtacagctagaatctggaatctgagcgagaactccacgtccggcagcacccagctcgtacttagacattgtattcgggaaggaggccaggatgtcccaagcaataaagacgtgacctccctggattggaatagtgaaggcaccttactggctaccggtagctacgacggatttgcccggatttggaccaaggacggcaacttggcctccacgctcgggcagcataaaggtcctatctttgccctaaaatggaacaagaagggaaactttatcctttccgctggtgtagacaagaccactatcatctgggacgcgcacacaggggaggctaaacagcagttcccctttcacagcgcgcctgctttagacgtcgactggcagtctaataatacgttcgcaagctgttccacggacatgtgtatccacgtctgcaagttagggcaggacaggcccatcaagacttttcaaggacacactaacgaggtaaacgctatcaaatgggatcctacaggtaacctccttgccagttgttctgatgacatgacacttaagatctggagtatgaaacaggacaactgcgtgcacgacctccaggcccataataaagagatttacaccattaagtggtccccaacgggacccgggacaaacaatcccaacgctaacctgatgctcgcctccgctagctttgattcgaccgtgagactctgggacgtggatcgaggcatctgtattcacactcttaccaagcatcaagaacccgtgtactccgtggctttttctcccgacggccgttatcttgccagcgggtccttcgataaatgcgtgcacatctggaatactcagactggagcattagtgcatagctatcgcgggaccggggggatctttgaagtgtgttggaacgcggcgggggataaagtgggggcatcagctagcgacgggagcgtttgcgtattggatcttcgtaagtag

SEQ ID NO: 16644 - DNA, 2034 bp, Artificial Sequence
  Description of Artificial Sequence: Synthetic coding sequence
atggaagaaacaatgaagttagccacgatggaggacacagtcgaatactgcctgttcctgatccccgacgagtcacgggattcagacaaacataaagagattttgcagaagtatatagaaaggattatcacccggttcgcccccatgctcgtaccatacatctggcagaaccagccatttaacctcaagtataagcctggcaaaggcggtgttcctgctcacatgtttggcgtgaccaaattcggagacaatattgaagatgaatggtttatcgtctacgtcattaaacaaattactaaggagtttccagaactggtggcacgtatagaggataatgacggcgagtttttgcttatcgaagccgcagactttctgcccaaatggctagatccagagaactcaaccaatcgggtctttttttgccacggcgagctctgcatcatcccagcgccccgaaagagtggtgcagagtcttggctgccaaccaccccccccacaattcctcaggctctgaatattataactgcacattccgagaagatcctcgcgtccgagtctatccgagccgctgtgaataggcggattcgagggtaccctgagaagatccaggcatccctgcaccgggctcattgttttcttccagccggaatcgtagctgtactaaagcagcgccccaggcttgtggctgccgccgttcaggccttctacctgcgggatcctattgacttgcgggcatgcagggtttttaagacttttttaccagaaacacggataatgaccagcgtgacctttactaaatgcctttacgctcagctggtgcagcagcgatttgtccccgatagacggtccgggtataggctgccacccccatccgacccacagtacagggctcacgagctcggcatgaagctagcccacgggttcgagatcctctgctccaagtgcagtccccatttttccgattgcaaaaagtctctcgttaccgctagccccttgtgggcgtcttttctcgagagcctgaagaagaatgattactttaaagggttgattgaagggagcgctcaataccgggaacgtctggagatggccgaaaattactttcaactttctgtggactggcccgagcggttggaggtgcagtggcgcgaccctggactcctgcaggccccaccaccaggatttaccccatttatctgcctcagtctcctgtcaacatgggacaattctagtctggccatgagccccggcgaggagatcctcacgttgttgcagactatcccattcgatatcgaggacctgaagaaggaagctgccaacctgcctcccgaggatgacgaccagtggctcgatctgagtcccgaccagcttgaccagcttttgcaagaagccgtcgggaagaaagagagcgaaagcgtaagcaaagaagaaaaggagcagaattacgacttgaccgaggtatccgaatcgatgaaggctttcataagcaaggtcagtacacacaagggcgcagaacttccacgggagccatccgaagcgcccataacgttcgacgcagattcctttttgaactactttgacaagattctgggcccccggcctaatgaatctgatagtgacgatttggatgacgaagacttcgaatgccttgattccgacgatgatctggattttgagacccacgagcccggagaggaggctagcctcaaaggaacattggataaccttaaatcttatatggcacaaatggaccaggagcttgcccacacttgcatctccaaatccttcaccacccggaatcaggtcgagccagtttcacagacaaccgataacaattcagacgaggaagacagtgggaccggagaaagcgtgatggcaccagtggatgtggatttgaatctggtgtctaacatcctcgagtcgtactcctctcaagccggtctggcaggacccgctagtaacctgctgcagagcatgggcgtgcagctccctgataatactgatcaccggcccacttccaagccaacaaagaactag

SEQ ID NO: 16645 - DNA, 1821 bp, Artificial Sequence
  Description of Artificial Sequence: Synthetic coding sequence
atggaagagtcgcccctttcacgggccccttcacgcgggggcgtgaactttttgaatgttgcgcggacatacattcccaacacgaaagtcgaatgccactatactttgccccctgggacaatgccctccgctagtgattggatcggaatattcaaagtggaggccgcttgtgtgagagactatcatacgttcgtctggtcgtccgtgcccgagtctacaacggacgggtctccaatccacacaagcgtgcagttccaggagccacgccctatggacgagctcgtcacactggaggaggctgatggaggaagcgacatattgctcgtggtgcccaaagccacagtgctgcagaaccagctagatgagtctcagcaagaacgcaatgatctcatgcagctaaaactgcagctcgagggacaggttacggagctcagatctcgcgtgcaggagctcgagcgcgctttggctaccgcaaggcaggaacataccgagctgatggaacaatataaagggattagcaggtctcatggggaaatcaccgaagagcgtgacatcctcagccgacagcaaggagatcacgttgcaaggattttagaactggaggatgatatccagaccattagtgaaaaagtcctcacgaaagaggtggagttggatcgtctgcgtgatacagtcaaagctctcacccgagagcaagaaaagctgctaggtcagcttaaagaggttcaggcggataaggagcaatctgaggccgaactggaaccactaaaagaacaacttaggggggctcaagagttggctgccagttcacaacagaaagccacactactgggcgaggagctggcaagcgcggccgcagccagagacagaaccatcgctgagttacatcggagcaggctcgaagtggcagaggtgaacggccgcttggcagagttggggctccatctgaaggaagagaaatgtcagtggtctaaggagagagcaggcctgctccagagcgtagaggcagagaaagataagatccttaagctgagcgcagaaattttaaggcttgaaaaggctgtgcaggaggagagaactcaaaatcaggtgttcaaaaccgagctggcccgtgagaaggattcctccctggtgcaactgtctgagtctaagcgggagttgactgaacttcgctccgcactgcgggtccttcaaaaagaaaaagaacagctccaagaagaaaagcaggaactccttgaatatatgcggaaactcgaagccagactggagaaggtcgcagacgagaaatggaatgaggacgctacaactgaggacgaggaggctgccgtgggcctaagttgtccagccgctttgacagatagcgaggacgagtctcccgaggacatgaggcttccaccatacggactgtgtgagcggggagacccagggagttcccccgccggtccacgggaggccagtcctctcgtcgtgatttctcagccagcccccatctcaccccatctgtctggcccagccgaagactcctcatcagactctgaggcggaggacgagaagagtgtcctcatggccgctgtgcaaagcggaggtgaggaggcgaatttgctgttgccagaactgggaagtgcgttctatgatatggcctctggtttcaccgtaggcaccctgagcgagactagtactggcggcccagcgacccccacctggaaggaatgtcccatttgtaaagagcgcttccctgccgagtcagataaggacgccctagaggatcacatggatggacactttttcttttctacccaggacccgtttactttcgagtag

SEQ ID NO: 16646 - DNA, 2997 bp, Artificial Sequence
  Description of Artificial Sequence: Synthetic coding sequence
atgaacagaagaagaaaatttctattagcttccgtattggcactgcagaacagctcattcatatacccttcatgccaaaagtgcttctccaggataatcctggtctccaagagatctaactgtccgaagtgcggctcaactggggagtcgggaaacgccaactaccgatataagttgtctttaaaggtagcagagagtaataagctcttcgtgattacagttttcggtagctgtctggacacatttttcgggctaacagctaccgggctgcatcggtatatacaggaccccaacaaaataccagagaccttggataatgatacaacccagaatcttttgacaaaagccgtcgaaacttgctttgtgggacagtcgttcatctttggcgtaacgaattttgagaatcagcctggacagggctcagatgcaagtaactttctccagcagtgttctgatcataagcgcaaagccaaagcactggtagcatgccagattgtgttgcccgacccgggaattgccggatttaccgtgatcgattacttccaccagttgctccagactttcaatttcaggaaactacagtgtgactctcaggcaccaaacaaccaccttctcgccctcgatcattccaactccgatctatcctctatttatacttcggactctacaagtgatttcttcaaaagctgcagtaaagacacgtttagcaaattctggcaaccttcattggagtttacctgtattgtcagtcagctcacggacaatgacgatttttcagccagcgaacagtccaaggcattcggaacgctgcaacagaaccggaagtctatttctattgcagaagccaccggcagctctagctgtcacgaccccattcaggattcctggtccctcgtgtcctatatggacaagaagtctaccgccgaaaaattggggaaagaattgggcttacaggccaaagagctcagtgccgtgcacagctcccatcacgagataggggttaacgatagtaatctcttcagcctggagatgcgagagccgctggaatcgtctaacaccaagtccttccacagtgccgttgagatcaaaaaccgtagccagcacgaactcccttgtttccagcatcacgggatagacacaccaacctctctgcagaagagatcagcttgctgtcctccctctctgttgcgactggaagaaactgcaagctcctcccaggacggagacccccaaatttgggacgaccttccctttagcgaaagcttaaataaattcctggcagttctagagagcgaaatcgctgtgacccaggcggatgtgtctagtcgcaaacatcacgtggacaatgatatagacaagttccacgcagaccactctcgcctgtccgtgactccccaacggactacaggcgcactgcacaccccaccaatagcactccgctcttcccaggtcatcgtgaaggcgaattgttccaaggatgattttttgtttaattgtaaaggaaatctgagtccttccgtcgagaaagagagccaacccgacaacaaggtcgaagctgtgtcggtgaaccataacggacgcgatatgtctgaatactttctacctaacccatacttatcggcactttcttcctcttctaaggatctggaaactatcgtcacattgaaaaaaaccatccgaatttctccccaccgagagtcagaccactcttctcttaataacaaatacctgaatggttgcggagaaatttccgtgtccgagatgaatgagaaactgacaaccctatgttatcgcaaatataatgacgtgagcgacctctgcaaactggaaaataaacagtattgtaggtggtctaaaaaccaggatgatagcttcactatctgccgcaaactgacttatcccctggaaaccctgtgcaatagccctaataggtccacgaacacactaaaagaaatgccatgggggcatatcaataacaacgtgacccagtcatactcgatcggttacgagggttcttacgatgccagtgccgatttgttcgacgatattgctaaggaaatggatatcgcaaccgaaatcactaagaagagccaggacattcttctgaagtggggcacctccctcgcagagtctcatccatcagagtccgacttcagcctgagaagcctgtccgaggactttattcagccgtctcagaagctctctctgcaaagtctcagcgattccaggcactcaagaacatgcagtccaacaccccacttccagtcagacagcgagtacaacttcgagaatagccaggactttgtgccttgctcccagtctaccccaatttcaggctttcatcagacccggatccatggtatcaatagggcgtttaaaaaacctgtgttctacagtgatctcgacggtaactacgagaagatacgtatcttcccagagaatgataaacagcaggcttcccccagttgccccaagaatattaagactccgagccagaagatcaggagccctattgtgagcggcgtgagtcaacccgatgtgttcaatcactaccccttcgctgaatgccatgagacagatagcgatgaatgggttcccccaaccacccaaaaaattttcccatcagatatgctcggattccaggggatagggctgggcaagtgtctcgcagcttaccactttcccgaccagcaggagttgccccggaagaagcttaaacacatcaggcaggggaccaacaaaggacttattaagaaaaagctaaagaatatgctggcagcggttgtgaccaagaaaaagactcataaatataactgcaagtccagtgggtggatctccaaatgtccagatatccaggtgttagctgccccgcagctccaccctatactcggacccgactcgtgttctgaagtgaagtgctgtctaccattcagtgaaaaagggcctcccagcgtgtgcgagacaagatccgcctggtcccccgagctattttcctag

SEQ ID NO: 16647 - DNA, 471 bp, Artificial Sequence
  Description of Artificial Sequence: Synthetic coding sequence
atggccgactctccggggggctataaggagtgcggtacgaatgaaggcccacaggaggacgagaacggatcttcagcttccggatcatcgaaggtgcggcagctgtggtctgaagattcctgtgaatccggtaagttacctgccaccaggaccgtctactgcatgaacgaggctgagatagtagacgtggccctgggcatcctgatcgaatcccgaaaacaagaaaaggcgtgcgagcagcccgccctggctggcgccgacaatcctgagcattcacctccttgctccgtgtccccacatactagtagcggctctagctctgaggaagaagattctggaaagcaagccctcgcacctggactctctccaagccagaggcctggagggtcctcgagcgcctgttctcggtcccctgaagaagaagaagaggaagatgtgcttaaatacgtcagagagatttttttcagctag

SEQ ID NO: 16648 - DNA, 1377 bp, Artificial Sequence
  Description of Artificial Sequence: Synthetic coding sequence
atggctgaactgcagatgctgctggaagaggaaatccctggcggccgcagagccctctttgattcctacacaaacctggagagggtggcagactactgtgagaataattatatacagagcgccgataaacagagggccctcgaggagacgaaggcctacactacccaaagtttagctagcgtggcgtacctaatcaatacgctcgcaaacaatgtcctgcagatgctggacattcaggcttctcagctcagaagaatggagtcctcaatcaaccacatatctcaaactgtggatatccataaggagaaggtcgcccgcagagagatcggtattcttacgacaaacaagaataccagtaggacccacaagatcattgcgcctgctaacttggagaggcccgtgagatacatcaggaagccaattgactatacgatactggacgacatcggacacggcgtgaaagtctccacccagaacatgaaaatgggcggcctcccacgcaccacgcctccgactcagaagcccccgtcacctcccatgagcggcaagggtacactgggctcatcaggatcatctggggggagtcatccgagtagcaggtcatcctcccgagagaactccggatccggctccgttggcgtcccaatcgccgtcccaaccccctcccccccgtcggtgttccctgcgcctgccggttctgcgggaacgccaccattacccgccacaagcgcctctgcaccagcgcccctcgttcccgccactgttccaagctccacagcccccgacgctgccgccggcggcgcccagacacttgctgatggctttacctcacccacacctccggtggtgagttccaccccacccacaggccaccctgttcaattctattctatgaatagaccagccagtcggcatacccctcctacgatcgggggatcgctgccttaccgccgtcccccctctattacgtcgcaaacctcactccagaaccagatgaatggagggcctttttattctcaaaacccggtttctgataccccgccaccccctccacccgtggaggagccagtgtttgacgagtctccccctccacctccccctcccgaggactacgaggaagaggaggctgctgtggtggagtactccgatccgtatgctgaggaagatcccccgtgggctccacggtcatatctcgaaaaagtggtggcgatttatgactatactaaggataaagaggatgagctgtctttccaagagggcgctattatttacgtgataaagaagaatgacgacggatggtacgagggcgttatgaacggcgtaacagggcttttccccggcaactatgttgaaagcattatgcattattccgagtag

SEQ ID NO: 16649 - DNA, 5223 bp, Artificial Sequence
  Description of Artificial Sequence: Synthetic coding sequence
taaaaaatttatccagaggagattactcccttactgcccgccatctccggcgaaaaaatagctgaagaccaaacatgtttttttctccagatactgctgaagtatatggttatccaagcggcctccctcgaatggaagaataaggaaaaccaagacacagggtttaagttcctgtttacgctcttcaggaagtactacctgcctcacttatttccctcctttactaagctaactaacatatacaagccagtgctcgacataccgcatttgagacccaagcctgtatacatcaccaccactcgcgataacgaaaacatatattctactaagattccctatatggctgcccgggtggtctttatcaagtggatcgtaacctttttcctggaaaagaagtatttgactgccactcagaatactaagaacggggtagatgtgcttcctaaaatcatccagaccgtcgggggcggtgccgttcaggagcgcgcccccgagcttgacggcggaggccccaccgagcaggacaaatctcacagtaatagctctactctctctgatcgacggctctctaactcttcactgtgctccatcgaagaagaacaccgcatggtttacgagatggtccagcgaatacttttgtccacacggggctacgtcaactttgttaacgaggtctttcaccaggcgtttttgctgccaagttgtgagattgcagtgacgcgtaaggtagtccaggtttaccggaaatggattctccaggataagcccgtgttcatggaggagcctgatcgtaaagacgtggcgcaggaggacgccgagaagcttggcttttctgagactgacagtaaagaagctagttcagaatcctctgggcataagaggtcctcatcttgggggcggacatattcctttacctccgcgatgtcccggggatgcgtaaccgaggaggagaatactaacgtcaaggctggcgttcaggccctgctccaagtctttctgactaattctgctaacatatttctgctcgaaccatgcgccgaagtaccggttctcctcaaggagcaggtggacgcctgtaaagccgttctgatcattttcaggaggatgatcatggaacttaccatgaacaaaaagacttgggagcagatgctgcaaatcctcctcagaatcaccgaggccgtcatgcagaaacctaaggacaagcagataaaagacctgttcgcccaaagcttagccgggctcctttttagaactttgatggttgcttggattagggctaacttatgtgtttacattagtcgggagctgtgggatgatttcctgggcgtcctgtcgagtctgaccgagtgggaggaactgattaatgagtgggcaaatatcatggactccctgacggctgttctcgcacgcacagtatacggcgtggagatgactaacctccctctggataagcttagcgagcagaaggagaaaaagcagagaggaaagggatgtgtgttagatcctcaaaaagggacaactgtgggtagatcgttcagcctcagctggaggtcccatcccgatgtgacagaacctatgagattcaggagcgccaccacaagcggcgcaccaggcgtggagaaggcgcgaaacatagttcgtcagaaggcaacagaggtcgaggaatgtcagcaatcagaaaacgctccggcggcgggatcgggccatttaaccgtagggcagcagcagcaggttcttcggagttcttcaacttctgatattcctgagcccttgtgttccgattcctcacagggccagaaggcagagaatacacaaaacagcagtagcagcgaacctcagccgatccaagagaacaagggccacgtgaagcgagaacatgagggtattacaattctggttaggcgcagcagctcccctgctgaactcgacttgaaggatgacctacagcagactcagggcaagtgccgagaaaggcagaagtccgagtccactaactccgatacaacactcggctgtacaaatgaggcagaactaagcatggggccatggcagacttgcgaggaggacccggagctcaacacgccgaccgatgtagtagcagatgcagacgcccgccattggctgcaactttcgcccaccgatgcgagcaacctgacagacagctcggaatgcctgacagacgactgttcaattatagcgggaggcagcctgaccgggtggcacccagacagtgccgctgtgctttggcggagggtgctgggcattttaggggatgtgaacaacatccagtcccctaagattcatgccagagttttctgctacctgtatgaactgtggtataaactggcaaaaattcgggacaacctcgccatttccttggataatcagtcaagccccagtcccccagttctgattcccccactgcgcatgttcgcatcctggctctttaaagctgctacgctcccaaatgaatataaagaaggaaaactacaggcataccgtctgatctgcgctatgatgaccaggcggcaggatgtactccccaattcagacttcctggtgcatttttacctcgttatgcatctgggactgaccagtgaagaccaggacattctgaacactatcataagacattgcccaccacgtttcttctctctgggtttcccgggctttagcatgttggtcggcgacttcatcacagccgccgcccgcgtgctgtctacagatattttgaccgctccacgcagcgaagcggtaactgtgctaggttcactcgtgtgctttcccaacacttatcaggagatacctctccttcagagtgtgccagaggtcaatgaagccattactgggaccgaagacgtgaagcactacctgattaacatcctgctgaagaatgctactgaagagcccaacgagtacgcgcgctgtattgcagtttgtagcctgggcgtttggatatgtgaggagctagcacagtgtactagccatccccaggttaaagaagccattaatgtaatcggtgtgacattgaagtttccgaacaaaattgtggctcaggttgcctgcgatgtccttcagctgcttgtgtcctattgggagaagctccagatgttcgagacctctctaccccgtaaaatggccgaaatcctggtcgccacagtggctttccttctgcccagcgccgagtacagcagcgtcgagactgacaagaaattcatagtgtctctcctgctgtgcctgctggattggtgtatggccctgcccgtctccgttctattacaccccgtgtcaaccgcagtcctagaggagcagcactccgcgagggcccctctacttgactacatctatcgtgtgctgcactgttgtgtgtgcggttctagcacctatacacaacagtcccactacatcctgaccctggctgatctgtcctctacggattatgatccctttctacctctcgccaacgtgaagtccagtgaacccgttcagtatcacagttcagcagagctgggaaacctgctcacagtggaggaggaaaagaaaagacggtctcttgagctgatcccccttaccgcaagaatggtgatggcacatctagtgaatcacctgggtcattatcccctgagcggcggcccggcaatactccacagcttagtctccgagaaccatgataatgcacacgttgagggatctgagctgagcttcgaggtgtttcggtcacccaatttgcaactctttgtgttcaacgatagcacccttatcagctaccttcagacgcccaccgaaggacctgttggagggtccccagtcggaagcttatccgacgttcgggtcattgtgagagacatctcgggtaagtactcgtgggacggtaaggtgttatacggaccgttagagggttgcctcgcacctaacggccgcaaccccagtttcctgatctcctcctggcaccgggacacttttggccctcagaaggactccagccaggtagaggagggagacgacgttctggataagctgttggagaatatcggtcatacttcgccagagtgtttattaccatcgcagttgaatctgaacgaaccgtctcttacaccctgtggcatgaactacgatcaggaaaaggagataatcgaggttatcctgcgccagaacgcacaagaagatgaatatatccagagtcataacttcgacagcgcaatgaaggtcacgtctcaggggcagccctcccctgtcgagccacggggccctttttatttctgtagattgcttctagacgacctcgggatgaattcctgggatcgtagaaagaacttccatcttctgaagaaaaactctaagctgctgcgtgaactgaaaaatctggattccaggcagtgtcgcgagactcataagatcgctgttttttacatcgcggaaggacaagaggataaatgctccatcctgtctaatgaaagggggtcccaggcttacgaggatttcgtagcaggcctggggtgggaggtcgacttgagtacccactgtgggtttatgggtggactgcagcggaatggaagtactgggcagaccgcaccctattacgccacaagcacagtggaggtgatcttccatgtcagcactcgcatgccttctgactccgatgattccttgacgaaaaagcttcgccacctggggaacgacgaggtccatattgtatggagcgagcactcccgggactatagacggggtataattccaacagcatttggtgatgtttccattattatatatcctatgaaaaaccatatgttcttcatcgctatcaccaagaagcccgaggtgccctttttcggccctcttttcgatggcgctattgtatcgggtaaactcctcccttctctagtgtgtgcgacatgcatcaatgcatcacgagcagtgaagtgtctaattcctttataccagtctttctacgaggagcgtgcactctacctggaagcgatcatccagaatcatcgcgaagtgatgacattcgaagattttgccgcacaggtctttagtccctctccttcctatagcttgagtggaaccggcgctcttgctagctccctgtcagctgatttggaagagcccttatcagaagaggaaacggaacatccactcctacccctcccacgtgccacaaagcctcgtataagtagaaagtttcggtgctgcacttccgcgctgtctagatcgtcacactag

SEQ ID NO: 16650 - DNA, 1836 bp, Artificial Sequence
  Description of Artificial Sequence: Synthetic coding sequence
atgccgcaccttgatatgaagacacatgtgtgtccgagtgtggaggggcccaaaaaaaaaggagggattacctgtttttgttgtggaggccccttcagggccgcagacagatccaagaccaggagccctaaactgagccacagccctcagcctccctccctgggggatcctgtggagcacttgtccgagacaagtgcagattccctggaagccatgtctgagggggatgctccaacacctttttctagaggctccagaacacgtgcctccctcccagtggtccgctctaccaaccagactaaggaaaggtctcttggagtgctctacctgcaatatggtgacgagacaaaacagctcaggatgccgaacgagatcacctccgccgatactattagagctctgttcgtgtctgcattcccgcaacagttgaccatgaagatgctggagagccccagtgtggcgatttacatcaaggacgagtctcgcaacgtgtactacgagctcaacgacgttcgaaacattcaggatcggagtctgttgaaagtgtacaataaagaccctgcacacgcctttaaccacaccccgaaaaccatgaatggtgacatgagaatgcaacgggagctcgtgtacgctcggggagatggccctggagcgccccggcctggatccaccgcccacccaccgcatgcgattcctaattcacctccctccaccccagtccctcactctatgcccccctccccctccagaattccatacggtggtactcgctctatggtggtccctggcaacgctaccattcctagggaccgtatctctagcctacccgtcagcagacctatcagccctagtcccagcgctatcctggagagaagagatgtaaaaccagatgaggacatgtctggcaaaaacatcgccatgtatcgcaatgaaggattctacgccgatccgtacctgtatcacgaggggcgaatgtctatcgcatcatcacacggcgggcatcctctggatgtgccggatcatataattgcataccacagaactgctattaggtcagcctccgcctattgcaacccatccatgcaggctgagatgcacatggagcagtcgctgtatcggcagaagtctcgcaaatatcctgactctcatctgccaacccttggtagcaagacccctcccgcatctccccaccgagtgtcagatctcaggatgatcgatatgcacgcccactataacgctcatgggcctcctcacactatgcagccagatagggcttctccttctaggcaagccttcaagaaggaacctggaaccctcgtttatatcgagaagccccgatctgctgcgggcctctctagccttgtagacctggggccaccattaatggagaagcaagtctttgcttattccactgcgacaattcccaaagaccgagagaccagtgagaagatgatgaagactactgctaatcggaaccacactgactcagcgggcaccccgcacgtcagtggagggaagatgctctcagctttggagtcaactgtgcccccatctcagcccccgcctgtgggaacgagtgctattcacatgagcctcctcgaaatgcgcagaagcgtggctgaactgcggttacagctccagcagatgcgtcaattgcagctgcagaatcaggagttgcttcgcgctatgatgaaaaaggcggagctggaaatcagtggaaaggtcatggaaaccatgaaacggctggaggatcccgtccaaaggcagcgcgttctagttgaacaagagcgacaaaaatacctccacgaggaggaaaagatcgttaaaaagctttag

SEQ ID NO: 16651 - DNA, 189 bp, Artificial Sequence
  Description of Artificial Sequence: Synthetic coding sequence
tgagagaatcctctggtctactgcgatggccatggctgctccgtggctgtccatcaggcttgttatggaatagtccaagtgcctaccgggccttggttttgccgaaagtgcgagtcccaagagcgcgcggcccgggtggttggccctatgtggttcgtcccatgcatcttccagagatataatttgtag

SEQ ID NO: 16652 - DNA, 1869 bp, Artificial Sequence
  Description of Artificial Sequence: Synthetic coding sequence
atggccatggcaccatctccaagcttggtgcaggtttatacatccccagcagccgtggctgtgtgggagtggcaagatggactcgggacctggcacccttattcggccacagtatgttcttttatcgagcaacaatttgtgcagcaaaaggggcaacgcttcggcctggggtctctggcacacagcataccccttggtcaggcagaccctagcctggccccctacatcattgacctaccctcgtggacacagttcagacaagataccggaactatgcgcgccgtgcgcagacatctgttcccacagcatagcgcaccggggcgcggagtcgtctgggagtggctgtctgatgacggaagttggactgcatatgaagctagcgtctgcgactacctggagcagcaagtcgcgcgaggcaaccagttggttgacttggcccctcttggttacaactataccgtcaactatacaactcacactcagaccaataaaacatcatcgttctgcaggagtgtcagacggcaggccgggcctccctaccccgtgacgactatcattgctcctccagggcacaccggcgtggcctgttcttgccaccagtgcctctcaggctcgagaacaggacctgtaagcggaagatatagacactccatgactaatctgcccgcctatcccgtgccccagcatcctcctcataggactgccagtgtattcggaacacatcaggccttcgctccctataataagccttccctgtcaggagccaggtctgctccacggctcaacacaactaatgcttggggtgcagcacctccatctctgggtagccagcccctctacagatcctctctgtcccatttgggcccccagcacctgcctcctggatccagcactagtggggcggtgagcgcaagtctgcccagcggtccctcatctagtcccggctcagttcccgctaccgtgccaatgcaaatgccaaaaccaagccgggtgcagcaagccctcgcgggcatgacaagtgtgttaatgtctgcaattggcctgcccgtatgcctctctcgtgcccctcagccaactagccccccagccagccgcctcgcatcaaagagccacggaagcgtcaaacggctcaggaaaatgagcgtgaagggcgcaactccaaagcctgagccagagcccgagcaagttattaaaaattacaccgaggagcttaaggttccgcccgacgaggattgcatcatctgcatggagaagctgtccactgctagcggttacagtgatgtgaccgacagcaaggccattgggagcctcgccgtgggccatctgaccaagtgcagccacgcgttccatctgctctgtctactcgccatgtactgcaatggcaataaagacggctcccttcaatgcccctcgtgtaagaccatttatggcgaaaagacagggacccagccccagggcaagatggaagtacttagatttcagatgtcattacctggccatgaagattgtggtaccattttgattgtctatagtatccctcatgggattcagggccccgagcatcccaaccccgggaaacctttcacagcccgcggattccctcgccagtgctacttacctgataatgcccagggcaggaaggtgctggaactgctgaaagtggcatggaagcggagattgatcttcacagtcggcacatcctccacgactggagagacggatacagtggtgtggaacgagattcaccataagacagaaatggataggaatattaccggacatggctacccggaccctaactacctgcagaatgtgctggccgaactggcggctcagggcgtgaccgaagattgtctggagcagcagtag

SEQ ID NO: 16653 - DNA, 546 bp, Artificial Sequence
  Description of Artificial Sequence: Synthetic coding sequence
atgggcgggaggagtgcacaggcgggtcttggcacccggatcacccctatgatggaacttaaaccaaacgccggaagtgaccgggcatgggtgtggaatacacatgccgattttgccgatgagtgtcctaaacccgagctccttgcaatcaggttcttgaacgccgagaatgcacagaagtttaaaactaagttcgaggagtgtagaaaggagatcgaggaaagggagaaaaagggtgatgtggtcccttgggtcggagggctcctgtgcagattgactctgcacctcacaatcctgcccggaggatgttttttttgtctccccgacaagcacagccgggtcctttggccaccccacgtcagccgggttatgcaattgcctggcgacaccggagcaagttggggcgctttatctacttgccagtgttgttggcctcaaagcaattgggccgggatcggtgttagggctctgcctggggcacatcagaaagtgctttacgacggacccaggtttgttagccagcgggcttggtcacctctgccttag

SEQ ID NO: 16654 - DNA, 378 bp, Artificial Sequence
  Description of Artificial Sequence: Synthetic coding sequence
atgtccagctctggatacccacccaatcagggggccttcagtaccgagcaatccagataccccccccattcagtccaatatacctttcccaacactaggcatcagcaggagttcgcagtgcccgattatcgaagctcccacttggaagtgtcccaggccagtcaattattacagcaacaacagcagcagcagctcagacgccgtccaagtttgttatccgaattccacccagggtccgaccgacctcaggaacggaggacgtcctatgagccctttcacccgggccctagcccagtggatcacgactctctagagtccaagagaccccgcttggaacaggtttcagactcccacttccagcgcgtctccgccgcctag

SEQ ID NO: 16655 - DNA, 318 bp, Artificial Sequence
  Description of Artificial Sequence: Synthetic coding sequence
atgttaagatgtggacaaatgatatttgcgcaggcactggtttgcagacacctggggagggattggagatggactcagcgcaaaagacaaccagacagctatttttccgtgcttaacgcatttatcgaccggaaggacagttactactccatccaccagatcgcgcagatgggggtgggagaaggaaaatccattggccagtggtatggtccaaacactgtcgcccaggttctcaaaaagcttgctgtattcgacacatggtcttctctcgcagttcatatcgccatggacaataccgtggtgatggaggaaatctag

SEQ ID NO: 16656 - DNA, 1305 bp, Artificial Sequence
  Description of Artificial Sequence: Synthetic coding sequence
atggacattgataaagatcttgaggccccactgtacctgacaccagaagggtggtcgttattcttacagcgttactaccaagtagtccacgagggcgccgaattacggcacctggacactcaggtgcaacgctgcgaagatatcctgcaacaactccaagccgtggttcctcagatcgacatggagggcgatagaaatatttggattgtcaagccaggcgcaaaatccaggggtagggggataatgtgcatggaccatcttgaagagatgctgaagctggtaaacgggaatccagttgtgatgaaagacggcaagtgggtggtccaaaagtatatcgaaagaccgttgctgatattcggaaccaagtttgacttgcggcagtggtttttagtgacagactggaatccattaaccgtgtggttctacagggattcctacattagattctccacgcagccttttagccttaagaatctcgacaacagcgtccatttgtgcaataatagcatccagaaacacctcgaaaattcctgtcaccggcaccccctgctgccaccagacaatatgtggagctcgcagcggttccaagcccaccttcaggagatgggcgcccctaatgcctggagcactataatcgtgccaggtatgaaagacgctgtcattcacgccctccagacaagccaggacaccgtccagtgccggaaggcaagcttcgaactgtatggtgcagatttcgtctttggtgaggacttccagccatggcttatcgaaatcaacgcaagtccaactatggcccccagcactgccgtgacggcccggctttgtgccggcgtgcaggctgacacattgagagttgttattgaccgcatgctcgaccgtaattgtgataccggtgcctttgaactgatctataaacagcccgctgtcgaagtgcctcaatatgttggcatcagattgttggtggagggattcaccataaagaagccgatggctatgtgccaccggagaatgggcgtgcgccctgctgtccctctcttgactcaaaggggcagtggtgaagccaggcatcattttccctctctgcatacaaaagcacagctgccatcaccgcatgtgctcagacatcagggtcaggtactcaggcggcaacacagcaagctggttggcactaaagctctgtctaccaccggcaaggcgctgcgcaccttacccacagccaaggtctttatctcattacctcccaatctggactttaaagtcgccccctctatcctcaaaccacgaaaggtgggcctggatctgtag

SEQ ID NO: 16657 - DNA, 576 bp, Artificial Sequence
  Description of Artificial Sequence: Synthetic coding sequence
atggccattggaaagaggctggcaacattacctacgaaggaacagaagacgcagagactgatcagtgagctctctcttttgaaccataagctgcccgctcgtgtgtggctgcctaccgccggctttgaccaccacgtcgttagggtgccccatacccaggcagtggtgctaaattccaaggacaaggctccatacctaatttacgtggaagtgcttgagtgcgagaacttcgatacaacctcagttcccgcccggatccccgagaacaggattcgcagtacccggagcgtggagaatctccccgagtgcggcatcacccacgaacagagggctggctcttttagcacggtccctaattatgataacgatgatgaagcctggtccgtcgatgatattggcgagctgcaggtagaactgcccgaagtgcacacgaactcttgcgacaacataagccaatttagcgtcgacagcataacatcccaggagagcaaggagcccgtatttatagccgcgggtgatatcaggcggcgcctgtctgaacaactggcccacacccctaccgcctttaaacggtag

SEQ ID NO: 16658 - DNA, 903 bp, Artificial Sequence
  Description of Artificial Sequence: Synthetic coding sequence
atggcaaaatggggtcagggaaacccacactggatcgtggaagagagagaggatgggacaaatgtaaataattggcgctggcgtaccgagcgggatgcgacatcattaagtaaagggaagttccaggagttactggtcggcatcgtggtggaaaatgatgcagggcgaggggagatcaatgagctcaagcaagtggagggtgaagcctcttgcagctcccggaaaggcaagctgatttttttctacgagtggaacatcaagctgggctggaagggtattgttaaggagagtggtgtaaaacacaaggggctgatcgagatccccaatctatccgaagagaacgaggtcgatgatacagaagtatccctgagcaaaaagaaaggagacggcgtgatcctgaaggaccttatgaagactgcggggactgcaaaggtgcgggaagctctgggcgattatctgaaggcgctgaagactgaatttactactggaatgatcctacccactaaggcgatggccacacaggagctgacagttaagcgcaagctctctggaaatacactgcaggttcaggctagttccccagtagcattaggggtgaggatccccacagtcgcccttcacatgatggagctgttcgatactaccgtcgagcagctgtactcgattttcaccgtgaaagagctgactaataaaaagataattatgaagtggcggtgtgggaactggcctgaagagcattatgcgatggttgcactgaattttgttccaaccttaggacagaccgaactccaattgaaggagttccttagtatttgcaaggaagaaaacatgaagttctgttggcaaaaacaacattttgaggaaattaaaggatccctccagctgacaccactaaacggttag

SEQ ID NO: 16659 - DNA, 1137 bp, Artificial Sequence
  Description of Artificial Sequence: Synthetic coding sequence
atgaaggacgtccccggattccttcaacaaagccagaactctggcccgggccagccagccgtctggcataggcttgaagagttgtatacaaaaaacttcatgaagactctcagcgtaaaccttaacactggtaaatccctctccagcgtgtttcattttgaaaatgagtgtattgacgctcggaggtgtagtaaggccggcggattctattttagggtgaaccctttgtcgctcgtcgagattatcctgcatgtcgtcagacagatgactgaccctaacgtagccttgacatttctcgaaaaaaccagagagaaagtgaaaagctctgacgaggctgtgatcctgtgcaagacagccatcggcgctttgaagttaaacatcggcgatctgcaggtcacaaaagaaacaatagaggatgtggaagaaatgcttaataatctgcccggggttacaagcgttcattcccgattctacgatctctcctccaagtactaccagaccatcgggaaccatgcgtcatattacaaggacgctctgaggttcctgggttgtgtcgacatcaaggacctgcccgtgagcgagcaacaggagagggcgttcacattaggactggccggcctgttgggagagggcgtttttaactttggagaactgcttatgcaccctgtcttggagtctctgaggaataccgacaggcaatggctgattgacacattgtatgcattcaactcaggcaacgtcgagcgttttcagaccttaaagacagcatgggggcagcagcccgatctggctgctaatgaggctcagctccttcggaagattcagcttctctgtctgatggagatgacttttactaggccagccaaccatagacaactcaccttcgaggagatcgccaagtccgccaagatcacggtgaatgaagtcgaactactggtgatgaaggctctttcagtcggcttagtgaaaggctccattgacgaggtcgataagcgcgtccatatgacgtgggtgcaacctcgggtcctggaccttcaacagattaagggaatgaaagatagattagaattctggtgcacggacgtaaagagtatggaaatgctcgtggaacaccaggcccatgatatacttacctag

SEQ ID NO: 16660 - DNA, 603 bp, Artificial Sequence
  Description of Artificial Sequence: Synthetic coding sequence
atgctcttggaacagaatctgatcacagtggacatgcaaaagcatagtctcaccttttggtggttagtggagtgctggccccaggtgtttaacaagctaatccgccgatataagtatctcgaaaagggctttgaagacgaagtcaagaagttgctgctgttcttgaaaggcttttcagagtccgagaggaacaaactggctatgctgaccggtgtgttgctcgcaaacggcaccctgaacgcgtctatcctaaactccctgtataatgagaacctcgtcaaggagggcgtgtctgcagctttcgcagttaagctgttcaagtcctggataaacgagaaagatattaatgcagtggcggcctccctgcgaaaggtttccatggataatcgactgatggagttgtttcccgctaacaaacaaagcgttgagcatttcactaagtacttcaccgaggccggcctgaaagagctcagcgagtatgtacggaaccagcagacaatcggagcaagaaaggaacttcagaaagaacttcaggagcagatgagtcgaggtgacccatttaaagacatcatcctgtatgtaaaagaggagatgaaaaagtag

SEQ ID NO: 16661 - DNA, 1446 bp, Artificial Sequence
  Description of Artificial Sequence: Synthetic coding sequence
atggccagtgctgcatcagtgaccagtctggctgatgaggtcaattgtcccatctgccaaggtaccctgagggaacctgtcactatcgattgtgggcacaatttttgcagagcctgccttacgcggtactgtgagattcctgggccggacctggaagagagccccacctgccccctgtgcaaggaaccttttagacctggctcattcagacccaactggcagctcgccaatgtggtggagaacatcgagaggctacaactcgtatcaaccctggggttgggagaagaggatgtatgtcaggagcacggagagaagatctatttcttttgcgaagatgacgagatgcagctttgcgtggtgtgtagagaggcaggggagcacgcaactcatacgatgagatttctggaagatgctgccgccccatatcgggaacagatccacaaatgcttgaagtgcttacggaaagagagagaggagatccaagaaatccaatcccgagaaaacaagcgaatgcaggtactgctcacgcaggtttctacaaagcggcagcaggtcattagcgaattcgcacacctgagaaaatttttggaggagcagcaatccatacttctggcccaattagagtctcaggacggggatatccttcgacagcgggatgaatttgacctcctggtggccggtgagatctgtcgttttagtgctttgattgaggaactcgaggaaaaaaatgaaaggccagctcgagaactcctgacagacatcagatctacactcattcggtgtgaaacccgaaagtgccggaaaccggttgccgtcagccccgagctcgggcagagaatacgggatttccctcagcaagcactgccattgcagagagaaatgaaaatgtttctggagaagctttgtttcgagctcgactatgagccagctcacatatcgctcgaccctcaaaccagccaccccaaactgctgctgagtgaagatcaccagcgcgcccagttctcctataaatggcagaactcgcctgataaccctcagaggttcgaccgcgccacctgcgtactcgctcacaccggtattacaggcggcaggcacacctgggtggtctcgatcgacctggcacacggaggatcctgtaccgttggagttgtgagcgaagacgtgcaacggaaaggggagctcagactgagacccgaggagggagtttgggcggtacggctagcatgggggttcgtgagtgctttgggcagcttccccacaaggctgactctcaaagagcagccgcgccaggtgagagtatctctggactatgaggtcggctgggtgacgtttacgaacgcggttaccagagagccaatttacacattcaccgcaagttttacccgcaaagtcatcccgttttttgggctgtggggacgtggcagttctttttccttgagttcttag

SEQ ID NO: 16662 - DNA, 261 bp, Artificial Sequence
  Description of Artificial Sequence: Synthetic coding sequence
atgggaaaaatggtaagtgtgattaacactgtagataccagccatgaggatatgatccacgatgcccaaatggactactatggcacccgtcttgccacatgttcctccgacagaagtgtaaagatcttcgatgttcgcaacggcggtcaaattctgatcgctgacctgcgagggcatgagggcccagtctggcaggtggcttgggcccaccccatgtacggtaacatcttggccagctgcagctatgaccgtaaagtatag

SEQ ID NO: 16663 - DNA, 660 bp, Artificial Sequence
  Description of Artificial Sequence: Synthetic coding sequence
atggaaccgagcgcacagcagctccagttagctgcatctctacctgccaatctctcaaatttttgtcagggttctgaaatgcccacaacaagccgaccggcattggatgtgaagggggggactagtcccgcgaaagaggacgctaaccaggagatgtcaagcgtagcttattcaaatctcgctgtaaaagacagaaaggctgtggcaatactgcattaccccggggtggcgtccaacgggaccaaggccagcggtgcacccacttctagcagcgggtcaccaattggctcaccaacaacaacaccgccaactaaaccaccttcatttaacctgcacccagcccctcaccttcttgctagcatgcacctgcagaagctgaatagtcaataccagggcatggctgccgccacacccggacagcctggtgaggcgggacccctccagaattgggattttggtgcacaggctggaggcgccgagtccttgtcaccttctgccggagcacagagccctgcaattattgacagcgaccctgtggatgaagaggttttaatgtccctggtggtggagctgggcctggaccgcgccaatgagctcccagagctgtggttaggccagaatgagtttgatttcaccgctgattttccctcctcttgctag

SEQ ID NO: 16664 - DNA, 396 bp, Artificial Sequence
  Description of Artificial Sequence: Synthetic coding sequence
atgttatgctggggctactggagcctgggtcagccaggaatttctaccaacctgcagggaatcgttgccgaaccccaggtgtgcggctttatctctgaccgaagcgttaaggaagtggcctgcggaggcaatcacagcgtatttctcctggaggacggcgaggtttacacgtgcggcttgaacactaaggggcagctgggccatgagagggaagggaacaaacctgagcagattggagctctggctgatcagcacatcatccacgtggcctgcggcgagtcccacagtctggctctcagtgatcgagggcagctatttagttggggggccggaagtgatggacagcttggtctgatgacaaccgaggactccgtcgctgtcccgcgactgatttag

SEQ ID NO: 16665 - DNA, 3099 bp, Artificial Sequence
  Description of Artificial Sequence: Synthetic coding sequence
atggaaggggctctgacagctagggacaaagtcggtgtgcaggacttcgtgcttttagatgcatacacctcagaatctgccttcgtcgacaacctgcggaaaagattttctgaaaatctgatctatacttatattggcaccttattagtgtccgttaatccctatcaggaactgggcatttataccgtgtcacagatggaactctaccagggcgtaaactttttcgaactacctccacacgtgtatgcaatcgctgataacgcctacagaatgatgtgcgctgagcttaacaaccactttatccttatcagcggcgaaagtggcgccgggaaaaccgaagcaagcaaaaagatactggaatacttcgcagtaacttgtccaatgacacagtcattgcagatcgccagggatcgtttgctcttttctaacccagtccttgaggcttttgggaacgctagaacactcaggaacgacaacagtagcagattcgggaaatacatggacattcaattcgatttccagggcattccagtggggggacacataatatcctacttgattgaaaaatctcgcgtggtgtaccagaatgagggcgagcggaattttcacattttttatcagctgctggccggaggcgaagaagaaagactgtcttatttgggcctcgagagggacccgcagctgtataaatatttgagtcagggccattgcgcaaaagagagtagcatctccgataaaaatgattggaagacagtgtcaaatgccttttcggtcattgactttacggaggcagacttggagaatctttttggaatcatcgccagtgtgttgcatttagggaatattggcttcgaagaggatgaccaagggtgcgccactattcccgatacgcatgaaatcaagtggattgctaagcttttgggcgtgcacccctctgtattgctagaggcgctcactcacaggaagatagaagcgaaaacagaagaggtcatctgtcctctcaccctggaactgtccgtgtatgcccgcgatgcaatggccaaagcagtgtacggccgcacattcacttggctggttaataagataaacagcagcttggtaaacaaggtggggcagcggatcttggacccactgttgctcctaacttggaaaacagtgatcgggttgcttgacatttacggctttgaggtctttgacaagaatggattcgagcagttctgtattaactactgcaatgaaaaactacagcaactgctgattgaacgtaccctcaaggccgagcaggccgagtatgagatggagggcatcgaatgggaaccaatcaagtacttcaataacaaaatcatctgcgacctcgttgaagagaggcacaagggaatcatatcgatcctggacgaggagtgcatcaggcctggcccagcaacagacctctccttcctggagaaactcgaggagaaggtcgggaagcacgctcattttgaaacccgaaaactagcagggcctaaagggagaaaaaggattggatggatggaattcagattactgcattatgccggggaggtaacctactgcactaaaggcttcctggagaagaataatgatttgctgtacaggcaccttaaagaagtcctgtgtaagagcaaaaacatcattctccgggaatgcttcctgctggctgaactggagaacagacgacgcccgccaactgtggggacacagttcaagaacagtctgagttcacttttagaaactctgattagtaaggagccgtcttatatccgctgcatcaagcccaacgaccgtaaggagcccagcaagttcgatgattttctcatccggcatcaaataaaatacctggggctcatggaacatttgagagtccgtagagccggtttcgcctaccgccgcaaatacgaacacttcttacagcggtataagagtctgtgtcctgatacttggccccattggcatggtcctccagctgaaggcgtggagcggttgattaagtatatcggttacaaacctgaagaatataaactgggaaaaaccaagatctttatccggttccccagaacgttgtttgctaccgaagatgcgtttgagttctctaaacaccagcttgtcgctcgcatacaggctacatataagagatgtctcggcagacgcgagtatgtcaaaaaaagacaggctgccatcaaacttgaggctcattggagaggcgccctggctcgcaaggcgatacagagacgaaagtgggccgttagaatcataaggaaattcataaaagggtttatatccaggaacaagccgctctgtccagacaatgaagaattcattgtgtttgtccgaaagaactacatacttaatctgaggtatcaccttcctaagaccgtgctggacaagtcttggctgcgacctcctggcattctcgagaatgcatctgatcttttgcgaaagatgtgcgtacgcaatctggtgcagaaatattgtcgcggcatcaccgcagagcgtaaggctatgatgcaacaaaaggtagtcacttcagagatctttagggggaggaaggatgggtatactgagtctctgaaccagccgtttgttaacagccgaattgacgagggggatatcaacccgaaagtgctccagctaattagccacgaaaagatccaatatggcgttccggtgattaagtacgatagaaagggcttcaaagcccgccaacggcagttgattcttacacagaaggccgcatatgtggtggaactggccaaaataaaacaaaaaatagagtacagcgctctgaagggggtctcaacctctaatctgtctgatgggattctcgtaatccatgtgagccctgaagactccaagcagaaaggcgatgctgtgctccagtgcggccacgtgttcgaggccgtcacaaagttggtgatgctcgtaaaaaaggaaaacatcgtcaacgttgtgcagggatcgctccagtttttcataagtcccggcaaggagggtacgatcgtgtttgataccgggctggaggaacaggtgtataagaataaaaatgggcagctgaccgtggtctccgtgcggaggaagagttag

SEQ ID NO: 16666 - DNA, 1176 bp, Artificial Sequence
  Description of Artificial Sequence: Synthetic coding sequence
atgtgtagccagctatggttcctaactgaccggcgcattcgtgaagactacccccaagtacagatcttacgtgcactgaggcaaaggtgtagtgagcaggacgtgagattccgggctgtcctcatggaccagatcgccgtaactatcgtcggggggcatctcgggttacaacttaaccaaaaagcgcttactacattccctgacgtagtcctggtgcgagtgcctaccccttctgtgcagtcagacagtgacataaccgtgctgcgccatctagagaagttaggttgtagacttgtcaatcgacctcagtcgatccttaattgtatcaataaattctggactttccaggagctagctgggcacggggtgcccatgcccgacactttctcctacgggggacatgaggacttctccaaaatgatagatgaggcagagccactcggttatcctgtagtggtcaagagcacacgtgggcaccgaggtaaagcagtatttcttgccagagacaagcaccacctcagcgatatctgtcacctgatccgacatgatgtgccatacttatttcagaagtacgttaaggaatcccacggcaaggatataagggtcgtggtagtgggaggacaggtgattggatccatgctccggtgctcaaccgacggcagaatgcagagcaattgcagccttgggggcgtcggcgtcaagtgcccccttaccgagcaagggaagcagctcgcaatccaggtgtcgaacatcctggggatggacttctgcggaattgacttattaattatggatgatgggtccttcgtggtgtgcgaggccaacgcaaatgttggattcctcgccttcgatcaagcatgcaacttggacgtcggcggtatcatcgccgattacacaatgagcctgttgccaaatcggcaaaccggcaaaatggcagtgctccccggtttgtccagtccacgcgagaaaaatgagcctgacgggtgcgcatctgcgcagggggtcgccgagtcggtgtatacaatcaattcaggatcgacttcttcagagtctgaaccagagctgggcgagatacgcgacagcagcgcaagcacgatgggcgcacctcccagcatgctgcctgagcctggctacaacatcaataacagaatcgcatcagaacttaagctgaagtag

SEQ ID NO: 16667 - DNA, 1065 bp, Artificial Sequence
  Description of Artificial Sequence: Synthetic coding sequence
atggacatggatcacattatgacgtgggcgaccgatgtggctaaagggatgcattatctgcacatggaggccccagtgaaagtgattcacagggacctgaaatcacgcaatgtggttatagctgccgatggcgttctgaagatttgtgacttcggcgcatcccggttccacaaccacacaactcatatgagcttggttggcacgtttccctggatggcccccgaagttattcagagcctgcctgtctctgaaacttgtgacacgtattcttacggcgtggtactatgggagatgctcacccgcgaggtgcccttcaagggtctcgaaggactccaggtggcatggcttgttgtggagaaaaacgaacgcttgactatccccagctcatgcccccggagcttcgctgagctgctgcatcagtgctgggaggccgacgccaagaagcgtcctagtttcaagcaaatcatctccattttggagtctatgagtaacgacacctccctccctgataagtgcaatagctttctccacaacaaggctgagtggaggtgcgaaatcgaggctacgctggaacgcttaaagaagttggagcgtgacttgagtttcaaagagcaagagttgaaagagcgggaacggcgcctgaagatgtgggaacaaaagctcacagagcagtcaaatacaccccttctgctgccactagccgcgcgtatgagtgaagaatcatacttcgagtctaaaaccgaagaatccaatagcgctgagatgtcttgccagatcacggccacaagtaacggggaaggccacgggatgaacccatcactgcaggccatgatgttgatgggatttggcgatatattttctatgaataaggcaggagcggtcatgcactccggcatgcaaatcaacatgcaggccaaacagaattcctctaaaaccacttcaaaacggcgcgggaagaaggtgaatatggcattgggattcagtgactttgacctgtcggagggagatgacgatgatgacgacgacggcgaagaggaggataacgacatggacaactcagagtag

SEQ ID NO: 16668 - DNA, 1707 bp, Artificial Sequence
  Description of Artificial Sequence: Synthetic coding sequence
atgttggagaggccccccgccttagccatgccaatgccaacagagggtacaccacccccgttatctggaacacctatcccagtccccgcatatttcagacacgccgagcctggatttagtctcaaacgaccacgcggattgagtaggtcacttcccccaccacctccagccaaaggctcaatccccatttctaggcttttcccgccacgcacacccgggtggcaccaattgcagccgcgacgcgtgtcctttaggggggaggcatctgagacacttcagagcccaggttatgatccctctcgcccagaatcgttcttccagcagtccttccagcgactttcccggctgggccatggcagttacggcgaggtatttaaagtgcgtagcaaagaagatggtaggttgtatgcagtcaaacgctcaatgtcacccttccggggtcccaaagacagagccaggaagttggccgaggtgggatctcacgagaaagtggggcagcacccctgttgtgtccgcttagaacaggcgtgggaagagggaggaatcctgtatctccagacagaactgtgtggcccttctctccagcagcattgcgaggcatggggggcatcactccccgaagcccaggtctggggttacctcagagacactctgctggcgctggcccacctacactcacagggccttgtgcacctggatgtaaagcccgccaacatattccttgggcctaggggtaggtgcaagctgggagatttcggtcttctggtcgagcttggcactgccggcgcgggcgaggtgcaggagggcgaccctaggtacatggcacccgagctgctccagggctcttacggaacagcagctgatgtgtttagcctgggactgacaatccttgaggtggcctgcaacatggagcttccccacggtggcgaaggatggcaacagttgaggcaaggctatcttccgccggagttcacagcgggactgtcatccgaactccgaagcgtactggtgatgatgctggaacccgaccccaaattgagagccacggcagaagctcttcttgccctcccagtattgcggcagccacgagcctggggcgtactgtggtgcatggcagctgaggcacttagccggggatgggctttatggcaggcgttactggccctgctatgctggctgtggcacggcttggcgcaccctgcgtcatggctgcagcccctggggccacctgcaacgccacctggaagccctccttgtagtctgctgttggatagctcactctcttccaactgggacgatgactcgctgggacctagtctgagtcctgaggcagtgcttgctcgcaccgttggaagcacctccacccctcgctcccggtgcaccccccgggtccttaccccactcaggttgtccccggccgctgagcccagcgctccaggactgggccccgcagctgaggccccctgttgcgttgagcagcgtggattcctgtctaggcacatacctcgaagcttcagcgctttccaggctgcaccccccaagagtgcgtgcaatgccctccatctccacggccacactcagccatccgcctttgtgtggtccctgacttgcagctcacatcacggccggacattcgaagctaggaccaaagtggatcctctttttaaaatttgtggtggctttctgactgttttcgctgatctgtag

SEQ ID NO: 16669 - DNA, 642 bp, Artificial Sequence
  Description of Artificial Sequence: Synthetic coding sequence
atggcagagaccgaggagaggtcactcgacaatttcttcgcaaagcgggataaaaaaaagaaaaaggagaggagcaatcgcgccgctagtgccgcaggcgcggctggctccgctggcgggagctctggagcggccggggccgctggaggaggcgctggcgccggaactcggcccggagacggcggcaccgccagcgcgggcgcggcaggtccaggcgcggccactaaagccgtgacaaaagatgaagatgaatggaaggaactggagcagaaggaggtggactacagtggcttgcgtgtgcaggcaatgcagatcagttccgagaaagaggaagatgacaatgagaaaagacaggatccgggcgataactgggaggagggtgggggcggaggcggtggcatggagaagtctagtggaccatggaataagacagcaccagtgcaagctccacctgctcctgttatcgtgaccgaaacgcccgaacctgccatgactagcggggtctaccgcccacccggcgcccggctgaccacaactcggaagactccccaaggcccccctgaaatctattctgacactcagtttccctccctgcagagcacggctaaacatgtggagtcccgcaatcgctacctgaaatag

SEQ ID NO: 16670 - DNA, 4140 bp, Artificial Sequence
  Description of Artificial Sequence: Synthetic coding sequence
atggcttcctctcctacaaaagggcttaccatgtctgtaccggttgcccctaagaaatcctgttacacacagctcagagataaccgcaatgcagcccgaaataacaatgaatctatcctcagtttgggagacaccaacgccaaccagattatgctggaagtatcatcctcacatgacgagtctaaaacgtgcgatcttggcgacgagatcggtaacaccaatagtagcgagcccgaaaacagaacacacttccacaaggagtttcaccaactgcagggtttcggcaagggctctcaggctggttctgcttcccttaaggattttagactttctagcaccatccagcgggagcttaacgaggaacatacagtcgagcgcggcactgatagcctgcagaccacaaggtcaattcagggaccgagcctctcttcctggaggaatgtgatgtcggaggcttctcttgatgtgttggccaagagggatgcagagatccccaggcatgtccccaaggacaagctcgccaagacgctggataatgaggagttgaggcggcactctctagaacgggcctcctcgagtgttgctgcagttggaagtctgacgccgcaacatccacaaccactttcgctcgactctcgcgaagccagaggccaaatccccggaggaggagaagggccgcaaaagactctgccagatcatgccgtccccgccgcattccctgccaccgactccaccagcgaaggaaagtcagtccgccacccgaagcccagtacaagcgagagtaaacaatcgaccccatcagagacacagacagtcggcgcccacgtcttgcaggtttgttctgagcacacctcccactcagctcaccctgaacccgccctgaatctgacactggcttctaaagagattccttccaagctggaggcccagcttggccaagggaaaggcgaggcaaagttagaccttaagtacgtgccccctagacgcgtggagcaggaaggaaaagctgcccaggagggctacttgggctgtcacaaggaggaaaatcttagtgcactcgaaggcagggacccttgcggtgaggcacatccagaggccaccgatgctcttgggcacctgctcaattccgacttacaccacctaggcgttggacggggaaattgcgaagagaaaagaggcgtgaatcccggagaacaggattcattacacaccacccctaagcagggatcagccagccttggaggcgccgataatcagccaaccggcaaaattagcccatgtgccggtgagaagctgggcgagcggacatctagctccttctcacctggagatagccacgtggcattcataccaaacaacttaaccgattcaaagcccctggacgtgatcgaagaggaacggaggcttgggtccgggaacaaggactccgtgatggttcttgtgttcaatccttccgtgggcgagaataaaaccgaagtcccagagcccctcgacccccaatccggccggtccgaggcccgagagagtaaggaagtgaccacttcagtggccgaaaatagaaacttactggaaaatgcagataagattgagagtaccagcgcccgcgcagatagtgtcctcaatataccagccccgctccaccccgagacaacagttaatatgacttaccagcccaccacacccagctcaagcttccaagatgtcagtgtctttgggatggacgcaggaagtccgctagttgtccctcctccgacagattccgcgcgtctgcttaacacgagcccaaaggtcccagacaagaacacctgccccagtggtattccaaagcccgttttcacgcactcgaaagataccccctcttctcaggaaggcatggaaaactaccaggtcgagaagaccgaggagcgtacggaaacgaagcccatcattatgcccaagcccaagcacgtccggcctaagatcatcacctacattagaaggaacccacaggctctcggccaggttgacgcctccctcgtcccagtcggtctaccatatgcacctccaacatgcactatgccgctaccccacgaggagaaggccgcaggtggcgaccttaagccctccgcaaatctttatgagaagttcaagcctgatctccagaagcccagggtcttttcaagcggcctcatggtcagcggtattaaaccacccgggcatcccttttcccagatgtccgagaaatttctgcaggaggtaacagatcaccctgggaaagaagagttctgctctccgccctacgcccattacgaggtacctcccaccttttaccgttcagcaatgctcctgaagccgcagctcggcttaggagctatgtctcggctgccgtccgccaagtctcgtattctgatagcctcacaaagatccagcgctagtgccatccaccctccaggtcccatcacaaccgccaccagcctgtattcgagtgacccgagcgcagatttgaaaaaggcctcatctagcaacgcagcaaagagcaatttgcccaaatcaggcctccggccgccgggttattcacggcttccggcggccaaactggctgcgttcggcttcgtcaggtccagtagtgtgtcaagtgtaagctccacacagagcggcgactcggcacagccagagcagggccgccccgccacgcggtctacgttcggaaatgaggaacagccagtcctgaaggcttcactgccttccaaagacactccgaaaggagctggacgggtcgcaccccctgccagttccagtgtgactgctccacgccgctctctcctgccagcacctaaatcgacaagcaccccagccgggactaagaaagatgcacagaaggaccaggacacaaacaaacctgctgtgagctcccccaagcgggtggcggccagcaccaccaagctacacagccccggataccctaaacagcggactgccgcagcacggaatgggtttccaccgaagccagatccacaagctagggaagcggaaaggcaactggtgttgcgacttaaggagagatgtgagcagcaaactcgccagctcggggtggcacagggggagctgaaacgagctatctgcgggttcgatgctctggcggtcgctacccagcactttttccggaagaacgaatccgccctggtgaaggaaaaagaactgagcattgaactcgccaacattcgggatgaggtcgcttttcacacagctaaatgtgaaaagcttcagaaggagaaagaggaactggaaagaagattcgaggacgaggtgaagcggctgggatggcagcagcaagcggagttgcaggaacttgaggagaggctgcagctgcaattcgaagctgagatggcccgcctgcaggaggagcacggagaccagctgctttcaattagatgccaacaccaagagcaggtcgaagacctgaccgcttcacacgacgccgccctcctagagatggagaacaaccatactgtcgctattacaattctgcaggatgaccacgaccacaaggtccaggaactaatgtccacccatgagcttgaaaagaaggaactggaggaaaactttgagaagctaagactttctctgcaggaccaggtggataccctgacctttcagagtcagtcactgcgggatcgcgcccgacggtttgaagaggccctcagaaagaacacggaggagcagttggaaattgcgttagccccttaccagcacttggaggaggatatgaagagcctcaaacaggttcttgagatgaaaaatcagcagattcatgagcaggagaaaaagattctagaactcgagaagctggctgagaagaatattatcctcgaagagaaaattcaggtgctacagcagcaaaatgaggacctgaaggctcgcatagatcagaacactgtggtaacaagacaactgagcgaagaaaacgcaaatttacaagagtatgtagagaaggagacccaagaaaaaaaaaggctgtctcgcacaaatgaggaattgctttggaagcttcagactggcgaccctacgtcgcccattaagctgtcgcctacaagccccgtgtaccgtggcagctctagtggaccttcttcccccgcacgggtgtccaccacaccccgatag

SEQ ID NO: 16671 - DNA, 1041 bp, Artificial Sequence
  Description of Artificial Sequence: Synthetic coding sequence
atgcagcatctgaagtccaagaagcgtgaagagaggtggatgcgcgcctctaagcgtcaaagcgaaaaggagatggaagagctgcaccataatattgacgacctactgcaggagaaaaagagcctcgagtgcgaagtagaagagttgcaccgcacagtccaaaagagacagcaacagaaagacttcattgacggtaatgtggaatccctcatgaccgagttggagatcgagaagtcattaaagcaccatgaggacattgtggatgaaattgagtgtattgagaaaaccctactgaagcggcgaagcgaattgcgcgaagcggatagactgctggcagaagcagagtctgagttgtcttgcaccaaggagaaaacaaaaaatgccgtcgaaaaatttacagacgccaagaggtctctattgcaaactgaatctgacgccgaggaacttgagcgtcgggcccaggagacagccgtgaacctcgtgaaggccgaccagcaactgaggagtcttcaggccgacgccaaggacctagaacagcacaagattaagcaggaagagatcctcaaggagattaataaaatcgtggccgcaaaagatagcgatttccagtgcctcagcaagaagaaagagaagcttaccgaagagctgcagaaactgcagaaggatattgaaatggctgagagaaacgaagaccatcatctccaggtactcaaggaatctgaagtgttgttgcaggccaaacgggccgaactggagaaattgaagagtcaggtgacttcgcagcagcaggaaatggcggtattagatcgccagctcgggcacaagaaagaagaacttcatctgctacaggggtcaatggttcaggctaaagccgatcttcaggaggcactgcggttgggcgaaactgaagtcaccgaaaaatgtaaccatattagggaagttaagtctcttctggaggagctgtcatttcagaagggggaattgaacgtgcagattagtgagcgcaagacacagctgacccttataaagcaggagatatag

SEQ ID NO: 16672 - DNA, 369 bp, Artificial Sequence
  Description of Artificial Sequence: Synthetic coding sequence
atggccacaagcgcacctctgcggtcccttgaggaggaggtgacatgctccatttgcctggactatcttcgagacccagtgacaattgactgcgggcatgtcttttgccggtcttgtaccacggacgttcggccgatctccggatcccgccctgtgtgccccctgtgtaaaaagccatttaagaaagagaacattagacccgtgtggcagttggcatccctggttgagaacattgaacgactgaaggtggacaagggcagacaacccggggaagttacgagagaacaacaggacgccaagctgtgcgagcgccatagagagaagctgcattattattgcgaggatgacggaaagttactctgcgtttag

SEQ ID NO: 16673 - DNA, 291 bp, Artificial Sequence
  Description of Artificial Sequence: Synthetic coding sequence
atgagtatctccagtgacgaggttaatttcctggtctataggtacctgcaggaaagtggcttttctcacagcgcgttcacatttggcatcgagtctcacatctcgcagtctaatattaacggcgctttggtccctcctgccgctcttatatctatcatacaaaagggcctgcagtacgtggaggccgaggtgagtattaatgaagatggaactcttttcgacggacggcccattgaatccctctctcttatcgacgccgtgatgcctgacgtagttcagactcggcagtag

SEQ ID NO: 16674 - DNA, 2913 bp, Artificial Sequence
  Description of Artificial Sequence: Synthetic coding sequence
atgctccagcaagtaaatggacacaatcctggatctgacgggcaggcccgggagtatctgcgcgaggatctgcaagagttccttgggggcgaagtactgctgtacaaactggacgacttaacccgcgtgaaccccgtgactctggaaactgtgttgcgatgcctccaggctcgctatatggctgacaccttctacacaaatgcaggttgtaccctcgttgccctgaacccttttaaaccggtcccccagctgtactcgcctgagctaatgcgcgagtaccatgctgcccctcagccgcagaagctgaaaccccacgtgttcaccgtgggcgagcagacttataggaacgtcaagtcacttatcgagccagtgaaccaatcaattgtcgtgtccggcgaatctggtgcaggaaagacctggacctctcgctgtctcatgaagttttacgcagtggtggctacctcccctgcatcctgggaatcccacaaaattgctgaaagaatcgaacagcgcatcctgaacagcaaccctgtgatggaggcttttggtaatgcctgcacactccggaacaacaacagctccaggtttggcaaattcatacagctccagctcaaccgcgcccagcagatgacaggggccgctgtgcagacttacctacttgagaaaacacgggtggcttgccaggcatcatctgagcgaaattttcatatcttttaccaaatctgtaaaggggcttccgaggatgagcggttacaatggcacttacctgagggtgctgcattttcctggctgcctaacccagaacggagcctcgaagaggattgtttcgaggtaaccagagaggccatgctgcacctcggaatcgacactccgacccagaataatatcttcaaggttctcgcaggcttgctccacttaggaaatatacagttcgccgctagcgaagacgaggcgcaaccttgccaacctatggatgatgcaaagtactcagtcaggacagccgcatccctgctgggtctgccagaagacgttcttttggaaatggtccagatacgaacaatcagggccggacggcaacagcaagtgttccggaaaccttgtgcccgcgccgagtgtgatacaaggcgtgattgtctggctaagctgatttacgcgagactctttgactggttagtttccgtgataaacagctcgatctgcgctgatactgactcttggacaacgtttatagggctcctagatgtgtacgggtttgagagcttccctgacaatagtcttgagcagctgtgcatcaattacgccaatgagaaactgcaacagcatttcgtggcccattacctgcgggctcagcaggaggaatatgctgtcgaggggctggaatggagcttcatcaactatcaagataatcagccatgtctggatctgattgagggatcccctattagcatatgtagcctgataaatgaggagtgtcggttaaatagacccagctcggccgctcagctacagactcgcatcgagacagccctcgccgggtcaccgtgtctgggacacaataagctatctcgtgagccgagcttcatagtagttcactatgctggcccagttcgataccatactgcaggtctggtggaaaagaacaaagatccaattccacccgagcttaccagacttctccaacagtcgcaggatccccttcttatgggcctgttcccaacaaaccccaaagagaagacacaggaggagccaccgggtcagtccagagccccagttctaaccgttgtgagcaaatttaaagcatctcttgaacaacttttgcaggtgctccacagtactacccctcactatatccgatgcattaagcctaactcacagggacaggcacagactttcctgcaggaggaggttctgtcccagttagaagcctgcgggttggtcgaaactatacatatcagtgccgcgggctttcctatcagagtgagccaccgaaatttcgtcgagagatacaaactcttgcgcaggttacatccgtgcacctcttccggacctgatagtccctaccccgcgaaaggactgcctgaatggtgtccccattctgaagaggctactctggagcctctgattcaagacattctccatactttaccggtgctgacgcaggccgctgccatcacaggggactccgcggaggcaatgcctgcccctatgcattgcggaagaacaaaagtgttcatgaccgactctatgctagagcttctcgaatgtgggcgcgctagggtgttagagcaatgtgcccggtgcatacagggcggttggcgccgccacaggcaccgggaacaggagagacagtggcgcgcagtgatgctgatccaggcagccattcgcagctggctaacgcgcaagcatattcagcgtctacacgccgccgctacagttattaagcgggcttggcagaagtggcggatccggatggcctgcctggctgcaaaggaattagatggcgttgaagaaaaacactttagtcaggccccctgctctctctctacttccccactgcagactcgcctcttggaagctatcattcgtctgtggcccctgggacttgtgcttgccaacaccgctatgggagtgggaagcttccagcgcaagctggtagtctgggcgtgtttacagctgcctcgcggtagtccctcctcctataccgtgcaaacagcccaagaccaagctggagttacatctattcgggctctcccccagggatccattaagttccattgccggaaaagtccgctccgctatgctgacatttgtccagaaccatctccttactcaatcaccggctttaatcagatcttactggaacggcatcggctcatccatgtgacctcttctgcatttaccgggctaggctag

SEQ ID NO: 16675 - DNA, 3303 bp, Artificial Sequence
  Description of Artificial Sequence: Synthetic coding sequence
atgtcgtactaccagcgtcccttttccccctctgcttactcactaccggcaagtttgaattcaagcatagtcatgcaacatggaacaagcctagactcgaccgatacgtaccctcagcacgcccagtcgttggacgggaccacctcttcctctatccccctgtaccgcagtagcgaagaggaaaagagagtgaccgtgatcaaggcacctcattaccccgggatcggccctgtcgacgagtcaggtatcccaacagctatccggaccactgtggaccgcccaaaagattggtataaaaccatgtttaagcagatacatatggtgcataaacctgatgatgatacagacatgtataacacaccttatacttataacgctggactctataatccaccatacagtgcccagagccaccccgccgctaagacgcagacctataggcctttaagcaagagccacagcgacaatagcccaaacgcatttaaagacgcttccagcccggtgcccccaccacatgtgcccccacctgtaccacccttacgcccgagggacagatctagcacggagaagcacgactgggaccctcctgataggaaggttgatacacggaaattccgtagcgaaccccggagcatctttgagtatgagcccggaaaaagtagcattctccaacacgaacgacccgcaagtttataccagagctctattgatagaagtctggagcgccctatgagcagtgcctctatggctagcgatttcagaaaaagaaggaaatccgaacctgctgtcggccccccccgtggtttaggtgaccagtcggcgtccagaacctcccctggccgggtagaccttcccggaagttccaccactctcaccaagagttttacctcaagtagcccttcctccccgagtagggctaaagggggagatgatagcaagatatgtcctagcctctgttcttactcaggcctaaatggaaacccctccagtgagctggactactgctctacctatcgtcagcacctggatgtaccgcgggattctccccgtgccatcagctttaaaaatggatggcagatggcgagacagaatgccgagatctggtctagcactgaggaaacggtttcccccaagatcaagagtcggtcgtgtgacgatctcctcaatgatgactgcgactcgtttcctgaccctaaggtgaaaagcgaatcaatgggttcactcctctgcgaggaagacagcaaggaatcatgccccatggcctgggggagtccctacgtccctgaagtgcgatccaatggaagatctcgcatccggcatagatctgccaggaatgctccagggtttctcaaaatgtacaaaaagatgcacaggattaatagaaaagacctgatgaactctgaagtgatttgtagtgtcaaatcacggattctgcagtacgaaagtgagcagcaacataaggatttactgagagcttggtctcagtgtagcacggaagaggttccccgggatatggtgcctactcgtataagtgaatttgaaaaattgatacaaaaaagtaaatctatgcctaatctcggagatgatatgctaagcccagtcactctggaaccccctcaaaatggcctgtgcccgaaacgtaggttttccattgagtacctactggaagaggagaatcagtctggcccacctgcacgcgggagaaggggttgtcagagcaacgccttagttccaatccacattgaggtgacgtccgacgagcaaccccgcgcacacgtggagtttagcgatagtgaccaagacggcgtagtatcagaccactccgattatatacacctagaaggcagctctttttgcagtgaaagtgactttgatcacttttcttttacgagcagtgagtcattttatggaagttctcaccatcaccatcaccaccaccaccaccaccacagacatttgattagcagctgtaaaggccggtgtccagcctcctacactcgatttacaaccatgctcaaacacgagcgcgcccggcacgagaataccgaggagcctcgcaggcaggagatggaccctggtctttcgaagttagccttcctagtgagcccagttcctttccgcaggaagaaaaattctgctccaaagaagcagactgagaaggctaagtgtaaagcctccgtgtttgaggcacttgatagcgcgttaaaggatatctgcgatcagataaaggctgaaaaaaagagaggctcattgcccgataacagtatattacacaggctgatcagcgagctgcttcctgatgttcctgagagaaactccagtctgagagccctgcggcgctcgccactgcatcaacccctgcaccccttgccacccgatggtgctattcattgtcccccataccagaacgactgtggaagaatgcctcggtccgctagctttcaggacgtagatacagcaaactccagttgccatcatcaggatcgtgggggggcactacaagacagagagtccccgcggtcatatagtagtaccctgaccgacatgggccgatcagctcccagggaacgccggggaacgcccgaaaaggagaaactgccagccaaggccgtttatgattttaaagcccaaacatccaaggagctttcattcaaaaaaggcgacactgtgtacattttgcgcaagattgatcaaaattggtacgagggggagcaccacggaagggtggggatctttcccatttcctatgtggagaaattgactccgcccgagaaggcccaacccgcgcggcccccaccgcctgcccagccaggggagattggcgaggccatcgcaaagtacaatttcaacgccgatacaaacgtcgaactcagtcttaggaagggagatcgggtgattctcctgaagcgggtggaccagaactggtatgagggaaaaatcccaggcacaaacaggcaggggatctttcccgtatcctatgtggaagtggtgaaaaagaatacaaaaggagccgaggactatcccgacccgcctatacctcatagttacagcagtgaccgcatccacagcctcagttccaataagccacaaaggcccgtcttcacccatgagaacatccagggtgggggagaaccgttccaggctctgtacaactacacaccaagaaacgaagatgagctcgaactgagagagtccgatgtcatagacgtcatggaaaaatgtgatgacggatggtttgtcggcacgtcccgccgcacgaagtttttcggaaccttccctggcaattatgtcaaaagactgtag

SEQ ID NO: 16676 - DNA, 390 bp, Artificial Sequence
  Description of Artificial Sequence: Synthetic coding sequence
atggcagagcttatccagaaaaagctgcaaggtgaagttgagaaatatcaacaactgcagaaggacctaagcaagtcaatgtcgggcaggcagaagctggaagcccaactcacagaaaataatatcgtgaaggaggagttggcactcctcgatggctctaacgtggtttttaagctcttgggtccagtcttagtaaagcaggagctgggagaggcacgcgcgacagtgggtaagagactggactacatcacagctgagataaaacggtacgaatcgcagctccgcgacctggagcgacaatcagaacagcagcgggaaacgttggcgcagctccagcaagagtttcagcgggctcaagctgccaaggcaggtgcgccagggaaggcatag

SEQ ID NO: 16677 - DNA, 498 bp, Artificial Sequence
  Description of Artificial Sequence: Synthetic coding sequence
atgtccctgcacggtaagaggaaggagatttacaagtacgaagccccctggacagtctacgcaatgaattggagcgtgcgtcccgacaagcgctttagacttgcactgggaagttttgtcgaggagtacaataataaggtccagcttgtgggtctcgacgaagagtcatctgaatttatatgtcgtaacaccttcgaccatccataccctacaacaaaattgatgtggattcccgatacaaagggggtctaccccgatcttctggccacctccggagactacctaagggtatggcgcgtgggcgaaacggaaacccgcctcgagtgcctcctgaataataataagaacagcgatttttgtgcgcccttgacaagcttcgattggaacgaagtggacccctacctgttgggtacctcttccatcgataccacctgttgcttccagtggcctgtgtgtctgagtttgctgtgtacccactgctatcagaaactgctgtag

SEQ ID NO: 16678 - DNA, 1044 bp, Artificial Sequence
  Description of Artificial Sequence: Synthetic coding sequence
atgagccttgctcagtcaccggggatctggggagaggatccagtgaagctgacactggctctgaaaatgaccagacaggatcttacaaggactcagatggagctcaacaatatgaaggcaaacttcggggatgtggtgcctcggcgggattttgagatgcaggagaaaaccaacaaggacctacaggagcagttagacactcttcgcgcctcctacgaggaagttcgtaaagagcatgagatattgatgcagttgcacatgtctacccttaaagagcgcgatcaattcttctccgagctccaggagattcagcggacctccactccgagacccgactggacaaagtgcaaggatgtcgttgctggcgggcctgagcgatggcagatgctggcagaaggtaagaattcagatcagttggtggacgtactgctggaggagatcggatcaggactgctgcgagaaaaagattttttcccaggtctcggttacggggaagctatccccgcgttcctgagatttgacggattggttgaaaacaagaagccctctaaaaaagacgtcgtcaacctcttgaaagatgcttggaaagagcggctggcggaggaacagaaagagacgttccccgactttttctttaactttctcgaacacaggttcgggccaagtgacgcaatggcctgggcgtacactattttcgagaatattaaaatttttcattcgaatgaagtgatgtcccagttctacgcggtcctgatggggaagaggtcagagaacgtgtatgtgacccagaaggagactgtagcgcagctcttgaaggagatgaccaacgctgactcacagaacgagggcttgttgaccatggagcagttcaacaccgtcctcaagtccacgttcccactgaaaacggaagaacagattcaggagctcatggaggccgggggatggcatccatcttcgagtaatgctgacctcctaaattatagaagtttgttcatggaagatgaggaggggcagtccgagccttttgtgcagaaactatggtag

SEQ ID NO: 16679 - DNA, 219 bp, Artificial Sequence
  Description of Artificial Sequence: Synthetic coding sequence
atgtggagtctgacagctagtgaaggtgagtctactaccgcgcacttcttcctgggggcaggagacgaagggctgggtaccagaggcattggcatgcggcccgaggaatcagacagtgaactgctcgaggacgaagaggacgaggtaccccccgagcctcagattattgtgggtatctgtgcgatgactaaaaagagcaagagtaaacctatgacatag

SEQ ID NO: 16680 - DNA, 1149 bp, Artificial Sequence
  Description of Artificial Sequence: Synthetic coding sequence
atgttaagatggacagtccacctagagggcgggccgcggcgggttaaccacgccgcggtagctgtgggtcacagggtgtactcattcggcggttattgtagcggcgaagactatgaaaccctgcgccagattgacgtgcatatttttaacgcagtgtctctaaggtggactaagctcccacctgtgaagagtgcaatcagagggcaggctcctgttgtgccctatatgaggtatggacatagcacggtgctgattgacgatacagtgctcctttgggggggccgcaacgacacagaaggagcctgcaacgtactttacgctttcgatgtgaacactcacaaatggtttaccccccgagtctctggaacagttccgggcgcaagagacggacattctgcatgcgtacttggcaagatcatgtatatcttcgggggatatgaacagcaagcagactgcttctcgaatgacatccacaaattggacacttccacaatgacgtggactctcatttgtacaaagggctcccctgccaggtggcgggacttccattcagcgacaatgctggggtcccacatgtatgtgtttggtggacgcgccgacagatttgggcccttccacagcaacaatgagatctattgtaatcggatcagggtcttcgatacaaggaccgaagcatggctggattgtccacccacacccgtcctccccgaggggaggcgcagccacagtgcttttggctataatggagagctgtacatattcgggggatacaacgcgcgcctgaatagacacttccacgatttatggaagtttaatcctgtgtcattcacctggaagaaaatcgaaccaaaagggaaaggcccctgtcccaggcggagacagtgttgttgtattgtgggagataaaatcgtgctcttcggaggcacaagcccgagccccgaagagggtttgggtgatgagttcgatctgattgatcactccgatttacatatccttgattttagcccttccctcaaaaccctatgtaaactggctgttatccaatacaatctggaccagtcttgcctgccgcatgacattcggtgggaactgaacgcaatgaccaccaacagtaacatttcccgcccaatcgtgtccagccatgggtag

SEQ ID NO: 16681 - DNA, 1620 bp, Artificial Sequence
  Description of Artificial Sequence: Synthetic coding sequence
atggccaccagtgcgccattgcgcagcttggaggaagaagtgacttgttcgatttgcctagattaccttcgggaccccgttaccatcgactgtggccatgtgttctgccgttcctgcactacggacgtgagacctatctcagggtccaggccagtgtgcccactgtgtaagaagcctttcaagaaggaaaatattcgtccagtatggcagcttgccagtcttgtggagaatatagagaggctgaaagtagacaaaggccggcaacccggcgaagtaacaagggagcagcaagacgccaaactatgtgagagacacagggagaagcttcattattactgcgaagacgatggaaagctcctatgcgtgatgtgtagggagtctcgtgagcacagaccccatactgccgtactgatggaaaaggccgctcagccgcatcgggagaagatcttaaaccatctgagcactttgagaagagaccgagataagatccaaggttttcaggctaaaggagaggctgacattttggctgctcttaaaaagctgcaagaccaaagacagtatattgtcgccgaatttgagcagggacatcagtttctacgagaacgggaagagcatctcctcgagcagcttgccaagctcgaacaagaattgacagaggggagggagaagtttaagtcccggggcgtgggcgagctcgctcggttggccctggtgattagcgagctggaagggaaagcacaacagcctgcggcggaactgatgcaagatacacgtgatttcctcaaccggtaccctcggaaaaagttttgggtaggcaagcccatcgcccgagttgttaaaaaaaaaaccggcgagttctctgataagttgttgtcccttcaacggggcttgagagagtttcagggcaagctgctccgcgacctggaatataagaccgtcagcgtgacgttggacccacagtctgcaagcggatatttgcaactgtctgaagactggaaatgtgttacttatacctccctttacaagagtgcttacctgcatcctcagcagtttgattgcgagcccggcgtgttgggttctaaaggcttcacctggggaaaagtatactgggaagttgaggtggagagagagggctggtccgaggatgaggaggagggggatgaagaagaagagggtgaagaggaggaggaagaagaggaggctgggtacggggatgggtatgatgattgggaaactgacgaagacgaagagagcctgggcgatgaagaggaggaggaggaggaagaggaggaagaagtgcttgagtcatgcatggttggtgttgctagagatagtgttaagaggaaaggcgacttaagcttacgccccgaagacggcgtgtgggccctgcggctgagcagctctggcatctgggccaacaccagcccggaggcagagttattccctgccctaaggcccagacgagtggggatcgcgctggactatgaagggggcaccgttacatttacgaacgcagaaagccaagaattgatctatacctttactgccacctttacacggagacttgtgcctttcttatggttgaaatggcccggaacaagactgcttttacgtccctag

SEQ ID NO: 16682 - DNA, 390 bp, Artificial Sequence
  Description of Artificial Sequence: Synthetic coding sequence
atggccgaacttatacagaaaaagctgcagggtgaggtagagaagtatcaacagctgcagaaagacttatcaaagtctatgagcggacgccagaagctggaggcccaactgacagaaaataatattgtgaaggaagagctggccctgctggacgggtccaacgtggtctttaagctgctgggtcctgttctggtgaagcaggagctcggcgaagcaagggccaccgtcggaaagcgcttggactatatcacagcagaaattaaacggtacgagtcacagctgagggacctggagcggcagagtgaacagcagagggaaacattggcacagcttcagcaggaattccagagggcccaggccgccaaggctggagctccgggcaaagcttag

SEQ ID NO: 16683 - DNA, 1089 bp, Artificial Sequence
  Description of Artificial Sequence: Synthetic coding sequence
atgctgaaaaacaagggccatagttccaaaaaggacaacctggccgtgaacgccgtggccctccaggaccacatactgcatgatctgcagctaagaaatctctcagtggcagatcacagcaagactcaggttcagaagaaggaaaacaagagtctcaagcgggacactaaggccattatcgacaccggcctcaagaagactacgcagtgtcccaaacttgaagactccgagaaggagtacgtgttagatcccaaaccccccccactgaccctggctcagaaacttggtctgatcggacccccaccacctccattgagttcagatgaatgggaaaaagtgaagcagcgcagcctcctccaaggagatagcgtgcagccctgcccaatttgtaaggaagaatttgagctgcggccccaagtgcttctgtcttgcagccacgtgttccataaggcttgtcttcaggcctttgaaaaatttacaaacaaaaagacatgccctttgtgccgcaaaaaccagtatcaaactcgagtcatccacgatggtgcccgtttgtttaggattaaatgcgtgaccagaatccaagcgtactggcgcggctgcgtcgtgaggaaatggtatcgcaatttgcggaagaccgttcctcccaccgacgccaagctgaggaagaagttcttcgagaaaaaatttacagagatctctcatcgcattctgtgctcatataatacaaatatcgaagagttattcgccgaaattgatcaatgcctcgctattaatcgcagtgtcctccaacagctagaggaaaagtgcggccacgagataacagaggaagagtgggagaagatccaggtgcaggccctgaggcgggagactcacgagtgctccatttgtttagcccctctaagcgcggcaggtggccagagggtgggtgcggggagaaggtcgcgggagatggctctgctgtcctgctctcacgtcttccaccacgcctgcctgctggccctggaggaattcagcgtgggcgaccgacccccctttcacgcgtgcccactgtgcaggtcctgctatcagaagaagattctggagtgttag

SEQ ID NO: 16684 - DNA, 1266 bp, Artificial Sequence
  Description of Artificial Sequence: Synthetic coding sequence
atgtccgctctgcggaggagtggatacggcccgtcagatgggcctagctatggacgttactacggaccaggcggcggtgatgtacccgttcaccccccccctcctctctaccctctgagacccgagccacctcagccccctatcagctggcgagtacgaggaggggggcctgccgaaaccacatggcttggagaaggcggtggtggggacggatactaccccagtggcggcgcttggcctgaaccaggcagggcaggagggagccaccagtccttgaattcctatacaaacggcgcgtacgggcctacctaccctccaggtcctggtgcaaacacagcttcctacagcggggcctattacgcacccggctacacacaaacctcctactcgaccgaagtgccttcgacctacagaagcagtggcaacagtcccacccccgtctctagatggatatacccccagcaagactgtcagactgaagcaccgcccttaagggggcaagtgccaggatatcctccctcgcaaaatccaggcatgaccctgccacactatccatatggtgacggaaaccgctctgtgcctcagagcgggccaaccgttcggcctcaggaggacgcatgggcctcacccggggcctacggcatggggggaaggtatccttggccaagctcagcaccttccgcccctcctgggaatctgtacatgacggaaagtactagtccctggcctagttcaggttcaccacagtcacctccgtcgcccccggttcaacagcctaaggattctagctacccttacagtcagagcgaccagtcaatgaatcggcataatttcccatgcagtgtccaccaatacgaaagctctggcaccgtgaataatgatgactctgacctcctggattctcaagtccagtattcagccgaaccacagctgtacggtaatgccacctctgaccaccccaataaccaggatcagagtagcagccttcctgaagagtgcgtgccaagtgatgaatcgaccccaccaagcatcaagaaaatcattcacgtgctggagaaagtgcagtatttagagcaggaggtggaagagtttgtcggaaaaaagactgacaaggcctactggttattggaagagatgctgaccaaggagctgctggagttggatagtgttgaaacaggcggtcaggattctgtccggcaggctaggaaagaagccgtctgtaagattcaggcgatcctggagaagctggagaagaaaggactgtag

SEQ ID NO: 16685 - DNA, 321 bp, Artificial Sequence
  Description of Artificial Sequence: Synthetic coding sequence
taaaacttaagggaaggtgccgagcagaaagtcgtatttatcacaggacgtgtccacccaggcgaaacgccatcgtctttcgtgtgtcagggcatcatcgactttctggtgtcccagcatcccattgcatgcgtcttacgcgaatacttggttttcaagatagcccccatgctcaatcccgatggtgtgtatctgggcaactacaggtgtctgtctttgatgaggaatgggagcagagggagacccttctttccgagctctagcgcacggatgcttcgcacaagccccattccggctcacccgctgactgggactctgtag

SEQ ID NO: 16686 - DNA, 684 bp, Artificial Sequence
  Description of Artificial Sequence: Synthetic coding sequence
taacttatcttcgcatgtttagtgccaggattcccggctgtgatgtcctccagaggtccatgtactttggaaacgcttatcaatcccagcccctccgttgcagacgtcaaaatttatcccgaggaaatcacccctttactccctgctataagtggtgagaagattgccgaagaccaaacttgcttttttctccagatcctgctgaagtatatggtgatccaggcagcctctttagaatggaagaacaaagaaaaccaggacaccggctttaagtttttattcacactattcaggaaatactacctcccgcaccttttcccatccttcactaagctgacaaacatatacaagccggtgttggacatcccccatctgagaccaaagcctgtatacatcaccacgacgagagacaacgagaacatctattcgaccaagatcccctacatggcggcaagagtggtcttcattaaatggatagtcacctttttcctcgaaaaaaagtacttgaccgctacccagaatactaaaaacggagtcgatgtgctgccaaaaattatccaaacagtcggcggaggtgccgtgcaggaacgcgcccccgagctcgatgggggtggccccaccgagcaagataaatcacactctaactcaagcaccctctcagatcgaaggcttagcaattcctag

SEQ ID NO: 16687 - DNA, 573 bp, Artificial Sequence
  Description of Artificial Sequence: Synthetic coding sequence
atggagcccccaatggaaccgtcaggaggggagcaggagcccggtgccgttcggtttttggacctgccctgggaagacgtcttgctcccacacgtgctgaacagggttccgttacgccagctgctgaggctgcagagggtaagccgtgcgtttcgctcactggtccagttacacctggccgggctacgacggtttgatgcggcccaggtgggccctcagattccacgggccgcactggcccgcctcttgcgcgatgcagaagggctgcaggaactggccttggctccgtgtcacgaatggctgtccgatgaggacctggtccctgtgcttgcccggaatcctcagcttcggagcgttgcacttgggggttgtggccagttatctcgaagggctctgggcgctctggctgagggctgtcccagactacagcggctgagcctggcgcactgtgactgggtggatggcctagctcttcgggggctggccgacagatgtccagccctcgaagagttggatttgacagcctgccggcagttgaaggacgaagcaattgtttacctggcgcagcgatag

SEQ ID NO: 16688 - DNA, 270 bp, Artificial Sequence
  Description of Artificial Sequence: Synthetic coding sequence
atgtcagagcaaggcgatttaaaccaggctatcgctgaggagggtgggactgagcaggagactgccacccctgagaacgggatagtaaagagcgagtccctcgatgaagaagagaagctcgagctccagcgacggctggaagcccagaaccaggagcgccggaaatccaaatcaggtgccgggaaaggcaagttgactcggagtctcgccgtttgtgaggaatctagcgcgaggccaggcggagagtccctgcaggatcagactctgtag

SEQ ID NO: 16689 - DNA, 381 bp, Artificial Sequence
  Description of Artificial Sequence: Synthetic coding sequence
atgacgacccgttccgttcttgacgtggagaccttcgttgccgacattttgaagggcgagaacctgtctaagaaagcaaaggaaaagagagagagtttgattaagaagattaaggatgtcaagagtatatatctgcaggagtttcaagataaaggagacgcagaggatggagaggaatatgatgacccctttgcgggtccaccagatacaatttctctggcctccgaacggtatgacaaggacgacgaggctcccagtgacggcgcccagtttccccccatagcagcccaagatttacctttcgtccttaaagcaggctatctggaaaagaggcggaaagatcactccttcctcgggttcgaatggcagaaacggtggtag

SEQ ID NO: 16690 - DNA, 678 bp, Artificial Sequence
  Description of Artificial Sequence: Synthetic coding sequence
atgctgagtgcagttgcgcgtggttaccagggctggtttcacccctgcgccagactctctgttcggatgtcatcaactggcattgaccgcaaaggcgtcttggccaatcgcgtggcagtggtgaccggtagcacttcaggcatcggttttgctatcgctcgccggctcgctcgggatggggcccacgtggttatttcgagtcgcaaacagcagaacgtggatagagcaatggccaaattacagggggagggtctaagcgtggccggtatcgtctgccacgtcggtaaagctgaagatagagaacaactcgtcgccaaggctctggagcactgtgggggtgtcgatttccttgtctgttctgctggcgtcaacccgctcgttggctcaactttggggacgagcgaacagatatgggataagattctgagcgtgaatgttaagtccccagccttgctcctctcccagttactcccatacatggagaaccggagaggcgccgtaattttggtgagcagtatagcagcttacaatcctgtggtggctctcggggtctacaatgtctccaaaaccgcactcttgggcctgacacgcacactggctctcgagctggcccccaaggacatcagggtcaattgcgtagtccctggcatcatcaagactgacttctcaaaagtttag

SEQ ID NO: 16691 - DNA, 1080 bp, Artificial Sequence
  Description of Artificial Sequence: Synthetic coding sequence
tgagccaccgcaatgacgtccgcttggttggcccaaggaactggagagggtgttaacgatgttagaaagggggcgtgcgcttcacacgtctccactatggcaagttttctaaagggcgcacacgttacgatcaatgcacgtgcggaagaagacgttgaacccgagtgtatcatggaaaaagttgctaaggcctcgggcgcaaactacagtttccataaggaaagcggcaggtttcaggacgttggccctcaggccccagtcggctccgtttaccagaagacaaatgctgtgtcagaaatcaagagagtcgggaaagactccttctgggcgaaggctgaaaaggaggaagagaacaggagactggaggaaaagcgtcgcgccgaagaggctcagagacagttagaacaggagcgaagagagagagagctgagggaggccgcgaggagagagcagaggtaccaggaacagggcggagaggcctccccacagcgtacttgggaacagcaacaagaagtggtaagccggaacagaaatgagcaggagagtgctgtgcatcccagagagatctttaagcagaaagaacgtgctatgtccacaacaagtataagctctccccagccaggaaaactgcgatcaccctttctgcagaagcaacttacccagccagagacacactttggccgcgaacccgccgcagctattagtcggcctagagcagacctccctgccgaggagcccgctcccagcacgcctccctgtctggtgcaggcagaggaggaggccgtttacgaggagccgcctgaacaagaaactttctatgaacagcctcctttagtgcagcagcagggtgccggatctgaacacatcgaccatcatatccagggtcaaggccttagtggacagggactttgcgctcgcgctctgtacgactaccaggccgccgacgataccgaaatcagttttgatcctgagaatctaatcacaggcattgaagttattgatgaaggctggtggcgtgggtatggtcccgacgggcatttcggcatgttcccagctaattacgtcgagttaatagaatag

SEQ ID NO: 16692 - DNA, 483 bp, Artificial Sequence
  Description of Artificial Sequence: Synthetic coding sequence
atggaggcagagaggccacaggaggaagaagacggtgaacagggccctcctcaggacgaggagggttggcctccacccaatagcacaactcggccctggcgaagtgccccaccttcgccaccacctcctgggacgcggcacacagctctgggcccgcgctcagccagcctgctgtcactccaaaccgaacttctgttggacctggtggctgaggcccagagccgcaggcttgaggagcagcgagctactttttataccccacaaaatccttccagtctggcgccggcaccactgaggccactggaggaccgagagcaattgtactccaccatactctcccatcagtgtcagcgtatggaggcccagcgaagcgagccacccctgcccccaggtgggcaggagctgctggagctgctgttgagagtccaggggggtggccgtatggaggaacagcggtctaggccccctacccatacatgttag

SEQ ID NO: 16693 - DNA, 2616 bp, Artificial Sequence
  Description of Artificial Sequence: Synthetic coding sequence
atgggagacagcgacgatgagtatgacagacgaaggagggacaaattccgccgggagagatcagattacgatcgctcccgagagagggatgagcggaggcgtggcgacgattggaacgatcgggagtgggacagaggacgcgagagacgaagcaggggtgagtatagggactatgatcgaaaccggcgggaacgcttcagtccccctcgacacgagctgagccctccccaaaaacggatgaggagggactgggatgagcacagcagtgacccctatcactccgggtatgagatgccttacgcaggggggggaggggggcctacgtacggtccacctcagccttgggggcatccggatgtccacatcatgcagcaccatgttctgccaatccaggccagactgggctccattgcggaaattgacttaggcgtgccaccccctgtaatgaaaacttttaaagaatttctcctaagcttggatgacagcgtagacgaaactgaggccgttaaacgatataacgactataagctggattttcgcagacagcagatgcaagacttttttctggcccataaggacgaggaatggtttcgcagtaaatatcaccctgatgaggttgggaagagacggcaggaagctagaggtgccctgcagaatagattacgggttttcctgtctcttatggagaccggctggtttgacaacctcctgttagacattgacaaggccgacgctatcgtgaagatgcttgatgccgctgtgattaagatggagggcggaaccgagaacgatctccgtatcctggagcaggaggaggaggaagagcaggcaggaaaacctggtgagccatccaagaaggaagagggcagggcgggagcaggactcggggacggggagcgcaagacaaacgacaaagatgagaagaaggaggacggaaagcaagctgagaatgacagtagcaatgatgacaagaccaaaaagagcgaaggtgacggcgacaaggaagaaaaaaaggaagattctgaaaaggaagctaaaaaatcgtccaagaaacggaataggaagcattctggcgatgattcttttgatgagggtagcgtgagcgagagcgagtctgagtccgagtctggccaggccgaagaggagaaagaagaagccgaagccctaaaggaaaaggagaagccgaaggaggaggagtgggaaaagcccaaagatgccgccggcctggagtgcaaaccaagacctcttcataaaacatgctccttgttcatgcggaacatcgccccgaacatcagtcgcgccgagatcatctcactatgcaagcggtacccaggttttatgcgggtggctctcagcgaacctcaacctgagcgtcgcttcttccgcaggggatgggtgacctttgatcgctcggtgaacatcaaggagatttgttggaatctgcagaatatacgtctcagggagtgtgaactaagccccggagtaaatagggatctcacgagacgtgttcggaatataaatggcatcacgcaacataagcagattgtccgaaacgatatcaaacttgccgccaaacttatccatactctagatgatcggactcagttatgggcctccgaacccggcactccccctctgcctacttctctcccgagccaaaatcctatactgaagaacattaccgattacctaatagaggaggtctctgcagaggaagaagagttactgggaagctctggcggtgctccccctgaggagccccccaaggaggggaatcccgctgaaatcaacgtggagcgggatgagaagttgatcaaggtattggataagttgctcctatacctgcgcatagttcactcactggattactataacacctgtgaataccctaatgaggacgagatgcctaacaggtgcggcattattcatgtgcgaggcccaatgccgccaaatagaatttcccacggggaggttctggaatggcagaaaacatttgaagagaaactgactcccctgttgagcgtgcgcgagtccctatccgaagaagaggctcaaaagatggggcgtaaggaccctgaacaggaggtcgagaagtttgtgacctcaaatacccaggaactcggcaaagacaagtggctgtgcccactttctggtaaaaagttcaagggccccgagtttgtgcggaagcatatattcaataagcatgcggagaaaattgaagaggtcaaaaaagaggttgctttttttaacaactttcttacggacgcgaaaagacctgcactaccagaaatcaaacctgctcagcccccaggccccgcacagtctttgactccaggcctgccttatccccatcagaccccccagggcctgatgccatatggacagccacgaccacccatcttggggtatggtgcgggagcggtaagacccgcggtaccaactggtggaccgccctatcctcatgcgccatacggcgcaggtcgtggaaactacgacgctttccgcggccagggggggtatcctggcaagccacggaatcgcatggtgagaggcgatccacgagcgatcgtcgagtaccgggatcttgacgcgcctgatgatgttgacttcttctag

SEQ ID NO: 16694 - DNA, 2025 bp, Artificial Sequence
  Description of Artificial Sequence: Synthetic coding sequence
atgcagacttcatcaagtaggtcagtgcacctgagcgaatggcagaagaactattttgctatcacgagtggcatctgtacaggacctaaggctgacgcttacagggcccagatcctgcgcatccaatatgcctgggcaaatagtgagatctctcaggtgtgcgcaaccaaattgtttaaaaaatatgctgaaaagtattcagcaattattgacagcgataacgtcgaaagtgggttaaacaactacgcggagaacatcctgacactggccggatcccagcagaccgactcggacaaatggcaaagcggcctgtccatcaataatgttttcaaaatgtcatccgttcaaaagatgatgcaggcaggtaagaagttcaaagactccctgctggagcctgccttagccagcgttgttatccacaaggaagcaacggtgtttgacctgccgaaattttctgtttgcgggtcttcccaagagtctgactcactaccaaactccgcccatgaccgagataggacgcaggacttccctgagtccaacagactcaaactactgcaaaacgctcaaccccctatggttacaaataccgcccgcacgtgccccaccttcagcgccccagtgggcgaatccgccacagcgaagttccacgtgacacccctgttcgggaatgtcaagaaagaaaatcatagctccgctaaggagaatataggcttaaatgtcttcctctccaatcagagctgcttcccagctgcctgcgagaacccgcagcggaaatctttctatggttctggtacaatcgacgcactaagcaatccgatcttgaacaaggcctgcagtaagaccgaggataatggccctaaagaagactcttccctgcctacatttaaaactgcaaaagagcaactgtgggtagatcagcagaagaagtaccaccagccccagcgcgccagcggcagttcgtatggaggcgtaaagaagagtttgggcgccagcaggtctcgagggatcctgggcaagttcgtgcctccaatccccaaacaggacggaggagagcagaatggcggcatgcagtgcaaaccatatggagccggccctacagagcctgcccaccctgtggacgaaaggttgaagaatctcgagcctaagatgattgagctgattatgaatgagattatggaccacggtccacccgtgaattgggaagatatcgctggcgtggagtttgctaaggccaccattaaggagatagttgtctggccaatgctgcggccggacatatttactggtctgagggggccaccaaaaggaatactgctcttcggcccgcccggaaccgggaagaccctgataggaaaatgtattgcaagccagtccggggcaacctttttcagcatctccgccagttctctgacttccaagtgggtaggggagggagagaaaatggttagggctttgtttgctgtcgcacgttgtcaacagcccgccgtcatcttcattgacgagattgacagccttctatctcagcgcggcgacggtgaacacgaaagttcccgacgcattaaaaccgagttcctggttcagctggacggtgccaccaccagttcagaagatagaattctcgtggtgggagcgaccaaccgaccacaggaaatcgatgaagcagcgcggcggcgattagtaaaaaggttgtatattcccctcccagaagcgagtgctcgaaagcagatcgttatcaaccttatgagcaaggagcaatgttgtctttctgaggaagagattgagcagatcgtgcagcaatctgatgctttctctggcgccgatatgacccaactctgccgggaagcatccctggggccgattcgctcgctgcaaacagccgacatcgctaccattactcccgaccaagtgcgcccaattgcttatatcgattttgagaacgcttttaggaccgtgcggccttcagtttcaccaaaagacctggagttatatgaaaactggaacaagactttcgggtgtggtaaatag

SEQ ID NO: 16695 - DNA, 1467 bp, Artificial Sequence
  Description of Artificial Sequence: Synthetic coding sequence
atgagcgacgaggtcttctctacaaccctggcctacactaagagcccgaaggtgacgaagagaacgacgtttcaggatgaactcattcgggccattacagcccgctcagcccgtcagcggtccagtgagtacagcgacgactttgactctgatgaaattgtgtcacttggagatttttcagatacatccgccgatgaaaactcagtcaataaaaagatgaacgatttccacatctcggacgacgaagaaaagaatcctagcaagttgctttttctcaaaaccaacaagtccaacggcaatattactaaagatgagcccgtctgtgctatcaagaacgaagaggagatggcccctgatggatgcgaggatattgtagtgaaaagcttttcagaatctcagaacaaggatgaggagttcgaaaaggacaagatcaaaatgaaacctaaaccacgaattctctctattaagtctactagcagcgagaacaatagtttggatactgatgaccattttaagcccagccctagaccccgctcaatgctgaaaaaaaaatcgcacatggaagagaaagatggtcttgaggacaaagagaccgccctttcagaggagctagagttgcacagtgccccctccagcctgccgacccccaacggcattcagctggaggccgaaaaaaaagccttttccgaaaaccttgaccccgaggacagttgcctaaccagcttggcaagctcaagtctgaagcagattctgggcgacagtttttcccccggctctgaggggaatgcctccggcaaggatccgaacgaagagatcacagaaaatcataatagcttgaagagcgatgaaaataaggagaactcattttctgccgaccatgtgaccacagctgtcgagaaatccaaagagtcccaagtaacagcggatgacctagaggaggaaaaagccaaggccgagctcatcatggacgacgaccggactgttgacccgcttctttctaaatcacagtcaatcctgatctcaacatctgcgaccgcctcctccaagaaaaccattgaggacaggaacattaaaaacaaaaaaagcacaaacaacagagcctccagcgcctccgctcggctgatgaccagcgagttccttaagaagagcagcagtaagaggcggactccatcgaccacaacatcatcccattaccttggcactcttaaagtgctggaccaaaaaccctctcagaaacaatcgatcgagcccgacagggctgataacatccgggctgctgtgtatcaggaatggctggagaaaaagaatgtttatttacatgagatgcatcgaattaaaagaatagagtccgagaatctccgcattcagaacgagcagaaaaaggcggccaagcgggaagaggcccttgcctctttcgaggcttggaaagccatgaaagaaaaggaggccaagaaaattgcggcctag

SEQ ID NO: 16696 - DNA, 564 bp, Artificial Sequence
  Description of Artificial Sequence: Synthetic coding sequence
atggtaagggaacctgggcccaggcccggcacacctgggtgttccgcctctgggcaatggactgcaactctgcgcccatatttgagcgctgtgagggctaccctccaggctgcactgtgtctggagaatttcagcagtcaggtggtagagcgtcacaacaagcccgaggtggaagtgcgttcgtccaaagaattactccttcagccagtgactattagcagaaacgaaaaggagaaagtcttgatcgagggctccattaatagcgtgcgtgtgtctattgcagtgaaacaggctgacgaaatcgagaaaatcctctgccacaaattcatgcgcttcatgatgatgcgggccgagaattttttcatactgagacgaaaaccggtggaaggctatgatattagtttcctgatcacaaactttcacaccgagcagatgtacaaacacaaacttgttgatttcgtgattcactttatggaggagattgataaagagataagtgagatgaagctgtccgtcaatgcccgtgcaagaatagtggccgaggaatttttgaagaatttttag

SEQ ID NO: 16697 - DNA, 1068 bp, Artificial Sequence
  Description of Artificial Sequence: Synthetic coding sequence
taatctctcgcttccagtttaaggaataaggaagggacactcgggtctaaggtagggtaccttgatgtcgaggcacgggggccgggggaaggaagaggggggggcggagaatcaccaccgctgcagcctcctcctccagctcccgtgcttctgtacgatcagggcggcggcagaagaagaaggggcgaggcagaagccgaggctgaagagtgggaggcagaaagtgtactcggcactctactgcagaaacttagagaggagggttatttggcctactaccttcaggggggattcagccgatttcaggccgagtgtccccacctgtgcgaaactagcctggcagggcgcgctggatcatctatggcacccgtgcctggaccagtcccagtagtgggattgggttccctttgtttaggaagcgactgttctgatgctgagagtgaggccgacagagacagtatgagctgcgggctggattcggaaggggctacacccccccccgtgggcctgcgcgcttctttccccgtgcagattctgccaaatttatacctgggctcagcccgcgactctgccaatcttgaaagcttggcaaagttgggcatccgttatatcttgaatgttactccaaacttgccgaactttttcgaaaaaaacggggatttccattataagcagatcccaataagcgatcattggagtcagaacctctcacgtttctttcccgaggctatagaattcatcgatgaggcattgagtcagaactgtggcgtcttagtgcactgcctggctggcgtttcccgctcagtcaccgttactgtggcttatctgatgcagaagttacatttgagcctcaatgatgcatacgatctggtaaagaggaaaaagagcaatatatctcccaactttaacttcatggggcagctattagacttcgagcgaagtctccggctggaggagcggcacagccaggagcaggggagcggaggacaagcttccgccgccagtaacccgccctcattctttaccaccccaacatccgacggagccttcgagctagcccctacttag

SEQ ID NO: 16698 - DNA, 51 bp, Artificial Sequence
  Description of Artificial Sequence: Synthetic coding sequence
atgtgcacatctgagacattccaggctctggacacgtttgaggcccggtag

SEQ ID NO: 16699 - DNA, 1620 bp, Artificial Sequence
  Description of Artificial Sequence: Synthetic coding sequence
atggctacatccgcccccttacgaagtcttgaggaagaggttacatgctctatttgcctggattacctgcgggaccctgtgaccatagattgcggacatgtgttctgtagatcctgtaccaccgatgtgaggcctatttctggatctcggcccgtgtgcccgctatgtaagaagccatttaaaaaggagaacatacgcccagtgtggcagctggccagccttgttgaaaacatcgaaaggctcaaggtggacaaggggaggcagcctggcgaagtgactcgtgaacagcaggacgctaaattatgcgagcgccaccgcgaaaaattgcattactactgcgaggatgatgggaagctactctgtgtgatgtgtagagaatcccgagaacaccggcctcacactgctgtcctcatggagaaggcagcacaaccccacagagagaagatcctgaatcatctctctactcttcgacgggatcgggacaaaatccaggggtttcaggccaagggagaggcggacattctagccgccctgaaaaaactgcaagaccagcgacagtatattgtcgccgagtttgagcagggccatcagtttttgagagaacgggaggaacacctcttggagcagctagcaaaactagagcaggaactaaccgagggacgggaaaaatttaagagccgcggggtgggtgaactggcaaggcttgctctggttattagtgaactggaaggcaaagcacagcagcctgccgccgagctcatgcaggatacccgcgatttcctcaaccggtatcctcgaaagaagttttgggtggggaagccaatcgcaagagttgtaaaaaagaagactggcgagttttccgataagctcctatctcttcaacggggtctgcgggaattccagggaaaactgttgcgggatctggagtacaaaactgtttctgtaaccttggatcctcaaagtgctagcggctacctccaactgtctgaagactggaaatgtgtgacatacacttccttgtataaaagcgcatatcttcatccccagcaattcgactgtgaacccggagtcctgggatctaagggttttacttggggcaaggtgtattgggaggttgaggtggagcgagaggggtggagcgaggatgaagaagagggagacgaagaagaggaaggtgaggaagaggaggaggaggaggaggccgggtatggggacggttacgatgattgggagacagatgaagacgaagaatcactcggcgacgaggaggaggaagaggaggaagaggaggaggaagtcctcgagtcctgcatggtcggtgtggctagggatagcgttaaacgcaagggagacttatcactgaggccagaagatggagtctgggccctacgcctgagctcttccgggatttgggccaatacctcgcccgaagccgaactgttcccagctttaaggccccgccgtgtgggcattgcgctcgactacgaaggaggtactgttacctttacgaacgcagaaagccaggaactgatatatactttcacggctaccttcactcggcgtctggtaccctttctatggctcaaatggcccgggacacgactcctcctccggccttag

SEQ ID NO: 16700 - DNA, 474 bp, Artificial Sequence
  Description of Artificial Sequence: Synthetic coding sequence
atggccacttccgccccccttcggagcctcgaggaggaagtgacttgctccatatgcctggactatctcagagatcccgtcacgattgattgcggccatgtcttttgtcggtcatgtactactgatgttaggcccatctcagggtcccgccccgtgtgccccctgtgcaagaaaccttttaagaaggagaatattcgccccgtgtggcaactagcatccctcgtagagaatatcgaacgactcaaagtcgacaagggaagacagccaggggaagtgactcgcgagcaacaggatgccaagctctgtgagcgccaccgtgagaagctacactactactgcgaggacgatggaaagctcttatgcgtgatgtgcagggagagtagagagcatcgaccgcacactgcagtattgatggagaaagctgcacagccacacagagagaaaattctcaatcacttatccacattaaggtag

SEQ ID NO: 16701 - DNA, 2553 bp, Artificial Sequence
  Description of Artificial Sequence: Synthetic coding sequence
atggagccagaacggaagggtctgtctctggctagctcctctgacggggacggccgggaggagaacaagttgaaacagggcatctctcaagacctggcctccagttctaggctggataggtacaagatagccagacagcttacagagaaggctattaaggaaaagaaaatcttttccatctacggtcattacccagtcgtgcgggctgccctaaggaggaaggggtgggtcgagaagaaattccactttctgcccaaggtgatcccagacgtggaggacgagggcgccagggtcaatgacgacacatgcgctaaagtcaaagaaaaccaggagatggcattggaaaagacagacaacatacacgacgtaatgtcccgactggtaaagaatgagatgccatatctgctgtggaccatcaagcgcgacatcattgactatcattctctaacctatgaccaaatgctcaaccactacgccaagaccgccagtttcaccacgaaaattggcctgtgcgtaaatatgcgatcccttccgtggtacgtacctgccaaccctgactcctttttccccaggtgttattccctatgtactgaatccgaacagcaggaattcctggaggatttcagacgaacaatggctagttctattcttaagtgggtggtatcccaccagtcctgctccagaagctcaagatcgaagcctcgtgaccagagggaagaagccggctcttccgatctcagttcaagacaggatgccgagaacgccgaggccaagctacgcggccttccgggccaactggtcgatattgcttgcaaggtgtgtcaagcttatctcggtcagttagagcatgaggatatagataccagcgcagacgccgtcgaagacctaaccgaggctgagtgggaggaccttacgcaacagtattactcactggtgcacggggacgcctttataagcaattcccgcaattatttcagccagtgccaggccttgctgaaccgcatcacatcagtcaatcctcagactgatatcgacgggctcaggaacatctggattatcaaacctgccgcaaagtcacgaggaagagacattgtgtgtatggatagggttgaggaaattctcgagctggcagccgccgatcatccactgtcccgggacaacaaatgggtggttcagaagtacatagagacacctctcctcatctgtgatacaaagttcgacattcggcaatggttcctcgtaaccgactggaaccccttgaccatttggttctataaggaatcttacctgagattttctactcaaagattctctttagacaaacttgacagcgccatccacttatgcaataacgcagtccaaaaatacttgaagaatgatgttgggcggtcccctttactgcccgctcataatatgtggacctccacaagattccaggaatatctccagaggcaaggccgaggtgccgtatggggatccgttatctacccctctatgaaaaaggctatcgcacatgctatgaaggtagcacaggatcacgtggagcctcgtaaaaacagctttgaattgtacggcgcggactttgtgctaggaagagacttcagaccgtggctgatagaaatcaattccagcccgaccatgcatccgtctacaccagtcacagcgcagctgtgtgcccaggtgcaggaagatactattaaggtggccgtcgatagaagctgcgacatcggcaacttcgaacttctctggaggcagcccgtggtcgagcctccgcctttcagcggtagcgatctgtgcgtagccggcgtctccgtgaggcgagctcgacggcaggtgctgccggtctgcaaccttaaggccagcgctagcttactcgacgcacagccactgaaggcgcggggacctagcgccatgcctgaccctgcacagggcccacccagccctgccctacaaagggatctcggactcaaagaggaaaagggcctgcctctggcgctcctcgcacccctgagaggagccgccgagagcggcggggctgctcagcctacccggacgaaagccgccggcaaggtcgagctcccagcatgtccctgtaggcacgttgactctcaggccccgaataccggagtgccagtagctcagcctgctaaaagctgggaccctaatcagcttaatgcccaccctctggagcccgttctgcgggggctgaagactgccgagggcgccctgagaccacctccggggggaaaaggggaaggtacagtatgcagccgactgccgcaccacgggcaccacgtcgccgcatgccaaactacggggactacctgggatgggggccctggcgtctgttttctgcgccaactcctggcatctgagctccccatggggccgggattgccacgagaccctagggcccctccctgtctggtctgtcggggtctgctgccccctgctggtccttgcaaacgctgccggtctttctgcgcagctgttctccagggagcctcatttgtgcgtctaggaggcagaagctgttcaccaaggacaccttag

SEQ ID NO: 16702 - DNA, 2739 bp, Artificial Sequence
  Description of Artificial Sequence: Synthetic coding sequence
atgaaacggggcattcgacgggatcccttccgcaagagaaagctgggaggtagggcaaagaaggtccgggagcctaccgccgtcaactccttttacagagaggcctccctcccaagcgtatgggcctccttgaggcgtagagagatggttaggtccggcgccaggcctggacaggtcctgagttcaggccgtcacaccggaccagccaagctgactaacggcaaaaaagctacctacctgcgcaagattcccagattcaatgcagattcaggctattccatccattctgattccgaatcgcaggctgagaccgtgcatggcctggacggttgcgccagcctactgagggatattctgcgcaatgaggatagcgcctcctctgacaacaaaaagcaaatccccaacgaggcctccgctcgcagcgaaagggacacgtcagacctcgagcagaactggagcctgcaggaccattataggatgtatagcccaataatttaccaggccctctgtgagcacgttcagacacagatgtctttaatgaatgatctcacgtcaaagaacattcccaacggcattcccgcagtaccatgtcacgccccaagtcactccgagagtcaggccacgccacatagctcatacggactgtgtacatctaccccggtatggagcctgcagagacctccttgtccacctaaggtgcactctgaagtgcaaacagatggtaacagccaattcgctagtcaggggaagactgtatcggcgacctgcacagacgtgctgaggaacagctttaacacatctccaggtgttccttgttccctgccaaagactgacatcagcgcaatccccacactacagcagctgggcctggtaaacggcattctcccacagcaaggcatccacaaggagaccgatctactcaagtgtatacaaacttacctctcgctttttcgctcgcacgggaaggaaacgcatctggatagtcagacacatcgcagtcccactcagtctcagccagccttcctggccacaaacgaggagaagtgcgctcgggaacaaatacgcgaggccacaagtgagaggaaggacctcaacatccatgtaagggacaccaagacagtgaaagatgttcaaaaagccaaaaacgtgaacaaaactgccgaaaaggtaagaatcattaaataccttttgggagaactaaaagcattggttgccgagcaggaagattcagagatccaacgactcatcacggagatggaggcctgtatctcagtgctccccacggtgtctggtaatactgatattcaggtggaaatagcattggctatgcagccgctgcgcagtgaaaacgcacagctgcgccggcaactgaggatcctgaaccaacaattacgggagcagcaaaaaacccaaaagccttccggagctgtcgattgcaacctggaactcttttcgctacagtcactcaatatgagccttcagaaccagttagaggagtccctgaaaagtcaggagctccttcaatccaaaaacgaggaactgctaaaagtcatcgaaaaccaaaaggatgagaacaaaaaattctcctcgattttcaaggataaagaccagaccattctggagaataagcagcaatatgatatcgagatcacccgcatcaagattgaactggaggaggctctcgtgaatgtgaaaagttcacagtttaaactcgagactgctgaaaaggagaaccagatcctaggaattaccctgcgccagcgggatgctgaggtgacgcgtctccgggaactgaccaggaccctgcagacaagcatggcgaagctgctgagcgacctgagtgtcgacagtgctaggtgtaaaccaggcaacaatctgaccaagagcctccttaacatccatgacaagcagctgcagcacgatccagctcctgcccacaccagcattatgagctacctgaacaaactggagaccaattactcattcacccacagtgaaccattgtctactatcaagaacgaggagacaatcgaacctgacaaaacctatgagaatgtgctgagcagtcgcggaccgcagaactctaacactcgaggaatggaagaggcctcagcccccggtataatcagtgctctttcaaagcaggatagcgatgagggaagcgagaccatggccctgattgaagatgagcataacctggacaacacaatctacattcccttcgcccgatcaacccctgaaaagaagtcccctctctccaaacggctatcgccccagccccagattcgggctgctaccacccagctagtcagcaattcaggacttgccgtatcgggaaaggagaacaagctatgtacaccggttatatgcagcagcagtaccaaagaagctgaggatgcccccgaaaaactgtccagggcaagcgacatgaaagatacccaactgcttaagaagattaaggaagcaatcggaaaaatccctgctgcgacgaaagaacccgaggagcagaccgcttgccacggcccaagcggatgccttagtaatagcctgcaggttaagggaaatacggtgtgcgacggctccgtctttacatctgacttgatgtcggattggtccatcagctctttctctacctttacgtcgcgagatgaacaggacttccgcaatggcctggctgctctagacgccaacattgctcgcctccaaaagtctttgcggactggattgttggagaaatag

SEQ ID NO: 16703 - DNA, 528 bp, Artificial Sequence
  Description of Artificial Sequence: Synthetic coding sequence
atggagttaaccatcttcattcttcgactggcaatatacatactcacgttccccctgtatcttttgaacttcctgggcctgtggtcttggatctgcaagaagtggtttccctacttcctagtgaggttcaccgtgatctataacgagcagatggccagcaaaaaacgtgaactcttcagcaaccttcaggagtttgctggccctagcggcaaactgagcctgctggaagtcggatgcggaaccggagctaattttaaattctaccctcccggctgcagagtgctgcgtcccggaggagcattctacttcatggagcatgtcgcagccgagtgtagcacttggaactatttttggcagcaggtcctggaccctgcttggcatctgttgtttgatggttgtaacctgacaagagagtcctggaaggccctggaacgggcctcgtttagcaaattgaaacttcagcatatacaggctcccctctcctgggagctggttcgaccccacatctatggttacgccgtgaaatag

SEQ ID NO: 16704 - DNA, 1392 bp, Artificial Sequence
  Description of Artificial Sequence: Synthetic coding sequence
atgagtggtggtactccgtacatcggaagtaagatttctttaatctcaaaggccgagatccgatacgaaggaatcctgtacaccattgacacagaaaacagcacggtggccctagctaaggtgcggagcttcggcacagaggaccgccctaccgaccgccctattcccccacgcgatgaggtgtttgagtacatcatcttccgcggctccgacatcaaagacctaaccgtttgtgagcccccaaaaccacagtgttcactacctcaggaccccgcaattgtgcaatcatctctcggctcctctacctccagctttcagagcatgggcagctatggtccatttggccggatgccaacatattcacagtttagcccttcatctctcgtcggacagcagttcggcgcagtgggcgttgccggcagttctttgacgtctttcgggactgaaacaagtaacagcggaaccctgccacaatctagcgcggtgggttcagcttttacgcaggacacccggtccttgaagacccagctttctcaggggcgcagtagtcctcagttggaccccctacgcaagtctcccactatggaacaagccgtgcaaactgcatccgcccatctgcccgcgcccgccgccgtcggacgccgctctcctgtcagcacccgacccctccctagtgcttcgcaaaaagccggcgagaaccaggaacacaggcgcgccgaagtccataaggttagtcggcctgaaaacgagcagctgcgcaatgataacaagagacaggtggctcccggcgccccctccgctccgcggagagggcggggaggacaccggggaggccgtggcaggttcggaattagaagggatggtcctatgaagtttgaaaaagacttcgacttcgagagcgccaatgcacaattcaacaaagaagagattgaccgggaattccacaataaattaaaactgaaggaggacaaactcgaaaaacaggaaaaacccgttaacggcgaagacaagggcgattcgggcgtggacacccaaaacagcgagggaaatgcggacgaagaagacccactgggacctaattgctattatgacaagacaaaaagtttcttcgacaacatctcctgtgacgataaccgcgagcgcagacctacctgggccgaggagcgccgcctgaacgccgaaacttttgggatccctctccgcccaaacaggggccgcggcggatatagaggcaggggcggcctcggctttcggggaggtagaggccgtggaggcggtcggggcgggacattcaccgcacctaggggttttagaggtggctttagaggcggccgagggggacgagagtttgctgatttcgagtaccgtaaaacaaccgcctttggaccatag

SEQ ID NO: 16705 - DNA, 2790 bp, Artificial Sequence
  Description of Artificial Sequence: Synthetic coding sequence
atggccgaagtggaggccgttcaactgaaagaggaaggaaatcgccatttccagctgcaggactataaggctgctaccaatagctattcgcaagcactcaaactgacgaaagacaaggcgttgctggcaactctttacaggaatcgtgccgcctgcgggcttaaaaccgaaagctacgtccaggccgccagcgacgcctcgagagctatagatatcaacagtagcgatatcaaggcactataccgaagatgccaggcactcgaacacttaggcaagcttgaccaagctttcaaggacgttcaaagatgcgcaaccctggagcctcgaaaccagaacttccaggaaatgctccgtaggctgaacacaagcattcaggagaaacttagagttcagttttctactgacagtcgagtgcagaagatgtttgaaatactgctggatgagaatagcgaagccgataagcgagagaaggccgcaaataacctcatcgtactggggcgggaggaggcaggggccgagaagatcttccagaataacggagtggccctgcttctacaactgttggacaccaagaaacccgaattggttctcgctgccgtaagaacccttagcggcatgtgctccggccatcaggctagagctaccgtcattttacatgccgtcaggatcgacaggatctgcagcttgatggccgtggaaaacgaagagatgagccttgccgtatgtaacctgttgcaggcaatcatcgattcactgagcggcgaagacaaacgggagcatagggggaaggaggaggctctggtccttgatacaaaaaaggatttgaagcagataaccagccacttgttggatatgttggtatccaagaaggtgtctggacaaggcagagaccaggcactcaatctacttaataaaaatgtcccgaggaaagatctagctatccatgataattctcgcacaatctatgtggttgacaacggcttgagaaagatcctgaaagtggtgggtcaggttccagatctgccgtcttgtttgccgctcacagacaatacaaggatgctcgcttccattctcattaacaagttatacgatgatctaaggtgcgatcctgagagggaccattttcggaagatctgcgaggaatacatcacaggcaaattcgaccctcaagatatggataagaacctgaatgctattcagacagtttccggcatccttcagggaccctttgacctggggaaccagttactgggcttgaaaggagtaatggagatgatggtggccctgtgcgggagcgagagggaaaccgaccagctcgtcgctgtggaagcgcttatccacgctagcaccaaactttctagggctaccttcatcattacaaacggagtcagcctgctgaaacagatctacaaaacaacaaaaaacgagaaaatcaaaatcagaactctggtaggcctctgtaaactgggctcggcagggggaactgactacggcttaaggcagtttgcagagggatcaaccgagaaacttgctaagcagtgtaggaagtggctgtgcaacatgagcatcgatacacgcacccgcagatgggcggtggaaggcctggcctacctcacattagacgccgacgtcaaagacgattttgtgcaggatgtcccagcactgcaggccatgtttgagttggcgaaaacctccgacaagacaatcttatattccgtcgcaacaacactggtcaactgtactaattcatacgatgtgaaagaagtaattcccgagctcgttcaactggccaagttctctaaacagcatgtccctgaggagcaccctaaagataagaaagactttatcgatatgagggtaaaacgcctactgaaagcgggagtgatttccgctctggcttgtatggtgaaggcagatagtgctatactcactgatcagacgaaggagctgctggccagggttttcttagcgttgtgcgataatccaaaggacagaggaaccatcgtcgcacaaggtggtgggaaggcgctgattcctttggcattggaaggaaccgacgtcggtaaagtaaaagcagctcacgcactggccaagatagccgctgtgtctaatcccgatattgccttccctggggagcgggtatacgaggtcgtgaggcctctggtgcggctcctggatacacagcgggatggattgcagaactacgaagctttgctgggactgaccaacctcagcggtagatctgataaactcagacagaaaattttcaaggagcgagctcttcctgatatcgagaattatatgttcgagaaccatgatcagctgcggcaagcagccactgagtgcatgtgtaacatggttctccataaggaagtccaggaaaggttcctcgctgatggaaacgaccgccttaagctcgtggtccttctatgtggggaggatgatgataaggtgcagaacgcagcggccggagccctcgccatgctgaccgccgctcacaagaagctgtgcctgaaaatgacccaggtgaccacacagtggctggagattttgcagcgcctgtgcctgcacgatcagttgtcagtgcagcatcggggactggtaatcgcctataatctgttggcagccgacgcagaattggccaaaaaacttgtagagagcgagctgctggaaatccttacggtggtgggaaagcaggagcctgatgaaaagaaggccgaggtagttcagacagcaagggagtgtcttatcaaatgtatggattatgggtttattaaacctgtgtcgtag

SEQ ID NO: 16706 - DNA, 246 bp, Artificial Sequence
  Description of Artificial Sequence: Synthetic coding sequence
atgtcccactatggctcatattatggtggactgggttattcttgtggtgggtttggcggcctcggttacgggtatggctgcgggtgcggttctttctgtcggcgcggatccgggtgcgggtatgggggatacggctacggatctggattcggcggatacggatacgggtcagggtttggaggctacgggtacggatgttgcagaccctcatataacggcggctatggcttcagtggtttttactag

SEQ ID NO: 16707 - DNA, 150 bp, Artificial Sequence
  Description of Artificial Sequence: Synthetic coding sequence
atggaggtgccaagattagatcatgctttgaacagcccaacctcaccatgtgaagaggtcatcaagaatctttcattggaggcaatccaactatgcgatagagatgtagtttttgaggagctgacgagtaagcagactcggaaaggctag

SEQ ID NO: 16708 - DNA, 498 bp, Artificial Sequence
  Description of Artificial Sequence: Synthetic coding sequence
atgagccgatacctgcggccgccaaatacatcattattcgtccggaatgtcgctgacgacacacggagcgaagacctcaggagagagttcggacggtacggacctattgtggatgtctatgtcccgctcgacttctacacccgccgcccgcgcgggtttgcatacgtgcagtttgaggacgtgcgcgatgcggaggacgctctgcataacctggacagaaagtggatatgcggccgtcagattgagattcagttcgcccagggtgacaggaagacgcctaaccagatgaaagctaaggaaggtaggaacgtctactcttctagccgttacgatgactatgacaggtaccgccgaagtagaagtaggtcatacgagaggagaaggtcccgtagcaggagttttgattataactatagaaggagttactccccacgaaaaccaaactgcagctggaatacccagtattcctctgcctactacacaagccgcaaaatctag

SEQ ID NO: 16709 - DNA, 1803 bp, Artificial Sequence
  Description of Artificial Sequence: Synthetic coding sequence
atggcatcgaaccataaaagctccgcggccaggcctgtctctaggggcggagtgggcttgaccggtcgcccaccctctggcatacgtcccttgagtggtaatatcagagtagctacagccatgccccctgggacggctcggcccgggtctagggggtgcccaattggcactggaggggttttaagttcacaaatcaaagtcgctcaccgcccagtgacacagcagggcttgaccggtatgaagacaggcaccaaagggcctcagagacaaattctggacaaatcatactacctcggtctccttagatctaaaatctcagaactgaccacagaggtgaacaagttgcagaaaggaatcgagatgtacaaccaggaaaatagcgtgtatctttcctatgaaaaacgtgctgagacccttgctgtagagataaaagaactgcaaggacagctggccgattacaacatgcttgtggataaactgaacaccaacactgagatggaggaggtgatgaacgactacaacatgctgaaagctcagaatgatagggagactcagtctcttgacgtgatctttaccgagaggcaggcaaaggaaaagcaaatcagatctgtggaggaagaaattgaacaggagaaacaagctactgacgacataattaagaacatgtctttcgaaaaccaagtcaaatatctggaaatgaagacaaccaatgagaagctcctgcaggagctggacacgctacaacagcagctcgacagccagaatatgaagaaggagtcactagaggctgaaattgcacatagccaggttaagcaggaggcagttttgttacatgaaaagctgtacgaactcgagagccatagggaccagatgattgctgaggataaaagtattggctcccccatggaagaacgcgaaaagttgttaaagcagattaaagatgataaccaagaaatcgcctctatggaaaggcagctgaccgacacaaaggaaaagatcaaccagtttatcgaggaaattagacagctggatatggatttggaggagcatcaaggtgagatgaatcagaagtacaaagaactgaagaagcgggaggaacatatggacactttcatcgaaacatttgaagaaacaaaaaatcaggagctgaaacggaaagcccagattgaggccaacatcgtggctctgctcgaacactgctctcgaaacatcaatcggattgaacagatttcttcaatcaccaaccaggaactgaagatgatgcaggatgacctcaattttaagagcacagaggtgcagaaatcacagagcacagcacagaatctgactagtgacatacagcgccttcagctggatctgcagaaaatggaactgcttgagagcaagatgactgaggaacagcatagtctgaaaagcaagataaaacagatgacgaccgatctcgagatctataatgacttgccggccttaaagtcatccggcgaagaaaaaatcaagaagctgcaccaggagagaatgatactgagcacacaccgtaacgccttcaagaaaatcatggagaagcagaatatcgagtatgaggccctgaagacacagctccaagagaatgagacacacagccaacttactaacctggaacgcaaatggcaacacctcgagcagaataattttgccatgaaggaatttattgccaccaaaagtcaagaatccgattaccagcccattaagaaaaatgttaccaaacagatcgcagagtataacaaaacaatcgttgacgctttgcactccacgtcgggcaattag

SEQ ID NO: 16710 - DNA, 465 bp, Artificial Sequence
  Description of Artificial Sequence: Synthetic coding sequence
atggtatcctcggcccagatgggtttcaaccttcaggccctcttagaacagctgtctcaggatgaactgtcaaaatttaagtatctgattacaaccttctctcttgctcatgagttgcagaagatccctcacaaggaggttgacaaagctgacggcaaacagctggtggagattctgaccacccactgcgattcatactgggtggaaatggcttcactgcaggttttcgagaagatgcaccggatggatttgagcgagagggccaaggatgaggtgcgagaggcggccctcaaatcatttaacaaacgaaaacccctgagtttaggcatcaccagaaaggagcggcccccacttgatgtggatgagatgctggagcgctttaagactgaggcacaggcatttacggagaccaaggggaatgttatttgtctcggcaaggaagtattcaaagggaaaaagccatag

SEQ ID NO: 16711 - DNA, 474 bp, Artificial Sequence
  Description of Artificial Sequence: Synthetic coding sequence
atggctacctccgcccccctgcgttccctcgaggaggaggtgacgtgttctatctgtttagattacctgagggacccagttactattgactgcggccacgtattttgcagaagctgtacgacagatgtccggcctataagtggatcgaggcccgtctgccctctgtgtaagaagcccttcaagaaggaaaatattcggcctgtttggcaactagcaagtcttgttgaaaatattgagaggttgaaagtggacaagggtcgccagcccggagaagtgacccgcgagcagcaagacgcgaagctgtgtgaacgacatcgagaaaagctgcattactattgcgaggatgacgggaagctgctctgtgtcatgtgcagggaatcacgggagcatcggccacatactgcagtgctcatggaaaaagccgcccagccacatagagagaagatcttgaatcatcttagtactctcaggtag

SEQ ID NO: 16712 - DNA, 348 bp, Artificial Sequence
  Description of Artificial Sequence: Synthetic coding sequence
atgccacatctccccctcgcttccttccgtccacccttctgggggctgcggcactcgcgaggcttgcccagattccatagcgtctccacccagagcgagccccacggctcccctatttctcggaggaaccgggaagctaaacagaaacgcctgcgcgagaaacaggcgactctcgaggcagaaattgccggcgaatcaaaatcaccagccgaatccattaaggcttggagacccaaagagcttgtactgtatgagatacccaccaagccaggagagaaaaaggacgtatccggcccacttcccccagcatatagtcctagatatgtggaagctgcttggtacccctag

SEQ ID NO: 16713 - DNA, 432 bp, Artificial Sequence
  Description of Artificial Sequence: Synthetic coding sequence
gtgagagagttagaggccgagctcgatgcagagcagaagaagcatgctgaggccttgaaaggggtgcggaagcacgaaaggcgtgtgaaggagctcgcttatcaggtgggagaccgcgtatccttaggctctgggcccggagccgggccagcccaggcttctcctgaatcccccttgcctgcacaggctgaagaagatcgcaagaacctggccaggatgcaggatctagtggataaactgcaatctaaagtcaaaagctacaagagacagttcgaagaggcagaacaacaggccaataccaaccttgctaaataccgaaaggcccagcatgagctggacgatgcagaggaaagagccgatatggctgagacccaggcaaacaagttgagggcacggacgcgggatgctctgggtccaaagcataaagaatag

SEQ ID NO: 16714 - DNA, 828 bp, Artificial Sequence
  Description of Artificial Sequence: Synthetic coding sequence
atgagcacaattgggtcattcgaggggttccaggcggtgtctcttaaacaggaaggggacgaccagccaagtgagactgatcacctcagcatggaagaggaggatccaatgccccgccaaatctcacggcagtcctcagtcactgagtctactctgtatcccaacccgtaccatcagccttatataagccgtaagtattttgccacacgacccggcgcgattgagactgctatggaggatctgaagggccatgtcgcagaaactagcggagagacgatccagggcttctggttgctgaccaagatcgaccactggaataacgaaaaagaacggatcttgctggtgacggataagacgttgcttatctgtaagtatgatttcataatgctgtcttgcgtgcagctgcaaagaatccctctttcagccgtttaccgaatctgcttgggtaaatttactttccctggcatgagcctggacaaaaggcagggtgagggtttgaggatttactggggaagcccggaagaacaaagtctgctgtcacgctggaatccctggagcacagaggttccttacgccacttttacagaacaccccatgaagtacacctctgagaagttcctggagatctgtaagcttagcggcttcatgagtaaactggtaccagccattcaaaacgcccataaaaactcaacgggaagcggaagaggcaagaaactgatggtgctgactgagcctatcctgattgaaacctacactggactaatgtctttcatcggcaacagaaacaaactcggctattcactcgccagggggtcgataggcttttag

SEQ ID NO: 16715 - DNA, 339 bp, Artificial Sequence
  Description of Artificial Sequence: Synthetic coding sequence
tagtgcgcccgcaccgccggcggatgcctcgggtgcctgtccggtcagtgctgttgtaggctgtgcccattgactttacccgccacacgctctttgtgcccagggagggtagtctgggccagaagaagatggtggccctcctggctggcctggcgttgtttgtggtgcacaacgaggccaccggcgtgtatggaaaatactgatgccttcctgttcttatttagctttactgaccgagcctccttcgaagatctgccaggacaactggctcggatcgccggcgaggctcctggtgtcgtccggatggtgatcggatccaagttcgaccagtatatgtag

SEQ ID NO: 16716 - DNA, 3330 bp, Artificial Sequence
  Description of Artificial Sequence: Synthetic coding sequence
atgggcaccggtgattttatatgcatatctatgaccggcggtgccccctggggctttcgactgcagggaggcaaagaacagaaacagccactgcaggttgctaaaatccggaaccagtccaaagctagcggctctggactctgcgagggtgacgaagtagtgtccatcaatggaaatccctgtgccgacctgacataccccgaggtgataaagttgatggagagcatcacagactcactgcagatgttgattaagcgtccctcttctgggataagcgaagccttgatctccgagaacgaaaacaagaacttggagcatctgacccatggaggatatgtcgaaagtactactctgcagattagacccgccaccaagacccagtgtaccgagttttttctcgccccggtaaagaccgaagtgcctctggccgaaaaccagagaagcggtccagactgcgccggctccctcaaggaggaaacaggcccaagttaccagcgcgcccctcagatgccagacagccagcggggacgcgtagccgaagagctcatattacgggagaaagtggaggccgtgcaaccaggtccagtcgtggaattgcagctgtcactttcccaggaacgccataaaggagcctccggtcctctcgtggccctacctggtgccgaaaaatcgaaatcacctgaccctgaccctaatttgagccacgatcggatcgtgcatataaacagcattccaactaatgagaaggcagatccctttctgcggtccagcaagatcatccagatctcatcgggacgggaactcagggtgatacaggaatcagaggcgggagacgccggattaccccgagtagaagtcatccttgattgcagtgatcggcagaaaactgagggctgtaggctccaggctggtaaagaatgcgtggacagccctgtagaagggggacagtctgaggcgccgcccagcctcgtctcctttgcggtgtccagcgaaggcaccgaacagggcgaggacccacggtccgagaaagaccatagcagacctcacaaacatcgtgcgagacatgcccgcctgaggaggtctgagagtctgtctgaaaagcaagtgaaggaggcaaaatccaaatgcaaaagcatcgctctgcttctgacagatgcccccaacccgaatagtaagggcgtgctgatgtttaaaaaacggcgtcggcgggctcgtaagtatactcttgtctcttacggaaccggcgagctcgaaagagaagctgacgaggaagaggaaggcgacaaggaggatacttgtgaggtggcattcttgggggcaagtgaaagtgaagttgacgaggagctcctctcagatgtggatgacaacactcaggtggtgaattttgattgggacagcggtttggtggatattgaaaagaagctgaacagaggagataaaatggagatgcttcctgataccactggtaagggggcactgatgtttgcaaagcgtcgagagagaatggaccaaatcacggcgcagaaggaagaggacaaagtcggaggtacacctagccgcgaacaagacgccgctcaaacagacgggcttcgaacgacaacaagctaccagaggaaggaagaggagagcgtgagaactcagtcgtccgtaagtaagtcttacattgaggtgtcccacgggttggggcacgttccacaacaaaacggttttagtggcacaagtgagacagctaacatccagcggatggtccctatgaaccgaactgcgaagcccttccccgggtccgttaatcagcctgctacacctttttcccccacccgaaatatgacatccccaattgctgactttccggctccaccgccctacagtgccgtcaccccaccccccgatgcattttcccgcggcgtgtccagtcccattgcagggcccgcacagccgccaccgtggccacaaccagctccatggagccagcccgcattctacgacagctcagaacgcatagccagcagagacgagcgcatctccgtgccagcaaagcgtaccggtatacttcaggaggctaagcggagaagtaccactaagcccatgtttactttcaaggaacccaaggtaagcccaaaccctgaattactaagcctgctgcagaactccgaaggaaagagagggacaggcgccggcggcgatagcggcccagaggaagattatttgtcactgggcgctgaggcgtgtaacttcatgcagagctcgtctgccaagcagaagactccacctccagtggctcctaaacccgctgttaaatcatcgtcatctcaacctgttactccagtgagccccgtgtggagccctggggtcgcacccacccaacccccagccttccccacatctaacccaagcaaaggaaccgtcgtgagcagcataaagattgcccagccctcatatccccccgctagacctgcctccactctgaatgtggccgggccatttaagggcccgcaggcagccgttgcttctcagaattatacacctaaacccacagtcagtactcctaccgtaaatgccgtccagcctggggccgtgggaccttccaacgagcttcccggaatgagcggccggggggcacagctttttgccaagagacaaagtcgcatggagaagtatgtggttgactcagatacagtacaggcccatgccgccagagcccagagtcctactcctagtcttcctgcctcctggaagtacagctccaatgtgagggccccgcccccagtcgcctacaatcccatccatagcccatcatatcctcttgcagccctaaaaagccagccatccgctgctcagccaagcaaaatggggaaaaaaaagggcaagaagccgctgaacgcattggacgtaatgaaacatcagccataccagctgaacgctagtctcttcaccttccaaccccccgatgccaaggacggcctcccgcagaagagcagcgtaaaagtgaacagtgcattggccatgaagcaggccctgcctcctcgtccggtcaatgctgcgagccctactaacgtgcaggcctctagcgtttacagcgtgcctgcctacacctcgccaccatccttctttgcagaggctagctcccctgtgtctgccagtccggtgcccgtcgggatccccacaagccccaagcaggagtccgcgagctcatcttattttgtggccccccgtccgaaattttccgcaaaaaagtcaggtgtgaccatacaagtcaaatgcaaatcgggaattcactctcaggatatcatcagaacatacttccccgcttacctcagctcaagcacttag

SEQ ID NO: 16717 - DNA, 1554 bp, Artificial Sequence
  Description of Artificial Sequence: Synthetic coding sequence
atggaaaccgaccttaactcccaggataggaaggatctggacaagtttataaaattctttgcgctcaagaccgtgcaagtgatcgtgcaggcccgcctaggcgagaagatctgcacacgcagttcatcaagtcccacaggcagcgattggtttaatctggcaatcaaggatattcccgaggttacccacgaggcaaaaaaggctctagctgggcaactcccagcggtggggcgatcaatgtgcgttgaaataagtttgaagacctctgagggcgacagtatggaactcgagatttggtgcctggaaatgaacgagaagtgcgacaaggaaatcaaagtctcatacactgtctataaccgattgagtctgcttctcaaatcactgttagcaattaccagggtgacgccagcctataggctttccaggaagcagggacacgaatatgtcatactctaccgtatttactttggagaggtgcagctcagcggtttaggcgaaggctttcagaccgtgagggtgggcaccgtgggcactccagtaggaaccattacactctcctgtgcttaccgcattaacttggccttcatgtcaactagacagtttgaacgtactccccccatcatgggtattattatcgatcacttcgttgaccgcccttaccctagtagcagccccatgcacccctgcaattatagaacggcgggcgaggacacaggcgttatttaccctagtgtggaggattcacaggaggtatgcacaacgagcttcagtactagtccgccctctcagctatcttcaagtagattgtcctatcaacctgctgccctcggtgtgggaagtgcagatctagcataccccgtagtgttcgcagccggactcaatgcaacccatccccaccagctgatggttcccggtaaggagggtggggttcccctcgctccaaaccagccagtacatggcactcaggccgaccaagagcggttggccacatgtaccccatctgatcgcacccactgcgctgcaacacctagtagtagcgaggatacagagactgtttccaactcgtcggagggcagagcctctccccacgacgttctggagacaatattcgtgaggaaagttggggcatttgtgaacaaacctatcaatcaagtgacattaacctcactagacatcccgtttgcaatgtttgctcccaagaatctggagctggaggacactgatcctatggttaatcctcccgactctccagagacggagtcgccgcttcagggctcattgcacagcgacggcagcagtggaggctcctcagggaatacgcacgacgacttcgttatgatcgattttaaacctgctttcagcaaagacgacatcctgcccatggacctaggaacattctaccgtgagttccaaaatccaccacagctttccagccttagtattgatataggcgctcaatcaatggccgaggatctagactcactgccagagaagctcgctgttcacgagaagaacgtccgcgaattcgatgccttcgtcgaaacgctgcagtag

SEQ ID NO: 16718 - DNA, 348 bp, Artificial Sequence
  Description of Artificial Sequence: Synthetic coding sequence
atgccacacctgccgctcgcctctttccggccaccgttctgggggctccgtcattccaggggactgccaagattccactccgttagcactcagtcagaaccacacggttcacccatctctagaaggaatagggaagcgaaacagaaaaggctgcgggaaaagcaggccaccctggaggccgagatcgccggggagtctaagtccccggccgagtctataaaggcctggcggccaaaggaactggtgctgtatgagatcccaaccaagccaggggagaagaaagacgtgtcaggtccacttcctcccgcctattccccaagatacgtcgaagcggcatggtacccttag

SEQ ID NO: 16719 - DNA, 1014 bp, Artificial Sequence
  Description of Artificial Sequence: Synthetic coding sequence
atggaattgaagaccctgtgggaaaacaaacttatgcagtccagggcagttgatggctttcactccgaagagcagcagctgctgcttcaggtgcagcagcagcaccagccccagcagcagcagcatcatcatcatcaccaccaccagcaagcccagcctcagcagaccgttccccagcaggctcagacgcaacaggtcctgatcccggctagtcagcaggcaaccgcccctcaggtgatcgtaccagactctaaactcattcaacacatgaacgctagcaacatgagtgcagccgcaacagcagccactctcgcgcttccggccggggttacgcccgtccagcaaatcctcacaaactccggtcagcttctgcaagtcgttcgggcagccaatggagcccaatacatcttccagcctcagcagtccgttgtgctccagcagcaagtcattcctcagatgcagccagggggcgtccaggcacctgttatccaacaggtgttagctccgttacccggaggtatttcaccccagaccggggtgataatccagcctcaacagattcttttcactggaaacaagacccaggtgattccgaccaccgtcgcagccccaacccccgcccaggcacagatcacagcgacaggccaacagcaaccacaggcacagcccgctcaaacccaggcccctctggtccttcaggtcgatgggacgggagacaccagctccgaggaggacgaagacgaggaagaggactatgatgatgacgaggaggaagacaaggagaaagacggggcagaggatggccaggtagaggaagaacccctgaacagcgaggatgacgtttctgatgaagagggacaggaattgtttgatactgaaaacgtcgtcgtctgtcaatacgacaaaatccaccggtccaaaaacaaatggaaattccatctgaaggacgggataatgaatctgaatgggcgcgattacattttcagcaaggcaatcggcgatgccgaatggtag

SEQ ID NO: 16720 - DNA, 3012 bp, Artificial Sequence
  Description of Artificial Sequence: Synthetic coding sequence
atgtctcagtggacgcctgagtacaatgagttgtatacccttaaggttgacatgaaaagcgaaatcccatcggacgctccaaagacccaggagagcttgaagggaattcttcttcaccccgagcctataggcgctgcaaagagcttcccagctggtgtggaaatgatcaatagcaaagtgggtaatgagttcagtcacctctgtgacgattcgcagaaacaggagaaagaaatgaacggaaaccagcaggagcaagagaagtccctggtcgtgaggaagaagaggaagagccaacaggctggcccctcttatgtgcagaattgcgttaaagagaaccaagggattctgggactgagacaacacttagggacaccttctgacgaagataacgactcgtctttctctgactgtctgagtagccccagctctagcctgcatttcggggattctgataccgtaacctcagacgaggacaaggaagtgtcagtaaggcactctcagacaatccttaacgcaaagtcacgatcgcacagtgccagatctcataaatggcccagaacagagactgaaagcgtgtctggactcttaatgaagcgcccatgcttgcacgggtccagcctgagacgattgccttgccggaaaaggtttgtgaaaaataattcttcacagcggactcagaagcagaaggaaagaattctgatgcagagaaaaaaacgtgaggtactagccagacgcaaatacgccctgctcccctcgtcatcttctagttccgaaaatgatctcagcagtgaatcatcctcatccagcagcaccgaaggcgaagaggacctgtttgtatcagcttctgaaaatcatcagaacaatcccgccgtcccttccggttcaatagatgaagacgtggtagtgatcgaagcaagttccaccccacaagtgacagctaatgaggagattaatgtgacatcaacagactccgaggtcgagatcgttacagtgggtgaatcctaccgcagccggagcaccttggggcattcgaggtcacactggagccaggggagttcctctcacgcctcacgcccacaggaacctcgcaatcggagccggatcagcacagtaatccagcctttgcgtcagaatgccgctgaggtcgtcgacctgacagtcgacgaagacgagccgaccgtcgtcccgactaccagcgcacgcatggaaagtcaagccacttctgcctctatcaataacagtaacccgagcaccagcgaacaggcaagtgacacggcttcggccgtgacgagtagccaacccagcacagtgagcgaaacctccgccactctgacatccaacagtaccactggaaccagcatcggcgatgattcccgacgcaccacttcatccgccgttaccgaaaccggccctcccgcgatgcccaggttaccaagctgttgtccacaacatagcccttgcggcggttcctctcagaatcaccacgctctcggccatcctcatactagttgcttccagcagcacggacatcattttcaacatcaccaccatcaccatcataccccccatcctgctgtccctgtttcaccttccttctctgaccctgcctgtcctgtcgagcgacctcctcaggtccaggccccttgcggcgccaacagcagctcggggacctcatatcatgagcagcaggcgctgcctgtggatctatcaaattcaggcatccgtagtcacggcagtggctccttccacggagcctctgcattcgacccatgctgtcccgtgagttcaagtcgggccgcaatctttgggcatcaggccgccgctgctgcaccatcccaacctttgagctcaattgatggctacggttcctcgatggtggcacagccgcaaccacaaccaccccctcagccaagtctgtcctcatgtcgccactatatgccacctccctacgcttccctcaccagacccctgcaccaccaggcttctgcttgtccccattcccacgggaaccctcctccccagacacagccgccgccgcaggtggactacgtgatcccacaccctgtgcacgcatttcatagccagatctccagccacgccacgagtcatcccgttgctcctcctccacccacacatctggcctcaacagccgcgcccatccctcaacatctgccaccaacgcaccagcccatttcccatcacatccccgccaccgcccccccggctcagaggcttcatcctcatgaggtcatgcagcggatggaagtgcagaggcgcagaatgatgcagcatcccaccggcctctttgtcttctgtgttagcagacgtgctcatgaacgacccccaccgcatccccaccggatgcaccctaactacggccacggccaccacatacatgtacctcagactatgtcctcacaccccaggcaggcacctgaacgttcggcatgggagctgggcatcgaggcgggtgtaactgctgcaacctacacacctggtgctctccacccccatctggctcactaccatgcccctccccgactccatcatctccagctgggagccttgccactgatggttcccgatatggctggctacccgcacattcgctatatctctagtggcctggatggtacttccttccgaggcccattcagaggaaatttcgaggaactgatccacctggaagagaggcttgggaatgtcaatcgtggagcgtcacagggcacgatcgaacgttgtacgtaccctcacaagtataagaaagttaccacagattggtttagccagagaaaactgcactgcaaacaggacggcgaagagggaacggaggaggacactgaggaaaagtgtacaatttgcctgagcattttggaagaaggggaggatgtgcgcagattgccgtgcatgcacttgttccatcaggtgtgcgtggaccagtggctgatcactaacaagaaatgccccatatgtagagttgacatcgaggcacagctgccctcagagtcatag

SEQ ID NO: 16721 - DNA, 3309 bp, Artificial Sequence
  Description of Artificial Sequence: Synthetic coding sequence
atggcagagaaagaagccaggaggaaattcaaacagattgtcacagcggtgtacttttgccactgtcgcaacatcgtccaccgggacctgaaggcagagaaccttctgctagacgccaaccttaatatcaagatcgcagattttggtttttccaatctattcacccccgggcagctgctgaagacatggtgcggctcccccccttacgcggcccctgagttgttcgagggcaaggagtacgacggaccaaaggtggacatttggagcctgggagttgtgctatacgtgttggtgtgcggtgccctcccatttgatggatctaccttgcagaatctgagagcgcgtgtcctatcgggcaagtttaggatacccttttttatgagtaccgaatgtgagcacctcatccgacatatgctggtgctagatccaaataagcgcctgagcatggagcaaatctgtaagcacaagtggatgaaattgggagacgctgatcctaatttcgacaggctgatcgccgagtgtcaacaattgaaggaggagcgtcaggtcgacccactaaacgaggacgtgctgctggcgatggaggatatgggcctcgataaagagcagactcttcagtccttaagaagtgacgcatacgatcactattctgcgatctatagtctgctatgcgacagacacaagcgtcataagactctgagattgggagcgctgccaagcatgccacgggctctcgcattccaggcgccggtgaacatccaggccgaacaggcggggactgccatgaatatcagtgtgccccaagtacagctgatcaatccagagaatcagatcgtggagccggacggcacattgaaccttgatagcgatgaaggggaggaaccctccccagaagccctggtgaggtacctcagcatgcgtcggcatactgtgggggttgccgatcccaggacagaggtgatggaagacctgcagaaactgctacccggcttcccaggcgtaaacccgcaggcgccctttctgcaggttgcaccgaacgtcaatttcatgcataatctgctacctatgcaaaatctgcagcctacaggacagctcgagtataaagagcagtccctcctgcagccacccactctgcagctcttaaatggcatgggtcctctggggaggcgggccagtgatgggggtgctaacatccagctgcacgcccagcagttgctcaagcgtccccgcggaccgtcccccctggttaccatgacccctgcggtacctgcagtgacacctgttgacgaggaatcatccgacggggagcccgatcaggaggcagtccagtctagcacttacaaggattcaaacaccctgcatctgcctacggagagatttagcccagtgagacgtttcagtgatggtgctgccagtatccaggccttcaaggctcatctcgagaagatggggaataattctagtatcaaacagctgcagcaggagtgcgaacaactccagaaaatgtacggaggtcaaattgacgagcggactctcgaaaagacccagcagcagcatatgctctaccaacaggagcaacaccaccagatcctgcagcagcagatccaggactccatctgtcccccacaacccagccctcctttacaggcggcttgcgagaatcagcccgctcttctcacacatcaactgcagagactcaggatacagcctagctcccctccgcctaatcaccccaataaccacctgtttagacagccgtctaattcaccaccccctatgagtagcgcaatgatccagccccacggcgccgcttcgtcatcccaattccaaggtctccccagccgcagcgctatttttcagcaacagccagaaaactgttcctcacctccaaatgtcgccctcacctgtctgggtatgcagcagccagctcagagtcaacaggtcactattcaggtgcaagaacctgtggacatgcttagcaatatgccaggaaccgctgccgggtcttctggcagagggatttccataagtcccagcgcgggtcagatgcagatgcagcaccggaccaacctgatggctacgctgtcgtacggacatcgtcctctgagcaagcagctgtcagccgatagtgccgaagcccattcagctcaccaacaacctcctcactacaccaccagcgctctgcagcaggcccttctctccccaacaccccctgactatacccggcaccagcaggttccccatatacttcagggcctgctttctcccaggcactccctgaccggccattctgacatcaggctgccaccaaccgaattcgcgcagctgattaaacggcaacagcagcagcggcagcagcagcagcagcagcagcagcaacaggaatatcaggagctgtttcgccacatgaatcaaggagatgctggaagcctcgctccttcactgggggggcagtccatgacagagagacaggccctctcttatcagaatgcagattcttaccatcatcacactagtcctcagcatttgctccagatccgggcccaggagtgcgtgagtcaggcctcctcacccacaccccctcatggatatgcccatcaacccgccttgatgcacagcgaatctatggaagaggactgcagctgcgagggcgcgaaagacggctttcaagactccaagtcatccagcacactcacgaaggggtgtcacgacagcccactcttgctgtcaacggggggcccgggcgacccagaatccttgttagggacagtatcccatgcacaagagctggggattcatccttacgggcaccagcctacagccgcattctccaaaaacaaagtgccctcccgggagcctgtgatcgggaattgcatggatcgcagttctccaggccaggccgtggagctgcccgaccacaacgggctcggttaccccgccagacccagcgtgcacgagcatcatcggcctcgagcactgcaacgccatcataccattcagaattccgacgacgcctacgtgcagctcgataatctgcccggaatgtccctggtggcaggtaaggctctatcctctgccagaatgagcgacgccgtcttgagccagagctccctgatgggttcacagcaattccaggacggtgagaacgaagaatgtggagcgagccttggagggcatgagcaccctgacttaagcgatggttctcaacacctcaactcctcctgttacccaagtacttgtatcacagacatactgctttcctataagcacccagaggtctccttcagcatggaacaggcgggagtgtag

SEQ ID NO: 16722 - DNA, 1461 bp, Artificial Sequence
  Description of Artificial Sequence: Synthetic coding sequence
atgacactgatggtgctgacgtttagtagctatattttggactttattaacgtccttagttacgatttgcacgggagttgggaacgcttcactggccataactcgcccctcttttcattgcccgaagatcccaaaagctccgcttacgccatgaattattggaggaagttgggggctccatccgagaaactcattatgggaataccaacttacggtcggacctttagactgttaaaagcatccaagaatggattacaggcaagggccatagggcctgcttcaccaggaaaatacaccaagcaggaagggtttctcgcctactttgagatatgctcctttgtctggggagccaagaagcattggatcgactatcaatacgttccctacgctaataaaggcaaagagtgggtggggtacgataacgccatctctttcagctacaaggcatggtttattcgacgcgagcacttcggcggagctatggtgtggacattggacatggacgatgttcgtggcactttttgcggcacaggtcccttccctctcgtctatgtcctgaatgatatcctggtgagggcggagtttagtagcacctccttgcctcaattttggttgtcctctgccgttaactccagttctacggacccggaaaggctcgctgtcacaacggcctggacaacggattcaaagatcttgcctcctggcggcgaagctggcgtcaccgaaattcacgggaagtgtgaaaacatgacaatcaccccacgggggacgacagtgacgcctactaaggagaccgtgtcactcggcaagcacacggtagctctcggagaaaagactgagattacaggagcgatgactatgacctcagtcgggcatcagtccatgacgccgggagaaaaagcactgactccagttggacaccagtccgtgaccactggtcagaaaacccttacctcagtcggctaccagtccgtgacccccggcgagaagacccttactccggtagggcaccaaagcgtgactcccgtgtcccaccagagtgtgtctcctgggggcaccactatgactcccgtgcacttccaaacggagaccctcagacagaatactgtagccccacgccggaaggccgttgctcgggagaaggtcactgtcccaagccgtaacatctcagttacaccggaaggccaaaccatgccactgcgcggtgaaaacctgactagcgaggtcgggactcaccctcggatgggaaatctgggactgcagatggaggcggagaaccgcatgatgctcagcagttcccctgttatccagttaccagagcagactcccctggcatttgataaccgctttgtcccaatttacggaaaccattcttcggtgaatagcgtaacaccccagacctcgccactgtctctgaaaaaagaaattccagaaaacagtgctgtggacgaagaggcctag

SEQ ID NO: 16723 - DNA, 1017 bp, Artificial Sequence
  Description of Artificial Sequence: Synthetic coding sequence
atggagctctggggtaggatgctgtgggcattactgagcgggcccggtcgccggggctctaccagggggtgggcattctcttcgtggcagcctcagcctccactggcggggctgagttcagccatcgagctggtttcacattggacgggcgtatttgagaagcgagggatccctgaagcacgggaatcttctgagtacattgtcgcgcacgtgcttggcgcaaagaccttccagtctctcaggccagctttgtggacacagcctctgacttcacagcaactgcaatgtatccgcgaactgtcatcaagacggctgcagcgcatgccagttcagtacatcctgggcgaatgggatttccagggtctcagccttagaatggtaccaccggtgtttatcccaaggcctgaaaccgaagaattagttgagtgggtgcttgaggaagtagcacaacgtagccatgcggtcgggagccctggttctcccctgatcctcgaggtcggctgtggttcaggcgcaataagtctgtcactgctgtctcagctgccacagtcaagggtgattgccgtcgataagcgcgaagcagctatctcactgacccatgagaacgcccagcgattgcgactgcaggaccgaatctggatcatacatttggatatgacctccgagcggagctggacgcacttgccatgggggcccatggacctgatcgtgagcaaccccccatatgtgtttcatcaagacatggaacaactggcgcctgaaattcgttcatatgaagaccccgccgctcttgacggaggggaagagggcatggacattatcactcacatcttggcactcgccccccgcttgctgaaagactccgggtcaatctttcttgaggtggatccgaggcatcccgagctggtatcaagctggctccagtcccgccctgacttgtatcttaatctcgtggcagtgagacgggacttctgcgggcgccccagattcttacatattcgcagatccggcccatag

SEQ ID NO: 16724 - DNA, 1899 bp, Artificial Sequence
  Description of Artificial Sequence: Synthetic coding sequence
atggacaccatgatgctcaacgttaggaatctttttgaacagctggtcaggcgcgtggaaattctctcagaggggaatgaagtgcagtttatccagcttgccaaggacttcgaggatttcaggaaaaaatggcagaggaccgaccacgaactcggaaagtataaagacttgctgatgaaggctgaaaccgaacgctctgccctcgacgtgaaactcaaacacgcgagaaaccaggtggacgtcgaaataaaaaggcgacagagggcagaagccgactgcgagaagttggagaggcagatccaactcatcagggagatgctgatgtgcgatacttcaggctccatccagttgtccgaggaacagaagagcgcactggccttcctgaataggggacaaccctcatcgagcaatgccggcaataagcggctgtctaccatcgatgagtccggatccatcctcagcgacatcagctttgataagacagacgagagcctagactgggatagttcactggtgaagacgtttaaactcaaaaagagggaaaaacgccgctctactagccggcagtttgtggacggtccgccaggtcccgtcaaaaagacacgtagcatcggcagcgcagtcgatcagggcaacgagtccatcgtggcgaagacgaccgtgactgtcccaaacgacggaggcccaatcgaagcagtctctactatcgaaaccgttccctattggaccagatctcgccgcaagacaggcacactccagccgtggaatagcgactccacccttaactcccgccaacttgaaccgagaacggagacagactccgtgggaacaccccagagtaatggtggtatgcgcttacacgacttcgtgtctaagacggtgatcaaacctgagtcttgcgtcccatgtggaaaacggattaagtttggtaagctgtcactcaaatgtcgcgattgcagagtcgtgagtcatccagagtgtcgggaccgctgcccgctgccttgtatcccaaccctaattggaactccagtgaaaatcggcgagggcatgctggctgactttgtgagtcaaacctcccctatgatcccaagtattgtggtgcactgcgtcaatgaaatcgaacagagaggtctgactgaaaccggtctgtaccgaattagcggatgcgatcgcactgttaaagagctgaaagagaagttcctccgcgtgaaaactgtgcccctgttgtccaaagtcgacgatatccatgctatctgctctctgctcaaagatttcctgcggaatctcaaagaacctcttttgactttccgccttaaccgcgcatttatggaggccgccgagatcacagatgaagacaattctattgctgccatgtaccaggctgtaggtgagcttccccaggccaatcgggacacgcttgcttttctaatgatccacttgcagcgcgtggcccagtcaccccacactaaaatggatgtggctaatctcgccaaagtcttcgggccaacaattgtagcccatgctgtccctaaccctgaccccgtcaccatgctacaagacatcaagaggcagccaaaagttgtcgagcgtctgttgtctctgccactagagtactggagccaattcatgatggtcgaacaggagaatatagacccactgcacgtgatcgagaatagtaacgctttcagcacgccacaaacgcccgatatcaaggtgtctctgctggggccagttacaacccctgagcaccagctccttaagacacccagttcatcatcattgagccagcgcgtacggagtacattaaccaagaatacaccgcgcttcgggtctaaatctaagtctgcaacaaacctgggccgccaaggtaatttttttgcatcccctatgctcaagtag

SEQ ID NO: 16725 - DNA, 1791 bp, Artificial Sequence
  Description of Artificial Sequence: Synthetic coding sequence
atgtcaaaccagcaggaaaagtacgaggcccagaatatcgtcaattctactgaagaaagcgacgacgcattcgatacagtgaccattccagttcccagcgaagaaccgcaagagagcgaccagactgaagagcatgaaagtggcatcgagcagttcagcgaaagccatgcaatacacgtcgaggagcagtcagatcagtcattttcaagtctcgagcctgacaacgagcagctcatggaagaggtgatcagcccacgacaggtaagttatacaccacaacaccatgagaagcagtacgcaatgcagcgccccaatgatgattcactggcctttcttgacaaaattaagagcgtcaaagagagcctgcaggagtccgtggaggattcgctggcgactgtaaaagttgtactcatccctgtgggccaggagattgtgatccccttcaaggtggatactatcctgaaataccttaaggaccattttagccatctgcttggcatcccccatagcgtgttgcagatacggtatagcggcaaaatcctgaagaacaatgaaactcttgtgcagcacggggtgaagccccaggaaatagtgcaagttgagatttttagcaccaaccctgatctataccccgtgaggaggattgatggactgacagacgtctcacaaatcatcactgtgacagtgcagacagggttagatcagtatcaacaggtgcctgtagaaatcgttaagtccgacttccataaaccctttctgggcggcttccggcacaaggtgacaggggtcgagtaccacaatgcagggacccagacagttcctaagcgcatcccagagagactatcaattttttgccgggacacccagacagtgtttcaaaaaaagaacctgcagcagacaactaacacaacgagtacacagatgaccaatattggcgtatacgtaagtaacatgacagataagctcgttacgccggggaaatattttagcgcagccgaatatcatgcccaaaggcttaaagccgttattgtgatacagacttattatcggcagtggcatgccaagatatttgtcgagaatctcagacgccagaagtcattgcgattagagtgggagacccaacaggagctgcggaagattcgcgaaaaggaagaatggattaaactggactatcacagacggcacaacccaaaaacaaacgaagactttgaatttctctacaatgccctcgagttctggaggcaggaggagctcacccggattaaccagtcattcaccggcgccgaaagaaaggcggctctttgcgaactcttggaaaaagaaacccagatcattgcctcaatagggcgccaccgatatattgcctatatggccaatcaggaggccgcaatccaggcgttcctggacaagtgtagcgctcccaagatctggcgaacccctaacggtaagacaatagaaatggatacgcagttcactatacgggcgagggaactgcagaatatttataagtgtattatgttgaagaacatctctcaggatgagcgcttggacgtgctcctgacccttaagcatacagtgaaagagcatgagtgcaaactcacgcaggaaatactagaacttattgaccgggaggtcgacctgatgatgagaggagtgaagcaccacaatctcgagggcctgcgtaaacgtattgcgacactgttttttcactacatcaagaccccattgtttaaccctgaggtagcaaagtacttaaagatgggcggggagtacctgagcatggccctatag

SEQ ID NO: 16726 - DNA, 1305 bp, Artificial Sequence
  Description of Artificial Sequence: Synthetic coding sequence
atggtgcaagatggcacatttaagaccagggactccacatggacttgtgagagcactagaatggccgcagctcccccaagctactgcttcgtggcttttccacccagggctaaagacggactggtcgtgttcggaaagaactccgcccgtccgcgcgatgaggtccaagaggtggtgtatttcagtgcagccgaccacgaacccgaaagtaaagtagaatgtacttatatctcgatcgatcaggtcccgcggacctacgccattatgatcagtcggccagcgtggttatggggcgctgaaatgggggctaacgagcatggcgtctgcattgctaacgaagccatcaacacacgggagccagcagctgaaattgaagccctgttgggtatggaccttgttcgcttggggttggagcgaggcgagactgcaaaggaggcccttgacgtgatcgtgagccttctggaagaacacgggcagggtggaaattacttcgaggatgcgaactcgtgtcactcctttcaaagcgcctatcttatagtcgaccgcgatgaagcctgggtactggaaacaataggcaagtactgggccgccgagaaagttaccgaaggagtgcgctgcatttgttctcagctgtccctcaccaccaagatggacgctgaacatcctgagcttaggtcttacgcccagtcccagggttggtggactggggagggggaattcaacttcagcgaggtcttctcgcctgtggaggaccatcttgactgcggagccggaaaagactcccttgagaaacaggaagagtcaattacggtgcagacgatgatgaacaccctcagagataaagccagcggagtgtgtatcgactccgagtttttcctgacgaccgcatccggcgtcagcgtgctcccccagaatcggagctccccttgtattcattactttacgggaactcccgatccaagcaggtctatttttaagccattcatcttcgttgacgacgtgaaacttgttccgaagacccagtctccatgtttcggggatgacgacccagcaaaaaaggaacccagattccaggaaaagcctgaccggcggcacgagctgtacaaggcacatgaatgggctagggccatcatcgagtctgaccaggaacaggggcggaagcttcgaagcactatgctcgagctggaaaagcaaggactggaggctatggaagagatactgacgtcctccgagccccttgacccggcagaggtaggcgacctattctacgactgtgtcgatactgaaattaaattttttaaatag

SEQ ID NO: 16727 - DNA, 1320 bp, Artificial Sequence
  Description of Artificial Sequence: Synthetic coding sequence
atggcttggccctgcattacgagagcctgctgtattgcccggttttggaaccagcttgacaaagctgatatcgccgtcccgctggtgttcactaagtactcagaagccactgagcaccccggcgcacctccacaaccacctccccctcagcagcaggcccagccagctttggcgcccccaagcgcaagggctgtggcaatcgaaactcagcccgcgcagggggaactagatgctgttgctagagcaaccggacccgcccctggaccaacgggggaacgggaaccagccgctggacctgggaggagcggacccgggcctggactgggatctggcagcacatccgggcctgccgatagtgtgatgagacaggattatcgggcttggaaggtgcagcgacccgagccctcatgtagaccacgctcagagtatcagccaagcgacgcgccatttgagcgtgagactcaataccaaaaagattttcgggcctggccgctgcccagacggggggaccacccctggataccaaagcccgtgcaaatctccgctgcctctcaagcaagcgctcctatcctgggtgcccctaaacgcaggcctcagtctcaggagcgctggccggtgcaggccgccgctgaggccagggaacaggaagctgctcctggcggcgcaggcggcctggctgccgggaaggcctcaggggctgacgagagggatacaaggcgcaaagctgggccagcctggatagtccggagagccgagggcctcggccacgaacagacacccttacctgcggcgcaggctcaagtgcaggccacgggcccagaggccggaagagggagagcggccgccgatgcgctaaatagacaaattcgagaggaagtcgcttccgctgtgagcagtagttatagaaatgaattccgagcctggactgatattaaacccgtgaagcctataaaggccaaaccacagtataaaccacccgatgataaaatggtacacgagacatcctactcggcccaatttaagggcgaggctagcaagcccacgacagcagacaacaaggtgattgacagacggcgcattcgttctctgtactccgaacccttcaaggagccgcccaaggtcgagaagccatcagtgcaatcatcgaagcccaagaaaaccagcgcttcccataagcccactcgcaaagctaaggacaaacaggccgtaagtggacaggctgccaaaaagaaatcggcagagggtccatctaccaccaaacctgacgacaaagagcaaagcaaggagatgaataacaaactggccgaggcgaaagaatag

SEQ ID NO: 16728 - DNA, 813 bp, Artificial Sequence
  Description of Artificial Sequence: Synthetic coding sequence
atgggaggttgtttctcgaagcctaagcccgtcgagctaaaaatcgaagtggtcttgcccgaaaaggagcgcgggaaagaagaactgagcgcaagcggaaagggatcccctcgcgcttaccaaggcaacggaaccgcaagacacttccatacagaggaacgtctgtccacccctcatccttatccctctccccaagactgcgtcgaggcggctgtgtgccacgtcaaggatctcgagaatgggcagatgcgggaggtcgagctcgggtgggggaaagtattactcgtgaaagacaacggagaattccatgcactgggccataagtgtccccattatggcgctcccttggttaagggagtgctatcccggggcagggtacgctgtccatggcacggggcatgcttcaatattagtactggagatctcgaagacttccccggcttagattctttacacaaatttcaggtgaaaatagagaaagagaaagtttacgttcgggccagcaaacaggcactgcagctccagcgacgaactaaagtgatggctaaatgtattagcccatccgctggctacagctcatctaccaacgtgctgatcgtcggagccggtgccgccggcttggtgtgtgccgagacactgcgccaggaggggtttagtgaccggatcgtgctgtgtactctggatcgccatctgccctacgacagacctaagttgagcaagtcactggatacacagcctgaacagcttgcactacggcccaaagagttttttagagcatacggaatagaggtcctcacggaggctcaggtgtag

SEQ ID NO: 16729 - DNA, 369 bp, Artificial Sequence
  Description of Artificial Sequence: Synthetic coding sequence
atggctacctctgctccacttagaagcctggaggaagaagtaacatgttccatttgtctagactatctacgagatcccgtgactatcgactgtggccatgtcttttgcaggtcctgcaccaccgacgtgaggcctatcagtgggagtcggccagtgtgccccctctgtaagaaaccatttaagaaagaaaatatccggccagtgtggcagttagcgtcgctcgttgaaaatatagagcggttgaaagtggacaagggaaggcagcctggcgaagtcacacgggagcaacaggatgctaagctgtgtgagcggcatcgagaaaagctccactattattgcgaggacgatgggaagttgctgtgcgtgtag

SEQ ID NO: 16730 - DNA, 1269 bp, Artificial Sequence
  Description of Artificial Sequence: Synthetic coding sequence
atgacgccaagtataccaagcatcagacgactggggtcgggttactttagtagtaacggaaagctggaggaagtaaaaacccctaagaaccccgttaagcgtaaggatttgctgaggcacgatcccgacttacacatgcatcaaggatatgataaatatgacgtatctgaattctgtagctatattaagtcttcgtcctcactgggaaatgccaccagtgatgaggatcctaacacgaacattatgaacatcaacgagaataaaaatattcctaaagccaagaataaatccgaatctgaaaacgaacctaaggccggcacggacagtccagtatcttgtgcatccgtcactgaggagcgtgtcgcgtctgacagccccaagcccgctctcaccctgcaacagggacaggagttcagtgcgggcggccagaatgctgaaaacctctgtcagttttttaagatttcacccgacttaaacatcaagtgcgaacggaaggatgactttctgggagctgctgagggaaagcttcaatgcaacaggttgatgcctaatagccagaaggactgccactgtctcggcgatgttttgattgaaaatacaaaggaatcaaaatcccagtctgaagacctgggaaggaagcctatggaatcctcctcggtagtttcctgcagggacaggaaagaccgacggaggtccatgtgctacagcgacgggagatccttgcacctagaaaaaaacgggaatcacactccttcaagttccgtgggatcttctgtagagattagtttggaaaattctgaactgttcaaagatctgtctgacgcaatcgaacaaacattccagcggaggaactcagaaaccaaggtcaggcgaagcacgcgtctgcagaaagatctggaaaacgaaggactcgtctggataagcctcccgctgccgagcaccagccagaaggcaaaacgcagaaccatctgtacgtttgacagcagcggatttgaaagcatgagcccaatcaaggaaaccgtgagtagccgacaaaaacctcagatggcacctcccgtcagtgaccctgagaattctcagggtcctgccgccggtagtagcgacgagccagggaaaagacgaaaatctttctgcatcagcaccctcgctaacacaaaagccacttcccaattcaaaggctaccgtagacggagtagtctcaacgggaagggagagagctccctgacggccctggagcgcatcgagcataatggggaacgaaagcagtag

SEQ ID NO: 16731 - DNA, 3336 bp, Artificial Sequence
  Description of Artificial Sequence: Synthetic coding sequence
atggtcagggaaaggaagtgcatactgtgtcatatcgtatattccagtaagaaggagatggacgaacacatgcgctctatgttacaccacagggagttggagaacctgaaaggtcggttcggcatagagatggttccactcgtacaaaacgaacaggaggctctggatctggacggagagccagacctgagttcacttgagggtttccagtgggaaggggtctccatttcttctagccccggactggccagaaagcggagcctgagtgaaagtagtgtcataatggatagggccccttccgtttacagtttcttcagcgaagagggcactggcaaggagaatgagcctcagcagatggtttcaccttcgaatagcctgagggcgggccagtctcaaaaagctaccatgcacctcaagcaagaagtcacaccgagagcagcatccctgcgaaccggcgaaagggctgagaacgtggcgacccaacggcggcatagcgctcaactttcttccgatcatatcatccctcttatgcatctagcgaaggacttgaactcccaagaaagatccattccaccctcggaaaatcagaactcacaggagagcaacggtgaagggaactgcctgagctccagcgcctcgtcagctctggcgatcagcagcctggcggatgcagctacggactcctcctgcacaagcggcgccgaacaaaacgacggacagagcattcggaagaagaggcgggccaccggtgatggctcgagccccgaactgccctccttggaacggaaaaataagcgccgcaaaattaagggcaagaaggaacgttctcaggtggatcagctcctcaacatctcactgagagaagaagaactgtccaaaagtttgcagtgcatggataacaatctactgcaggcccgtgcagccctgcaaactgcatacgtcgaggtccagcggcttctgatgctgaagcagcagatcaccatggagatgtccgccttgcgaacacatcgtattcagatcctgcaaggactacaagagacgtacgagccttccgaacacccagatcaagtgccctgttctttgacaagagaaaggcggaattctcggagtcagacttcaattgacgcagccctcttaccaacacctttctttccgctgttcctggagccgcccagcagccatgtcagcccttctcccacaggggctagcttgcagataacaacctcacccacttttcagacacacggtagcgtgccagccccagattccagtgtgcagatcaagcaggagcccatgagcccggagcaagatgaaaacgtgaacgcagttcctccttcctcagcctgtaatgtgtcgaaagagctgctagaggcaaatagggagatctcagactcttgtccagtatatcccgtgatcaccgcccgtctctcgctgcctgaaagtacggagagtttccacgagccatcacaggaactgaaattctcagtggagcagcggaacactcgcaatcgtgaaaactctccgagctctcagtcagccggtctctcatctataaacaaggagggggaagaacccaccaaaggcaactcagggagcgaggcttgcacatcttcatttctaaggctgtctttcgcctccgaaactccactggagaaggaaccacattctcccgcagaccaacccgaacagcaggctgagagtacactcacctccgccgaaacaaggggcagcaagaagaagaaaaagctgaggaaaaagaaatctcttcgcgccgctcatgtccctgaaaatagcgacacggagcaggatgtcctgactgtgaagccagtgcggaaagtgaaagcgggaaaactgataaagggcggtaaggtcacaactagcacatgggaagactccaggacaggccgcgagcaggagtccgtgcgagacgaaccagatagcgattcctctctcgaagtgttggagatccctaatccccagctcgaggtcgtggcaattgacagctccgaatccggagaggagaagcccgactccccaagtaagaaggacatttggaactcaaccgaacagaatcccttagagacaagtaggtccggatgtgatgaggtctccagtaccagtgaaatcggtactagatataaggacggcatccctgtgagcgttgcagagacacagaccgtgatatcctcgattaagggatccaaaaacagttctgaaataagcagcgagcccggggatgatgacgaaccaacagagggctcctttgagggacaccaggccgcagttaacgcaatccaaatctttggcaatctgctgtatacatgcagtgctgataagaccgttagagtctacaatctggtcagccgtaagtgtattggagtgtttgaaggccacaccagcaaagtgaattgcctccttgttacccagacctctgggaagaacgcggccctgtacacaggttctagcgaccacacgattcgttgttataatgtgaaatcacgggaatgtgtcgaacagctgcagctcgaggacagggtgctgtgtctgcattcacggtggcgcatcttatatgcggggctcgctaatggaaccgttgtgacatttaacatcaagaacaacaagcgccttgaaattttcgagtgccatggccctcgggctgtctcctgcctggcgaccgctcaggaaggcgcccggaagctccttgtcgtgggatcttacgattgcaccatctctgtcagggatgcccgcaatggactcttactgaggactctggaggggcactctaagactatcttatgcatgaaggtggtcaacgatttggtctttagcggttcgtccgatcagtctgtgcacgcccacaacattcacaccggggagcttgtacgaatatataaagggcacaaccacgctgtcacagtcgtgaacatcctggggaaggtgatggttaccgcctgcctagacaaatttgtgcgggtgtatgagctgcagtcacatgaccgactccaggtgtatggaggtcataaggatatgattatgtgtatgaccatacacaagtccatgatctacacaggatgctacgatggcagcatccaggccgtacggctgaacctcatgcaaaattacagatgttggtggcacggctgttccctaatatttggcgtagttgatcacctgaaacagcatctgctcacagaccacacaaatccaaactttcaaaccttgaagtgccgctggaagaactgtgatgcttttttcactgcaagaaaaggcagtaaacaggatgcagcggggcacattgagcgtcatgccgaagacgacagcaaaatcgattcctag

SEQ ID NO: 16732 - DNA, 354 bp, Artificial Sequence
  Description of Artificial Sequence: Synthetic coding sequence
atgtattccccgattatctaccaggccctctgcgaacatgtgcagacccagatgtctttgatgaatgacttaacttctaaaaatattcctaatggaattccagcagtgccatgccatgctccgtctcattccgaatcccaggcgacaccgcatagcagctacggcttgtgcactagcacaccggtctggtccttgcaacgccctccctgtcccccaaaggtccactccgaggttcaaacagatggtaactcacagtttgcatcccaggggaagaccgtcagcgccacttgtactgacgttttgcggaactccttcaacacttcccccggggtgccctgcagccttccaaaatag

SEQ ID NO: 16733 - DNA, 189 bp, Artificial Sequence
  Description of Artificial Sequence: Synthetic coding sequence
atggcagcgctgaggcccttagtcaaaccaaagatcgtcaagaaaaggacgaagaagttcattaggcaccaatctgaccggtacgtcaaaattaaacggaactggcggaagccaaggggtatcgacaaccgcgtacgacggcggtttaaggggcagatcctgatgcctaatattggatatggttcttag

SEQ ID NO: 16734 - DNA, 411 bp, Artificial Sequence
  Description of Artificial Sequence: Synthetic coding sequence
atgagcgcatcatgtgacggctgcgtcgggagcagaccccctgtccacctcgccagcggatattcactcgccgatctattagtactagagatggggatgggtacacagtgctggaccgaagatcagagacggtggtccagcttgtggccttggtcccatttatcgagcgtgctgctggccgacaaggagggcggtccccccgccgtggacgaagttcttgatgaagctgtaccagaatacagagcgccaggtcggaagtctctgctggagatcaggcaattagaccccgacgaccgctccctggccaagtataagagagtacttcttggccctctgcctccagcagtcgatccaagcctgcccaatgtgcaagtgacgcggttaaccctgctgtctgaacaggccccctag

SEQ ID NO: 16735 - DNA, 1803 bp, Artificial Sequence
  Description of Artificial Sequence: Synthetic coding sequence
atgcccgagattcgagtcacccccctcggggccggacaggacgtgggtagatcctgtattttggtgagtatagcaggaaagaacgtcatgcttgactgcggtatgcacatgggattcaacgacgataggcgctttcccgacttcagctacattactcagaatgggcgattaaccgattttctggattgcgtcatcatttcccactttcacctcgatcattgcggcgcactgccttatttttcagagatggtgggctatgacggccctatctacatgacacaccccacacaggccatctgccccattttgttagaagattatcgaaaaatcgccgtagacaagaaaggagaagccaatttcttcacctctcaaatgattaaagattgtatgaaaaaggtcgtagctgtgcatctgcaccaaaccgttcaggtggacgacgagctggagatcaaggcgtactatgcggggcacgtgctgggcgctgcaatgttccagatcaaggtgggttccgagtccgtcgtgtatactggagattataatatgaccccggacaggcacctcggagcagcttggatcgacaagtgccggcctaatctgctgattaccgaaagcacttacgccactactatccgggactccaagagatgtagggagcgcgattttcttaaaaaagttcatgaaaccgtagagcgtggaggtaaggtgctgatccccgtatttgctttgggacgggcacaggaactgtgcattcttctagagacgttctgggagcgaatgaacctgaaagtgcctatttatttcagcaccgggttgacggagaaggccaaccactactataagctatttataccttggactaatcagaagatcagaaagacatttgtacagcggaacatgtttgagtttaagcacatcaaagccttcgatcgggccttcgccgacaatcctggtcctatggtggtcttcgccacccctgggatgttgcatgcaggccagagcctgcaaatattcaggaaatgggcaggtaatgaaaagaatatggtgataatgccaggctattgtgtccaaggcaccgttggccacaagatccttagcggccagaggaaacttgaaatggagggtaggcaggtcctggaggttaaaatgcaggtcgagtatatgtcatttagcgcccacgctgatgcgaagggtatcatgcagctcgtgggccaggcagagccagagagcgtgttactcgtgcacggggaggcgaagaaaatggagttcctaaaacagaagatagaacaagagttgagggtcaattgttacatgccagccaacggcgagacagtgaccctgcctacctccccaagtatccccgtgggaattagcctgggactgctaaaaagagagatggcacaggggctgctgcctgaggctaaaaaacccaggctgctgcacggcaccctaataatgaaggatagtaattttcggctggtaagcagcgaacaggcgttgaaggagctaggactggcagagcaccagctcagattcacgtgtagagtgcacctccatgatactcggaaagaacaggagaccgcgcttcgagtttattctcatctgaaaagtgtcctcaaagatcactgcgtccagcatctccccgatggttccgtgaccgtggaatcagtcttactccaggccgccgcaccgtcggaggaccctggaactaaggtgctgcttgtgagctggacgtaccaagatgaggagttggggtccttcctcacgtcactcttgaagaaagggctaccccaggccccctcttag

SEQ ID NO: 16736 - DNA, 774 bp, Artificial Sequence
  Description of Artificial Sequence: Synthetic coding sequence
atgctggagtatgctctcaagcaggaacgggcaaagtatcacaaactgaagttcggaaccgatctgaatcagggcgaaaaaaaagcagatgtgtccgaacaagtatctaatgggcccgtcgaaagtgtgaccttggagaacagtccactggtctggaaggagggccgccaattactgcgacagtatctggaggaggtagggtatacagacacaattctcgacatgcggtctaagcgcgtcaggtcactgctgggacgttcactggaactgaatggtgccgtcgagccaagtgaaggcgcccccagggccccccccggccccgctgggctgagtggaggcgaatccctgctagtgaaacagatcgaggagcagataaagcgtaacgcagccgggaaggacggcaaagaacgcctcgggggatccgtactggggcagattccctttttacagaattgcgaagatgaggacagcgacgaggacgacgaactagattccgtgcagcacaagaaacaaagagtgaaattgccatcaaaagcacttgtgcctgaaatggaggatgaggatgaagaggacgactccgaggatgcgatcaacgaattcgatttcctgggtagcggcgaggacggtgaaggcgcacctgatccccgcaggtgcactgtagatggaagtcctcacgaattgggtcctgaactccatagcccaaccgagtggcagggagctctgagtgtgggcaaagcctcgccaatgcctgattgggtgggtacagctggctag

SEQ ID NO: 16737 - DNA, 381 bp, Artificial Sequence
  Description of Artificial Sequence: Synthetic coding sequence
atgcccggtgtgaaacttacaactcaagcttattgcaaaatggtcctgcacggggccaagtacccacactgtgccgtaaacggcttgttagtggctgaaaaacaaaagccacgaaaggaacacctccccctaggcggcccgggggctcaccatacactgttcgtggattgcattcccctgtttcatggaactttggctctggccccgatgctagaagtcgctctcaccctgattgattcatggtgtaaagaccattcttacgtcatagccggctattatcaggccaatgaacgcgtgaaggacgcatctcctaaccaggtggcagaaaaagtcgcttctcgcatcgctgaagggttttctgacaccgctttgattatgtag

SEQ ID NO: 16738 - DNA, 450 bp, Artificial Sequence
  Description of Artificial Sequence: Synthetic coding sequence
gtacgagagttggaggctgagctcgatgccgagcaaaaaaaacatgccgaggccttaaaaggagtcagaaagcacgaaagaagagtgaaggaattggcctatcaggttggtgatagggttagccttggctctggaccaggggcaggaccggcccaggcatccccagagagccctctccctgcgcaggccgaggaggatcggaaaaacttagcccgaatgcaggatctggtggataaacttcaatccaaggtaaaaagttataaacggcaattcgaagaggctgaacagcaggcgaacacaaatctcgccaaatacaggaaggcccagcatgaactggatgatgccgaggaacgggcggatatggcggagactcaggcaaataaactgagggcgcgcacaagagacgcgctcggcccaaagttgtcattatcaccacagcataaagagtag

SEQ ID NO: 16739 - DNA, 2349 bp, Artificial Sequence
  Description of Artificial Sequence: Synthetic coding sequence
atggatagttcaatccatttgtccagcctcatatcccgccacgacgacgaggcgactaggacctccacgtcagaggggctggaagagggagaggttgagggagagactctccttattgttgagtccgaagaccaggcatcagttgacctgagccacgaccagagtggcgactccctcaactcagacgagggcgatgtctcatggatggaagaacagctgtcctacttctgcgataaatgccagaagtggatccccgcttcccagctgagggaacagttgtcatacctcaaaggcgataacttcttcaggtttacgtgctcagactgctcagccgacggcaaggagcaatacgagcgcctgaagctgacatggcagcaggtggtgatgctggcgatgtataacctcagtctggagggaagcgggcgtcagggatactttcggtggaaagaggacatttgtgcattcattgaaaagcactggaccttcctgttaggcaaccgtaagaaaaccagcacatggtggagcactgttgccggttgcctttccgtcgggtctcctatgtatttccgctccggcgcacaggaatttggggaacctggatggtggaagctggtgcacaacaaacctcccaccatgaagccagagggtgagaaactaagtgcctccaccctgaaaatcaaggctgcctctaagcctacccttgaccccatcattactgtcgaaggactcaggaagcgcgcctcccggaatccagtggagagtgccatggagctcaaggaaaagagaagtagaacccaggaggccaaggacatacgccgggcacagaaggaggcggctggcttcctagatagaagcaccagttctactcccgttaaatttattagccgcggtaggcgcccagatgtgatccttgagaaaggtgaagttatcgacttcagctccttgagtagttctgaccgcacccctctcaccagtcctagcccatcaccttcgctggacttctctgcaccgggaacccccgcatcccacagcgcaactcccagtctgctgtctgaagcagatctcattcccgacgtgatgccccctcaggctttgttccatgatgacgatgaaatggaaggagatggagttattgatcccggcatggagtacgttcctcccccagccgggtcggtagcatccggaccggtagttggtgtgcgtaagaaggttcgagggccagagcagatcaaacaggaggtggagagcgaggaggagaagcctgatagaatggatattgattcagaggataccgattccaacaccagcctgcaaactcgtgcacgagagaagcggaaacctcagctggagaaagacactaaaccaaaggagccaagatacacacccgtgtctatttatgaggaaaaactgctcctgaagcgtcttgaagcctgccccggtgctgtggccatgacacctgaagctagacggttgaagcgtaaattgatagtccgacaagccaaaagagatcgggggttaccattgtttgacctggatcaggtcgttaatgctgccctgctgctggtggatggcatctacggtgcaaaggaaggcggtatctccagactgccggctggccaagctacataccgcaccacttgccaggattttcgaatcctcgatcgctatcagacatcattaccatccagaaaaggattccgccaccagacaacaaagtttctgtacaggctagtggggtccgaggatatggccgtggaccagagcatcgtgagtccatatacttcacgcatcctcaagccttatataaggcgcgactacgagaccaagccacccaaattacagcttctgtcacagattaggtcccaccttcatcgctcagacccccattggactcctgagcctgacgcaccactggattactgctatgttcggccaaaccatattccgaccattaattctatgtgtcaggagttcttttggccaggaattgatctctccgagtgtctgcagtaccctgacttttccgtagtcgtgctgtacaagaaggtcatcatcgcttttggctttatggtgcctgacgtgaagtataacgaggcctacatatctttcttgtttgtgcatcctgaatggcgacgcgcagggattgccacctttatgatttatcatctgatccagacatgcatgggaaaggatgtcaccctgcacgtctcagccagtaatcctgcaatgttgctttaccagaagtttggcttcaagaccgaagagtatgtgctcgacttttatgacaagtattatcctctggagagcactgaatgcaaacatgcttttttcttgcggctcaggcgatag

SEQ ID NO: 16740 - DNA, 495 bp, Artificial Sequence
  Description of Artificial Sequence: Synthetic coding sequence
atgatgtctgaggttgaggaggcaatgcaatgcgtggaggagttgaatgcccagggtttgctccacgtgtttgtgcgggtgggcgttgaatccactctggagaggtcccagattacccgggaccacatgggtcagctgctctatcaactggttcagtctgaaaaactgtcaaagcaggatttttttaaaggattctcagagactctggagctggcagatgacatggcaatcgacataccccatatttggctctacctggccgagttagttaccccaatgctcaaagaaggaggcatctcgatgagggagctcacaattgagtttagcaagccactgctacctgtcggcagagcaggagtgctgctgtcagaaatcttgcacctgctttgcaaacaaatgtcacacaagaaggtgggcgctctctggagggaggcagatttaagctggaaggattttctgcccgaaggtgaggacgtacacaacttccttctgtag

SEQ ID NO: 16741 - DNA, 369 bp, Artificial Sequence
  Description of Artificial Sequence: Synthetic coding sequence
atggctacatctgcaccactgaggagcctcgaggaagaagtgacttgtagcatttgcctagattatctacgcgatcctgtgacaatagactgtgggcacgttttttgtcgctcctgtaccaccgacgtgaggcctatcagtggttcccgcccagtttgccctttgtgtaagaaaccattcaagaaagagaacatcaggcccgtgtggcagctggcctcgctcgtcgagaatatcgagcgactgaaggtagataagggacggcagccaggtgaagtgacacgagagcagcaggacgctaagttgtgcgagagacacagggaaaagttacattattattgcgaagacgacggtaagcttctttgcgtctag

SEQ ID NO: 16742 - DNA, 3345 bp, Artificial Sequence
  Description of Artificial Sequence: Synthetic coding sequence
atggcctgtcggagacggtatttcgtcgaaggcgaagcgccttccagtgaaactggaacctctcttgattccccatcggcttaccctcaggggcccctggttccggggagctcactctctccggatcattatgaacacacaagcgtaggcgcatatgggctctatagcggacctccagggcagcaacaaagaacaaggaggccaaagctgcagcactccacgtctattctgcgaaaacaagctgaggaggaggctatcaaacgctcccggtcactgtccgaaagctacgagctcagcagtgacctccaggacaaacaggtcgagatgttggagagaaaatatggtggcagactggttacaaggcatgccgctcggacaattcaaacagccttcagacaatatcagatgaacaaaaacttcgagcggctccgcagctctatgagcgaaaaccggatgtcgcggcgcatcgtcttatcaaacatgagaatgcagtttagctttgaaggtccggagaaggtgcactctagctactttgaaggcaagcaggtgtctgttaccaatgatggttctcagctcggggctctggtcagcccagaatgcggtgacttgtcggagccaacgacactaaagtcccctgctccatcctccgacttcgccgatgccattacagagctggaagatgctttcagccgacaggttaagagcctcgcggagtcaattgacgatgcactcaattgtcgtagcctccacaccgaggaagcccctgctctggatgcagcacgggcccgggatacagaaccgcagaccgcattgcacggcatggaccaccggaaactcgatgagatgaccgccagctattccgacgtgactctgtacattgacgaggaggaattgagcccacccctaccattatcccaggcgggggacagaccttcaagtacggagagcgatctcagactccgggccggcggggcagccccggattactgggcgctcgctcataaggaggataaggccgacactgatacctcatgtaggtctaccccatctctggaaaggcaagaacagcggctgagggttgaacatctacctctgctcacgatcgaaccacccagcgatagctcagttgatttatccgacagatccgaacgcggatccctgaagcgtcagagcgcatacgagcggtcgctgggcggccagcaagggtccccgaagcacggaccacattctggcgccccaaagtctcttccgagagaggagcccgaacttcggccgaggccgcctcgccctctcgacagccatctcgcaatcaatggatccgcaaacagacagtctaaatcagagagtgactactccgacggagacaatgacagtatcaactccaccagtaacagcaatgataccattaattgtagttctgagagcagcagtcgagacagtcttagggagcaaacccttagcaaacagacttaccacaaagaggctaggaattcgtgggactcccctgcattctcaaacgacgtgatccgaaaacggcactaccgcattggcctgaatttatttaacaaaaagcccgagaaaggcgttcaatatctaattgagaggggcttcgtaccagacacaccagttggagtggcccatttcttactgcagaggaaaggccttagcagacagatgataggcgagtttctgggcaaccggcagaaacagttcaatcgggatgtgcttgactgcgtggtggatgaaatggatttcagtaccatggaactcgatgaggccttgcgcaagttccaagctcatattcgggtgcaaggagaggcccagaaagtcgagcgactgattgaagcctttagccaaaggtactgcatctgtaatccgggcgtggtgaggcaatttaggaacccagataccatttttatactggctttcgccattatcctactgaacactgatatgtactcacccaacgtgaagccagaacgcaagatgaagctagaggactttatcaagaacctcaggggcgtggacgatggagaggacattcccagggagatgctgatgggcatctatgagcggattcggaaaagagagctaaagacaaatgaggaccacgtgagtcaggttcagaaagtggaaaaattgatcgtgggcaaaaagcctataggctcgcttcatcccggattgggttgcgtgctctcactgcctcataggagactggtctgctactgcaggctgtttgaagtccccgatcctaacaaaccacagaagctggggctgcaccagagggagatttttctatttaatgacctgctggtcgtcactaaaatattccagaagaaaaaaaatagtgttacatatagctttaggcagagctttagcctttatggcatgcaggtgctgctgttcgaaaatcagtattatcctaacgggattcggttaacttcgtccgttcccggggcggacattaaagtgctgatcaatttcaatgcccctaatccacaagaccgaaaaaagttcactgatgacctccgcgaatccatcgccgaggtccaggagatggaaaaacataggatcgagtccgaactcgagaaacagaaaggggtggtcaggccctcaatgtcccagtgcagtagtttgaagaaagagtctgggaacggaactctctcgagggcctgtctcgacgatagttacgcctccggggagggcctgaaaagatcagccctatccagctctctacgagatctttccgaagccggaaaacgcggccgccggtcgagcgctggctcacttgagtctaatgtggaaggctcgattatcagtagcccccatatgaggcgtagggcgacttcaacccgcgaatgtccttctcgaccccatcagaccatgcccaatagctcgtcactcctagggtccctcttcggatccaagcgcggcaagcctcctccccaagcacacttacccagcgcccccgctcttccccccccacacccaccggtggtgctgccccacctgcagcacagcgtcgcagggcaccatctgggcccaccggaaggacttcctcaagctgcaatgcatggccaccacacccagtactgccatatgcagaaccctccgccttaccatcaccatcatcaccaccaccccccacagcatatccagcatgcacatcagtatcaccacggtccccatgggggccacccagcttatggagctcacgctcatggacatccccccttgccctctgcccatgtgggtcacaccgtgcatcaccacggccagcccccagccccaccacccccaactagctcaaaagccaaaccctcgggaattagtactatagtgtag

SEQ ID NO: 16743 - DNA, 903 bp, Artificial Sequence
  Description of Artificial Sequence: Synthetic coding sequence
atggccgaggaggtgtcaactttaatgaaagcaactgtgctgatgcgccagcctggaagggtacaagaaatagtcggagcgcttcgcaaggggggaggggatagactccaggtgatctctgacttcgacatgaccctcagtcggttcgcttacaacggcaaaaggtgtccctctagctacaacattctagacaactccaaaatcattagtgaagaatgtaggaaagaactgactgcattgctgcatcattactaccctatcgagattgatccacatcggaccgtaaaggagaaactaccccacatggtggaatggtggacaaaagcgcataacctgctgtgccagcagaagatacaaaaatttcagatagcccaggtggttagggagtcaaatgctatgttaagggaggggtataagacgttctttaacactctctaccacaacaacatccccttgttcatattctccgctggaattggcgacattctagaggagatcatacgacagatgaaggtttttcaccctaatatacacatcgtgtccaattacatggactttaacgaggatggattcctgcagggcttcaagggacaattaattcatacgtataacaagaacagctctgcatgcgaaaactccggatatttccagcagttagaaggaaagaccaatgtgattttactcggtgatagcatcggtgacctcacaatggcggacggagtccctggagtccagaatattctgaagatcggcttcctcaatgacaaggttgaggagcgccgtgaacgctatatggactcctatgatatcgtgctggaaaaggacgaaacactggatgtggtcaatggactactgcagcacattctctgtcaaggcgtacagctggagatgcagggaccttag

SEQ ID NO: 16744 - DNA, 834 bp, Artificial Sequence
  Description of Artificial Sequence: Synthetic coding sequence
atgttcccgggcgctacaaccccattgccaaaagcagccgcgtacccaggtgtatacggctcgaacggcagaacaccacaacctgcatacctcagcgaggcaatgaagcttacacagagtgaacaagcgcacctgtccctggaacttcaaagggactcccatatgaagcagctgctcctcatccaggagaggtggaagcgcgctcagcgggaagaacgcctcaaggcacagcagaataccgataaggatgctgcagctcatctgcagacatcacataaacctagtgccgaggacgctgaaggccagtcgcccctgtcccaaaagtacagccctagtactgaaaagtgtttgccagaaatccaaggtatctttgatagggacccagacactcttctctatctcctccaacagaagtctgagcccgccgaaccctgtatcgggtcgaaagcacccaaagacgataaaaccatcatcgaagagcaggccaccaaaatcgctgatttgaagcgccatgtcgaattcctggtcgctgaaaatgagcgtctgcgcaaggagaataagcagctgaaggctgagaaagctaggctgcttaagggaccaattgaaaaagagctggacgtggacgcagacttcgtggagacctcagagttatggtcccttcctcctcatgccgagaccgcgacagcgagttcgacatggcaaaaatttgcggctaatactggaaaggccaaagatatcccgataccaaacctgcctcctcttgactttccctctcccgagctaccgcttatggagctaagcgaagatatcctgaagggcttcatgaacaactag

SEQ ID NO: 16745 - DNA, 138 bp, Artificial Sequence
  Description of Artificial Sequence: Synthetic coding sequence
atgtcacctcagaagcgggttaagaatgttcaggcacaaaaccgaacatcccagggttccagcagctttcagaccacactcagtgcctggaaggtaaagcaggaccccagtaattctaaaaacatctcaaagcactag

SEQ ID NO: 16746 - DNA, 819 bp, Artificial Sequence
  Description of Artificial Sequence: Synthetic coding sequence
atgccaggggaccatcgcaggatcagggggccagaggagagccagccacctcagctgtatgcagcagacgaggaagaggcccccggcacaagagaccccaccaggctcagacccgtgtacgcgcgagccgggctgctgtcccaggctaagggcagcgcctacctcgaagccggaggtacgaaggttttgtgcgccgtaagcggtccaaggcaggcagaaggtggtgaaaggggagggggaccagccggagcaggaggagaggcccctgctgccctccgtgggcggttactgtgcgactttcggagggctccatttgctggaaggcgcaggcgggcacctccagggggctgtgaggaacgcgaattggcattggcactgcaagaggcgctggagcccgccgtgcgcctgggtcggtatccacgcgctcagcttgaggtgtctgctcttctgctcgaggacgggggatcagctcttgctgcggctctcacagcagccgccctggcccttgcagacgctggggtggagatgtatgacctggtcgtggggtgtggactctcactggcccccggacccgcgcccacatggctgctcgatcccacaaggctggaggaggagcgggccgccgcaggcctgacggttgcactgatgccagtgctcaaccaagtcgccggcctccttggcagcggggagggtggactcacagagagctgggccgaggccgtgcgcctgggccttgagggatgtcagaggctatacccagtgctacaacaaagcctcgtacgggcggccagacgccgtggggctgccgcccagccctag

SEQ ID NO: 16747 - DNA, 429 bp, Artificial Sequence
  Description of Artificial Sequence: Synthetic coding sequence
atggcctccggaaacgcgcgaatcggaaaaccggccccagatttcaaggccactgcagtcgtcgatggagcattcaaagaggtgaagctgtctgattacaaaggcaaatacgttgtgctatttttctatcctctggatttcacattcgtgtgtcccaccgagattatagcttttagcaaccgcgccgaggatttcagaaaattagggtgtgaagtgcttggtgtgagcgtggatagccagttcacacacttggcatggtatgagcaggggcccaagagagaagtggctgccaaattaaccccatccggccccagcagcgtcgcatcatggccgctgttaaacctctggaatctgagatttcccatagtgaaaatcatggagaccctgccccccaagagtctgagaatgatgaccgtgatttccatctag

SEQ ID NO: 16748 - DNA, 1137 bp, Artificial Sequence
  Description of Artificial Sequence: Synthetic coding sequence
atggaggtcaaacccccccctggacgcccccagcccgactcaggacggcggcgccgacgacgcggtgaagaaggacacgacccaaaagagccagagcagctgcggaagctgttcatcggtggtctgagttttgagactacagacgacagcctgcgggaacattttgagaagtggggcactcttactgactgcgtggtgatgcgggatcctcagaccaagaggtccagaggcttcggtttcgtgacatattcatgcgtggaggaggtggacgctgccatgtgtgctcgcccgcacaaggtagacggccgcgtggtcgaacctaaaagagctgtgtccagagaagattccgtaaagccaggtgcacatctcacagtcaaaaaaatattcgtcgggggtattaaagaagacactgaagagtacaatctccgggattacttcgagaaatacggcaaaattgaaaccatcgaggtgatggaggacaggcagtcaggcaaaaaacgcggctttgccttcgttacttttgatgatcatgacaccgtcgataagatcgtagtgcagaagtaccacacaatcaatgggcataattgtgaggtgaagaaggctctgagcaagcaggagatgcagtccgcaggctcccagcgcggtcgagggggaggttccggcaattttatgggaagaggtggaaactttggggggggcgggggaaatttcgggcgggggggcaatttcggaggccggggcggctatggcggcggaggcggtggatctcggggctcttacgggggtggcgacggggggtataatggattcggcggagatggtgggaattatggaggcggccccggttactcttctcgtggaggttacggaggcggagggcccggctatggcaaccagggaggcggttatggcgggggcggcggttatgatggttacaatgaaggcgggaattttggcggaggcaattacggtggtgggggcaactacaacgacttcggtaactactcaggacagcagcagagcaactacggcccaatgaagggtgggagctttggagggcgctcaagtggctcaccttatggggggggctatggctctggcggcgggagcggcggatatggctctagaagattctag

SEQ ID NO: 16749 - DNA, 324 bp, Artificial Sequence
  Description of Artificial Sequence: Synthetic coding sequence
tgaattcatgagcaatgggaaaaggccaatgtctcttctcctcatagggaattcccacccgccacagcccgcgaagtggatcccctccgcataccccctcatcatccccatacaagcaggcagcctccttggccgcgcagagggggaatgatagtggatcctctgcgttctggctttccccgcgccctcattgacccttcctccggcctcccaaatcgtctcccacctggcgcagtcccccccggagctaggtttgacccgtttggacccatcgggacatccccaccagggccgaatccagatcacctgccacctccaggctag

SEQ ID NO: 16750 - DNA, 201 bp, Artificial Sequence
  Description of Artificial Sequence: Synthetic coding sequence
atggctgctgccactggtgatcctggcctcagcaaactgcagttcgccccctttagcagcgctctggatgtgggattctggcacgaacttacccaaaagaagttaaatgagtaccgcttggatgaagcacctaaagatattaaggggtactactataatggggactctgccggcttgccagcccgcctgacactagaatag

SEQ ID NO: 16751 - DNA, 2115 bp, Artificial Sequence
  Description of Artificial Sequence: Synthetic coding sequence
atgctcccaaccgcctcttcaaagcggcgcacatttgccgcccggtacttcacccggagtaaatctcttgtaatgggtgagcagtcgcggtcccccggccgtatgccatgtccgcatagactggggcccgtgctgaaagcaggatggctgaaaaaacagcggagcataatgaaaaactggcagcagcgttggttcgtactaaggggagaccaattattctactataaggacaaggatgagattaagccgcaagggttcatcagcctgcaaggcacccaggtgactgaattgccaccgggccctgaagaccctgggaaacacctgtttgaaatctcacctgggggcgccggggaaagggagaaggtgcccgccaatcctgaggccttacttctgatggccagcagccagcgagatatggaggactgggtccaggctatccgcagagtcatttgggcccctctgggtggcggtattttcggacagcgtttagaggagaccgttcaccacgaacgtaaatacgggccccggttagcccctttgctcgtagaacagtgcgtggattttatcagggagcgaggactgaccgaggagggactatttagaatgccgggtcaggcaaaccttgtgcgcgacctccaagatagctttgattgcggagaaaagcctctgtttgattccacaacagacgtgcacacagtggcatcgctcctcaagttataccttagggagctgccggagcccgtggtccccttcgcccgttacgaggattttctttcatgtgcacagcttctgacgaaagacgaaggtgaggggactttggagttggcaaagcaggtttccaacttgcctcaggcaaactacaatctgctaagatatatctgcaagtttttggacgaggtgcaagcctatagcaacgtgaataagatgtcggtccagaacctcgcgacagtatttgggcctaatatcctccgtcctcaggtggaggacccagtgaccattatggaagggactagtctggtccagcacctgatgactgtgttaatccggaaacatagtcagctgttcacagcgcccgtgcctgagggtcccacatctcctaggggtggtctgcagtgtgccgtgggttggggcagcgaggaggttacgcgtgatagccagggagagcccggcggtcctggcttgccagcacatagaacttcatccctggacggggctgctgtcgcggtcctgagtcgcactgccccaaccgggcccggcagccggtgctcccctgggaagaaagtgcaaaccctgccaagttggaagtcctcgttcagacagccacgcagccttagtggatccccaaaaggaggcgggagttctttagaggttcccatcatatcttctggcggcaactggctgatgaacggccttagctctctccgcggacatcgccgagcatcatccggcgatcgcctgaaggactccgggtcagttcagcgcttgtccacctatgataatgtgcctgctccaggcctagtcccaggtataccaagcgtagcctcgatggcctggtctggtgcatcctcctctgaaagtagtgttggaggcagtcttagtagctgcacggcctgcagagccagcgacagctccgcgcggagcagcctgcatacagactgggccctggagccctccccactcccttcatcttctgaagatcccaaatctctggacctagatcacagtatggatgaggcaggagcaggggctagcaatagtgagcccagcgaacctgattctccgacccgggagcacgcccgccggagcgaggctctgcagggcctggtgaccgagttgcgggcggagttgtgcagacaacgaaccgaatacgaacggagtgttaagcggattgaagaagggagtgctgatctgaggaaaagaatgagtcgcttagaagaggagctggaccaggaaaagaagaagtatatcatgctggaaattaaactccggaactcggagcgtgctcgtgaggacgcagaaagacgcaaccagctgttgcagagggagatggaggaatttttcagtaccttgggtagtttaacagttggcgccaaaggcgccagagcacccaagtag

SEQ ID NO: 16752 - DNA, 630 bp, Artificial Sequence
  Description of Artificial Sequence: Synthetic coding sequence
atgattagcaattaccgcaatggatctgaactggtttgcttcaactctggcgtgggatgtttcctgataggttgcgattgggctttcaccgtactggtaaatacctttttttcctttctgagacggaaaacagacttctttatcggaggagaagaggggatggctgagaagttaatcacgcagacattcagtcatcacaaccagcttgcccagaaaactcggcgagagaaaagggcacgccaggaagcagagcgacgagagaaagctgaacgcgctgctcggttagccaaagaagctaagtccgagaccagtgggccccagattaaggaactgacggacgaggaagccgagagattgcaactcgaaattgatcagaaaaaggatgcggagaaccatgaggcccagctgaagaatggttctttagacagtcccggaaaacaagacacagaagaggatgaggaggaggacgagaaagataaaggcaaactgaagccaaacctcggaaacggggccgatctcccgaactacagatggacacagacattgtctgaactggaccttgctgtgccgttctgtgtgaactttaggctgaagggcaaggatatggtcgtggatattcagaggcgttag

SEQ ID NO: 16753 - DNA, 309 bp, Artificial Sequence
  Description of Artificial Sequence: Synthetic coding sequence
atgaacgaggcggaaatcgtagatgtggctctgggaatcctgatcgagtccagaaaacaagagaaggcatgtgagcagccagctcttgctggcgctgacaaccccgagcatagccccccctgctcagtgagtcctcacacaagctcgggctctagtagtgaggaagaagatagcgggaagcaggcccttgcccctgggcttagtccttcccagagaccaggtggtagttcatctgcgtgtagtagaagtccagaggaagaggaggaagaagatgtgctaaagtatgtgagggagattttcttttcatag

SEQ ID NO: 16754 - DNA, 273 bp, Artificial Sequence
  Description of Artificial Sequence: Synthetic coding sequence
atggcaatggccccttcccctagcctagtgcaggtgtacaccagcccagctgctgtggctgtgtgggaatggcaggacggactgggtacttggcatccatactcagcaactgtctgtagtttcatcgagcagcagttcgttcagcaaaagggacaacgttttggactgggaagtctggcccattccatacccttagggcaagccgacccctctctagctccttatataattgacctcccctcctggacccagttccgccaggacactggctag

SEQ ID NO: 16755 - DNA, 207 bp, Artificial Sequence
  Description of Artificial Sequence: Synthetic coding sequence
atggatgctaacagcaaggacaagccacctgagaccaaggagtccgcaatgaacaacgctgggaatgcatctttcatcctaggtactgggaaaattgtgactccccagaaacatgccgaattgccacctaacccctgcacacctgatacgttcaaaagccccctcaactttagcacggtgacagtcgagcagcttgggatcaattag

SEQ ID NO: 16756 - DNA, 879 bp, Artificial Sequence
  Description of Artificial Sequence: Synthetic coding sequence
atggatggatctttcgtccaacacagcgtgagggtgttacaggagctcaacaagcagagggaaaagggccagtattgtgatgccacattagacgttggaggtcttgtgtttaaagcccactggagcgtcctggcatgttgttctcacttcttccagtctctgtatggcgatgggagcgggggttctgtggttctccctgctggattcgcggaaatcttcggccttctcctggactttttttacactgggcatcttgcattgacaagcgggaatagagatcaagtgttattggctgcaagggaactgagagtgcccgaggccgtggaactatgccagagcttcaagcccaaaacatctgtcggccaggccgcagggggacagtctggactcggtcccccagcatcacagaacgtaaatagccatgtgaaggaacctgcgggactggaagaagaggaagtgagcaggactctaggtctcgtgccacgcgatcaagagcctcgggggtctcatagccctcaaagaccgcagcttcattcccctgcccagtctgagggcccatcctctctgtgcggcaagcttaagcaggcactaaagccctgtccattagaggacaagaaaccagaagactgcaaggtcccgcctcgcccattagaagcagaaggtgcacaactgcaaggtggcagtaatgaatgggaggtggtggtgcaggtggaagacgatggtgatggagactacatgagtgagccagaggccgtgctgacgaggcgcaaatccaacgtaattaggaagccatgtgctgctgagccagccctgagcgctggttctcttgctgccgagccggctgagaaccgaaaagggaccgctgtgccagtggagtag

SEQ ID NO: 16757 - DNA, 408 bp, Artificial Sequence
  Description of Artificial Sequence: Synthetic coding sequence
atggcagccctgcgcccacttgtgaagcctaagatcgtgaagaaacgcacaaaaaaatttatccggcatcagagcgacagatatgtaaaaattaaaagaaactggaggaagccgaggggcatcgacaatagggtacgtcggcggtttaaaggccaaattctgatgccgaacatcgggtatgggtctaacaaaaaaaccaagcatatgctgccctcgggcttcaggaagtttttagtgcacaatgtgaaagagctggaagtcttactaatgtgtaacaaatcttattgcgccgagattgctcataacgtgtcctcgaagaaccgtaaagcaattgtggagagggcagcccagcttgcaatccgtgtgacaaacccgaatgcccgcttgcggagcgaggaaaatgaatag

SEQ ID NO: 16758 - DNA, 810 bp, Artificial Sequence
  Description of Artificial Sequence: Synthetic coding sequence
atgaagaccccagtcgaactggccgtctcgggcatgcagacactggggctgcagcacagatgccgagggggctaccgagtcaaggcacggacaagctatgtggacgagacactctttggctccccagccggcaccaggccaaccccccctgattttgaccccccctgggtggagaaagccaatcggactcggggcgtagggaaagaggcaagcaaggccctaggcgctaaaggatcatgcgagactaccccaagtcgcggcagcacacctaccctgactcctcgaaaaaaaaacaagtaccggcctatctcacacaccccttcctactgcgatgaatccctttttggctcgcgaagtgaaggcgcgtctttcggggctcccaggatggctaagggcgacgcagccaagttgcgggccctattgtggacccctcctcctaccccacggggcagccatagtccgcggccccgtgaagcacccctgcgcgcgatccaccctgccggcccctctaagactgagcccggcccagccgcggattctcagaagctcagtatggggggactccatagtagccgcccgctgaaacgcgggctgtcccattctcttacgcacctgaatgtccccagtactggacatccagctactagtgcccctcacacaaacggtccacaggatctgcgcccttccacctctggagtcacctttaggtctcctctggtgacaagtagagcccgttctgtgtctatcagcgtgccttcaactcctcgaagaggcggcgcaacccagaagccgaagcccccatggaagtag

SEQ ID NO: 16759 - DNA, 840 bp, Artificial Sequence
  Description of Artificial Sequence: Synthetic coding sequence
atggttgaccacttggctaacactgagatcaattcccagcgtatcgcagcggtcgagagctgcttcggggcttccggccagccgttggcgctgcctggccgagtactgctgggagagggtgtgctcacaaaggagtgtcgtaagaaagccaagccccgcattttcttcttgttcaacgacatactcgtctatggctcaattgtactgaataaaaggaaataccggagccagcacatcattcctctcgaagaagtgactctggaacttttgccggagacactccaggccaaaaacagatggatgattaagacagctaaaaaaagcttcgtcgtctcggcagccagtgctaccgagcgtcaggagtggatctcacacatcgaggagtgtgtgaggagacagttgcgagctactggtagaccaccaagtaccgagcacgctgctccctggatccctgacaaggcaacagatatctgcatgcggtgtactcagacacgattttctgccctgacgcggcggcaccattgtcggaaatgcgggttcgtggtttgcgctgaatgttccagacaacggtttctgttgcctaggttgagcccaaaacctgttcgcgtctgttcactttgctatagagagctggccgctcaacagagacaggaggaggctgaggagcagggtgccggttccccaggtcagccagcccacctggcacgacccatttgcggcgcctcttccggtgatgacgatgattccgacgaggacaaagaaggttctagagatggagactggccaagctccgttgaattctacgcttctggtgttgcgtggtccgcatttcactcatag

SEQ ID NO: 16760 - DNA, 279 bp, Artificial Sequence
  Description of Artificial Sequence: Synthetic coding sequence
taacgaagctcgacaagcccgtgcggcactagtaaatctcccaatagagaatgggaagggaagagtgtggcttacatgccctacgcggaagtaaagcgcgctctggagcaggaggcccagatgcacaataccgccgctcgcagtgccagtccctgtcggctgtcaccgcgcgaggtctccaaggcagcaccgcagccagacatgagtgctgctcggtactccgtgcctccagttctgcagcccgcacctcatcaagtgatcaccaacttgccagaatag

SEQ ID NO: 16761 - DNA, 771 bp, Artificial Sequence
  Description of Artificial Sequence: Synthetic coding sequence
atgtccaataacctgtctgagctggacactaaaatccaggaaaaggccatgaaagtcgacatggatatctgccggcggatcgacatcaccgcgaaattgtgtgatgtggcacagcagcgaaactgcgaagacatgatccaaatgttccagaaaaagcttgttccctcaatgggtggaaggaaaagggagaggaaggcagcagtggaagaagatacaagcctctctgagagcgaaggcccgcgccagcctgacggagatgaggaggagagtactgccctaagcatcaatgaggaaatgcaaagaatgcttaaccagctccgggagtatgactttgaggacgactgtgattctctcacatgggaggaaacagaagagactctgctgctgtgggaggactttagcggatacgccatggcagccgcagaagcccagggtgagcaacaggaggatagtctggagaaggtgatcaaggacacggagagtctattcaagaccagggaaaaggaataccaggagaccatagaccagattgaacttgagcttgccaccgctaagaatgacatgaataggcatctccatgagtatatggagatgtgcagcatgaagcggggacttgacgtccagatggagacctgtaggcgccttatcacccagagtggtgacagaaagtcccctgctttcactgctgtgccattatctgaccccccacctccgccatccgaagccgaggattcagaccgagatgtgagctcagactcatccatgcgatag

SEQ ID NO: 16762 - DNA, 1620 bp, Artificial Sequence
  Description of Artificial Sequence: Synthetic coding sequence
atggccaccagcgccccactaaggtcactagaggaagaggtgacctgcagcatctgcttggattacctcagagatcctgtgaccatcgactgtggacacgtcttctgtaggagttgtaccaccgatgttaggcctatctccggatcccggcctgtttgcccgctgtgtaagaagccattcaagaaagagaatatccgacccgtgtggcagctggcctccttggttgaaaatatcgaacgactgaaagtggataagggccgccagccaggagaagttaccagagaacagcaggatgctaagctgtgcgagcgccacagggagaaactccattattactgcgaggacgacgggaagctgctctgcgtaatgtgcagagagtctcgggaacacaggcctcatacagccgtcctgatggagaaagctgcccaaccacaccgagaaaagattctaaaccatctgagtactctgagacgggaccgggataagatccaaggcttccaggcaaaaggcgaagcagatatcctcgctgccctgaagaaactgcaggaccagcggcagtatatagttgcggagttcgagcaaggccaccaattcctacgggagcgagaagaacaccttttggagcagctagccaaactggagcaggagctgacagagggcagagagaaatttaagtcacgcggggtgggagagctggcacggcttgccctcgtgataagcgagcttgagggaaaggcccagcaaccggctgccgagctgatgcaggacacaagagactttcttaacaggtatccccgcaagaaattttgggtaggcaaaccgattgcccgcgtagtcaaaaagaaaaccggcgaattttccgataagctgctgtcattacagagagggcttagagagttccagggcaaactgcttcgggacctagagtacaagacagtgtcagtgacccttgacccgcagtccgcttccggctatctgcagctgagcgaagactggaaatgtgttacatatacatccctctataagagcgcatatttgcacccacagcagtttgactgcgaacctggggtgctgggttcaaagggattcacatggggcaaggtttattgggaggtggaggtagagcgcgagggctggagtgaagacgaagaggaaggcgacgaggaggaggagggagaggaagaggaagaggaggaagaggccggctacggcgacggttacgatgactgggaaactgacgaggatgaagagtccctcggagatgaagaagaggaggaggaggaagaagaggaggaggtgctggagagctgcatggtaggggtcgctcgggactcagtcaagagaaagggggatctgtctcttaggccagaggacggagtgtgggccctgagattatcaagctccggtatctgggcgaacacgagccctgaggccgaactgtttccggccctaaggccccgcagagttggaatcgccctggattatgaaggtggaaccgtgaccttcactaatgctgagagccaggagctaatctatactttcaccgccaccttcacgaggcggctggtgccttttctgtggctaaagtggccgggaacacgacttttgctcagaccgtag

SEQ ID NO: 16763 - DNA, 750 bp, Artificial Sequence
  Description of Artificial Sequence: Synthetic coding sequence
atggctttcatgactcgtaagctctgggatcttgagcagcaagtcaaagcgcagaccgatgagatcctatcgaaagaccagaaaatcgccgctctggaggatctggtgcagaccttgaggccccatcccgctgaggctacactacagaggcaggaagaacttgagaccatgtgtgttcagctgcaacgacaggtacgcgaaatggagcggttcctatctgactatggactgcagtgggtcggcgaacctatggaccaggaagatagcgaaagtaagactgtatcagaacatggggagagagactggatgaccgcaaaaaaattttggaaacccggtgactccttggcccctcccgaggtcgacttcgacaggctgctggcctccctccaagacctctccgagctggttgtggagggggatacacaagtgacccctgtgcccgggggcgcgagattgcgcaccctggagcccatcccgctaaagctctatcgcaacggaatcatgatgtttgacggcccatttcagcctttctacgatccaagtacgcaacggtgtctgagggacatactggacggatttttcccaagcgaactgcagcggctttatcctaacggggttcctttcaaagtgatcagctgctcgtccaatcatacattcggagatttcgaggggagcggtgatacccagccgccacagacccctcctatcttgaggggttctagatgtactccttggggcacgccagtctag

SEQ ID NO: 16764 - DNA, 2763 bp, Artificial Sequence
  Description of Artificial Sequence: Synthetic coding sequence
atgtctgaagattctgagaaggaggactattctgaccgaaccattagcgatgaggatgagtctgatgaggacatgttcatgaaattcgtttcagaggacctgcatagatgcgctctattaacagccgattcttttggcgacccattttttccccgcactacgcaaatcttgctcgaataccaactggggcgctgggtgccccggttgcgcgaaccgagagatctgtacggcgtgtccagttcaggccccctttcccctacccgctggccatatcattgtgaggtgatcgacgaaaaggtgcaacacatcgactggacaccatcctgtcccgagcccgtgtacataccgaccggcctcgaaaccgagcccctttaccctgattctaaagaggccactgttgtttaccttgccgaggacgcatacaaagagccttgctttgtgtacagcagggttggcggcaacaggactcccctgaaacaacctgtggactatagggataacactctcatgtttgaagcacgctttgaaagcggaaacctgcaaaaagttgtgaaagttgcagaatatgaatatcagctgacagtcaggcccgacctgttcacgaataagcacacccagtggtactattttcaggtgacaaatatgcgtgccggtatcgtttacagattcacgatcgtgaactttactaagcccgccagtctttattcccgcggtatgcggcccctgttttattcggagaaggaggcgaaggcccaccacattggttggcagaggattggggatcaaatcaagtactataggaacaacccgggacaggatggcagacactacttttccctgacatggaccttccaattcccccacaataaagatacttgctacttcgcccactgttatccatatacctacaccaatctccaggagtatctgtcgggtattaacaacgatcccgttaggagtaaattctgcaaaattagggtgctctgccacacactagcgagaaacatggtgtatatccttacgattaccacccctctcaaaaactccgatagccggaaaaggaaagcagtcatcctcaccgccagagtgcacccgggagaaaccaacagcagttggatcatgaaaggattcctagactatattctcggcaactctagcgacgctcaactactgcgcgatacatttgtgtttaaggtggtacccatgttgaatcctgacggggtaattgtcggaaactacaggtgttctctggccggacgcgatctgaatcggaactacacatctctcttgaaagagagcttcccctccgtctggtatacccgaaacatggttcataggctgatggagaagcgagaagttattctgtactgcgatctgcacgggcattccaggaaggagaacatctttatgtacgggtgcgatggcagtgatcgatccaaaacactctatcttcagcagagaatttttcccttaatgctatcgaagaattgtcccgataagttcagcttctccgcctgcaaatttaacgtccagaagagcaaggagggcacaggaagagtcgtgatgtggaaaatgggaatacgaaactccttcactatggaggctactttctgtggcagcaccctgggtaacaaaagaggtacccacttctcaaccaaggatctagagagcatgggttatcacttctgcgatagtctcttggactactgcgatcctgatcgtaccaaatactaccgatgcctcaaggagctagaggagatggagaggcacatcactttagaaaaggtgttcgaggacagtgataccccagtcatcgacatcacactcgacgtggagtcctctagcaggggatcggactcctctgagagcattgacagcttaacgtatctcttgaagctcacctcacagaagaaacacctcaagacaaaaaaagagaggaactctacaattgcctcacatcagaatgctcgaggacaggaagtgtatgaccgcgggcacctgttgcagcggcatacacagtcgaattcggatgtcaaggacactagacccaacgagccagacgactacatggtagactacttccgtaggcaactgcccaaccaggggctcgatctacaccataacctgaagagtaaaattaaggaatgtataagctttcagagcaagaaaactgggatcaattggacagacgacgaaaagcgttcttacaaggataagggcatcgttcaaacccaagagatcctgcagtacttgttaccgattgtccattctacaaagaacatgcaaaccactcaaatcaagcaactgtttaatccacgaaccaacttccaaattcagcaccagctcaaccctgctacatgcaggaatataaaaaagtactcaacttcttggacagctcctcggaaccaccccttcgtgatccaaggcgatgtgatggccaactcatcagagtgggttcagagtaaaccccacagatccctagaatcgctctctcccttaaaggggccaaagaagaataagcacagccagatctgggcaattaagaatgaggatatcaagccactttcatcaaagtgggagacagcaagtagtagcttcggcatggatgccaacgttttgaaatacaagtccttgcaggcggaagagactaatcaacagtcatcaaaacatactgcactgcatctgacgaagaataaggatgagcaggccaataaaaacgatgggcagccgaccctgtacctgaagtttcagcgggagtcctag

SEQ ID NO: 16765 - DNA, 858 bp, Artificial Sequence
  Description of Artificial Sequence: Synthetic coding sequence
atgaccaatgcacagataattcttctgattgataacgccaggatggcagtggatgactttaacctgaagtacgaaaacgaacactcatttaaaaaggaccttgagattgaagtggaagggctacggcggacattggacaacctcaccattgtgaccaccgacctcgagcaggaagtagagggtatgcgaaaagaactgatcctcatgaaaaagcatcacgagcaagagatggaaaagcatcacgtcccctcggactttaacgttaacgtgaaagttgacacagggcctcgcgaagacctgattaaggtgttggaggacatgcggcaggagtatgaattgatcattaaaaaaaagcaccgagacctggacacatggtacaaagagcaaagcgctgccatgtcccaggaggccgcatccccggccacagtccaatctcgccagggggacatccatgagctgaaacggactttccaagcactggagattgacctgcagacccagtacagcactaagagtgctttggaaaacatgctcagtgagacacagtctaggtacagttgtaaattacaggacatgcaggaaatcattagccactacgaagaagagctgacccaactccgtcatgagctggaaaggcaaaataatgaatatcaggtgctccttggcataaagacacatctggaaaaggaaattaccacatatcggcgccttctggaaggagagagtgaagggacacgggaggagagcaagtcatcaatgaaggtgtcagctacacccaagattaaggcgatcactcaagagacaatcaatggtcgactggttctgtgtcaggtcaacgaaattcagaagcacgcttag

SEQ ID NO: 16766 - DNA, 2013 bp, Artificial Sequence
  Description of Artificial Sequence: Synthetic coding sequence
atgagcccatgttcaggcggcagaggcgaacttcgggcagcttgcctacagcctgaagttccaggcgccccagggctctcctggtggccttctacagccggcctgagacagagccaaacagaccttcaactgtcgctgtctatatggtgcggaaagaagatggggagttacctgagtgtgcccgcctattttactagcagggatctcttccgatgcagcgagtgtcaggattctttgaccaattggtactatgaaaaagatgggaaactatactgtccgaaggactactgggggaaattcggcgagttctgccatggctgcagcttactgatgaccggaccttttatggtcgccggcgagtttaaataccatccagagtgtttcgcctgtatgagttgcaaagtgatcatcgaggacggggacgcctacgctctggtgcagcatgcgactctgtactgtggcaaatgccacaatgaggtggtgttggctcctatgttcgaacgcctgtcaactgagtcagtccaggagcagctgccctattcagtcacactgatctcaatgcccgccactacagaaggcaggaggggatttagtgtcagcgtggagtctgcctgctccaactatgccaccaccgtgcaagtaaaggaggttaaccggatgcatatatcgcctaataacagaaatgctatccaccctggcgacagaattttggagatcaacgggactcctgttcggacactgcgggttgaagaggtggaggacgctatctcccagacatcccaaacccttcagctgcttatcgaacatgaccctgtgagtcaaagactcgaccagctgaggctggaagcccgtctggctccgcacatgcagaatgctggtcatccacacgctctgtccactctggacaccaaagagaatctcgagggtacattgagaagaagatccttgagacgaagcaatagcatcagtaaaagcccaggaccaagctctcccaaggagcctctgcttttttctagagatatatctagatcagagagtctaaggtgcagttcatcatactcacagcagattttccgaccctgcgacctgattcatggtgaggtgctaggcaagggattttttggacaggccatcaaagtcacccacaaggcaacgggcaaagtgatggtgatgaaagaattaatccgctgcgacgaggaaacacaaaagaccttcttaaccgaggtgaaggtgatgcgtagcctggatcatccaaatgtgcttaagttcataggagtcctatataaagataagaaactgaacctgttgaccgagtacatcgagggtggtactctgaaggatttcctgagatctatggacccttttccatggcagcagaaggtgcgattcgcaaagggaattgcctcagggatggcgtatctacattccatgtgcattatccatagagatctcaattcccacaattgcttgattaaactggacaaaacggtggtggtcgcggacttcggccttagcagactgatagtcgaggaaaggaaaagggctcccatggagaaggcaactactaagaagcgaacactgcgaaagaatgaccgaaaaaaacgttatacagtcgtggggaacccttattggatggccccagaaatgttgaacggaaagtcctacgatgagactgttgacatttttagttttggaattgtgctttgcgagataatcggccaggtgtacgctgaccccgattgtcttccccggaccctggactttggactgaacgtgaagctattttgggaaaaatttgtccccaccgattgtcccccagccttttttcccctcgccgccatctgctgcagactggagcccgagtcacgaccggccttcagcaagctcgaagactctttcgaggccctgtcgttatatctcggggaactgggcattccactgccggcagagctcgaggagcttgaccatacagtgagcatgcagtatggtctgactcgggactctcccccctag

SEQ ID NO: 16767 - DNA, 459 bp, Artificial Sequence
  Description of Artificial Sequence: Synthetic coding sequence
atggctcacctgcggggcttcgcaaatcagcattctcgtgtggaccctgaggagttatttacaaaactggaccggatcggtaaggggagttttggcgaagtgtataagggaatcgataatcacacaaaggaggttgttgcaatcaagattattgatctggaggaggcggaggacgagatcgaggacatccagcaggaaatcactgtgctaagtcagtgtgactccccttacatcactaggtactttggctcttatctgaagagcacgaagctttggattatcatggaatatttggggggaggatccgctcttgacctgctgaaaccgggtccattagaggaaacatacatcgctaccatcctgagagaaatccttaaaggactggattatctgcactctgagagaaaaatccatcgcgatattaaggccgctaatgtgcttctgtccgaacaaggctag

SEQ ID NO: 16768 - DNA, 1365 bp, Artificial Sequence
  Description of Artificial Sequence: Synthetic coding sequence
atggccccttgccgagcccggaccgggccaagcacatggaggtctgcaacttcctcaactaggaggcggaagggcgcaaggagacacctatcagccctccaggtgctggagacctgcgtaaagaattgtgggcaccggtttcacgtgctggttgcctcacaggatttcgtggagtccgtcctggtgcggaccattctgcctaagaacaacccacccacaattgtgcacgataaagtactgaatctgattcagagctgggcagacgcatttcgttcaagcccagacctcacaggcgtggttacaatttacgaggaccttagaagaaagggtctggaatttcctatgactgatttggacatgctgagccccatccatacccctcaacggacagtgtttaactccgaaacacagagtggccaggactccgtaggtacagattcttctcaacaggaggattcgggccagcacgccgccccattaccagcccctccaatcctctccggagacactcctatagcccccactccagagcagatcggcaagctccggagcgaacttgaaatggtgtccggtaatgttagggtgatgtccgagatgttgaccgagctggtgcccacccaggccgaacctgccgatcttgagttgttacaggaacttaacaggacctgcagggctatgcagcagcgcgtactagagctcattcctcagatcgccaacgagcaactcaccgaagagctcctgatcgtcaatgataatttgaataacgtttttctcagacacgagcggtttgagcggttccgaactggtcaaacgactaaggcacccagtgaggcggaaccagcagccgatctgatagacatgggtcccgaccccgcagccaccgggaacctgtcatctcagctagctgggatgaaccttggttctagttctgttagggcaggtctgcagtccctggaggcatctggccggcttgaggacgaattcgatatgttcgcattgacacgaggaagttccctcgcagatcagcgaaaagaggtcaaatacgaggcaccacaggctacagacggcctggccggagccctggatgctaggcaacagagcaccggagcaattccggtcacccaagcttgcctcatggaagacatagaacagtggctgagtactgatgtcgggaatgatgcagaagagcctaaaggagtcacaagcgaggagtttgataaattcttggaagaacgtgctaaagctgccgatcggctcccaaatcttagctccccttcggccgaaggtccccctggccccccctccggtccagctcctaggaagaaaacccaggaaaaggatgacgatatgctgttcgcactgtag

SEQ ID NO: 16769 - DNA, 378 bp, Artificial Sequence
  Description of Artificial Sequence: Synthetic coding sequence
atgcagacttcttcatctagatccgtgcaccttagtgagtggcagaaaaattactttgccattacctccggaatctgtacaggaccgaaagcggacgcctatcgcgctcagattctgcggatccagtacgcctgggccaactccgaaatctctcaggtttgtgccacaaaactgtttaagaagtacgctgaaaagtactccgccataatagattctgataacgtggaaagtggactgaacaactacgcagaaaatattctgacgctggcaggtagccaacagacggactccgacaagtggcagtccggtctgtcaatcaataacgtatttaaaatgtctagcgtacagaaaatgatgcaggcagggaagaagttctag

SEQ ID NO: 16770 - DNA, 30 bp, Artificial Sequence
  Description of Artificial Sequence: Synthetic coding sequence
atgtctcacctgcaatctctattgctatag

SEQ ID NO: 16771 - DNA, 270 bp, Artificial Sequence
  Description of Artificial Sequence: Synthetic coding sequence
atgtcagaacaaggcgacttgaaccaggctattgccgaggagggtggaaccgaacaggagactgcaaccccagaaaatggaattgtgaagagcgagagcttagatgaggaagagaaattagagttgcaacggcgactggaagcccaaaatcaggagagacgcaaatccaagtctggtgctggcaaaggcaagctcactcgttcactggcggtgtgcgaggagagtagcgctcgacctggtggtgaaagtcttcaggaccagactctctag

SEQ ID NO: 16772 - DNA, 3732 bp, Artificial Sequence
  Description of Artificial Sequence: Synthetic coding sequence
atgctgataaaagagtaccacatcttactaccaatgtccctggacgagtaccaggttgcccagctgtatatgatccagaaaaagtctagagaggagtcctccggagaaggtagcggcgtggaaatcctggccaaccgtccgtacacagacggacctggagggtctgggcagtatactcacaaggtgtatcacgtcggttctcacatccccggctggtttagggctctgctgcctaaagctgcacttcaggtggaagaggagagctggaacgcctatccttatacccgcactcgttacacctgtccgtttgtagaaaaattcagcatagagattgaaacgtactacctgccagacggcggtcagcagccaaacgtgttcaatctgtccggcgccgaacgcaggcagagaatacttgacaccatcgacatcgtacgcgatgcagttgctcctggcgagtacaaagccgaggaggacccgagactgtaccactccgtgaaaacagggaggggccccctgtcagatgactgggcccggaccgccgcccaaacgggccccctcatgtgtgcttacaagctttgcaaagtggagtttcgttattggggaatgcaggcaaaaatagagcagtttatacatgacgtcgggctgcgccgtgtgatgctgcgggctcaccgccaagcctggtgctggcaggatgaatggacggaactgtctatggctgacatccgggccctagaggaggaaactgctcgtatgctcgcccagcggatggcaaagtgcaatacaggcagcgaggggtccgaagctcaaccacctggaaagccctcaaccgaggcgagatcggcagctagtaatactgggactcctgatgggccagaggcacccccgggcccggacgcttcccctgacgcgtcttttgggaagcaatggtcttccagcagcaggtcgagctactcatcccagcacggcggcgcagtaagcccccagtctttaagtgaatggcgcatgcagaatatcgctcgtgactctgaaaactccagcgaggaggagttctttgatgcccatgagggattctccgattccgaggaggtgtttccaaaggagatgacaaaatggaactcaaacgacttcatcgacgccttcgccagccccgtggaagccgagggcactccagagcccggcgctgaagctgccaagggcatcgaggacggcgcccaagcccctagagacagtgaaggcctcgacggcgcaggcgagctcggcgcagaagcttgtgctgtccatgctctgtttctcatcttgcactctggcaatattctggactccggccctggtgacgctaacagtaaacaggcagacgtccaaacactaagctctgctttcgaggccgtaaccaggatccattttcccgaggctctgggccacgtagccctgagactggtgccatgccctcctatatgcgcagccgcttatgccctagtctccaacctgagtccttatagccacgacggtgactctctgagccggagccaagaccatattccactggctgcccttcccctcctggccacctccagctcacgatatcagggtgcagttgcgactgtaatagcgcgaaccaatcaagcctactcagccttcttgcggagccccgagggagcaggtttctgcgggcaggttgccttaataggcgacggagttggtggaattcttggttttgatgccttgtgccatagtgcgaacgctgggacaggatctaggggcagctcgcggagaggctccatgaataatgaattgctgtcgcctgaatttggccccgtgagagatccgctagccgatggggttgaagggctaggccgggggagtcctgaaccgtctgcattgccaccccaacgcattccatccgatatggctagtcccgaaccagaaggatcccaaaacagcctccaggcagcaccggcaaccacaagcagctgggagccacggcgcgccagtacagctttctgccccccagccgcttcctccgaagctcccgacggtccctcaagcaccgctagactcgattttaaggtatctgggttcttcctcttcggtagtccgcttggcctggtcctcgctctgcggaagaccgtcatgcccgccctcgaggcccagatgaggccagcatgcgagcagatctacaatttgttccacgctgccgacccatgcgcgtcgcggctcgaacccctgctggcccccaaatttcaggcaattgcaccactcacggtgccccgataccagaagtttcccctcggcgatggatcatcgctcctgttagcagatactctacagacccactctagtctcttcctggaggagctagagatgctggtgccaagcacaccaacaagcacgtccggcgccttttggaagggctctgagctggccaccgatccaccggctcagcctgccgccccaagcaccacctctgaggttgtgaagattctggagcgctggtggggtacaaaaaggatcgactactcactgtactgtcctgaggccctgacagcctttccgaccgtaacccttcctcacctcttccatgcctcgtattgggaaagcgctgatgtcgtcgctttcatcttgagacaggttattgaaaaggagcggccccagcttgccgagtgcgaggagccatcgatctactccccggcatttccacgtgagaaatggcagcggaagaggacacaggtcaagatacgaaacgtcacctcaaatcacagggcatctgatactgtagtgtgcgagggccgcccgcaggtgctaagtggcaggtttatgtatggccccttagatgtggtgacactcacaggggagaaggtggacgtctacattatgacgcagcccctctcagggaagtggattcactttggaactgaagtgactaatagctccggaaggctcaccttcccagtccctcccgagagagctctgggcataggtgtatatcccgtccggatggtggtgagaggcgatcatacttatgcagagtgttgtcttactgtagtggcacggggaaccgaggctgtggtttttagtatcgacggtagcttcacggcttctgtaagtatcatggggtctgatcccaaggttcgggcgggtgctgtcgatgtcgtgcggcattggcaggactctggctacctgatcgtctacgttaccggaaggcccgacatgcagaagcaccgagtagtcgcgtggctgtctcagcataacttcccgcacggggtggtctcattctgtgacggcctcacccacgaccctctcagacaaaaagcaatgtttttgcagtccctggtccaagaagtcgagttgaacattgtagcaggctacggctctccaaaagatgtggcggtttacgccgctctgggtctctccccaagtcagacatatattgtaggaagagcggtccggaagctgcaggcacaatgtcagtttctgtccgacgggtatgtggcccacctgggtcaactcgaagctggaagccactctcacgcatcttcaggtccacctcgggccgcgctcggtaaatcaagctatggggtcgcagcccctgtcgatttcctgcgcaaacaaagccagctcctgcggtccagaggcccgagccaggctgagcgggagggacctggaacacccccaacaactctggcacggggcaaggctaggagcatatccttgaaattggattccgaggaatag

SEQ ID NO: 16773 - DNA, 1614 bp, Artificial Sequence
  Description of Artificial Sequence: Synthetic coding sequence
atgtcctcttctggttatcctccgaaccagggtgccttctccaccgagcagagccggtacccgcctcacagcgtgcagtatacctttccaaatactcgacaccagcaagaattcgcagttcccgactaccggtcttcacatcttgaagtgtcacaggcctcccaattactgcagcaacagcagcagcagcaactaaggagacggccaagcttactgagtgagttccacccagggtccgaccgaccccaggagcggcggaccagctatgagcccttccatccaggcccatcaccggttgaccacgatagcctggagtccaagcgaccaaggttagagcaggtgtccgatagtcactttcaaagggtgagtgccgccgttctgcccttagtgcatcctctgccagagggactgagggcaagcgctgatgcgaagaaggatcccgcattcggcggcaagcatgaagcaccttctagccccatttctggacagccctgtggcgatgaccagaacgcctctccctcaaaattgagcaaagaggaattgatccagtccatggatagggtggacagagagattgctaaagtagagcagcagattctgaagctgaagaaaaaacagcagcagctcgaggaggaagcagctaaaccccccgaaccagagaaacctgtgtctccccctcctgtggaacaaaagcataggagtatcgtgcaaataatttatgatgagaatcgaaagaaagcggaagaggcacacaaaatcttcgagggcttaggccccaaagtagagctccctttgtataatcagccatcagacaccaaagtgtaccacgagaatataaaaaccggggtccctgcacggagaatgatgaaaaaccaagtgatgcggaagaaacttatcctgttctttaaacggagaaaccacgcccgtaagcagagagagcagaagatttgtcagcgttatgatcagctgatggaggcttgggagaagaaagtagatcgtattgaaaataaccctcggcggaaagccaaggagagtaagacccgcgaatactacgagaagcaatttccagagatcagaaaacagcgagagcagcaggaaaggttccagcgggtgggccagcggggagccggcctttccgccacgattgcccgaagcgaacacgagatatctgaaatcattgacggtttgtctgaacaggaaaacaatgagaaacagatgagacagctgtcagtcatacctcccatgatgtttgacgccgagcagcggagggtgaagttcattaacatgaatggcttgatggaagaccctatgaaggtctacaaagatcgacagtttatgaatgtgtggaccgaccatgagaaggaaatctttaaggacaaattcattcaacaccccaaaaactttggcttgatagcttcctacctggagaggaaaagtgtgcccgactgcgttctgtactactacctgaccaaaaaaaatgaaaattacaaagccttagtccgacggaactatgggaagagacggggtcgaaaccagcagattgcaagaccttcccaggaagaaaaggtggaggaaaaggaggaggacaaagccgagaagacagaaaaaaagtag

SEQ ID NO: 16774 - DNA, 147 bp, Artificial Sequence
  Description of Artificial Sequence: Synthetic coding sequence
atggaggacctgttcgagacatttcaggatgaaatgggcttttctaacatggaggacgacggtccggaagaagaggagcgcgtcgcagaaccacaggcaaatttcaacaccccccaagccttgaggcaactcctgctgctgatgtag

SEQ ID NO: 16775 - DNA, 798 bp, Artificial Sequence
  Description of Artificial Sequence: Synthetic coding sequence
atggcatccagctctgtcccacctgctacagtgtccgccgcaacggcagggcctggcccagggttcggattcgcgtcgaaaacaaaaaagaagcatttcgtacagcagaaggtaaaagtattccgggccgcagatcccttagtcggcgttttcctgtggggtgtagcacacagcattaacgagttaagtcaggtgcccccaccagtgatgcttctgccagacgattttaaggcaagttcaaaaatcaaggtcaataatcatttgtttcatagagaaaatttgccttcccactttaagtttaaggagtactgcccacaggtgttccgcaatctccgagacagatttgggatcgacgaccaagattatctcgtcagtctcacccgtaaccccccttccgaatcagaggggtccgacgggcgattcctgatatcctacgaccgtactcttgttataaaagaggtgtccagcgaagacatcgctgatatgcatagcaatctatccaactatcaccagtatatcgttaaatgtcacggtaatacactccttccacagttcctggggatgtatagagtttccgtagacaacgaggacagctacatgttggttatgagaaacatgtttagtcaccggctgcccgttcaccgcaaatatgacctcaaaggatctttagtttctcgtgagccagcaattcggaagagactcaaaaactgtcctccactgaggatttggacatttagtacgagaaccaggaagtatatcttagtcaagagacgcagaaaatacttctggagaagttag

SEQ ID NO: 16776 - DNA, 462 bp, Artificial Sequence
  Description of Artificial Sequence: Synthetic coding sequence
atgagcccggaagtggcgttgaacagaatctcacccatgctgagtccatttataagtagcgtcgtgaggaatggcaaggtcggattggacgcgactaactgtttgagaatcacggatcttaagagcggatgtaccagcctgactcctggaccaaattgtgataggttcaaacttcatatcccctatgccggtgaaacgctgaagtgggacatcatcttcaatgcacagtacccggagctgccccccgattttatcttcggcgaagatgctgagttccttccagacccctctgccctgcagaatctggcctcgtggaatccgtctaacccagagtgtctgttgcttgtcgtcaaggagctcgtacagcagtatcatcagttccaatgtagccgccttcgcgagtcctcacgcttgatgttcgaataccaaaccttgctagaggagccccagtacggcgagtag

SEQ ID NO: 16777 - DNA, 78 bp, Artificial Sequence
  Description of Artificial Sequence: Synthetic coding sequence
atggagctgcgttgtggaggactcctgttttccagcagattcgatagcggcaacctggcccacgttgaaaaggtgtag

SEQ ID NO: 16778 - DNA, 228 bp, Artificial Sequence
  Description of Artificial Sequence: Synthetic coding sequence
atggcctccgaagtggggcataatttggaatccccggagacaccaggtggcgggggctggactcgggtggaatttccccctccagcgccgaagggcgcggctaccgtctggtgtcttaataggcttggctcgcgaaagttatcactgatctggatcacatttaatactggttggaatatgaagtctagacttataattttgattcagcaggtgagttgtcaccattag

SEQ ID NO: 16779 - DNA, 1620 bp, Artificial Sequence
  Description of Artificial Sequence: Synthetic coding sequence
atggctacttcagcacctctgcgctccctcgaggaggaagtcacgtgctccatctgcttagactatctgcgcgatccagtgacaattgactgtggtcacgtgttctgccgctcctgcacaactgacgttcggccaattagtgggtcgagaccagtgtgtccgctgtgtaaaaaaccgttcaagaaggagaatattcgccccgtgtggcaactggcctcattggtggaaaatatcgagaggttaaaagtggataaaggcagacagcccggggaagtcacaagagaacagcaggatgccaaactttgcgagcgccacagggagaagttgcactattattgcgaggatgatggaaagctactgtgcgtgatgtgtagggagagcagagagcacaggccccacacggccgtcttgatggaaaaggccgcccaaccacacagggaaaagatacttaaccatttgagtaccttacggcgggacagagacaaaatccaggggttccaagccaagggggaagccgacatcttagccgctctgaagaagctgcaggatcaaaggcaatatatcgtcgccgaattcgaacagggccaccagttcctgagagaaagggaggaacatttgctcgagcagctggctaaactcgaacaggagctaaccgagggtcgggagaaattcaaatcccggggtgtcggcgagctagcgaggctcgcattagtcatcagtgaactagagggtaaggcccaacaaccagcagccgagttaatgcaggacacccgagattttctcaatagataccctcggaaaaagttttgggtgggtaagccgatcgccagagtagttaaaaagaagacaggtgaattcagtgataagttactatcccttcagcgcggcctcagagagtttcagggaaagctgctgcgcgacctggagtataagacagtgtccgtgacccttgacccacagtcagcaagcggctaccttcagctaagtgaagactggaagtgcgtcacctatactagcctgtacaaatctgcttacctgcacccacaacagttcgattgcgaacccggagtacttggtagtaagggcttcacatggggcaaagtatattgggaagtggaagttgagagagaagggtggagcgaagacgaagaggagggcgacgaagaggaagaaggtgaggaagaagaagaggaagaagaggctggctacggagacggttacgacgattgggaaacagacgaagatgaagaatcactaggcgacgaagaagaggaggaagaggaggaggaggaagaagtgctcgagtcttgcatggtcggtgtggcgcgcgattcagtcaagcggaagggcgatctgagcctcaggccagaagacggcgtgtgggcccttcggctcagcagctctgggatttgggccaacacctcgcctgaagcggagctgttcccagccctgcggccccgacgcgtgggaattgcgctggactacgagggaggtactgtgacatttaccaatgcagaatcacaggagctgatatatacatttactgcgaccttcaccaggcggctcgttccttttttgtggctcaagtggccagggactagattactcctgcgaccatag

SEQ ID NO: 16780 - DNA, 390 bp, Artificial Sequence
  Description of Artificial Sequence: Synthetic coding sequence
atgcctgggttatcctgccggttctaccagcataaattccccgaggtggaagacgtagtcatggtcaacgtccggagcatcgccgagatgggcgcctacgtgtctctgctcgagtacaacaatatcgaggggatgattctcctgtccgaattatcaagaagacggattcggagcatcaataaattgatccggattggacgcaacgagtgcgttgtggtgatacgagttgataaggagaaaggctacatagacctttccaagaggcggctgacgctctgggaaactgaaagcaaccttaggaacacagaacaaaggtttctggcagttaaccctcggcttgagtcatttcctgtgctaaagacctctaaactgaatatattttatttctag

SEQ ID NO: 16781 - DNA, 1842 bp, Artificial Sequence
  Description of Artificial Sequence: Synthetic coding sequence
atggcaacaattccagactggaaactgcagttactagcccgccgccgccaggaagaagcatccgtaagagggagagaaaaggctgaacgtgagcggctgtcacagatgcccgcctggaaacgggggttgttagagcggcggcgagcaaagctgggcctttccccaggtgagccaagtccagtcctgggtacagtcgaagccgggccacccgaccctgacgagagcgcagttctgctggaggccatcggaccagtgcaccagaacagattcatcaggcaggagagacagcagcaacagcagcagcagcagcggtcagaagaacttctggctgagcggaagccaggcccgctcgaggcacgggagagaagaccttctcccggagagatgcgcgatcagtccccgaagggaagggaatcccgggaggaaaggttgtctcccagagaaacacgcgaaagaagactgggcatcggaggggcgcaagagctgtctcttcgaccactggaggccagggattggaggcagagcccaggtgaggtgggcgaccgaagctctagattgtctgaggcttggaagtggcggctgagcccaggggaaacccccgaaaggagcctgaggctggcagaaagtcgggagcagtctccacggcggaaggaggtcgaatctaggctgtcccccggggagtccgcctaccagaagctgggactgacagaggcgcacaaatggcgccccgacagccgcgaaagtcaggaacagagcctcgtgcaattggaagcaactgagtggcgcctgaggtccggcgaggagagacaggattattccgaggaatgtggacgaaaagaggaatggcccgtgccaggagtggccccaaaggaaactgctgagctgagcgagaccctgacccgtgaagcccaaggaaattcatcagctggggtggaggcggccgaacagagaccagtggaggatggcgagcgcggcatgaaacccaccgaaggatggaagtggaccctgaatagcggaaaggccagggaatggacacccagagatatcgaggctcagacacagaagcccgaacccccggaaagtgccgaaaaactgctggagtctcccggggttgaggcaggagagggggaagcggaaaaagaagaagccggcgcacagggccgccctcttagagccctgcaaaactgctgcagtgtccccagtccgttaccccccgaggacgctggaactggtggcttgcgtcaacaagaggaggaagctgtggaacttcagccacccccgcccgctcctctgagccccccaccacctgctcccacggcccctcagccccctggcgatccactcatgagccggctgttctacggcgtcaaggccggtcctggtgtgggcgctcctcgacggtccggacatacattcaccgttaacccaaggcgatcagtcccacccgctaccccagccaccccaacctccccagctactgtcgacgctgctgttcccggcgccggtaaaaagagataccccacagccgaggagatcctggtgctaggcggctacttaagactctctcgaagctgtctggctaagggaagccctgaacgccatcataagcagctcaagatctctttctcagaaacagccttagagaccacttatcagtatccatctgagtctagtgtgctcgaggaactcggacctgagcccgaagtaccctccgcccctaacccgcccgccgcccagcctgacgatgaagaagatgaagaagaactcctgctgctccagcccgaactgcaagggggactcagaaccaaggcccttattgtggacgagagctgcaggcggtag

SEQ ID NO: 16782 - DNA, 1983 bp, Artificial Sequence
  Description of Artificial Sequence: Synthetic coding sequence
attgccaagccgcagggtacatatcaggtgttaccccccaatacagggagtctatacatcgataaggactgctccgccgtctattgccacgagtcttcatccaatatttactatccattccagaaacgggaacagctgcgcgctgggaggtatatcatgagacacacctcggaggtcatttgtgaagttctcgaccccgagggaaataccttccaggtcatggccgatgggagtatcagtacaattctgccagaaaaaaagctggaagacgatctgaacgagaagactgagggctatgattccctctcttcaatgcaccttgaaaaaaaccaccagcagatatacggcgaacacgtcccacgttttttcgtgatgtacgccgacgggagcggcatggagttgctcagggactcggacatagaggagtacctgtctctcgcttataaagagtctaataccgtggtactgcaggagcctgtgcaggaacaacctgggaccctaaccattactgtcctccggcccttccatgaggcaagtccctggcaagtgaagaaggaggatactattgtgcccccaaatttacgctctagatcctgggaaacattccctagcgtggagaagaaaaccccaggacctccattcggaacgcagatttggaagggtctttgtattgagtctaagcaactcgtcagtgcccccggtgcaatattgaagtctcctagcgtgttgcaaatgcgccaatttattcaacacgaagtgatcaagaacgaagtaaagttgcgacttcaggttagtttaaaagactacatcaattatatcttgaaaaaagaagatgaactgcaagagatgatggtcaaggactcccgtacagaagaagaaaggggcaacgccgccgatctacttaaactcgtgatgtcattccccaaaatggaggagaccacaaaaagccatgtgacggaagttgccgcccacctcacggacctctttaaacaatctttggcgaccccacccaaatgcccaccggacacatttggcaaggacttcttcgaaaagacttggcggcacaccgccagcagcaagaggtggaaggagaaaatcgacaagacacgaaaagaaattgaaaccacacagaattatttaatggatattaaaaataggatcatccctcccttctttaagagcgagctaaatcagttgtatcagagtcagtataaccaccttgacagtcttagcaagaagttgccctcatttacgaaaaagaacgaggacgccaatgagaccgcagttcaagacaccagtgacctgaacctagatttcaaaccacataaggtctccgaacagaagagcagcagcgtccctagcctgcctaaacctgaaatctcggctgacaaaaaggatttcaccgcacagaaccagacggagaatttgacaaagagccccgaggaggccgagagttacgagcccgtgaagattccaacacagtccttgttgcaggatgtggctggtcaaactcgaaaggagaaggtgaagctccctcactatctgctctcatccaaacctaagagtcagccactcgcaaaagtgcaggactctgtgggcggcaaggtcaatacttcttctgtggcctccgccgccattaataacgccaagagtagcttattcggattccacctcctaccctcgtcagtcaaattcggcgtgctgaaggaagggcacacttacgcgacagtagtgaaacttaagaacgtcggggtggacttctgtaggtttaaggtcaaacaacctccaccaagtacaggcctgaaggtgacttataaacctggtccagttgccgctggcatgcagaccgagcttaatattgagttgttcgctactgccgtgggtgaagatggcgccaaaggtagcgcccacatctctcataacattgaaataatgacagagcatgaagtcctctttctgcctgtcgaagccaatattctttag

SEQ ID NO: 16783 - DNA, 2475 bp, Artificial Sequence
  Description of Artificial Sequence: Synthetic coding sequence
atgtactccaatgaggacagcagacagactatagtgtatagcgaagaatctaacaccactatgagttacactcaaaaaattaccaatcctttgccggccgcttcatcgacagaccctgctcccttcgccaatatcaatactcctgtgctgcaggaagattaccgccaggacagtcagacgagaaggatctctacacttaagctgactcataaccaggacctgggaagctcctctcctatttccactccacagttttctaaaagtgtcgaggtgccatcattccttaagaggcccaggtcgctgaccccaaaccccgtgcctgaaactcataccgcatcgttgagcattcaaatagcccccctttccggacaagatctcgaaagtcacaagcagctgccggagctgagccctgaaacagccaagattcctctgcagcaagagagacagaagagcgcagtcgctgccgcatctcaatcttctgactgtcgcgtgtcgcagatcacggtcaacggaaacagtgggggtgccgtgtccccgatgtcatactatcaacgcccgttttcacccagcgcttatagcttgcccgcgagtctcaactccagcatcgtcatgcagcacggcacaagtctcgatagcacagatacataccctcagcatgctcagtctctcgacggcacaaccagctctagtatccccctatacagatccagcgaggaagaaaaaagggtaaccgttatcaaagcaccacattacccaggcatagggcccgtggatgagtccggcataccgaccgccatccgcaccaccgtggataggccaaaggactggtacaaaacaatgtttaaacagattcacatggtccacaagcccgatgatgacaccgatatgtacaataccccatacacctataacgcagggctctacaatcctccatactcagctcagtcacatcccgcggcaaaaactcagacttataggcccctctctaagtctcactcggacaattcccctaacgcatttaaggatgcctccagccccgtcccgccacctcacgtacctccccctgttcctccactgcgtccccgcgaccggagctcaaccgagaagcacgactgggatccacctgatagaaaagttgatactaggaaatttcgctctgagccgcgttccatcttcgagtacgagcccgggaaaagcagtatcctgcagcatgaaagaccaccccctcttccaaccacacccacacccgtgccccgcgaaccaggccgaaagccgcttagcagttctcgtctcggggaagttactgggagtcctagcccaccgccccgttccggcgcaccaactccttccagtagagcacctgcgctatcccctactcgcccccctaaaaaaccgctggactatgttcaggaccacagcagcggcgtcttcaatgaggcctcactgtaccaatcctccattgaccgcagcctcgaacgccccatgagttccgctagtatggcctccgactttaggaagcgccggaaatcagagcccgccgttggccctccccgtgggttaggcgaccagtccgcctcaagaacgtctcccgggagagtggacctgcctgggtcgtcaacaacgctcacgaaatccttcacaagttcaagtccttcctcgccctcgcgcgccaaggacagggagtcaccacgctcgtatagctccacccttactgacatgggacgaagcgcccccagagaaaggcgcgggacacccgagaaggaaaagttacctgccaaagctgtgtatgatttcaaggctcagacatctaaagagttgagttttaagaaaggcgacaccgtgtacatacttcgcaaaatcgatcaaaactggtatgaaggtgaacatcacggcagggtggggatcttcccaattagctatgtggagaagctcactccacccgaaaaggcacagccagcccgcccacctcccccagcccagcccggggaaattggagaggccattgccaaatacaatttcaatgctgataccaatgtcgaattatcactccgaaagggagatcgggtgatactgctcaagcgtgtggaccaaaactggtatgaaggaaagattccaggcacgaaccgacagggcatcttcccagtgagctatgtggaagtcgtaaaaaaaaatacaaaaggcgcagaggactatccggatcctccaatccctcacagctacagctccgatcggatacattctctctccagcaacaagccacagcgccctgtgttcacacatgagaacattcagggaggaggcgagcctttccaagcgctgtataactacaccccacggaacgaagatgaactggaactgcgtgaatcagacgtaatcgacgtcatggagaagtgcgacgatggctggttcgtaggcaccagcaggcgaaccaagttcttcggaactttcccaggaaattacgtgaagcgtttatag

SEQ ID NO: 16784 - DNA, 228 bp, Artificial Sequence
  Description of Artificial Sequence: Synthetic coding sequence
atgcggtactatggctcctactaccggggtctggggtatggatgtgggggtttcgggggcctgggatacgggtgcggttgtggagggtaccgctacggaagtggctatggcgggtacagatacggctgctgcaggccctcatgcagagagggctacggtttctccggatttaagaaactggccgactctcataccttaacccctaggtcctgcccatatgctagctag

SEQ ID NO: 16785 - DNA, 183 bp, Artificial Sequence
  Description of Artificial Sequence: Synthetic coding sequence
atggtcttaatcttaggacggagactgaatagggaagatctgggagtgcgcgactccccagcaaccaaacgcaaggtatttgagatggaccctaaatccttgacaggccatgaatttttcgatttctcaagtgggtcatcccatgccgaaaatattctccagatcttcaacgaatttagatag

SEQ ID NO: 16786 - DNA, 600 bp, Artificial Sequence
  Description of Artificial Sequence: Synthetic coding sequence
atgaaactcgggaagaaacctatgtacaagccagtggacccatattcccggatgcagagcacatacaactacaacatgcgcgggggagcctacccacccaggtacttctaccccttccctgttccacccctgctgtatcaggttgagttgtccgtgggcggacagcagtttaacggcaaggggaaaactcggcaggctgccaaacatgacgcagcagcaaaagcccttcgaatcttgcaaaacgagcccctacctgagaggctggaagttaatgggagagaatccgaagaagaaaatctaaataagagcgagatcagccaggtgttcgaaattgcgttgaagcgcaatctgcctgtgaacttcgagagctttcctctcaaacaggtggctagagagtctggaccaccccacatgaagaatttcgtcaccaaagtcagtgttggcgaatttgtaggggagggagagggaaagagcaagaagatttccaagaagaacgctgcaattgccgttctggaggagctgaaaaagctaccacccctcccagcagttgaacgagtgaaacctagaatcaagaagaagactaagcctattgtgaagtag

SEQ ID NO: 16787 - DNA, 2685 bp, Artificial Sequence
  Description of Artificial Sequence: Synthetic coding sequence
atgccagagcagttttcagttgccgagttcttggccgtaacagccgaggatctgtcctccccggcaggggccgcagctttcgccgcaaaaatgcccagatataggggagccgcacttgccagagaagagattcttgagggggatcaggccatattgcagaggatcaaaaaagctgttagggcaattcattctagtgggctgggtcatgttgaaaacgaggaacaatatcgagaagccgttgagagcctggggaactcccatttgagccaaaactctcatgagctgagcacaggtttcctgaacttagccgtgttcactcgcgaagttgctgcactattcaaaaatttaatccaaaacctgaataacatcgtttctttcccgctagactccttgatgaagggccagctgcgcgatggacggcaggcctccctgagtctcggaagtagggccaaactagagaaagaacgggatagagccagggtcaccggaggaatcccaggcgaggtcgctcaggatatgcagcgtgagagaagaattttccagctccatatgtgcgaatacctcctgaaggcaggtgagtcgcagatgaaacagggccccgatttcttgcagagtctgataaagttcttccacgcacagcataatttcttccaggatggctggaaggcggcccagtccctctttccttttatcgaaaagttggcggcaagcgtccatgccctgcaccaggcccaggaggacgagcttcaaaaattgacccaactgcgcgacagcctgagggggacacttcagctcgaatcacgcgaggaacacttatctaggaaaaattccggatgtgggtactctatccaccagcatcaaggtaacaagcagttcggcacagaaaaggtgggctttctgtacaagaagtccgacggtatccggcgggtgtggcagaaacgcaagtgtggtgttaaatacgggtgtctgaccatcagccactccacaatcaaccggcctcccgttaagcttactttgctgacatgccaggttcgccccaatcctgaagaaaaaaaatgctttgacctcgtgactcataataggacttaccacttccaggctgaggacgagcacgagtgcgaagcctgggtgtctgtgctgcagaatagcaaagatgaagcactgagctctgccttcctcggcgagccaagcgcgggccctggcagttggggctccgccgggcacgacggcgagccccatgatttgacaaaactgctaatcgccgaagttaagtctcgccctggcaattcacagtgctgtgactgcggcgcagccgatccaacctggctcagcacaaatctgggagtcctaacttgcattcagtgcagtggagtgcaccgggagttgggtgtgcggttcagccgcatgcaaagtctgactctggaccttttaggacccagtgagctgctgctcgcgttgaatatgggtaacacatcctttaatgaagttatggaagcccagctcccctctcacggtggtcctaagccaagtgccgagtcagatatgggtacaaggagagactacataatggccaaatatgttgaacatagatttgcgcggagatgtactcccgagcctcaacgtctttggaccgccatctgcaaccgggacctactgtctgtgctcgaggctttcgcaaacggccaggatttcggacagccactgccggggccagatgctcaggctcctgaggagctagttcttcacctcgcggtcaaagtggctaaccaggctagtctccccctggtcgacttcattatccagaatggtggacatctcgatgctaaggctgcagatggcaacacagccttgcactacgccgccctctataaccagcccgactgcctgaagctgcttctcaaagggcgggcacttgttgggacggttaacgaagctggcgagacagctctggacatcgctagaaagaaacaccataaggagtgcgaggagttgctggagcaggcacaagcaggaacattcgcctttcctctgcatgtggactacagctgggttatctccacggagcccgggagcgacagcgaggaagacgaggaggagaagagatgcttgctgaagctacccgcacaggctcactgggcatccggacggctcgacatctcaaacaagacatacgaaacagtagcctcactcggcgcggccacaccccagggtgagtccgaggattgtccccccccgctgcccgtgaagaactctagtcgcacgttggtccaggggtgcgctagacacgcatcaggtgatcgaagtgaagtcagcagcttatcgtctgaggcccccgagacccctgaatccctgggatctcctgctagcagcagttcattgatgtccccgctcgagccgggggacccaagccaggccccgcctaattccgaagaaggcttgagagagcctccaggtacatctcgccctagcttgacgtccggtactacgccgagtgagatgtacctgcccgttcggttcagctccgaaagtactcgctcctatcggcggggcgcgcggagtcctgaagatggaccctctgcacgacaaccacttcctaggcggaacgtgccagtcggcataaccgaaggcgatggctccaggaccggatcactccccgcctcatcagtccaactcctccaggattag

SEQ ID NO: 16788 - DNA, 354 bp, Artificial Sequence
  Description of Artificial Sequence: Synthetic coding sequence
atggctttctcagggcgcgcgcgtccatgcatcattccagagaacgaagagatccctagggccgccttgaacaccgttcacgaggcaaacgggactgaagacgagagagccgtgtctaagcttcagcgcagacattcagatgttaaagtatacaaagagttctgcgatttctatgccaagttcaacatggccaatgccctcgcctcagcaacgtgtgagcgatgcaagggcggtttcgcccccgccgagaccatcgtgaattccaacggggagctgtatcatgagcagtgctttgtttgtgcacagtgtttccaacagttccccgagggcctgttttacgaggaaagaacctag

SEQ ID NO: 16789 - DNA, 1797 bp, Artificial Sequence
  Description of Artificial Sequence: Synthetic coding sequence
atgttcgtgtctgatttcaggaaggaattctatgaagtggtccagtcccagcgggttttacttttcgtggcaagcgacgtggacgcactctgtgcctgtaagatcctgcaagccctcttccagtgtgatcacgtgcagtacaccttggtgccagtgagcggttggcaggaattggagacagcttttcttgaacataaggaacagttccactacttcattctgatcaattgcggggctaacgtggatctactagacattctgcaacctgatgaggatacaatctttttcgtctgcgacacacaccggccagtcaatgttgtcaatgtgtataatgatacccagatcaaactactaatcaagcaagacgacgacttggaggtgccagcttacgaggacatcttcagggacgaggaggaggacgaggaacatagtgggaacgattcagacggcagcgaacccagtgagaagcgaactagactcgaagaggaaattgtggagcagactatgagaaggaggcagaggcgcgagtgggaagcccggagcggctctggctccgaaccagttgccgccgcgctagaaaagagtagtagactgttcgctgggcccatgtctgaccgcaccgcccctaggagtcctcgacgcgacattctgttcgactatgaacagtatgaataccacggaactagcagcgccatggttatgttcgaattagcttggatgctttctaaagaccttaacgatatgctttggtgggccatcgtgggtctgactgaccagtgggttcaggacaaaatcacccaaatgaaatacgtaaccgacgtgggagtgcttcaaaggcacgtaagtcggcataaccacaggaatgaggatgaggagaataccctcagcgtagattgtacaagaatctcgttcgagtatgacctgcgcttagttctgtatcaacactggtcccttcacgatagtttgtgtaacacaagctacaccgctgcgcgtttcaaactctggagtgtgcatgggcagaaaagactgcaggaattcctggctgacatgggattacctctgaaacaggttaaacaaaaatttcaagccatggatatttctctcaaggagaatctgcgcgagatgattgaagaatccgcaaataagtttgggatgaaggatatgagggtacagaccttcagcatacactttggttttaagcacaagttccttgccagtgatgtggtgttcgcaactatgagtctcatggagtcaccggagaaagatggtagcggtaccgatcactttattcaagccctggactctttaagcagaagcaacctggataagctgtaccatggactggaattggcgaagaagcaattgcgggccacccaacagaccatcgcttcatgtttatgtacaaatctcgttatatctcagggtccttttctgtactgtagcttaatggaggggacgcctgacgtgatgctgttcagccgacccgccagtctgtctctattgtcaaagcacctcctgaagagttttgtgtgcagcaccaagaatagacgctgtaagctgctacctctagtgatggccgctcccctgagtatggaacacggaaccgtaaccgttgtgggcatcccccccgaaactgatagctctgatcgcaagaacttctttggtagggcctttgagaaggctgccgagagcacctccagcagaatgttacacaaccattttgacctgtccgtgatcgaactaaaggcagaagacaggagcaagtttctcgacgccctgatcagtctgttgagttag

SEQ ID NO: 16790 - DNA, 2994 bp, Artificial Sequence
  Description of Artificial Sequence: Synthetic coding sequence
atgccatcggagaagaagattagtagtgccaacgactgcatttccttcatgcaggcaggatgtgagcttaaaaaggtccggcctaatagtagaatttataatagattcttcacacttgacactgacctgcaggcgctgcgctgggagcctagcaagaaggatctggagaaagccaagctcgatatctcagctatcaaggaaatcaggctggggaaaaatacagaaactttccggaataatgggcttgcagatcagatttgcgaggactgtgctttctccatcctgcatggcgaaaattatgaaagtctggatctcgtggccaactcagccgatgtagcgaatatttgggtctcaggactgagatatttggtctcacgttcaaaacagcccctggattttatggagggtaaccagaatacgcctaggtttatgtggctcaagacggtttttgaggccgctgacgtggacggaaatgggatcatgttggaggacacttcagtggagcttattaagcaactgaaccctactctcaaagaggccaaaatacgactgaagtttaaggaaattcagaagtccaaagagaagctaaccacgcgggtcacagaggaagaattctgcgaggccttttgtgagctctgtacccgccccgaggtatatttcctgctggtgcaaatttctaaaaataaagaatatctggatgctaacgaccttatgctcttcctcgaagccgaacagggagtcacacacattaccgaagacatttgcctggacattatcagacgctacgagctgagcgaggagggccgccagaaagggtttctggccatcgacggctttacccagtacctgttgtcgagtgaatgtgacatatttgaccccgagcagaagaaagttgcacaggacatgacacagccattaagccactactatatcaatgccagtcacaatacttacctgatcgaagaccagtttcgcgggcccgctgatatcaacggttacattagggccttgaaaatgggatgccgatccgtggaactcgacgtgagtgatgggagcgataatgaacccatcctctgtaatcggaataacatgactacacacgtcagcttccggtccgtaattgaagtgatcaacaaatttgcttttgtcgctagcgagtacccactgattttgtgtcttggcaatcactgtagccttcctcaacagaaggtgatggctcaacagatgaaaaaagtgttcgggaacaagttgtacacggaagcccctttacctagcgaaagctatctgccaagcccggaaaaactgaaacggatgatcattgtgaagggcaaaaagctcccgtccgaccccgacgtcctggagggtgaggtgacagacgaagacgaggaggctgagatgagtcgccggatgagcgtggactacaacggcgagcaaaagcagataaggctgtgccgggagttatcagacctggtaagtatctgcaaaagcgtgcagtaccgggactttgagttatctatgaaaagtcaaaactactgggaaatgtgttcgttttctgagaccgaggcctctcgtattgctaatgagtaccccgaagattttgtgaactataacaagaaatttttatctcggatctacccaagcgctatgcgtatcgacagttccaatttgaatccccaggatttttggaattgcggctgccagatcgtggctatgaacttccagacgcccggcccaatgatggacctgcacacaggatggtttttgcagaacggcggttgtggttatgtgctgaggccctctattatgcgagatgaggtgagttacttttccgcaaacacaaagggcatcctgcccggagtgtcccctttggccctgcacataaaaatcattagcggtcagaacttcccgaagcccaagggcgcttgtgccaagggtgatgtgatagacccgtacgtgtgtatcgaaatccacggaatacccgcggattgctccgaacagaggacaaagaccgttcagcagaactcagataaccctattttcgacgaaaccttcgagttccaggtcaaccttcccgagctggctatgattagattcgtggtgctggacgacgactacataggagacgaatttatcgggcagtacacaatcccctttgaatgtcttcagcctggatatagacatgtgccactgcgatccttcgtcggcgatatcatggagcatgtcactctctttgtgcacatcgctatcacaaatagaagcgggggggggaaagcacaaaaaaggagcctgagtgtgcggatgggcaagaaagtgcgcgagtacacgatgctgcggaacataggtcttaagaccatagatgatatattcaaaatcgccgtgcaccctctgagggaagcaatcgatatgagagaaaacatgcagaacgcaattgtcagcattaaagaactttgcgggctcccaccgatcgcgtctctgaaacagtgcttgctgacactcagctctaggttgattacttctgacaacactcccagtgtatcccttgttatgaaagactccttcccttacctggaacctctgggggctattcccgatgtccagaagaagatgctgaccgcttacgatctgatgattcaggaaagtaggtttcttatcgaaatggccgacacagttcaggagaagattgttcagtgtcagaaagcgggcatggaatttcatgaagagttacacaacctgggcgccaaggaagggctgaaaggtcgcaagcttaacaaggcgacggagagcttcgcctggaacatcacagtactcaagggacagggggatctgttaaagaatgcaaagaatgaggctattgagaacatgaagcagattcagcttgcctgcctctcttgcgggctgtccaaggcgcctagcagttccgccgaggctaagtccaagagatcactggaagcaatcgaagagaaggagtcttcagaagaaaatggaaaattgtag

SEQ ID NO: 16791 - DNA, 612 bp, Artificial Sequence
  Description of Artificial Sequence: Synthetic coding sequence
atgcgcaatggtgatttcctgcccacgcggcttcaggcccagcaggatgccgtgaacatcgtgtgccactctaagacaagatccaatcctgagaacaacgtaggcttgataactttagcaaacgactgcgaggtacttacaactctgacacccgacacaggtcgcatcttaagtaaattgcacaccgtccagccgaagggcaagatcactttctgcaccgggatcagggttgcccacttggctttgaagcatcgccagggaaagaatcataagatgagaatcatcgctttcgtagggtcccccgtggaggataacgagaaagacctcgttaaactggcaaaacgcctcaagaaggaaaaggtgaatgttgatatcatcaattttggagaggaggaagtgaatacagaaaaacttactgcctttgtgaacaccttgaacgggaaggatgggaccgggtctcacctcgttaccgtgccgccagggccctctctggccgatgcattgatatcatctccaattctggccggcgaaggaggagccatgctgggcttgggcgcatccgactttgaattcggcgtagatccttctgccgaccctgaattagccctctag

SEQ ID NO: 16792 - DNA, 429 bp, Artificial Sequence
  Description of Artificial Sequence: Synthetic coding sequence
atgagtataagctctgacgaagtgaattttttggtgtaccgctacctgcaagaatctggcttcagccactccgcctttacctttggaatagaatcccacatcagccaatccaacattaacggagctttggtgcctcctgctgcactgatcagcattatacagaaggggctgcagtacgtggaagccgaagtaagcatcaacgaggacggaaccttgttcgacggtcgcccaatcgagagcctgagcctcatagacgcagttatgcccgacgtcgttcagacccgtcagcaggcatatagggataagctggctcagcagcaggctgccgccgccgcggccgcagcagctgcagcatcacagcaggggagcgcaaagaacggagaaaataccgccaacggcgaagaaaatggagctcacacaatcgcctag

SEQ ID NO: 16793 - DNA, 1410 bp, Artificial Sequence
  Description of Artificial Sequence: Synthetic coding sequence
atgtgctccctggctagtggcgctacagggtattcccacttgcttaaaaagcattttcatactgttagcttgagtattagcctcatcctgacggcctggttcattaacatgaatccgacagtggaatacatgaactccatttacaaccccgtgccttgggagaaggaggaatatctgaagccagtgctggaagatgaccttctcctgcagttcgacgttgaagatctgtatgaaccagtgtccgtgccattcagttatccgaatggtctgtctgagaacacatcagtggttgaaaagctcaagcatatggaagcaagggcacttagtgcagaggcagccctggccagagccagagaagatctacagaaaatgaagcagttcgcacaggactttgtaatgcatacagacgtgaggacgtgtagctctagcacttcggtgatcgctgatctgcaagaagatgaggacggcgtgtacttttcaagctatggacattatggcatccacgaagagatgcttaaagacaagatccggacagagagctaccgcgattttatctaccagaatccgcacatattcaaggataaggtcgtgctggacgtgggctgcggcaccggcattctgagcatgtttgccgccaaggcaggggcaaagaaggtgcttggggttgaccagtccgagatcctgtatcaagccatggacattatccggctcaacaaacttgaggacacgatcacattgatcaaaggaaaaatcgaggaggtgcacctgccagtggagaaagtggatgtaattatttcagagtggatggggtacttccttcttttcgaatctatgctggactcagtactgtatgccaaaaacaagtatctggccaaaggtggttctgtctacccagacatttgcaccatttcacttgtggccgtatctgatgtgaacaagcacgctgatcgaattgccttttgggatgatgtttacggattcaaaatgtcatgcatgaaaaaggccgttatcccggaagccgtggtggaggtgcttgaccctaagaccctgatttccgagccttgcggcattaaacacatcgactgtcatactacttcgatcagtgacctcgagttctcatcagacttcacgctaaagatcacaaggacctccatgtgcactgctatcgctggatactttgatatctacttcgagaaaaattgtcataatcgcgtggtcttctccacaggacctcagtccactaaaacccactggaagcagaccgtgttcctgcttgagaaacccttcagtgtgaaagcaggtgaagccttgaagggcaaagtcactgttcacaaaagcaaaaaagaccctcgaagcctgaccgtgactttaacgcttaataattctacacaaacctatgggctccagtag

SEQ ID NO: 16794 - DNA, 525 bp, Artificial Sequence
  Description of Artificial Sequence: Synthetic coding sequence
atggcttccgccggtacacagcactactcaatcgggctcaggcagaagaacagtttcaaacaatctggtccttccggtacagtccccgccaccccaccagagaagccatctgaagggagagtgtggcctcaggcccaccaacaagtgaagcctatctggaagttggaaaagaagcaggtcgagacgctgtcagccggcctcgggcctggactcctcggagtgccccctcagcctgcatatttcttctgtccttccacactctgttcctccggcaccactgctgtgatcgccggtcactcctccagctgttatctgcactctctcccagatctgttcaactctacgcttctctaccggaggagtagctaccgacagaagccctaccagcaactcgagtcattctgcctgcgaagttcccccagtgaaaaaagcccattttctctgccccagaaaagtctgcctgttagcctgacggccaacaaggcaacgagcagcatggtgttctccatggcgcagccaatgtag

SEQ ID NO: 16795 - DNA, 1572 bp, Artificial Sequence
  Description of Artificial Sequence: Synthetic coding sequence
atgcagaaagagcgcgagctgcaggaaaccatctactttaagaatacttggcctgcttgcatgtttctaatcgttgcacccttatccgtgctatacaactggaaggatgagctggatacttggggatacttcagggtcactgtgctgcacggaaatcgcaaggacaacgaattaatcagagtcaaacagcggaaatgtgaaatagcactcactacatacgaaacgttaagactgtgtctcgatgagctgaactctctagagtggtccgctgtgatagtggacgaggcccacaggattaaaaatccaaaagcacgtgtcacagaggtgatgaaggctctgaagtgcaatgtcagaatagggctcacaggaacgatcctgcagaacaatatgaaggagctctggtgcgtgatggattgggccgtccccggactcctcggatctggcacatactttaaaaagcagtttagtgaccctgtcgaacacggtcaacgacacacggccaccaagagggaattagccacgggcaggaaagccatgcagcggctggcaaagaagatgagcggttggttcctgaggaggactaagactttaatcaaagaccaacttccgaagaaggaggaccgcatggtgtactgtagtctcacggatttccagaaagctgtataccagaccgtccttgagacagaagatgttacactaatcctccagagttcagaaccttgcacatgccgatccggtcagaaaaggcggaattgctgttacaaaacaaattcccatggggagacggtcaaaacactgtacctgagctatctgaccgttctacagaaggtggctaaccacgtggctcttctgcaagccgcatcaacttccaagcaacaagagacattaattaaacgcatttgcgatcaggtttttagccgatttcccgatttcgtgcaaaagagcaaagacgcagccttcgagactctaagtgatcccaaatatagtgggaaaatgaaagttctccagcagttgctgaatcactgcagaaagaaccgcgacaaggttctgctgtttagctttagcactaaattgctcgacgtgctccagcagtactgcatggcttccggccttgactatcgcagactagatggttccacgaagagtgaggagcgtctgaagatcgttaaagagtttaattcgacccaagacgtaaatatttgcctcgtctcaactatggctggcggcctgggtctaaattttgtcggtgctaacgtcgttgttctgtttgatccaacatggaatcccgcaaatgacctacaagcgatcgaccgagcatacaggattggccagtgccgtgacgtgaaagtgttacggttgatttctctggggacagtcgaggagataatgtatctgaggcagatttataagcagcagcttcactgtgtggtcgtcggcagtgagaatgctaagcggtactttgaagcagtccaggggtctaaagagcaccagggcgagctgtttggaatacacaacttattcaagttcagatctcagggttcctgccttacaaaagatatattagaagtgtag

SEQ ID NO: 16796 - DNA, 1179 bp, Artificial Sequence
  Description of Artificial Sequence: Synthetic coding sequence
atgggtactacctgcctgcatttagggacgcttgagcagagtctagttttcgagaacaaggttaactccgagaaggtcaagctctctctcaggaactttccccacaatgactacgaggatgttttcgaagagccatcagagtccgggtcagacccttccatgtggacagcccgtgggccctttcggagagacaggtggagttctgaggacgaggaagcagctggcccttcccaggctttatcccctctgctttcagacacccggaagattgtgagtgaaggggagctggaccagctggctcagatccggccactaatttttaattttcacgagcaaacggctatcaaggattgtcttaagatcctagaggagaagactgcagcatatgatatcatgcaggagtttatggccctggagcttaaaaatctgccaggcgaattcaactccgggaatcaacctagcaatagggagaagaaccgttatagggacatattaccgtatgactccacgagggtgcctctgggaaaaagtaaggattacattaacgcctcttatattcgaattgtgaattgcggagaagaatatttctacatcgccacccagggacctctactgtccacaatagacgacttttggcagatggtgctggagaataactctaatgttatcgctatgatcaccagggagattgagggagggattattaaatgctaccactactggccaatttctctgaaaaaacccctggagctaaagcacttccgagtcttcctggaaaattaccaaatacttcagtactttatcatacggatgttccaggtggtagaaaaatccacaggcacatctcacagcgttaagcaactccagttcaccaaatggcccgaccacgggactcccgcctctgccgactcctttattaagtatatacggtacgcacggaaatcacatctaaccggtcctatggtggtgcactgttcagccggcataggacggacaggcgtgtttctgtgcgtggacgtagtgttctgcgccatcgttaagaattgcagttttaacattatggacattgtggcacagatgagggaacaacggtctggcatggtccagacaaaggagcagtaccacttttgttacgacatcgtcctcgaagtgctgcgtaagttgttgaccctcgattag

SEQ ID NO: 16797 - DNA, 1566 bp, Artificial Sequence
  Description of Artificial Sequence: Synthetic coding sequence
atggagcaaagttcactgtacttctgggacctgctagaagggtccgagaaggcggtagtcggtaccacctataaacaccttaaggacctgctgtcaaagctgctgaacagtgggtacttcgagtctataccggtgcccaaaaacgcaaaagagaaggaggtccctctcgaggaagagatgttgattcaatccgagaagaagacgcagctgagtaagaccgaaagcgtaaaggagtctgagagcttgatggagtttgcccaacctgagattcagcctcaagagttcctgaacagaaggtatatgacggaggtagattatagtaacaagcagggagaagaacagccgtgggaagcggactatgccaggaagcccaacctgcccaagcgctgggacatgctgacagaacctgatggccaggaaaagaaacaggaaagctttaaatcatgggaggcgtccgggaagcatcaggaggtaagtaagcccgctgtgtctctggaacaacgcaagcaagatactagtaaactgcgcagtactttgccagaagagcagaagaaacaggagatctccaagtcgaagcctagccccagccagtggaagcaggatacaccaaaatctaaggccggatatgtgcaggaggagcagaagaagcaggaaacaccgaagttgtggcccgtccaactgcagaaggaacaagacccaaaaaagcaaactcctaagtcatggacgccaagcatgcaatccgagcaaaacacaacgaagagctggacaacccctatgtgtgaggagcaggattcgaagcagcccgagacgcccaaaagctgggagaataatgtggaatctcagaagcattcattgacctctcagtctcaaattagccccaaatcttggggcgtcgccactgcaagtctcattcccaacgaccagttacttccaagaaaattaaatacagaacccaaagatgtgccgaagccagtgcatcagcctgttggttcctcctccactctgcccaaagacccagtcctccggaaagagaagttgcaagacttgatgacacaaatccagggaacatgcaactttatgcaagagagtgtgttggatttcgacaaaccatcatcagcgataccaactagtcagcctccttctgccacccctggttccccagtggcaagcaaggaacagaatctgtctagtcagtccgatttcctccaagaacccctccaagcagcgattccaccgggcaagcagcccagctccctcgcctcccctaaccctcctatggcaaagggcagcgagcagggatttcagagtccccctgcatcatcaagcagcgtgactattaatactgctccgttccaagcaatgcaaaccgtttttaacgttaacgcgcccttgccgccacgcaaagagcaggagataaaggaatcgccctattctcctggctataatcagtcttttaccacagcatcaacgcagacaccaccccaatgccaacttcccagcatccacgttgagcagacggttcactctcaagagaccgcgccaggcaaccatcacagcaccttctag

SEQ ID NO: 16798 - DNA, 480 bp, Artificial Sequence
  Description of Artificial Sequence: Synthetic coding sequence
atggccacctccgctcccctgcggagtctggaggaggaggtaacctgctccatttgcctggattatctaagagacccagtcactatcgattgtggccatgtattttgtcggagctgtacaacggacgtccgtccgatcagcggaagccgtcctgtttgtcccctgtgcaagaaacccttcaaaaaggagaacattaggcccgtatggcagttagaaaagatccttaaccatttgtccacactccgacgcgacagggataaaattcagggatttcaggccaagggtgaggctgacatactggccgcccttaaaaaattgcaggatcaacgacagtacatcgttgcagaatttgagcaaggccatcagtttttaagagaacgggaggagcatctcctcgagcagttggccaagctggagcaggagctgaccgagggaagagaaaaattcaagagcagaggcgtcggcgagttggcccgctag

SEQ ID NO: 16799 - DNA, 270 bp, Artificial Sequence
  Description of Artificial Sequence: Synthetic coding sequence
atgtccgagcagggcgacctcaatcaggccatcgccgaggagggcggcacagaacaagagaccgctaccccggagaacgggattgtgaaatcagaaagcctggatgaggaagaaaaactagagctgcaacggcgactggaggcacagaaccaagaaagacgcaagtcgaaatctggcgccggaaagggaaaattgacccgtagcttagccgtgtgcgaagaatccagcgcacggcccggaggcgagtctcttcaagaccagactctgtag

SEQ ID NO: 16800 - DNA, 1356 bp, Artificial Sequence
  Description of Artificial Sequence: Synthetic coding sequence
atggctgagggcgcccagccccaccagccaccccagcttgggcctggggccgcggccaggggaatgaaaagggagtctgaactcgaactccctgtgcccggtgctggaggtgacggcgctgatccgggactgagtaagcggcccagaactgaagaggccgctgccgacggcggaggtgggatgcagaacgaacccctcacacccggttatcacgggtttcccgcccgggatagccaagggaaccaggagccgaccactacccccgacgcaatggtgcaaccctttacgaccatcccattccctccgccacctcagaatgggattcccaccgagtacggagtccctcacacgcaggactacgcggggcagaccggagaacacaacctgaccctgtacgggtctactcaggcgcacggagagcagtcttccaactcacccagtactcagaatggttcgcttacacagactgaggggggtgcccagacggacggtcagcaatcacagacccagtcaagcgaaaattccgagagtaagtcaacccctaagaggctgcatgtgtcgaacatcccttttcgattccgggatccagatctccggcagatgtttggacagtttggtaagattctcgacgtggagatcattttcaacgagagaggctcaaagggattcggatttgtaacttttgagaacagcgccgatgccgacagggcacgcgagaagttgcacgggactgtggtggaaggccgaaagattgaggtgaataatgctacagcccgcgtgatgaccaataagaagatggtgacgccgtatgccaacggatggaagctctcaccagtagtcggcgccgtctacggccccgagctttatgccgccagcagttttcaggcagatgtgtccctaggaaacgatgcagcggttccattgagcggccgtggaggaattaatacctatattcccctgatttctctgccactcgtgcccggttttccgtaccccacagccgccacaacagccgcggcatttcggggtgctcacctgagggggaggggccgcacagtttacggtgccgttcgtgccgtgcccccaaccgcaatccccgcctatccgggagtcgtgtatcaggacgggttttatggcgctgacctttacggtggctatgccgcttacagatatgcccagcccgccacagcgacggcagcaacggccgccgctgccgccgctgcagcctactcagacggatatggacgggtctataccgccgatccttatcatgccctggcacctgctgcatcttatggagtaggcgctgtagcttctctctatcgtggaggatactctaggttcgcgccatactag

SEQ ID NO: 16801 - DNA, 855 bp, Artificial Sequence
  Description of Artificial Sequence: Synthetic coding sequence
atgttctctcgccgcagtcacggggacgtcaaaaaatcaacccagaaagtcctggaccccaagaaggatgtgttgactcgtctgaagcatcttcgagctctgcttgataatgtggatgcaaacgacctgaagcaatttttcgagacaaactacagccaaatctattttatattctatgaaaattttatcgccctggagaattccctgaaactaaaaggtaataacaagtcacagcgggaggagctggattccattctgttcctttttgagaagatcttacagttcctgcccgaacgaatcttctttcggtggcactatcagagtattggctccaccctgaaaaagctgctccataccgggaactccatcaaaatcagatgcgaaggaattcggttgttcttactatggttgcaagccctacagaccaattgtgccgaggaacaggttcttatcttcgcatgcctggtccctggattccctgcagtaatgagctccaggggaccatgtacgcttgagaccctaattaatcccagcccctccgtagccgacgtcaagatataccctgaagagatcacaccattgctcccggccatctcgggtgagaaaatagccgaagaccagacctgcttttttttgcaaattctcctgaaatacatggtgatccaagctgcctccctcgagtggaaaaacaaggaaaaccaggacaccggcttcaagtttttattcacactgttcaggaaatattacctgccccatctcttcccctctttcacaaaactgactaacatttacaaacccgtgcttgacatcccgcacttaagacccaaaccagtgtatataacaaccacacgctag

SEQ ID NO: 16802 - DNA, 846 bp, Artificial Sequence
  Description of Artificial Sequence: Synthetic coding sequence
atgggagacaccgtcgttgagccagcgccccttaaaccgaccagcgagccgacctctggaccccctggcaataacggaggtagtctcctatcagttatcaccgaaggggtcggcgagctgtccgtgattgatcccgaagttgcccagaaggcctgccaggaggtcctggaaaaggtcaagttactgcacggaggagtcgccgtgtcatccagaggcacaccactggagcttgtgaatggagatggggtggactccgagatccggtgtttggacgacccccctgctcaaattagggaggaggaggatgagatgggggctgccgtagcaagtgggactgcgaagggggctcggcggagaagacaaaataactcagcaaagcagtcatggctgctgcgcttgttcgagtctaaactgtttgacattagtatggctatctcctatctatacaatagtaaagagccgggtgtgcaggcatatataggcaaccggcttttttgctttcggaacgaggatgtcgatttctacctgcctcaattactcaacatgtacatccacatggacgaggacgtcggcgatgcaatcaagccttacattgtccaccgttgcaggcagagcatcaacttctccttacagtgcgctctgctgctgggggcatacagttcggacatgcacattagcactcagaggcacagtcgtggcacaaaactccgtaaactgattctgagtgatgaactgaagcctgcgcacaggaagagggagctaccatctctctcccccgctccagacaccgggcttagcccctcaaagaggacacaccagcggtcaaagagcgatgccactgcttag

SEQ ID NO: 16803 - DNA, 591 bp, Artificial Sequence
  Description of Artificial Sequence: Synthetic coding sequence
atggaggatctttttgaaacctttcaggatgagatgggtttctccaacatggaggacgatgggcccgaagaagaagaaagagtagctgagcctcaagctaatttcaacaccccacaagcactccggttcgaagaattgttagccaacctgctcaacgagcagcatcagattgccaaagagctgtttgagcagctgaaaatgaaaaaaccgtctgccaagcagcagaaggaggtagaaaaggtgaagccacaatgtaaagaggtgcaccagactctgattctcgatccagcccagcgaaagagactccagcagcagatgcaacagcacgtacagttactgactcagattcacttgctagctacatgtaacccgaacctgaatccagaagccagtagcacacgaatctgccttaaggagctcggaacctttgcccagagttccattgccctgcatcaccaatacaaccctaagttccaaacccttttccagccttgtaatctcatgggcgcaatgcagctgatcgaggacttcagtacccacgtcagcatcgactgttccccccacaaaaccgtaaagaagaccgtctgttag

SEQ ID NO: 16804 - DNA, 1620 bp, Artificial Sequence
  Description of Artificial Sequence: Synthetic coding sequence
atggcgacttcggcgcccctgcgctctcttgaggaggaggtgacctgcagcatttgcctggactatctacgcgaccccgtgacaatcgactgcggacacgtattttgtcggtcgtgtacgacagatgttcgcccaatatctggaagtaggccggtatgtcctctgtgcaagaagccattcaagaaggagaacatccgacctgtctggcaactcgcatcactggttgagaacatcgagagactgaaggttgataagggccgacagcctggtgaagtaacgcgtgaacaacaagatgccaaactgtgcgagaggcacagggaaaaattacactattattgcgaggacgatggaaagttgctgtgcgtcatgtgccgcgaaagccgcgagcaccggccacacacagccgtgctgatggagaaggccgcccagccccacagggagaagatcctcaatcatcttagtaccctgaggcgagaccgggataaaattcaagggtttcaggcaaaaggtgaggcagatattctagccgccttgaaaaagctgcaagaccagcgtcaatatattgtcgcagaatttgagcaagggcaccagtttctgcgcgaacgggaggaacatctgttagaacagcttgctaagcttgagcaggaactgactgaaggccgagaaaaatttaaatcgcgcggcgtgggcgagctggccagactggccctggttatctcagagctggaaggcaaggcacagcagccggccgccgagctaatgcaagatacccgggactttctgaacagatatcctcgaaagaagttctgggtaggcaaacccatagcccgcgtcgtcaagaagaagaccggcgagttcagcgataaactgttgagcctgcagaggggactgcgcgagttccagggaaagttactccgggatctcgagtacaaaacagtgtcagtcaccctggacccccaaagcgcctccggctatcttcagttgagtgaggattggaaatgcgtcacatacactagtctatacaagtcggcgtacttgcacccacagcagttcgattgcgagcctggcgtgctgggcagtaaaggctttacttggggtaaagtgtactgggaagtggaggtggaacgagaggggtggtcggaggatgaagaggagggtgatgaggaggaggagggcgaggaagaggaagaagaggaggaagccgggtatggagatggctacgacgactgggagacagacgaagatgaagaatcactgggagatgaagaagaggaggaggaggaggaggaggaagaggtgcttgagtcctgtatggtaggagttgccagggacagtgtcaaaaggaagggggatctgtcactgcggcccgaggatggtgtctgggccctcaggctatcttcttccggcatctgggccaacacatcgccagaggcagaactgttccccgcgctgcggcctcgaagagtgggcatcgctttggattacgagggcggaactgtgacttttaccaatgccgaaagtcaggagctgatttatacatttactgctaccttcactaggagacttgtcccttttttgtggttgaaatggcccggaaccaggttactgctgcgtccctag

SEQ ID NO: 16805 - DNA, 1086 bp, Artificial Sequence
  Description of Artificial Sequence: Synthetic coding sequence
gtgacgaccgaaaaaacatatacttcaacgtcaaataattccatctctggctctctcaagaggttagaggacacaactgctcgatttactaatgctaactttcaggaggtgtcagctcacacctcgtcaggcaaggatgtatccgaaacaaggggttccgaaggaaagggaaagaagagcagcgcccatagttcaggacaacggggccgcaaaccgggcggggggagaaacccaggcacaactgttagtgccgcgagcccgtttccacaggccgggtataagagggcccagaccagcggtatcgaagaggaaaccgtgaaggagaagaaaaggaaggggaataagcaaagcaaacatggtccaggaagacccaagggcaataaaaaccaagagaatgtctcccacctctccgtctcctctgcaagtcctacgtcatctgttgcttcagccgcgggttccattacgtcttcttctctccagaagtcccctacactgttgcgcaatggcagcttgcagagcttgtcggtcggatctagtccggtgggttccgagataagcatgcagtatcgccacgacggcgcctgccctacgactactttttcagaactgctgaatgcaatccataacgatcggggagacagcagcactctcactaaacaagagctgaagttcatcggaatatacaactctaatgatgttgccgtgtcatttccaaacgtggtgagcgggtcgggaagctcaaccccagtgtcctccagccaccttccacagcagtcgtctgggcatttacagcaggttggtgctcttagcccatccgcagtgtcgagcgctgcacccgctgtcgccaccacgcaagccaacacactgagcgggtcctcacttagtcaagctcctagccacatgtatggcaaccgcagtaattcgtctatggctgccttaatcgcacagtcagaaaacaatcagacagaccaggacctcggtgacaactcgagaaacctggtgggtcgaggcagttcacctagagggtctctgagcccaaggtcacctgtctcttcgctgcagatccgctatgaccaacctggttag

SEQ ID NO: 16806 - DNA, 426 bp, Artificial Sequence
  Description of Artificial Sequence: Synthetic coding sequence
atggcagccgcaccaccttcctactgcttcgtggcatttcctccccgcgcaaaagacgggctggtagtgttcggcaagaattccgctaggccccgtgatgaagtgcaggaggttgtctacttctccgccgcagaccatgaacccgaatctaaagtcgagtgtacctacatcagcatagatcaggtgccccgcacttatgcgatcatgattagccgacctgcttggctctggggggccgagatgggcgcgaacgagcacggtgtctgcatcgcgaacgaggctataaataccagagagcctgctgccgaaatagaggccctgctcggcatggatctggtccgtctcgggcttgaacgtggggagaccgcaaaagaagccctagatgtaattgttagtctgctggaagagcacggccaaggggggtag

SEQ ID NO: 16807 - DNA, 573 bp, Artificial Sequence
  Description of Artificial Sequence: Synthetic coding sequence
tagcagctggcagccctcaaagaaatccaggcagaggtgcaggagaaggaaagcgatgctgtcaaacccaaaaaccaggatattcagggtgggaaggcagctcctgccgaggcactgggaatcccagacgaacattacttagataacctttgcattttttgtggagaaaggtcagaatccttcaccgaagaggggctagatctgcactattggaaacactgtctcatgctcacccgctgtgatcactgtaaacaggtggtggagatctcctcactcacagaacacctgctcaccgagtgtgataagaaagatggattcggaaagtgctaccggtgctcagaagccgtatttaaagaagaactacctcggcacattaagcacaaagactgcaatcccgctaagccagagaagctagctaacagatgccccctttgccacgagaatttcagtcctggagaggaggcctggaaggcccacctgatgggcccggctggttgcaccatgaacctccgcaagacccacatactgcaaaaggcccccgcacttcaacctggagaggggcagcgccggtag

SEQ ID NO: 16808 - DNA, 723 bp, Artificial Sequence
  Description of Artificial Sequence: Synthetic coding sequence
atgacggtggggaagagtagtaaaatgttgcagcacattgactacagaatgaggtgcatattacaagatggcagaatattcataggcaccttcaaagctttcgataaacacatgaatctgattttgtgcgactgcgacgaatttcgaaaaatcaagccgaagaacagtaaacaagccgagagagaggagaagagagtcctcgggttggtgctcctgcgtggcgaaaacctggtgagcatgaccgtggaggggcctccgcctaaggatacaggaattgctcgcgtgcccctggcaggcgcagccggcggtcccggtatcggccgcgcagctgggcgcggaatccctgctggagtgccaatgccacaggcccctgccggactggccggccctgttcggggcgtgggtgggccaagccagcaagtaatgacccctcaggggaggggcaccgtggccgcagcagctgccgctgccaccgcttcaattgcaggggcgccgacccagtacccacccgggcgcggtggccctcccccccctatgggccgcggcgccccacccccagggatgatgggccccccaccaggcatgagacctcccatgggccccccaatgggcataccgcccgggaggggcacacccatgggcatgccccctcccggaatgagaccaccacctccagggatgagagggccccctcctcctggaatgcgccctccccgcccatag

SEQ ID NO: 16809 - DNA, 420 bp, Artificial Sequence
  Description of Artificial Sequence: Synthetic coding sequence
atggaaacagattgcaaccccatggaactcagctccatgtcaggtttcgaagaagggtctgaactcaatggttttgaaggcaccgatatgaaggacatgcggttggaagccgaagccgttgtgaatgatgtcctgtttgcagtaaacaatatgttcgtatccaagtccctgcgatgtgccgacgatgtggcatatataaacgtggagaccaaagagcgcaaccgttattgcttggagctgacagaagctgggctgaaagtggttggctacgctttcgaccaggtggatgaccatcttcaaaccccttaccacgaaacggtgtactccctcctggataccctgagccctgcctaccgggaggccttcggcaatgctttgctgcagaggctcgaggccctcaagcgagatggacagtcctag

SEQ ID NO: 16810 - DNA, 606 bp, Artificial Sequence
  Description of Artificial Sequence: Synthetic coding sequence
atggccggcctggaagtcctgttcgccagtgcagctcctgctattacctgcaggcaggatgccttagtgtgttttctgcattgggaagtagtcacacacggctacttcggtctgggcgtgggcgaccagcccggccctaacgataaaaagtccgagttgctccccgccggctggaacaataacaaggacctatatgtcctgaggtacgaatataaagacgggagtcgtaagcttctcgtgaaagcgattacagtggagtctagcatgattttaaacgtgctggagtatggtagccagcaggtcgccgacttaacactgaatctggatgactacatcgacgccgaacatctgggggattttcataggtgcgacccactgggtcctttcgtggtgggaggagaggaccttgacccctttggccccaggagggggggaatgattgtcgatccactgcggtcgggattcccacgggctctgatcgacccgagtagcgggctacctaaccgtctgcctccgggtgctgtgccaccgggtgctcgctttgatccatttgggcctattggcaccagcccccccgggccacgcccagacagaaggggccagtag

SEQ ID NO: 16811 - DNA, 747 bp, Artificial Sequence
  Description of Artificial Sequence: Synthetic coding sequence
atggctaccagcgcaccattgcgttcattggaagaagaagtaacttgcagcatctgcctcgattatctgcgtgatcccgtgacaattgattgcgggcatgtgttttgtcgcagttgtactaccgacgtacgacctataagcggcagcagaccagtgtgtcccctgtgcaagaaacccttcaagaaggagaacattagacctgtgtggcagctcgcctcgctggttgaaaacatcgagcgcttaaaggtggacaagggccgtcaacctggtgaggtcacacgggaacaacaagacgcgaaattatgcgaaagacatagggaaaagctgcactactattgcgaggacgacgggaagcttttgtgcgtaatgtgcagggaaagcagagagcaccggcctcatactgccgtccttatggagaaagcggctcagcctcatcgggagaaaatactcaaccatcttagtaccctgaggcgcgaccgcgataagattcagggttttcaggcaaaaggtgaggccgatatcctggccgctctgaagaaactgcaggaccagcgacaatacatagttgctgaatttgagcaagggcaccaatttctaagggaaagagaagagcatctgctggagcagttagccaagttagagcaggagctgactgaaggtcgggaaaagttcaagagtagaggagttggagagctggctagactggccctggttattagcgagcttgagggcaaagcccagcagtag

SEQ ID NO: 16812 - DNA, 1842 bp, Artificial Sequence
  Description of Artificial Sequence: Synthetic coding sequence
atggcaactatcccagattggaaattgcagctgttagcccgaagaagacaagaggaagcaagtgtccggggcagagaaaaggctgagagagagaggctgagccagatgccagcttggaagcgagggctactggaacggaggcgtgccaaactgggactgtctcccggcgaaccttcaccagtgctgggaacggtggaggccggaccacccgatccagatgagtccgcggtgctgctggaagctatcggcccagtgcatcagaatcggttcatccgccaagagagacaacagcaacagcagcagcaacaacgaagcgaagagctactagctgagcggaaaccaggacccctcgaagcccgggagagaagaccttcccctggagaaatgagagatcagagccccaaggggcgcgagtcccgggaggaaagactcagtccacgggagacacgagagaggcgtctgggtattggcggcgcgcaggagctgagtctgaggcccctggaggccagggattggaggcagtcgcccggcgaagtgggagataggtcttctcgactcagtgaagcctggaagtggcggctctccccaggcgagactccagagaggtccctgaggctcgccgagtcccgggagcagtccccccgtaggaaggaagttgaaagccgcctttcccccggagagtccgcctaccagaagctgggactgaccgaggcccacaaatggaggccggacagccgagaatctcaagagcagagcctcgtgcagttggaagctacagagtggagactccgtagcggggaggaaaggcaggattattccgaggaatgcggtagaaaggaggagtggcctgttccaggggttgcgcctaaggaaacagcagagttgagcgagacgctcaccagggaagcccaaggcaattcttccgccggagtcgaggccgccgagcaaagacctgtcgaggatggggaacgaggaatgaagcccacagaaggctggaagtggaccctcaatagtggaaaggcacgcgagtggacgccacgggacattgaggcgcaaacccagaaaccagagcctcccgaaagcgcagagaagctcttagagagtcctggcgtagaagccggcgaaggagaggccgagaaagaggaagctggagcacagggacggcctttaagggcactgcagaactgctgttcagttccatctccacttcctcctgaggacgccgggaccggaggtctgcgtcaacaggaggaggaagcagtggagttgcagcctcccccccccgcccctcttagcccaccccccccagcgcccaccgcccctcagcccccaggggatccgctgatgtcacgacttttttacggtgtgaaggcaggccctggcgttggcgccccacggagatcggggcacacttttacagtgaaccctaggaggtcggtaccccccgccacacccgccaccccaacctctccagctactgtggatgcagcagtgccaggtgccggaaagaagcggtacccaaccgctgaggaaatccttgtgctcggaggatatcttcgcctctctcggtcctgcctggccaaaggaagccctgaacgccatcataagcagctgaaaatcagtttctctgagactgccctagagactacataccagtacccatcagagtcaagcgttctggaggagctcggtcctgagcctgaggtcccaagtgcacccaatcctcccgccgcccagccagacgacgaggaagacgaggaggagctgctactccttcaacctgagctccagggaggcctccggacaaaggctctcattgtggatgaaagctgccgacggtag

SEQ ID NO: 16813 - DNA, 1620 bp, Artificial Sequence
  Description of Artificial Sequence: Synthetic coding sequence
atggctacaagcgcccctctgcggagcctagaagaagaagtgacctgttctatctgtctggactatttacgtgaccccgtgacgattgactgcggccacgtgttttgcaggtcatgcacaactgacgtcagaccaataagtggctcccgccccgtctgtccactttgtaaaaagccgttcaaaaaagaaaatatcagaccagtatggcagctggcctccctcgtggagaatatcgaaagactgaaggtcgacaaaggccgacagcctggggaggtgactcgcgaacagcaggatgctaaattatgcgaaaggcaccgggagaagctgcactattactgcgaggatgatggcaaactgctctgcgtgatgtgccgggaatctcgggaacacaggccccatacagcagtcctgatggagaaggcggcgcagccgcacagggagaaaattctgaatcacctctctactctgagacgcgatagagacaagatccagggcttccaggcaaagggagaagccgatattttagccgccctcaaaaagttgcaagatcagaggcagtacattgtcgctgaatttgagcagggacaccagtttcttagagaaagagaggaacatctgctggaacaattagccaagctggagcaggaactgactgagggtagggagaagttcaaatctcggggggtgggcgaactggctagattagcactggttatatctgagctggaagggaaggcgcaacaacccgctgctgaactgatgcaagacacccgtgatttcttgaatagataccccaggaagaaattctgggtgggcaagcccatcgcgagagtcgtgaagaagaagacaggagaattctctgacaagttactgtctctgcagagaggcctgcgggagttccaagggaagctgcttagggacctagagtacaagaccgtctctgttacactggatcctcagtccgcctctggttacctccaattgagcgaggactggaagtgcgttacttacactagcctatataagtccgcttatctgcacccacaacaatttgattgcgagcctggggtcctgggatccaaaggcttcacatgggggaaagtctattgggaggtggaagtcgaacgggaaggttggtccgaagatgaggaggaaggagatgaggaagaagaaggggaggaggaggaggaagaggaggaggccggctacggagacggttacgacgactgggagaccgacgaggatgaggaaagtctgggcgacgaggaggaagaggaggaggaggaagaggaagaagtgttggagtcctgtatggtgggagtggctagggattcagtgaagaggaagggggacctgtctttgagaccagaggacggcgtatgggcactacgactgtcttcctcgggaatttgggcaaatacgagtcctgaggctgagctgttcccggcgttgaggccccggagggtgggcattgccctcgattatgaagggggcactgtgacctttaccaatgctgagtcgcaggagctcatctatacctttaccgctacatttacccgccggctcgtcccattcctgtggctgaagtggcccggcaccagacttttactgagaccctag

SEQ ID NO: 16814 - DNA, 1089 bp, Artificial Sequence
  Description of Artificial Sequence: Synthetic coding sequence
atggctcccaagccaggtgctgaatggtccacagccctcagtcatctcgtccttggtgttgtgtcactccatgccgcagtatcgacggctgaggccagccgtggcgctgcagctggattcttactgcaagtccttgcggctacgaccacccttgcaccagggttatcaactcatgaggactgtcttgcaggcgcttgggtcgcaaccgttataggattgcctctactggcttttgatttccactggtgcacaaatggacacctgatgtgtgccggttgtttcatccaccttctagccgatgcccgtctgaaagaagagcaggccacttgccctaactgtcggtgtgagatctccaagtcactgtgttgtcgcaacttggctgtcgaaaaggcagtgtcagaactgccgagtgagtgcggattctgtcttcggcaattcccccgatctctgctagagagacaccagaaagaagagtgtcaagatcgcgttacacagtgtaaatacaagcgtataggatgcccttggcatggcccattccatgagttgactgtccacgaggcagcttgcgcccacccaaccaaaacaggcagcgagctgatggagattctagatggtatggatcagtcacatcgtaaggaaatgcagctgtataactccatcttcagcctgctgtcctttgagaaaattggatacaccgaagttcagtttcgcccgtaccgaaccgatgacttcattaccagattatactacgaaacaccacgctttaccgtccttaaccagacgtgggtgctcaaggcaagggtcaatgacagtgagcggaatccgaacttatcttgtaagcggacactctccttccagttgctgcttaagtccaaggtgactgcacctctggaatgcagctttctcctcttaaaaggaccgtacgacgatgtccggatcagcccagtgatttatcacttcgtgttcaccaatgagtccaatgaaacagactatgtcccgctgcccataatcgattccgtggagtgtaacaagctactggctgccaaaaatattaatctgaggctgtttctgttccagattcagaagtag

SEQ ID NO: 16815 - DNA, 273 bp, Artificial Sequence
  Description of Artificial Sequence: Synthetic coding sequence
atggccatggcaccctctcccagtctggtccaagtttatacatcacccgcagctgttgctgtttgggaatggcaagacggcctcggaacctggcatccttacagcgctactgtttgtagttttatcgagcagcagttcgtgcagcagaaagggcaacgatttggacttgggagtctggctcatagtataccactgggtcaggccgatccctcactggccccgtatataatcgaccttccatcctggactcagttccgacaggatactgggtag

SEQ ID NO: 16816 - DNA, 2502 bp, Artificial Sequence
  Description of Artificial Sequence: Synthetic coding sequence
atggctgtggaggattccaccctgcaggtggttgttcgtgtcaggcccccgacgcctcgagaactcgacagtcagcgtcgacctgttgttcaggttgtggacgagcgagtcctcgtatttaacccagaagaacccgacggaggttttccaggactgaaatggggaggcacccacgacgggcctaagaagaaaggcaaggatctaacattcgtgttcgacagagtcttcggtgaggctgccacacagcaagacgtctttcagcatacaacacatagtgtactggactcctttcttcagggatacaactgttctgtttttgcctatggagctacaggggccggtaagacgcataccatgctgggtcgggaaggagatcccggtattatgtacctgaccaccgtggaattgtacaggcgcctggaggcccggcagcaggagaagcactttgaagtgttaattagttatcaggaggtgtacaacgaacagattcatgatcttctcgaaccgaaaggtcctttagccattcgcgaagacccggataaaggcgttgttgtgcagggactaagtttccatcaaccagcctcggcagaacagcttttggagatcttaactagaggtaataggaaccggacccagcatcccacagacgctaatgcgacttcgagcagaagccacgccatattccagatcttcgtcaagcagcaggaccgagtcccaggattaacccaagccgttcaagtcgccaagatgtctctcattgatctggcgggatccgagcgggcctccagcacccatgccaaaggtgagagacttcgcgagggggccaacattaaccgatctctcctcgcattaattaacgtacttaacgccttagctgacgcaaaggggcggaagacccacgtcccttatcgggattccaaactgactaggctgctgaaagactctctggggggcaattgccgcacagtgatgatcgctgccatcagccccagcagcttgacatacgaggatacctataacaccctcaaatacgcggatcgcgccaaggagatacgcctttccctgaaatccaacgtgacatcgctagactgtcacatcagccagtatgctacaatctgccaacagctccaggccgaggtggccgcactccggaaaaaactccaggtttatgaaggagggggccaaccgccacctcaggatctaccgggatctcctaaaagcggccccccccccgagcacctccctagctccccactgccaccccacccaccgtcgcagccgtgtaccccggaactgcccgctggacctcgggctctgcaggaagagagcctaggcatggaggcccaggttgaacgtgcaatggagggtaactccagcgaccaggagcagagcccagaggacgaagacgaagggcccgctgaggaggtgcccacacagatgcccgagcaaaatcctacacacgccttacccgagagtccacgcctcaccctgcagcccaaacccgtggtgggtcacttcagcgcccgagaattagatggcgaccgaagcaagcaactcgctctgaaggtgctttgtgttgctcaaaggcagtatagcctgctgcaggcagctaacctgctaactccggatatgatcacagaattcgagaccctgcaacagctcgtacaagaagaaaaaatcgagccaggtgccgaggctcttcgcacatctgggttggcacgcggagccccactggcacaggagctttgcagcgagagtataccagtgccctcacccctctgccccgaaccacccggctatactggacctgtgactagaaccatggcacgccgcctgagtgggcctctgcatactttaggcataccgccaggccccaattgcactccagctcaaggatcacgctggcccatggaaaagaaacgtcggagaccttcagccctggaagccgactccccaatggctccaaagaggggtactaaaagacaaagacagtcatttctgccttgtcttaggcggggatctctgcctgacacacagccttcccagggtcccagcactcctaaaggtgagagggcctcctctccttgccacagtccacgagtgtgccctgctaccgtgatcaagtctagagtccccctgggcccgtccgctatgcagaattgttccactccgttagctctcccaacgcgggacctgaatgctaccttcgacctctcagaagagccccccagcaaaccctctttccatgaatgtatagggtgggataagatccctcaggagctatcgcggttggaccagcctttcatcccgagagctccagtgcccctcttcacaatgaagggccctaagccaacatcctctctgcccggcacttccgcctgtaaaaaaaaacgggttgcctcatctagcgtctcgcacggaaggagcagaatagccaggttaccttcatcaacactcaagcggcccgccggcccgctcgtcctcccgggagattggcattag

SEQ ID NO: 16817 - DNA, 1842 bp, Artificial Sequence
  Description of Artificial Sequence: Synthetic coding sequence
atggcaaccatccccgattggaaattgcagctccttgcacgccgtcgccaggaggaagcctccgtcagggggagggagaaggccgagcgcgagcgcctttcccagatgcccgcatggaaaagggggttgctggaaagacgacgggctaagttgggtctaagtcccggggagccctcccctgtgcttggcacagtggaagcagggccaccagatccggacgaatccgctgtgttgctcgaagccattggccccgtacaccagaaccgcttcattagacaggaaaggcagcagcagcagcagcaacagcagagatcagaggagcttttagctgagcggaagcctgggccactggaggccagagaaaggcgaccgtcccctggagagatgagagatcagtccccaaagggaagagagagcagagaggaacggcttagccctagagagacaagggagcggcgcctaggcatcggcggtgctcaggaactttccttacgtcccctggaggcacgggactggaggcagtcacccggcgaggtaggggatagatcctcgcggctttcggaagcctggaaatggaggctctcacccggcgagacaccagaacggagcctgagactggcggaaagtcgagagcagtcccctagaagaaaggaagtagagtcacgactgagtcccggcgagtccgcgtaccagaagctgggcctgactgaggctcacaagtggaggcccgatagcagggagtctcaggaacaaagcttagttcaactcgaagccaccgaatggcgactgcgctccggcgaagagcggcaggactattcagaagagtgcggtcgcaaggaggaatggccagtccccggggtggccccaaaggaaaccgctgagctgagcgagaccctgaccagggaggctcaagggaatagttcagctggcgtggaagctgcagagcagagaccagtagaggacggcgaaaggggcatgaaaccaacagaagggtggaaatggacacttaattctggtaaagcacgagaatggactccccgagatattgaagctcagacgcagaagccagaacctcctgaatccgccgagaaacttctagaatcaccaggagtcgaagccggcgaaggagaagcggaaaaagaagaagcgggagctcaggggagacctctcagggccctacaaaattgctgttcagtccctagcccactccctcctgaggacgccggaacgggtgggctgcgccaacaggaggaggaagccgtggagcttcagcctcctcctcctgcccccctctccccaccaccccccgcacccaccgccccacaacccccgggagaccccctgatgagccggctattttatggagtgaaggcggggcctggagtcggcgcacccaggcggagcggccacactttcacagttaatccgcgcaggagtgtcccaccagccaccccagccacgccaacgagtcccgcaaccgtcgatgcagccgtgcctggcgctggcaaaaagcgatatccgaccgcagaagaaatactggtattgggcggctatctgcgactgtcccgctcatgtctggccaaggggagcccggagagacaccataagcagctgaagatttcattttccgaaacggccttagaaactacttaccagtaccctagcgaaagttccgtattggaggagcttggccctgaaccagaggtgcctagcgcgcccaacccacccgctgcccagcctgacgacgaggaggatgaggaagaactgctccttctgcagcccgagctgcagggcggccttcgcacaaaggctcttatcgtggacgagagctgtcgacggtag

SEQ ID NO: 16818 - DNA, 654 bp, Artificial Sequence
  Description of Artificial Sequence: Synthetic coding sequence
atgaattcacagccacaaacgagaagtccctttttccagaggccgcaaattcaaccgccccgagctacaatacccaattcaagcccttcaataaggcccggtgcccagaccccgacggccgtgtaccaagccaatcaacatatcatgatggttaaccacctcccgatgccgtatccggtgccacaggggcctcagtactgtatcccccagtaccggcattctgggcccccatatgtaggccctccgcagcaatacccagtgcaaccacctgggcccggtccattttacccggggcccggcccaggagatttccccaatgcatatgggacaccgttttatccttcccaacccgtgtaccaatccgccccaataattgtgcctactcaacagcagcctcctccagctaagagagagaagaagactatccgcatccgggatccaaaccagggcggaaaagatatcactgaagagattatgtctgggggcgggtctcgtaatccgacacctcccatcggccggccaacatccaccccgactccaccgcaacaattaccctcacaagttcccgaacatagtcccgtcgtttacggtaccgtagagtccgcccatctggcggcatccactcccgtgacggccgctagtgaccagaagtag

SEQ ID NO: 16819 - DNA, 969 bp, Artificial Sequence
  Description of Artificial Sequence: Synthetic coding sequence
atgtacttttgctggggggccgatagccgagagttacagcgccggcgtacagcgggctccccgggcgctgagttgctccaggcagcttcaggcgaacgtcactctctgctccttctgacgaatcatcgcgtgctcagctgtggagataacagccgcgggcagttaggccgtcgcggcgcgcagcggggcgagctccctgaacctatccaggcactggagacgctaatagtggatctggtgtcctgcggcaaggagcatagtctcgctgtttgtcacaagggccgggtgttcgcatggggcgcaggcagcgagggccagttaggtattggcgagtttaaggaaatctcatttacgccaaagaaaatcatgaccctgaatgacatcaaaattatccaggtgtcgtgtggccactaccatagtctggccctgtctaaagacagtcaggtgttctcatggggaaaaaactctcatggacagctcggtttaggaaaggaatttccttctcaggctagtccccagcgtgtcaggtctcttgagggcattcctttagcgcaagtcgcagcaggcggggcacatagttttgctctgagcctctgcgggacttcctttggatggggcagtaattctgccggtcagctagccctgagtggaagaaacgttccggttcaatctaataagccactcagtgttggagctctgaagaatttgggagtagtgtatatttcatgcggggatgcacacaccgctgttctgacccaggatgggaaggttttcacattcggggacaataggtccggccaactagggtattctcccacccccgagaagcgaggcccgcagttggtcgagcgcattgatgggcttgtgagccagatcgattgtggcaggcttcgcgggtgtagttctcagactcatttttgctggaacatctgtcagctgtgtgacaactccagcgtaaagctcgagtag

SEQ ID NO: 16820 - DNA, 1743 bp, Artificial Sequence
  Description of Artificial Sequence: Synthetic coding sequence
atgcgggccctgactgtgcagcgcgtgaagtttgccatggatcttcctttactcaaaagggcaggccaggacctagctgaaaaaaccaaaaattttgtgtctaggagtctggtgatcggggaggtgctgtctatggcagacatggcgaccggtgttaagtgtggcatcatctactggctattcggcggggcaatcagaaatctgggctccccagaacacgtgaccaaatggttccaacccctccaggagcaaaaatacacaggtatgtttgccatgaccgaaagagggcacggctccaatgcaagaggaatccaaactgaagccacatttgatttgtcagcccaagagttcgtaatcgatactccctgcgagaatgcagagaagatgtacataggaaacgccatgtatggcaactatgccgccgtcttcgcgcagctgattatcgatgggcgatcgcaggggcctcattgtttcatagtcccagtaagggacgagaacggtagcctctatccaggtgtgacagcgatcgatatgatgtacaaggagggtctccacggtgtcgataatggcatcttgatttttgataaagttcgtattccacgtgagaacttactggacaaatttggttccgtcgcccctgatgggcagtaccattcccccataaggaataaatctgctaggttcaacgccatgttggccgctctcactccttcacgtctggcagtggcatttcaggccatgggggccatgaagcttggactcactattgccattcgctatagccattcccgacgccagttcgggccaaaaaccaaggaggaggtcaagatcatcgaacaccaaacccaaactttaaggctgatgcctcacctggcgacagctcttgcgttgacttttgtgtctcggtacgctggtgcccttcttgatgaggatgtctttcaggggaaggagctagtgaacagccgttccctccaggcccttgtggctggcctcaaagcctacagtacctgggaaaatatccgctgcctacaggactgtcgggagtgtactgggggtatggttgttgggcgggagctcctggcacaatataccaaacagtatgaggagaagcctctttttggcctgctgcaaaattgggccgaatccgttggggataaactcaggacctctttcctagcttttaatatggacacggtggacgacctggcctttctgcttaaagcggtaaagtttcgcgaacgggttctacagcggggtctggtggcaagaatttattataaagtcaagactaagaaagaagacttcttccacgcatggaacagttgtttgcatcatgtcgctagtctgtcactggcccatactcatagagtgactcttgagcaattcagtcttgcagtgaagagttgccccgatcaggaggatcaaaccctgttgatgaaattctgccttttatacggcactaagcttgtgttccaagaaagagcttggtacctagaacataaatacctcaccccgatggcctcgacccggattcgaaaccaacttctggatctgtgtgactccgttaaagacgatgccaggagggtgattagtacgttcaacatcccccatacgtatctgcatgcacccatagccggtatttccaatccaagagctgcatgggccttttaccctgcgcccctgcagccgagaccgcgcgaagaggcccgcagtagaagaccaaagctgggggcaaagctctag

SEQ ID NO: 16821 - DNA, 561 bp, Artificial Sequence
  Description of Artificial Sequence: Synthetic coding sequence
atgggggtgaaccagtctgtggggttcccgcccgtcacagggcctcacctggtcggatgtggtgacgttatggagggccaaaacttgcaagggagctttttccgcctgttttacccttgccagaaggcagaagaaaccatggaacaaccattatggattccacgatatgagtattgcaccggcttggcggaatacttgcagtttaacaagcggtgtgggggcttgctttttaatctcgcggttgggagttgtcgacttcctgtgagctggaatgggccctttaagaccaaagattcaggatacccacttattatcttctcccacggccttggggcattcaggacactgtactcggccttttgcatggaacttgcttcgcgtggctttgtggtggcggtgcctgagcacagatgtgtctatttcagggatcggtcggctgcaactacttacttttgtaagcaagcccccgaggagaaccagccaaccaacgagagcctgcaggaggaatggattccttttcgccgcgttgaggaaggtgaaaaggaattccacgtgaggtag

SEQ ID NO: 16822 - DNA, 1620 bp, Artificial Sequence
  Description of Artificial Sequence: Synthetic coding sequence
atggccacatcagcccctctccgatcccttgaggaggaggtgacctgttctatctgcctcgactaccttcgcgatccagtcaccatcgactgcggccacgtgttctgccgctcctgcactaccgacgttcgcccaataagcggctctaggccagtttgtcctttgtgtaagaagcccttcaagaaggagaacattcgcccagtgtggcaattggcgtccctcgtggaaaatatcgagcgcttgaaagtggataagggaaggcagccaggagaagtgacacgggagcagcaggatgccaaactgtgcgaacgccacagagaaaaattgcactattattgcgaggacgacggcaaactgctgtgcgtgatgtgtagggagagccgagagcatcgcccacacaccgccgtcctcatggagaaggccgctcagccacacagagaaaagattctgaatcacctgtcaactcttaggagagacagagacaagatccaaggatttcaggctaagggagaggctgacatcttagccgctcttaaaaagctgcaggatcagagacaatatatcgtggctgagtttgagcaaggtcatcagttcctccgcgaacgagaggaacacctgttggaacagctggctaaattggaacaggagttgacggaggggcgggagaaattcaaaagccgaggcgtcggcgagttggctaggctggcactggtgatctccgagcttgagggaaaggctcaacaaccagccgccgaactgatgcaggatactcgggactttctgaaccgatacccccgcaagaagttctgggtcgggaaacctatcgcacgcgtggtgaagaagaagactggcgaatttagcgacaaactgttgagcttgcaacgggggctccgggaatttcagggaaaactcctgcgcgatctcgaatacaagactgttagtgtcacactggatccccagtctgcatccggctatcttcagctatccgaagattggaagtgcgtgacctatacttcgctgtacaagtcagcatacctacacccccagcagtttgactgcgagcccggcgtgcttggctccaaagggttcacctggggtaaagtgtactgggaggttgaagtggagcgggagggatggtctgaagacgaagaagaaggagatgaagaagaagagggcgaagaggaggaggaagaggaggaggcgggttacggcgacggttacgatgactgggaaaccgatgaggatgaggagtccttgggggatgaggaggaagaagaggaggaagaggaagaggaagttctggagtcttgcatggtaggagtggctagagactcggtgaaaaggaagggcgacctgtcattgaggccagaggatggcgtgtgggctctgaggctgtcatcctcaggaatttgggctaacactagtcccgaggctgagctgttcccagccctgcgaccccgaagggtgggcattgctttagattacgaaggcgggaccgtaacatttacaaacgctgagtcccaggaattaatttacacattcacggccaccttcacacgcaggttggtgccattcttgtggctgaagtggccaggaacccggctactgttgcgcccatag

SEQ ID NO: 16823 - DNA, 2613 bp, Artificial Sequence
  Description of Artificial Sequence: Synthetic coding sequence
atgtcaaggaatcctagctcaaattcacccgaggaagacaccgtaccggtccccaaaggtagtgtgcccgcagcccggccatcccgcggtggaatgtccgtagtaggtatcgacctggggttcctcaattgttacatcgcagtcgcgcgatcagggggcatcgaaacgatcgctaatgaatatagcgaccggtgcaccccagcgtgcatcagtctgggctccaggacgagggctatcgggaatgctgctaagtctcagattgttacgaacgtgagaaatacaattcatggcttcaaaaagttgcacggtaggagcttcgacgaccccatcgtgcaaactgagcgtattagactgccctatgagctccagaagatgccaaacgggtctgccggagtgaaagttcgatatctggaggaagaacgccctttcgcgatcgagcaggtcaccggtatgttgttggcaaagctaaaggagacatctgaaaatgcgctgaagaaaccggtggctgattgtgtgatatcgatcccaagtttcttcactgacgcagaacgcaggtctgtcatggcagctgcacaggtcgctggactgaattgcctgcgactgatgaacgaaacaactgccgtggcactagcttacggcatatacaagcaggacctgccacccctcgatgaaaaaccgagaaacgttgtcttcatagatatggggcactcagcataccaggtgttggtctgcgcattcaataagggcaagctcaaggttctcgcgaccacattcgacccctatctcggtggccgcaactttgacgaggcgctggtcgactatttttgcgacgagtttaagaccaaatataagattaacgttaaggagaattcacgagccttgctccgcctgtatcaggaatgtgagaaacttaaaaagctgatgtcagcaaatgcttctgatcttcctctcaacattgaatgttttatgaatgacctggacgttagcagcaagatgaatcgggcccagtttgagcagctttgcgccagtctgctggcccgagtggaaccacccctgaaggctgtgatggagcaggctaacctccagagagaggatatctcatcaattgagatcgttgggggagccaccagaatccctgctgtgaaagagcagattactaagttcttcctcaaagatatatctaccactctgaacgccgacgaggctgttgccagaggatgtgccctccagtgcgccattctgagccccgctttcaaggtccgggaattttctattacggacctcgtgccatattccatcaccctgcgatggaagactagcttcgaagatggctcgggagaatgtgaggtattttgcaagaatcatcccgcaccattctccaaggtgattacatttcataagaaggaaccgtttgaactagaagcattctataccaatctgcacgaagtcccctacccagatgcccgtatcggcagctttaccatacaaaatgtgtttccccaaagtgacggcgacagctctaaagttaaggtgaaagtgagagttaacatccacggaattttttccgtggcgtccgcaagcgtgatcgagaaacagaaccttgaaggtgaccatagcgatgcccccatggagactgaaacatcctttaaaaacgagaacaaagacaacatggataagatgcaggtggatcaggaggaaggccatcagaaatgtcacgctgaacacacccctgaggaggagatagatcacaccggggccaaaactaagtccgcagtctcggataaacaggaccgtctgaaccagacgctgaagaagggaaaggtgaaaagcatcgacctaccaatccagtccagtctctgccgtcagctagggcaggaccttctgaacagttatatcgagaatgaggggaagatgataatgcaggacaagcttgagaaagaaaggaatgacgctaaaaacgcagtagaggagtatgtatatgatttcagggatcgcctgggcactgtctacgaaaagttcatcacaccggaggacctgtctaagctttctgcagttctggaggacaccgagaactggctgtatgaggatggagaagatcagcctaagcaggtgtatgtcgacaagctgcaggagctgaaaaagtatggacaacctattcagatgaagtacatggagcatgaggagagacctaaggccctgaatgacttgggaaagaagatccaactcgtgatgaaggtaatcgaggcataccgcaataaagacgagcgatacgaccacctggatcccacagagatggaaaaggtggagaagtgtatctccgacgctatgtcctggttaaattctaagatgaatgcccagaacaaattgagcttgacacaagaccccgtcgtgaaagtgtcagaaatcgtggccaaatcaaaggaactcgataacttttgcaatcctattatctacaagccaaagcccaaggcagaggtcccagaagataagccaaaagctaacagcgagcataatgggcctatggatggtcagagtggaacagagacaaaatctgactccactaaagattccagtcagcacaccaaatccagtggagagatggaggttgattag

SEQ ID NO: 16824 - DNA, 5463 bp, Artificial Sequence
  Description of Artificial Sequence: Synthetic coding sequence
atggaacctcctcaggagaccaatagacccttctcaaccctcgacaataggagtggccaggttcaggtgctctcagccactcccttgttgcaaaggaatccctattcgtctccagacattatgcacatcaagggatccgaagcctcatctgtgccttacgcactgaatcaggggacgaccgcccttccgaagaacaaaaaccaagaaggaacaggccatcggctcctgaacatgctcaggaaaacgctgaaggagagtgactccgaggaattagaaatcacccaggagactccgaacctcgtaccattcggggacgtggtggggtgtcttggaattcatatcaaaaactgcagacattttatgcctaagatttcactccaacactacgccaaccttttcattaggatttcaatcaacaaggcggtgaagtgcacaaaaatgtgcagcttactatccaagaatgacgagaaaaacacagtgataaagttcgacgaggtcaaatatttctcagtacaggtacctcggaggtatgacgataagcggaacaacatccttcttgaattaatacagtacgacaaccgtgagaagagggcctttctgctggggtcagtgcagatccatctatatgaggtgattcaaaaaggctgctttatcgaggaggtgcaggttctgcatgggaacatcttcgtttgtcgcctcgaggtggaattcatgtttagctacgggaattttggctatggcttttctcaccaactgaaacctcttcagaaaatcaccgagccctccatgttcatgaaccttgcaccacctcccgagcgcacagaccctgttacaaaggtgattaccccacagacggtggagtaccccgccttcttatccccagatctgaatgtgactgtgggcacgccggccgtacagagctccaatcagccaagtgtcgtgaggctcgaaaagctgcaacaacaacccagagagcggctagaaaagatgaaaaaagagtatcgcaacttgaacacgtggattgacaaagccaactacttggagagcatactaatgcccaagttagagcacaaggatagtgaagagacgaacattgacgaagcttcagagaacaccaaatcgaaccatcctgaagaagaactagagaacatcgtgggagtggatattccattagtcaatgaggaagccgagacaaccgccaatgagctgctggataacgactctgaaaagggactgactatacctaccctgaatcagagcgaccaggacaacagcaccgcagacgccagtaagaatgacgagtctaccccctcccctactgaagtacacagtctctgtacaatttctaaccaagagaccatcaaggcaggcagaattccccctttaggcgagcggcaatcggaatctatgcctgatcgaaagatgaagaacgttttctttccccttgaggtcaagctaaaagacaattatccctcgattctcaaagccgattcttccctctctgaagtcgccttcagccctaaggagtataactcacccagtttcaggccagaatatatcgagtttaaacccaagtttcaatttcagaaattcaacaagaatggattcgacccatttctgaggaacataaataaaatgtccgtacggaaacgcaaggaccaggacatctacaaatacaggaacattctcggtgccgaggttatcgaacatgaagaccaagacccaccctatccagcccagtctaagacggctggcccagccaacaccacctgggctcatgaccctaacatcttcactaccaagatgttagaaactgagaataagctcgcgcccgaccccactatcaatacgattaagggcctcgataccaagaactctttaaaagagaatctgcctaacgtgagcctcccgtccattaagggtgagtcctcaagggcggggaacgtgcaggccaatacctgtcacctgagtaaatctcttaatttcactccccacatagagtatttgaagcaatccatgatcctgaagagtatcctatccgaaaacctgcaggatctttccgacaagctcttctctaagcccgaagtgagcatgaacagcgaagcaagagagaagagctcttctcctctgctgtccatacacgacaaatcttctagctctatggaggacaacgtgctggagaaaaaacaagatctgaataactggctgtctgaaaaagatattctcaattccaagacaaccctgtcccagataatcaaaaacatccctgccgattcctttagcgaagggagccagattatcgaaaacatcccagccgattctctgctggagggcggacaggttatcaagaatatcccagagtatagcctgtcagaaggagggcagattataaagaacatccctgcagattctttccttgagtcaggtccaggccaatctcctgaggttgaggagcacgttagcaagaaacacttcgaggcggatgaacgtgacttcccaatcaagaaaaattccagcactaaaaagaagcatctgatctctgaggtgccgaattccaaaagtgggagttcaggcaccgttcacgattatatcatgagacagatctttacggcgcccatttttagcgagctagagatcgaggtgaaggagccgtccgaaacccccatgaacttggagaatcagctcccaacgccctggaagaggtcgttgtcatcgcacattctgttccacgaagagaatgctgacgaaatcgaattaccccaacccagaagtgcaacatcccagataattcaggcctttcccatcgacacgctcctcgagagcggcataatcaaggtgatagagcttgataaggaacatcataagtcatctcttctcggcacagggattacttcaccaaaggggaacctgaaagacagccaagagtactactctgagatccgctctgagactgaaccactgtcagagcagtctatccctattatcccaaaggacacaaccagtgtgtcgagggctgagttcatccaagaggaccagaatatgttcccacaggactcatcctactactcgatcgccaataaagagctgtatctcccaaggaatggtcagcgcctgtgtaaggataagaatgacttatcatctaccctggaatctctgaccaatagtcttatggataagttgtccgaatccgatgagataatgttgaaatctttccttaagaacatatttaatgtcttcttcaaatacaatcactctgagaggcggggccaaccagagaaggaattagaacgcctcattcagccctcgtttacttccgacacagagcatcttgaggagcttcaagaggattttgataaggccgacaaactggacaggaaaccaattctgtcccccaagctgagagtattcctggaagagctaagtgagagtgaggtcaagcacctgaagtctgaactctccaagcagatccagcactatctggtggaaagactttctgaatccggtcatatcaccaaggaggatctccctaaaatctaccagaatttataccttatgaatgagaaggctgagcagaagggacctaactcatttcagggaaagtacagtgagactgtaaaggagatcatgtcatttgttaacaacttcaatcatcactttatcgacaagcatctggaaatcaaactgcggtcctttctcaaagagatcctgcagaactacttcctgaaaaacatatctgaaagttccttgttcaatgaaaccgcctctgagactatctatcccaacatttcctctctcagaacaaagagcgtgtctatctcttttcacgaacttgagcaggacatttccaagggctcctttgggaggcggtttgagattaacatgaagtaccctctcagcaaatccttgcagaactatcttattgctctgagtgaaaatgaactgctgcaccttaaggccgatctctccaagcacctccagagcctttttatcgaaaaattaagtaagagcggcttgatgaccaaaaagcagcttgaaggcataaatcagcacattaaccttcttaatagctcctcaatccccctaaagtatattaagacacacttgcccttcagggatgactgccactttgtggagaaacactctgaaaaacagaataagtattcccgcatcgtgcagcagacaacactccaaactgtgagcgaggacaaactgagggaggctgagctaattcgggagaaagagaagaagtacttccccctccagaatctgaagggaaactcaagtctgattaaggagcagaaatcttattatacaaaagaggaggccaagaccccttcacttatcaaagtgcaaccatcaagcaatgaaaacatccaggcatcaccgctgtctaagagcagcgaaatactcaccgacattctgctgaagaagctccgcaaagagcacgtatttacccagctcccccaggcagaaaacagcgtgcataaaactgagatacaggacccctacagctggggtggaaaatccaagatcacacagtctaaggcttggtgcgaaaagaccctaaagatgaaatccttggacagaaaggagcacgtgaacatttacaagtggactgtgcaggaaaaacccgaagccgtgctaacctcttacccccgcatccctaacgcaaggatgcctagagaggatgagtatctcaataggataacatttcccagctggcagtcaagtaccttgacacactttaatacggagacgggagaaaagagcaaactcgaggaccagtactgccaaacccttaagggtaacaacaacaacaataagaaacacttagtgactttcgcgcaatataagaaggagattcaaacgctgtacattaaaccagacgagatctgcagtgaaaaatgcgctaaattcccagagattcagtcctttcagtacaaggtggtggaggacgagaagaatctcaaaccacatttgtttccggagctgtttaagatagaagatctcaaacccaaagtgcggaaggaacgggatcgtgtggcgcagcctaagaagtcatttaataaaatcgtgcgcattctgcctacaactttgccaacgactaggatccacctgaagaagtctgtccccagaacgctcttacactggaccgctaggaggacaattcacgactgttctgacaagtttgaggacctccacgatatgacctctttcacccatctcaaaaaagtaaagagcaggagtcgccttctcggcaagtcatccgacgatatccacaatcatgcgagacatagtgcccggccatatacagccccggaggtcaacaaacaacgcgagtcttactccggcaagtttaccagccgccggatggtatcgtccggactggttcacatcaatgataagacatctgattatgagatgcataaaatgagacctaaaaagatcaaaagagggtactag

SEQ ID NO: 16825 - DNA, 498 bp, Artificial Sequence
  Description of Artificial Sequence: Synthetic coding sequence
atggagcctacaagagattgtcctctgttcggtggggcattctcagcaattctgcctatgggggcaatcgatgttagcgaccttcgacccgtcccagataatcaggaagtcttttgtcacccagtgacagaccagagtctcatcgttgaactgctagaacttcaggctcacgtgcgcggagaagccgcagccaggtatcacttcgaggatgtgggaggagtccagggggcacgagctgtacatgtggagagcgtgcaacctctgagtctggaaaacctcgctctgcgagggcgctgccaagaagcttgggttttgtcagggaagcagcagatcgccaaggagaatcagcaggtgcgagcgcgagagtgtgttatgtcctggaagggcggctcaggcgatgctgaaattcaagtgagcatcctcactttaattcctctaggctctaaaggcagggatactagttctggattagccgaagcagctcccgtgccagactag

SEQ ID NO: 16826 - DNA, 4482 bp, Artificial Sequence
  Description of Artificial Sequence: Synthetic coding sequence
atggcttcgatcacgcagctcttcgacgatctttgcgaggccctgctgcccgccgctaaaacacacttgggccaacgatccgtcaaccgcaaacgcgctaagagatctctcaagaaagtggcatacaacgccttgttcaccaatctgttccaagacgagacacagcaactccagcctgacatgagcaagctgcctgcacgtaataagattctgatgctgagcttcgaccttcgcgtcggcggactgggccctaaagctgatcggcttgaagaactggtggaagagctcgaggcagccccttgctgccccttgctcgaagtcgggtccgttttggacttactagtgcagcttgccgggtccggcccaccccaagtcctgcctagaaaacgtgattatttcctgaacaataagcacgttggaagaaacgtgccctacagtgggtatgattgcgatgacttatccgtgttcgagatggacgttcagtcactcatatctagggaggagtgcctgtgccacagcatgattcaggagacgcttcaggttatggaagcagcccccggcaccggcctacccactgtggggcttttcagttttggggacccgtgtggcgaccgattcgagcgagacacaagagtctcactgttcggcgccctcgtccattccaggacatatgatatggacgtgcgcctgggtctcccaccagtcccggacaacgcggacctgtctggtttggcaatcaaggtacctccctcagttgaccaatgggaagatgaggggtttcaaagcgcaagcaatctgactcccgacagtcagagtgagccatctgtcacgccggacgtcgatttgtgggaagcagcgcttacctacgaggcctccaaacgacgatgctgggaacgcgtcggctgccccccgggacacagggaagaaccctacctaacagaggcgggacgagatgcatttgacaaattttgtcggctgcaccagggcgagctccaactcctggcgggcggggtgctgcaggctccccaacctgtactggtaaaggagtgtgagcttgtaaaggatgtgcttaatgtgctgatcggcgttgtgtctgctacattcagtctatgtcaacccgctcaagctttcgtcgtcaaacgtggggtgcacgtgagtggggcctcccccgagtctatatctagcctgctgtcagaagtggctgaatatggcacttgctacactcggttatcacatttttccctccagccagtacttgactcgctgtacagcaaaggtctggtgtttcaagctttcactagcgggctgcggcggtatctgcagtactatagggcttgcgtactgtcaacaccgcctaccctttccttgttaacaatcggatttctgttcaaaaagcttggccggcagttacgctatctcgcagagctttgcggcgtcggcgccgtgcttcctggaacctgcgggggcgggcctcgcgcagcatttcccaccggtgtgaaactgttgtcctacctctatcaagaggctctccacaactgtagtaacgaacactaccccgttctgctgagtctgcttaagacttcatgcgaaccctacacccgttttatccacgactgggtctactccggggtgtttcgggacgcttatggagagttcatgatccaggtgaaccacgagtacctttcattccgggacaagctgtactggacacatggctatgtactgataagtaaagaagttgaggattgtgtacctgtgttcctgaaacatatcgcccatgacatttacgtatgcggtaaaacaatcaatctactgaagctgtgttgtcctaggcactacctgtgttggtcggatgtcccagtgcccaggatttctgtgatttttagcctcgaggaattaaaggaaatcgagaaagactgcgctgtgtacgtgggcagaatggaacgggtcgctcgccacagcagcgtcagcaaggaagagaaagagctgcgtatggagatcgccaaacaagaactgatcgctcatgctcgcgaggcggcttcccgggtgttgtcagccctcagtgaccgccagatgtcggagcggatggccctcgatgccagaaaacgggaacagttccagagactgaaggagcagttcgtaaaagaccaagagcgccggcaagccgctcgacaggaggagctcgacgacgacttcagctatgctcgcgaactacgggacagagaacggcggcttaagagcctcgaggaggaacttgagagaaaggcccgtcaggccttggtggaccactactctaaactgtccgccgaggctgccaggagggagcagaaagccttgtggaggattcaacgccacagattagagtctgctcgcctgagatttctgcttgaggatgaaaaacatattcaggaaatgctgaaagctgtttccgaggcccatcagccacaggagcctcctgatgtgctgctatccgtgcacccccaagtcacctcgccggggcccgaacatcccgagggcggccagggatgcgacagcggatccgcggaacagcattctccggcatgggatggctggaacagacctggcctcttaactcctcagccattgaagccactagcggtgggagccggaggacggggcctgcagcaagcagaaggagcacgccctttctccgactccctgtcaatcggagattttctgccggttggcccgggagccgagccttcagtgcagaccggcatggtcccactgcttgaggtggcacttcagaccattaaccttgatcttcctcctagtgcaccaggagaagcaccggctgccgcttcgactcagcccagtagaccccaggagtatgacttctcgacggtgctcaggcctgctgtagcgacgagcccagcccccggccccctgcaggcagccgagtgctcacttggcagttccggacttcagctgtgggaggactcctgcgggaaaatggacgcttgtgggtccgcatcgcgcgagacacttctgcccagtcacccacccagaagggccgctctggaggaaggaagctcccagcctaccgagaggctgtttggtcaagtgagcggtggggggctacccacaggtgactacgcatccgaaattgcgcctacacgcccccgttggaatactcacgggcacgtctctgacgcatctatcagggtgggggagaacgtgtccgacgttgcgcccacgcagcctagatggaacacccatggccatgtgagcaatgcaagcatctctctgggtgagtcagtgtcggacgtggcccctacccgtccgcgctggaacatccacggccacgtaagtaacgctagcattcgagtgggcgagaatgtctctgacgtagctcctactcgcccaaggtggaatacccacggccacgtgtccaacgcgtccatcagagttggcgaaaatgtttccgatgttgctcccacccgccctaggtggaatacacacggacacgtcagtgacgccagcatctcactgggtgaatcagttagtgatatggctcctgcacgcccacgctggaacacccacggtcatgttagcgatgctagtatttctctgggggagagcgtatccgacatggctcccacgcggcctaggtggaatacacatggacatgttagcgacaccagtattagggtcggggagaatgtaagcgacgtcgctcccatcagatcgcgatgtaacactcacggccacgtcagtgacgcatcaattagtctgggcgagccagtgagcgacgtggtgtccactcgcccacgatggaacacccacgttcctatccccccaccccacatggtcctgggcgccctgtcgcctgaggcagagcccaatacgcctcgcccgcagcagagcccccctgggcatacatctcaatcagccttgagccttggcgctcaatcaaccgtcctggactgcggcccgcgcctccccgttgaagtcggaccgagtctatcttccccatcctctggatgtggcgagggatcaatttcagtcggagaaaatgtgtcagacgtggcgcctactcaaccctggtggcctaacactcctggcgactccgtgtccgaagagctgggccaatctcgtgtggcagggggccaggaatgggactgtggcacgcatcgggcgtgggaggccctgggcggggcaggtaccctacgaacttcactccagatcggcctgagcacacacaggaaaacccagctcccacgcgccgcacaagccgttgtgagacgcagacggcaccggcgcagacgtctgagggtgggatctagaccaacctggcaagcttggcaggggtctacaacctggtctggcacgcgtacagttacatccccatgtccaagccgtccattactcatcttctgcgctccctgctttccaggaccatctccctctccctggacaccgaggagttctctgccactaatgagactgctgtgttcatag

SEQ ID NO: 16827 - DNA, 1077 bp, Artificial Sequence
  Description of Artificial Sequence: Synthetic coding sequence
atggcccctcagaatctgagcactttttgcctgctcctgctctacttaatcggcgctgtgattgccggcagggacttttacaaaattcttggtgtgccccgctctgcttcaatcaaggatatcaaaaaggcctataggaaactggcactgcagctacatcctgacaggaaccctgacgatccacaggctcaagagaaatttcaggatttaggtgccgcatatgaggtgctttctgacagtgagaagaggaagcagtatgatacatatggtgaggaaggcctgaaagacggccatcagtcgagccacggcgacattttttctcatttcttcggagactttggcttcatgttcggtgggaccccacggcagcaggataggaatattcctaggggatcagacattatcgtcgatctggaagtgacgctggaggaggtgtatgctggtaacttcgtggaggttgtgcgcaacaagccggttgccagacaggctcccggaaaacggaaatgtaattgtcggcaagaaatgagaacgacccagctgggtcccggtcgctttcaaatgacgcaagaggtggtctgcgacgagtgtcctaatgttaaattggtgaatgaggagcgaactctcgaagtcgaaattgaaccgggagtgcgggacggtatggagtatcctttcattggcgagggggagcctcatgtggacggcgagcccggtgatctccggtttagaatcaaagtcgtgaagcaccctatattcgagcgccggggtgacgatttgtacacgaacgtgacaatcagcctagtggaaagcctggtcggctttgagatggatatcactcatttagacggtcacaaggtgcatatttctcgagacaaaatcacccgccctggtgctaaactctggaaaaaaggggagggtctcccaaatttcgacaataacaacatcaagggctccctcattatcacctttgatgtggacttccctaaagaacagcttaccgaagaggccagggaggggattaagcagttattgaagcaggggagcgttcagaaagtgtacaatggactgcagggatactag

SEQ ID NO: 16828 - DNA, 2757 bp, Artificial Sequence
  Description of Artificial Sequence: Synthetic coding sequence
atggcctccctgagtcgcgccctgagagtagccgcagctcatccgcgccagtctccaacaagagggatgggcccatgcaatctgagtagcgctgccggacccaccgcggaaaagagtgtaccctaccaaagaacgcttaaggagggtcagggaactagtgttgtggctcagggtccaagccggcccctcccatctacagcaaatgtggttgtcatcggagggggcagcctcggatgccagacgctctatcacctggcaaagctaggcatgtctggcgctgtgttgctggagagggagagactgactagtgggaccacgtggcatacagccggactactgtggcagctgcgacccagcgacgtcgaagtcgagctgctggcacacactcggagggtggtgagtcgtgaactggaggaagaaacaggcctgcacacagggtggatccagaacggcggcctgtttatcgctagcaacaggcagagactcgatgagtacaagagactgatgtccttgggaaaggcttacggggtcgaatctcacgtattgtcgcccgctgagaccaagactttatatcctctgatgaatgtggacgacttgtatgggaccctgtacgtcccacacgacgggacgatggacccagctggtacctgcacaactctggcgagagccgcgtccgccaggggtgcccaggtgatcgagaattgccctgtaacgggcatcagggtgtggaccgacgactttggggtccggcgcgtagccggggtcgagacacagcacggctccattcaaacaccatgtgtcgtaaattgtgccggcgtctgggcttccgcagtgggccggatggcaggagtgaaggttccccttgtggctatgcaccacgcatacgtggtgacagaaaggatcgaggggattcagaacatgccgaatgtccgggaccacgatgctagcgtgtatctgcggctgcagggagacgctttgtctgttggaggctacgaggccaaccccatattctgggaggaggtgtctgacaagtttgcattcggtctttttgacttggattgggaagtgttcacccaacacatagaaggcgccataaaccgggtgccggtccttgaaaagacaggtattaagtctactgtctgtggacccgaatcttttacacccgatcacaaaccacttatgggggaagcccctgagctgcggggcttcttcttaggatgcgggttcaactcggccggtatgatgctcggcggcgggtgtggacaggagctggcccattggattatccacggaagacctgagaaagacatgcatgggtacgacattagaaggttccaccactccctgaccgatcatcctagatggattcgggaacggtcgcatgagagttatgcgaagaactattccgttgtgtttccgcatgatgaacctttagctggtcgcaatatgcgccgagatccccttcatgaagagctattggggcaggggtgtgtttttcaagagagacacggatgggagcgccccggttggttccacccccgcggcccagcacccgtattggaatatgactattacggtgcatacggttcacgagctcacgaagactatgcctatcggaggcttctagccgatgagtacacttttgcttttcccccacatcacgataccatcaaaaaggagtgtctggcatgtaggggtgcagcagccgtcttcgacatgtcctattttgggaaattctacctcgtcggcttggatgccaggaaggccgcagattggctgttcagtgcagacgtgtctcgaccaccaggcagcaccgtgtacacatgcatgctcaaccatcgcggagggaccgaatctgatcttaccgtcagccggctcgcaccgagccatcaggcttccccattggcccccgcctttgagggcgacggatactacctggccatggggggggcggtggctcagcacaactggtcacacatcactacagtgctgcaggaccaaaagagccaatgccaactgatagactcatcggaggacttaggaatgatctccatacaaggtccggcctcaagggcgatcctgcaggaggtgcttgatgccgacttaagtaacgaggccttccctttttctactcacaagttgcttcgtgctgccggacatttagtacgcgccatgagactgagctttgtgggggagttagggtgggaactgcatatcccgaaagctagctgcgttccagtctaccgcgcggtgatggccgcgggagctaaacatgggctcatcaacgccggatacagagctatcgacagcctttctatcgagaagggctatcgacattggcacgccgacttgcggcctgatgactctcctctggaggccggcctcgccttcacgtgcaaactcaagtcacccgtgccctttctgggacgcgaggcacttgaacagcaacgagccgccgggctgaggagacggttggtctgtttcacaatggaggacaaggtgccaatgttcggcttggaagcgatctggcgtaatgggcaggtcgtggggcatgtgcgccgggctgacttcggctttgcaatcgataagacaatagcttacggctatatccatgatccctccggtggaccagtgtctctggatttcgtaaaaagcggagactacgcactggagagaatgggagtgacttatggagctcaggcccacctcaaaagtccttttgaccccaacaataagcgggtgaaaggaatctattag

SEQ ID NO: 16829 - DNA, 222 bp, Artificial Sequence
  Description of Artificial Sequence: Synthetic coding sequence
atgtcttaccagcagcagcagtgcaaacagccgtgccaaccacccccccccgtgtgccggctgcctaagcgcccagaaccttgtccccctctcaaatgtcctgaaccgtgcccgccccccaaatgcccccagccttgccctccccaacaatgtcagcagaagtaccccctggttaccccaagccccccttgtcagcccaaatgccctcccaaatctaagtag

SEQ ID NO: 16830 - DNA, 576 bp, Artificial Sequence
  Description of Artificial Sequence: Synthetic coding sequence
atgggcaagaagaccaagagaacggctgactcctctagctccgaggatgaagaggaatatgtcgtcgaaaaagtattagatagacgcgttgtgaagggccaggtagaatacctattaaaatggaaggggttcagtgaggagcacaatacctgggagccggagaaaaatctcgattgtcctgagttaatctcggaattcatgaagaaatataaaaagatgaaggaaggtgagaacaataagccccgggagaaatccgaaagcaataagagaaaaagcaatttttcaaactcagctgatgacatcaagagtaagaaaaaacgggaacaatcaaatgacatcgctaggggtttcgagcgagggctggagcccgaaaaaatcataggggccactgacagctgtggggacctgatgtttttgatgaaatggaaagacacggatgaagccgacttggtcttggccaaagaggccaacgttaagtgcccgcaaattgtaattgctttttatgaagagagactgacctggcatgcctatccggaggatgccgaaaacaaagagaaagaaaccgcaaaatcatag

SEQ ID NO: 16831 - DNA, 60 bp, Artificial Sequence
  Description of Artificial Sequence: Synthetic coding sequence
atgctgaagaataagggacacagttcgaagaaagataatctcgctgtcaatgccgtgtag

SEQ ID NO: 16832 - DNA, 1026 bp, Artificial Sequence
  Description of Artificial Sequence: Synthetic coding sequence
atggaatcaaacttcaatcaagaaggtgtgccaaggccctcttatgtttttagtgcagacccaatcgctcgaccaagtgaaattaactttgatggtattaagctggatctcagtcatgaatttagcctggtcgcgccgaataccgaagccaactctttcgagagcaaagattatctgcaggtgtgtctcaggatacgccccttcacgcagagcgaaaaggagttagagtccgaggggtgtgtgcacattctggacagccagacagtggtgcttaaagaaccgcaatgtatacttgggagattgtccgagaagagcagcggccagatggcccagaagttcagctttagcaaggtgttcggcccagccaccactcagaaggaatttttccagggatgcattatgcaaccagttaaagacctacttaaggggcagagccgattgatttttacctatggattaaccaactctggaaaaacctacacatttcagggcacagaggaaaatataggtattttaccaaggaccctgaacgttctgttcgatagtctgcaggaacgcctctatacaaaaatgaatctgaaaccccacagaagccgcgagtatctgagactgtctagtgagcaggagaaagaggaaatcgcctcaaaaagtgcacttctcaggcagatcaaggaggtgactgtgcataacgactctgacgatacactgtacggttccctaacgaactcattaaacatctctgagtttgaagagtcgatcaaagactatgagcaagccaatctgaatatggccaattcaataaagttctctgtgtgggtatccttttttgagatctacaatgagtatatttatgatttatttgtgcctgaattggctaagacaaagggcgagttgattaagaccaaggaagaactgaaaaagcgcgaaaacgaatcggactccctcatacaagaacttgaaacctctaataaaaagattataacgcagaaccaacggatcaaagaattgattaacatcatagattag

SEQ ID NO: 16833 - DNA, 27 bp, Artificial Sequence
  Description of Artificial Sequence: Synthetic coding sequence
atggcagacactgatctgttcatgtag

SEQ ID NO: 16834 - DNA, 2628 bp, Artificial Sequence
  Description of Artificial Sequence: Synthetic coding sequence
atgatgtacactgttctgcccgatggatcaccggtgcctcagggtatggccctgtatgccccccccccacctctcccaaataacagcaggcccctaacacctggaacagtagtctatgggcctcctcctgctggagcacctatggtttatggcccaccaccccccaatttctccatcccttttatccccatgggggttctccactgtaacgttcctgagcaccacaatttagagaatgaagtgagccgcttagaggacataatgcagcatttaaagagcaagaaaagggaagagagatggatgcgcgcaagtaagagacagtcagagaaggagatggaggagctccatcataacattgacgatctgctacaggaaaagaagagtttggagtgcgaagtggaggagcttcatcggaccgtccaaaagcgccagcagcagaaagactttattgacggcaatgtggaatccctgatgacagagctggagattgaaaagtccctcaaacaccatgaggacattgtggatgagatcgagtgcattgagaagacactgctcaaacgccggtcagagctgagggaagcagaccgcctgctggcagaggccgagagcgagctctcctgtactaaggaaaaaaccaaaaatgccgtggagaaattcaccgatgctaagcgttccctgttacagactgagtctgatgcagaggaattagagcgtcgcgcacaagaaaccgctgtcaacctggtgaaggcggaccagcagttgagatctctgcaggccgacgccaaagatttagaacagcataaaatcaagcaggaggagatactcaaggaaattaacaaaattgtggcagctaaggattcagattttcagtgtctcagcaagaaaaaggagaaattgaccgaggagctgcagaaattacagaaggacatagaaatggccgaacgaaacgaggatcaccacctgcaagtgttgaaggagagtgaagtacttttgcaggccaaacgcgccgaactggagaagttgaaaagccaggtcacaagccaacagcaggagatggccgtgctggatcgacagttggggcataagaaggaggagttacatctgcttcagggcagcatggtgcaggcaaaagccgatctgcaggaggctctgcggttaggtgagacagaagtgaccgaaaagtgcaaccacattcgcgaggtgaagtctctattagaagagttaagtttccagaaaggcgaactaaacgtccaaatctctgagcgcaaaacacaactgacgctgatcaagcaggaaattgagaaggaggaagaaaacctgcaggtggtcttgcgacagatgagcaaacataaaacagaactgaagaatattttggacatgctgcagctggagaaccatgaattgcagggccttaaactgcagcacgaccagcgggtctctgagctggagaagacacaggtcgcagtgttggaagaaaagctggaattggagaatctccagcagatatctcagcagcaaaagggcgagatcgagtggcagaagcagctgcttgaaagggacaaacgagaaatcgagcgcatgacagcagagtccagggcactgcaatcatgcgtagagtgcctgtcaaaagagaaagaggatttgcaggaaaaatgcgacatctgggagaagaagctcgcccagacaaagcgggtattagccgcggccgaagagaattcaaaaatggagcagtctaacctagaaaaacttgaactgaatgtaaggaaactgcaacaggaactcgatcaattgaatcgcgataaactgagcctgcataacgatataagcgcaatgcagcagcagttgcaagagaagcgagaggctgtgaacagccttcaggaggaactggctaacgtccaggaccatctcaatctcgccaagcaggatctgctgcacactactaaacaccaagacgtgctgttgtccgagcagacgcgactccagaaggacatatcagaatgggcaaaccgcttcgaagactgccagaaggaggaagagaccaagcagcaacaactgcaggttctgcagaatgagatcgaggagaataaactcaagctggttcagcaggagatgatgtttcagagattgcagaaggagagggagtccgaggagagcaagctcgagacaagcaaggtcaccctgaaggagcaacaacatcaactggaaaaggagctgacagatcaaaaaagcaagctagatcaggtcttatctaaggtactggccgccgaggaacgggtgaggaccttacaggaagaggagcgctggtgcgaatcccttgagaagaccttgtctcagacgaagcggcagctgagcgagcgggagcagcagttagtggagaagtccggtgaactactcgcgttgcagaaggaagccgatagcatgcgcgcggactttagcttattacgaaaccagttcctcaccgaacgcaagaaggccgaaaagcaggtcgctagcctgaaggaggccctcaaaatccagcgaagccaactggagaagaatcttctaaccgctagggaagctgaggcccaaaagctgaagaagcaggtatgtgcccagaaagcccagctggcctctctcggtagagaatag

SEQ ID NO: 16835 - DNA, 1188 bp, Artificial Sequence
  Description of Artificial Sequence: Synthetic coding sequence
atggaaccccctcaggagactaaccggcccttctccacgctggataaccggagcggacaagtccaggttctgagtgctacgcccctgttacagagaaatccttactctagtccagacattatgcacattaaggggtctgaagcatccagcgtcccctacgctctgaaccagggcaccaccgccttgccgaaaaacaagaaccaggaaggcaccggccatcggttgctcaatatgctcaggaaaaccttaaaggaatctgactcggaggagctggaaataacccaggaaacacccaacctggtacctttcggagacgttgtagggtgcctgggcatccacatcaaaaactgtaggcattttatgccaaagatctcactccaacactatgccaacttatttatccgtattagtataaacaaggccgtgaaatgcaccaagatgtgtagtctgctgagtaagaatgatgaaaaaaacaccgtgataaaattcgacgaagtgaagtatttcagcgtgcaggtgccccgtcggtatgatgacaaacgtaataacatattgctcgagctcatacagtacgacaaccgggagaaacgcgctttcctccttggatcagttcagatccatctgtacgaggtgatccaaaaagggtgtttcattgaagaagtgcaggtgctgcacggcaacatcttcgtatgtcggctggaggtcgagtttatgttttcatacggtaacttcgggtacgggttctcacaccagctgaaaccactgcaaaagatcacggagccttccatgtttatgaatctggccccaccgccagagcggacagaccccgtcacgaaagtaatcacaccccagaccgtggagtatcccgcctttctgagtcctgatctgaatgtgacagtgggaacacccgccgttcaaagttctaatcagccttccgtcgtgcgcctggaaaagctccagcagcagcctcgtgagcgactggaaaagatgaaaaaagagtaccgcaacctcaatacctggatcgataaggcaaattacctggagagtatactgatgccaaaattggaacataaggatagcgaggaaaccaatatcgacgaggctagtgagaacactaagtctaaccaccccgaagaagagttagagaacatcgtgggcgttggaggcttcttcaccaaacggatctag

SEQ ID NO: 16836 - DNA, 282 bp, Artificial Sequence
  Description of Artificial Sequence: Synthetic coding sequence
atgtcatattatcaacggcctttcagtccttccgcatactcactgccagcatccctgaactcttcaatcgttatgcaacacgggaccagcttagattcaacagacacatacccccagcacgctcagtccctggacggtacaacttcctcatccattcccctgtatcggagcagcgaggaggagaaacgcgtgactgtgatcaaagccccccactaccccgggattggcccagtggacgagtctggcattcctaccgccatcagaactacagtcgacaggtag

SEQ ID NO: 16837 - DNA, 558 bp, Artificial Sequence
  Description of Artificial Sequence: Synthetic coding sequence
atggctgccagcgtggaacagcgcgaggggaccatacaagtgcaagggcaggccctgttcttcagggaggcactcccgggatcaggccaagccaggttttctgtgttattactgcacggcatcagatttagcagcgaaacttggcagaatttaggcacgctgcatagactggctcaggccgggtaccgagctgttgcaattgacctgcccggcctgggacatagcaaggaagccgccgcacccgctcctatcggcgagctggcccccggaagcttccttgctgccgtagttgacgcattagaactcggcccgcctgtggtcccagtggctccaatttgcacggacaaaatcaatgctgctaactacgcttcggtgaagactccggccttgatagtgtatggcgaccaggatccgatggggcaaacgtctttcgagcatctgaagcagctgcctaaccaccgcgtgttaattatgaaaggcgcaggccacccttgctacttagataagcctgaagagtggcatactgggctactcgatttccttcagggtctgcagtag

SEQ ID NO: 16838 - DNA, 1443 bp, Artificial Sequence
  Description of Artificial Sequence: Synthetic coding sequence
atgcttgagaggcccccggccctcgctatgcctatgccaacagagggcaccccgccccccttgagtgggacccccatccccgttccagcctactttagacacgcagagcccggattcagcctgaagagaccaagaggcctgtccagatcgttgcctccccctcctcctgcaaaggggtctattccaatcagcaggctctttcctccgaggacccccgggtggcatcagctgcagccccgcagagtgtcattcagaggtgaggcctccgagacactccagtccccaggctatgacccatctcgtcctgagtctttctttcagcaatcctttcaacggctgagtcggttgggtcatggatcctacggcgaggtcttcaaagtgaggtccaaagaggacggccgactctatgctgttaaaaggagcatgagccccttcagagggcctaaagaccgcgcacggaagcttgccgaggtgggctcccacgaaaaggtgggccaacacccttgttgtgtacgccttgaacaggcctgggaagagggcggtattttgtatctgcagaccgaactctgtgggccatctttgcagcaacactgcgaagcttggggcgcatccctacctgaggcacaggtttgggggtacttaagagatacactgttagctttggctcacctccattcccaagggctcgtacacctggacgtgaagcctgcaaatatattcctgggtccgcgaggcaggtgcaagctgggagactttgggctgctcgttgaactggggactgccggagccggagaagtccaagagggggacccgagatacatggcaccggagctactccagggctcttacggcaccgcagccgacgtgttcagtttgggactcacaatcttggaggttgcctgtaacatggagctaccacacggcggggaaggatggcaacagttgcgccaggggtacctgccaccagagtttacggcaggcctgtcttcggagcttaggagcgttctggtgatgatgcttgaacccgacccgaagcttagagctaccgcagaggccctgctcgccctgccagtgctcaggcagccccgtgcgtggggcgtcttgtggtgtatggccgcagaggcactgagccgcggttgggccttatggcaggcccttctcgcactgctctgttggttgtggcatggcctcgctcatcctgccagctggctgcagcccttaggacctcctgccacacctccgggcagccctccctgcagcctcctgctggacagcagtctaagctcaaactgggacgatgactccctgggcccaggccatccaccttgtctggcatgtcccccggccggacttcactcaccgctgaggctgtcctggccaggtctgtggggtgcaccaccacctcccggcgcgggagcccatcccggcatgccttggacatag

SEQ ID NO: 16839 - DNA, 1740 bp, Artificial Sequence
  Description of Artificial Sequence: Synthetic coding sequence
atgagcgccgccaaccccgagacacctaatagcacaattagtcgggaagcttccactcaatccagttcagctgccgcgagtcaggggtgggttctgcctgagggcaaaatcgtacccaacactgttttcgtgggagggatcgacgcccgcatggatgaaaccgaaatcggatcctgctttggacgctacggttcagtaaaagaggtgaagatcattactaaccgaaccggcgtgtctaaaggttatggattcgtgagcttcgtcaatgacgttgatgtacagaagatcgtcggatcacagatccacttccatggcaaaaaactgaagcttgggccggctatacgtaagcagaaactgtgcgcgagacacgtccagccacgcccgctcgtggttaatccaccgccccctccccagtttcaaaatgtttggcgcaacccaaacactgaaacctatctccagcctcagattacccctaaccctgtaactcagcacgttcagtcagcggcgaaccccgagacccctaattctactatctctagagaagccagcactcagagctcgtcggcggccgcaagccaggggtgggttctacccgaaggcaagattgtgcctaatacagtttttgtcggtggtatcgacgctcggatggatgagaccgagatcggcagttgcttcggaaggtacggcagtgtcaaggaggttaaaattattacgaaccgcacaggagtgagcaaggggtacggttttgtcagtttcgtgaatgacgtagacgtgcaaaaaatcgtgggatcccagattcactttcacggtaagaagctcaagttgggccccgcgatccgcaaacagaaactgtgcgccagacatgtccagcccagacctcttgttgtcaatccaccaccaccaccacaattccaaaatgtctggcgcaatccaaacaccgagacctacttacagccgcagatcacaccaaaccctgtgacccagcacgtgcaagcctacagcgcttatccccactcccccgggcaggtgattacagggtgccagctccttgtctacaattatcaggaataccccacctatccagactctgcgtttcaggttacgaccggataccaactccctgtgtataactaccagcccttccccgcatatccaagaagcccattccaagtcaccgccgggtatcaacttccagtttacaactatcaagcctttccagcctaccctaatagccctttccaggtggccacaggataccagttccctgtttacaattatcaacccttccccgcctaccctagttctcccttccaggttactgccggttatcagctccctgtgtataactatcaggcttttcccgcctaccctaatagtccatttcaggttgccactggctaccagttccctgtttacaattaccaggcctttcccgcctaccccaatagccctgtgcaggtaacaactggctatcagttaccggtttataactatcaggcgttcccagcctacccaagcagcccgtttcaggtgacaacaggatatcaacttccagtgtacaactatcaggcattcccagcttaccctaattccgcagtgcaagtaacaactggttaccagttccatgtgtacaattaccagatgccaccccagtgtccagtcggagagcaaaggaggaatctgtggaccgaagcttataagtggtggtacctggtatgccttattcagaggagggattag

SEQ ID NO: 16840 - DNA, 975 bp, Artificial Sequence
  Description of Artificial Sequence: Synthetic coding sequence
atggaagctctggggccgggaggggaccgggctagtccggcatcctcgacgtcgtcgcttgatctctggcatctttcgatgcgggcggattctgcctactcaagcttcagtgccgcgtcagggggaccagaacctaggactcaaagcccggggacagatctccttccttacctggactgggattatgtgcgggtggtgtggggcgggcctggcccagctccaccggatgcggccttgtgcacatctccccgaccaaggcccgcagtggcggccaggtctggcccccaaccaacagaggtgccaggcacccccgggcccctgaacaggcaggccacacctctcttatatgctctagccgccgaagctgaggccgccgcacaggccgccgaaccaccttctcccccagctagcagggccgcttaccggcagcggctgcagggtgcccagcgtcgggttctgagggaaactagctttcagcgcaaggagctcagaatgagcctccctgctcggctccggcctaccgtgccagctaggccgccagcgactcatcctagatccgcttctctgagccaccccggaggggaaggggaaccagctaggtcacgagctccagctccgggcacagcgggtcgcgggccactggccaaccagcagcgcaagtggtgcttcagcgagcctggcaaactggacagagtgggacgtggtggcggacccgcaagagagtgtctaggtgaggcgtgctccagcagtggtcttcccggaccagaaccactggagttccaacacccagcgctcgctaaatttgaggaccacgaggtgggttggctccctgagacccaaccacaaggttcgatgaatctggattctggctcattgaagctgggggatgcctttcggcccgcctccaggagcagatctgcctcgggagaagttctcgggagctgggggggtagtggcggcaccattcccatttag

SEQ ID NO: 16841 - DNA, 780 bp, Artificial Sequence
  Description of Artificial Sequence: Synthetic coding sequence
atgccccgcgccaggtccgggcggcgatctcggggggctggaggccgcgaagaaaccttcctgcgtgtacgcgctaaccggcaaacaaggctgaacgcccgaatcggaaagatgaaacggcgtaagcaggatgaggggcagagggaaggctcatgtatggctgaagacgatgctgtcgatatcgagcatgaaaacaacaaccggtttgaggaatacgagtggtgcggccagaagcgaatacgggcaaccacactgttggaaggggggtttcgaggctcaggatttattatgtgttcgggtaaggagaatcctgacagcgacgccgacctggatgttgacggcgacgatacattggagtatgggaagcctcaatacactgaagctgacgtgatcccttgcacaggggaggaaccgggggaggccaaggagcgggaagcacttagaggagctgtcctgaatggtggccctccatcaacaaggattactcctgaattcagcaagtgggcatctgacgaaatgccctcaactagtaacggggagtcttccaaacaggaggctatgcagaaaacttgtaaaaattctgacatcgagaagatcacggaggatagcgcagtgaccacctttgaggctctcaaagccagggtacgagaattagagcgccagctctcacggggtgatcgttataaatgtctaatctgcatggactcctacagcatgccccttacatccattcaatgctggcacgtccattgtgaggaatgctggcttcgaactctttag

SEQ ID NO: 16842 - DNA, 369 bp, Artificial Sequence
  Description of Artificial Sequence: Synthetic coding sequence
atggccacctccgcccctctccgttctcttgaggaggaggtcacctgcagcatatgccttgattacctacgtgatcccgtcacaatagactgcggacacgtgttttgtcgaagttgtacaacagacgtccgcccaatcagtggcagtagaccagtgtgtcccctgtgcaagaagccatttaaaaaggaaaacattcgacccgtttggcagctcgcatctttagtcgagaacatcgagcggctgaaggtggacaagggcaggcaacctggagaagtcaccagagagcagcaggacgctaagctctgcgagaggcatcgggaaaaacttcactactactgcgaggatgatggaaaactgttgtgcgtttag

SEQ ID NO: 16843 - DNA, 984 bp, Artificial Sequence
  Description of Artificial Sequence: Synthetic coding sequence
atggcctccttcctgaaaggggcccatgtgactattaacgccagggcggaggaggatgtggagcctgaatgcatcatggaaaaagtggccaaggcctccggagcaaattactcattccacaaggagtcaggacgatttcaggatgtgggcccccaagcacccgtggggtctgtgtatcagaaaactaatgctgtcagtgagattaagagagttgggaaggacagcttctgggctaaggctgagaaagaggaagagaaccggcgattagaagagaagcgccgagcagaagaagcgcagaggcagcttgaacaggagaggcgggagcgggagcttcgggaggcagctagacgtgagcagcgatatcaagagcaagggggtgaggcctccccccagagaacatgggagcaacagcaggaggttgtcagccgcaatcggaacgaacaagaatccgctgtacatcctagggagatcttcaagcagaaggaacgagctatgtctactaccagcatctcttcccctcagcctggcaagctcaggtcaccgttccttcaaaaacaactcactcaacccgaaacccacttcggccgcgagcccgcagcggccatcagccgtccacgcgcggacttgcccgcggaggagcccgcccccagtacacctccctgcctagtacaggcagaagaggaagcagtctatgaggagccgccggagcaggaaacattctacgaacagcctcccctcgtgcagcagcaaggtgccggaagcgaacacatcgaccaccatattcaagggcaagggctgtcagggcagggcctctgtgctcgcgccttgtacgactaccaagctgccgacgacacagagatttcctttgaccccgaaaatctgatcacaggaattgaagtgattgatgaggggtggtggcggggttacggaccagacggacatttcggaatgttcccagccaactacgtcgagctgatcgagtag

SEQ ID NO: 16844 - DNA, 438 bp, Artificial Sequence
  Description of Artificial Sequence: Synthetic coding sequence
atgcagggccgcatcactaaagtgctcaacatgaaacctccggaaatcctgtccatgattgaagaagccgccggcacaaggatgtatgagtacaaaaagatcgctgcccagaaaactatcgagaagaaggaagccaaattgaaggaaatcaaaacaatcctcgaggaagagattacaccgacaattcaaaagttgaaggaggagagaagcagttacttagagtaccagaaggtaatgcgtgagatagaacatctcagcaggctctatatcgcttaccaattcctcctggccgaagatactaaggtgagaagtgcagaggagctgaaggagatgcaggataaggtcatcaaacttcaggaggaactgtctgaaaatgataagaaaattaaggccttgaatcatgagatcgaggagctcgagaagaggaaggataaatag

SEQ ID NO: 16845 - DNA, 816 bp, Artificial Sequence
  Description of Artificial Sequence: Synthetic coding sequence
atggaaaaagagacagggatctcgcagcaaaggaactactactttacgcaatccaagggggagcctttgcaaatcgaccacttggtgttcgtggtccacggcataggccccgcctgtgatctgagatttcgatcaattgtccagtgtgtgaatgatttccggtccgtcagcctcaatctgctccaaacacacttcaaaaaggcacaggagaatcaacaaattggacgggtcgagttcctcccggtcaattggcattctccccttcattcaactggcgtggacgttgatctgcagagaattactctaccaagcattaatcggctgaggcattttactaacgacactatacttgatgtgttcttttacaactcccccacatactgtcagactatcgtagataccgtagcaagtgagatgaataggatttacaccctgttcttgcagagaaaccccgacttcaaaggcggagtctccatcgccggtcactccctcggctccttaattctatttgatatcctgaccaatcagaaagattcattgggggacattgattcggaaaaggattcattgaacatagttatggaccagggtgatacacctacactggaggaagacctcaagaagctgcaactttcagaattcttcgacatcttcgagaaggaaaaggtcgataaggaagccctcgcattgtgtactgaccgcgacctccaagagatcggaattcctctgggacctagaaaaaatctgtctagcgccgtggctgtgatcctagaaatggtgaccatttggatgctcgcattgggacgatgcctgtag

SEQ ID NO: 16846 - DNA, 1818 bp, Artificial Sequence
  Description of Artificial Sequence: Synthetic coding sequence
atgggcggctgcttctccaagccaaaacctgtggagctaaaaatcgaggtggtgttgcctgagaaagagagaggcaaggaggaactctctgcctcaggaaaaggttctccaagagcctaccagggcaacggaacagcgaggcactttcatactgaagaaagactctctaccccccacccctacccttcaccccaggactgtgtggaagccgccgtttgccacgttaaggatttagagaacggccagatgcgagaggtggaactgggttgggggaaggtgctgctcgttaaagataatggcgaattccacgccttagggcacaaatgcccgcactatggagcccctctggtcaagggtgttctctctaggggtagagttagatgtccctggcacggcgcttgcttcaatatttccaccggggatctggaggatttcccaggtctggactctctgcacaaattccaggtaaagatcgagaaggaaaaggtctacgtgcgggcctcaaaacaggctttgcagctgcagcggcggaccaaagtcatggccaaatgtatcagtcccagtgctggttatagttcctcgacaaatgtactcatcgtgggcgctggtgccgccgggcttgtgtgcgctgagaccttacggcaagaggggttctcagacaggatagtactttgcacacttgaccggcatttgccttacgatcgtcctaagctgagcaaatccctcgacactcagcccgaacagctggctctccgacccaaggagttttttcgggcatatgggattgaagtgctgactgaagcccaggtggtaacggtcgacgttaggacaaagaaggtggtgtttaaggatgggtttaaactggagtacagtaaactgctcctggcccctggcagtagtcccaagaccctcagctgtaaggggaaagaggtcgagaacgtgtttacaatccggacaccagaggatgcgaatagagtagtccggcttgcaaggggtcgcaacgttgttgtcgtcggggccgggttcctgggtatggaggttgccgcgtacctgaccgaaaaagctcacagcgttagcgtggttgagctggaggaaactccctttcggcggttccttggagaacgcgtaggcagagctctgatgaaaatgttcgagaacaatcgagtcaagttctacatgcagacagaagtaagcgagctgcggggtcaagaagggaagctaaaggaggtggtcctgaaatcctctaaggttgttagggccgatgtatgtgtggtcggcatcggggcagtccccgccacaggatttctccggcaaagcggcattgggttagatagcagaggatttatcccagtgaacaaaatgatgcagacgaacgttccaggtgtgttcgccgcaggcgacgctgtcacctttccattggcatggcgcaataatcggaaggtaaatatcccacactggcagatggctcacgcacagggtcgcgtcgccgcccagaatatgctggcgcaggaagccgagatgagtactgtgccatatctctggaccgccatgtttggcaagtctctccgctacgcgggatatggcgaggggttcgacgatgttataatacagggagatcttgaagaacttaagtttgtggctttttacacaaaaggggatgaggtgattgcagtggcatcaatgaattacgaccccatcgtgtctaaggtcgcagaagtgctggcaagcggcagggcaatcaggaaacgggaggtagaactgttcgtcctgcacagtaagacaggcgacatgtcatggctcacaggcaagggctcgtag

SEQ ID NO: 16847 - DNA, 294 bp, Artificial Sequence
  Description of Artificial Sequence: Synthetic coding sequence
atgcagaccagttcttcacggagtgtgcacttgtctgagtggcagaagaactacttcgctatcaccagtggtatttgcaccgggccaaaggccgacgcctatagggcacaaattctcagaatccagtacgcctgggctaatagtgagatatcccaggtgtgtgctacaaaacttttcaaaaagtatgcagagaaatactctgccattattgacagtgacaacgtcgagagcggcctgaataattatgccgagaacattctcacattggccggcagccagcagactgattcgtag

SEQ ID NO: 16848 - DNA, 333 bp, Artificial Sequence
  Description of Artificial Sequence: Synthetic coding sequence
atggaggagattccggctcaagaggccgctggatcccccagagtgcagttccagagcctagagacccagtccgaatgcctaagccccgaacctcaatttgtgcaagataccgacatggagcagggattgacaggcggtatcctacttagactccctacgaccaggatccacagcgtgaacagttgtccggccttgtctcatacgcaggctagcgcgttctccggggagacactcgccgtgcttactgccgggatatcaaagagatggccaaagtacagactgcccattgacatcgcgaggccttgttccgaaacaccttttcctcgcctttag

SEQ ID NO: 16849 - DNA, 627 bp, Artificial Sequence
  Description of Artificial Sequence: Synthetic coding sequence
atggagccaccaatggaaccatcaggcggagaacaggagcctggcgcggtcagattcctcgatctcccatgggaggacgtgcttctgccccacgtgttgaatcgcgttcccctccgtcaactgctaaggctacagcgcgtctcccgagccttccgttccctggtccagctgcacttggctggactgcggcgcttcgacgccgcacaagtcgggccccaaataccacgcgctgcgttggcacgactcctaagggatgcagaggggctccaggagctggctctggcgccatgtcacgaatggttgtccgacgaggacctagttccagtgctcgctcgcaatccacagctgcgatccgtagctctcgggggatgtggccagctgtctagacgcgctttgggcgctctggccgaagggtgtccccgcctgcagcgcctgtccctggctcactgtgattgggtggatggcctggcgctgcgcgggctggctgatagatgtcccgccttagaggaactcgatcttactgcttgtcggcaattgaaagacgaggcaatcgtgtacctggcacagaggaggggcgccggactccgctcattatcactggccgtgaatgcaaacgtaggagactag

SEQ ID NO: 16850 - DNA, 1419 bp, Artificial Sequence
  Description of Artificial Sequence: Synthetic coding sequence
gtgactcattataagcaatatcctcctaatacgagtaaggtgtactcctatttcgagtgtagagagaagaagactgagaacagtaagttacggaaggtgaaatatgaagaaacggtgttttacggcctccagtatattcttaacaaatatctgaagggtaaagttgtgactaaggaaaagatccaggaagctaaagatgtttacaaagaacacttccaggacgatgtggttaatgagaaggggtggaattacatccttgaaaagtatgacggccacctccctattgaaatcaaagctgtgccagagggctttgtcatccctcgaggaaatgtgctgtttacagtggaaaataccgatccagaatgctactggctgaccaattggattgagactatcctggtacaatcgtggtatccgattacagtggccaccaatagtcgcgaacaaaagaaaatcctggccaaatacctgttagagacctccgggaacctcgacggtttagaatacaaactccatgattttggctaccggggagtgagttctcaggagactgcggggatcggggcgtcagcccatctggtgaatttcaaggggacagatacggtggctggactggccttgaataaaaaatactacggtacaaaagatccagtccccggctatagtgtaccagccgccgagcattccacaattactgcctgggggaaggaccacgaaaaggacgcctttgaacacatcgtgacccagtttagctcagtgcctgtctccgtagtgagtaactcctatgacatttacaacgcctgcgagaagatctggggggaggatctgaggcacctgattgtgtctcggtctactcaggcccctctcataatcaggcctgattctgggaacccgcttgatacagtcctcaaggtactggaaatcctgggcaagaaattccccgttactgagaattccaagggttacaagctgctacccccctatttacgggtgattcaaggtgacggtgtggacattaacactttgcaagagattgtggaaggcatgaaacagaagatgtggagcatcgagaatatcgcatttgggagtggggggggcctcctgcagaagttaacccgtgatcttttgaactgctccttcaagtgtagctacgtcgtgacaaatgggctcggtatcaacgtatttaaggatcccgtggccgatcctaacaagcggtcaaagaaaggacggctgtccctccaccgcaccccagctggtaattttgtgacactcgaggagggtaagggtgaccttgaggagtatggccaggatctgctccataccgtcttcaagaatggcaaagtgacgaagtcgtattcctttgacgagatccggaaaaacgcccagttgaatatagagttagaagccgcccaccactag

SEQ ID NO: 16851 - DNA, 519 bp, Artificial Sequence
  Description of Artificial Sequence: Synthetic coding sequence
tgcaagcaaagtacaaagactgaagagaagctgaggccaactcggacatcatcggagagtatatattcccgaccaggcagcagtattcctggatcacctgggcacactatctacgctaaggtggacaacgagattctcgattataaagacttggccgccattccaaaggtcaaagccatctatgatatagaacgtcccgacctgattacttacgaacccttttacacctctgggtacgacgataaacaggaacgacagagccttggcgagtctccgcgcaccctctctccaacccccagcgcagagggctaccaagacgttagggatcggatgatacatcgctctacatcccaaggcagtattaactcaccagtgtattctaggcactcatatacacctacaaccagtcgctccccgcagcatttccacagacccgaccagggtatcaatatttacagaaagccccccatctacaagcagcacgtgctgttcgaagtgatcctcctgctgcttatttag

SEQ ID NO: 16852 - DNA, 2445 bp, Artificial Sequence
  Description of Artificial Sequence: Synthetic coding sequence
atgcggttgttggacggaaaacaaaccagccgctactcagagaatgcctgcgagaaaaagatattctctatctacggccactatccagtcgtgagagcggccctccgcagaaagggctgggttgaaaagaaatttcacttcctccccaaggtaatcccagatgtggaagacgaaggcgctcgtgtgaatgacgacacctgcgcaaaggtgaaggagaatcaggagatggcacttgagaaaaccgacaatattcacgatgtcatgtcacgactcgttaagaatgagatgccatatctgctgtggaccatcaagagagacataatcgattaccactctctgacatacgaccaaatgctcaaccattatgcgaaaacagccagctttaccaccaaaattggtctgtgtgtaaatatgagatcccttccatggtacgtgcccgctaacccagatagcttcttcccacgatgctattctctctgcactgagtccgaacaacaggaattcctcgaagacttccgtagaaccatggcgagctcaattcttaaatgggtggtctctcaccaaagctgtagtcgctcttcgaggtctaagcctcgagatcagcgcgaggaagccgggagctccgatctttcctccaggcaggatgcagagaatgccgaggcaaaactgcgcggactccccggccagcttgtcgacattgcctgcaaagtgtgtcaagcctatttaggccagctcgagcacgaagacattgatacttctgccgatgccgtcgaagacttaacggaagccgaatgggaggatctaactcagcagtattacagccttgtgcacggagacgccttcatttcaaatagtcgtaattattttagccaatgccaagctttattgaaccgtattacatctgtgaatccacagacagatatcgatggacttcgcaacatctggatcattaaacccgcagccaaatcacgaggccgcgatattgtgtgcatggaccgagtggaggagatcctcgaactcgctgctgcagaccatcctctgtctcgggataacaaatgggttgtccagaagtacattgaaactccattattaatatgcgacaccaagttcgacatccgccagtggttcttagttaccgactggaaccccctcactatttggttctataaagagtcatacctccggttcagcacccaacgcttttcgctagataaattagactcggccatccacctgtgcaacaacgccgttcagaagtatctgaagaacgatgtgggtaggagccccctactgcccgcacataacatgtggacatcaactaggttccaagagtacctgcaacggcaaggcaggggtgcagtctggggaagtgtgatttatcctagtatgaagaaggccattgctcatgcgatgaaggtagctcaggaccacgtcgagccacgcaaaaactcctttgaattgtatggtgcagacttcgtgcttggtcgtgacttcaggccatggctgattgaaatcaactctagcccgactatgcatcctagcactcctgtgactgcacagttatgtgctcaggtccaggaggatacaatcaaggttgctgtggatcgatcctgtgacatcggcaacttcgagcttctgtggcgccaaccggtggtagagccaccccctttttcaggctctgatctgtgcgttgctggcgttagcgttcgccgcgcccgccggcaggtactgccggtctgcaatctgaaggcaagtgccagtctgctggacgcgcagccattgaaagcaagaggacctagtgccatgcctgatcccgcacagggccctcccagcccggccctccagcgggacctcggtctcaaagaggagaagggactgccccttgccctgctggctccccttcgaggcgcagctgaaagcggcggcgccgcccagccgacaaggaccaaggccgccggcaaggtagaattaccagcctgtccatgccgccacgtcgatagccaagctcccaatactggagttcctgtggcacagcccgccaaaagctgggacccaaatcagctcaatgcccacccactggagccagtgctgcgaggactgaagactgcagagggggctcttcgaccacccccaggggggaaaggcgaaggtacagtgtgttcccggcttcctcaccatggccatcacgttgccgcatgccaaaccaccggcactacttgggatggcggaccaggcgtttgcttcttgagacagcttctcgcttcggaactacccatgggcccgggtctgcctagggatcccagagcccctccttgtctggtgtgcagaggccttcttccccctgcaggcccctgtaagcgctgccggtccttctgtgccgcagtcctgcagggggcctcattcgtccgactggggggcagatcttgcagccccagaactccttag

SEQ ID NO: 16853 - DNA, 318 bp, Artificial Sequence
  Description of Artificial Sequence: Synthetic coding sequence
atggacaagaatattggtgaacagttgaataaggcctatgaggcctttcgccaggcctgtatggaccgggattccgctgtgaaagagttgcagcagaaaacagaaaactatgaacaaaggataagggaacagcaggagcagctcagccttcaacagactattatagacaagctgaagagtcaactgctgctggtgaattccacgcaggacaataattacggctgtgttccccttttggaagattccgagacaaggaaaaacaacctgacacttgatcagccgcaggacaaagttatttccggtatcgctcgtgagtag

SEQ ID NO: 16854 - DNA, 816 bp, Artificial Sequence
  Description of Artificial Sequence: Synthetic coding sequence
atggcacccgttggtgtcgaaaagaagttgctgctgggtccaaatggccccgctgtcgcggccgctggagatctgacttctgaggaggaggagggccagtctctgtggtcgtcaatcttgagcgaggtctctacgagggcccgctccaagctcccttccggaaaaaacatactggttttcgatcatactcgctgcaacgtgtggatcctagacggcgatctgtatcacaaagggctgctgaaatttgctgttagcgcggagtcactccctgagactctggttattttcgtggctgatatgagtagaccctggactgtcatggagtccctccagaagtgggccagcgttctgcgagagcacattgataagatgaaaatcccaccagaaaagatgagagagctagagaggaagttcgtgaaagacttccaagattacatggagcctgaagaggggtgccagggctcgccgcagaggcggggcccactgacatcgggttccgacgaggaaaacgtggcgctgcctcttggcgataacgtactgactcacaacctgggaatcccagtgctcgtggtgtgcaccaaatgcgacgcagtgtccgttctggagaaggagcacgattatagggacgagcaccttgactttattcaatcccacctccggcgcttctgcttgcagtacggcgcagcactgatctatacctcggtgaaggaggaaaagaacttggatctgctttataaatatattgtgcataaaacttatgggtttcacttcaccacgccggccctcgtcgttgaaaaggatgcggttttcatgtag

SEQ ID NO: 16855 - DNA, 522 bp, Artificial Sequence
  Description of Artificial Sequence: Synthetic coding sequence
atggctgaccgaatgcagattgtggttatactgtcagagttcttcaacaccacctggcaagaggcaaattgtgcaaattgcctcacaaataatagtgaggagctgtcgaactctactgtgtattttctaaatctgttcaaccacaccttaacgtgctttgagcataatctgcagggcaacgcccattctctgctacaaactaagaactacagcgaggtgtgtaagaattgccgggaggcctataaaaccttgtcctctctctactccgagatgcagaagatgaacgagctggaaaataaggccgagcccggcacccatctctgcatcgacgtggaagatgctatgaacattaccaggaagctctggtcccgcacctttaattgttccgtcccttgtagtgacaccgtgcctgttatagcagtgtcagtgttcatactgttcctccccgtggtgttctacttgagctcatttttgcacagcgaacagaaaaaacggaagttaattctgcccaaacgactttag

SEQ ID NO: 16856 - DNA, 435 bp, Artificial Sequence
  Description of Artificial Sequence: Synthetic coding sequence
tgattcatccattgcactgatgacagcccggacccctgtattgaatatgagctggtgctgcgcaagtggtgcgagctgatcccaggggccgagtttcggtgctttgtaaaggagaacaaactcatcggcatttcccagagggactatacccaatattatgaccacatttctaaacagaaggaggaaattagaagatgtattcaggacttctttaaaaaacacatccagtacaagtttctggatgaggacttcgtttttgatatctaccgcgattcgcgaggcaaagtttggcttattgacttcaatccctttggggaagtaaccgacagtctgttatttacatgggaggaactcatctctgaaaataatctcaacggtgatttcagtgaggtagatgctcaagaacagaaaagaaaccagcaggaggacgactag

SEQ ID NO: 16857 - DNA, 978 bp, Artificial Sequence
  Description of Artificial Sequence: Synthetic coding sequence
tgaattcagggggaggctagcaggagagctgccggtgaaccggaggctggaagtgattatgtaaagttcagcaaagagaagtacatcctggactcgtctccggagaaactgcacaaggagcttgaggaagaactgaagcttagctcaactgatctcagaagtcatgcctggtaccacggaaggatcccacgggaagtcagtgaaactcttgtacagagaaacggcgattttcttattagagactccttgacgagcttaggtgattacgtcttgacctgccggtggaggaatcaggccctgcatttcaaaatcaacaaagtcgtggtgaaagctggtgaaagttacacccacatacagtacctcttcgagcaggaatccttcgaccacgttcccgccttagtgagatatcatgtgggctcccgtaaggcggtgtccgaacaatcaggggccatcatctactgccccgtgaaccggacctttcctttgcgatacctggaggctagctacggactgggacaggggagtagcaaacctgcatcccctgtgtctcctagcggccctaagggcagccacatgaaaaggcggtccgtcactatgacagacggcctcactgccgacaaggtaacccggtctgatgggtgcccgacgtccactagcctcccaagaccacgcgacagcatcagatcttgcgctttgagcatggatcaaattccagatcttcacagcccaatgtctcccatatctgaatccccgtcaagtcctgcctattctacagtgacaagagtacatgctgctcccgctgctccctctgctaccgcactgcccgcgtctcccgtggcccgcagatcttctgaaccacagttgtgcccaggctctgctcccaaaacgcacggggagagcgacaaaggaccgcacacaagcccaagccatactctggggaaggcttctcctagcccaagcctgagttcttattcctag

SEQ ID NO: 16858 - DNA, 330 bp, Artificial Sequence
  Description of Artificial Sequence: Synthetic coding sequence
atgtccagcaaagggtcctccacagacggccgcaccgaccttgctaatgggagcttgtcttcgagtcctgaagagatgtccggagccgaagagggtagggagacaagctctggcatagaggttgaggcatccgatctcagccttagcctgaccggcgacgatggtgggcctaatcgcacctctaccgaaagcagaggaacagacacagaatcgtcaggcgaagacaaggactccgacagcatggaagacacggggcactactccatcaatgatgaaaaccgcgtgcatgacagatccgaggaggaagaagaggaggaagaggaggagtag

SEQ ID NO: 16859 - DNA, 1638 bp, Artificial Sequence
  Description of Artificial Sequence: Synthetic coding sequence
gccgccggagctcctaggctactagggcccggggccgtgagggggcccgcaggcgtgggacgcgttgctgccggggcgatggagggcgtgctatacaagtggacgaattatctttccgggtggcagccccgttggttcctgctgtgcggcggtatcctgtcctattacgacagcccggaggatgcttggaagggctgtaaggggtcaattcagatggctgtatgtgagattcaggttcattctgtggacaacacccgaatggatttgattatcccgggagagcagtatttttatcttaaggccaggtcagttgctgaacgccaacgctggttggtcgctctgggttccgccaaggcctgcctaactgattcccggacccagaaagagaaggagttcgccgagaacactgagaacctgaaaacgaaaatgtctgagctgcggctttattgcgatctgctggtccaacaggtggataagaccaaagaggtcactacgacaggtgtgtcaaacagtgaggagggaatcgacgttggtacgctgctgaaatctacttgcaacacgtttctgaagactctggaggaatgcatgcagatcgctaatgccgctttcacctctgagctgctttaccgaacgccacccgggtctccccagctagctatgttgaagtcatccaaaatgaaacaccctattataccaattcacaattccctggagagacagatggagttgagcacttgtgagaacggctctctgaatatggaaataaacggagaagaagaaattcttatgaaaaacaaaaactctctgtatctgaagagcgccgagatcgattgttccatctcttccgaggagaataccgacgacaacatcactgttcaaggcgagatacggaaggaggatggaatggaaaaccttaaaaatcacgacaacaacttgacccagagcgggtcagattcctcctgtagccccgaatgcctttgggaagaaggcaaggaggtgatcccaacatttttctcaactatgaatacaagcttttccgatatcgaactgctggaggactcagggattccaactgaagccttcttggcatcttgctacgcagtcgtcccagtcctagacaagcttggacccactgtgttcgcgccagttaaaatggatttagtcggcaacatcaagaaggtcaaccagaaatatattacgaataaggaagagttcactactctgcagaaaatcgtcctgcatgaagtggaagcggatgtggcccaagttcggaatagcgctacagaagctctcctatggctcaaacggggcctcaagttccttaaaggatttctaacagaggtgaagaacggtgaaaaggatattcagactgccctgaataacgcatatggcaaaacccttcgccaacatcacggatgggtggtcaggggggtgttcgctctggcacttagagcagcgccttcctacgaggatttcgttgccgcactcaccgtcaaagagggggaccatcagaaagaggcctttagtataggcatgcagcgggatctgagcctctacttaccggctatggagaaacaactcgcaatcctggacacactctatgaagtacatggcctcgagtctgatgaggttgtgtag

SEQ ID NO: 16860 - DNA, 522 bp, Artificial Sequence
  Description of Artificial Sequence: Synthetic coding sequence
atgtatacattgttatcaggactctacaagtacatgttccagaaggatgagtattgtattctcatactgggcttggacaatgccggcaaaacgacatttctagaacaaagcaagacgcgttttaacaagaactacaaaggcatgagtctctcaaaaatcaccaccacagtgggtctgaatatcggcaccgttgatgtgggcaaagcccgcctgatgttttgggacctgggggggcaggaagagcttcaatcactgtgggacaaatattacgcagagtgccatggcgtgatttatgtgatcgacagtaccgatgaggaaagattggcggagtctaaacaggcattcgaaaaggtcgtgaccagtgaagcgctgtgtggcgtgcccgttttagtactggccaacaagcaagacgtggaaacttgcctgtccatacctgacatcaaaaccgcctttagtgattgtacttccaagatcggtagacgggactgtctcacccaagcttgctctgcactcacaggctag

SEQ ID NO: 16861 - DNA, 729 bp, Artificial Sequence
  Description of Artificial Sequence: Synthetic coding sequence
atggggctcgtgtgtgtgctcggggacggtaaaaccgagcaaaagggtggggataagaaacggggcgtcaaaaggccccgagaggaccacggcagaggatactttgagtatattgaggagaacaagtacagtcgggccaagtccccccagccacccgtggaagaggaagacgagcattttgatgatactgtggtgtgtttagacacctataattgtgatttacatttcaagatctcccgggataggctgtcagcctcctcccttactatggagtcctttgccttcctctgggccggcggtcgcgcctcgtacggtgtgagcaagggcaaagtttgtttcgagatgaaagtgactgagaagatccctgtcagacacttgtatacaaaagacatcgatatccatgaagtgcggatagggtggtccttaacaaccagtggaatgctgctgggggaagaggagttctcttatggttattctctgaaaggcattaagacatgcaattgtgagaccgaagactatggggagaagttcgacgagaacgacgtcataacatgcttcgccaactttgagtccgatgaggtcgaattatcctatgccaagaatggccaagacctaggagttgcatttaagattagcaaggaagtcttggccgggcgacccttgttcccccatgtgctatgccacaactgcgccgtcgaatttaatttcgggcagaaggagaagccatag

SEQ ID NO: 16862 - DNA, 2922 bp, Artificial Sequence
  Description of Artificial Sequence: Synthetic coding sequence
agctcatccgacaaagaatcaattctgacaatactcaaagtgctcggagatctcctctcagtcgggacggatcgccggattcattatatgatctctaaggggggcagcgaggcccttctgcagacactcgtggacacagctcgtactgcaccccccgactacgatatcctgttgccacttttccgcctactggcaaaagtcggactcagggataaaaaaattgggcggaaggccctcgagctggaggcattggacgtgacactcattttggctcggaagaatctctcacacgggcaaaacctgctacattgtttatgggctctgagagtgttcgcctctagcgtgtctatgggggccatgctgggtattaatggtgcaatggagctgctcttcaaggtaattactccttacaccagaaagcggacacaagccatacgggccgctaccgaggtgctggctgccttgcttaagtccaaatcgaatgggcgaagagcagtgaacagaggctacgtcacttctctcttaggtctgcaccaggactggcacagccacgatacagcgaatgcttacgtgcagatccggcgcggcttgctgctgtgtctcagacacatagcagctcttcgatccggacgggaggccttcctggccgcgcaaggcatggagatcctcttttccactacacagaactgcctagatgacaagtcgatggaaccagtgatttcggttgtgctgcagatcctgcgccagtgttaccctactagtccactccccctggtgaccgcgagctcagcatatgcgttccctgttccaggctgcataacgacagaacccccccacgacctgccagaagaagattttgaggatgatggagatgacgaagtcgacaaagacagcgatacagaggacggaaaagtggaggacgatgacctcgagacagacgtgaataagctgagtagtaagccaggactggatcgaccagaagaagaattaatgcaatacgaggttatgtgcctggagttgagctacagcttcgaggagcttcagagcaagctgggcgacgatctaaacagcgaaaaaacacaatacgctaaccatcaccacatcccagcagcagcctcatctaaacagcactgctactcaaaagaccagtcatcctgtggacaagaaagggaatacgccgtgcagacctctctgctgtgcagagtcaagaccgggcgttctactgtgcaccttggttccaaaaagaatccaggcgtcaatttgtaccaaaacgtgcaaagcaactctctccggagggattctagtgaatctgaaattcccgatatccaggcttcccccaaagctgatgcttgggacgtggacgccatattctgtcctcggatgtcggcatcattctctaattctaccagaaccagggaagttgttaaggtgattgataagctcctgcagacacatctaaaacgcgtcccctttcatgacccgtatctgtatatggccaaggcccgaagaaccagctcggtggtggacttcaagatgatggcctttcctgatgtgtggggccattgccctcccccaacaacccagccaatgctggaacggaagtgcggcgtgcagagaatccggatttttgaggacataagacgcctgattcagccaagcgatgtgataaataaagtcgttttctctttggatgagccctggccccttcaagataatgcgtccaactgcctcaggtttttctcaaagtttgagagtgggaatcttcgtaaggcaattcaggtgcgagagtttgaatacgacttacttgtgaacgccgacgtgaacagcacccagcatcaacagtggttctactttaaggtctccgggatgcaggcagctatcccgtaccattttaacatcattaactgtgaaaagccaaattcgcagttcaactacggaatgcagccaacactgtactccgtgaaggaagcgctccttggtaagcccacctggatcagaacaggtcacgagatctgctattacaaaaaccactatcgccaatccaccgccgttgctgggggcgcctccggaaagtgttattataccctgacttttgccgtcactttccctcattctgaggatgtatgctatctcgcctaccattatccctacacgtacaccgccctaatgactcacctagatattctggagaaatctgtgaacctcaaagaagtttacttccggcaggacgtgctgtgccagactctgggaggtaacccctgccctctggtcaccattacggctatgcctgagagcaacagtgacgagcatctggaacagttcagacacaggccttaccaggtaataacagcgcgcgtgcatcccggagagagtaatgcatcttgggtaatgaaggggacactcgagtttctggtgagtagcgaccctgtggctcggctattgcgcgaaaatttcatttttaagattattcccatgctgaatccagatggggtaatcaatgggaatcatagatgctctctcagcggagaggacctcaacagacagtggttaagtccatcagcccacctgcagcccactatataccacgccaaggggctcctgtaccacctgagttcaatcgggagaagtcctgtcgtgtcacactttctgctggtcttctgcgacttccacggccactcacagaagaaaaacgtttttctgtatggctgttccattaaagagactttatggcaggcagcgtgtacggttggcacctcgactatcctggaggaggtaaactatcggacactgcctaagatccttgacaagctggcccctgctttcacaatgtccagctgctcctttttggtagagaagtctcgtgcatctactgccagagttgtggtgtggcgcgagatgggggtgtctcgctcgtatacctag

SEQ ID NO: 16863 - DNA, 7752 bp, Artificial Sequence
  Description of Artificial Sequence: Synthetic coding sequence
tagagctctatcacattctctgttaaagtcgaggggagacctgtccccacagttcattggctgcgcgaggaagccgaacggggcgtgctgtggattggcccagacaccccaggctacacagtagcaagctctgcacagcagcactctttagtactgcttgacgtgggacggcagcatcagggcacctacacatgtatagctagtaacgccgcagggcaagccctgtgtagtgcgagcctccatgttagtggcttgcccaaggtggaggaacaagagaaggtcaaggaggctttgatctccaccttcctgcagggcaccacccaggctatcagcgctcagggacttgagacagcctcattcgccgatctcgggggccagagaaaggaggaaccactggccgcaaaagaggcgctgggccatcttagcctggccgaagtaggcactgaagaattcctgcagaagctcacatcccagataaccgagatggtgtcagcaaaaatcacccaagctaagctccaggtacctggaggcgactctgatgaggatagtaagactccctctgctagtcctagacatggccgctcccgacctagctcatccatacaagaaagctcttccgagtccgaggacggggacgcacggggagagatcttcgacatctatgtcgttacagctgactaccttccattgggtgcagagcaggacgcaattactttacgagaaggccagtatgtggaagtgcttgacgctgcacatccgctaaggtggctcgtgagaactaagccaacgaagtccagtccgagccgacaaggatgggtttccccggcttatctcgatcgaagactgaaactgagcccagaatggggggctgctgaggcccccgaatttcccggtgaggctgtatctgaggacgaatataaggcacggttgagcagcgtcattcaggagctcctttcttctgaacaagcgtttgtggaggagttgcagtttctgcaatcccatcacctacagcacctggagagatgtccgcacgtcccgattgccgtagctggacagaaggccgtgatctttcgcaacgtgagagatattggccggtttcacagctccagtttcttgcaagaactgcagcaatgtgataccgacgacgacgtggcaatgtgtttcattaagaaccaagctgctttcgagcagtacctggaattccttgtgggcagagtccaagcagaaagcgtcgtagtgtcgaccgctattcaggaattctacaagaaatacgctgaagaagctctacttgcaggtgacccatcccagcccccccctcctccattgcagcattatttggagcagcctgtggagcgtgtccaaagataccaggctcttctcaaggagttgattagaaacaaagcgcggaacagacaaaattgtgccttactggaacaagcctacgccgtggtgtccgccctgccccagcgggcggaaaacaagttacacgtgtccctgatggagaactatcctggcaccctgcaggccctgggagaacccatcaggcagggccacttcatagtatgggaaggcgcccctggagcaaggatgccatggaagggtcacaaccgacacgtttttctgttcagaaatcatctggtgatatgtaagcctagacgagactccaggacagacaccgtgtcatacgtttttcgaaatatgatgaaactaagctccattgacctgaacgaccaagtcgagggagacgaccgcgctttcgaagtttggcaagaacgtgaggatagtgttaggaagtacttgttgcaagcccgtactgccattattaaatcaagctgggtgaaagagatttgcggcattcagcagaggctggcgttgcctgtctggcgcccacccgactttgaggaggagcttgccgactgtaccgctgagctcggagaaacagttaaacttgcatgtcgggttactggaaccccaaaaccagtgatctcctggtataaagacggcaaagccgtgcaagttgatccacatcacatactgatcgaagatccagacggcagttgcgcactgattttggattcactgaccggagtggacagtgggcagtacatgtgcttcgccgcttccgccgccggtaactgctctacactgggaaaaatactggtgcaggtaccacctagattcgtgaataaggttcgcgctagccctttcgtagagggtgaggacgcccaatttacctgcacaatcgagggtgcgccctacccccagatccgctggtacaaggacggcgcccttctgaccactgggaacaagttccaaactctgtcagagccccggtctggccttctggttctggtgatccgggcagccagcaaagaagatctgggcttgtatgagtgcgagctcgtcaaccgacttggcagcgctagggcgtcagctgagctgcgaattcaaagccccatgctgcaggcacaagaacagtgccacagagagcagctggtcgccgccgtcgaagatactactcttgagcgggctgatcaggaagtgacttccgtcctgaaacgtcttctcggacctaaggcccccggacctagtacaggagacttgacaggaccgggtccatgcccacgcggtgccccagcgctgcaggagactgggtcacagccccccgtgactggaacctcagaagcccctgccgtgccacctagagttcctcagccactactgcacgaaggaccagagcaggaaccggaagctattgccagagcacaggaatggacagtccccataaggatggagggagccgcttggccaggggctggaacgggagagctgctgtgggacgtccatagccacgtggtccgcgagacgactcagcgaacgtatacctaccaggcgatcgacacacacaccgcacgcccaccctctatgcaagtgactattgaggacgtccaggcacagaccggcggtaccgctcagtttgaagccatcattgagggcgacccccaaccttcggtaacttggtacaaggattccgtacagctagtagattcgactcggctgtcacagcagcaggaaggaactacttactctttggttttacgacatgttgccagcaaggatgccggcgtgtacacttgccttgcccagaacactggagggcaggtgctttgcaaagcagagctgctcgtgctgggtggtgacaacgagccagactcagagaagcaaagtcaccggagaaaactccacagcttttatgaggttaaagaggaaataggccgaggtgtgttcggcttcgtgaagagggtgcagcacaaaggaaataaaattttgtgtgcagcaaagttcattccactgcggtcccggacacgcgcacaggcatatagggagcgcgacatcctagccgctctgtctcacccgctcgtcactggactgttggatcaattcgagaccagaaagactctgatactgatactcgagctgtgttctagcgaggagcttctggacaggctgtatcgcaagggggtggtcacggaggcagaggtcaaagtgtacattcagcagctggtagagggattgcattacctgcacagccatggggtgcttcacctggatatcaagccttccaacatcctgatggtacaccctgcgagggaagacattaaaatatgcgacttcggtttcgcccagaatatcacacctgctgagctacagttttcccaatatggttcccctgagttcgtgagcccagagataattcaacaaaatccagtttctgaagccagcgatatctgggccatgggagtcatttcctacctgtcactcacatgtagcagtccctttgccggagaatccgatagggccaccctgttaaacgtacttgaagggcgggtcagttggtctagccctatggcggctcatctgtctgaagatgccaaggattttattaaggcaactctccagcgggccccccaggctcgaccaagtgccgcccagtgtctgtcacatccatggttcttaaaaagcatgcccgccgaggaggcacatttcatcaatacgaaacagcttaaattcctgctggcaagatcacggtggcaacgatccctgatgtcgtataaaagcatccttgtgatgaggtccatccctgagttgttacggggtccccccgacagcccatcactcggggtggcgagacatctctgcagagatactgggggttcatccagtagttcatcgtcatctgataatgaactggccccgttcgcgagggccaaatctctccctccaagcccagtgactcacagccccctattacatccccggggctttctgcgcccaagcgccagcctccctgaggaggctgaggcttcagagcggtcaactgaggctccggctcccccagcctcacctgagggagctgggcctccggccgcccaggggtgcgtgccacgccattctgttattcgaagtctgttttatcaccaggctggagagagtccggagcacggtgccttggctccaggaagcaggcggcaccccgcccgacgccggcacctgctcaaaggagggtatatcgccggcgccctacctggcttgcgggagccactcatggagcaccgggtactcgaagaagaagccgcgcgagaagaacaggcgacacttcttgcaaaagctccatcattcgagacggcactgcgtctgcccgcctctggcacacacctggcccctggccatagtcattccttagagcacgatagcccttccacaccgcgaccttcgagcgaggcctgtggcgaggctcagcgactcccaagtgccccttcaggcggagcaccaatcagagacatgggccacccccagggcagtaagcagctcccatctactggcgggcatcccgggactgcacagccggagcgccctagtcccgacagtccatgggggcagcctgctccattctgtcacccaaagcagggctcagcacctcaggaggggtgcagcccacatcccgccgtcgctccttgcccgcccggcagctttccacccggttcatgcaaggaagcccctctggtgccgtcgagcccattcctcgggcagcctcaggctccacctgctcctgccaaggccagcccccctctggacagtaaaatgggtcctggtgacatttctctccccggaaggcccaagcctggcccctgtagttcccctgggagcgcaagtcaggcctcctcatctcaggtgtctagcctaagggtgggaagtagtcaagtcggcaccgaaccgggacctagtttggacgccgagggctggacccaagaggctgaggatctgtctgattccactccaaccctgcagaggcctcaggaacaggccacaatgagaaagtttagcctgggcggccggggcgggtatgcgggcgtagctgggtacggcaccttcgcatttggtggcgacgcaggggggatgctgggccagggccccatgtgggcccgcattgcctgggcggtaagtcagagcgaggaggaggagcaggaagaagcgcgcgcagagtcccagagcgaggagcaacaggaggctcgtgctgagagcccactgccgcaggtctcagcacggcctgtgccagaggtaggcagggcaccaacacggtcctctcccgaaccaaccccttgggaggacatcgggcaggtgtcattggttcaaatacgtgatctgtccggtgacgctgaggcggccgacaccattagcctggatataagcgaagtcgaccctgcatacctaaatctgtccgacttatatgacattaagtacctcccctttgagttcatgattttccgaaaggtgcccaaatcagcgcagccagagccacccagccctatggctgaagaagaactggccgagttcccagagcctacttggccatggcccggtgagctaggcccacacgccggtctggaaatcacagaggagagcgaggatgttgacgcactgctggccgaagctgccgtcggcagaaagcgaaaatggagtagcccctctcggtcactctttcacttccctggacgccatctgcctctcgatgagccggcggaactgggcctgcgcgaacgggtgaaagcaagcgttgaacatatctcacgcatccttaaaggccggcctgaggggctggagaaggaaggtcctcctcggaagaagcccggacttgccagttttcggctttcaggactcaagtcatgggatcgcgcacctacatttctgagagaattatccgatgagacggtcgtcctgggccagagtgtcaccctggcttgtcaggtttctgcacaacctgccgctcaggctacctggtccaaggacggggctcccctggagagttccagcagggtccttatttccgctacactgaaaaactttcaattgctcactatcctcgtagtggtggcagaggacctgggtgtgtacacctgttccgtttcaaacgcccttggcacagtcactacaacaggggtgctgcggaaggccgagcggccatcatccagcccatgccctgacattggcgaagtttacgcagatggagtgctgttagtgtggaaacccgtagaatcttatggacctgtgacttatatcgtgcagtgcagcctggagggcggatcttggacgactttggcttccgatatttttgactgctgttacctcacttccaagttatcccgtggaggcacctacacattcaggacagcgtgcgtgtcaaaagccggcatgggaccctatagttcaccctcggaacaggtcctacttggcgggccatcgcatttagcctctgaagaagaatcccaaggccgttccgcccagcctctcccatctaccaagaccttcgctttccagacccagattcagcgcggaagattctccgttgtgcgccagtgttgggagaaggcaagcggtcgggccctggcagccaagataataccatatcaccctaaagacaagactgctgtgctgcgggaatatgaggccctgaaggggctgcggcatcctcacttggcacagcttcatgctgcttacttgtccccgcggcacctcgttctcatcttggaactgtgcagcggacctgagctgctaccgtgtctggccgagcgggcctcatatagcgagtccgaggtcaaggactacttgtggcagatgctctctgctacgcagtatctccacaaccaacacatcttgcatctggatcttaggtccgaaaatatgatcattactgaatataacctgctcaaggtggttgatctcgggaatgcacagagtctcagtcaggaaaaggtcttgccctctgataaatttaaggattatcttgaaaccatggaactccttgaggggcagggtgctgtcccccagaccgacatctgggcaataggggtcacagcgttcataatgctgagcgctgaatatccagtttctagcgagggcgcaagagacctacagcgaggcctgagaaaggggctggtgaggctcagcagatgctacgctggactgtctggaggagccgttgctttcttgcgaagtaccttgtgcgcccagccttggggtcggccttgtgcaagcagctgcctccagtgtccctggttgacagaagaaggaccggcatgctcacggcccgcccccgtgacttttcctaccgcacgccttagggtatttgtgaggaatcgcgaaaagagacgcgcactgctgtataagaggcacaacttagcacaggtgcggtag

SEQ ID NO: 16864 - DNA, 1749 bp, Artificial Sequence
  Description of Artificial Sequence: Synthetic coding sequence
atggaaaaagcggttaacgatggatcccactccgaggaattattttgccacctcaagaccatctcagaaaaagaagatctgccaagatgcacaagtgaatcccatttatcctgcctcaaacaggatattcttaacgagaagaccgaactcgaagccacattgaaggaggctgaattagtgactcactccgtcgagcttctcctgcctctctttaaagacactatagagaaaattaatttcgagaacgctaatcttagtgccctgaatcttaagatttctgagcagaaggagattctcatcaaagaactggacacattcaagtctgtgaagctggccctagagcacctactgagaaagagagactataaacagaccggggataacttgtcctcgatgttactcgagaacctcacggacaacgaatcagaaaacacaaacctcaagaagaaggtgttcgagaaagaggcccatatccaagagctctcgtgtctcttccagagtgagaaggcaaacaccctgaaagccaaccgcttctcacaaagtgttaaggttgtacacgagcggctgcagatacagattcacaaaagagaagccgaaaatgataagcttaaggagtacgtgaaatcgttagagacaaagatcgctaaatggaacctgcagtctaggatgaataaaaacgaggccatcgtgatgaaagaggccagcaggcagaaaacagtagcccttaaaaaagccagtaaggtatataaacagcgactggaccattttacaggtgctatcgagaaactgacaagccagatcagagaccaggaggctaagctctccgagacaatctcagcgtctaatgcttggaagagccattacgagaagatcgtaatcgagaaaactgaactggaggttcagatcgagaccatgaagaagcaaatcatcaacctgctcgaggatctgaagaagatggaagaccacggcaagaactcgtgcgaggagatcctgagaaaggtgcatagcatagagtacgagaacgagactctaaacctggagaacacaaagctgaagactacgctggcggcgctaaaggacgaggtggtgagcgtggagaatgaactaagcgaattacaggaggtggagaagaagcagaagacactcatcgaaatgtacaaaacccaggtgcaaaaattgcaggaggccgccgagatcgtgaaaagccgctgcgaaaacttattgcacaagaataatcaaatcaccaagaccaaaaacaagaatgtcgaaaaaatgcgaggacaaatggagtctcacctcaaggagctggagcgggtgtgtgatagtctgacggccgctgagagaagattgcatgaatgccaagttgatggcaaccataacctcttgacaaagctgtccctggaggaagaaaattgcctgatccaactgaagtgtgaaaatcttcagcagaaattggaacagatggacgccgagaataaggagttagagaaaaagctcgccaatcaggaagagtgcctaaaacacagcaatcttaagttcaaagagaaaagcgcagagtacaccgcattggcgcgtcagcttgaggccgctctggaggaaggacggcagaaagtggcagaggagattgagaagatgtcctcacgagaatccgcactccagataaagatcctcgatctggagacggagctcaggaagaagaacgaagagcagaaccaactggtgtgcaaaatgaatagcaccaatggttag

SEQ ID NO: 16865 - DNA, 384 bp, Artificial Sequence
  Description of Artificial Sequence: Synthetic coding sequence
atggtctccagtggcaggagatggcttcgggaacagcagcatcggcgctggcgcttgcactgcctaaagctgcagccattatcacctgtcccttcggatattgagataagcagaggccagaccccaaaagccgtggatgtactggccaaagagatcggattacttgcagacgaaattgaaatatacggtaaatcaaaagccaaagtgcggctgtcagtcctggagcggttgaaggatcaggccgacggaaagtatgtcctggtcgccggaattaccccgacgccccttggcgagggaaaatctaccgtcactattggcttggtgcaggcactgactgctcacctgaacgtcaattcattcgcctgcctcagacaaccctcttag

SEQ ID NO: 16866 - DNA, 1929 bp, Artificial Sequence
  Description of Artificial Sequence: Synthetic coding sequence
atgaaaatcttctgctctagagccaaccctacaaccggttccgtcgagtggctggaggaggatgagcactacgattaccatcaggaaatcgcccgtagctcttacgccgatatgctgcatgacaaagaccgggtctttaagcctatggcagatgccgccgtcaaaatcgtggagaaaaacggcttttcggacaagattaaagttataaacaagcattctactgaggtcacagtcgggccagaaggggacatgccatgcagggccaatatcttggtaactgaactctttgacaccgagctcatcggcgagggagctttgccatcgtacgagcacgcccatcgccatctcgttgaggagaattgcgaagcggtgccccaccgcgcaacagtgtacgcacagcttgtggaaagcggcagaatgtggagttggaacaaactatttcccatacacgtgcaaacctcccttggcgaacaggtgatcgtcccacccgtggatgtggaaagttgccccggagctccaagtgtgtgcgacattcaattgaaccaagtgtccccagcagacttcactgtgctgagcgatgttctgccaatgttttcgattgacttttccaagcaggtttccagttccgctgcatgtcattcccgcaggtttgagcctcttacaagcgggagggctcaagtagtgctttcttggtgggatatcgagatggatcccgagggaaagatcaaatgtacaatggctccattttgggctcattccgaccccgaagagatgcaatggcgagatcactggatgcagtgcgtgtacttcctgccacaggaggaaccggtagtgcaggggagtgccttgtacctagtcgctcatcatgacgattactgtgtttggtacagcctgcagaggacatcccccgagaagaacgagagagttcggcagatgcggcccgtgtgcgattgtcaggcacacctgctgtggaaccggcccagatttggtgagattaacgatcaggatcggactgatcgctatgtccaagccttgcggaccgtgttaaagccggacagtgtttgtctgtgcgtcagtgacggatccctgcttagcgtcctcgcccatcacctgggcgtggagcaggtgtttaccgttgaatcgtctgccgcttcacacaagcttctcaggaaaatctttaaggccaatcatctagaagacaaaataaacatcatagaaaagcgtccagaactgcttaccaatgaggacctgcaggggagaaaagtctccttgttactcggcgaaccattttttacaacctccttgctgccttggcataatctctatttctggtacgttaggaccgcagttgatcagcatctgggtcccggggcaatggtcatgcctcaggcagcttcacttcacgcagtagtcgtggaatttagggacctctggcggatccgcagcccgtgcggggactgtgagggattcgacgttcacatcatggacgatatgataaagagggccctcgacttccgggaatcccgcgaggccgagccacatcccttgtgggagtatccttgccgcagtctgtcagagccgtggcagattctgacctttgactttcagcagccagtgcctttgcaacccctatgtgcagaagggaccgtggaactgagacggccagggcaatctcatgcggccgtactctggatggagtaccatctgacccctgagtgtacactctcgaccggactactggagccagcggaccctgaggggggatgctgctggaacccacactgtaagcaagccgtgtacttcttttctcccgcacctgacccccgggccttactgggcgggccccggacagtttcctacgctgtggagttccatccggatacaggcgatatcataatggaattccgccacgctgacacacccgattag

SEQ ID NO: 16867 - DNA, 300 bp, Artificial Sequence
  Description of Artificial Sequence: Synthetic coding sequence
atggtagtgaaactgctctctaacaaaagatcacaggctgtgggcatcttgatgtctagcttacacctcgacatgaaagacattcagcatgcagtggtgaacctggacaattccgtggttgaccttgaaacactccaagctctgtacgaaaaccgggctcagtctgatgaactggagaagattgaaaagcacggaagatcttccaaggacaaggagaatgccaagtccctggacaaacctgagcagttcctttacgagctgagtctgattcccaacttctctgaacgagtcttctgctag

SEQ ID NO: 16868 - DNA, 390 bp, Artificial Sequence
  Description of Artificial Sequence: Synthetic coding sequence
atggggggatgtttctccaagcctaagcccgtcgagctgaagatcgaagtcgtgctcccggaaaaagagcgggggaaggaagaactgtccgcttcagggaaaggaagccctagggcctatcagggcaatgggaccgcgcgtcattttcataccgaggaacgcctgtcaacaccccatccttatccatcgcctcaggattgtgtggaggcggccgtgtgccacgtcaaagacctggagaatggccagatgcgcgaagtcgaactcgggtggggcaaagtgctgctggtgaaagacaacggcgagtttcacgctctcggacacaagtgccctcattacggtgctcctctggtgaaaggtgtgctgtcacgcggacgggtgcgttgcccctag

SEQ ID NO: 16869 - DNA, 453 bp, Artificial Sequence
  Description of Artificial Sequence: Synthetic coding sequence
atgaatctcgcggagatttgcgataacgccaagaagggtcgggagtatgcactgctgggaaactatgactcctctatggtctactaccagggcgtgatgcaacagatccagaggcattgccagagtgtgcgtgaccctgctataaaagggaagtggcagcaggttaggcaggaactgctggaggagtatgagcaggtcaaatctatcgtctctactctagagtctttcaagatcgataagccccctgactttcctgtctcttgtcaggacgagcccttccgggaccctgcagtgtggcctcccccagtgcccgcagagcatagggcaccgccgcaaatcagacgccctaaccgagaagttcgcccactcaggaaagagatggccggcgtcggtgcccgagggcccgtgggccgagcgcatcctatctctaaatctgaaaagccatccacatag

SEQ ID NO: 16870 - DNA, 498 bp, Artificial Sequence
  Description of Artificial Sequence: Synthetic coding sequence
atgggagtgaaccagagtgtcggctttcctccggtcacgggtcctcatctcgtagggtgcggcgatgtgatggagggccagaatcttcagggaagtttcttcaggctcttctacccatgccaaaaggcggaagagacaatggaacagcccctgtggatcccccgctatgagtactgtactggcttggcagagtatctgcaattcaacaagagatgcggaggtctgctattcaatctggcggtagggtcatgccgcttaccagtgagttggaacgggccattcaaaacaaaagattccggataccctttaattatcttcagccacgggttgggtgccttcagaaccttgtattccgctttttgcatggaactcgccagtagggggttcgtggttgccgtccctgagcaccgcgacagatccgccgctacaacatatttttgcaaacaggcccctgaagaaaaccaaccaaccaacgagagccttcaggaggaatggtag

SEQ ID NO: 16871 - DNA, 270 bp, Artificial Sequence
  Description of Artificial Sequence: Synthetic coding sequence
atgtccgagcagggcgacctgaaccaggctatcgccgaggaaggcggcacggaacaggagaccgctacaccggagaacggaattgtgaaatccgaatcattagatgaagaggagaagctggagctccagagacgactcgaagctcaaaatcaggaacgacgcaagtctaagagcggcgctggcaaggggaaactgactcgatctctggctgtttgtgaagaaagttcagcccggccaggcggtgaatctttgcaggatcaaactctttag

SEQ ID NO: 16872 - DNA, 6009 bp, Artificial Sequence
  Description of Artificial Sequence: Synthetic coding sequence
atggaggagcgaaagcacgagacaatgaatcctgctcacgtcctatttgatcgatttgtacaagcaacaacgtgcaagggaactctcaaagcctttcaagaactgtgtgatcacctggagttaaaacctaaggattatcgctctttttatcacaagctaaaatctaagttgaattattggaaggccaaggctctgtgggcaaaactggataagaggggctctcataaggactacaagaaaggcaaggcttgcacaaacacaaaatgccttataatcggtgctggcccgtgtggcttacgcacagcaatcgatctgagcctgctaggcgcaaaagtggtggtcatagagaagagagacgcgttctcacgtaataacgtgctacacttgtggccgttcacgattcacgacctcaggggcctaggcgccaagaagttctatggaaaattttgcgcaggggctatcgatcacatctccattcggcagctacagctgattctgcttaaggtcgccttgatcttaggtatcgagatccatgtgaacgtggaattccaaggccttatccagccgcctgaggatcaggagaacgagaggatcggttggcgggctctagtgcatcccaagacgcaccccgtgagtgagtatgagttcgaagtaatcatcggcggtgacgggagacggaatacgctggaagggtttcggagaaaggaatttcggggcaaacttgcgattgccattacagccaacttcattaaccgcaatactaccgcagaggctaaggtcgaagaaatcagcggtgtagcttttatttttaaccagaagttttttcaggagctacgcgaagcaaccggtattgacttggagaacatcgtgtactacaaagacgatacccactactttgtgatgacagctaaaaagcagtctctccttgataaaggagtgatactccatgattacgccgataccgagttactgctgtccagagaaaacgtggatcaggaggctctattgtcctacgccagggaagccgctgacttctccacgcaacaacaattgccctcccttgactttgccatcaaccactacggtcaacctgacgtggcgatgtttgactttacatgcatgtatgcttctgaaaacgcagcactagtcagagaacaaaacggccaccagttgttggtcgccctcgtcggtgatagccttctcgaacctttttggcctatggggactggcattgctcgcgggtttttagctgcgatggacagcgcttggatggtaagatcttggagcctgggaaccagtcctttggaggtgctggccgaaagggaaagcatctacaggctcttgccacaaactacacccgagaatgtttcgaaaaatttctcccagtattcgatagaccccgtgactcgatacccgaacatcaacgtgaatttcctgcgaccatcccaagtccgtcacctgtacgacacaggagagaccaaagatatacatttagaaatggagagcctggtcaactcaaggactacccctaaactcacacgtaacgaaagcgtagcacgctcctctaaactgctcggctggtgtcagcgccagaccgacggatatgccggagtaaatgtcactgaccttacaatgtcttggaagtcaggtctggcgctttgcgccatcattcatcgctatcgccccgatttaattgattttgactccctggacgagcagaacgtcgagaaaaataaccagctggcctttgacatagctgaaaaagaattgggcattagtcctatcatgaccggcaaagaaatggcctccgtgggggagccagacaaacttagtatggtcatgtatctcacccagttctatgaaatgttcaaggacagtcttccgtcgagcgacacccttgacctcaatgctgaagaaaaggcggtcctgatagcctccacacggtctccaatctctttcctgagcaagctcggccagacaatctcgcgcaagagatctcccaaagataaaaaagagaaggatctggacggggccggaaagcgtcggaagacaagccagtctgaggaggaggaggccccacgaggccacaggggggagcggcctacccttgtttcgacgctcacggaccgcaggatggacgttgccgtgggtaaccagaataaagtcaaatacatggccacacagctgctcgcaaagttcgaggagaatgcccccgcacagagcatagggattaggcgccaaggaagcatgaagaaggaatttccacaaaatttgggagggtctgatacttgctacttctgccagaaacgagtgtatgtgatggagcgcctgtcagccgagggtaaatttttccaccggagttgcttcaaatgcgagtattgcgccaccaccttaagacttagcgcttacgcctacgacattgaggatggcaagttttattgcaaacctcactactgttatagactgtccggttatgcacagaggaaaagaccagctgtggccccgctatccggcaaagaggcgaaggggccactccaagatggcgccacaacagatgcaaacggacgcgccaacgccgtcgcctcatctaccgaacgtaccccagggtcgggcgtaaacggtctggaagagcccagtatcgccaaacgtttgcggggaacccccgaaaggatagaactcgagaactacaggttgtccttgagacaggccgaagctctgcaggaagtgcccgaagaaacgcaggcggaacacaacttgtcatctgtcctcgataccggtgctgaagaggatgtagcttcatccagctcagaaagtgagatggaggaagagggagaggaagaggaagaggaaccccgtttgccaccaagcgacttgggtggcgtcccctggaaagaagcagtgcgtatccacgccttattgaaaggtaagagtgaggaggagctggaggcttccaagagcttcgggccaggcaatgaagaagaggaggaggaagaggaggagtatgaagaggaggaggaggaggactacgatgaagaggaggaggagtcgtcagaggctggcaatcagcgcttgcagcaggtcatgcacgccgcagatcccttagagattcaggctgatgtccactggacccatatcagagaaagggaggaggaagaaaggatggcacccgctagcgagtcctctgcaagtggcgctccactggatgagaatgacttggaggaggatgttgactccgagcctgcagaaatagaaggtgaagccgcggaggacggggaccccggtgacaccggggctgagctggacgatgatcaacactggtccgatagccccagcgatgcagatagagagctacgtcttccctgcccggccgagggcgaggcagagctcgaattgcgagtctccgaggacgaagaaaagctgcctgccagtcccaaacaccaggaacggggacctagccaggctacctcccccatcaggagcccacaggagtcagctctcctgttcattcctgtgcactcaccatctacagaaggtccacagctgccacccgttccagccgctactcaggagaagagtccagaagagcggttgttcccagagccattactcccaaaggagaaaccaaaagccgacgccccctctgaccttaaggcggtacattctcccataaggtcacagcccgtcaccctgcccgaagcccgcactccagtgagcccaggtagccctcagccccagcctcccgtggccgcaagtactccgccaccttcccctctaccaatttgtagccagccccagcccagtaccgaggctacggtaccttcacctactcagtcacccatccgcttccaacctgccccggcgaagacctccacacctctggcgccactgcctgtccagtcgcagagcgatacaaaagatagattaggcagcccactcgctgtggatgaagccctccggagaagcgatctggttgaagaattttggatgaagtctgcggaaattaggcggagccttggattaactcctgtggatcggtcaaaggggccagagccatccttccccacacccgccttcaggcccgtgtcattgaagagctattccgtggagaaaagcccccaggatgaaggactgcacctgttgaagcctctctctattcccaaacgtttgggtctcccgaaacccgaaggggaacccctttccctgcccacccctcggagcccatccgaccgagaattgcgaagcgctcaggaggagcgacgcgaactgagtagttcttctggtttggggttgcacggtagctcaagcaacatgaagaccttagggtcacagtctttcaacacatctgattcagcaatgttaaccccaccatccagcccaccccctccccctccccctggcgaggagccagccaccttaaggagaaagttaagggaagccgagccaaacgcctccgtggtgcccccccccctccccgctacctggatgaggccgcctagagagcctgcccagccccctcgagaggaagtccgcaagagttttgtcgagtcggtggaggagattccgttcgcggacgatgtcgaggatacgtacgatgacaaaacggaagattcctctctgcaggagaaattctttacgccgccatcttgctggccgaggccggagaagcctcgccaccccccgttagctaaggaaaacggacgcctgcccgccctcgagggcacattacagcctcagaagcgcggcttgcccctcgtaagtgcagaagccaaagagctcgccgaagaacggatgcgagccagggagaagagcgtcaaaagccaagcccttagggatgccatggccaggcagctgagtcgtatgcagcaaatggagcttgcctccggcgccccccgtccacggaaagcgtcatccgcaccctctcagggaaaggagaggcgcccagacagtcccacccgcccaacattaaggggaagcgaagaaccaacccttaaacacgaggctacatctgaagaagtgctatctcccccctccgacagcggtgggcctgacggcagtttcacgtctagtgaagggtccagcggaaagtccaagaagaggagttctctgttctctcctcggaggaacaagaaagaaaaaaagagtaaaggagaaggaagaccccccgaaaaaccaagctcaaacctgctggaagaagcagcagccaagcccaagtcactctggaagagtgttttttccggatataagaaggacaagaaaaagaaggctgacgataagagttgccctagcaccccaagcagtggtgctacagtggactctgggaagcaccgagtcctgcctgttgtcagagctgagcttcagctacgcagacagctgtcattcagcgaagattcagatttgagctccgatgatgtattagaaaaatctagccagaagagtcgcagagagccaagaacttacaccgaagaggagctcaatgctaaactcacacgacgcgtgcagaaggcagcaaggcgccaggccaaacaggaggagctcaagcgtctgcatagggctcagattatccagcgccagctgcagcaggtggaagagcgacaaaggagacttgaagaacggggggtggccgtggaaaaggcccttcgaggggaagccgggatgggcaagaaagatgacccaaaactcatgcaggaatggtttaaactggtgcaggaaaaaaatgcaatggtacgatatgagagcgaactcatgattttcgcacgcgaactggagctggaggaccgacagtcacggttgcagcaggaacttcgagagcggatggctgtagaagatcacctaaagaccgaagaagaactgtctgaagagaagcaaattctaaacgagatgttggaggtggtggaacagagggacagtctggtcgctctgttggaagaacagaggttacgtgagcgcgaagaagataaggacctggaagcggccatgctatctaagggtttttctctgaactggagttag

SEQ ID NO: 16873 - DNA, 540 bp, Artificial Sequence
  Description of Artificial Sequence: Synthetic coding sequence
atgtccagcaacgagtgctttaaatgcggccgctcaggccattgggctcgagagtgcccaactggcggaggccgtggcaggggaatgcgttcaaggggtagaggaggattcaccagcgacaggggtttccagttcgtatcgagcagcctacccgacatctgctatcggtgtggtgagtccgggcacctggccaaggactgcgacttgcaggaagatgtggaagcatgttacaactgcggcagaggcggtcatatcgccaaggattgcaaagagcctaaacgcgaacgtgaacagtgttgctacaattgcggcaaaccaggccatctggctagagattgcgaccacgccgatgaacagaaatgctactcctgcggcgagtttggtcacatccagaaagattgcacaaaggtgaagtgctatagatgtggtgaaaccggacatgtggctattaattgtagtaagacctccgaagtgaattgttacaggtgcggcgaatcagggcatcttgcgcgagaatgtacaatagaagctactgcctag

SEQ ID NO: 16874 - DNA, 1140 bp, Artificial Sequence
  Description of Artificial Sequence: Synthetic coding sequence
gcccgggcagtacctgtcggatccggcctgcgagggctgcagcggacgctcccattagtggtcattctcggggcaaccggcactggcaaatctaccctcgcactgcagctcgggcaacgactgggcggcgagattgtgtctgctgatagtatgcagccacaagaaatgggaactgagaaagtgatcgaccgaaaagttgaactcgagaaagaggatggcttggttttgcataagaggctgtcgcaggtggacccggaaatggctgcgaagctgcatccacatgacaaacgtaaagtcgcccgtagtctccaagtttttgaagaaacaggcatttctcattccgagttcctgcaccggcagcatactgaagagggtggcggtcccttgggcggtcctcttaagtttagtaatccctgtatcctgtggctgcatgctgatcaggccgacgaacgactcgacaaaagggtggacgacatgctggccgcgggactgctggaggagctgcgtgatttccacaggaggtataaccagaagaacgtcagcgagaattctcaagactatcagcatggaatcttccagtccattggatttaaggagtttcatgaatacctaataactgaggggaagtgtacgctggaaacttccaatcagctgctgaaaaaaggcatcgaggccctgaaacaagtgacaaaacggtacgcccggaaacagaataggtgggtcaagaaccgtttcctctcccgacccggtcccatcgttcctcctgtctacggacttgaggtatctgacgtgtcaaagtgggaggaatcagtcctggaaccagccctggaaattgtccaaagctttattcaaggccacaagccaactgccactccaattaagatgccatataacgaggctgagaacaaacggagttaccacctgtgcgatttatgtgatcgaatcatcataggcgacagagagtgggccgcgcatatcaaatcaaaatcccacctgaaccagctaaagaagcgaagacggctggatagcgacgccgtgaacacgatcgagtcgcagtcagtttccccagaccataataaggagcctaaggagaagggatcccccgggcaaaacgatcaggaacttaaatgctctgtgtag

SEQ ID NO: 16875 - DNA, 483 bp, Artificial Sequence
  Description of Artificial Sequence: Synthetic coding sequence
atggaggcagaacggcctcaggaagaggaggatggcgaacaaggacctcctcaggatgaggagggctggcctccccctaacagtacgacccgcccctggcggtctgcgcccccctcacctccccctcccggcaccagacacaccgctctcggaccacggtctgctagcctgctgtctctccagacggagctcttattagatctggttgcagaggcacaatctaggagactggaggaacagcgggccaccttctacacccctcagaatccttcatctctcgcgccagcgccattgcggccgctggaggacagggaacagctgtacagcacaatcctctctcaccagtgccagagaatggaggcccaacggtctgagcctcctctgcccccgggaggtcaggagctgctggaactgctgcttagggtccaaggggggggacggatggaggagcagcggtccagacccccaacacacacatgttag

SEQ ID NO: 16876 - DNA, 816 bp, Artificial Sequence
  Description of Artificial Sequence: Synthetic coding sequence
atgaatctggagaagctgagtaagccagagctgctcacactgttctccattcttgagggcgagctcgaggcccgcgatttggtgattgaggcgcttaaagcccaacacagagacacattcattgaggagcgctacggaaagtataacattagcgaccctctgatggccctccagagagatttcgaaacactcaaagaaaaaaacgacggcgagaaacagcccgtgtgcaccaacccgctgtctatcttaaaggtggtcatgaaacagtgcaaaaacatgcaagaacgaatgctgagccagctggccgcggcagagtctaggcataggaaggtgatattggatctggaagaagaacgccagagacacgcccaggataccgctgaaggggacgatgtcacatacatgctagagaaagaacgcgagagactgacgcagcaactcgaatttgagaaatctcaggtgaagaagttcgagaaagagcagaaaaagctaagttcccaactggaggaagagaggagccgtcacaagcagctgtcatccatgttagttttggaatgtaagaaggcaacaaataaagcagcagaagagggacagaaagcaggggagctaagcctcaagctggaaaaagagaaatctcgagtgtccaagttggaggaggagctagccgcggagcgtaaaagagggctccagaccgaagcacaggtggagaaacagctcagcgagttcgatattgagagggagcagctgagggccaagttgaatagagaagaaaaccggacgaaaacccttaaagaagagatggaatcacttaaatag

SEQ ID NO: 16877 - DNA, 1482 bp, Artificial Sequence
  Description of Artificial Sequence: Synthetic coding sequence
atggatcaggattacgaaaggcgcctactacggcagatcgtcattcagaacgaaaacacaatgccccgagtgaccgaaatgaggcgaactctgacccccgcctcgtcccccgtgtcgtctccatcgaaacatggggacaggttcattccctctagagcaggagccaactggtctgtgaactttcacagaattaatgagaacgagaagtcccccagtcaaaatcgcaaggctaaggacgcgaccagcgataacggtaaagacggcctggcctactctgctctcctgaagaatgagctgcttggagccgggattgagaaagttcaggatcctcagactgaggacaggcgattacaacccagtacacccgagaaaaaaggcctctttacttacagtctgtccaccaagaggtcatctcccgacgatggcaatgacgtatctccttactccttgtctcccgtttcaaataagtctcagaaactcctgagatctcctcgcaagcctacaagaaagatcagcaagattcctttcaaggttctcgatgccccggaactccaggacgatttctacctgaatctggtcgattggtcaagtctcaatgtgttgtctgtcggactgggaacctgtgtttatctgtggagtgcctgtacctcccaggtgacccgtttatgcgacctatccgtggaaggcgactctgtaacctccgtaggatggagcgagagagggaacctggtggccgtgggtacacataaaggtttcgtgcagatatgggatgccgccgctggcaaaaagctgtccatgctggagggacacacagctcgcgtgggggctctggcttggaatgccgagcagttatcctctggctccagagaccggatgatcctgcaaagggatatcagaacccccccactgcagagcgagcgacggctgcagggccaccgccaggaggtgtgtggtctcaagtggtccactgatcatcagctactagcctcaggggggaacgacaacaaactccttgtctggaatcacagctcactatcgcctgtacaacagtacacagagcatctggctgccgtgaaggctatcgcatggtctccacaccaacatggcctgctcgcttctgggggaggtaccgctgacaggtgcattcgtttttggaatacactaaccggacaaccactgcagtgtatcgacaccggctcacaggtgtgtaatctcgcatggtcaaagcatgcaaatgagctggtgtccacacatggctactcccagaaccaaatattggtctggaaatatccatctctgacacaagtggctaagttgacgggtcatagctatagggtgctgtatctggctatgagccccgacggtgaggcaatcgtcacaggagcaggtgacgagactctccggttctggaatgttttcagcaaaaccaggtccaccaaggaaagcgtgtccgttctgaatttattcacaaggatccgatag

SEQ ID NO: 16878 - DNA, 552 bp, Artificial Sequence
  Description of Artificial Sequence: Synthetic coding sequence
atgaagaaggagcacgtcctacattgccaattctccgcatggtatccttttttccgcggagtgacaattaaatcggtaattttgccgctgccccaaaacgtcaaagattatctgctcgacgatggaaccttggtggtctcagggagggacgaccccccaacccattctcaacctgacagtgacgacgaggctgaagagatccagtggtcagacgatgaaaacacggcaacattgaccgatgcctactggatagccatgaacagctccttgaagtgtaagaccctgtctgatatattcttactgtttaaatcttctgactttatcacccgcgattttacccagccctttatccattgcactgacgattcgcccgatccctgcatagaatatgaacttgtgctcaggaagtggtgtgaactcatccctggcgccgaatttagatgctttgtcaaggagaataagttgatcggcatctcacagcgcgactacacccaatactacgaccacatctccaagcaaaaggaggagatcagaagatgtatccaggactag

SEQ ID NO: 16879 - DNA, 672 bp, Artificial Sequence
  Description of Artificial Sequence: Synthetic coding sequence
atggaggatgtgaaactggaatttccgtctttgcctcaatgcaaagaggacgcagaggaatggacctatcctatgagacgggaaatgcaggagatcctaccggggctgtttcttggcccatatagctcagctatgaagtccaagctccccgtcctgcagaagcatggaatcacccacatcatctgcataaggcaaaacatcgaggcaaactttatcaaaccaaatttccagcagctgtttagatacctggttctcgatatcgcagataacccggttgaaaacataatacgattttttcctatgactaaagaatttatcgacggctctctgcagatgggcgggaaggtgttggtgcacggtaacgcaggcatttcgcgatctgccgccttcgttatagcttacattatggagaccttcggcatgaaataccgcgacgcgttcgcatacgttcaggagagacggttctgtatcaaccctaatgcaggctttgtgcaccagttgcaggaatacgaggctatctacctcgccaaactcactatccagatgatgtctcctctccagatcgagagatctctctcagtgcactccgggaccactggatctcttaagcggacacatgaggaagaagacgactttggtactatgcaggtcgccaccgctcagaatggttag

SEQ ID NO: 16880 - DNA, 348 bp, Artificial Sequence
  Description of Artificial Sequence: Synthetic coding sequence
atgccaattttactctttcttatcgacacatccgccagtatgaaccagcgcagtcatcttggaactacatatcttgacacggctaagggagccgtggagaccttcatgaagttgcgagccagagatccagcttctcgaggggatcgctatatgctggtaactttcgaggagccaccgtatgctataaaggccggatggaaggagaaccatgctacctttatgaacgaactgaaaaacttgcaggccgagggtctgactaccctgggccagtccctgcgtacagcgttcgacctccttaatctgaatagactggtcactgggattgataactatggccaggtgggttag

SEQ ID NO: 16881 - DNA, 390 bp, Artificial Sequence
  Description of Artificial Sequence: Synthetic coding sequence
atggccgaactgatacagaagaaattgcagggggaggtggaaaaataccaacagctgcagaaggatctgtcaaagagtatgtcggggcgccagaagttagaagctcagctgacagaaaataatatcgttaaagaggagcttgcccttctggacggaagcaacgtggtgttcaagctgctgggaccagtgctggttaagcaggagttgggagaagcaagggctacagttggaaagcgacttgactatattactgcggagatcaagcgttacgagtcccagcttagggatttagaaaggcagagcgaacagcagcgggaaactctcgctcaattacaacaggagttccaaagggcacaggccgcaaaagccggagctccaggaaaagcgtag

SEQ ID NO: 16882 - DNA, 2676 bp, Artificial Sequence
  Description of Artificial Sequence: Synthetic coding sequence
atggtggcaccagtgctggagactagccacgtgttctgctgtcccaatcgtgtgcgaggagtcttgaactggtcctcaggtccccgaggattgctggctttcggaacatcttgctcggttgttctctatgaccccctgaaacgggtagttgtgacaaacctcaacggccacacagccagagtaaattgtatacagtggatctgcaagcaggatggtagcccgtcaaccgagttggtgagcggcggctcagataatcaggtaattcactgggaaattgaggacaaccagctgctgaaggccgtccacctgcagggacatgaaggcccggtgtacgctgttcatgcggtgtatcagcggcggaccagtgatccagcactatgcactttgattgtgtctgctgccgccgatagtgccgtcaggttatggagcaagaagggacctgaagtcatgtgcctccagacccttaactttggaaacgggttcgcgctggcgctgtgcctctcatttctgcccaacacagatgtgacatggaagacagggcaagtcgaacgaggccgggcttggaagccccctgcaagccttgcactgtgcagccgctcctgcgactctatggtgtcatgctacgcaagcattttgtgcaaagcactgtggaaagagaagctgcacactttctggcaccacaaccggatttcgttccttcccagcgcttttagacccattcccatcctggcctgtggcaacgatgattgcagaatccacatttttgctcagcaaaacgaccaattccagaaggtcctgtccctttgtgggcatgaagactggatcagaggcgtggagtgggctgccttcggcagagatctgttcttggctagttgtagccaagactgtttgatccggatctggaaactttacatcaagtccacttccttggaaacccaggacgatgacaacatccgcctcaaggagaatacattcacaatagaaaatgagtctgtgaaaatcgcgtttgcagtcactctcgagacagtgctggccggccacgagaactgggtgaatgcagtgcactggcagcctgtgttttataaagatggcgtgctccaacagccagttaggttgctcagtgcgtctatggataagaccatgattctctgggccccggacgaggaatcaggcgtatggctggaacaagtgagggttggagaggtcgggggcaacaccctcggattttatgactgccagttcaacgaggacggctctatgattatagcgcacgctttccatggagctttgcatctgtggaagcaaaataccgtgaaccctagggagtggacccctgagattgttattagcggccactttgacggagtgcaggatctggtatgggaccccgaaggggaatttataataaccgttggcaccgaccagacaacacgactgttcgcaccatggaagcgaaaagaccagtctcaggtgacatggcacgagatagcgaggccacagatccatgggtatgaccttaagtgcctggcaatgatcaataggttccaatttgttagcggagcggacgagaaagtgctccgggtcttttctgctccacgaaatttcgtcgagaatttttgtgccatcactgggcagagcttaaaccacgtgttatgtaaccaggatagcgacttacccgagggcgccactgtccctgccctgggtctcagtaacaaggccgtttttcagggtgacattgccagccagccaagcgatgaggaggaacttttgacgagtacaggatttgagtaccagcaagtcgcatttcagccgtctattcttactgaacccccgaccgaagaccatctgctgcaaaacacattatggccggaggtgcagaagctctacggacacggatacgaaatcttttgcgtcacgtgcaacagctccaaaacacttcttgcttctgcttgcaaggcagcaaagaaggagcatgcagccattatcttatggaacactacttcgtggaaacaagttcagaacctagtgtttcacagtctcaccgtgacccaaatggcattctcacccaatgagaaatttttgctcgcagtttctcgggaccgtacttggagtttatggaagaagcaagacacaatctcgcccgagttcgagccagtgttctcactttttgcgttcactaacaaaatcacttccgttcactcaaggatcatctggtcctgcgactggtctccagactcaaagtacttcttcaccggatcacgagataagaaggtagtggtgtggggcgagtgcgatagcactgatgattgtattgaacacaatatcggaccgtgcagcagcgtcttagacgttggcggagcagtgactgcagtgtcggtgtgtccagtgctgcatcccagccagcggtacgtggtggctgttggccttgagtgcggtaaaatttgcctctatacctggaagaagaccgaccaggtcccggagatcaatgactggacccattgcgttgaaaccagtcagagccagagccacaccctagccattcgaaagctgtgttggaaaaattgttcgggcaaaacagagcagaaagaggctgaaggggccgagtggctacatttcgcgagctgcggagaagatcacactgtgaagatacacagagtcaacaagtgcgccctgtag

SEQ ID NO: 16883 - DNA, 573 bp, Artificial Sequence
  Description of Artificial Sequence: Synthetic coding sequence
atgggcccccttccccggacggttgagcttttctacgacgtgcttagcccctacagttggttaggatttgaaattttgtgtcggtaccagaacatctggaatatcaacttgcaactgcggccatccttgattacgggcattatgaaagatagcggcaataagcctcccgggttgcttccacgtaaaggactttacatggctaacgatttgaagctattgcgacaccacttgcagatccctatccactttcccaaagatttcctaagcgtgatgcttgagaaggggtcattgtcagcaatgagattcctcaccgctgttaatttggagcaccctgagatgcttgagaaagcatccagggagttatggatgagggtttggagcaggaatgaagacatcacagaacctcagtccatcctggcggccgccgagaaggccggcatgagtgcagagcaggcccagggcctgctggagaagattgctacccctaaagtaaaaaatcagctgaaggaaacgactgaagcagcatgcaggtatggagaacgatctggttgggcgctctacctgcagccctag

SEQ ID NO: 16884 - DNA, 1482 bp, Artificial Sequence
  Description of Artificial Sequence: Synthetic coding sequence
atgatgaagaggcagttgcatagaatgagacagctagcccaaaccggatctctgggccggactcctgaaaccgcggaatttctgggtgaggacctgctacaggtggagcaacgcctcgaacccgcaaaaagagccgcacacaatatccacaaacgactgcaagcatgcttgcagggtcagtccggcgccgacatggacaagcgcgtgaagaagctacctctaatggctctgagcactactatggcagaaagcttcaaggagctcgatcctgatagcagtatgggcaaggctctggagatgagttgcgcaatacagaatcagctggccaggatcttggccgagtttgaaatgactctcgagagggatgtactgcagcccctgagccggctgagtgaagaagagctgccagccatattaaagcacaagaagagcctgcagaagctggtgtctgattggaatacactgaagagccgcctgagccaggcaaccaaaaacagcggttcctcccagggcctcggaggatcacctgggtcccatagccatacaaccatggccaacaaggtggagaccctgaaggaagaggaggaggaacttaagcgaaaagtggagcagtgcagagacgaatatctagctgacctataccattttgtaacaaaagaagacagttacgcaaactactttatcagactgctagagatccaggcagactaccacaggaggagtctgagctcactggataccgcccttgcggaacttagggagaaccatgggcaggccgatcatagcccctccatgacagcaactcacttccccagggtatacggcgtctctttagcaacacacctgcaggagcttggcagggagatcgcacttcccatcgaagcctgcgtaatgatgctcctgagtgaggggatgaaggaggaagggctgttccggctggcggctggcgcctcagtgctgaagcggttgaaacagactatggcatctgacccacattcattagaagaattctgctccgatcctcacgccgtcgccggtgctctgaaaagttacttaagagagttgccggaacctctgatgacgtttgacctctacgacgattggatgcgcgccgcgtcccttaaggagcctggtgctcgcctgcaggcgctccaggaggtgtgttcaagactccctcccgaaaacttgagtaatcttagataccttatgaagtttctggctcgactcgccgaagaacaggaggttaataagatgacaccatctaatattgccattgtgttgggtcccaacttgctatggccaccagaaaaagaggggctggagtattcaggagccatttctgcgcactgcaacctacggttacctggaagttccgatagctcagcctccgcttgtcaggtggccggaacgaccggtacaagaccttcttggatgcagcccccttgtctccctagccgctggtgggccagcagccgcagatag

SEQ ID NO: 16885 - DNA, 45 bp, Artificial Sequence
  Description of Artificial Sequence: Synthetic coding sequence
atggctatggctccatccccttccctggtgcaggtctacacatag

SEQ ID NO: 16886 - DNA, 828 bp, Artificial Sequence
  Description of Artificial Sequence: Synthetic coding sequence
atgtctgccgaagtgaaggttactggtcagaaccaagaacaattcctgttactggcaaagtcagcaaaaggagccgccctggccacactgatccaccaggttttggaggctccaggagtctacgtatttggcgagctcctggatatgccgaacgtgagggaattggcagagagtgatttcgctagcacgtttagactgctgaccgtgtttgcttacggcacatatgccgactatctcgctgaggcccgaaatttgccaccactgactgaagcccaaaaaaacaaattgcggcacctgtcagtcgtaacactggcagctaaggtgaaatgcatcccctatgccgtcctgctggaggctctggcgctgcgtaacgttaggcagctggaggatctcgtcatcgaagccgtttatgcagatgtcctcagaggcagcctggaccaacggaatcagcgcctggaagtggattatagtattgggcgcgacattcagagacaggacctcagcgcaatcgcacgcactctacaagagtggtgtgtcggatgtgaagtagtgctgagcggcatcgaggaacaagtttctagagcgaaccaacataaagaacaacagctggggttgaagcagcagatagaatccgaagttgcaaatctgaaaaaaacaattaaagttaccacagcagccgcagctgccgccacatcccaggacccagagcaacatctaaccgaactgagggagcctgccccagggaccaaccaaagacagccctctaagaaggcctccaagggcaaagggcttaggggtagcgctaagatatggtctaaaagcaactag

SEQ ID NO: 16887 - DNA, 1506 bp, Artificial Sequence
  Description of Artificial Sequence: Synthetic coding sequence
atggccgcacccgagcctgctcccaggcgcgccagagagagagagcgggagcgcgaggacgagtccgaagacgaaagcgacatcttggaggagagtccttgtgggagatggcagaaaagacgcgaacaggtcaaccagggcaatatgcccggacttcaaagtacctttctggccatggacactgaagagggcgtcgaagtggtgtggaatgagctccacttcggcgaccgaaaagcctttgctgctcatgaagagaagatccaaacagtgtttgagcaactagtcctagtagaccatccgaacatcgtgaagctccacaagtattggctcgatacatcagaggcctgtgcccgggtcatctttataactgagtacgtcagttcaggttcattaaagcagtttttgaaaaaaaccaaaaagaatcataaagccatgaacgcccgggcctggaaaagatggtgtacacagatcttgtccgctctctctttcctgcacgcttgtagccctcctattatccacggaaatctgacatccgataccatctttatccagcataatgggctcatcaagatcggatcagtatggcatcggatcttttccaatgccttgccagatgacctcaggagcccgatccgcgccgagagagaagaattgaggaacctccatttttttcccccagagtatggcgaggtggctgatgggacggcggttgacatattctcttttggaatgtgcgctctggagatggccgtgctcgagatacagacaaatggagacactagagtgactgaggaggctatcgcgagagcgcgtcattccctctcagatccgaatatgagggagttcattctgtgttgcctcgctcgagatcctgccaggcgccctagtgcccactctctgctgtttcacagggtactgtttgaagtgcatagcttgaagctgcttgcggctcactgttttattcagcaccagtaccttatgcctgagaatgtagtggaggagaagactaaggcgatggatttgcacgcagtcttagctgagttgcccaggcccaggaggccccccttgcaatggcgatattccgaggtcagctttatggagctggacaagttcctggaggatgtgaggaacggcatttacccactgatgaattttgcggcgacacggcctctgggactgccccgcgtgctggcccccccacctgaggaggttcaaaaggctaaaactcctacgccagagccattcgactccgagacaaggaaggtgatccagatgcagtgcaacttggagagaagcgaggacaaagcgaggtggcacttgaccctcctccttgtgttggaggacaggttgcatcggcagttgacatatgacttactaccaaccgactcagcacaggatctggccagtgaactcgtgcattacggttttttgcacgaggacgatcgcatgaagcttgccgcgtttctggaaagtacatttctgaagtatagaggcactcaggcctag

SEQ ID NO: 16888 - DNA, 36 bp, Artificial Sequence
  Description of Artificial Sequence: Synthetic coding sequence
atgactgctcctagttgtgccttccctgttcagtag

SEQ ID NO: 16889 - DNA, 534 bp, Artificial Sequence
  Description of Artificial Sequence: Synthetic coding sequence
atgctgctagacaagaacgtgcccaatcccaggatcaagttgatagacttcggcatagcccacaagattgaagccggcaatgagtttaaaaatatattcggtacccccgagttcgtggcccctgagatcgtgaattacgaacctctcggcttagaggctgatatgtggagtatcggggtgatcacttatattctcctttccggcgccagtccttttctgggcgagacgaagcaagaaacccttacaaatataagcgcggtcaactacgactttgatgaggaatacttcagcaataccagtgagttggcaaaggatttcataagacgcctcctggtcaaggaccctaagagacgcatgaccatagcgcagagtctggagcatagctggatcaaggctattcgtcgaagaaatgttcgcggagaggattctggaagaaagcccgagaggaggcgcttaaaaacaactaggttaaaagagtataccatcaagtctcattcaagcgcgagcccaattgtcgcccctgtggacgcctag

SEQ ID NO: 16890 - DNA, 615 bp, Artificial Sequence
  Description of Artificial Sequence: Synthetic coding sequence
atgggcgacaagaaatcgccaacgagaccaaagcgccagcctaaaccttcttctgacgagggctactgggattgttccgtgtgcacattccgtaattctgccgaagcctttaagtgcatgatgtgcgacgtgcggaagggaacctctactcgcagtaccctttttgaagtgattgtcagcgcgagccggacaaaagagccactgaagttcccaatcagtggcagaaagccaagaccggtttcacagttggttgcacagcaggttacgcagcaattcgttccaccgacccagagtaaaaaagaaaaaaaggacaaggtggagaaggagaaatcagaaaaagaaaccacgtctaagaaaaacagccacaagaagacccgcccaaggctaaagaatgtcgatcggtcttcagcccagcatctcgaagtcaccgtcggggatctgaccgtcatcattactgacttcaaggagaaaactaagtccccccccgcctcctctgcggcttccgcagatcaacactctcaatccgggagttctagcgacaatactgagcgcggaatgagccggtcctcgtctccacgtggcgaagcttccagcctgaatggtgagagtcactag

SEQ ID NO: 16891 - DNA, 1350 bp, Artificial Sequence
  Description of Artificial Sequence: Synthetic coding sequence
atgatgctggggacagaaggaggagagggcttcgttgttaaggtgcgtgggctgccttggagctgctcagccgacgaggtccagcgatttttctccgactgcaagattcagaacggcgctcaggggatcagattcatatacaccagagaagggagacccagcggcgaggcatttgtggaactcgagtccgaggacgaagtgaaactcgcactcaaaaaggacagagaaaccatggggcaccgatacgtagaagttttcaagagtaataacgtggagatggattgggtgttgaagcacacggggcctaactcgcccgatacagcaaatgacggctttgtccggttgaggggcttaccttttggatgtagcaaggaggagatcgtgcagttttttagtggccttgaaatcgtgccaaacgggataactcttccagtggatttccaagggaggagtaccggtgaagcctttgtccagtttgctagtcaggaaattgcggagaaggctctcaagaagcataaggagcgcatcggtcatcggtatatagagatatttaagtcttcacgggccgaggtcagaacccattacgaccccccaagaaagctgatggccatgcaacgccccggaccatatgataggccaggggccggccggggctataactcaataggccgaggagcagggttcgaaaggatgaggaggggagcatatggaggggggtacgggggctacgacgattacaacggatacaatgatggttatggattcggctccgatagatttggcagggaccttaattattgcttcagcggcatgtccgatcatcgctacggtgatggaggtagcacctttcagtccaccactggccactgtgtgcacatgcgcgggctgccatacagagccactgaaaacgacatatacaatttcttctcgccgctgaaccccgtgcgagtgcatatcgagattgggcctgacggacgagtcactggggaagctgatgtggagtttgctacacatgaggatgctgtagcagcgatgtccaaagacaaggccaatatgcagcacagatacgtcgagttgtttctgaactctacagctggggcgtccgggggagcatacgagcaccgctacgtggagttgttcctgaatagtactgcgggtgcatctggcggggcttacggctcccagatgatggggggaatgggactcagcaaccagtccagctatgggggcccggcatcccagcagctgtctggcgggtacgggggagggtacggaggccagtcctctatgtctgggtacgaccaagtcttgcaggagaacagttctgactttcagtccaatattgcttag

SEQ ID NO: 16892 - DNA, 153 bp, Artificial Sequence
  Description of Artificial Sequence: Synthetic coding sequence
aagactggcctgaccggaagtccctcgagtttatgggacctgctcagggagatgtttgtcgtgtgtagtaaggagcagttgcagagcggtgggaagtactcccaccaggtctgggcgcctttttccccacttgcctcaggggccgcattctag

SEQ ID NO: 16893 - DNA, 4386 bp, Artificial Sequence
  Description of Artificial Sequence: Synthetic coding sequence
atgcaaagagagctagtgtatgcccggggcgacggacccggtgctccgaggcctgggagtactgcgcacccccctcacgcaatacccaattcacctccgagtactccagttccccattctatgcctccctctccaagccgcatcccatatggagggacccgatctatggtggtgcccgggaacgccactattccacgagacagaatctcaagccttccagtctccagaccaatatccccgagcccatctgccatcctggagagacgcgatgtgaaacccgacgaagacatgtccggcaaaaatatagctatgtaccgtaatgaagggttttacgccgatccctatttgtatcacgaaggacggatgagcattgcctccagccatggaggccatccactggacgtcccagatcatatcattgcttatcacagaacggctatacgcagtgccagtgcgtactgtaatccctcaatgcaggctgaaatgcacatggagcaaagcctgtaccgccagaaatctcggaagtatcccgacagccacctcccaactctaggatcaaaaaccccaccagccagcccccatagagtcagcgatctccgtatgatcgacatgcacgctcactataatgcacatggaccaccccatacaatgcaaccagatagggcatcacctagtagacaggcattcaaaaaggagcctggaacattagtgtacatcgagaaaccaaggagcgccgccgggctcagcagcctggtagacttaggcccaccgttgatggaaaaacaggtatttgcatactctaccgcgactatccccaaagatagggaaacatcggagaagatgatgaaaaccaccgcaaacaggaatcacacagatagcgctgggactcctcacgtttctggcggtaaaatgctatccgcactagaatccaccgttcctccaagccagcctcctcctgtggggacttccgccatccacatgagcttgctcgagatgagacgttctgttgccgagctgcgactgcaacttcagcagatgcgtcagctgcagctgcagaaccaggaactactcagggctatgatgaagaaggccgagctcgagatatctgggaaagtgatggaaacaatgaagcggctggaagacccagtacagcgtcaaagagtcctggtcgaacaggagaggcagaagtatctccacgaggaggaaaaaatcgtgaagaagctttgcgaattggaggactttgtggaagatctcaaaaaagacagcaccgcagctagtcgactagtgaccctgaaggacgtcgaggacggagcctttttgctgcgacaggtcggggaggcggtcgcaacacttaaaggagagtttcctaccctgcaaaataaaatgcgagctatactgcggattgaagttgaggccgtgagatttctgaaggaggaaccccacaaactcgattcactgctaaaaagagtgaggtccatgacagatgtgttgactatgctaagacgacacgtgacagacggcctgctcaagggcacggatgcggcacaagctgctcagtacatggccatggagaaggccaccgccgctgaggtactgaagtctcaagaagaagcagcccacacctcagggcaaccatttcactctaccggcgcgcccggcgacgccaaaagtgaggtggtgccactttctggaatgatggtgcggcacgcccagtcatctcctgtcgtgattcagccctctcagcacagtgtagcactgctcaatcccgcgcaaaatttgccacatgtggcatccagtccagccgtccctcaggaggccacctccactttacagatgtcacaggctcctcagagccctcagattccaatgaacggtagtgccatgcagagcctcttcatagaggaaatccattccgtatccgccaagaatcgcgccgtaagcattgagaaggctgaaaaaaagtgggaagaaaaacgtcagaacctggaccattacaacgggaaagaatttgaaaagttgctcgaggaggcccaggccaacataatgaagtcaattccgaatttagaaatgccacccgcaacaggacctttgccaagaggggacgccccggtcgataaagtggagcttagtgaggatagccctaactccgagcaagacctggagaagctcggaggcaagtccccacccccgccccctcctcccccgagacgctcttacctgccgggatccggcctgaccactacccgtagcggcgatgtggtgtacacgggccgtaaggagaacatcacggccaaggccagcagcgaggacgcaggcccttcacctcagacccgcgctactaaataccctgcggaagaaccagctagtgcttggacacccagtccccctccggtcacaaccagcagctccaaagatgaagaagaagaggaagaagagggggacaaaatcatggccgagctacaggcctttcagaaatgctcctttatggatgtgaacagtaacagccatgcagaaccctccagagcggattcacacgtgaaggatacgcggagcggggccaccgttccccctaaagagaaaaagaacttggaattctttcacgaggacgtccgaaagagtgacgttgagtatgaaaacggaccccaaatggaattccagaaggtcactacaggcgccgtgagacctagcgacccacccaaatgggagcggggaatggagaactccatttcagatgcatccagaacatctgagtacaagacagagattatcatgaaggagaactcaatctccaacatgtctctgctcagagactcgagaaattactcccaagagactgtgcccaaggctagttttggcttttccggaatcagccccctggaggatgagattaataagggtagcaagatcagcgggcttcagtacagcattcctgataccgagaaccagactctcaactacggcaagactaaggaaatggaaaaacaaaataccgataagtgccatgtgtctagccataccaggctcacagagtcctcagtacatgattttaaaaccgaggatcaggaagtcattaccactgactttggacaggtggtgctccggccgaaggaggctcggcatgctaatgtaaaccccaacgaggacggcgaatcttccagctccagccccactgaagaaaatgctgccactgacaatatcgccttcatgatcaccgaaaccactgtgcaggtcctgtcgtccggagaagtccatgacatcgtatcccagaagggagaggatatccaaacggttaatattgatgcccggaaggagatgactcctaggcaggaggggaccgacaacgaggaccccgttgtgtgtcttgacaaaaaacctgtgatcatcatttttgacgagccaatggacatacgctccgcttacaaacgactgtcaacgatctttgaagagtgtgacgaggagcttgaacgcatgatgatggaggaaaaaattgaggaggaagaagaggaggaaaatggagactccgtcgtgcaaaataacaacacatcgcagatgtcccacaaaaaggtcgcacctggtaacttgaggactggccagcaggtcgaaactaagagccagccacactctttggccacagaaacccgaaaccctggtggtcaagagatgaaccgcaccgaactcaataagttctcccacgtggattcacctaattcggagtgcaagggagaggacgcaactgatgaccagttcgaatcacctaaaaagaagttcaagtttaagtttccaaaaaagcagctggctgccttgacccaggcgatcaggaccggtaccaaaaccggtaagaagaccctccaagttgtcgtgtacgaggaagaagaggaggatggaaccctgaagcaacataaggaagctaaacgctttgagatagcgcgtagtcagccggaggatacacccgagaacaccgttcgtcgtcaggaacaacctagcattgaatccacaagtccaattagccgcactgacgaaatccgtaaaaacacttacaggaccctcgatagtctcgagcagaccatcaaacagcttgagaacacaatttctgagatgagtcccaaggctttggtggacacctcgtgttcaagcaaccgggactcagtggcgtcctcctcacacattgcacaagaagcttccccacgccctctgctggtccccgatgaaggcccgacagctctcgaacctcccacttcaatcccgagcgccagcagaaaggggtctagcggcgctcctcaaacttcgcggatgcctgtgccaatgagtgccaagaatcgacccgggaccctggacaaacccggcaaacaatcaaaactccaggacccacgacagtatcggcagtag

SEQ ID NO: 16894 - DNA, 2118 bp, Artificial Sequence
  Description of Artificial Sequence: Synthetic coding sequence
atgctcaccctcctcgctgaggaccgggccgtgccaagtgctcctacggggcccgggcctcttctggagttcgcactccacgaagatctgctgacacgggtcttaacctggcagctccagtgggatgagcttggtgacggtgtggaagagaggcgagccgaacagctgaaactgtttgagatgttggttagtgaggcgagacaaccgttactgcgtcacggtcccgtccgagaggcgctcttgacgctgctggacgcttgcgggcggcccgttcccagcagtcctgccttagacgagggcctggtcctgctgttgtcccagctgtgcgtatgcgtggcccaggagcctagtctgctcgagttcttccttcagcctcccccagaacctggcgccgccccacgcttactcttgttttcacgcctagtcccttttgtccaccgcgagggcacactggggcagcaggcacgcgacgccctcctgctccttatggcacttagcgccggatcacccacagttggaagatatattgcggatcatagctacttttgcccagtgttggccacaggactgagtgctttgtactccagtttgccacggaagatcgaggtcccaggcgacgactggcactgtctgaggagagaggattggctgggcgttcctgccctggccctgttcatgtcaagcttggaattctgcaatgctgtgattcaggtcgcacatcctcttgttcagaaacagttggtcgactacatccataacggttttctggttcctgtcatgggacctgcactccataagaccagcgtcgaagaaatgatcgcaagtactgcttatttggagttgttcctgaggtcgatatctgagccggctctgctgcggactttcctgaggtttctgctgctgcatcggcatgacacacatacaattctagacacactagttgccagaattgggtcgaactctcgcctgtgcatggtttccctgtctttattcaggactcttctcaatctgtcttgcgaagatgtcctgttgcagttggtgctccggtacctggtgccgtgtaatcacgtgatgctatctcagaagcctgctgtgagagacgtggatctctatggaagggccgccgataaatttctgagtcttattccccgatgctgccgccaccatgcacccagtccacctagacccgaacatgcctcctgggcccgcgggcccggaagtccgtccgtcgattcaagctctgtcactaccgtaccgcgcccatcgacgcctagccggcttgcactgtttctcaggcagcagtcactcggcgggtctgagagccccggtccagcaccctgctctcccggactgtctgcctctcccgcaagtagtcctggtaggcgacccacacccgcggaagagccaggcgaacttgaggataactacctggagtacctcagagaggcccgtcgaggtgtggatcgatgcgtgagggcatgccggacctggagtgcaccatacgacggcgagcgccctagcccagagcctagcccgttcgggtcccggactaaaaagcgctcattgctgccagaggaagacagaaataacgtaggtgaaggagaagaggaggagctgggccgaagaggacgggcaggcggcgcgggcgaaggccctgggcatcttccacctccacaactcaacggcgtgccggggtcatggcctgaaggcgcaaaaaaagtacgattggtgcctaaggaaggggcgggggagctgctggagggaatctcggaaggcatggctgggttagaaggcttcggccaagaactgcgcgagctggaagttgctctgtcaaacggcgggacagggtcggagtcgccactcgaaccccccctgcctttggaagaagaggaagcctacgagagctttacctgccctcctgaaccacccgggccctttctctcctccccactcagaacgctcaaccaattgccatcacagccatttaccgggccttttatggccgtcctctttgccaagttagaaaatatgcttcagaattcggccctgagctgttccacaccaacctggtcatccagtcccgtctcctccccatgctgtagatgttgggccctgtag

SEQ ID NO: 16895 - DNA, 804 bp, Artificial Sequence
  Description of Artificial Sequence: Synthetic coding sequence
atgatgaggggatatattaagaaggtcttgaaaaacacttcctatcacgtgaaccagtatctcttcattcagcacggatggagcgggtctggcgaccagtccgtgctctactcttgtaacctgatgcgcatggtgacacgcacaaagaagatatttgttggtggattatctgccaacaccgttgtcgaagatgtgaagcagtatttcgaacagtttggcaaggttgaagacgcaatgctgatgtttgacaagaccaccaatcggcatcgtggattcggatttgtgacatttgaaaacgaggatgtagtggagaaggtgtgtgaaattcatttccatgaaattaataataagatggtggagtgcaagaaagcacaacctaaagaggttatgtttcctcctggcaccagggggagggctcgtggtttaccctacaccatggacgccttcatgctgggtatgggaatgctgggctaccctaatttcgtcgctacttacggtcggggatatcctgggttcgcaccaagttacggataccagtttcccggattccccgctgcagcttatggtccagtggccgcggccgctgtcgccgcggctcggggctcgggcagcaacccggctcgcccggggggttttcctggtgcaaattcgcccggacctgtggccgacctttatgggcctgcctcccaggactcgggagtcggcaactacatcagcgctgcctctcctcagccaggaagcggatttggtcacggcatcgcggggccacttatagccaccgcttttacaaatgggtaccactag

SEQ ID NO: 16896 - DNA, 483 bp, Artificial Sequence
  Description of Artificial Sequence: Synthetic coding sequence
atgtctagcccactggcgagtctcagcaagacgcgcaaggtgcctctaccctccgaacctatgaatcctgggcggcgtgggatccgaatttatggagacgttcccgcctcacacgattctgagctcatggcgttcatgacccggaaactgtgggacctggaacagcaggtcaaggcgcaaaccgatgaaattctttctaaggaccagaaaattgcagcactcgaagatctggtacagaccctgcgaccccaccccgcggaagccaccttgcagcgccaggaggagctggaaacgatgtgtgtgcaactgcagcgacaggttagagagatggagcggttcttgtctgattatggtctgcagtgggttggagagccaatggatcaggaggactccgagtccaagacggtgtcagagcacggagaaagagactggatgacagcaaagaaattttggaagccaggggggctgattggcgctccctag

SEQ ID NO: 16897 - DNA, 462 bp, Artificial Sequence
  Description of Artificial Sequence: Synthetic coding sequence
tgatcagtccagagtcccgcccaacaacaggtgccggctaggcccggggctccgtctgtccaggtgccttcacctttcctgctgcagaaccagtatgagcctgtccagccgcattggttctactgcaaggaagtcgagtacaagcaattatggatgccgtttagcgtgtttgacagcctcaacctcgaggagatttataatagtgtgcaacccgatccagagagcgttgtcctcggtacagacggcggccgttatgacgtgtatctgtacgacaggattcgcaaggcagcttattgggaggaagagccagccgaagttagacgctgcacatggttttacaagggcgatacagactcacggtttattccctacaccgaagaattctccgagaaactggaggtacgcgtgctgtattttttcatgagcttctttaagaaatgtcgttcatatattcattggtag

SEQ ID NO: 16898 - DNA, 1062 bp, Artificial Sequence
  Description of Artificial Sequence: Synthetic coding sequence
atggagcaagaactggaacagctggcccagctgccaagttcaaagaactcactgctgaaggacgccatggcgccgggcactcccaaaagcttgttgctgagcgcctccatcaaacgcgaaggtgagtcccctacagcaagcccacacagtagtgccactgacgacctgcatcactccgatcgctaccagaccttcctccgtgtcagagccaacagacagaccagattgaatgctcgcatcggtaaaatgaaacgacgtaaacaagatgagggccaggtctgtcctctgtgtaaccgacctttggctggatctgaacaggaaatgtcccggcatgtagaacactgcctgtcgaaacgcgagggaagctgtatggccgaggacgacgcagtagacattgagcacgaaaataataatcggtttgaggaatacgagtggtgtggacagaagcggattagagctacaaccctgctggagggagggtttagaggatctggattcatcatgtgtagtggcaaggaaaatcctgactccgacgccgatcttgacgtggacggagacgacaccctcgaatatgggaagccacagtacacagaagcagatgttataccttgcaccggcgaggaacctggcgaggccaaagagagggaggcactgagaggtgccgtcttaaatggtggacccccgagcacacggatcactccagaattctctaaatgggcctccgacgagatgccgtccacgtctaacggcgaatcctccaaacaagaggcaatgcagaagacctgcaagaacagcgacattgaaaagattaccgaggactccgccgttaccacctttgaagctctgaaggcccgggtgcgagagcttgagagacaactcagccgcggcgatagatacaagtgtcttatatgtatggactcttattcgatgccgctaactagcatccagtgctggcatgtccactgcgaggaatgttggctgaggacactgggtgccaaaaagttgtgtccccagtgtaacaccatcaccgccccaggggatctcagacgtatctatctctag

SEQ ID NO: 16899 - DNA, 1782 bp, Artificial Sequence
  Description of Artificial Sequence: Synthetic coding sequence
atggaaaagctcagtgccctccaggagcaaaagggcgagctcagaaaaaggctgtcttacactacacataagctcgaaaagctggagacagagtttgacagcacgagacattacctggaaatcgagctgcggcgggctcaggaagagttagagaaagtgaccgaaaagctgagacgaattcagtcgaattatatggcactgcaaaggatcaatcaggagctggaggacaaactgtaccggatgggccagcactacgaagaggagaagagggcgctgagtcacgagatagtagccctgaacagtcatctcctcgaggccaaagtaaccattgataagttgtccgaggacaacgagctgtatcgaaaagactgcaatctggccgcgcagctcttgcagtgtagccaaacatatggccgggttcacaaggtgtctgagttgccatcagacttccaggagagagtgtcgcttcacatggaaaagcacggttgttccttgcctagccctttatgccatcccgcctacgcagactctgtgcccacttgcgtgattgccaaagtcttggagaaacccgatcccgcgtcactttcttcgcgattgtctgatgcatcagccagagatctggccttctgtgacggggtggaaaaacctggtcctcgccccccctacaaaggcgacatttactgttcggataccgcactgtactgccctgaggaaagaaggcgcgaccgaaggccctccgtggacgctccagtgacagacgtcggattcttacgtgctcagaatagtacagactcggccgctgaagaagaggaggaggctgaggctgcagcctttcccgcaggcttccagcatgaagcgtttcccagttacgccggaagtctaccaacttcctcctcctactcctcatttagcgccacaagtgaggagaaggaacacgcacaggccagcacattaacggccagtcaacaggccatctatctcaactcgagagacgagctttttgatagaaagccacctgccaccacttatgagggatctccacggttcgcaaaggcgaccgctgccgtggccgccccactagaagccgaagtcgcaccaggtttcggcaggactatgagcccttatccagcggaaactttccgattcccagcctcacccggtccacagcaagcactgatgcctccaaacctttggtccttgagagctaaaccaggaactgcccggttgcctggcgaagacatgcgagggcagtggcggcctctgtcagtggaggatattggggcttattcttatccagtgtctgccgcgggaagagcttccccatgctcattctcagagcgctactacggcggagccggcggctcgcccggaaaaaaggccgatggtcgtgctagccctctgtatgcatcatataaagccgactccttctcggaaggagacgatctgtcccagggacacctcgcagagccgtgcttcctgcgcgccggaggcgatctgtctctgtcaccagggagatctgctgatccccttccaggctatgcaccctccgagggcggagacggggaccggctgggggtgcaactgtgcggcacagcctcttcacccgaacccgaacaaggctcccgggacagtctggaaccctcgtccatggaggctagtccagagatgcatcctgccgctcgcctgagtccgcagcaggccttcccaagaaccggcggaagcggactgagccgaaaggattcactcacaaaggctcagctctatggcaccctgctgaattag

SEQ ID NO: 16900 - DNA, 363 bp, Artificial Sequence
  Description of Artificial Sequence: Synthetic coding sequence
ctggctcttcagattagcgaaaatctgtttagcaataaggtgctgaatgctctcaagcctgaaaaggacgtagacggagtgactgatatcaacctaggaaagttggtaagaggggatgcccacgagtgctttgtgagccccgtggccaaggcagtcattgagctgctcgaaaagtcaggggtgaacctggacggcaagaaaatcctcgtggtgggagcacatgggagcttggaagccgcattgcagtgcttgttccagaggaaagggtctatgaccatgagcatccagtggaagactaggcagcttcagagcaaaaccgagtcaagaagcgtcactaggctggagtgccgtagagtgatctag

SEQ ID NO: 16901 - DNA, 1167 bp, Artificial Sequence
  Description of Artificial Sequence: Synthetic coding sequence
atgtctgggacatttttgatccggaagcctcagttgctgcaaggagtgtacgccatgggattcaaccgaccctcaaagatccaggaaaacgcattacctatgatgttggccgaacctccgcagaacttgatcgcccaaagccagtctgggactgggaaaactgcagcttttgtgcttgccatgttgagtagagtggaaccaagcgacaggtacccccagtgtctgtgtctatccccgacgtatgaattagctctgcagactggcaaagtgattgagcagatggggaagttctatcccgaactgaaactggcctatgccgtacgaggcaataagctggagaggggacagaagattagtgagcagatcgtgattggtacccctggcaccgtgcttgattggtgttcaaaacttaaatttattgaccccaagaaaattaaagtcttcgtactggacgaggccgacgtcatgatcgctactcagggacaccaggaccagtcaattcgcattcaacgtatgctgccccggaactgtcagatgctgcttttttccgcgaccttcgaggattctgtgtggaaattcgcccagaaggtcgtaccagaccccaacgttatcaaactcaagagagaggaggaaacactcgatacgataaaacaatactatgtgctctgctcatcacgcgacgagaaattccaggccctgtgtaatctgtacggagccatcaccatcgctcaggccatgatcttttgtcacacccgtaaaactgcctcatggcttgcagcagagctgagtaaagaaggacaccaggtggccctgttgtcaggtgagatgatggtcgagcagcgcgccgctgtgattgagcggtttagggaagggaaagaaaaagtcctggtcacaactaacgtgtgtgctcgggggatcgacgttgagcaggtgtcagtagtcatcaattttgatctccccgttgataaagacggcaacccggacaacgaaacttatctgcaccggatagggcggaccggacggtttggcaagcgaggtttggcggtaaacatggtggactccaagcattccatgaatattctgaatcggatacaggaacattttaataagaagattgaacgattggatactgacgatctagacgaaattgagaaaatcgccaattag

SEQ ID NO: 16902 - DNA, 1821 bp, Artificial Sequence
  Description of Artificial Sequence: Synthetic coding sequence
ctccgtcagtgttacaattataactgcccttcctttctcgccgcagctttggctcgcgcaacatcagacgaagttcttcaaagcgacctgtccgctcactatattccgaaggagaccgacggaaccgagggtacagtcgagatcgagacagtaaaactggccaggtccgtattctcgaagctgcatgagatctgctgttcttgggtgaaggactttcccctacggaggcggccccaactgtactacgaaacctctatccacgcgattaagaacatgcgcaagctcttttacaagcacatttccaaaaagaagaaaaaaagaaagaaacgcgattgggatcaggaggagcaggcttacttcgccgtgttcgatgggcatggaggtgtggatgctgccatttatgcatcaatacacctacatgtcaatctggtgcgccaggagatgttcccacacgatccagctgaggctctgtgccgcgccttcagggtaaccgatgaacgattcgtccagaaagcagcacgggaatctctgagatgtggaaccaccggcgtcgttactttcatacggggtaatatgttgcacgtggcatgggttggggattcccaagtgatgctggtgaggaaaggtcaagctgtggaactgatgaaaccccataaacctgaccgagaggacgagaagcaacggatcgaagccctaggcggctgcgtggtttggttcggcgcatggagggtcaacggatctctctcagtatctagggcaattggagatgccgaacacaagccctacatttgcggagacgcggattcagcgtccaccgtcctggacggaacggaagactacctcattttagcctgcgatgggttctacgatacagtgaatcctgatgaggcggtaaaagtcgtatctgaccatttaaaagagaacaatggtgactcatccatggtggctcacaaacttgtggctagcgctcgcgatgccggtagctctgataatattaccgtgatcgtcgtgtttttaagagacatgaacaaagccgtgaacgtgtcggaggagtccgactggacagagaatagctttcaggggggccaagaggacggtggagatgataaggaaaatcacggtgagtgcaagcgcccgtggccacaacaccaatgctcggctccggctgatctgggctatgacgggagagtcgatagctttacagacagaacatctctgagtccagggagccaaattaatgttctggaggatcccgggtaccttgacctcacccagatcgaggccagcaaaccccatagtgctcagttcctcctgcctgtagaaatgtttggccctggagctcccaagaaagccaatctgataaatgaacttatgatggagaagaaatccgtgcaatcatcgctccctgaatggtctggcgctggagagttcccgacggctttcaacctcggttctactggcgaacagatctataggatgcagtccctgtccccggtctgctccggcctcgaaaatgagcaatttaaatcgcccggaaaccgggtgagcaggcttagtcatctgcggcaccattactctaagaaatggcaccggtttaggttcaatccaaaattttactcattcctgagcgcccaagaaccgtctcacaagatcggaacctccctgtcttctctcacagggagtgggaaacgcaataggattcggtcctctttgccttggagacagaacagttggaagggctactcggagaatatgagaaagcttcgaaaaactcatgacatcccttgtcccgacctcccttggtcatataaaatagagtag

SEQ ID NO: 16903 - DNA, 678 bp, Artificial Sequence
  Description of Artificial Sequence: Synthetic coding sequence
atggagaatttgctgcaggctactaaaagccacgtagataaggtgatcatgaaattaggcaagacgaacgcaaaggccgttagcgaaatgcggcagaaaatatggaacaacatgcccaaagaccacccagaccatgagctgatcgacccttttccagttcctctggtcattattggctcaaagtacgatgtttttcaagatttcgagtctgagaagagaaaggtcatctgcaagacactccgcttcgttgcgcactactacggcgcttccctaatgttcacttcaaagtctgaggctttactcctgaagattcggggtgtgataaatcagttggcatttgggatcgacaagtcaaagagtatctgcgtcgatcagaataaaccgttattcatcaccgcaggtttggactcttttggtcagatcgggagcccaccagtaccggaaaatgacatcggaaagctgcacgcgcactccccaatggagctgtggaaaaaggtgtacgaaaaactgttcccccctaaaagcattaatacgttgaaagacatcaaggatcctgcccgtgacccccagtacgcggaaaacgaagtcgacgaaatgagaatccagaaggaccttgagttagagcagtacaaacgaagctcctcaaagtcatggaagcagatcgaattagacagttag

SEQ ID NO: 16904 - DNA, 621 bp, Artificial Sequence
  Description of Artificial Sequence: Synthetic coding sequence
atgggatttagcaacatggaggatgacggacccgaggaggaggagcgcgtggctgaacctcaggctaattttaacactccgcaggcgcttcgcttcgaagaactgttggcaaatttgttaaatgagcagcatcagattgcgaaggagctctttgagcagcttaagatgaagaagccttcagctaagcagcagaaggaagttgagaaggtaaaaccgcagtgcaaggaggtgcaccagactctcattctggatcctgctcagcggaagagacttcagcagcagatgcaacagcacgtgcagctcctgactcagatccatttactggctacctgcaacccaaacctgaacccagaggctagtagcactcggatatgccttaaggaactggggacatttgcccaatcgagtatcgctttgcaccatcagtacaatccaaaatttcagactctgttccagccttgtaatctgatgggagccatgcagctgatagaagattttagcacccatgtcagcatcgattgcagcccacacaaaacagtgaagaaaactgcgaacgagttcccctgtttgcctaagcaggtggcgtggattctagcgacctccaaagtgtttatgtattag

SEQ ID NO: 16905 - DNA, 468 bp, Artificial Sequence
  Description of Artificial Sequence: Synthetic coding sequence
atgggcaaagattactacaaaattctcggcatccctagcggagcaaatgaggacgagatcaaaaaagcttatagaaagatggccctgaaataccaccccgacaagaataaggagccgaatgcggaagaaaaattcaaagagattgccgaggcttatgacgtgctgagtgaccctaagaagagagggctttacgaccagtatggggaggagggtctcaagacgggtggcggcaccagcgggggcagttccggcagttttcattataccttccatggcgatccccacgcaacctttgctagtttctttggtggctccaacccttttgacatcttcttcgctagttcccggtccaccagaccgttcagtggctttgacccggacgatatggatgtggacgaggatgaagaccccttcggtgcctttggacgctttggctttaatgggttgagtcgcgggccacgccggtag

SEQ ID NO: 16906 - DNA, 246 bp, Artificial Sequence
  Description of Artificial Sequence: Synthetic coding sequence
atgtctatttcctccgacgaggtgaacttccttgtctatagatacctgcaggagtccgggttcagtcattccgctttcacctttgggatagagagtcatatcagtcagtccaacatcaacggagccctggtgccccccgccgcactgatctctatcatccagaagggccttcaatatgtagaggcagaagtatccattaatgaggatggcactctgtttgatggccgacctatagagtccctgtag

SEQ ID NO: 16907 - DNA, 1248 bp, Artificial Sequence
  Description of Artificial Sequence: Synthetic coding sequence
atggccccggttggggttgagaagaagcttcttctcggtcctaatggtccagccgttgcagctgccggtgatctcacaagtgaggaagaagaaggccaaagcttatggtcctctatcctgtccgaagtcagcactagagctagatcgaagcttccgagcgggaagaacattctggtgttcggtgaggatgggtccggaaagaccactctcatgacaaagctgcagggcgccgagcatggcaagaaaggccgaggcctcgagtacctgtatctgtcagtgcacgacgaggatagagacgtggtgaaagatttccaagactatatggagccagaggaaggatgccagggtagcccccaacgaaggggcccgctgactagcggcagcgacgaggagaacgtggcactacctttgggcgataatgtcctcacccataatctaggaatcccagtgctcgttgtctgtactaagtgtgacgccgtaagtgtgcttgaaaaggagcatgattacagagacgagcacctcgactttattcagagtcaccttaggcgcttctgcctccagtacggggcagccttaatctacacatcagtcaaagaagaaaagaacttagacctcctgtacaagtacattgtccataagacgtatggattccactttacaacccccgctctggtggttgagaaggacgctgtatttatccccgcaggatgggacaatgagaaaaagatcgcgatcctgcatgagaattttactaccgtgaagcctgaggatgcatatgaggatttcatcgtgaagcccccggtgaggaagttggtacatgacaaagaactcgcagctgaagatgagcaggtcttcctgatgaaacagcagtccctcctagcaaagcagcccgctacaccgacacgggccagtgagtcaccagcccggggtccttcagggtcaccgagaacccagggcaggggcgggcccgcctctgtcccctcttcatcacctgggaccagtgtgaaaaaacctgaccccaacattaaaaacaatgccgctagcgaaggtgtgctggcctcctttttcaactcccttctctcaaagaagactgggtcgcccggatcaccaggcgcagggggggttcagagcacagccaagaagtcaggacagaaaaccgtcctgagcaatgtgcaggaggagctggacaggatgacgaggaaacctgattccatggtaacgaatagctctaccgagaatgaggcctag

SEQ ID NO: 16908 - DNA, 1929 bp, Artificial Sequence
  Description of Artificial Sequence: Synthetic coding sequence
atgaggagcataacacagggcgcctgccggttcatttgggaggataagggatacatttccggagatcatataaacctggtgagctcgtcgctgagctcattccccatactgcaaaggtctagcgaagagaagattctgtatagtgatcgtctgtcactggagagacagaagttaacagtttgccctattatcaacggcgaggatcacctacgccttctgaattttcagcataattttatcacacgcattcagaacatatcaaatttacagaagctcatcagcctcgatttgtacgataaccagattgaggaaatttcaggtctcagcacattacgttgtctgcgggtattgctcctcggaaagaacaggattaaaaagataagtaatctggagaacctgaagtcacttgatgtgttagacctgcacggtaaccagatcactaagatcgaaaatattaatcacctgtgtgagctccgggtcctgaatctcgccagaaatttcctctcccatgtggacaatttgaatgggttggattcactgactgagctcaaccttaggcacaatcagatcacttttgtgagggacgtggacaatctgccctgcctgcagcatctgtttctgtcatttaataacatctcaagtttcgacagcgtatcctgtctcgctgactctagctctctctcggacatcacgtttgatggaaaccctatcgcccaggaatcttggtacaagcatactgtactacagaacatgatgcagctgcgtcaactggatatgaagcggatcactgaagaggaaaggaggatggcatccgtcctagctaaaaaagaggaggagaagaaaagagaatctcataagcagagtctgcttaaggagaagaaaagactcaccataaacaacgtggccaggcagtgggatctgcagcagcagcgggtcgccaatattgctactaacgaggacaggaaggatagcgacagcccccaggacccgtgtcagattgacggcagcacgttgagtgccttccccgaggagaccggccccctggatagcgggcttaacaacgcacttcagggactcagcgtgattgatacctatcttgttgaagtcgacggcgacacgctgtcgctgtatgggtctggcgcgttagaaagcctggatagaaactggagcgtgcagaccgctgggatgataaccaccgtaagctttacattcatagagttcgacgagatcgttcaagtgttgcctaagcttaagatcaaatttccaaattccctccacctgaaattcaaagaaacaaacctcgtgatgttacagcagttcaatgccctggcccaacttcgaaggatcgaccagctgacgatagatcctcagggcaacccggtggtaaactttaccctgtggaagtactatgtcctgttccggctctcccacttctcaatgcagaaaattaatgggaccgaagtgacgcagaacgacatgattatggcagaaaggctttttgggattctggcccacgtcgcgtctagtgaactgcctcagtatcgactaatcagtattctgggggatgccagaaagaagcagtttagatatttactggaatcaaaggggaaaaagcccggtataattaacgaagagaacaatgactcgaagagattagtgggcgagaatacaaacagggccacattaaactacacaacaagagatttttacaacgagaaactagaagagatcaaggaaaagaagaagttctgcaagacatatattgaggatctcgtgaaagaggccaccgaaattaacatgaaaaatgaagctctccagaagttatggcctcaaatgtttatcgagctggtcagagatgctgttatcgagatacgcaataagaacagctatatgaaactgtgtctgcagcagataactgatcagaagtag

SEQ ID NO: 16909 - DNA, 432 bp, Artificial Sequence
  Description of Artificial Sequence: Synthetic coding sequence
cggctagggcgatatgaggtcgaaaagagatgcgcagtcgagaaggaggactatgacctagccaaggagaagaaacagcaaatggagcagtatcgagcagaagtgtatgagcagctagaattgcacagcttactcgacgcggagcttcactccgcagttgatccgctgctcccagcaaccgacccacacccgaagattaacgccgaaagtctgccttatgatgaacggccactgcccgcaattcgcaaacattatggcgaagcggttgtggagcccgagatgtccaatgccgatatttccgacgcacgcaggggcggcatgttgggtgagcctgagcctctgactgaaaaggctctacgcgaagcctcgagtgctatcgatgtgttgggtgagacactggtggcagaggcctactgtaaaacatggtcttag

SEQ ID NO: 16910 - DNA, 1842 bp, Artificial Sequence
  Description of Artificial Sequence: Synthetic coding sequence
atggccaccatcccggattggaagctccagttgttagctcggaggagacaggaagaggcttctgtccgcggaagggagaaagccgagagagagcgcctttcccagatgcccgcttggaaacggggtcttctggagagacgtagggcaaagttaggtctctcacctggagagccctctcctgtactaggtacggtggaggccgggccccctgaccccgacgagtctgccgtgcttcttgaggcaatcgggccagttcatcagaaccgctttattaggcaggagagacaacaacagcagcaacagcaacagcgatcagaagaactactcgccgagcggaaacccggaccactcgaggccagagagagaagaccgagccctggcgaaatgagggaccaatccccgaaaggacgggagagccgcgaagaaaggctctccccaagagaaactcgtgaacggagacttggaattggaggagcgcaggaattgtccttgcggcctctagaggcccgagattggcgacagtctccgggtgaagtgggcgacaggtccagcagactaagtgaggcctggaagtggaggctgtccccaggcgagacccccgaacgctcacttcgtctcgctgaatctagagagcagtccccgcggaggaaagaagtggagagccggctgtcccccggggagtcagcttaccagaagttaggccttaccgaggcccacaagtggagacctgactcacgggaatcacaagagcagagcctggtacaactggaggccaccgagtggcggcttcggagcggggaggaacgccaggattactcagaggaatgtggtcggaaggaggaatggcccgtgcccggggtggcaccgaaggaaaccgccgaattatctgaaactctaacaagggaggctcaagggaactcttccgccggtgtcgaagctgcagaacagaggcctgtcgaggatggagaacggggaatgaagcctacagaagggtggaagtggaccttgaatagtggaaaggctcgggaatggacccctagagatattgaagcgcagacccagaagcctgagcctccagagtccgctgagaagctactcgaatccccaggggtcgaggccggcgagggcgaggctgagaaggaagaggcaggcgcacagggacgtccactgcgggcccttcaaaattgctgcagcgtgcctagtccactgccccccgaagacgccggaactggcgggctgagacaacaggaggaggaagccgtagaactacagcccccaccgcccgcccctcttagtccacctccacccgcccccacagcccctcagccaccgggggacccccttatgtctagacttttctatggagtaaaggcggggcccggcgtcggggcaccacggagatccggacataccttcactgtcaaccctcgtcggagcgtgcccccggccacccccgcaacccctacttctccggccactgttgacgcagcggtgcccggggctggaaaaaagaggtacccaaccgccgaggagatcttggttcttggcggatacctgcggctgtccagatcgtgcctggcaaagggtagccccgagaggcatcacaaacaattaaaaataagcttcagtgaaaccgcactggagacgacataccaatatccttccgagagcagcgtcctcgaggaattggggcctgagcctgaggtcccatccgcgccaaaccctccagccgcccagcccgacgacgaagaggacgaggaagagcttctcctcctgcagccggaattacagggtgggcttaggactaaggcacttatcgtggatgagagctgtcgacggtag

SEQ ID NO: 16911 - DNA, 552 bp, Artificial Sequence
  Description of Artificial Sequence: Synthetic coding sequence
atgggccctctgcctagaacagtggaactgttctatgacgtgctgtccccatacagctggctgggctttgaaatattgtgtcggtaccagaacatctggaacataaatctccagctacgccctagtctcatcaccggcatcatgaaggattcagggagtctgtcagccatgagatttctgaccgctgtcaacctcgagcatccagagatgctggagaaggcaagccgtgagttatggatgagggtctggtctcgcaatgaggatattactgaaccccagtccattctcgccgccgctgaaaaagctgggatgtccgccgaacaggcccagggcctgttggaaaaaatagccacaccaaaggttaagaaccagttgaaagagacaacagaagccgcctgtcggtacggtgcttttggcctaccaatcacagtggctcacgtggacgggcagactcatatgctgtttgggagcgatcgaatggagctgctcgcacacttgctaggggaaaaatggatggggccaatccccccagcggtcaacgctaggctctag

SEQ ID NO: 16912 - DNA, 306 bp, Artificial Sequence
  Description of Artificial Sequence: Synthetic coding sequence
gaagggactagcggaaaaacagccctacatttggccgttgagacacaggaacgagggctagtgcagtttcttttgcaggcaggggcacaggtggacgctcggatgctgaatggctgcactcccctgcatttggccgccggacgtggattaatgggcatttccagtacgctatgtaaggcaggagccgactcattgcttagaaacgtggaagatgagaccccccaggacctcacagaagaatctctggtgctacttccatttgatgatctaaaaataagtggaaagctattactctgcacagactag

SEQ ID NO: 16913 - DNA, 14586 bp, Artificial Sequence
  Description of Artificial Sequence: Synthetic coding sequence
atggctaccatgatccctcccgtcaaactgaagtggctggaacatttgaattcttcctggatcacagaagactcagagtcaatagccacaagggaaggagttgccgtcctctacagcaagctggtctccaacaaagaggtggtccccctcccacagcaggtgctgtgtctgaagggcccacagctacctgactttgagcgtgagagcctgagttcagatgagcaagaccattacctggatgcgctactgtcttcccagctcgccctggccaaaatggtgtgcagcgactcccccttcgcgggagcacttcgtaagaggctgctagtgctgcagagagttttctacgcactgagcaacaagtaccacgacaaaggaaaagttaaacagcagcagcacagtcccgagtcaagctcaggctccgccgacgttcattcggtgtcagaacgacctcggtcaagcaccgatgccctaatagaaatgggagttagaactgggttaagcctcctgttcgctctccttagacagtcctggatgatgcctgtcagcggacccggattgtctctgtgcaacgacgtcattcataccgctatagaggtcgtttcatcactaccccccctttctctggctaacgaaagcaagattccccccatgggcctagactgtctctctcaggtcaccacttttctgaaaggggtgacgattccaaattcaggggcagacaccctggggcggaggctagcatccgaattgttgcttggtcttgccgcgcaacggggctcccttcgttacttgcttgagtggatagaaatggcccttggggcatctgctgtggtccacactatggaaaaaggcaaactgctaagttcccaagaagggatgatctctttcgattgttttatgaccatccttatgcagatgcgccggtcgctcggatctagcgcagacagaagccagtggagagagccaactcgcacttccgacgggctatgtagtctctatgaagccgcgctttgtctgtttgaagaggtctgcagaatggcaagcgattacagccgcacttgtgcaagccccgacagtattcaaacgggagacgcacccattgtttcggaaacgtgcgaggtgtacgtctggggtagtaactcgagccaccaactggttgaggggacccaggagaaaattctccagcctaagttggctccttcatttagcgacgctcagacaatcgaggcaggtcagtattgtaccttcgtcatttctactgacggctctgtccgggcttgcggcaaaggatcatatggccgcttgggccttggcgatagcaacaaccaatctacactgaagaaattaacatttgagcctcatcggagcatcaaaaaagttagctcctccaagggatctgatgggcatacgctggcttttactacagagggggaggtctttagctggggcgatggagattatggcaagcttggacatggaaatagctccacacaaaagtatcctaaactgatccagggccctctgcaagggaaggttgtcgtgtgcgtatctgctggatataggcattccgccgctgtgactgaggacggtgaactgtacacttggggggaaggtgacttcggaagactaggacacggcgacagcaattccagaaacatcccgaccctcgtgaaggacatcagcaacgtaggcgaggtgtcgtgcggcagctcacacaccatagccctttctaaggacggtcgcacagtatggagtttcgggggcggggataacggcaaactcgggcacggagacactaaccgcgtgtataaacccaaggtcattgaggccctccaaggtatgtttatcaggaaggtatgtgccggatctcagagttccctggcattgacgagcactggtcaggtgtatgcatgggggtgcggagcctgtcttggatgcgggagctcggaagccaccgccctgcgccccaagctgatagaagagttggccgccactcgtatcgtcgacgtgtccatcggggactcacactgcctcgcattgtctcatgacaatgaagtttatgcctggggaaataactcgatgggccagtgtggacagggaaactccaccggacctattacaaagccaaagaaagtgtccggattggatggcattgctatccaacagatttctgctgggacctcacatagtcttgcctggaccgccctaccccgggatagacaagtagtggcttggcaccgcccatactgcgtggacctggaggagtctaccttcagccaccttagatcttttcttgaacgctactgcgacaagatcaacagcgaaatccctccacttcctttcccatcctcccgagagcatcactctttcctgaaactgtgcctgaagctacttagcaaccacctcgccctcgctctcgccggtggagttgctacttccatcctgggccgtcaggcgggaccactccgtaatctcttattccggttgatggatagtacggtcccagacgaaattcaggaggttgtgatcgagaccctgagcgttggcgccacaatgcttcttccacccctccgggagcggatggagctgctccattcgttgcttccccaaggtcccgaccggtgggagtcgctgagtaaaggacagcggatgcagctggacattatccttacaagcctgcaggaccacacacatgtggccagcttgctggggtattcaagccccagcgacgccgcagacctgagtagcgtttgtacgggttatggcaacttaagcgatcaaccctacggaacccagtcttgccaccctgacactcacctcgcggaaatccttatgaaaacactgctgcgaaacctcggattctacactgaccaagccttcggcgagctcgagaagaacagcgacaaatttctcttaggcaccagcagcagtgaaaatagccagccagcacatctgcacgagctgctgtgcagtctgcagaaacagttgctcgctttttgccacatcaacaatatcagcgagaatagctccagtgtggccctgctgcacaagcacttgcagctactcctgccccacgctaccgacatttattctagatccgccaacctgttgaaagagagcccatggaatggttccgtcggggaaaagctcagggacgtgatctacgtgtctgccgcggggtccatgctctgccagattgttaacagtctccttctgctgccagtgtctgtagctcgcccactactctcatacctgctcgatctattgccaccactcgactgtctcaaccggttgctgccagccgctgatctgctggaagaccaggagttgcaatggcccctgcacggtgggcccgagctcattgaccctgcggggctcccattgccacagcccgcgcagagctgggtatggctcgtggacctggagaggaccattgccttgctcattggtcgctgcctgggaggaatgctgcaaggctcacctgtgagccctgaagagcaggacacagcgtactggatgaagactcccctgttctcagacggggtggagatggacactccgcagctcgataaatgcatgtcttgtctgctggaggtggctctgagcgggaatgaggaacagaagccattcgattacaaattgcgcccagaaattgctgtgtatgtggacctcgccctcgggtgctccaaggaacctgccagatctctctggatttccatgcaggactacgcagtgtctaaagattgggattctgctaccttatctaacgagtccctgctggacaccgtaagccgcttcgtgctggctgccctcttaaagcacacaaatctgcttagccaagcctgtggggagagccggtaccaaccaggaaagcacctgtctgaggtgtacagatgcgtgtacaaggtacggtctcggttattagcctgcaaaaatctcgaacttattcagactcgctctagctcaagagacagatggatttcagagaatcaagattccgcagatgtcgatcctcaggaacatagcttcactcggacgatcgacgaggaggccgaaatggaggagcaggcagaacgcgatagggaggaaggacaccctgagcctgaggacgaagaggaggagcgggagcatgaggtcatgacggctggcaaaatattccaatgttttctgagtgccagggaggtggccagatctagggatcgcgaccgaatgaactccggcgccggaagcggggctcgcgcagatgacccacctccccagtcacagcaggaacgccgagtatcgactgatttgcccgaggggcaagatgtctacactgccgcttgcaacagcgtcatacatagatgtgctttactcatccttggggtatctcctgtcattgacgaattgcagaaacgacgcgaagaagggcagctacagcagccatccaccagcgcgtccgaaggaggaggactgatgacaaggtccgagtctctaactgccgagagtcggctggtgcacacatcccctaattaccggctgattaaatcgcggtcagagtcggacctatctcaaccagagtccgatgaggagggttatgctttgtcagggcgtaggaatgtggacctcgaccttgccgcatcccataggaagcgcggaccaatgcacagccaactcgaaagtctcagcgattcttgggctcgactgaaacactcccgggattggctgtgtaattccagctactccttcgaatctgatttcgatttgacaaagtctctgggcgtccatacacttattgaaaatgtggtgagcttcgtcagcggggacgtgggaaatgctccaggctttaaagagcccgaagaaagtatgagcacttctccccaggcttctatcattgctatggagcaacagcagcttcgagcggagttaagattggaggccttgcatcagattttagtcctcctgagcggcatggaagaaaaggggtctatctctctggccgggtctagattgtcctctggcttccagtctagcacactgctcaccagcgttaggttacagtttctcgcgggatgctttgggctcggcacagttgggcacaccggtggcaagggtgagagtggccgcttacatcactatcaggacggcatccgggccgccaagaggaacatacagatagagattcaggtggctgttcacaaaatttaccagcaattgagcgctaccttggaacgggccctccaagccaacaaacaccacattgaggcccagcagaggctgcttctcgttactgtgttcgccctgagtgtgcactaccagccggtcgacgtctcccttgccatatcaacaggcctgctcaatgtcctgtctcagttgtgcggaaccgacactatgctgggtcagccgctgcaactcttgcctaaaacgggcgtaagtcaattatcaactgctctgaaagtggcctctaccaggctactgcagatcttagccatcaccaccgggacttacgccgataaactgtcccctaaggtggtgcagagtctgttggacctcctgtgcagccagttgaagaacctcctctcccaaacaggagtgctgcacatggcatctttcggcgaaggcgagcaagaagacggtgaagaggaagaaaaaaaagtggacagcagcggggaaacggaaaagaaggatttcagggcggcattacgcaaacagcatgctgctgagttacatctaggtgattttctggttttcctccggcgagtggtgagctcaaaagcaattcagtccaaaatggcatcccctaagtggacagaagttttactcaatattgctagccaaaagtgtagctcagggatcccactggtcgggaatctgaggactcgccttctcgctctccacgttctagaggccgttctgcccgcctgcgaaagtggggttgaggacgatcagatggcacagatcgtggagaggctattcagtctcctgagtgattgcatgtgggagactccgattgctcaggctaagcacgcaatccaaataaaggaaaaggaacaggagattaaattgcagaagcaaggcgaattggaggaagaagacgaaaaccttccaattcaggaagtttcgttcgacccagaaaaggcccagtgctgcttggtggaaaacgggcagattcttacacatggtagtggcgggaagggttacgggcttgcctcgacaggcgtcacatctggctgctatcagtggaagttctacattgtgaaggagaatcggggaaacgagggcacgtgcgtaggggtcagtagatggccagtacacgacttcaatcatcgtactacttccgatatgtggctctatcgagcctactctggtaatctctatcacaacggcgaacagacgcttaccctgagctcctttacacagggcgactttatcacttgcgtgctagacatggaggcgaggacaatcagcttcggaaagaatggagaggaaccaaaattggcttttgaggatgtggatgctgcagagctgtatccgtgtgtgatgttttactcgtccaaccctggcgagaaagtgaagatctgcgacatgcagatgaggggcaccccaagagacctgcttcctggggatccgatttgctctccggtagccgccgtattagccgaggccactatccaactcattagaattctccatcgcaccgaccggtggacatattgcatcaacaaaaagatgatggagcgccttcataagataaagatttgtatcaaggagagcggacagaagctcaagaaatcgagaagcgtccagtctagggaagagaatgaaatgcgagaagagaaggagtccaaagaagaggagaagggaaaacacactcgccatggtttggccgacctgtccgagcttcaactgaggactttgtgcatcgaagtttggcccgtgctcgccgttatcgggggtgtggacgcaggtctccgcgtgggcggacgatgcgtacacaagcagactggcagacacgcgaccctactgggggtagtcaaagagggatctaccagcgctaaggtccagtgggatgaagccgagattaccatcagtttccccaccttttggtcaccttccgacacacccttgtacaatctagagccctgcgaacctctgcccttcgacgtggctaggtttaggggccttaccgcttctgttctgctcgacctgacatatctgaccggggtgcacgaagatatgggtaagcaatctacaaaacgtcacgagaagaagcaccgccacgagtctgaggaaaagggggatgtggaacaaaagcccgagagcgaatcggcattggacatgagaaccggtctcacttcggacgatgtgaagtcccagtctactacatcttctaaaagtgagaacgaaatcgcctcattctcccttgacccaactctcccctcagtcgagtcgcaacaccagattacggaaggaaagcgaaagaatcatgaacatatgtctaagaatcacgatgtcgcccagtctgagattcgggcagtgcagctatcatacctctatctgggcgctatgaagagtttatccgcacttctcgggtgttcaaagtacgccgaactgctgcttattccaaaagtactcgccgagaacggacataactctgattgtgctagtagccccgtcgtgcatgaagatgtagagatgcgcgctgcattgcaatttctgatgcgccacatggtcaagcgagccgtaatgcgatcgcctatcaaaagggctctgggcttggctgatctggagagagctcaggccatgatctacaaattagtggtacatgggctgcttgaggatcaattcggtggaaaaataaagcaggagattgatcagcaggccgaagagtcagaccccgctcaacaggctcaaacccctgtgaccacctccccatcagcttcctcaacgacaagctttatgagtagctccctggaagataccaccacagctactacaccggttacggacaccgaaaccgtgccagcctccgagtcccctggcgtcatgcccctgtcactacttagacagatgttttcttcctacccaactacaactgttctaccaaccaggcgggcccagacccctcctatctccagccttcccaccagtccaagtgatgaggtcggccgacgacaaagtctgacatcccccgattctcagagcgccaggccggctaacagaactgccctgagcgacccatcctctcgtctttctacaagcccccccccccccgccatcgccgttccgctgcttgagatgggcttcagcttgcggcagattgccaaagctatggaagctacaggggcaagaggcgaagcagacgctcagaacatcaccgtcctggcaatgtggatgatagagcatcccggtcatgaggacgaagaggagccccagtcagggtctacggccgacagtaggcccggagccgctgtgcttgggtctggagggaaatctaacgatccatgttacttgcagagcccaggcgatatcccgtcggctgacgctgctgagatggaggagggatttagtgaatctcctgacaacttggaccacactgaaaacgccgctagtgggagcgggcccagcgcgcggggcaggtctgcggtcacacgtcgccacaaatttgacctggccgccaggactctgctagcacgcgcggcagggttataccgcagcgtccaggctcaccggaaccagtcaaggcgggaggggatctcgttacaacaagaccccggcgcactatatgatttcaatctggacgaggagcttgagatagatcttgacgatgaggccatggaagcaatgttcggccaggatctcacatctgataatgatattctgggaatgtggattcctgaggtgttggactggcctacatggcacgtttgtgaaagtgaggaccgagaagaagtcgtggtgtgcgaactgtgcgagtgtagcgtggtgtcttttaatcagcacatgaagcgcaaccaccccggatgcggtagaagcgccaataggcagggatatcgatctaatggctcctacgtggacggttggttcggcggcgagtgtggcagcggaaatccatattacctgctctgcggcacctgcagagaaaaatacttagccatgaagactaagagcaagagcactagtagcgaaagatacaaaggtcaagccccagacttaatcgggaagcaggattcggtatatgaagaagactgggatatgttagacgtcgacgaggatgagaagctgacaggggaagaggagtttgagttgctggctggcccgttgggccttaatgaccgacgaattgtgcctgagcccgtacagtttcctgattcagatccacttggtgcctccgtggccatggtgacggctacaaattccatggaggaaacactgatgcagattgggtgtcatggctcggttgaaaagtcatcctcaggcagaattactttgggcgaacaggccgccgctttggccaatccccacgaccgagtggtggctttgcgcagggtgacggcggcagcacaagtgctcctggcgcgcactatggtgatgagggctctatccctactgagcgtgtctggatcttcttgctctttggcagctggcctggaaagcttgggtcttacagacatacgaacgctcgtgaggctgatgtgtctagctgcagctggccgagccgggctgagcacatccccttccgccatggcatctacttcagagaggtcacgagggggccattctaaggcgaacaaaccgattagctgtctggcgtacctgtctacagccgtaggatgtctggcctcgaatgcaccctcagcagccaaactgttggtccaactttgcacgcaaaacctgatctctgcagcaaccggggtgaacctcactactgtggatgactcaatccagaggaaatttttgccatcctttctgaggggcatcgccgaagaaaacaagctggttacctcgcccaatttcgtggtaacccaggctttggtcgcgctgctggcagataagggggccaagttgagacccaactacgacaagagtgaggtcgagaaaaagggccctctcgaattggcaaacgctcttgctgcctgctgcctttctagccgcctgagtagccagcatagacagtgggccgcccaacaattagtcagaacattagccgctcacgaccgggataatcagacaacattgcagactttagccgacatgggtggcgatttaaggaagtgtagcttcatcaagctggaggcccaccagaaccgggtgatgacttgtgtttggtgtaacaaaaagggcctcctggccactagtggtaacgatggaactatccgcgtgtggaacgtaactaaaaagcagtattccctgcagcagacttgcgtattcaatcgcctcgagggggacgctgaagagtctttggggtccccctccgatccaagtttctcaccggtgagctggtctatcagcggaaaatatttggctggtgctctggaaaaaatggtcaacatttggcaggtaaatggcggaaaagggcttgtagatattcagccccattgggtttccgctctcgcatggcccgaggaggggccagcaacagcctggtcaggcgaatccccggaactcctgctggttgggcgaatggacggatccctaggcctcatagaagtggtggatgtgtcgactatgcacagacgcgaactggaacattgctatcgcaaggacgtaagtgtaacatgcatagcctggttctcagaggaccggccctttgctgtggggtactttgatgggaaactcttactgggaaccaaagagcctctcgagaagggaggaattgtcttaattgatgctcacaaggacaccctgataagcatgaagtgggaccctactggccacattctcatgacgtgtgccaaggaggactcagtgaagttgtggggcagcatatctggttgctggtgttgtttgcacagcctgtgccacccctcgattgtgaacgggatagcgtggtgccgcctgcccgggaaagggtccaaactacaactcctcatggcaacagggtgccagagcgggttggtgtgcgtatggcgcattccacaagacacaacccagacaaatgtgaccagcgctgaaggctggtgggagcaggaatctaattgtcaagacggatataggaagtcgtctggtgccaaatgcgtgtatcaactcagaggtcatatcactcctgttaggactgtggccttcagctccgacggtctggctctggtgtcagggggtctgggcgggctcatgaacatttggagcttgcgcgatggcagtgtcctgcagacagttgtcatcggctcaggggctatacagaccactgtctggattccagaagttggcgtggctgcttgctctaaccgcagcaaagatgttcttgtcgtgaactgcactgctgaatgggccgcagctaaccacgtgttggccacttgccggactgcgctgaaacagcaaggagtgctgggactgaacatggctccatgtatgagggccttccttgaacggctgcccatgatgctgcaagaacagtacgcatacgagaagccacatgtggtgtgcggggaccagctcgtccatagcccctacatgcagtgcctcgcctccttggctgttggcctccaccttgaccagctgttgtgcaatccacctgtaccaccgcatcaccagaactgcctgcccgatcctgcaagttggaatcctaatgagtgggcatggctggagtgcttttcaaccaccattaaggcagctgaagccctgacaaatggtgctcagttcccggagtcatttactgtccccgacctagaaccggttccggaagacgaactggtttttttaatggataactctaagtggataaacggcatggacgagcaaattatgagttgggcgacgtctagacccgaggactggcatctcggaggcaagtgcgatgtgtacttgtggggagccgggcggcacggacaactagccgaagccggtcggaacgttatggtgcctgcggctgctccttcttttagccaggcccagcaggtcatctgtggccagaactgcaccttcgtgattcaggccaatgggactgttctggcttgcggagaaggttcctacggacgcctgggccagggaaactctgatgacttgcacgtcttgactgtgatttcagctctccagggcttcgtggtcacccagctggttacaagttgtggtagcgatggccactctatggccctgacggaatccggcgaggtctttagttggggagacggcgactatgggaagctcggccacggcaactccgatcgccagagaaggccacgtcaaatcgaggcactgcagggagaggaagtcgtgcagatgtcatgcggcttcaagcatagcgctgtggtgacgtcagatggcaagctgttcacttttggcaacggggattacggcaggcttgggctgggcaatactagcaataaaaagctgccagagagggtgaccgcactggaagggtatcagatagggcaggttgcctgcggcttgaaccacacactggccgtgtccgcagatggatccatggtgtgggctttcggggacggcgactacgggaaattgggcttagggaatagcaccgctaaaagcagcccccagaaaatcgatgtactgtgcggtattggcatcaagaaagtggcatgcgggactcaattttcagttgcattaacaaaagatggtcacgtctacaccttcggccaggacagactgattggcctcccggagggaagggccaggaatcataaccgaccacaacaaatccctgtgctggctggtgtgattatcgaggatgtcgcagtgggcgccgagcataccttagccctggcttcaaacggtgacgtctatgcatggggctccaactccgaagggcaactcggactggggcacacaaatcacgttcgtgagcccaccctagtaacgggacttcaaggcaaaaatgtccggcaaatcagcgcgggcagatgccattctgccgcctggaccgctccgcccgttccccccagggctcctggggtgtctgtgccactgcagctgggcctgccggacacagtgcccccgcagtacggcgcgctccgggaagtgtctatccatacggtgcgcgcgagactgcggctcctctatcacttcagcgatctgatgtattccagctggcgcttactgaatttatctccaaacaatcaaaattcaacgtcccattacaacgctggcacctgggggattgtccagggccagttacgccctctcctggctcctagagtgtataccctgccgatggttcgatcaattgggaagacaatggtgcagggcaagaattatgggccgcagatcaccgtgaaaagaatcagcacacggggtcggaagtgcaaaccaatctttgttcaaattgcacgccaagtggtgaagttaaatgcttcagatctaaggctccccagccgcgcttggaaagtgaagctggtaggggagggagcagatgacgctgggggcgttttcgatgatactatcactgaaatgtgccaggagctagagacaggcattgtagatctgctgatcccgagcccgaatgctacagccgaagtcggctataatcgggatcgcttcttattcaatccaagtgcttgtctggatgaacatttgatgcagtttaagtttctcggcatccttatgggggttgccattcggaccaagaagcctctggacttgcatctggcccccctcgtgtggaagcagctttgctgcgttcctttgaccttggaggacctggaagaggtcgatctgctttacgttcagactctgaattccatcctgcacatcgaggattccgggattactgaagagtcttttcacgaaatgatcccattggatagttttgtgggtcaatccgccgacggcaagatggtgcccatcatcccagggggaaattccattcccctcacattcagcaacagaaaggagtacgtggaaagggcaattgaatataggcttcatgagatggacaggcaggtggccgcagttcgcgaggggatgtcgtggatcgtcccggtgccacttctttcccttctgacggcaaaacagctggaacaaatggtgtgtggcatgcccgagatctcggtggaggttcttaagaaagtggtgagataccgcgaagttgatgagcagcaccaactcgttcagtggttttggcacacactcgaagagttcagcaatgaagagcgagtgctctttatgagatttgtgtccggtagatccagacttcctgcaaacaccgcagatatttcccaacggtttcagattatgaaggttgaccgcccctacgactctttgcctacatcccagacctgctttttccagcttcgattacctccttactcaagccagcttgtgatggcagaacgtctccgttatgcgatcaacaactgccgcagtattgatatggataactatatgctctcaaggaatgtggacaatgctgaagggtctgataccgactactag

SEQ ID NO: 16914 - DNA, 3633 bp, Artificial Sequence
  Description of Artificial Sequence: Synthetic coding sequence
atggccagccaactgcaagtgttttctccacccagcgtttcgagctcagccttctgttcagctaagaagctgaaaattgagccgtccggctgggatgtgtccgggcagtctagcaacgataagtattacacccactcaaaaaccttgcctgctacccagggacaggcaaactcgagtcaccaggtggccaacttcaatatccctgcatatgatcaaggattattactaccagcccccgccgttgagcatatcgtcgtaacagcagcagattcatctggttctgctgcaacctcaacctttcagtctagtcaaacactgacccacagatctaacgtgtcactcctggagccataccagaaatgtggtctaaagaggaagtccgaagaggtggactcaaatggctccgtgcaaatcatcgaggagcatccaccattgatgttgcagaaccggaccgttgtcggcgctgccgctaccacaactacagtaaccaccaagtctagttctagcagcggagagggcgactaccagctggtgcagcacgagatcctgtgtagcatgacaaacagttatgaagtgctggagtttttgggcagaggcacattcggccaagtagccaaatgttggaagaggagcacaaaggagattgtcgctattaaaatcctgaaaaatcatccaagctatgctcgacaaggacagattgaggtgtccattctgagccgcctctcctccgaaaatgccgacgaatataattttgtgcggtcctacgagtgcttccagcacaaaaatcacacatgccttgtcttcgaaatgttagagcagaatctctacgacttcctcaagcagaataagtttagccctcttcccctgaagtatatacgacctattctgcagcaggtagccaccgctctgatgaagctgaagtcgttgggactgatacacgcagatttaaagccggagaacataatgctggttgatccggtgcgccagccatatagggtgaaagtgattgacttcggatccgccagtcatgtttctaaagccgtgtgtagtacctacctccagtcacgatactatcgcgcaccagagattattctggggctccctttttgtgaagctatcgatatgtggagccttggctgcgttatcgccgagctgtttctgggctggccactataccctggagcgagtgaatatgatcaaatacgttatatcagtcagacccaggggctgccagctgaatatctgctgagtgctgggaccaagacaactcggttttttaatcgggaccctaatctcgggtaccctttatggagactgaaaacgcccgaggagcatgagttggaaaccggaatcaagagtaaagaagccaggaagtacatttttaattgtttggacgatatggctcaggtcaacatgagcactgacttggaggggactgacatgcttgccgagaaggccgatcgcagggaatatatagacctgctgaagaaaatgctcacgatcgacgccgacaaaaggatcacccccttaaagactttgaatcaccaattcgtcaccatgactcacctgctagatttcccgcattctaatcacgttaagagctgtttccagaatatggaaatttgcaaacgccgtgttcacatgtatgacacagtctcacaaatcaaatcaccattcaccacccatgttgcccctaatacatcaacgaatctgacaatgtcttttagtaaccagctcaataccgtgcataaccaggcctccgtgctggcgagtagcagtaccgctgcagctgctacactgtccctcgcgaactctgacgtgtcccttcttaactatcaatccgctctgtacccatctagcgctgcccctgtgccaggagttgcccagcaaggggtgtcactgcaacccggaactacccaaatctgcacacagacagaccccttccagcagacgttcatcgtgtgtccgccagcgttccagaccggcctgcaagcaactactaaacactctggcttcccagtgaggatggacaacgcggtgccgattgtaccccaggctcccgctgcccagccacttcagattcagtcaggcgtcctcacacaggggagctgtacacctttaatggtcgcgacgctgcacccccaggtggcaacaatcacgcctcagtatgccgtgccctttaccctaagctgcgccgccggccggccagccctcgtcgaacagactgccgcagtcctccaggcttggccaggcggaactcagcagatccttttacctagcacatggcagcagctcccaggagtggctctgcataacagtgtgcaacctactgctatgattcctgaggccatgggatccggccagcagctagcagactggaggaacgctcattcccacgggaatcagtattcaacaatcatgcagcagccctccctcctcaccaaccatgtcactctggcaaccgctcagccgctgaacgttggcgttgctcatgtggtgcgccagcagcagtcctcgagcctcccatccaagaagaataagcaaagcgcccccgtgagctccaagtcttctctggacgtgctgccttctcaagtgtactcactcgtgggcagcagcccgttgagaactaccagcagttataatagcctggtgcctgtgcaggatcagcatcagccaatcatcatcccggacacgccatccccaccagtgtccgtgatcacaatcaggagcgacacagatgaagaggaggataataagtataaaccctctagctcagggttaaagccacgtagcaacgtgatttcttatgttaccgtcaacgactcccctgacagcgattcatccttgagctctccctatagcaccgataccctgtcagcccttcggggaaatagcggctctgtcctggagggcccaggccgggtggtggcagacggtacgggaacccggactattattgtccccccattaaaaacacagttgggcgactgtaccgtggctacacaggcctcaggtctgttgagcaacaaaaccaagccagtggcttcagtgtccggccagagctctgggtgctgcatcacacccaccgggtaccgcgcgcaacggggcggtaccagcgccgcacagccgctcaatttgtcccagaatcagcaaagcagcgccgccccaacatcacaggaaagatccagtaaccccgccccccggcgccagcaagctttcgtggcccctctgtcgcaggccccttacacctttcagcacgggtctccactgcactctacaggccacccccatctggctccggcccccgctcacctgccttctcaggcccacctgtatacctacgcagcacctacttccgcagcagcactggggagcacttcatccatcgcccacctgttctccccacaaggttcctcccgacatgccgctgcctatactacccatccttctacattggtacaccaggtacccgtctcagtggggcccagtctattgaccagcgcgagcgttgccccagcacagtatcagcatcaattcgctacacagtcctacatcggcagctcccggggcagcactatctacaccggctatcccctctcccccacaaagatctctcagtattcctatctttag

SEQ ID NO: 16915 - DNA, 579 bp, Artificial Sequence
  Description of Artificial Sequence: Synthetic coding sequence
atgggaaaagggtgtaaagttgtcgtttgcggattgcttagtgtcgggaaaacagccatactagagcagctcctgtacggaaatcataccatcggcatggaagattgtgaaacaatggaggatgtttacatggcctccgtagaaaccgaccgcggagtgaaggagcagctccacttatatgacacgcgcggcctacaggaaggtgtcgaactgcccaagcactatttttcctttgctgacgggttcgtgttagtgtactccgtcaacaatctcgaatctttccagagagttgagcttctaaagaaggagatcgataaattcaaggacaagaaagaagtggcaatagtggtactggggaataagattgatctcagcgagcagcgccaagttgacgctgaggtggcacagcagtgggccaagtctgagaaggttcgcctatgggaggtcaccgtgaccgaccgaaaaactttgatagagccattcaccctgttggcttcaaagttgagccagccacaaagcaagtcatcattcccattacccggcaggaagaataaaggaaattctaactccgaaaattag

SEQ ID NO: 16916 - DNA, 1803 bp, Artificial Sequence
  Description of Artificial Sequence: Synthetic coding sequence
atggcaagcaatcacaaaagcagcgccgcgagaccagtgagcagagggggcgtgggccttaccggaagacccccttcaggaattcggcctctttccggaaatattcgtgtcgcaacagctatgcctccaggcactgccaggcccggaagccgcggatgtccaatcggcactggcggagtcttaagcagtcaaattaaggttgcccataggcccgttacccaacaaggacttactggcatgaaaaccggcactaagggccctcaaagacaaatacttgataagagctactaccttggtctgttacggtccaagatttcagagctaaccactgaagtgaataagctgcagaagggtatcgaaatgtacaaccaagagaacagcgtgtacctgtcatacgagaaacgcgcggagaccctggcagttgaaattaaagagctgcaggggcagttggcagactacaacatgctagttgacaaattgaacacaaatacagagatggaggaggtgatgaacgattacaacatgctgaaggcccaaaacgatagggaaacccaatccttagacgtgatctttactgaaaggcaggccaaagaaaagcagatcaggtccgtagaggaggaaatcgagcaggagaagcaggcaacagatgacatcatcaagaacatgagcttcgagaaccaagtgaagtacctagagatgaaaaccactaacgagaaactgctccaggagctggataccttacaacagcagttggacagccagaacatgaaaaaggaaagcctggaagctgagatcgcccactcccaggtgaaacaagaggctgtattactgcacgagaaactgtatgaattagagagtcatcgggaccagatgattgcagaagacaagtccataggaagtcccatggaagaaagggaaaaactactgaagcagattaaggacgataaccaggaaatcgctagtatggagagacagctgaccgataccaaagagaaaattaaccagtttatagaggagattaggcagctggacatggatttggaggagcatcagggggagatgaatcagaagtacaaagagctcaagaagagagaagaacacatggacacttttatagagaccttcgaggagacaaagaatcaagaactgaagaggaaagcccagatcgaggccaatatcgtggccctccttgaacactgctccaggaatattaaccgtatagagcaaatctcgtccattactaatcaggagttaaagatgatgcaggacgacttgaactttaagagcacagaagtccagaagtcccagagcacagctcaaaatctcacaagtgacattcagcgtctgcagctcgacttgcaaaaaatggaactgctcgagtctaaaatgacggaagagcagcactctttgaaatctaagattaagcagatgaccaccgaccttgaaatttacaatgatctgccggcccttaaaagctcaggcgaggaaaagattaagaaactccatcaggagagaatgatcctgtccactcacaggaatgccttcaagaaaatcatggaaaaacagaacattgagtatgaggccctaaaaacacagctgcaagagaatgaaacacattcacagctgaccaatctggaacgaaagtggcagcacctcgaacaaaataacttcgccatgaaagagttcatcgcaactaaatcccaagagagtgattatcaaccgattaagaaaaacgtgaccaagcagatcgcggagtataataaaacaatcgtcgatgcgcttcactcaacaagtggaaattag

SEQ ID NO: 16917 - DNA, 1197 bp, Artificial Sequence
  Description of Artificial Sequence: Synthetic coding sequence
atgttaagaaggaaaccaagcaacgcctccgagaaggaattcaatctggacgacaatattccagaggatgactctggcgtccctactcccgaagacgccggtaagtccggcaagaagttagggaagaagtggagagccgtgatctcccgaacaatgaataggaagatgggaaagatgatggtcaaagcactcagtgaagaaatggccgacacactagaagagggctctgcatctccaacgagcccagattactccctcgactcacccggcccagaaaagatggccctcgcatttagcgaacaggaggaacacgaactgcccgtgctttctagacaggccagcactggaagcgaattgtgttctccttctccagggagtggcagctttggagaggagcccccagctccgcagtataccgggcctttttgtgggagggccagagtccatacagacttcacaccttctccttacgatcatgattccttaaagctccaggtgcgcagtgctagtggactgttgtggagcctcgcaggctgcgctcagaagggttcttggacagagcctggctacgattccgtgagcggcggtcaggggccaccatatcctctcagcctcgcaccattcagctcccccctcccacagcagaagggtgatgttattcagatcattgagaagcctcccgtgggcacctggctcggattgctgaatggaaaggtgggctcatttaaatttatttacgttgatgtccttccagaggaggccgtaggtcacgcgcgccctagccgacgccaatctaaaggaaagaggccaaaacctaagactttgcacgagctcctcgagcgaattggtctggaggagcacactagcaccctcttactcaacgggtaccaaacattggaagatttcaaggagttgagagagacgcatctgaatgaactcaacattatggatcctcagcatcgcgccaagctgctgaccgctgctgagctcctgttggattacgatacagggagtgaggaggcagaagagggggctgaatctagtcaggagcctgtagcccacaccgtatccgagcccaaagtggacatccccagggattccggatgctttgagggttcagaatccggccgtgacgacgctgagctggctggtaccgaagagcagctgcaaggcctgtccctagccggtgccccttag

SEQ ID NO: 16918 - DNA, 1002 bp, Artificial Sequence
  Description of Artificial Sequence: Synthetic coding sequence
atgggcacacggaaaaaggtgcacgcctttgtgcgcgttaaacctaccgatgatttcgcacacgaaatgattcgctacggcgacgacaaaaggtccattgatattcatttgaagaaagatatccgccgcggggtagtcaacaatcagcagactgactggtccttcaaactggacggagttctgcatgacgctagtcaggacttagtttacgaaactgtagccaaggacgtggtcagccaggctcttgacggctacaatggcactattatgtgctacggccagaccggcgccggcaaaacatataccatgatgggggccacagagaactacaagcaccgcggaatattgcctcgggccttgcagcaggtttttcgaatgatcgaagaacgacccacccacgcgattactgtccgagtttcctatttggagatatataatgaatccctgtttgatctgttaagtaccttgccatacgtgggaccctcggttacccccatgacaattgttgaaaacccacagggcgtatttataaaggggttatctgtgcacctgacaagtcaggaagaggatgccttctctctgttatttgaaggcgaaaccaaccgcatcatcgcgagccacaccatgaataaaaattcctcaaggagccattgcatctttaccatttacctggaagcccacagcagaaccttgtcagaagagaagtatataaccagtaaaatcaatctggtggatctcgcaggttccgaacggctgggcaagtcgggatccgaggggcaggttctcaaggaggccacttatattaataagtccctgagttttctggagcaggccatcattgccctgggggatcagaagagagatcatataccatttcgtcagtgtaaattgacacacgctttgaaagactcactggggggcaattgtaacatggtccttgttaccaatatctatggggaagccgctcagttagaggagaccggtagcagactgtggctgtag

SEQ ID NO: 16919 - DNA, 1248 bp, Artificial Sequence
  Description of Artificial Sequence: Synthetic coding sequence
atgatgctgggacctgaaggtggcgaaggtttcgtggtgaagctccgtgggctgccgtggagctgcagcgtagaagatgtacagaacttcctgtctgattgcaccattcacgatggagcagcaggtgtccactttatttacacgcgtgagggccgccagagtggggaggcattcgtcgagctgggcagcgaggatgacgtgaaaatggcactcaaaaaagatcgggagagcatgggccacagatacatagaggtctttaaatctcatcggaccgagatggattgggtgctgaagcactccggaccgaattcagctgattccgcaaacgacggctttgtacgcctgagggggctgcccttcggctgtaccaaagaggaaatcgtgcaattcttctcaggtctggaaatcgtgccgaacggcattactctgccggtggatcccgaaggcaagattacaggcgaggcgtttgtccagttcgcctcacaagagttagctgaaaaggcactgggcaagcacaaggaacgtatcggacacagatatattgaagtcttcaagtcttcccaggaagaggtccggagctatagcgacccccccttgaagtttatgtccgtgcagagacccgggccctacgataggccgggcacagcgcgacgatacatcggcatagtgaagcaggccggtttggaacggatgaggcctggcgcctacagtacaggctatggggggtacgaggaatactcaggcttatcagacggctacggttttacgactgatctgttcggcagagatctgtcatactgcttgtcaggcatgtacgaccatcggtacggagactcagaattcacggttcagtccacgacagggcactgtgtgcatatgcggggactcccatataaggccaccgagaatgacatctacaactttttcagtcccctgaaccctgtgagagtacacattgagatcgggcccgacggcagggtgactggagaggccgatgtggagtttgcaactcacgaagaggctgttgccgcgatgtcgaaggaccgggccaacatgcaacacaggtacattgagcttttcctgaattctacaactggcgcctcgaacggtgcatacagtagccaggtgatgcagggaatgggcgtgtctgccgcgcaggccacttacagcggtctggaaagtcagtcagtgtctggctgttacggcgccggctactctggccaaaacagcatggggggatacgactag

SEQ ID NO: 16920 - DNA, 3108 bp, Artificial Sequence
  Description of Artificial Sequence: Synthetic coding sequence
atgagcgaacaggaaaggatacaggaatgtctccgcaaagaaattagaagtttgctgatctccaccaaggacggattgtctccacaggagctcgagaaggagtatctgctgatggtgggcaaccatttgcccctgcggatcctcggatatagaagcactatggaactagtcctggacatgcccgacgtcgtcagggtatgtcccggcgctggtggaactgtgatcctgaaggctattccggatgagtcaaccaagggaatagccagtctggtggctaagcaacgtagtagccacaaactaaggaactcaatgcacaagggcaggccttccatctatagtggccccaggagtcatcgccgggtgccttatagaggccgagttgcccccatattgcctgcggtggtgaagagcgagctcaaggacctgctggccctgtctcccgtactgctcagcgactttgaaaaagctttcgccaagagatttgggcgaagtttccagtatatgcagtacggcttcttaagcatgttcgaagtgcttaatgccgcatcagatgtgattagcgtggaacaaacaagagccggttccttgctgatgttaaagaaaagcgtgaccgaagaaaagccgcgtggatgtcccgctgggaaaatattcactcaaccgttccgaatgaagcaaggcagctactcaacaggcttcccagtggctaaaccatgctttagccagcccacttccaacatggaaccaccaaagcaaattatgtcgatggaaaaaacctccaagctgaatgtggtggagacttcacggcttaatcatacggagaagctcaaccagctggaaaacactttcaagtcagtgatcgcacagataggaccgggtggtacgatttcctccgaactcaagcataaaatcaagtttgtcgtgtctaagttcccagaagggctcttcatctccaagctgctgggcgagtatgaagtaatctttaaggagcagctttcaccgaagaagcttggcttcctgaacgtcaccgagctcgttggtgcactgtccgacatccttcatgtggaatttaggaaagggcaccaggacctgttggttttcgacgccgacaaaaaaccattgccaccggtgcagagcgacaagaagatcgaggccaaagcctgtgtgagttccccccctagaaacagtctgtccacagccgccgtgaaagagacagtctggaactgccccagcaagaaacagaaagagccacagcagaagatttgcaaaaagcccaatcttgtcgtcaagccccttcagcttcaagtggagactaataagagcgaactcaatctagccatggctaaccatgacattcccccagacgccgttccaaacaaaaagttgtgccgtcttccgcccctggatacgtcgtctctaatcggggtctttgtcgaatatataatctcccccagccaattttacatccgcatctattcgcgggactcaagcgaattgctggaagatatgatgattgagatgcggaggtgttatagcaaccagctggtgtccgatcgctacgtcatgcctgagtgctttatacaacccggccatctgtgctgcgtaagaatcagcgaggacaagtggtggtaccgtgtgatcattcaccgggtattagagaagcaggaagttgaggtgttttatccagacttcggtaacataggcatcgtgcagaaatcatccttacgcttcctgaagtgctgttataccaagctccctgcccaggctattccttgttcactcgcctgggtgcgcccagtggaagagcactggacctctaaggccattttgcagtttcagaaactgtgtgggcttaagcctctggtgggggtggtggatgaatacgttgacggaatcctcaatattttcctatgcgatacctctagcaatgaggatgtgtatttccaccatgtgctccgcacagaaggccacgccatagtctgcagggagaatatctcatccaagggcttctcggagctgaacccgctggccctttatacgacttcatctggcggacccgaggacatcgtgctcactgagcttggctaccccagccagcagcattacttcaatgaggatcggaagatttccccccaatccaaagagagtgagttacggatcctgcaggatattaacgacgaaaagagcttgagccatctgaagtctgaaagcaaggaaccattgaaggactctgaatttgagtcactaaagacttgcaataaaagctttgaggaggatcctaaatggtctaatcccgagcctaacgatctgaaggaggaaaacgaggatgaaatcccaactggcatgccatgtttagaatctgttactataggagacgacatatgggacgaaaactggcttccactgcaagcaaaaatgggaaagggcggcgacgccgcttcgcatttgtttacagccagcctcggggggaagaatcagtactcttcttgcaaagagatgccccaaaaagactggtgcttttccactcccaaggatacatgggacgactcttggcagccctcaggtctggttaacggaactaaagtcgaagtgcacaagccagaggtgttaggagctcaagagaaaaatactggcactaaccggactcagaaacagttggatatcaacggttcttccgattcttctacattgccgaagctggaagaattttgcacttctctgacacaaagcgagcagagcgccgacggatctcagtccgagcccaacaatagccagacgcagccgaaacagattcagctcagtactgccgccccatgctccactactgccgttgatgactctgccgagaagccgagcggttccgtcgagtcaagcccagagatcctgaaaaacgaggacttttcctcatcaagggctataactctgtataaagataagcggcaagagtcagtggaccagttgtcactgatcctgtcttacgaatgccaaatctctcagaagctatacatcccccggagcactgccacagccgctctcggggctgctgctcggctagccacctctcggagcctgctgcattggtatccgtcagtaaaaagaatggaagcttag

SEQ ID NO: 16921 - DNA, 660 bp, Artificial Sequence
  Description of Artificial Sequence: Synthetic coding sequence
atgggaggcgcccagctggagttgccttctggcgctcgcccaggagtttgcgtgaggcggtcttttcgggctcacgcgggggatcagcctcggaggccacccggtccaatccccgtgccggggactatgaaacaggagtcagccgctccaaatacccccccaacatcacaatctcccacaccctcggctcaattcccccgcaacgacggagacccgcaggctctgtggatttttggctacggctccctagtgtggagaccagatttcgcctattccgattccagagtcgggtttgtgagggggtatagccgccgtttctggcaaggcgatacctttcataggggctccgataagatgcctgggcgggtggttaccctcctggaagaccatgaagggtgcacttggggagtggcataccaagttcagggcgaacagaatccggggtacttggggcctgcacctgaggaagcgatagccacccagatcctcgcatgccgcggatttagtggccataacctagaataccttttgagactggccgactttatgcaactctgcgggccccaggcccaggacgaacacctggccgcaatcgtggacgcagtgggaacaatgctaccttgtttttgtcctacagaacaggctctggccttagtgtag

SEQ ID NO: 16922 - DNA, 2382 bp, Artificial Sequence
  Description of Artificial Sequence: Synthetic coding sequence
atgagcgaacagggtgatctcaaccaggccatcgctgaggaagggggaacagagcaggaaactgccacgcctgaaaatgggatcgttaagagtgaatccctggacgaggaggagaagttagagctccagaggaggctcgaagctcagaaccaggaacggagaaaatctaagtccggggctggcaagggaaaactgacccgcagcttggctgtctgtgaggaaagttcagccaggcccggaggcgaaagccttcaggaccaggagtccatccatctgcagttatcatctttctcatcattgcaggaggaggacaagagccggaaggacgattcagaacgcgagaaagagaaggacaaaaacaaggataagaccagcgagaagccaaagatcagaatgctgagcaaggactgtagccaggagtataccgatagtactggtatagacctgcatgagttcctgatcaatactttgaagaataactctagagaccgcatgattctgctgaagatggagcaagagatcatcgactttatcgctgataataataatcattataagaaattccctcagatgtcgtcgtaccaaaggatgctcgtgcaccgcgtcgccgcttattttgggctggatcacaacgtggatcagactgggaagtcagtcatcattaacaaaacctcctctacccggatccctgaacagaggttttgcgaacatctgaaggatgagaaaggcgaggaatcacagaagcgcttcatcctgaaaagggataacagttcaattgataaggaagacaatcaaagcgtatgcagtcaagagagtttgtttgtagagaatcgtggcaatcgagacgggagcggacgaactagtggatctcgccaatcttcaagcgagaacgagttgaagtggtcagatcaccagagagcctggagctctaccgatagcgacagttcaaacagaaatcttaagcccgccatgacgaaaaccgcttctttcggggggataactgtgttgacccggggggatagtacgtccagcactcgctccactgggaaactctcaaaggccggctctgagagtagctcatctgccggttcgagcggctccctgtctaggactcatcccccacttcaatccacacccctcgtgagtggtgtcgctgctggctcccccggctgcgtgccgtatccggaaaatgggatcggcggacaggtcgcaccctccagcaccagctacattctgctgcccctcgaagctgctacggggattccgccgggctccatcctactgaacccccacactgggcagcccttcgtgaaccccgacggaacacctgctatctacaacccccctacctctcagcaacccctgcggtccgccatggttggacagtcccagcagcagcctccccagcagcagccctccccgcagcctcagcagcaggtgcaaccgccccagccccagatggcgggtccccttgttactcagagtgttcagggcctgcaggcctcttcccagagtgtgcaatatcctgcagtgagctttccgccacaacatctgttgcccgtctcaccaactcagcattttccaatgcgggatgacgtcgcaacacaattcggacagatgacgttgtcacgccagtcatccggggagactcctgagcctcctagtgggccagtatatccgagtagtctcatgccacaacctgctcaacagcccagttatgtgatcgctagtacaggccagcagctgccaacggggggattttctggaagcggcccacccatatctcaacaggtactgcagccccctccatcgccccagggcttcgttcagcaaccccccccagctcagatgcccgtttattactatcccagtggtcagtaccccacctctactacccagcagtataggcctatggctcctgtgcaatacaatgcccagaggtcacagcagatgccgcaggcagctcagcaagccggctatcagccggttcttagcggccagcaaggcttccagggtctgatcggtgtacagcaaccccctcaatcccagaacgtcattaataaccagcagggaactcctgttcagtccgtgatggtgtcttatcctacaatgagttcttaccaggtgccgatgacccagggttcccagggcctgccccaacaaagctaccagcagcccattatgctcccgaatcaggccggtcaggggagcttaccagcaactggcatgccagtttactgcaatgttacaccccccacacctcagaataacctgcggctaatcgggcctcactgtccttctagcactgttccagtgatgtccgcctcttgccgcactaattgcgcttctatgtcgaatgctgggtggcaggtcaaattctag

SEQ ID NO: 16923 - DNA, 1842 bp, Artificial Sequence
  Description of Artificial Sequence: Synthetic coding sequence
atggccacaatccccgactggaaattgcagctgttggcccggagacggcaggaggaggctagcgtccgtggcagagagaaggcagaaagggagaggctgtctcaaatgcctgcgtggaagcgcggcctgctggaacggcgaagggcgaagttggggttatcacccggagagcccagccctgttcttggcacggtggaagcaggaccaccagatcccgacgagagtgccgtactcctagaggcaataggtcccgtgcatcagaatagatttataaggcaggaacgccagcaacagcagcagcagcagcaacgttctgaagagctgctggccgagcgcaagcctggacctctcgaggcccgtgagcgtagaccatccccaggagaaatgcgcgaccaatcaccgaagggcagggaatcacgcgaggagcggcttagcccgcgcgaaacacgcgagagacggctgggcattggaggtgcccaggagctttctctccgcccactcgaggcaagggattggaggcagtcacccggggaggtgggtgaccggtcgagtcgcctctctgaggcttggaagtggcgcctttcccctggcgaaacaccagagcggtcactccggttggcagagtcacgtgagcaatccccacgccggaaggaggtggaatcacggctgagtccaggggagtctgcatatcagaagctcggactgaccgaggcccataaatggcgacccgattcccgcgagagtcaggaacagtctctagttcagcttgaggcgacggaatggcgtttgagatctggggaggaacggcaagactattccgaggagtgcggacgaaaggaggagtggccggtgccgggcgtggcaccaaaagagaccgcagagctgtctgagacactcaccagagaggcccaggggaacagcagcgccggcgtggaggccgcagaacagaggcctgtggaggacggagaaagaggcatgaaaccaacggagggatggaagtggaccctcaattccggaaaggcacgcgagtggaccccccgggatattgaggcacagactcagaagcctgagccacctgagtctgccgaaaagctgttggagtcccccggcgtcgaggccggggagggcgaagccgaaaaagaggaagccggggcacaggggcgtcctctaagggcgctgcaaaactgctgctccgtgccaagccccctgccgccagaagacgcagggaccgggggcctgcgacagcaggaagaggaagctgtggagctgcagccacctcccccagccccgctgagccccccccctcctgctcccaccgctccgcagcctcctggcgaccctctcatgtcgagacttttttatggggtgaaagccggcccaggagtaggcgctccacgccggagcgggcacaccttcaccgttaatcctcggcggagcgtacctcccgccaccccagcaacacccacaagtcctgcgaccgtcgacgccgctgtgcccggtgcgggaaaaaaaaggtaccctaccgccgaagagatcctggttcttggggggtatctgcgtctgtcacggtcctgtctggccaaaggctcccctgagagacaccataagcagctgaaaatcagcttctccgagaccgccttagaaaccacttatcagtatccatcggagagctctgtactagaggagctgggtccagagccagaggtgcccagcgctcccaacccgcccgcagctcagcctgatgacgaggaggacgaggaggagctgctcctgctccagcctgaactccagggcggattacggactaaagctctgatcgtggatgaatcatgtagaaggtag

SEQ ID NO: 16924 - DNA, 582 bp, Artificial Sequence
  Description of Artificial Sequence: Synthetic coding sequence
atggcccgcgcaggccctcggttggtgctcagcgaggaagcagtaagggctaagagtggactgggtccacatcgggacctggccgagttgcagagcttgagtatccctggcacttaccaggagaaaatcacccacttaggccactcactgatgagcctgaccggactaaagagtctcgatctgtccagaaatagcctggtgtctctggaaggcatccagtatttgactgctttagaatcattaaacttgtattacaactgcatcagctctcttgccgaggtgttccgcctccatgcactgactgaactcgtggatgttgacttccgtctcaaccccgtggtgaaggtggagcccgactatagactgttcgtcgtgcacctgctgccgaaactgcagcagttggatgatagacccgttcgagccagtgaacgcaaagcaagcagattgcatttcgcctctgaagacagtctggacagtaaggagtccgtgcctgctagcctgaaggaggggaggattcaaacgagcgtggaacccgcggtggggacagtgcccgtttggggcttgtgggaggctggaccatag

SEQ ID NO: 16925 - DNA, 177 bp, Artificial Sequence
  Description of Artificial Sequence: Synthetic coding sequence
atgtattttaactacaaatctgtgtgcggctcgtgcggctttggctcatgctacgggtgtggatatgggtgtattcactccacccactgtggttgcaatgggtattacggctgctacgaaaataaatattctgtgattgacgatctcattttcttcgcctcaaagaagtgccactag

SEQ ID NO: 16926 - DNA, 585 bp, Artificial Sequence
  Description of Artificial Sequence: Synthetic coding sequence
atgaatggacgcgccgactttcgggaacccaacgctgaggtgccccggccaatcccacacattggaccagattacatccctaccgaagaagaaagaagagtttttgccgagtgcaatgatgaatccttttggtttcggagcgtgccgctggcggctaccagcatgctgattacacagggcctcatatccaaaggcatcctgtcatcacacccaaaatacgggtccattcctaagctcatcctggcctgcatcatggggtattttgccggcaagctgtcctatgtaaagacctgtcaggagaagtttaaaaagctagagaactcaccgctgggggaggctctacgcagtggacaggcacgcagatcatcacctcccggccactactaccagaaatcaaagtacgattcaagtgtgtccggacaatcctcctttgtgacctcgcctgcggccgataacatcgaaatgctgcctcactatgagcccattccgttctcctcaagtatgaatgaatcagcccccaccggcatcaccgatcacatcgtgcaggtgaaagttaacaaatacggggatacctgggacgaatag

SEQ ID NO: 16927 - DNA, 2421 bp, Artificial Sequence
  Description of Artificial Sequence: Synthetic coding sequence
atgtcgtcctctcccgttaatgtaaaaaaattaaaagtatcagaactaaaagaagaactgaagaaaagaaggttgtcagataagggtctaaaagcagagttgatggagaggctgcaggccgcgttggatgatgaagaagctgggggcaggcccgccatggagccagggaatggctccctggatttgggcggcgattcggccggtaggagcggcgctgggctggaacaggaggccgcagcaggcggcgacgaagaggaggaggaggaggaggaagaagaagagggtattagcgccttggatggagaccaaatggagttgggggaagaaaatggggctgcaggcgctgcagactctggacctatggaggaggaggaagccgcgtcagaggatgaaaatggcgatgaccaagggttccaagagggagaggatgagctcggcgacgaggaagaaggggcaggcgacgaaaatggccatggggagcagcagccccaaccccccgcaacccagcagcaacaacctcaacagcagagaggtgcggcaaaagaggccgcagggaaaagcagtggtcctaccagcctctttgccgtcactgtcgccccgcccggggcccgccagggccagcagcaagcaggtggcgacggcaaaacagagcaaaaaggcggcgacaagaaacgcggcgttaaacgaccccgggaggaccacggccgagggtatttcgagtacatcgaagaaaataaatatagccgggccaagagtccccagccaccggtggaagaagaggacgagcacttcgacgataccgtggtgtgtctggatacttataactgcgacttacactttaaaatctctagggaccggctgagcgcctcatccctgaccatggagtctttcgcattcttatgggctggcggtcgggcttcctatggtgtgtccaagggaaaggtttgttttgagatgaaagtgacggaaaaaattccagtgcggcatttgtatacaaaggacatcgacatccatgaggttcgtattggctggagtctaacaacttcaggcatgttgttaggagaagaggaattctcttacgggtattcattgaagggtataaagacctgtaattgcgaaaccgaagactacggcgagaaatttgacgagaacgatgtaatcacgtgtttcgctaatttcgagtcggacgaggttgagcttagctacgccaagaatggacaggatttaggagtcgcctttaaaatttcaaaagaagtgctagccgggcgtcccctgttcccccatgttctctgtcataactgtgctgtggaattcaactttggacagaaggagaagccatatttccccatccccgaggagtatactttcattcagaacgtccccctggaggatagggtccgtggcccgaagggtccagaggagaagaaggattgcgaagtggtgatgatgattggcctgccaggtgccggcaaaacaacatgggttacgaagcacgccgcagagaatcccggaaagtacaatatactggggacaaacacaatcatggacaagatgatggtcgctgggttcaagaagcagatggccgacaccgggaagttaaatactctgctgcaacgcgcaccacaatgtctcggaaagtttattgaaattgctgcaagaaaaaagcgtaatttcatactggatcaaaccaacgtatcagctgctgctcagcgccgaaaaatgtgcttgtttgctgggtttcaacgtaaagcagtggtagtgtgcccgaaggatgaggactacaaacaacgaacccagaaaaaagccgaagtcgagggcaaagacttgcccgagcatgccgtcctgaagatgaagggaaactttacactgcccgaagtagcagaatgctttgatgaaattacctatgttgaactccagaaagaggaagctcagaaactactggaacaatacaaagaggagtctaagaaagcgttgcccccagaaaagaagcaaaatacagggtctaaaaagtcaaacaagaataagagcgggaaaaaccagttcaaccgaggaggtgggcatcgtggccgaggcgggtttaatatgcggggaggtaatttcaggggaggcgctcccggaaatagggggggctacaacagacgagggaatatgcctcagcgggggggagggggtggcggctcaggaggaatcgggtacccatacccacgtgctcccgtattccccgggcgcggatcgtattccaatcgggggaactacaatagaggcggaatgccgaataggggtaactacaaccagaactttcgcggaaggggcaataaccggggttataaaaatcaaagccagggctataatcaatggcagcagggccagttttggggccaaaaaccgtggtcacagcattatcaccagggttactattag

SEQ ID NO: 16928 - DNA, 651 bp, Artificial Sequence
  Description of Artificial Sequence: Synthetic coding sequence
atgagcacagtggacttggcacgtgtcggagcctgcatactcaagcacgccgtgacaggggaagcggtggagctgagatcactctggcgcgaacatgcctgtgttgtagctgggttacgaaggtttgggtgcgtggtgtgtaggtggattgcccaagacctttcaagtctggcaggcctgttggatcagcacggggttcgccttgtgggcgtcgggccagaggcgctggggctgcaggagtttttagacggtgactatttcgcgggagagttgtacctggatgagtctaaacaactatacaaagaattggggtttaaaagactttggactcaggccagtcccgaatttggtcaggccacgtggtgcctaaggcgttacaacagcctctccattttacctgccgccctcggaaagccggtgcgggacgtggcggcaaaagcgaaagcagtgggtattcaggggaacctgtccggagacctcctgcagtccgggggcctgcttgtggtttccaagggaggagataaagtcctccttcattttgtacagaagtcacctggagactacgtgccgaaagagcacattctgcaagttctgggtataagtgcagaggtgtgtgcctctgacccgccccagtgtgatagagaagtgtag

SEQ ID NO: 16929 - DNA, 1191 bp, Artificial Sequence
  Description of Artificial Sequence: Synthetic coding sequence
atgttctggaagttcgacctgcatacatcctctcacctagataccctcctagagcgcgaggacctgtctcttcccgagctgctggacgaagaggacgtgttgcaggagtgcaaggtggtaaaccgaaagctgctggattttctgctccagcctccgcatctgcaggccatggttgcctgggtaacccaggagccgcctgattcaggagaagagagattgcgctacaaatacccgtccgttgcttgtgagattttgacgtccgacgtcccacagatcaatgatgctttgggagcagacgagagcttgcttaacagactctacgggttcctgcagtccaccggctccttgaatccactgcttgcctccttcttctcaaaggtcatgggcatcctgatcaaccggaagacagaccagctggttagcttcctacgcaagaaggatgactttgtagacttgctattgcagcacattggcactagcgctataatggacctcctgctacggctcctgacatgtgtggaaagaccacagttgaggcaggatgtggtgaattggttaaatgaggagaagattgtacagcgcctgattgaacagatacatcctagtaaagatgaaaatcagcattccaacgccagccagtcgctatgtgacatcattcgtctgtctcgagagcagatgatacaagtgcaggattcgcccgtgcctacagacgccccgacgtcaccacgtgtctcgggagaggaggagctccatacaggacctcctgccccccagggacccttgagcgtgcctcagggacttcccactcaatctctggcatctccaccggcccgtgatgcactgcagttaagaagtcaggatccgacaccgcccagtgcaccccaggaggccactgaggggtctaaggtgaccgagccctctgccccctgccaggcccttgtgtccattggtgatcttcaggccaccttccatggcatcagatcagcgccttcgtcaagtgacagcgcgactcgcgatccgagtacttcagtgccggcttccggcgcccatcaaccaccacagacgactgaaggggaaaagagtccagaacccctggggcttccacagagccaaagcgcgcaagcacttacccctcctccaattcccaacggctcagcccccgaaggccctgcttcacctggtagtcaatag

SEQ ID NO: 16930 - DNA, 2178 bp, Artificial Sequence
  Description of Artificial Sequence: Synthetic coding sequence
atgggcactcggaaaaaggtgcacgcattcgtgagagtcaaacctaccgacgattttgctcatgagatgattaggtacggtgacgacaagagatcaatcgatatacatctgaagaaagacataaggcggggagtcgtaaataatcaacagaccgattggagctttaagcttgacggggtgcttcatgacgcgtcccaagacttggtttacgaaaccgtcgccaaggacgtcgtgtcacaggcactggatggttacaacggaaccatcatgtgttatggacagacaggggccggaaagacctatacaatgatgggagcaactgaaaattacaaacatcgaggaattctgcctcgcgcgctacagcaggtcttcagaatgatagaagagcgtcctacccacgcgatcaccgtcagagtgtcctacttggaaatctataacgagtctctctttgacctgctgtccacgttgccatacgtggggcccagcgtgacccccatgacaatcgttgagaatccccagggtgtgttcatcaaagggctgagcgtgcacctcacttcccaggaagaagatgcgtttagtcttcttttcgaaggagagaccaaccggataatcgctagccataccatgaataaaaacagctcccgctcccattgtatttttacaatctacttggaggcacactccaggactctaagtgaggagaagtatattacctcaaagatcaacctcgtagacctggccgggagtgaacggttgggcaaaagcggatcagaggggcaagtgctgaaggaagcaacttatatcaataaatctctgtcttttctagaacaagctattatcgccctgggggatcagaagagggatcatattccttttcgtcagtgtaaactgacccacgccctgaaagactcgcttggggggaattgtaatatggtgctcgtgacgaatatttatggagaggcagcccagctggaggagacgttgtcgagcctgcggttcgcaagcagaatgaaactggtgacgacagaacccgcaattaacgagaagtacgatgcagagaggatggtcaaaaatctggagaaagagctggcactgttaaagcaagaattggctattcatgatagtctgacaaaccgaacctttgtgacttatgatcctatggatgagattcaaatcgctgagatcaattcacaggtgagaagatacttggagggcactctcgatgagattgatatcatttcattgcggcagatcaaagaggtcttcaaccaattccgagtcgtcctgtcccagcaggaacaggaagtggagtccactttaaggcggaaatatacacttatagaccgtaacgatttcgcagccatcagcgcgatccaaaaggccgggctggtggatgtggacgggcacttagtgggcgagccagaaggccagaactttggactgggcgtggcgccattttccaccaagccaggcaagaaggcgaaaagcaaaaagacgtttaaggagccactgaggccagacacccctcctagcaagcccgtggcctttgaggaattcaaaaacgagcaggggtctgaaattaatagaatctttaaagagaataagagcatactgaacgaaagaaggaaacgggcctccgaaaccactcaacacattaacgctattaaaagagaaattgacgtgacaaaggaggccctcaacttccagaagtctctgcgggagaaacaaggtaagtacgagaataagggcctcatgattatcgacgaagaagagtttttactaattctgaagctcaaagacctgaaaaagcagtacaggagcgaatatcaggatctccgggacttgcgggcagagattcaatactgtcaacatctcgtagaccaatgtcgacatagactactcatggagttcgacatctggtacaacgagtcttttgttattcccgaagatatgcagatggccctgaaaccaggcggatccatccgaccaggcatggtcccagtcaacagaatcgtgtcacttggtgaggacgaccaagataagtttagccaactccagcagcgggtgcttcctgaggggcctgacagtatcagcttctacaatgcgaaagttaaaatcgagcaaaagcataattatttgaagaccatgatgggactccagcaagcccaccgaaagtag

SEQ ID NO: 16931 - DNA, 282 bp, Artificial Sequence
  Description of Artificial Sequence: Synthetic coding sequence
atggctgccgccaccggtgaccccggactgagcaagctccaattcgcgccattcagtagtgcactcgacgtgggattctggcacgaactgacgcagaagaagctgaacgagtacagactggatgaagcccccaaggacatcaaaggctattattataatggggattccgccggattaccagctcgcctcactctggagttctctgcattcgatatgagtgcacctactcctgcgcgctgctgccctgccattggaaccctatacaatacgaacactctgtag

SEQ ID NO: 16932 - DNA, 333 bp, Artificial Sequence
  Description of Artificial Sequence: Synthetic coding sequence
atgggtaaaaaacagaacaaaaagaaggtcgaagaagtgctcgaagaggaagaagaggagtacgtggtcgaaaaggtgttagatcgccgcgtggtcaagggcaaggtggagtatctgctcaagtggaaaggtttcagcgacgaggacaatacttgggaaccagaagagaatttggactgtcctgacctgatcgctgaattcttgcaatctcagaagactgcccacgagaccgataagagcgaaggtgggaaacggaaagccgatagcgactccgaagataagggcgaggagagcaagcccaagaaaaaaaaggaggagtccgagaagccatag

SEQ ID NO: 16933 - DNA, 270 bp, Artificial Sequence
  Description of Artificial Sequence: Synthetic coding sequence
atgtcctactatcaacggcctttttctcccagtgcgtactcattgccagccagccttaactcctctattgttatgcagcacggaacctctctggactcaacagacacctacccccaacacgctcagtcactggacgggactactagctcttcaattccactgtacaggtcttctgaggaggaaaagagagtgacagtcatcaaggccccgcattacccggggattggccctgtcgacgaaagcggtattcctactgctattagaacctag

SEQ ID NO: 16934 - DNA, 1269 bp, Artificial Sequence
  Description of Artificial Sequence: Synthetic coding sequence
atggagagaaaggactttgagacctggcttgataacatctccgttacttttctcagtttgaccgacttgcaaaagaacgagactcttgaccacctgatctccttgtcgggtgccgtgcagttaaggcacctatcaaataacctggagacactcttgaagagggatttcctcaaacttctaccattggagttgtctttttatttgctgaagtggttagacccacagacccttctgacttgctgccttgtgagtaagcaatggaataaagtgatcagcgcttgcactgaagtgtggcagactgcctgtaagaacctgggttggcagatagacgacagtgtacaggacgcattgcactggaagaaggtatacctcaaggccattttgaggatgaagcagttggaggaccatgaggccttcgaaacatccagtttgattgggcacagcgcaagagtgtacgctctgtactacaaagacggactgctttgtacaggatctgatgacctgagtgcaaagctgtgggatgtttcgacaggacagtgtgtttatggcatccagactcatacatgcgctgccgtgaagtttgatgagcagaagctagtgactggcagctttgataacactgtcgcatgttgggagtggtcatctggggccaggacacagcactttcgggggcacacaggagccgttttctcggtggattataatgatgagctagatattctggtaagcggcagcgcagacttcactgtcaaggtgtgggcgctgagtgcagggacgtgcttaaatacgctcaccggacatactgagtgggtgacaaaagtggtgttacagaagtgcaaagtcaagtccttgcttcattcgcctggcgactacattctgctctctgccgataaatatgagattaagatctggcccataggacgggagataaactgcaaatgtcttaagacactaagtgtgtctgaagataggtctatctgtctgcaacctaggcttcatttcgacgggaaatacattgtgtgctcttcagctttgggtctgtaccagtgggacttcgcatcttacgacatcctgcgtgtgataaaaacccctgaaatagctaatctggccctccttggattcggggatatctttgccttgttattcgacaaccggtacctgtatatcatggacttacgcaccgagagtttaatctccagatggccacttcccgagtaccggaaaagcaagcgagggagtagcttcctggccggggaacaccccgggtag

SEQ ID NO: 16935 - DNA, 1179 bp, Artificial Sequence
  Description of Artificial Sequence: Synthetic coding sequence
atgtctgccctggcgggcgaggacgtgtggaggtgcccgggctgtggggaccatatcgcacctagccagatctggtaccggacggtgaacgagacatggcacggatcctgtttcaggaggagcaactcaattagtaagagccccggcccttcctcgccaaaggagcctcttctgttttctagagacattagtcgatccgaatccctaaggtgttccagtagctactcccagcaaatctttagaccatgcgacctcatccatggagaggtgttgggtaaggggttcttcgggcaggctatcaaggtaacacacaaagcaaccggaaaagtgatggtgatgaaagaacttatccgatgtgacgaagagacgcagaagactttcctgacggaggtgaaagtcatgagaagcctcgaccaccccaacgtgctcaagttcatcggtgtcctgtacaaggacaagaagctcaacctacttacagaatatattgagggaggtacgttgaaagactttctaagatccatggatccctttccatggcagcagaaagtgcggtttgccaagggcatcgcctctggaatggcttacctgcattccatgtgtatcattcaccgggacttaaattcccacaactgtctaataaagctggacaagaccgtggtggtagcagattttggtctttctagactcattgtggaggagcgcaagcgtgcccccatggaaaaggctacgaccaagaaacggactctgcggaagaatgatcgcaaaaagcgctacacagtcgttggaaacccgtattggatggcacccgagatgctcaatggcaagtcctatgacgaaaccgtcgatatattttcctttgggattgttctgtgtgagatcattggccaagtgtatgccgaccccgattgtttgcctaggacactggactttgggctcaacgttaagttgttttgggaaaaatttgtcccgacggattgcccccccgccttctttccccttgccgctatatgctgccgcctggagccagaatctcggcccgccttttccaagctcgaggattcatttgaggcgttgagcctctacctcggagaacttggcatcccgctgccagccgagctggaagaactggatcatactgtcagtatgcagtatggccttacacgggacagccccccctag

SEQ ID NO: 16936 - DNA, 480 bp, Artificial Sequence
  Description of Artificial Sequence: Synthetic coding sequence
atggctacgagtgcccctctgcggagcttggaagaagaggtcacatgctcaatctgtctcgactatctgcgagaccctgtgaccattgactgtggccacgttttctgcaggagctgtacaactgacgtgaggcctatttcagggtccaggcccgtgtgtcccctgtgtaaaaaaccatttaagaaggaaaatataagacccgtgtggcagctggaaaaaatcctgaaccatctctctacactgagaagggaccgggacaagattcagggctttcaggctaaaggtgaggccgatattctcgcggctcttaaaaagttgcaggatcagaggcagtacatagtggctgaatttgaacaagggcatcagttcctgcgagagagggaagagcacctgctcgagcagctggcaaaattagaacaggagcttactgaggggcgcgaaaaatttaaatctcgcggcgtcggggagttagctcgctag

SEQ ID NO: 16937 - DNA, 3585 bp, Artificial Sequence
  Description of Artificial Sequence: Synthetic coding sequence
atgttcagcctggatagctttagaaaagatagggcacagcatcgccaacgccagtgcaaattgcctccccctcgcctaccacctatgtgcgttaaccccactcccggtggaaccatcagtcgcgcatccagagacctcttaaaggaattcccacagccgaagaatctcctgaattccgtaataggaagggctctaggcatcagtcacgcaaaagacaaactggtgtacgttcatactaacggacccaagaaaaaaaaggtaacactgcatattaagtggcccaaatctgtggaggttgaaggatacggctcaaagaaaatcgatgcagagcgccaggcagccgctgctgcttgtcagctttttaaggggtggggcttgctgggtccccgaaacgagctttttgatgccgctaagtatagggtgctcgcagataggtttgggagtccggcggacagttggtggagaccagaacccactatgccacccacaagttggcggcaattaaacccagagtcaattcggcccggcggacccggtggactgagtcgtagcttggggagagaagaagaggaggacgaggaagaggaattagaggagggcaccatagatgtgaccgattttttaagcatgacacagcaggacagtcacgcacccctgcgggactcccgggggagctcattcgaaatgacagacgatgattcagccatccgcgcactcacacagtttcccctgcccaaaaatctcctggccaaggtgatacaaatcgccacatctagcagcacagctaagaacctaatgcagtttcacaccgtgggaactaaaaccaaattgtctaccttgacacttctctggccatgtcccatgaccttcgtggcaaaaggtcgcaggaaggcagaggccgagaataaagctgctgccctggcttgtaagaagttaaagagtctagggcttgtcgacaggaacaatgaacctctcacacatgcgatgtacaatttagcctccctaagagagctgggtgagacccaacggagaccttgtacaattcaagttcctgaacctatcctgaggaagattgaaaccttccttaaccattacccagtcgaatccagttggatcgcacctgagctgcggttacagagtgacgacatcctgcccctgggaaaggacagcggccccctgtctgatcccatcactggcaagccttacgtacctctgctcgaagccgaagaggtgagactatctcagtcgctgctggaactatggaggcgccgggggcccgtgtggcaagaagctccacagctgccagtagatcctcaccgcgataccatcctcaacgccattgaacagcaccctgtggtcgtgatttctggagataccgggtgtgggaagactacacgcatccctcaactgctgttggaacgctatgttacggaggggcggggggcccggtgtaatgtaattatcacacagcctcgccgcatctcagcggttagtgtggcccagagagtgagccacgaactaggtccatcactgcgcagaaatgtcggcttccaggtgcgcctcgaatctaaaccgccatccagaggaggcgctctgctgttctgcactgtgggaattctgctccgcaaattacaatctaacccttcactcgagggggtttctcatgtgatagttgacgaagtccatgaacgggatgtaaatacagacttcttgctcatcctcctgaaaggcctgcaacggcttaaccctgcacttcgtctggtgctgatgtcagccacaggtgataatgaacggttttcccgctacttcgggggctgtcccgtgatcaaagttcccggattcatgtacccagtgaaggaacactacctagaggacatattggccaaactcggcaagcaccaatacctgcatcgccatcgccaccacgagtctgaagacgaatgcgcgctcgatcttgacttagtaactgacctggttttgcatatcgatgcgcggggagagccaggcggtatcctgtgctttctgcccggttggcaggaaattaaaggcgtacaacagagactgcaggaggctctgggaatgcatgaatcaaaatatttgatcctccccgtacacagtaacatcccaatgatggatcagaaggctatatttcaacaaccacctgtcggggtccggaagattgtgttggcaaccaatattgcagaaacttccattacaatcaacgatatcgtgcacgtggtggatagcggcctccataaggaagagcgctatgacctaaaaaccaaggtgagctgcctggaaacagtctgggtatcaagggccaatgtcatacagcgccggggtagagcaggccgttgtcaaagcggttttgcataccaccttttccctcgcagcaggctggagaaaatggtgcccttccaggtcccggagatactccgcacgcccctggaaaacctcgtgctgcaggccaagatacacatgccagaaaagaccgccgtggagttcctatctaaggcagtggacagccctaacatcaaagctgtcgacgaggctgtgattctgctccaagagattggtgtgttggatcagcgtgagtacctgacaacgctcggacagaggttggcccatatctctaccgatccacgccttgctaaggctattgtcctggccgccatcttccggtgtctccaccccctgctggtagtagttagttgtctgaccagggatccattttctagcagcctgcagaacagagccgaggtggacaaggtgaaggccctcctctctcacgactcgggctcagaccatctcgccttcgtgcgggccgtagcagggtgggaagaagtcctaagatggcaggatagatcatctagagaaaactacttggaagaaaatctgctctatgcgccgagcctcagatttattcacggactgatcaagcagtttagcgagaacatctatgaagcttttctggttggcaaaccctccgattgtaccttggcctctgctcagtgtaacgagtacagtgaagaggaggaacttgtgaagggtgttctgatggcggggctgtacccgaacttgatacaggttaggcagggaaaagtaacccgtcagggtaagttcaagcctaactcagttacctataggactaaatctggcaacatcctcttacacaagtctacgataaatagggaggccacacgactgagaagtcgttggctgacctacttcatggccgtcaaatctaacggatcagttttcgtaagggatagctcgcaagttcacccactggcagttctcttgcttaccgacggcgacgtccacatccgggacgatggacggagggcgaccatatccctctcagattcagacctgctccgcctggaaggagactcccggactgttagactgctcaaagagttgcgacgtgctctcgggcgaatggtagaaaggtccctgcggtctgaattagcagcactgcccccctctgtccaagaggagcatggacagctgttagcactcctcgccgaactgctgcgtggcccttgcgggagtttcgacgtccggaaaacagctgatgactag

SEQ ID NO: 16938 - DNA, 207 bp, Artificial Sequence
  Description of Artificial Sequence: Synthetic coding sequence
atgagttactatcaaaggcccttcagcccaagcgcctactccctcccagcttcgctgaatagttccatcgttatgcagcatggcacatctctggacagcactgacacgtacccgcagcatgctcagtcactagatggcaccacctccagctcgatccctctgtaccgatctagcgaggaagagaagcgcgtaaccgtgattaaatag

SEQ ID NO: 16939 - DNA, 1419 bp, Artificial Sequence
  Description of Artificial Sequence: Synthetic coding sequence
atgtcccgaagggtggtgagacagagcaaatttcgtcacgtgttcggccaagctgccaaagccgaccaggcttacgaggatatccgcgtctccaaagtgacttgggattcatctttctgcgctgtgaaccccaaattcctagctattattgtggaggcaggcgggggaggggcctttatagttttaccattggctaaaacaggtagggtcgataaaaactaccctctggtcaccggtcatactgcgccagttctggacatcgattggtgccctcataatgacaacgtcatcgcgtctgcaagcgacgacacgacaatcatggtttggcagatcccagattacacacccatgaggaatattactgaaccaattataacgttggagggacattcaaaaagagtgggcatattatcatggcatcccacagcacgcaatgtgttacttagcgccgggggggacaacgtaatcatcatctggaacgtcgggactggcgaggttctgctctccttggacgacatgcacccagacgtcattcattctgtgtgttggaactcgaatggatccttactggcaacaacctgtaaagacaaaactctgaggatcatcgacccaaggaagggacaggtggtggccgagcaggcacggccccatgagggggcgaggcctctccgcgctgtgtttacagcggatggtaagttactgtccaccggattttcccggatgagcgagcgccagcttgcactatgggaccctaacaatttcgaggagccagtcgccctgcaggaaatggacaccagtaatggcgtgctcttaccattttatgaccctgacagctcaatcgtgtatttatgcggtaaaggcgacagcagtatccggtatttcgagataacggacgaaccacccttcgtccactacctgaatacgttctccagtaaggaaccccagcggggaatggggttcatgcccaagaggggcctggacgtcagcaagtgtgagattgcgaggttttacaaactgcatgaacggaagtgtgagcctattattatgaccgtgcccagaaagagcgaccttttccaggatgatttataccctgacacacccgggcccgaacccgctttagaggcagacgagtggctctcaggccaggatgcggagcccgtgcttatatccctccgggacgggtatgtgcctcctaagcacagagagttgagggttactaagcgaaacattctggatgtgcgcccaccatcaggacctcgtcgaagccaatcagcttcagacgctcccctgtcacagcagcacactttagaaacgctcctagaggagattaaggccctgcgggagagggtacaggcccaggaacagagaatcaccgcactcgagaatatgctctgtgagctcgtagacggtaccgactag

SEQ ID NO: 16940 - DNA, 390 bp, Artificial Sequence
  Description of Artificial Sequence: Synthetic coding sequence
atactgcactctctcgtgcagaccgggatctgtgtgattacattagcggagtcccatcctgtcctgcaaagcggaaaaactatcaagagcatctcctaccaaatatccaccaactgttcccggttacagaacaaggtgtccggcaaattcaagaggggtgcccagtttttgactgaactcgccccactatgtaagatttattgttctgacggggaggagtatactgtgtccagctgtgtgagggggagactaatggaagtcaatgagaacatactgcataagccgtccatactccaggagaagcctagtacagagggttacatcgcagtcgtcctccccaagtttgaagagtctaagagcatcaccgaaggattacttacgcaaaagtag

SEQ ID NO: 16941 - DNA, 735 bp, Artificial Sequence
  Description of Artificial Sequence: Synthetic coding sequence
atggtgcaccaggataattgttcttatcaggcccaaaagaatgagcgggagtcaattcggcagaaactagccctgggctcattctttgatgatggacctggcatctatacctcgtgtagcaagtctggaaaaccttcgctctcgagccggctgcaatcaggtatgaacttgcagatctgcttcgtcaacgacagtggctccgacaaagattccgatgccgatgactccaagacagaaaccagcctggatacaccattgtctccaatgagcaaacaatccagctcttattctgacagggacacgacagaagaagagtctgagtctttggatgatatggattttttaactcggcagaagaagttgcaggccgaagcaaaaatggctcttgcaatggccaagcccatggccaagatgcaggtcgaggttgagaagcaaaatcgtaaaaaatcgccagtggccgatctcctgccccatatgccccacatatcagaatgcctcatgaagagatcattgaaaccaaccgacttacgagatatgaccattggtcagctgcaagtgatagtgaatgatctgcattctcaaattgagagcctcaatgaggagcttgttcagttgcttttaatcagagatgagcttcacacagagcaagacgctatgctagtcgacatagaggatctgacaagacacgccgagtctcaacagaaacatatggctgaaaaaatgcctgctaagtag

SEQ ID NO: 16942 - DNA, 1620 bp, Artificial Sequence
  Description of Artificial Sequence: Synthetic coding sequence
atggctacatctgccccgctccgtagtcttgaggaggaggtcacatgctccatatgcctagactatctgagagatccagtgacaatagattgcggacacgtcttctgcaggtcatgcacaactgatgtccggcccatctcagggagccggcccgtctgtcctttgtgtaaaaagccctttaaaaaagaaaacatcagaccagtttggcagctggcatctctggttgagaatatcgagcggctgaaggtagacaaagggaggcagcccggagaagtgacccgtgaacagcaggacgcaaagctgtgcgagcgacatcgcgaaaaactgcactattattgtgaagatgatggaaagctcctctgcgtcatgtgcagagaatcgagggagcacaggccccataccgctgttctgatggagaaagctgcccagccacacagggaaaagatactgaaccacctgtcaactctccggagggatcgagataagatacagggctttcaggcaaagggggaagccgacatcctggcagctctgaaaaagcttcaagaccaacgacagtacatagtggcagagttcgagcagggacatcaattcctccgggagagggaagaacatctgctggagcagctcgccaagctggagcaggagctgactgagggcagggaaaagttcaagtctcgaggggttggagagctggctcgtctggctctggtgatctccgagttagaaggcaaggctcagcagcctgccgctgagctcatgcaggatacaagggatttcttgaacaggtacccgcgaaagaagttctgggtgggaaagcctattgcaagagtggtgaagaaaaaaactggagaattcagtgataagctgctgtcactgcagcgcggattgcgggagtttcagggcaaactgctgagagatttggagtacaagaccgttagtgtaacccttgacccccagtcagcctctggttatttgcagctgtcagaagactggaaatgtgtgacttatacctctctatacaaaagcgcttatttgcacccacaacagttcgattgcgagcccggtgttctgggttccaaaggctttacctggggaaaagtttactgggaagtggaagtcgaacgtgaaggatggagcgaggatgaagaggaaggagacgaggaggaagagggtgaggaggaagaagaggaagaggaagccggttacggcgatggatacgatgactgggagactgatgaagatgaggagagccttggcgatgaggaagaggaagaggaggaagaagaagaggaagtgctggagagctgcatggtaggagtggcacgcgattctgtaaagcgcaagggggacctaagtcttcgcccagaggacggcgtctgggccttgcgactgtcatcttcaggtatttgggcaaacacctctccggaagctgagctatttcccgctttgaggcctcggagagtcgggattgcactggactatgaaggggggacagtgaccttcaccaacgccgagtctcaggaattgatctacacttttacagcaacttttacaagacgcctggtgccatttctatggctgaaatggcccggcacaagacttctgctcagaccttag

SEQ ID NO: 16943 - DNA, 441 bp, Artificial Sequence
  Description of Artificial Sequence: Synthetic coding sequence
atgtttgaaatcctgaccagcgagtttagttaccagcatagcctctctattttggtagaggaattcttgcagtccaaggaactaagagcgaccgtgacacagatggaacaccaccatctgtttagtaacatcctcgatgttttgggtgcttcacagcggttctttgaggacctcgagcagcgacataaggcccaggtgcttgttgaagatataagcgatatcctagaagagcacgccgaaaagcatttccacccgtacatcgcatactgttcgaacgaggtgtatcagcagcggacgctacagaaactcatctccagtaatgctgccttccgtgaggccctcagagaaattgaacgcagaccagcctgcggcggcctgcctatgctgtcgtttctgatcttgcctatgcagcgggtcacccgattacctctgctgatgtag

SEQ ID NO: 16944 - DNA, 483 bp, Artificial Sequence
  Description of Artificial Sequence: Synthetic coding sequence
atggaagccgaaagaccccaggaggaagaggacggcgagcaggggcccccacaggacgaagaaggttggccaccacctaactccaccacccgcccctggagatcggcacccccctcaccccctcccccaggtactcgtcataccgctctaggtcccaggtcggcctcactgctgagtctccagacggagctcctgctggacctggtagcagaagctcagagccggcgactcgaggaacagcgggcgactttctacacaccgcagaatccttccagtttggcccccgcccccctgagaccactggaggatcgggaacaattgtatagcacaatcctctcacaccaatgccaacggatggaagctcagagatccgaacctccactcccgccaggagggcaggagctcctggagctgctgttgcgcgtgcaggggggcggccgaatggaggagcaaaggtcgcgccccccgacccacacttgttag

SEQ ID NO: 16945 - DNA, 303 bp, Artificial Sequence
  Description of Artificial Sequence: Synthetic coding sequence
atgtcctactaccagcgtccttttagtccttccgcctatagcctccccgcctcactgaatagctcgatcgtcatgcagcatggtactagtctggactccaccgatacctacccgcagcacgcccagtctctcgacggcactacatcttcttccattccactgtatcgaagcagtgaggaggagaagagagtaaccgtgattaaggcaccccattaccctggaatcggacccgtagatgagagtgggataccaactgccatccgtacaactgtggaccgccctaaggactggtacaaaacctag

SEQ ID NO: 16946 - DNA, 369 bp, Artificial Sequence
  Description of Artificial Sequence: Synthetic coding sequence
atggcaacgtccgcacccctacggtcactagaggaagaggttacatgctcgatctgtcttgattatctgagggaccctgtcacgatcgactgtggccacgtgttttgtcggagttgcactaccgatgtccggccaatctccggaagtaggccagtatgtccgctgtgcaagaagccattcaaaaaagagaacattcgccctgtttggcagcttgcttcactggtggaaaatatagagcgattgaaagttgacaagggccgacagccgggcgaagttaccagagaacagcaggacgcgaaattatgtgagaggcatcgggagaaactgcactactactgcgaagatgatggcaagttactgtgtgtgtag

SEQ ID NO: 16947 - DNA, 633 bp, Artificial Sequence
  Description of Artificial Sequence: Synthetic coding sequence
atggtatcaatgtctgtcccagattgcctgtcaattatgacatatgtcagccagtattataaccacttttgttccccagggcaagctggcgtcagtccacccaggaagggacttgctccttgctcacctccgagtgttgcccccacgcccgtggagcctgaggacgtggcgcagggcgaggagctaagcagtggcagcctgagcgagcagggcactggacaaaccccttctagtacatgtgctgcttgccagcagcacgtgcaccttgtgcaaaggtatctggcagacggcaggctataccaccggcattgcttccgatgccgccggtgcagctcaaccctgttgccaggcgcgtacgagaatggacccgaagagggaacgttcgtgtgtgcggagcactgcgccagacttggacctggtacgaggagtggtaccagacctggtcccttcagtcagcctaaacaacaacaccagcaacagttagccgaggatgctaaagatgtccccggtggagggccatcatcaagtgcccccgcaggagccgaggcagatggcccaaaagcatctcccgaggcccgcccacaaatacccaccaagccccgtgttcctggcaagcttcaggagctggcttag

SEQ ID NO: 16948 - DNA, 390 bp, Artificial Sequence
  Description of Artificial Sequence: Synthetic coding sequence
atggccgagctcatacaaaagaaattacagggcgaggtggagaaataccaacagctgcaaaaagatcttagcaagtcaatgagtggaaggcagaagcttgaggcacagctgaccgagaacaatatcgtcaaggaggagttggcccttttggatggcagcaacgtcgtgttcaagctgctgggccctgtgttggtgaaacaggaactaggggaagcccgagccaccgtagggaagcgattagattacattaccgcagagataaaaaggtatgaaagccagctgcgagacctcgagcgccagtcagagcagcagagagaaactctggcacagttacagcaagagttccagagagctcaggctgcgaaagccggtgccccaggaaaagcatag

SEQ ID NO: 16949 - DNA, 621 bp, Artificial Sequence
  Description of Artificial Sequence: Synthetic coding sequence
atggccttaaatgtggcccccgtccgcgatactaaatggctaaccttagaagtttgtagacagttccagcggggtacatgctcaagatcagatgaagagtgtaagttcgctcaccctcccaagtcctgtcaggttgaaaatgggagggtgatcgcgtgttttgattcgctgaaggggaggtgctcccgggagaattgtaagtacctgcatcctccaactcacctgaagacccagctagagataaacggacgaaacaatttgatccagcagaaaacagctgccgctatgctcgctcagcagatgcaattcatgtttccaggaacccctctacatccggtggctttccctcccggcgctctccaccccttacctaagcggcaagcactggagaagtccaacgggacttcagctgtgttcaaccctagcgttcttcactaccagcaggccctcacctctgcacagttgcagcagcacgccgctttcattccaactgataacagcgagatcatctctcgcaatggcatggagtgccaggaaagtgctttgcgaattaccaagcattgctactgcacttattacccagtctcaagttctattgaactgcctcagaccgcctgttag

SEQ ID NO: 16950 - DNA, 978 bp, Artificial Sequence
  Description of Artificial Sequence: Synthetic coding sequence
atgcagcagcccgtacgcgccggcgacattggagtgtccagagtacagacgcaccacaatgcttctccttttagtgtgcccaaaaaacaggacgaatctccaatgatcggagacggtgaagactactttctgtctctatttggcgatagtaagaagctcaccgcccactctaactacacgcagaaaaccctgaagtatttctccatgatactggaggaggtgggacagtttacatcatctagcctgggcgatgtggagattgcagaggtcaatgttaaagggctattcgtgaagctgattaattcatccctggataaggaaatggccattggagaccacatcttgcagcaaaatgtgaacggacaaaccatatctctttaccgctttcttcctaatattgtaatgcaggctaatagcaccgtgactgtctgggcggctgcaagcgaggctaagcaccaacccccctccgatttcttgtggaaggagcaagataagttcagggccagtcccgactgtattactatcctctgtaagcccaacgggcaggccatcgcctggtatactcccatccattggaagcaagcgtgggaaaagctggatgccgatgtggagtttaaccgatgttctgtggtatcgcctaccttccgaaaacgcgtatttcagtggacagcctctaccgctacaattaccaaggaaaaacaggaccagcccaaaaaagatatctcaaactaccaggtggagcaggcccaggtcctactgaaaagggaaaaagagattccacctacagtcttccccaatcgatctccatggtgccagaacccatacgtgtcagcccatccatactgtcccctcatcgaaccacataataccagtaccgcaggcggacggctggatcgtcagcccaggacccgcagcactcggccgaacagagcgtccggcagcaagaagaagaagaccagcgagagtcagaaacagtag

SEQ ID NO: 16951 - DNA, 1257 bp, Artificial Sequence
  Description of Artificial Sequence: Synthetic coding sequence
atgcgtgagatcgtgcatatccaagccggtcagtgtgggaaccagattggcaccaagttttgggaggtgattagcgacgaacatggtatcgatccagccggagggtacgtgggtgacagcgcattgcaattggagcggatcaacgtatattacaatgagtctagctcccagaaatatgtcccccgcgccgccctggtggacctggagcccggaacgatggattcagtgagatctgggccattcggacagctgttccgtcccgataacttcatcttcggtcagaccggggcagggaataactgtctacaaggcttccagctgactcattcactagggggcggtactggctctggtatgggtacacttctgatttccaaaattagagaggaattcccagatagaatcatgaacacttttagtgttatgcccagccctaaggtgtctgacacggtggtagaaccttataatgccaccctgtcagtgcaccagctggtggagaacactgatgagacctactgcatcgacaacgaagctctctatgacatttgctttcgcaccctgaagctcacaacacctacctatggcgatctcaaccatctggtgtccgcgactatgtctggagtgacgacctcgctgcgatttcccggtcagctcaatgctgacttgaggaaattggccgtgaacatggtcccattcccccggttacacttcttcatgccaggatttgcccccctgactagccgcggatcacagcagtaccgagctctcacggtgcctgaactcacccagcaaatgtttgacgccaggaatatgatggccgcctgcgacccccgacacggccggtacctgaccgtcgccactgtgttccgggggcctatgtccatgaaagaagtggatgaacagatgctcgctatccagtcaaagaactccagctatttcgtggaatggattccaaacaatgttaaagtcgccgtctgcgacattccaccgaggggactcaagatggcttcaacattcatcggcaatagcacagccatacaggagctcttcaagcgaattagcgagcaattctccgccatgttccggcggaaggcttttctgcattggttcaccggggagggcatggatgaaatggaatttacagaagccgaatccaacatgaatgacttagtgtccgaataccagcagtatcaggatgcaacggccaacgatggggaggaagcattcgaggacgaagaagaagagattgatggctag

SEQ ID NO: 16952 - DNA, 270 bp, Artificial Sequence
  Description of Artificial Sequence: Synthetic coding sequence
atggacgtgctatctccactctcatttatcaaggtgtctcacgtccggatgcagggtatcttactactggtgtttgcgaagtatcagcatctgccttacatccagatcttgagtacaaaaagcactcccaccgggctattcggctactggggtaacaaggggggggtgaacatctgtctcaagctatatggttattacgtgagcatcatcaactgccacctgccccctcatatttcgaacaattatcaacgcctcgaacatttcgactag

SEQ ID NO: 16953 - DNA, 180 bp, Artificial Sequence
  Description of Artificial Sequence: Synthetic coding sequence
atgactagagggaatcagagagagcttgcaaggcagaagaacatgaagaaacagtccgactccgtcaagggcaaacggcgcgacgatggactctctgctgcggctagaaagcaacgtgattccgagattatgcaacagaagcaaaagaaagcgaacgagaagaaagaggagcctaaatag

SEQ ID NO: 16954 - DNA, 864 bp, Artificial Sequence
  Description of Artificial Sequence: Synthetic coding sequence
atggatgaaactgaaatagggtcctgcttcggccggtatgggtcagttaaggaggttaagattatcactaaccggacgggcgtgagcaagggctacggctttgtgagcttcgtgaacgacgtggatgtgcagaagattgttggcagccagattcactttcatggcaagaagctgaagctgggacccgcaattaggaaacagaagctgtgtgctagacacgtgcaacccagacccctggttgtcaacccacctccccctccccagttccagaatgtatggcgcaatcctaacactgaaacgtatctacagccacagattacacccaaccctgtgacgcagcatgtccaggcctactcggcctatcctcatagtcctggacaggtaattacgggctgccagctcctggtttacaactaccaggagtaccccacttatccagactccgcctttcaagtgacgactgggtatcagctgcctgtgtataactatcagccctttccagcatatccccgtagcccctttcaagtgacggcggggtaccagctgcccgtttacaattaccaagcttttcccgcttatcctaactcccctttccaagtagctactggataccagttcccagtctacaactaccagccatttcccgcctatccttcttcaccatttcaggttacagccggctatcaactcccggtgtataattatcaggcgttccccgcctaccctaattctccattccaggtcgcaacagggtaccagttccctgtctacaactaccaggcctttccagcttatcccaatagccctgtccaggttactacaggctatcaactacccgtctacaactatcagaaattcccttag

SEQ ID NO: 16955 - DNA, 1344 bp, Artificial Sequence
  Description of Artificial Sequence: Synthetic coding sequence
atggatatggggaatcagcatccttcgatctcaaggctgcaggagatccaaaaggaagtcaagtccgtagaacagcaggtaattggcttctccgggttgtcggacgacaagaactacaaaaaactggagagaatattaacaaagcagctctttgaaatagattcagtcgatactgaggggaaaggggacatccaacaggcaaggaagagagcggcgcaggagaccgagcgtcttctgaaggagcttgagcaaaatgccaatcatccccaccggattgaaatccagaacattttcgaagaggcccagtccctggtcagagagaagattgttccgttttacaatggaggcaattgtgtcaccgacgagtttgaagaagggatccaggacattatcctgcggttgactcatgtaaagacaggcgggaagattagtctgcgtaaagcacgttaccatacactcactaaaatctgcgctgtgcaggaaatcattgaagattgtatgaaaaagcagccaagcctgcccctgtcagaagatgctcatccctccgtcgccaagataaattttgtgatgtgtgaggtgaacaaggctaggggcgtactgatcgccctgctgatgggggtcaacaacaatgaaacttgcagacacctgagctgcgtcctgtctggcctcatagccgacttagacgccctggatgtctgcggtaggacagagattagaaactatcggcgggaggtggtggaagacatcaacaagctgctgaagtatctcgacttggaggaggaggcagacacgaccaaggcctttgacttgcgccagaatcactctatcctgaaaattgaaaaggtgcttaaaagaatgagggaaatcaagaacgaacttctgcaggctcagaatcctagcgaactatacctctcctccaagactgaactccagggcctgataggacagctggacgaggtgtcactggagaagaacccatgtattagagaagctcgtagaagggccgtgattgaagtacagaccctcattacctacatcgatctaaaagaggcgttggaaaagcgtaagctctttgcatgcgaggagcatccgtcccataaggcagtttggaacgtacttgggaatctgagtgaaatccagggagaagtgttatcgtttgacgggaatcggaccgataaaaactacattaggctggaggaactgctaaccaagcagctgctggctctcgatgcagtcgacccacaaggcgaagaaaagtgcaaggccgcaagaaaacaagccgtgcgactagctcagaatatcttgtcgtacctagatctcaaatccgacgagtgggagtactag

SEQ ID NO: 16956 - DNA, 474 bp, Artificial Sequence
  Description of Artificial Sequence: Synthetic coding sequence
atggccaacatcgcagtgcagaggattaaaagagaatttaaggaagtcctgaaaagtgaggagacttcaaagaaccagataaaggtcgacttggtggatgaaaatttcacagagctccggggggagatcgcgggtcctcctgatacgccatacgaaggcgggcggtatcagctcgaaattaaaatccccgagacctaccctttcaatcccccgaaagtcaggtttatcacgaagatctggcatccaaatatctcaagtgtaactggtgccatttgtctcgacatcctcaaagatcagtgggccgccgcaatgactctacgaacggtgctgctgagcctccaggccctccttgccgcggctgagcccgacgatccccaggatgctgtggtagctaatcagaatgccgtgatagtggcgctgtcctcaaaaagctgggacgtggaaacagccacagagttgttgctgagcaattag

SEQ ID NO: 16957 - DNA, 582 bp, Artificial Sequence
  Description of Artificial Sequence: Synthetic coding sequence
atgcctaccacttccaggcctgctttggacgtaaaaggcggcacatcccctgcaaaagaggatgccaatcaggagatgtctagtgtagcctatagcaatctggcagtgaaggacaggaaggccgtcgccattttgcattatcctggcgtggcctcaaacggcacgaaggcttctggagcgcccacctcctcatctgggtcacccataggcagtcctactaccacacctcccacaaaaccacctagttttaacctgcaccccgctccacacctgctcgcttctatgcacctccagaaacttaactcccagtaccaaggcatggctgctgcaaccccaggtcagccgggggaggcaggacctctgcagaattgggatttcggcgcccaagctgggggagccgaaagcctgtctccgagcgctggcgcccaatcaccagctatcatcgatagcgatccagtggacgaggaagtacttatgagtctggttgtggaactcggcctggacagggccaacgaattgcctgagctgtggctggggcagaacgaatttgactttactgcggacttcccaagtagttgttag

SEQ ID NO: 16958 - DNA, 1188 bp, Artificial Sequence
  Description of Artificial Sequence: Synthetic coding sequence
atggcttccgctgcttctgtcacttcactcgcagacgaggtaaactgccctatctgccagggcacgctccgagaacccgtcaccatcgattgcggtcacaacttctgccgggcatgcctgacaaggtattgcgagataccgggaccggatctggaagaatctccaacctgccccctctgcaaagagccttttcgacccggttcctttcgacctaattggcagctggcgaacgtcgttgaaaatattgaaagattgcagttagtttccacattgggcttgggcgaggaggatgtgtgccaggaacatggagagaaaatctattttttctgtgaggacgatgagatgcagctctgtgtggtttgtagggaggccggcgagcatgcaactcacacgatgaggttcctggaggacgccgcagccccataccgcgaacagattcacaagtgcctaaagtgccttcgcaaggaaagagaggagatacaggaaatccaatcaagagagaacaagcggatgcaggtgctgctcacccaggtgtccactaagcgtcagcaggtgatctcagagttcgcccacctgaggaagttcttagaggaacagcagagtatcttattggcccagctggagtctcaggatggtgatattctgagacagcgggatgaatttgacttgctggtggctggagaaatctgtagatttagcgccctgatagaggaactggaggaaaaaaacgagagacccgcacgtgagctgctcacggatattaggtccacattgattcggtgcgagaccagaaaatgccgcaaacctgtggccgtttcaccggaactgggccagagaatcagggactttccccagcaagcacttcctctccagcgcgaaatgaagatgttccttgaaaaattgtgcttcgagctcgattacgaaccggcacacatctcactggacccccaaacgagtcatcccaaactccttctctctgaagatcatcagagagctcagttttcttacaagtggcaaaatagccccgataaccctcagagatttgacagagcaacttgcgttctagcgcacactgggattacagggggccgccacacttgggtgtggatggctcgcgtgcctggcgactccgggtgctgccagttctgttccccgccttccgtacttggaaccgaggttgccgcttag

SEQ ID NO: 16959 - DNA, 624 bp, Artificial Sequence
  Description of Artificial Sequence: Synthetic coding sequence
atgaccgaggactcgcagcgaaatttccgcagcgtctactacgaaaaggttggctttcggggcgtcgaagagaaaaagtccctggagatcctgctgaaggacgatcggctgggtatactacctccacatcacgagtcacatgccaaagtgatgatgtacaggaaggagcagtatctcgacgtgcttcacgcgctgaaggtggttaggttcgtgtctgacgcaacaccacaggcggaggtttacctgagaatgtatcagctggagtctggaaaacttccccggagcccatcttttccattggagcccgatgatgaggttttcttggcaatcgcaaaggccatggaagagatggttgaagattccgtagattgctattggattacacggcgcttcgttaaccagctgaataccaagtatcgcgattccctgcctcagcttcccaaagccttcgaacaatacttaaatctggaggatggccggctgctcacacacctgagaatgtgtagtgccgcgcccaaactcccttacgacctttggttcaaacgctgtttcgctggttgtctgccagagtcgtctttgcaacgcgtgtgggataaggtggtctcgggaagctgtaagatttag

SEQ ID NO: 16960 - DNA, 1404 bp, Artificial Sequence
  Description of Artificial Sequence: Synthetic coding sequence
atggcttccctcttacagtcagacagggtgctgtacctggtacagggagagaaaaaggttcgagccccgttatcccagttgtacttctgccggtactgcagtgagctacggtctttagagtgtgtttcccacgaagtggatagccactattgcccaagttgtcttgagaacatgccatctgccgaggccaagctgaagaagaacagatgtgctaactgtttcgattgccctgggtgcatgcataccctttccacccgcgctacatcaattagcactcagttaccagatgatcccgccaagacgacaatgaagaaagcttactacctagcatgcgggttctgcagatggacgagtcgagacgtcggaatggccgataagtccgtcgcctcaggaggctggcaggagccggagaacccccacactcagaggatgaacaaactgattgaatattaccagcagctggcacagaaagaaaaagttgagagagatagaaaaaagcttgcacgacggcggaactatatgccacttgctttttctcagcacacgatccacgtggtcgataagtacggactagggacacgactacagcggccccgagctggggccagcattagcaccctggccggactaagcttaaaagagggcgaggaccagaaagaaattaaaattgagccggcacaggccgtagatgaggtggaaccactgccagaagactactacactcgaccagtcaacctcaccgaggtgaccacactccagcagagactgctgcagcccgatttccaaccagtatgtgcatcccagctctatcctcgacataagcatctattaatcaagaggtcgctgcgctgtcgcaagtgtgaacataacctgtccaagcccgagtttaaccctaccagcatcaagttcaagatccaactggtggctgtgaactacattcctgaagtgcgcattatgtcaatcccgaaccttagatatatgaaagagagtcaagtgcttctcacacttacaaatcctgtggagaatcttactcacgtcacgcttttcgaatgtgaagagggggatcctgacgacattaactctacagccaaggttgtggtgcctccaaaggagttggtgctcgctggaaaagatgcagccgcagaatatgacgaacttgctgagccgcaggatttccaggatgatcccgacattatagccttcaggaaagccaataaggtgggcatttttatcaaagtgactcctcagcgagaagaaggagaagtcactgtgtgttttaaaatgaaacacgattttaaaaacttagccgctccaattcggcccatcgaggaatctgatcagggcacggaggtcatctggttgacccaacacgtggaactgtctctgggcccacttctcccatag

SEQ ID NO: 16961 - DNA, 435 bp, Artificial Sequence
  Description of Artificial Sequence: Synthetic coding sequence
gttagagaacttgaagccgagttagacgctgagcagaagaagcacgcggaggccctgaaaggcgtcagaaaacatgagcggagggtcaaggaattagcctaccaggccgaagaggatagaaagaatctggcccggatgcaggaccttgttgataaactccaaagcaaggtcaaaagctacaagcgtcagttcgaagaggcagtttccgcattgggccctgggcacctggaccgggctccccagctgtgccccagagtgtgcggtcaggaacagcaagccaatactaacctggccaaatacaggaaggctcagcatgagctggatgacgctgaagaacgcgcagatatggctgaaacccaggcgaataaacttagagcgcgtacaagggatgccttgggaccaaagctttcactgtccccacagcataaggagtag

SEQ ID NO: 16962 - DNA, 747 bp, Artificial Sequence
  Description of Artificial Sequence: Synthetic coding sequence
atggctacgagcgcccccctgagaagcctggaggaggaagtgacttgcagtatatgtcttgattacctgcgtgatcctgtcactatcgactgtgggcacgtgttctgtcggtcatgcactacagacgtgcggcctatcagtggttcgcggccagtctgccctctgtgcaagaagccattcaagaaggagaatattcgacccgtctggcagctggcatccctagtcgaaaatattgagcgactgaaggtagataagggcaggcagcccggagaagtgacccgcgagcagcaagatgcaaaactatgtgagcggcacagagagaaactgcactattactgcgaagacgacggaaagcttctttgtgttatgtgtcgggagtcaagggagcatcggccccacaccgccgtgcttatggagaaagctgcacagccgcatagggagaagattctgaatcatctttctaccctacgccgggacagagataaaattcaggggttccaggccaaaggcgaagccgatatcttagcagccctgaaaaaactacaggatcagagacagtacatcgtggccgagtttgagcaagggcaccagtttttgagagagagagaagagcacctgctagaacaactggctaaactcgagcaggagctgactgaagggcgggaaaagtttaaaagtcggggggttggagaattggcgcggcttgccctcgtcatcagcgagctggaaggtaaagctcagcaatag

SEQ ID NO: 16963 - DNA, 3468 bp, Artificial Sequence
  Description of Artificial Sequence: Synthetic coding sequence
atggccgccagtagagatctgcttaaagagttcccgcagcctaaaaacctgctcaactctgtgattggacgagctctcggcattagtcatgccaaagataaacttgtatatgttcatactaatggacccaagaagaagaaggtcacgcttcacataaagtggccgaaatctgtcgaagttgagggctatgggtccaaaaaaattgacgccgagagacaggccgccgcggccgcatgtcagctatttaagggctggggcctcctgggtcctaggaacgaactgtttgatgccgcaaaatacagagtcctggctgacagattcggatcccctgccgactcctggtggagaccagagcctactatgcctccaaccagctggcgtcagctgaacccggaaagtatacggcctggggggcccggcggactgtccaggtctctagggcgcgaagaagaggaagacgaagaggaagagctggaagaaggcacaatcgacgtgacagattttttgagcatgacccagcaggattctcacgcacctcttcgcgacagccgggggtcctctttcgagatgacggatgatgacagtgccatcagagccctgacgcagttccctctcccgaaaaacttgctagcaaaggtgatccaaattgctacaagcagcagcacagccaagaacttgatgcaattccatacagtggggaccaagaccaaactgagtacgctgacgttactctggccttgccccatgacatttgtcgccaagggtcggagaaaagcagaggccgagaacaaagccgcggccctggcatgtaagaagcttaaatcactcggcctcgtagataggaataacgaaccactgacacacgccatgtacaacctcgccagtctgcgggagctgggagaaacccaaagacgcccatgcacaatccaggtgccggagccgatactcaggaaaattgagacctttctcaaccactacccggtggagagctcttggatcgccccagagctgcggcttcagagcgatgatattcttccactcggaaaagacagtgggccactgagtgatccaattacaggtaagccttatgtcccactgctcgaagcagaggaagtgcgactctctcagtctcttcttgaactctggcggagaaggggtccggtgtggcaggaagctcctcagctccctgtcgatcctcaccgcgataccatcttgaacgctattgagcaacaccctgtggttgtgatctcaggggataccggttgcgggaaaaccaccaggatcccacaattgctcctggagagatatgttaccgaaggcagaggcgccagatgcaacgtgattattactcagccccgccggatttccgcagtgtctgtggcacagcgggtgagtcatgagctggggccttcactgagacgcaatgtagggtttcaggtccggcttgagtcaaaaccaccctcccggggtggtgccttactgttttgcacagtgggaattcttttacgtaaactgcagagcaacccgagtctcgaaggtgtgtctcacgtcatcgttgatgaagtccacgagcgagacgtgaacaccgacttcctcttgatactcttaaagggattgcagagactaaaccccgctctccgactggttctgatgtccgccacaggcgataacgagcggttcagtaggtacttcggtggttgtcctgtgatcaaggtgcctggttttatgtatccagtgaaggaacactatctcgaagatatcctcgccaaactagggaaacatcagtacctccaccgtcatcgccatcatgaaagtgaagatgaatgcgccctggacctggatttggtgaccgatctggtcctgcacatcgacgcgcgaggcgaaccaggcggaattctttgttttttgcctggatggcaggaaatcaaaggggtgcagcagcggttgcaagaagctctggggatgcatgagtccaagtacctcattctgcccgtgcactcgaacattccaatgatggaccaaaaagccatctttcaacagccccccgtaggcgtccggaaaattgtcctggctacaaacatagccgaaacttccataacaattaatgatatcgtgcatgtcgtagatagcggccttcataaagaagaaagatacgacctgaagacaaaggttagttgtttagaaactgtgtgggtcagtagagccaacgtcatccaaaggagagggcgggcaggcaggtgtcagtcagggtttgcctaccatctctttccacggtcacggttagagaagatggtccccttccaggttcctgaaattctacgtacacccctggaaaacctcgtactgcaggcgaagatccatatgcccgagaaaactgctgtggaatttttatcaaaggccgtcgattccccaaatattaaggctgtggacgaagcagtcattctgctgcaggaaataggcgtccttgaccaacgcgagtacctgacgactctaggacagagacttgcccacatatccacagatcccagactggctaaggcgattgtgctggctgctatatttcgttgtcttcacccactattagttgtggtctcatgtctaacccgggaccccttctcttctagccttcagaaccgtgccgaagttgacaaggtcaaggccctcctctcacatgactctggatccgatcacctggcatttgtgcgggccgtggccgggtgggaggaggtcctcagatggcaggaccgaagttcaagagagaactacctcgaagaaaacttactctacgcaccttccttaaggttcattcacgggctcatcaaacagttttccgaaaacatttacgaggcatttctcgtgggaaagccaagtgactgcactctcgcaagcgctcagtgcaacgagtattcagaagaagaggagctcgttaagggagttctcatggcgggactttatccaaaccttattcaagttagacagggaaaagtaacacgacaggggaagttcaaaccaaactccgtgacgtaccggacaaagagtgggaatatacttttgcacaaatctaccataaaccgggaggccactcgtttgcgaagcaggtggctgacctatttcatggccgttaaaagcaatggctctgtgttcgttcgtgacagcagtcaagtgcatccactggccgtcctgctgctgacggacggagacgttcatatcagggacgacgggcgaagagcaactatttcactaagcgactccgacctgctgcggttagaaggggatagtcggacagtccggcttcttaaggaactgaggagggcactcgggcgcatggtcgaacgttctttgcggtcggaactagcagcactgcccccctcggtccaggaagaacatggccagctgcttgcattgctggcagaacttctccgaggaccttgcgggtcgtttgacgttcgaaaaactgctgacgactag

SEQ ID NO: 16964 - DNA, 762 bp, Artificial Sequence
  Description of Artificial Sequence: Synthetic coding sequence
tgagtgggggtggaggccgcacgcgtcatcgccaaagctttggagaaaaagtcagagctgaagaggtgccattggtcggacatgttcacggggcgcctcagaacagagatcccaccggccctgatcagcctcggggagggtctgatcactgcaggcgcccagctggttgaactagatttgtcagacaatgcttttggcccggatggggttcagggtttcgaggccttgctgaaaagctctgcctgctttacactgcaggagctgaagctcaacaactgcgggatggggatcggtgggggcaaagtgatcggtactctggaggaggtccacatgcctcaaaacggcatcaaccaccccggtattacggcactcgcccaggcctttgcggtcaacccactcctccgcgtaattaatctgaatgataatacttttactgagaagggggccgttgccatggccgaaactctgaagacgctgcgacaagttgaagtaataaatttcggagattgtctggtgcggagcaagggagcggtggcgatcgcagatgccattcgggggggcttgccaaagctgaaggaactcaatctctccttctgtgagatcaaaagggacgccgccttagctgtggcagaggctatggcagataaggccgagttagaaaaactcgatcttaatggcaacacgctaggggaggagggatgcgaacaacttcaggaagttttagaaggttttaatatggccaaggtacttgcctcgctctag

SEQ ID NO: 16965 - DNA, 3735 bp, Artificial Sequence
  Description of Artificial Sequence: Synthetic coding sequence
gatgttggaggcgaccggccctgggactctggaaacacccagctgcccccaagaaaccccgtgaaggcaaacgcaatgtttggagcgggagacgaggatgataccgatttcctatctccttctgggggtgcacggctggcttctctcttcggtctggaccaggccgctgccggacatggaaatgaattttttcagtacacagcaccgaaacagcctaagaaagggcagggcaccgctgccacgggtaaccaggccaccccaaagaccgctcctgccacaatgagcaccccaaccatcctggtggctacagcggtccatgcgtaccgctataccaatggccagtatgtgaagcagggaaagtttggggccgccgtgctggggaatcacactgctcgcgagtaccgtatcctgctctacatctcccaacagcagcccgtgacagtcgcacggattcacgttaactttgagctgatggttcgcccaaataactacagtactttctatgatgaccagcgtcagaattggagcatcatgttcgagtccgagaaggcggcagtggaatttaataagcaggtgtgcattgctaaatgtaattctacatcatctttagacgcagttctgagccaggatctcatagtggcagacggaccagccgtggaagttggcgactccctggaagtcgcctatacagggtggctcttccagaatcacgttctgggccaggtctttgatagcacagctaataaggacaagctcctgaggttgaagctgggctcaggcaaagtgatcaagggttgggaagacggaatgctcgggatgaagaagggaggaaaaaggctcctcattgttcctccagcctgcgctgtggggagtgaaggcgttatagggtggacccaagcaaccgactcaatactcgtattcgaagtggaagtgaggagagtgaagttcgcccgcgattcaggaagcgatggtcactccgtaagtagccgagactctgccgctccttcacctatccccggagctgacaatctgagcgccgaccctgtcgtatcaccccctacttcaatacccttcaaaagcggagaacctgcccttcgaacaaagtccaattccctctcagagcagctggctattaacacctctcctgacgccgttaaggctaagctcatatcccgaatggcaaaaatggggcagcccatgctccctatcctgccaccgcagcttgatagcaatgactccgagattgaagacgtgaacacacttcagggcggagggcagcctgtggtcaccccttcagtgcaaccttccctgcaccccgcgcaccccgcgctgcctcagatgacctcacaggcccctcagccgtctgtaactggcctgcaggccccatcagctgctctgatgcaggtgagttcccttgatagccactcagccgtcagcggcaacgctcagtcattccaaccatacgccggtatgcaagcatatgcgtacccccaggcctcagccgttactagtcagctccagccagtgaggcccctataccctgcccctctgagtcagcccccccacttccaaggaagcggtgacatggcctcgttcctaatgacagaagcgagacagcacaacactgaaatccggatggccgtgtctaaggtagccgataaaatggaccacctgatgactaaggtggaagagctgcagaagcactccgctggcaactctatgctgatcccttctatgtccgtaacgatggagacatccatgatcatgtctaatatacagaggataattcaggagaacgaacggctcaagcaggagatcttggaaaaaagcaacagaatcgaagaacagaacgataaaatctcagagttaatcgagcgaaaccagagatatgtagagcagagcaacctcatgatggagaaaagaaataactctcttcaaaccgctaccgaaaatacccaggcacgggttttacacgcagagcaagagaaagccaaggtgactgaggagcttgcagcagctacggcacaggtttcgcacctgcagctgaagatgaccgcccaccagaagaaagaaacagaactgcagatgcagctaaccgaaagtctcaaggagaccgatctgctccgtgggcagctgactaaggtccaggctaaactttccgaactccaggagacatcggaacaggcgcaaagcaaattcaaatctgaaaaacaaaatagaaaacaacttgaactcaaagtgaccagcttggaggaggaactgactgacctacgcgtagagaaagagtccctggaaaagaatctgtccgagaggaagaaaaaatccgctcaggaaaggtctcaggcagaagaggagatcgatgagatccgtaaatcctatcaggaagaactggataagcttagacagctgctgaagaagactagagtgagcacagaccaggcagcggcagaacagctctcactcgtgcaggcagagctccagacacagtgggaagccaagtgcgagcacctgctcgcttcagccaaagacgagcaccttcagcagtatcaagaagtttgcgcccagcgggacgcttaccagcagaagctagtgcaactgcaggaaaagtgccttgctcttcaggcgcaaatcacggcattgactaaacagaacgaacaacatattaaggagctggagaagaataagtctcagatgagcggcgtcgaggccgccgcttccgaccccagcgaaaaagtaaagaagatcatgaaccaagttttccaaagcctgagaagagaatttgagctggaggagagttacaacgggcgtactatactgggaacaattatgaatacaatcaagatggttactctccagctcttgaaccagcaggaacaggagaaagaagagtcttcttctgaagaagaggaggagaaagctgaggaacggccccgacgccccagccaggaacagtctgcttctgccagcagcggtcagccgcaagcgccactgaacagagaacgccctgaatcgccgatggtccccagtgagcaagtggtggaagaggccgtgcctctcccccctcaggccctgacgacttctcaagatgggcaccggcgcaagggggattcagaggctgaggcattgagcgagatcaaagatggtagtctacctcctgaactaagctgtattccatctcaccgcgtgctggggccaccaactagtattccccccgaacctctgggtccagtttctatggactctgagtgtgaagaaagtctcgcagctagccctatggctgcaaagcctgataacccctctgggaaagtgtgcgtcagggaagtggcgcctgatggtcctctgcaggagtcttctacaagactgtcactaacaagtgaccccgaagagggtgatccgctagcattgggcccagagtctccaggcgagccccagccccctcagctgaagaaagatgatgtgacgagcagtaccggaccccacaaagaactgtcttccacagaagccggctctacagtcgccggcgcggcacttagaccaagtcaccacagccagagaagcagtctctctggggatgaggaggacgaattgttcaaaggagctacgctcaaagcacttcgccctaaggcgcagccagaggaggaagacgaggacgaggtttccatgaagggtagaccaccccctaccccactgtttggggatgacgacgacgatgatgatatagactggctgggttag

SEQ ID NO: 16966 - DNA, 1653 bp, Artificial Sequence
  Description of Artificial Sequence: Synthetic coding sequence
atgaaatgggaagagtatgaggagctcctgcactatgcaatcgtgaccccaaacatagaaccttgcgctagtcagagtagccatccgaagggggaactcgtacccgacgttagaatctcgactattcacgacattctccactctcaaggcaacaacagcgaggtgcgggagaccgccattgaggtaggcaaggggtgcgattttcatataagttcacatagcaagacagacgaaagcagtccggtgctctcccctcgcaagccctcacatcctgtcatggacttctttagctctcacctactggctgattcgtcctcacccgccaccaactcttctcataccgatgcgcacgaaattcttgtgtctgatttcctggtgtctgacgagaatctacagaagatggagaacgttctggacctttggtcctctggccttaaaacaaatatcatatccgaactgtctaaatggaggcttaatttcatagattggcaccgcatggagatgcgaaaagagaaggaaaagcatgctgcacacctgaagcaactgtgtaaccaaataaacgaattgaaagagttgcagaagacattcgaaatctcaatcggtaggaaagacgaagtgatctcaagcctaagccatgccatcggtaaacagaaggagaagattgaactgatgagaacctttttccactggaggatcggacatgtaagagccagacaggacgtttacgaaggaaagttggctgaccaatactaccagagaaccctgctgaaaaaggtgtggaaggtatggcgttcggtcgttcagaagcagtggaaggatgtggtggagcgggcctgccaggccagagccgaagaagtatgcatccagatatcgaatgactacgaagctaaagtggccatgctctcgggtgctttggaaaatgctaaagcagaaatccagcgcatgcaacacgagaaggagcactttgaagatagcatgaagaaggcgttcatgaggggcgtgtgcgcactgaatttggaggctatgaccatctttcaaaatcgcaacgacgccggaatcgacagcaccaataataaaaaggaggagtatggtcctggggtgcagggtaaagaacactctgcccatcttgacccatctgctcccccgatgccacttcccgtgacgtctcccttactcccttccccgcccgcagccgtagggggagcgagtgcgaccgcagtgccctccgcggcaagcatgacgagtacccgcgcagcatccgctagttcagtgcacgttcccgtgtctgcactaggagccgggtcggccgcaaccgcagcttccgaggagatgtacgttccccgggtcgtgaccagcgcacagcagaaggctggaagaactataactgcaaggattaccggccgttgcgacttcgccagcaaaaatcggattagtagctcgctagcaattatgggggtctctcctcctatgtctagcgttgtggtggagaagcaccatcccgtgacagtgcaaacaattccccaagctacggcagcaaagtatccccgcactatccacccagagagcagcacgagcgctagccgcagtttgggcactaggtccgcgcatacacagtccctcacgtcggtccactccatcaaggtggtagactag

SEQ ID NO: 16967 - DNA, 402 bp, Artificial Sequence
  Description of Artificial Sequence: Synthetic coding sequence
atgagcccttcacagatgattatgccaaacgtcatggaaatgatcgctgcgctcggtcctggaccctctccctaccctttgccgcctccacccggggggactaatagcaacgactacagcagtcagggtaataattatcaaggccatggaaactttgatttcccccacggtaaccctggtggcaccagcatgaatgatttcatgcatggcccaccgcagcttagccacccacccgatatgcccaacaatatggcagcactagaaaagccactgagccatcccatgcaagagaccttgcttcctgaactgactaatccagacgagctgctctcctacctggacccccccgaccttcccagtaacagcaatgatgacctcctgagcctctttgaaaataactag

SEQ ID NO: 16968 - DNA, 1473 bp, Artificial Sequence
  Description of Artificial Sequence: Synthetic coding sequence
atgtcatcatgcgtgagttctcagcctagctcaaatcgggcagcccctcaggacgagctgggtggacgaggctcatcttcgagcgaatcgcagaaaccgtgtgaggctctccggggtttatcttctctgtcaatacacttaggaatggagtcatttatcgttgtgaccgaatgcgagccaggatgcgctgtagatctgggtctggcccgtgaccgcccactggaggcagatggtcaagaagtgccactggataccagcggctcacaggcccggccacatttgtcagggaggaagctgtccctgcaggaaaggtcccaaggaggcttagccgccggcggtagcctggatatgaacggcagatgcatctgcccttctctgccttatagtcctgtgagtagcccccagtcaagtcccagactgccccggaggccaaccgttgaatctcaccacgtgagtatcacaggtatgcaagattgcgtgcagttgaatcagtataccctgaaagacgagatcgggaagggttcctatggtgttgttaagttagcatataacgaaaatgacaacacgtactacgcaatgaaagtgctctccaagaagaagttgatcagacaagccggatttccaaggcgtccccccccccgcgggaccagacccgctcctggtggctgcatccagccacggggacctatcgaacaggtgtaccaggaaatcgctatcctcaagaaacttgaccatccgaacgtggtgaaactggtcgaagtcttggacgaccctaatgaagaccacttgtacatggtgttcgaattggtgaatcagggacccgttatggaggttcctactcttaaacccctgtccgaggatcaggctagattttatttccaggatctcattaagggtattgagtacttgcactaccaaaagattatccaccgagatattaaaccaagcaacctccttgtgggggaagatgggcacatcaagatcgctgatttcggcgtctcaaatgagtttaagggcagcgacgctctgctttctaacacagtcggcacccctgcgtttatggcaccagaaagcctgtctgaaacacgcaaaattttctccggtaaagctctggatgtgtgggccatgggagttacactctactgctttgtgttcgggcagtgccccttcatggacgaaagaatcatgtgtctccacagcaaaatcaagtcgcaggctcttgagtttcccgaccaacctgatatcgctgaggatctcaaggacctcataaccaggatgttagataagaatcccgagtcccgcattgtagtgccagaaatcaaaattctggtcaagacaatgatcagaaagcggtcttttggtaacccattcgaaggaagtcggcgagaagagcgttccctgtctgccccaggcaatcttttgactaaaaagccgaccagagagtgcgagtctctctcggaactaaagacctag

SEQ ID NO: 16969 - DNA, 1872 bp, Artificial Sequence
  Description of Artificial Sequence: Synthetic coding sequence
atggccgctgcaaccggcgatcctggactaagcaagcttcagttcgccccctttagctctgcactcgatgtaggattttggcatgagctgacccagaagaaactcaacgaatatcgtctggacgaggcacctaaagatattaaggggtattactacaacggagacagtgccggcctcccggcaagactaaccttagagttctcagctttcgatatgtctgcccccactccagcccgttgttgtcctgctattggcaccttgtataataccaacacacttgaaagcttcaagactgctgataaaaagttactgctggagcaggcggctaatgaaatttgggagagtattaagtccggtacagcactggaaaaccctgtgctgctgaacaagtttctcttacttactttcgccatcgaagcactggaatgtgcatacgacaatctctgtcagaccgaaggagtcactgcgctgccttacttcctgatcaagtatgatgagaatatggtcttggtatcgctcctgaaacactactcagattttttccagggccagaggaccaaaatcactatcggggtgtatgacccctgcaatctggctcagtatcctggatggcctttgcgtaattttctggttttagcagcgcatagatggagtagttcctttcagtcggtggaggttgtctgcttccgagaccgaacaatgcaaggagctagggacgtcgctcattctataatttttgaagtgaagttgccagagatggcattcagcccagactgcccaaaggccgtgggatgggaaaagaatcagaaaggaggaatgggccccagaatggtgaatctctccgagtgcatggatccaaaaaggctggcagaaagcagcgtcgatttaaatctcaagctgatgtgctggaggctcgtccccactctggatctggataaggtggtgagcgtgaagtgtctgctactcggcgccgggacactgggctgcaacgttgccaggactctgatgggttggggcgtaagacacattacctttgtggataacgctaaaatctcatacagcaaccccgtaaggcaaccattgtatgagttcgaggactgcctgggaggaggaaagcctaaagcgctggcagcagccgataggcttcagaagatctttcctggggtgaatgctcgcggtttcaatatgtccatccctatgcccggacatcccgtgaattttagctccgtcactctggaacaggctcgcagggacgttgagcagttggaacagctgattgagtcccacgacgtcgtcttcctcttgatggatactagggaatcacgttggctgccggccgtcatcgcagcctccaagcgaaaactagttattaacgctgctctcggtttcgacacctttgtcgtcatgagacacgggctaaaaaaacccaaacagcaaggagcgggcgatttgtgtcctaatcatcctgtggcgtctgctgacctcctggggtccagcttgttcgctaacatccccgggtacaagctcggatgttacttttgcaatgacgtcgtagccccgggggacagtacccgggaccgcaccctcgaccagcagtgtaccgtgagtaggcctggacttgccgtgattgctggtgctttggcagtcgagctgatggtatctgtgctgcagcaccctgagggagggtacgcgatcgcatcatcgtctgacgaccgcatgaatgagccaccaacctccctgggcctggttccccatcaaattaggggttttcttagccggttcgataacgtgctcccagtgtccttagcgttcgataagtgtactgcatgctcaagcaaaatctgggacatgagtgacgatgaaaccatatag

SEQ ID NO: 16970 - DNA, 966 bp, Artificial Sequence
  Description of Artificial Sequence: Synthetic coding sequence
agaaggaatgtggaactgattaatgaggaagcggctatgttcgatagtctcctgatggattcctacgtaagcagtacgaccggtgagtctgtaatcactagagaaatggtcgagatgctgttcagcgacgacagcgacctgcagctagctacaacccagaagtttaggaaactactgtccaaggagccaagccctcccatagatgaggtaattaacaccccacgcgtggtagaccggtttgtggaattcttgaagcgcaatgagaattgtaccctgcaggcagtttgggcacttgggaatatagcgggggatagctccgtatgcagggactatgtgctaaactgttccatcctgaaccctctcttgacgctgctcaccaagagcacccggctgacaatgactaggaacgccgtttgggcgctgtccaatctgtgccgcgggaagaaccctccgcccgagtttgccaaggtgtcgccttgtcttcccgtgctgagccgccttctgttcagctcagattcagacctgttggcggacgcttgctgggccctcagctacttatctgacgggcctaacgaaaagattcaagccgtgattgacagtggtgtctgcagacggctagtggaattgctgatgcataatgactataaagtggcatcccccgccctacgggccgttggaaatattgtgacaggcgacgacattcagacacaagtgatcctaaactgttccgccctgccgtgcctgttgcatttgctgtcctctcccaaagaatcgattcggaaggaggcatgttggactatcagtaatatcaccgccggaaatcgagcccaaatacaggccgtgattgacgcgaatatctttccggtgctgatagagatcctccaaaaggccgagtttcggaccagaaaagaggccgcctgggcaatcactaacgccactagtggcggcacacccgagcagatttag

SEQ ID NO: 16971 - DNA, 795 bp, Artificial Sequence
  Description of Artificial Sequence: Synthetic coding sequence
atggggggtgcccagctagagctgcctagcggcgcaaggcctggggtgtgcgtgaggaggagctttagagcacacgctggcgaccagcccaggagaccacccggacctattccagtgccaggaactatgaagcaggagagcgcggcacctaatacacctccaacttctcagtctccaactccctcagcccagtttcccaggaacgacggcgatccgcaggccctctggatttttggctacgggagcctggtgtggagacccgatttcgcttattctgactcgcgtgtcggattcgttaggggatacagcagacgtttctggcagggcgatactttccaccggggatcagacaagatgcccggaagggtggttacattactggaagatcatgaaggatgcacatggggcgtagcctaccaggtgcaaggcgaacaggtgtccaaggctcttaagtacttgaacgtgcgggaggctgttctgggtggctacgacacgaaggaggtgacgttttaccctcaggacgcacccgaccaacccctcaaggcccttgcctatgttgcgacaccacagaacccagggtacctgggtccagctcctgaggaggccattgctacgcagatcctggcttgcagaggattctctggccacaatctggagtacctgctgcgcttggcagacttcatgcagttgtgcggaccacaggcacaggatgaacacctggctgccattgtcgatgccgtagggactatgctgccctgtttctgtcctactgaacaggctcttgctctcgtgtag

SEQ ID NO: 16972 - DNA, 747 bp, Artificial Sequence
  Description of Artificial Sequence: Synthetic coding sequence
atggccactagcgctcccctgagaagtcttgaagaggaagtcacttgctctatctgtttggactatcttagggatcccgtgaccatcgattgcggccatgtcttctgccgaagctgcactactgacgtcagacctatttccggcagtcgacctgtatgtcctctgtgcaagaagccttttaaaaaggaaaatattcgaccggtgtggcagctggcatcactggtggagaacatcgaaaggctcaaggtagataagggccggcaacccggagaagtgactcgcgagcaacaggatgcaaagctttgcgagcggcaccgcgaaaagctgcactactactgtgaagacgacggcaaactgctgtgcgttatgtgtagagaatcaagggagcatcggcctcacaccgctgtgctgatggagaaagccgcccaaccccaccgggaaaagatcctgaaccacctgtcaaccctgcgccgggatcgagataaaatacagggattccaggccaagggagaggccgatattctggcggcccttaagaaactccaggaccagaggcaatacatcgtcgctgaattcgagcagggtcatcagtttctccgggagcgggaggagcatttacttgaacagcttgccaagctggagcaggagctgaccgaaggaagagagaagttcaagagcaggggtgtgggtgagctcgcgcgcctggctctcgtgatcagtgagctggagggcaaggcacagcagtag

SEQ ID NO: 16973 - DNA, 768 bp, Artificial Sequence
  Description of Artificial Sequence: Synthetic coding sequence
atgtcttcttcaatgtggtacatcatgcagagcattcagtctaaatactcgttgagtgaaaggctgatccggaccatcgccgctatccggtcgtttccacacgacaatgtcgaagacctgatccggggaggcgccgatgtgaattgtactcatgggaccctgaagccactccactgcgcttgcatggtttccgatgcagattgcgtggagttacttctggagaaaggggccgaagtcaacgctctggatggctataaccggacggcattgcactatgcggcggagaaggacgaggcctgcgtcgaggtgctcctcgaatatggcgctaatccaaacgccctcgactacaataacgatacccccctttcctgggccgctatgaaagggaacctggagtccgtatcaatcctcctagattatggggccgaggtgagagtgataaacctgattggtcagacaccaatctctaggttggtagcactgctggttagaggccttggtacagaaaaggaagactcctgtttcgagcttctccaccgcgcagtgggccacttcgagctgcgcaagaacgggactatgccaagagaagtggcaagagatccccagctgtgtgagaagctgacagtcctttgtagcgcacccggaaccctgaaaactttggccagatacgctgtccggcgctccctcgggttacagtatcttccagacgcggtgaagggtctaccgctgcctgcttcactgaaagagtatctgctactgctcgaatag

SEQ ID NO: 16974 - DNA, 585 bp, Artificial Sequence
  Description of Artificial Sequence: Synthetic coding sequence
gaacccgtgcagcctcattggttctattgcaaagaagtggagtataaacagctgtggatgcccttcagtgtgttcgatagccttaatctcgaggaaatatacaacagtgtgcagcccgatcctgaaagtgtcgtgctgggcactgacgggggccgttacgacgtgtatctgtacgaccgtattcggaaggctgcttattgggaggaggagcccgccgaagtaagaaggtgcacatggttctataaaggcgacaccgactcccgctttatcccatacaccgaagaattttcagagaagctggaagttattgtgcagttccagccaagctccgtacccgacgagtggggcacaacgcaagacggacaaacaagaccacgtgttgtgaagcgtggtatcgatgataacctcgatgagataccggatggagaaatgcctcaggttgatcacttggtctttgtcgtccatggtattgggcccgtgtgcgacctgcgcttccgatctatcatcgagtgcgttgatgatttcagggtcgtctctctcaagctattgaggacccatttcaaaaaaagccttgacgacggctag

SEQ ID NO: 16975 - DNA, 981 bp, Artificial Sequence
  Description of Artificial Sequence: Synthetic coding sequence
atgcctcacctccccttggccagcttcagaccaccgttttggggcctgcgccactcacgaggcctgcctcgcttccattccgtcagtacgcagtccgaaccgcacggatcccctatcagtcggagaaaccgagaagccaaacagaaaaggctgcgcgaaaagcaggctacactggaagcagagattgcaggagaatctaagagccccgcagagtccattaaagcatggcgcccaaaggaactagtcttgtacgaaattcctaccaagccaggcgagaagaaggacgtatcaggtcccttacctcctgcatatagcccccggtacgtggaggccgcctggtatccttggtgggtgagagaaggcttcttcaagcccgaatatcaggcacgcctcccccaggccaccggtgaaacctttagcatgtgtatcccccccccaaacgtaaccggatcccttcacatcggccatgcgctgactgtagctatacaagatgccctcgtgcgatggcacagaatgcgaggcgatcaggtcctgtgggtgcccggaagcgaccatgccgggatcgcgactcaggccgtggttgagaaacagctctggaaagaacgtggagtcaggaggcatgagctgagccgggaagccttcctgagagaggtgtggcagtggaaggaagccaaagggggggagatctgtgagcaactgcgcgccctcggcgcctctcttgattgggatcgagaatgcttcaccatggacgtagggtcttcagtcgctgttaccgaagcatttgtgaggttgtacaaggctggcttactgtatcgaaatcaccagctcgtgaattggtcttgcgctttacgctcagccattagcgacatagaggtggaaaatcggcccttacccggccacacccaattgagactgccaggctgtcccacccccgtgagttttggcctgctcttctccgtggcgttcccagtggacggttag

SEQ ID NO: 16976 - DNA, 990 bp, Artificial Sequence
  Description of Artificial Sequence: Synthetic coding sequence
atggccggagctttggaaggagacatcttcatcggacctaaggccgaagagcacagggggctcctcagcattcgctatcccatggaacacggcatagtgaaggactggaacgacatggagaggatctggcaatacgtctactccaaagatcagttgcagacttttagcgaggagcacccagttctcctaaccgaggcaccactgaacccaagaaagaatcgcgagcgggccgccgaggtattttttgaaacctttaacgtgccggctctatttatttctatgcaggccgtgttgagcttgtacgccacggggagaacgacaggcgttgtcctggattcgggcgatggagtgacccatgcagtccccatttatgaggggttcgcaatgccccacagtatcatgcgcatcgatatcgctggacgggacgtatctaggttcctacgattgtacctgcgcaaagaagggtacgattttcattcaagctcagaattcgagatcgtgaaggccattaaggagcgcgcctgctatctgtcaattaatccccagaaagacgaaacgctggagacagagaaggctcagtactatttgcccgatggctctactattgaaataggtccatcacgttttcgagccccagagttgttgttcaggccagacctcatcggggaggagtcagagggaatacacgaagttctggtgttcgccatccagaaaagcgacatggatctgaggcgcactctgttctccaacattgtgctgtctgggggctctaccctgtttaagggcttcggcgatcgtttattgagtgaggtcaagaagctggctcccaaggacgtaaaaatccgcatcagtgccccccaggaaaggctctactccacctggatcggtgggtctatactggcttccctggatactttcaagaaaatgtgggtttctaaaaaggaatacgaggaggatggtgccaggtctatccaccgaaaaactttctag

SEQ ID NO: 16977 - DNA, 450 bp, Artificial Sequence
  Description of Artificial Sequence: Synthetic coding sequence
atggaaaagacggagctgatccagaaagcaaagctggctgagcaggccgagcgatacgatgatatggccacatgtatgaaggccgtcacagagcaaggtgcagagcttagtaatgaggaaagaaacctactgtcggtcgcatacaagaatgtggtgggcgggcggcgttccgcgtggagggttattagttcgatcgagcagaaaaccgacacgtctgataaaaaactccaactcattaaggattatcgggagaaagttgagtctgagctgcgtagcatatgcaccactgtgctggaactcctggataaatacctaatcgcaaatgccacaaaccccgaatccaaggtgttttatttgaagatgaaaggagactatttccggtatctggccgaagtcgcctgtggcgacgaccgtaaacagactatcgacaattctcagggagcctattag

SEQ ID NO: 16978 - DNA, 735 bp, Artificial Sequence
  Description of Artificial Sequence: Synthetic coding sequence
atgctctctgataggaagagagagttggagcatcggttatcagcaacactggaggagaatgatttgcttcagggcaccgtcgaagaactgcaggaccgggtccttattctggagaggcaaggacacgataaagacctgcaattgcaccagagtcaattggagctgcaggaagtccgcttgagctgtcggcaattgcaggttaaagtggaggagttaacggaggagcgaagtttgcaatcgtcagccgcgactagcacaagtttgctctcagagattgagcagtcaatggaggctgaggaactcgagcaggagcgcgaacaagtgacattgctatctgttgaaatgaccgccctgaaggaagagcgggatcgcctccgtgtgacatctgaagataaagagcctaaggagcagctgcaaaaggccattcgcgatagagatgaggccatcgccaaaaagaatgccgtcgaactagagctggccaaatgccgcatggatatgatgtcgcttaattcacagcttttggatgctatacagcagaagctgaacctgagccagcagctggaagcatggcaggacgatatgcaccgggtgatcgaccgccagctcatggacactcacctcaaagagcgttcacagccagcagctgccctctgccggggccactctgctggcagaggcgacgagccttctatcgccgagggaaaacgcttgttttctttctttagaaagatctag

SEQ ID NO: 16979 - DNA, 603 bp, Artificial Sequence
  Description of Artificial Sequence: Synthetic coding sequence
tagcacatgctgtccaaggtcggtatgtgggatttcgatattttcttgttcgatcgcctgacaaatggcaatagcctggttacgctcttgtgtcatctgttcaatacccatggcctcattcatcactttaaattggacatggttactctgcatagatttctggtgatggtgcaggaggactaccactcccaaaatccttaccacaacgcggttcacgccgccgacgttactcaagccatgcactgctacctcaaggaaccaaagctcgcttctttcttgactcctctcgatattatgttggggctattggccgcagcagcacacgacgtagatcaccctggcgtgaatcagccgttcctgatcaagacaaaccaccacttggctaatctctatcaggtgcgggaacccaacctggagcctgccacagtgtggtctatagctttaggacccgtgctgaaacccgaaagctgcccttggagaaaaccctgcttcagggtgctggaagtgcagcgccgcatgaagcacaacctttgcccacaaaagtttgtccagacccagatgctaaagatgtccaaaatccaggctaatttgatccccgtttag

SEQ ID NO: 16980 - DNA, 1728 bp, Artificial Sequence
  Description of Artificial Sequence: Synthetic coding sequence
atggcgatggcgccgtcaccttcgctggtgcaggtatatacgagccctgccgcggtcgcagtctgggagtggcaagatggtctgggtacctggcacccatactccgcaacagtgtgcagctttattgagcagcagttcgttcagcagaagggccagcgatttgggctagggtcgctcgctcattccatcccactcgggcaagccgatcccagccttgcaccttatattatcgacctgccctcatggacccaattcaggcaggatacaggtaccatgcgagcagtgaggaggcatttgtttccccaacacagcgccccgggcaggggggtagtgtgggagtggctcagcgacgacggatcatggactgcatatgaggcatctgtctgcgactacttggagcagcaggtggccaggggcaaccaattggtcgacctcgcaccccttgggtacaattacaccgtaaactataccacacacacgcagacaaataaaaccagctcattttgtcgcagcgtcaggaggcaggctgggccaccttacccagtaacgacaattatcgctcctcccggacatacaggagtggcttgttcctgccatcagtgcctctccgggtcgaggacggggccggtcagcggcagatatcgccattcgatgacaaatctccccgcataccctgtaccacagcaccccccccatagaaccgcctctgtatttggtactcatcaggcgtttgccccttataataagccgtccctctccggcgcccggagtgcaccccgtctaaatactacaaatgcctggggcgccgctcccccatcactcggttcgcagcctttgtacaggagttccttatcccacctgggcccccaacatcttcccccaggatcctctacaagcggagcagtgtcagcgtccctccctagtggcccctctagcagtcccggatctgttcccgccaccgttccaatgcagatgccaaaacctagccgtgtccagcaggcacttgccggcgccacacctaaacctgaacctgagcccgaacaggttatcaagaattacacggaggagttgaaggtgcctcctgacgaagattgtataatctgtatggagaagctgagcactgccagcggatacagcgatgttactgacagcaaagcgatcggaagtctggcggtgggccacctgacaaagtgtagccacgccttccatttgctgtgtcttctggccatgtattgtaatgggaataaagacggatcactccagtgccccagttgtaaaactatttacggggaaaaaaccgggacacagccgcaggggaaaatggaggtgctgcggttccagatgagtctcccagggcatgaggactgcggtacaatcctcatagtctacagtattcctcatggaatccagggcccggaacatcccaaccccggcaaaccctttactgctcggggctttccaaggcagtgttacttgccggataacgcacagggccgaaaagttctagagctgctaaaggttgcttggaagaggcgcctgatctttaccgtagggacctcttcaacaactggggagactgacacagtggtttggaatgagatccaccacaagacagaaatggataggaacatcaccggacatggctacccggacccaaattatttgcagaacgtgttggccgaactggcggcacagggagtgactgaggactgcctagaacaacagtag

SEQ ID NO: 16981 - DNA, 3036 bp, Artificial Sequence
  Description of Artificial Sequence: Synthetic coding sequence
atggtctcctctgacaggccagtcagtctcgaagacgaagtgagtcattcaatgaaagaaatgatagggggatgctgcgtgtgtagcgatgagcgcgggtgggctgagaaccccctggtgtattgtgatggtcatggttgctccgtggccgtgcaccaggcatgttatggtatcgtgcaggtcccgacaggcccatggttctgcaggaagtgtgagagccaggaacgcgccgcaagggtgcggtgcgagttgtgccctcacaaagatggtgcgcttaagcggaccgataatggtgggtgggcccacgtagtttgtgccctgtatatccccgaggttcaatttgccaacgtgtcaacaatggaaccaatcgtgctgcagagcgtgccccacgatcgttataataagacttgctatatctgtgacgagcagggtagggagagcaaggctgctacaggggcgtgtatgacctgtaacaagcatggatgccgccaggcatttcatgtaacctgcgcccagtttgccggtctgttgtgcgaagaggaggggaacggggcagacaacgttcagtattgtggctactgtaagtatcacttctctaaactcaagaagtccaaaagggggtccaacagatcttacgaccagtcattaagtgatagctcctcccacagccaggataaacaccacgaaaaagaaaaaaaaaagtacaaggagaaggacaagcacaaacaaaaacacaaaaagcagccagagcccagccccgcattagtgccctcgctcacagtgaccaccgagaagacttatacctctacgtcgaataactccatttccggctcccttaaacgcctggaagataccacggcccgatttaccaatgcaaactttcaggaagtgtctgcccacacctcctccgggaaggatgtgagcgaaacaaggggttcggaaggaaaaggaaagaagagttccgcgcactctagcgggcagcgggggcggaagccaggaggtggccgcaaccccgggacaaccgtatccgctgccagtccttttcctcaggggagctttagcgggacccccggctcggtgaaatcgtcaagtggctcatcagtacagagccctcaggatttcctgtcatttacggacagcgatctgcgtaacgacagttactcccactcccaacagagctccgccaccaaggatgtgcacaagggtgaatctgggtcacaggagggtggcgttaacagctttagcaccttgatcgggcttccctcgacttcagccgttactagtcagccgaagagttttgagaatagtcctggcgacctgggtaacagtagtttgcccacagccggatataaacgcgcccagaccagtggcatcgaggaggagaccgtgaaggaaaagaaaagaaagggaaacaagcagtctaagcacggccccggacgtccgaagggcaacaaaaaccaggaaaacgtaagccatctgagtgtctccagtgccagcccaacctcctcagtggccagcgctgctggtagtattacctccagtagcttgcaaaagtccccaaccctcttaagaaacggctccctgcagagcttatcagtgggctcaagcccagtgggatctgagatttccatgcaataccggcatgatggcgcatgtcctactaccacattctctgagctcttaaacgccattcataatggcatatacaattcgaatgacgtcgcagtttccttccccaacgtggtttcaggcagcgggtcctccacacctgtcagttcaagccatctgcctcagcagtcgagcgggcatctgcagcaagtgggggcactgagccccagcgccgtgagcagtgcagctcccgccgtggccaccactcaggctaatacgctctccggatcatcactgtctcaggcaccttctcatatgtacggcaaccgctccaattcttccatggccgcccttatcgcgcagtctgaaaataaccaaacggatcaggatctaggcgacaacagtagaaatcttgtcggtcgtggctcatctcctcgcggcagcctgagccctaggtccccagtcagcagcctgcagattaggtatgatcaacctggaaacagcagcctggaaaacctgccccctgtcgctgcatctatcgaacagctcctcgagcgacaatggtcagaaggtcagcaattcctgctggagcaaggcactccatctgacattctggggatgctgaaatcactgcaccaacttcaggtggaaaatcgacggctagaagagcagattaaaaatctgacagcaaaaaaggagcgcctgcagctactgaatgcccagctcagcgttccgttcccaaccattactgcaaatccatccccgtcgcaccagatccatactttcagtgcgcagactgcaccgaccaccgattcgctcaactctagcaaatctccacacattggtaatagcttcctgcctgacaatagcctgcctgttctaaaccaggatctcacatccagtggccagagcacttcctcttccagcgccctatccacgccccctccagccggccagtcacctgcccaacaggggagtggcgttagtggcgtccagcaggtgaatggcgtcaccgtcggcgcactcgcttctggaatgcagcccgtgacatccactattcctgccgtctccgcagtcggcggcattatcggcgctctgccaggcaatcagctcgcaatcaacggcatcgtcggggccctcaacggagtgatgcaaacccctgttacaatgtcccaaaatcctactcccttaacacacacaacggtgcctccaaacgcaactcatccgatgcccgcgacactgaccaacagcgcgtccggtctggggttgctatctgatcagcagcggcagatcttgattcatcaacaacagttccagcagctgctcaattcccagcagctaacgcccgttcaccgccacccccactttacacaactccctcctacccatttctccccgagtatggagatcatgcaggtccgcaagtag

SEQ ID NO: 16982 - DNA, 3786 bp, Artificial Sequence
  Description of Artificial Sequence: Synthetic coding sequence
atggccgccgccgccgcctctggcgcaggtggggctgctggagcaggtaccggcggcgctggaccagctgggaggctcctcccacccccagcgcccggaagcccagctgcacccgcagccgtgtcgccagcggccggtcaaccgcgacccccggcccccgctagcagaggaccaatgccagcacgcatcggatactatgagatagatcggaccattgggaagggcaatttcgcggtggtgaagcgggccacccacctagtcactaaggcaaaggtcgcgatcaaaattattgataaaacccaattagacgaggagaatttaaagaaaatcttccgggaggtacagatcatgaaaatgctttgtcaccctcatataatacgtctgtaccaggtgatggagaccgagcgcatgatctacctcgttacagaatatgcatcaggcggagaaattttcgatcacctggtggctcacggaaggatggccgagaaggaggcccgtcgtaaatttaaacagatcgtgaccgcagtatatttttgccactgccggaacattgtgcatagggatttaaaggcggagaatcttctgctggacgctaatctgaatataaagatcgcggatttcggtttctcaaacctgtttacgccaggacaactgctaaaaacctggtgcggctcaccgccatacgccgctcccgagttgtttgaaggcaaggagtacgatggtccaaaggtcgatatttggagtctgggtgtagtgctatacgtgctggtgtgtggggctctgccgtttgacggctccacattacaaaacttgagagcccgagtgttgagcggcaaattccgtattcctttcttcatgagtacagaatgcgaacacttgattcgacatatgctggtgctcgaccccaacaagagactgtcaatggagcagatatgcaagcataagtggatgaaactaggagatgccgaccctaactttgaccgattaattgctgagtgtcagcagttgaaggaagagcggcaggtggatccgttgaatgaggacgtgctcctggccatggaggacatggggctcgacaaagaacaaactctgcaggcagagcaggctggtaccgctatgaacatcagtgtgccacaggtccaacttatcaatcccgagaatcagattgtcgagccagatggaacattaaacctagacagtgacgagggggaggagccttcccctgaggctctcgtcaggtacctgtcaatgcggcgccacaccgttggcgttgcggaccctcgcaccgaggtgatggaggatcttcaaaagctgttgccaggctttccaggggtcaatccacaagccccctttctccaggtcgcccctaacgttaacttcatgcacaacctgctgcccatgcagaaccttcagcctacggggcagctcgagtataaagagcagtccctactgcagccgcccactctacagttgctgaacggtatgggacccttaggacgcagagcctcagatggtggcgctaacattcagctacatgcccaacagctgctgaaacgtccacgggggcccagcccactggtcactatgaccccggccgtaccagccgtaacacccgtggacgaggagagcagcgacggagaacccgatcaggaggcggtgcaacgctatcttgcaaaccgtagcaagaggcacactctcgccatgacaaatcccactgccgagatacctccggacctccagcggcagttgggccagcagccctttagatctagggtctggcccccccacctcgtgcccgatcagcataggtcgacctacaaagactccaatactctccacctgcccactgagaggttcagtcctgtacgtcgcttctcagatggcgccgcatccatccaggcattcaaagcacacttggaaaaaatggggaacaactcttccattaagcaacttcagcaggagtgcgagcagctgcagaagatgtatggcggccaaatcgacgaaagaactcttgagaagacacaacagcaacacatgctgtatcaacaggagcaacatcatcagattcttcaacagcaaatccaagattctatctgcccaccgcagccctccccccccctgcaggccgcgtgtgagaatcagcctgccctgctcacccaccagttgcaacggctccggatccagcccagctctccacctcctaaccaccccaacaatcaccttttcaggcagccatctaattctcctccgccgatgagctcagctatgatccagccccatggcgcagccagcagctcccagtttcagggtctgcccagtcggtcagcaatctttcagcaacagcccgaaaactgctctagtccacccaacgtcgctctgacatgcctgggaatgcagcaaccagcgcagtctcagcaggtcacaattcaggttcaggaaccagtggacatgctctctaacatgccaggaacagcggccggtagttcaggaagaggcatcagcatatcaccttccgccggacagatgcagatgcagcatagaacgaacctgatggcgacattaagctacggtcaccggcccctttctaaacagctctccgctgattctgcagaggcacacagtgcccaccaacaacccccacattatacgacctctgcgctccagcaggctctactgagccctacaccacctgactatacgaggcatcagcaagtccctcacattctgcagggtctgttgtccccaaggcactcattgacaggccactcggacatccggctgccgcccaccgaattcgcccaactcattaagcgacagcagcaacagcgtcagcagcagcagcagcagcagcagcagcaggaatatcaggagctctttcgccatatgaatcaaggcgacgcaggaagccttgctccctctctgggcggccagtccatgaccgagaggcaggctctgtcatatcagaatgctgactcataccaccaccacacaagcccccagcacctcctccagatcagagctcaggagtgtgtgtcccaagcctcttcaccaactcctccgcacggatacgcccaccaacccgctctgatgcattccgagtccatggaagaggattgttcttgcgagggggcaaaggatggttttcaggattcaaaatcatcgtcgactctgaccaaaggctgtcatgattcaccacttctgctgagcactggggggcccggggaccctgaatctctgttggggacggtaagccacgcgcaggaactggggattcacccatacggccaccagcctacggccgcattctccaagaataaagtgcctagccgcgagccggtgattgggaattgcatggatagatcatccccggggcaagcagtagaacttccagaccacaacggtctggggtaccctgccaggccatctgtacacgagcatcatcggcccagagctctgcagcgtcaccacacgatccagaattcagatgatgcctatgtgcagctggacaatctccctggtatgtccctggtggccggcaaggccttaagtagcgcccggatgtcagacgctgtgctctcacagagttcacttatgggctcacaacaattccaggatggcgagaatgaagagtgtggcgccagtttgggcggccacgaacaccccgacctgagtgacggatcacaacatcttaatagctcctgctaccctagtacgtgtatcaccgacattctgctgagctataagcaccctgaagtctcttttagcatggaacaggccggagtttag

SEQ ID NO: 16983 - DNA, 519 bp, Artificial Sequence
  Description of Artificial Sequence: Synthetic coding sequence
atgtcttctaacgagtgtttcaaatgcgggcggtctggacactgggcacgcgagtgtccaacaggagggggaaggggtaggggcatgagatctcgcgggcgcgggtttcaattcgtgagctccagcctgccagacatttgctatcggtgtggcgagtctggacacttagctaaagattgcgacctgcaagaggacgtcgaggcttgctacaactgtgggcgcggcggacacattgctaaggattgcaaggagccgaaaagggaacgggagcagtgctgctacaactgcgggaagccaggccacctcgctagagactgtgatcacgccgatgaacagaaatgttattcttgtggcgaatttggacatatccagaaggactgtacaaaagtgaagtgctatcggtgtggtgagacaggacatgtggccatcaactgtagcaagaccagcgaagtcaactgttacagatgtggcgaatcaggccatttggcccgcgaatgtaccattgaggcgacggcctag

SEQ ID NO: 16984 - DNA, 471 bp, Artificial Sequence
  Description of Artificial Sequence: Synthetic coding sequence
atgcttgctgagaagttacccaatctgactcacttgaacctgagcggaaataaactcaaagacattagtacactcgagcctctcaagaagctggagtgtcttaaaagcctcgatctgttcaactgtgaagttaccaatctgaatgactatcgggagtctgtgttcaaacttctgcctcaactcacatacctggatggctacgatcgggaagatcaagaggcacccgattctgacgcagaagtcgacggagttgatgaggaggaggaagatgaggagggcgaggatgaggaggacgaggacgatgaggatggcgaggaggaagaatttgacgaagaggacgacgaagatgaagatgttgaaggcgacgaagatgacgacgaagtctcagaagaagaagaggagtttggcctggatgaggaagacgaggatgaggatgaggatgaggaggaagaggaaggaggcaaggggtag

SEQ ID NO: 16985 - DNA, 516 bp, Artificial Sequence
  Description of Artificial Sequence: Synthetic coding sequence
atgtcctccggtaacgcgaaaattgggcatccagcgcccaactttaaagccacggctgtgatgccagacggccagtttaaagacatatccctctccgactataaaggaaaatatgtggtctttttcttctaccctctggattttaccttcgtgtgtcctacagaaatcatcgctttttcggaccgcgcagaagaattcaagaaactcaattgccaggtcattggggcctcggtggacagtcacttttgtcatctggcatgggtcaataccccgaagaagcagggtggtctggggccaatgaatatccccctggtttccgaccctaaacgcaccattgctcaagattacggcgtgctgaaagcagatgagggaatatcctttaggggactcttcattattgatgacaaggggattctccgccaaataaccgtgaacgacctccccgtgggccgatccgttgacgagaccctacggttggtgcaggcattccaatttaccgacaaacacggagagtag

SEQ ID NO: 16986 - DNA, 111 bp, Artificial Sequence
  Description of Artificial Sequence: Synthetic coding sequence
atgatcgaaaaaatgcaggggtcacgaatggacgagcagcgctgcagctttcccccccccctgaagactgaggaagactatatcccctatccaagcgtgcacgaagtctag

SEQ ID NO: 16987 - DNA, 639 bp, Artificial Sequence
  Description of Artificial Sequence: Synthetic coding sequence
atgtcttccaaaggctcatcaaccgatggcagaactgacctcgccaatggctccctcagctccagccccgaggagatgtcaggagctgaggaaggtagagagacatcctcaggaatcgaagtcgaagcatctgacctgagcctttcactgactggcgatgacggcggtcctaataggactagtacagaaagtagaggtacggacactgagtcctctggggaggacaaagattccgattcgatggaggatacgggccactattctatcaacgatgagaaccgcgtgcacgatcggagtgaggaggaagaggaggaagaggaggaggaagaagaggaacagccacggaggcgagtacagagaaaacgcgctaacagggatcaggactctagtgatgacgaacgggctcttgaggactgggtatcttccgaaaccagcgcccttccgcggccaaggtggcaagccctgcctgccctccgcgaacgtgaactcgggtcctctgctcgcttcgtatacgaggcttgtggggcccgtgtttttgtccagcgattcaggctgcagcacggccttgaggggcataccggctgtgtgaacacgcttcatttcaaccaacgaggtacctggcttgccagcggctcatag

SEQ ID NO: 16988 - DNA, 726 bp, Artificial Sequence
  Description of Artificial Sequence: Synthetic coding sequence
atgaccagtgtcacccggtccgaaataatcgatgagaaaggacctgttatgagcaaaacccacgatcatcaacttgaatcttccttgagccccgtggaagtgttcgcaaaaacttctgcgtctctggagatgaatcaaggagtgagtgaagaacgcattcatctcggcagcagcccaaaaaagggcggcaactgcgatctctcgcatcaggagagactgcagtccaagagcctgcacctaagccctcaggaacagtccgcatcttaccaggaccgacggcagtcatggaggcgagcatcaatgaaagaaacaaaccgtagaaaaagcctccatcccattcatcagggaatcacagaacttagtagatcaattagcgtggatctggctgagagtaagaggctcggctgtctgcttctctcgtctttccaattcagcatccagaagctggagccttttctgagagacactaagggcttttccttggagtcatttagggctaaggcaagctctctatccgaggagttgaagcacttcgccgatgggctggagacagatggtacgctccagaagtgtttcgaggactcaaatgggaaagctagcgacttcagtctggaggctagtgtggctgaaatgaaggagtacattacaaagttttctctggagaggcaaacttgggaccaactgctcctccactaccagcaggaggctaaagagatcctttcttag

SEQ ID NO: 16989 - DNA, 1188 bp, Artificial Sequence
  Description of Artificial Sequence: Synthetic coding sequence
atggcttcggccgcttctgtcaccagcctcgccgatgaagtaaattgcccaatttgccaggggactttacgggagcctgtgacaatcgactgtggacacaatttctgtcgcgcttgcctgacgagatactgcgagattcccggaccggacctggaagagtccccaacatgtcccctttgcaaagagccttttcggcctggatcctttagacccaactggcagttggcaaacgtggttgaaaatattgagaggctgcagcttgtttccaccttgggcctcggagaagaggacgtttgccaagagcatggcgagaagatttacttcttttgcgaagatgacgaaatgcagctgtgtgtggtatgtcgcgaggcgggagagcacgcaactcacacaatgcgattcctagaagatgccgcggcaccataccgcgagcagattcataagtgcctgaaatgcttgaggaaggagagagaagaaatacaggagatccaatcacgcgagaataaacggatgcaagttttactcacgcaggtgagtactaaacgccagcaggttatcagtgagtttgcccatctcaggaaatttctggaggagcagcagagtattctgctggcccaactggaaagtcaggatggggacatcctcagacagagagatgagtttgatctgctggtggctggagaaatctgtcggttttcagcacttatcgaagaactggaagagaagaacgaaaggccggccagggagttactgaccgacatccgctccactctgattcggtgtgaaacccgtaagtgcaggaagcctgtggctgtgtcacctgagctgggacaacgcattcgggactttccacagcaagcgctccctctgcaacgggaaatgaagatgtttttggagaagctctgttttgaactggattacgaacccgcgcacatctctttagacccgcagaccagccaccccaagctgctcctcagcgaagatcaccagagagctcaatttagctacaagtggcagaatagtcccgataacccccagagatttgatcgcgccacttgcgtgctggcacacaccggcataacaggcggccgacacacatgggtttggatggctcgtgtgcctggtgactcaggatgttgccaattctgttctcccccaagcgtgctcgggactgaagtggccgcatag

SEQ ID NO: 16990 - DNA, 1887 bp, Artificial Sequence
  Description of Artificial Sequence: Synthetic coding sequence
atgagcgacaaatctgatcttaaggcggagctggagagaaaaaaacagagactggctcagatccgtgaagagaagaagcgcaaagaggaggaacgcaagaagaaagaagctgacatgcagcaaaaaaaggagcccgtacaagacgacagtgacctggatcgcaagcgtagggaaaccgaagctctcctgcaatcgataggaatctcccccgaaccgcccttagttcccacccctatgtccccttcttctaaaagcgtctctacacccagtgaggcagggagtcaggattccggcgatctcggtcccctcacccggaccctgcagtgggacaccgatccctctgtgctgcaacttcagtccgacagtgaactgggccgacggctccacaaacttggagtcagtaaggtgacgcaggtggacttcctgccacgtgaagtcgtcagttattccaaggaaactcagacccctctggcaacgcatcagtcggaggaagacgaggaagatgaagaaatggtcgaaagtaaagttggccaagattcagagctggaaaaccaagataaaaaacaggaggtgaaggaagcgccccctagggaactcaccgaggaagagaaacaacagatccttcatagcgaggaatttctgatcttcttcgataggacaatcagagtgatcgagagagcactggcagaggattcagacatcttttttgattactcgggacgggaattagaggagaaggacggtgacgttcaggctggggcaaacctatctttcaatcgtcagttttatgacgagcactggtccaaacaccgagtcgttacatgtatggactggtctctgcaataccctgagctgatggtcgcctcctacaataataatgaggatgcaccacacgagcccgatggggtcgctctagtatggaacatgaagtttaagaagactacaccagaatatgtgttccattgccagagcagcgtaatgtctgtgtgcttcgcgcggtttcatccaaatctcgtcgttgggggtacatatagtggccagatcgttttatgggacaaccgcagtcaccggaggactcctgtccagaggacacctctgtcagccgcagcacacacacatccggtgtattgcgtcaatgttgtgggcacccagaatgctcacaacctgattacggtctcaaccgatggcaagatgtgtagctggtccctggacatgctgagtactccccaggaaagcatggaactggtgtataacaagtcgaagcctgttgcagttaccggcatggccttcccaacgggcgacgtcaataacttcgttgtagggagtgaggaaggaactgtctacaccgcctgtcgccacgggtcaaaagcagggataggagaagtcttcgagggacaccagggaccagtgacaggaatcaattgccacatggccgtgggccctatcgacttcagccatctgttcgtgacctccagttttgattggacagttaaactctggacaacgaaacacaacaaaccattgtactcattcgaggacaatgctgactatgtctatgacgtcatgtggtctcctgtgcatcctgccctatttgcttgcgttgacgggatgggccgacttgatttgtggaacctgaataatgacaccgaagtaccaacagctagtgtggctattgaaggtgctagtgcactcaatagggtacggtgggcacaagccggtaaggaggtggccgttggtgactccgagggacgaatttgggtctacgatgttggcgagcttgcagtccctcacaatgacgagtggacacggtttgctcgtacccttgttgaaattcgcgccaatagagctgacagcgaagaagagggcacagtagagctatccgcctag

SEQ ID NO: 16991 - DNA, 1644 bp, Artificial Sequence
  Description of Artificial Sequence: Synthetic coding sequence
atggcggggaccaaaaataagacacgagctcaggccaagacggagaagaaagcagccattcaggcgaaggcgggggctgagcgcgaggccacaggtgttgttagacccgtcgccaaaactcgggctaaggccaaggccaagactggttctaagacagatgctgttgctgagatgaaagccgtttccaaaaacaaggtggtggcggaaaccaaggagggagcgctcagcgaacccaaaaccctcggcaaggcaatgggcgacttcacccctaaagctggaaacgaatctacaagcagcacctgtaaaaacgaggcaggaaccgatgcatggttttgggcaggggaggaggcgaccattaacagctggttttggaatggggaggaggcaggtaattctttctcaactaaaaacgacaagccagaaatcggtgcgcaggtttgcgctgaagaacttgaacccgccgccggggctgattgcaagcctaggtcaggcgccgaagaagaggaggaagaaaatgtcatagggaactggttctgggaaggagatgacacttctttcgaccccaatcctaaacccgtctctaggattgtgaaaccccagccagtttacgaaattaacgaaaagaaccggcccaaagactggagcgaggtgacaatatggccaaacgcacctgcagttactccagcagtgcttggctttagaagccaagctcccagcgaagcttcccccccatcgtacattgtattagcttctgctgaggaaaacgcctgctcactgcccgttgccacagcctgtcgaccgagtcggaatacgaggtcttgctcgcagcctattcctgagtgccgatttgactctgatccgtgtatccagaccatcgatgagatccgccggcagatcagaatacgcgaggtaaacggcattaagccttttgcctgcccatgtaaaatggagtgttatatggactcagaagagtttgagaagctcgtgagtctgttaaagagtacaaccgaccctttaatccataagatcgcgagaattgctatgggcgtccacaatgtgcacccttttgcccaagagttcatcaatgaggtaggagttgtgacactaattgagtcgttactgagttttccttctcctgagatgcgtaaaaagaccgtcattaccttaaatcctccgagtggcgatgaacgccagcggaagattgaactacacgtgaaacatatgtgcaaagaaactatgtctttcccactaaactctcccggacagcagagcgggttaaaaatccttggccagctgaccaccgacttcgttcatcactacattgtggccaactacttttctgagttattccatttgctatccagcggcaactgtaagacccgcaaccttgtgctcaagctcttgttaaacatgtctgagaacccaaccgccgcgcgtgacatgattaacatgaaggctcttgctgcccttaagcttatttttaatcaaaaggaggctaaggccaaccttgtgtcaggcgtcgccatctttataaacatcaaggagcacattagaaagggctcaatcgttgtcgtggatcacctcagttacaataccctcatggccatatttagagaggtgaaagaaatcatcgagactatgtag

SEQ ID NO: 16992 - DNA, 747 bp, Artificial Sequence
  Description of Artificial Sequence: Synthetic coding sequence
atggcctttagcggtcgggctaggccttgcatcatcccagagaacgaagagatcccccgcgccgcactcaacactgtccacgaggccaacggtaccgaggatgagagggccgtgagcaagcttcagcggcgacacagtgatgtgaaagtatataaagagttctgtgacttctatgcaaaatttaacatggctaatgcccttgcgtcggcaacctgcgagcgttgcaagggtggctttgcaccagcagaaactattgtaaactctaatggggaactttaccacgaacagtgctttgtgtgtgcacagtgcttccagcagttcccggagggtttgttctacgagtttgaggggcggaagtattgcgagcacgacttccagatgctgttcgctccgtgctgccaccaatgcggggagtttatcattgggagagttatcaaggccatgaataacagttggcatcccgagtgcttccgatgcgatctttgccaggaggtgttagccgatattggcttcgtgaagaatgcaggccgccacttgtgtaggccgtgtcataatagggagaaagcccgcgggttaggcaagtacatatgtcaaaaatgccacgccatcattgatgagcagccgctcatcttcaaaaacgacccttaccaccccgatcacttcaactgtgcaaactgcggacaggagggctcggattgtcggtgtaccggagccgagaggggcgccattctgcctgcaatgccttag

SEQ ID NO: 16993 - DNA, 621 bp, Artificial Sequence
  Description of Artificial Sequence: Synthetic coding sequence
atggaaagcaattttaaccaagaaggcgtgccaaggccaagctatgttttttctgcagatcccattgcccggccatctgagatcaacttcgatgggatcaagctcgatctgtcccatgagttttctctcgttgcgcccaataccgaggctaactcctttgagtcgaaggactatttacaggtgtgccttcgcatccggccctttacccagtcagaaaaggagctggagtccgagggctgcgtgcacattctcgactctcagacagtggtcctgaaggaacctcaatgcatcctgggacgcctgagtgaaaaaagcagcggccaaatggcccaaaaattctctttctcaaaagttttcggccccgccaccactcagaaggaatttttccaagggtgtattatgcagcccgtcaaggatctcctcaaggggcagtcccggctgatctttacctacggactgacgaactctggcaaaacctacaccttccagggtactgaagagaacattgggatccttcctcgcaccctgaacgttctgttcgattctttgcaggaacgtctttatactaagatgaatctcaaaccacaccgtagtcgggagtatctccgtctcagttcttag

SEQ ID NO: 16994 - DNA, 990 bp, Artificial Sequence
  Description of Artificial Sequence: Synthetic coding sequence
atggaagtcgcggaaccatcatcaccaacagaggaggaagaggaggaggaggaacactccgccgaaccacgacctaggaccaggtccaacccggagggtgccgaggaccgggcggttggcgctcaggcttccgtgggctctcgttctgagggtgaaggtgaggctgccagcgccgacgacggtagtctgaacacatccggggcggggcccaagtcatggcaggttccaccgccagcccccgaggtgcagatcagaacgcccagagtgaactgtcccgagaaggtcatcatatgcttggatctgagcgaggagatgtctctccccaagctggaaagttttaatggctcaaaaacgaatgcccttaacgtgagtcagaaaatgatcgaaatgttcgtacgaaccaaacacaagatcgataaatcccatgagttcgctttggttgtcgtgaacgatgacactgcatggctgtctgggctgacctccgatccaagggagctctgctcatgcctatacgatttagagaccgcctcttgttctacttttaacatcagcggcgccagccccgctaggcagcagaagactgaactgcccgtaacagaaaatgtgcagaccattccacctccttacgtggtcaggactattctggtctactcccggccaccctgccagcctcagttctccctgacagagcccatgaaaaaaatgttccagtgtccctactttttcttcgacgtggtgtatattcacaacggaactgaggagaaggaagaagaaatgagctggaaggacatgttcgccttcatgggatcccttgatacaaaggggacgagctacaagtatgaggtggccttagccggacccgcccttgaactccataattgcatggccaaactgttggctcaccctcttcagcgtccctgccagagtcacgcaagttactccctgctggaagaagaggacgaggccattgaggtggaagccacagtgtag

SEQ ID NO: 16995 - DNA, 1620 bp, Artificial Sequence
  Description of Artificial Sequence: Synthetic coding sequence
atggctacatctgccccactgaggtctctcgaagaggaagtgacttgttctatctgtttggactacctcagagatcctgtgaccattgattgtggacacgttttctgccgcagctgcacaacagacgttcgcccaatttctggttcaagacctgtctgtccgctgtgcaagaagcccttcaagaaggagaatatcagacctgtgtggcagctcgcgtccttagtggaaaatattgagagactgaaagtagacaaggggagacaaccgggggaggtcaccagagagcagcaagacgctaagctctgtgagcgccacagggagaaactgcactactactgtgaagatgatggtaaattgctatgtgtaatgtgtcgtgagtctcgggagcatcgtcctcacacagcagtgctgatggaaaaggcagctcagccccatcgtgaaaagatcttaaaccacctctctaccctgaggagggacagagacaagatccagggctttcaggccaagggagaggctgacatcctcgctgcactaaagaaattgcaggaccagcggcagtacattgtagccgaattcgagcagggccatcaattccttagggagcgggaggaacatttgctggaacagctggcgaaattggagcaggagctcactgagggacgggaaaagtttaagtctcggggagtcggggagctggcgcgcttggcactggttataagcgaactggaagggaaggctcagcagcctgctgccgaactgatgcaggatactcgggacttcctgaatcggtatccccggaagaagttttgggtcgggaagccaattgccagagtggtgaagaagaagactggtgaattttctgataagttgctttccctgcaacgcggcctaagagagtttcagggtaaacttctccgcgatctcgaatataagaccgtcagtgtcacacttgacccccaatccgcatccggctatctgcagctgagcgaggactggaaatgtgtaacgtatacaagtctgtacaagagcgcgtacctgcacccacagcagttcgactgtgagccaggcgtgttgggctctaaggggtttacttggggtaaagtgtactgggaggtcgaagtggagcgtgaggggtggagcgaagatgaagaggagggcgacgaggaagaggagggtgaggaggaggaagaagaggaagaggccgggtatggcgatggttatgatgactgggagaccgacgaagacgaagagtccctaggcgatgaggaagaggaagaggaggaagaggaagaggaggtcctagagtcatgtatggtgggcgtcgcccgggacagcgtgaaaaggaaaggtgatctgagtctccgacccgaggacggggtatgggcgctgagattgtcttcctcaggcatctgggctaatacgtcacctgaggcggaactctttcctgcactgcgccctcgcagggtgggaatcgcgctagactacgaaggcggtacggtgacgtttacaaacgctgagagccaggaactgatatacacctttacagctactttcactcggaggctggtacccttcttgtggctgaaatggccagggacgagactattactaaggccttag

SEQ ID NO: 16996 - DNA, 3558 bp, Artificial Sequence
  Description of Artificial Sequence: Synthetic coding sequence
atgtgtgaggtcatgcctactataaacgaaggcgacaggttaggtcccccccatggtgccgacgccgacgcgaacttcgagcagctgatggtgaatatgctcgacgaacgagaaaagttactggagagcctgagggagtcccaagaaaccctggcagcgactcagtcccgcttgcaagatgccattcatgagagagatcagctccaaagacatctcaactccgccctcccgcaggaattcgcgacattgaccagggagttgagcatgtgtcgggagcagctcttggagagggaggaggagataagcgaactcaaggctgaacggaacaacactcgtctgctcctagagcacctggaatgccttgtgagccggcacgaacgctctttgaggatgactgtggttaaacgtcaagcccagagtcccagcggcgtgtcctccgaggtggaggtgcttaaagcactgaagtctctgtttgagcatcataaagctctggatgagaaggtgcgtgaacggcttagagcagccttggagcgcgttacgactctggaagagcagctagctggggcccaccagcaggtcagcgcactgcagcagggtgcaggagtccgcgatggggctgctgaggaagagggaacggttgagctcggccctaagcggttgtggaaagaggacacagggcgggtcgaggaactgcaagagctcttggagaagcagaattttgagctctctcaggcaagagagaggttagtgaccctaaccaccactgttaccgaactggaggaggacctgggcaccgcccggagggatcttattaagagtgaggaactgtcttctaaacaccagagggacctcagggaggctctggcacagaaagaggacatggaggagcggattaccacattggagaaacgctatcttgcagcccagcgggaagctacctcaatccacgatctgaatgataagctggaaaacgaactagcaaacaaagaatccctgcataggcaatgtgaggagaaggcccgacacctgcaagaattgctagaagtagcggaacagaagctgcagcagactatgcgcaaagccgaaaccttgcctgaagtggaagccgaactggcacagaggatcgcagccttgacaaaagcagaagaacgacatggaaacattgaagagcacttgcgacagcttgagggtcaactggaggaaaaaaaccaggaactggcaaggactgcagtccaggttcggcaacgtgaaaaaatgaatgaggatcacaacaagcggctctcggacactgtcgataggctgctgtctgagtctaacgagaggcttcaactgcatctcaaggaacgtatggccgctttggaggaaaagaacaccttgattcaggagctggagtcctctcaacgtcagattgaagagcaacatcaccacaaaggacgcctgtccgaggagatcgagaagcttcgacaggaagttgatcagttgaaggggcgcggtggcccattcgtggacggagtccacagtagatcacatatgggatctgctgctgacgtgcgctttagtctcggcacaacaacccacgcccctccaggtgtgcaccggaggtactccgcactacgcgaggaatccgccaagctagctcttcctttgactgtgacccttcgctcaccgacgtggatgcgcatgtcccagggagtgtgttgcaaccttgaatatcacagtagcggcaccctgtgcgggtcctctgggccactgccagtgccagagatgatccaggaggaaaaggaatctaccgaacttcgagctgaagagattgaaacaagagtcacttcaggatcaatggaggccctgaacttaaagcaacttcgtaaacgggggtccatcccaacttctttgaccgccctctcactggcctcggcctcaccaccattgagtggcaggtcaacgcctaagctcacctcacgttccgctgcacaggatttagaccggatgggggtcatgacactgccaagcgatttacgaaaacacagacggaagctgctaagcccggtttcccgggaagaaaaccgtgaggacaaagcaaccattaagtgcgagactagtcctccgagctccccacgcacactacgccttgaaaaattgggccacccagccttaagccaggaggaagggaaatccgctctggaagaccagggcagtaacccgtcttcttccaattcctctcaggatagtcttcataagggggctaaaagaaagggcatcaagagttctatcggccgccttttcggtaagaaggagaaaggacgcctgatccaactctctagagacggtgccactggtcacgtgctcctcaccgatagtgaatttagcatgcaggagcccatggtacccgctaaactcggcacacaagccgagaaggatcggcgattgaaaaaaaaacaccaactgcttgaggacgcccgtcgcaagggcatgccctttgcccaatgggacggcccaactgtggtgtcatggctcgagctttgggtcgggatgcccgcctggtatgtggccgcatgcagagcaaatgtcaagagtggcgctattatgagcgcgttgtccgataccgaaatccagcgcgaaattggtattagcaatgcccttcaccgcctgaaactaagactcgctatccaagaaatggtgtccttgaccagtcctagtgcaccacccacctcacgaacaagctccggtaacgtgtgggtcacacacgaggaaatggaaaccctggaaacaagtactaaaacagactcagaggaggggtcctgggcccagactctggcctacggggacatgaaccatgagtggatcgggaatgaatggttaccctctctgggtcttccacaataccgaagctatttcatggagtgcctggtggacgctcgcatgcttgaccaccttacaaaaaaggatcttagagttcatttgaaaatggtggatagctttcatcggactagcttacagtacggaatcatgtgtctcaagcgcctgaactatgacaggaaagagctggaaaaaaggcgcgaagagagccagcacgagattaaggatgtgttggtgtggaccaacgaccaggttgtgcattgggttcagtctattggcttaagggactatgccggaaatcttcatgaatctggcgtgcacggcgcactcctggcattggacgaaaactttgatcataatactcttgctctgatcttacagattcccacccagaacacccaggctcgtcaggtgatggagcgggaattcaacaacctgttggctctcgggacagaccggaaactggacgacggggatgataaggtgttccgcagagcacccagctggagaaagaggtttagaccacgggagcaccacggtaggggcgggatgcttagtgccagtgcagagactctgcctgcgggctttagggtgagtacactgggcaccctacagccccctccggcgcccccaaagaagatcatgcccgaagcacactcccattatctttacggccacatgctctctgccttcagggattag

SEQ ID NO: 16997 - DNA, 1383 bp, Artificial Sequence
  Description of Artificial Sequence: Synthetic coding sequence
atggaaatatgtgacattattaacgaaaccgaggagggtccgaaagatgcccttagagccgtgaagaagcggattgtgggcaataaaaattttcatgaagttatgctagcactcacagttctggagacctgtgtgaaaaactgtggtcaccgcttccacgtgctagtcgcttcgcaggactttgttgagtccgtgctggtgcgaaccattctaccgaaaaacaacccacctacaatcgtgcatgacaaggtgctgaacctgatacagtcatgggcagacgccttcaggtccagccctgacctgaccggagtggtgactatctatgaggacctgaggcgaaaaggcctggagttcccgatgaccgaccttgacatgctgagccctatccatactccgcaaaggaccgtgtttaactctgagacacagtctgggcaggactcggtgggaactgattcctcccaacaggaagacagcggtcagcatgcggccccacttccagctccaccaatactgtccggagataccccaattgcgccaacgccagaacaaatcggtaaactccgctcagaattggaaatggtgagtggtaacgtgcgtgtgatgagtgagatgctcacggagcttgtgccgactcaagccgagcccgccgatctggagctcctgcaggagctgaatcggacttgccgagccatgcagcagcgcgtgctagaactgatcccccagatcgccaatgagcaactcacagaggagctgctgatcgtgaacgacaacctaaacaacgtgttcttgagacacgaacgcttcgagcgattccgcaccgggcagacaactaaggcgccgagcgaagccgaacccgccgcggacctgatcgacatgggacccgaccctgctgccaccgggaacctcagcagccagctcgcggggatgaatttgggcagctcaagtgtccgggccggactccagtctctcgaagcaagcggcaggcttgaagatgagttcgacatgttcgccttaacacgtgggtccagtctggccgaccaaaggaaggaggttaaatacgaagcccctcaggctactgatgggctggctggagctcttgacgcaagacagcaatcgacaggcgccatccccgttacgcaggcttgccttatggaggatattgagcaatggcttagtacagacgtgggcaatgatgctgaagagcctaaaggcgtaacaagtgaggggaagttcgacaaatttctggaagagcgtgctaaagcggccgatcgtctgcccaatttgtcttctccttcggctgaaggacccccaggaccaccctccggaccagccccgaggaagaagactcaagaaaaagacgacgatatgttgttcgcgctgtag

SEQ ID NO: 16998 - DNA, 180 bp, Artificial Sequence
  Description of Artificial Sequence: Synthetic coding sequence
atgatgatgaagatgatgatgcggatgaaaatcagaaaaatccgctaccattgtcagaggaagcagaaccttattcacaataacggcaacggcctgggctccgtgcctgtggagaagctggtccttcacccttctccaatccaaaacccccagcaaagtgccgtcgtgtcatgcgaatag

SEQ ID NO: 16999 - DNA, 537 bp, Artificial Sequence
  Description of Artificial Sequence: Synthetic coding sequence
atgctgggcctggacgcatgtgagctgggcgcgcagcttctggaactgcttcggctcgccctttgtgcaagagtcctgttggctgataaggagggtgggcctcctgctgtagacgaggtcctggatgaggccgtccctgaatacagggcaccaggacggaagtcgctgttggagataaggcagctcgatccagatgacagatcgctcgccaaatacaaaagggtgctgctgggacccctaccacccgctgtcgaccccagtctacccaatgttcaggtgacaaggctgacacttctttccgagcaggcccccgggccggtggtgatggatttaaccggcgacctggcagtccttaaagatcaggtatttgtcctgaaggagggggtggactaccgggtgcacagagagatcgtgtcagggctgaagtgtctgcatcatacgtatcgtcggggtctgagggtggataagaccgtgtatatggttggatcatatgggccatccgctcaagaatatgagtttgtcacccccgttgaatag

SEQ ID NO: 17000 - DNA, 1119 bp, Artificial Sequence
  Description of Artificial Sequence: Synthetic coding sequence
atggactcagttagaagtggccccttcggccaagtgtttcgcccggataatttcatcttcggccagtgcggcgcggggaataattgggcgaaggggcattataccgaaggggccgaacttatggaatccgtgatggatgtggttcgaaaagaagctgagagctgcgactgtctgcagggcttccaattgactcattccctgggtggcgggacaggcagcggcatggggacccttcttttgagcaagatccgcgaggaatacccagaccgaataattaacaccttttcaattctgccaagccccaaggtgtctgacaccgtggtggagccctataatgccaccttgtccgttcaccagctgatcgaaaatgcagacgaaaccttttgcatcgacaacgaagctctttacgatatctgctctaaaactctgaaactcccaaccccaacatatggagacctgaatcacctggtgagcgccaccatgtccggcgtgaccacttgtctgcggtttcccggccaacttaatgccgatctgcggaaactagcggtgaatatggtaccctttcctcgcttacacttcttcatgccaggctttgcgccattgacatctagggggtcccagcagtaccgcgcgttaaccgttgccgaactgacccagcaaatgttcgatgcgaaaaacatgatggctgcctgtgacccacgacacggccggtacctgacagcagccgcgatcttccgcggcagaatgcctatgagggaagtggatgaacagatgttcaacattcaggacaaaaactcctcatattttgctgattggctgcccaacaacgtgaagactgcggtctgcgatatcccgccacggggacttaagatgtccgccacttttatcgggaataacactgccattcaagagctgtttaaacgggtttctgaacaattcaccgctatgttccggcgcaaagctttcttgcattggtatacaggtgaggggatggatgagatggagttcacagaggccgagagcaacatgaatgatctggtgagcgagtatcagcagtaccaggatgcgactgctgaagaagaggaagatgaagagtacgccgaagaagaagtggcttag

SEQ ID NO: 17001 - DNA, 576 bp, Artificial Sequence
  Description of Artificial Sequence: Synthetic coding sequence
atggctgcagccaaggacacgcacgaagatcatgacacttccaccgaaaacactgatgagagtaaccatgacccccaatttgagccaattgtgtcccttcccgagcaggaaattaaaaccctggaggaggacgaagaggagctgtttaagatgcgggcaaagctgttccggtttgccagcgagaatgacctacctgaatggaaagaacgggggactggcgatgtgaagttattgaaacacaaaacgctgaagatctgtgccaatcattacatcacccctatgatggagctgaagcccaacgctggctctgatcgcgcctgggtgtggaacacccatgccgactttgctgatgagtgtccgaagcccgaactcctggcaatcaggttcctgaacgcagagagcgagccccgggcacttggcacatgtctgacttggggctctccagcctggcagagaggcggactctgtgccaccaacgctgttgctttctggggggagggagcggtaaccggaaagtgtgtggtttgggccgccctgccctgttgtctgggggctatgcctagactcaaaccatag

SEQ ID NO: 17002 - DNA, 369 bp, Artificial Sequence
  Description of Artificial Sequence: Synthetic coding sequence
atggccacctctgctccactgcgatccctcgaagaagaagtgacttgctcaatttgcctagattatctgcgggaccccgtcactatcgattgtggccacgtgttctgcagatcctgtaccaccgacgttcgccccatctccggctcccggccggtgtgtcctttatgtaaaaagccttttaagaaagagaatatccgccctgtttggcagctcgcatctttagtggagaatatcgaacgtctcaaggtcgacaaggggcgacagcccggagaggtgacacgtgagcaacaggatgctaagctgtgtgaacgccacagagagaagctacactactattgtgaagacgacggcaagttactgtgcgtgtag

SEQ ID NO: 17003 - DNA, 1383 bp, Artificial Sequence
  Description of Artificial Sequence: Synthetic coding sequence
atggcttccctcctgcagtctgaccgcgtcttgtacctggtgcaaggtgagaagaaagtgcgggcccctttgtcacaattatacttctgtcgctactgttcagaactacggtctctagagtgcgtgagccacgaggtggacagtcattactgcccctcatgtctcgagaacatgcctagcgcagaagccaagctgaagaaaaatcgttgcgccaactgcttcgactgccctggatgtatgcacaccctaagcacgagagccacctcgatctctactcagctgcctgatgacccagccaagactaccatgaaaaaggcatactatttggcatgtggcttctgccgatggacatctagagacgtgggtatggccgataaaagcgtcgcttccggtggctggcaagaacccgagaacccacacacacagaggatgaataagctaattgagtactaccagcagctggcacagaaggagaaggttgagcgggacaggaagaagcttgcgcgtaggagaaactacatgccgctcgcgttttccgacaagtatgggttaggcacacggttgcagcggccacgcgccggcgcatcaatcagcacattggcaggactgagtctcaaagagggcgaagatcaaaaagagattaagatcgagcctgcacaggccgtggatgaggtcgagccactgcctgaggactattacaccaggccagtgaatctgacagaggtcactaccctccaacaaagactgttgcaacctgacttccaaccagtctgcgcctcacaactgtacccccgccacaaacatttgctcattaagcgcagcctcagatgtcgcaagtgcgaacataatctctctaagcctgaattcaatccaacctccattaagtttaagattcagttggtggctgtgaattatataccagaggtgaggattatgagtatccccaacctccgttacatgaaagagagtcaggtactgctgacccttaccaaccctgtggagaatcttacccacgtgactctgtttgagtgcgaggaaggagaccccgacgacattaacagcacagccaaagtggtcgttcctcctaaggagctggttctggccggcaaggacgccgccgccgaatacgacgagctggctgaacctcaggactttcaggacgacccagatataattgcatttcggaaggccaataaggtaggaatctttataaaggtgaccccacagagggaagaaggagaggtgaccgtctgctttaagatgaagcatgactttaaaaatctggccgccccaattaggccaattgaagagtcagatcagggcacagaggtcatctggctgacccagcacgttgagctatctctgggcccgctactgccatag

SEQ ID NO: 17004 - DNA, 3336 bp, Artificial Sequence
  Description of Artificial Sequence: Synthetic coding sequence
atggaaatggacgcgcctaggcccccttccttggctgtacctggggccgcatcccgccctgggagactcttggatggaggccacggccggcagcaggtacaggctctaagctcccaattgctcgaggtgatccctgattccatgcggaaacaggaggttcgtaccggaagggaggctggtcaaggccacggcacaggctcaccagccgagcaggtgaaagctcttatggacttgctcgcaggcaaaggctcccagggcagccaggcaccccaagccctcgaccgcactcccgacgcccctctcgggccttgctcaaacgacagtcggattcaaagacacagaaaagcgctccttagtaaggtcggtgggggtccggagctcggcggaccatggcacagactcgcttcgttattgctggtggaaggcctgaccgatctccagctgcgggagcatgactttacgcaggtagaggcgacccgcggtggaggacatcccgccagaactgtagctctggatagattgtttctgccactgtcccgagtctccgtccctcctcgagtgagtattactattggtgtggccggcatgggaaaaacaacgctcgtgagacattttgtgcggctctgggctcacggtcaagtagggaaggacttttctctggtcctcccactcactttccgtgatctgaatacccacgagaagttgtgcgccgatagactcatctgcagtgtgttcccacacgtcggagagccttccctggctgtcgcagttccagccagggcactgctaattttggacggtctggacgaatgtcggacacctttggattttagcaacacagtcgcatgtacagatccgaaaaaagagatcccagtagatcacttgattaccaatattatccgcggtaatctcttccccgaagtgtctatctggatcaccagtaggccctccgcctccggacagattcctggcgggttggtcgatcgtatgaccgagattcgggggttcaacgaagaagagatcaaagtctgcctcgaacagatgtttccagaagatcaggccctcctcggatggatgctcagtcaggtgcaggccgatagggctctatatctcatgtgcacggtgcctgctttttgtcgactaacgggtatggcactgggacatctatggcgtagcaggacaggccctcaagatgcggagctctggccgccccgaactttatgtgagctgtattcctggtatttcaggatggcactctccggggagggccaggaaaaagggaaggcctctccgagaatagagcaagtggcacacggcggccgcaaaatggtcgggacattgggccggctggctttccacggtctgctgaagaagaaatacgtcttctacgagcaggatatgaaggcgtttggagtggatctggctctgctccagggcgctccatgcagttgcttcctgcagcgggaagaaactctggcctcttccgtggcatattgtttcactcacctgagtttgcaggaatttgtagctgctgcctattattacggagccagtcggcgagcaatctttgatttgttcacagagtccggtgtatcttggcctcgcctaggatttctgacacacttccgatccgccgcccaacgtgccatgcaggctgaggatggacgactcgatgtgtttcttcgcttcttatctggcctgctctcccccagagtcaacgcccttttggccggatctctgttggcacaaggagagcatcaagcttatagaacccaggtggcagagctcctccagggctgcctccgccctgacgctgctgtatgtgcccgagcaataaacgtgcttcactgtctccacgagctccagcacactgaattggccaggtccgtcgaggaggctatggaatcaggggctcttgctcgtctgaccggcccggctcaccgtgcagctctagcctatctacttcaggttagcgatgcatgtgctcaggaggccaacctgagtctgagtctgagccagggggtgctgcagtctctgctgccccaactgctatactgcaggaagctgcgcttggatactaatcagttccaggatccagtgatggagctgttgggctccgtgctctcaggtaaagattgcaggattcaaaagatctccctcgctgaaaaccagatctccaacaagggggccaaagctctagcgcggtcgctgctcgtgaatcgcagcctgactagtctggatctgcgcggaaattctatcggaccccagggcgctaaggccctggccgacgctctcaaaattaatagaacactcactagcctttctcttcagggaaacacagtccgcgacgatggcgcccgctcaatggccgaggcactggcctcaaataggaccctgtcaatgttgcatctgcagaagaacagcatcggacccatgggcgcccaaaggatggccgacctcaaacagaaccggtctttaaaggaactgatgttctcgtcaaattccatcggtgacggcggcgccaaggccttggctgaagcccttaaagttaaccaggggttagaaagtctcgatctccagtccaacagcatttctgacgccggtgtcgcggccctgatgggggcattgtgtacgaaccaaactttacttagcctgtcacttagagaaaacagcattagcccggaaggtgcccaggctattgctcacgccttgtgcgcgaactccactctcaagaatctggacttgaccgcaaatctgctgcatgaccagggcgcacgcgctattgcagtcgcagtgcgagaaaacaggaccctgactagcctacatcttcaatggaacttcatccaggctggagccgcccaggcactggggcaagcattgcagctaaataggtccctcacctcacttgacctgcaggagaatgctataggggatgatggagcctgcgcagtggctcgtgctctgaaggtcaacacagccctcacagctctataccttcaggtggcatctatcggagcttcaggcgcccaagttcttggggaagctttggcagtaaaccgtacgctcgagattctggatctcagagggaatgctatcggagtggccggcgccaaggccttggctaacgccctcaaagtgaattcttcactgcggcggctgaatctgcaggaaaacagtctgggaatggacggcgccatctgtatagccactgccctatcgggcaaccaccggctgcagcacatcaacctgcagggaaaccacataggcgactccggagcccgcatgatatccgaggctattaaaaccaacgctccaacctgtactgtcgagatgtag

SEQ ID NO: 17005 - DNA, 2424 bp, Artificial Sequence
  Description of Artificial Sequence: Synthetic coding sequence
atgcttgagcgacgtgctttactgtggcaaagagaggccggcccgggctggggggatagagcacgtgccgggacgggaggagctggagggggctgcggaggcgccatggctgaaagggggcctgctttttgcggcctgtatgatacctcttccttgctgcgatattgtaacgacgataatctgagtggaacctctgggatggaagtggatgacagggtgtcagctctcgaacagcgtctccaattgcaggaggatgaactggcagtgctcaaggcagcactggccgacgctctccggagactccgggcctgtgaggaacagggagcagcgttacgagctcgcggcacacccaaaggtcgtgcccccccgagactgggaaccacagcttccgtgtgtcagcttctaaagggcctccccacaaggaccccgctcaacggctcagggcctcctcgaagggtgggtggctacgcgaccagccccagctctcccaaaaaggaggcaacctccggccggagtagtgtcaggaggtacctgtccccagaacggcttgcttccgtccgtagggaggatccacggagccggaccacatctagctcgtcaaattgtagtgccaaaaaggagggcaaaacgaaagaggtgatcttttctgtggaggacggcagtgtgaagatgtttctgagaggcagaccagtaccaatgatgatcccagacgagctcgctcctacctacagcctggatactcggtccgaactgcccagctgtaggctgaaactagagtgggtgtacggataccgcggccgtgattgcagagctaacctgtacctgctgccgacaggggaaatagtttattttgtggcatcggttgccgtgctgtattctgtcgaggagcaacggcagcggcactaccttggccacaacgacgatattaagtgtctggcgattcaccccgatatggttaccatagccaccggccaggtggctggcacaaccaaagaagggaagccgcttcctccacacgtcagaatttgggattcggtgagcctctcaactctgcatgtgttgggcctgggtgtttttgacagggccgtttgctgtgttggctttagcaagtcaaacggcgggaacctgctgtgcgccgtggacgaaagcaacgatcatatgctgagtgtgtgggattgggctaaggaaaccaaagtggtggacgtcaagtgtagcaatgaggccgtgcttgtggctacctttcatcctaccgatcccaccgtgctgattacctgtggcaagtctcacatatacttctggacgttggagggtggatccctctcaaagcggcagggactcttcgagaagcatgagaagcccaaatatgtgctatgtgttaccttcctcgagggtggagatgttgttacaggtgattccggcggaaatctgtacgtgtgggggaagggaggtaataggattacccaagctgtgctgggtgcacacgacggaggagtgtttgggctctgcgcgctgcgcgacgggactctagtgtccggtggtggccggaacagcatcttgcaaggcagtgtgcacacagggttttcgcttctggtgcagggccacgtggaagaactttggggattggccactcacccatcacgagcccaattcgttacctgtggacaggacaagttagtgcatctctggagctcggatagtcatcaacccctgtggtcacgtattatcgaggatcctgcacgatctgctggctttcaccccagcggtagtgtcctggccgttgggaccgttaccggcagatggctgctgttagacaccgaaacacacgatctggttgctattcataccgatgggaacgaacagatcagcgttgtgtctttcagcccggacggcgcctacctggcagtgggaagtcacgataacctggtatacgtgtatacagtggatcagggaggtagaaaagtttcgcgcctgggaaagtgcagcggccattcttcgttcataacacatctggattgggcccaggacagcagctgcttcgtcaccaactcaggggattatgagatcctgtattgggacccggcaacctgcaagcagataacatcagcagacgcagtcaggaacatggagtgggccactgctacctgcgtattaggttttggagtgttcggcatttggtccgagggagcagacggcaccgacataaatgcagtcgctcgaagccacgacggcaagctcctggcaagtgcggacgatttcggaaaagtgcatctgttttcctatccatgctgccagccacgcgcactctctcacaagtacgggggtcacagctctcacgtgacgaacgttgcatttttatgggacgactctatggctctgaccaccgggggcaaggataccagtgttctccagtggagggtggtgtag

SEQ ID NO: 17006 - DNA, 1413 bp, Artificial Sequence
  Description of Artificial Sequence: Synthetic coding sequence
atggaagagactatcaaagaccccccaacatccgccgtgctcctggaccactgccactttagtcaggtgatcttcaacagtgttgagaaattctatatccctggcggagacgtcacttgccactatacctttactcagcacttcattccccggaggaaagattggatcggtatcttcagggcctttaagtgttttcaggacaaacttgagcaggaattgcttaagtggcggagtcaggggcagaagctgcaggtgggctggaagacaacaagggagtactatactttcatgtgggtcacgcttccaatcgacctgaacaataagagcgcgaagcaacaggaagtacagttcaaagcttactacctgcctaaagacgacgagtattatcagttttgctatgtggacgaggacggcgtggtgagaggagcttccattcccttccaatttagacctgaaaatgaggaggatatcctggttgtcactacccaaggcgaggttgaggaaattgaacagcacaataaagagctctgcaaagagaatcaggaactgaaggactcttgcatctctttgcagaagcagaattcggacatgcaggctgagctgcagaaaaaacaagaagagctggagactctccagagcataaacaaaaagcttgagctgaaggtgaaagagcagaaggattattgggagacagagctcctgcaactgaaagagcagaatcagaagatgtctagtgagaatgagaaaatgggcatccgcgtggatcagctgcaggctcagctctctacccaggaaaaagagatggagaaactggtgcagggtgatcaagacaagacagagcaactggaacagcttaagaaagaaaacgatcacctgtttctttctctcaccgagcagcgaaaagaccagaagaagctggaacagaccgtggagcagatgaagcagaacgaaactacggcaatgaaaaagcagcaggagctgatggacgagaatttcgacctctctaagagactgagcgaaaatgaaatcatctgcaatgctctacagcgccagaaggaaaggttggagggggaaaatgacctgttaaaacgggagaattctcggttgttatcttatatgggcctggattttaacagcctgccctaccaggtccccacgagcgatgagggtggagcgcgacagaatccaggtttggcctatggcaacccctattcaggtattcaagaaagtagtagcccctcacctctttccattaagaaatgccctatctgcaaggccgacgacatatgtgaccataccctggagcagcagcaaatgcagcccctgtgctttaactgccctatatgcgacaaaatatttcccgcgaccgaaaagcagatttttgaggatcacgttttctgccactctctctag

SEQ ID NO: 17007 - DNA, 1023 bp, Artificial Sequence
  Description of Artificial Sequence: Synthetic coding sequence
atgagcaagactcacgatcaccaactggaaagttccctttctcccgtcgaggtcttcgcaaaaaccagcgcaagtctggaaatgaatcagggagtctccgaagagcgaatccatcttggtagcagccccaagaagggggggaattgcgacctgtcccatcaggaaaggctacagagcaagtcacttcaccttagtccccaagaacagtccgcatcatatcaagatcgccggcaaagttggaggcgggcttccatgaaggaaacaaatagacgaaaatccttacaccccatacatcagggcataacagagctctcacgatctatctccgtggacctggccgagtctaaacgattggggtgcctgctactatcttcttttcaattttcgatacagaaactggaaccttttttacgagacacgaaaggatttagcctggagagctttcgagcaaaagcatctagtttgagcgaggagctcaagcactttgccgacggcctggagaccgacggaactctgcagaagtgtttcgaagatagcaacgggaaggcctccgacttctcattggaagccagcgtcgcggagatgaaggaatatatcacaaagttctcattggagcgtcagacctgggaccagctcttgctccactatcaacaagaggctaaggagatactcagtaggggcagcaccgaggccaagataaccgaggtgaaggtggagccaatgacttatctcggtagttcacagaacgaggtactaaacaccaaacccgactatcaaaagatcttgcaaaaccagagcaaagtcttcgactgcatggagctcgtgatggacgagctccagggatctgttaagcagctgcaagccttcatggatgaatcaactcagtgcttccagaaggtatctgtccagctggggaagcgctctatgcagcagttagacccatccccagcccgaaagttgctgaaacttcagctccagaatccacccgctatccacggttccggtagcgggtcctgccagtag

SEQ ID NO: 17008 - DNA, 522 bp, Artificial Sequence
  Description of Artificial Sequence: Synthetic coding sequence
atgactcacgtggcctcgcagttcgcctctagttacgtgttttattggcgggactatttcgaggaccagccactgctgtatcctccaggttttgacgggcgcgtcgtcgtttatccaagcaaccagaccctgaaggattatctcagctggagacaggctgattgtcatatcaacaatctatataacaccgtattctgggctctgatccagcaaagcggcctaactcctgtgcaggcccaaggacgccttcaaggcaccctggccgcagataagaacgaaatcctgtttagtgagttcaatattaattataataacgaattgcccatgtatcgcaagggaaccgtgctgatctggcagaaagttgacgaagttatgactaaggaaattaagctgccaaccgagatggaggggaaaaagatggccgtaactcgcacacgtacaaagccagtgcccctgcactgcgacattattggtgacgcattctggaaagagcaccctgagattctggatgaggattcttag

SEQ ID NO: 17009 - DNA, 285 bp, Artificial Sequence
  Description of Artificial Sequence: Synthetic coding sequence
atggagatggagtccgctgccgcgtccactagatttcaccagcctcacatggaacgcaaaatgagcgccatggcctgtgagatttttaacgagctgcgtctggaaggcaagctttgcgacgtcgtgattaaggtcaacggcttcgagttctctgcccacaaaaatatcctctgtagctgttctagctattttcgggcgctcttcacgagcggttggaataataccgagaaaaaagtgtacaatataccggggattagccccgatatgatgaagctcattatctag

SEQ ID NO: 17010 - DNA, 1572 bp, Artificial Sequence
  Description of Artificial Sequence: Synthetic coding sequence
atgaaccaaccatgtaacagcatggagccacgagtgatggatgacgacatgctgaagctagcagtgggtgatcaaggcccccaggaggaagctgggcagttagccaaacaggaaggcatactgtttaaggatgtcctcagtttgcagttggactttcggaacatactgcgaatagacaacttgtggcagtttgaaaatctgcgtaagctgcaactggacaataacataatagaaaagatcgagggtctagaaaacctcgcccacctggtttggctcgatctgagtttcaacaacatcgagacaatcgaaggtttagacactctagtcaacctcgaggatttgagtcttttcaacaaccggatatctaagattgattccctggatgctctggtaaagttgcaggtgctaagcctgggaaacaaccgcatagacaacatgatgaacattatttatctccgtcggttcaaatgcctccgcacattatccctgtctcgaaatcccatcagcgaagctgaggactataaaatgttcatatgcgcctatctccctgatctaatgtacctagattaccggcggattgacgatcatacaaaaaaactagctgaggccaagcatcagtactcaatagacgaattgaaacaccaagaaaatttgatgcaagcacagctggaggatgagcaggcacaacgggaagagttagagaagcacaagacagccttcgtggaacacctaaacgggagtttccttttcgactctatgtacgcagaggattcagagggcaataatctatcctatcttcctggtgtgggagaactcctagaaacttacaaggacaagttcgtcataatttgcgtgaatattttcgagtacggactgaagcagcaagaaaagcgcaaaactgagcttgacaccttttccgaatgcgtgagagaggccattcaggagaaccaggagcagggaaagagaaagatcgctaagtttgaggagaaacatctgagttctcttagtgccatccgagaagagctggaacttcccaacattgagaaaatgattctggagtgctccgcagatatcagcgaactgtttgacgccctgatgacgctggagatgcagcttgtcgagcagctggaggagactatcaacatgtttgaacgcaatatcgtggatatggtgggattatttattgaaaatgtccagtcactaatggctcagtgtagggacctcgagaaccatcaccatgagaagctgttggagatctccatctccactcttgagaaaatcgtggaaggagatctagacgaagacctccccaatgaccttcgagcactttttgtcgataaggacaccatcgtgaatgctgttggggcctcccacgacatccacctcctcaaaattgacaatagagaagatgaactggtcacaaggataaattcttggtgcacgcgactgattgacagaatccataaggacgagattatgcgcaacaggaagagagtcaaagaaatcaatcagtacatagatcacatgcagtcagagctggataatctggaatgtggcgatatcttggactag

SEQ ID NO: 17011 - DNA, 372 bp, Artificial Sequence
  Description of Artificial Sequence: Synthetic coding sequence
atgggcaccggagatttcatctgcatttctatgaccgggggtgctccttggggattcagattacagggaggcaaagagcagaagcagcccctccaagtcgcaaaaatccgcaatcagagcaaggcttccggttctggcctgtgcgagggggacgaagtggtgagtatcaacggcaatccatgcgccgacctcacatacccggaggtgatcaaactgatggagtcaatcacagatagtctgcagatgttgattaaacgaagggtgggggctccattcttatttctcgaagatcagtctcatcctcccttccttcatctcctgggctacacctccctgctcatcgtaaccctggtcaatcagcctatggactag

SEQ ID NO: 17012 - DNA, 1146 bp, Artificial Sequence
  Description of Artificial Sequence: Synthetic coding sequence
atgcctcttcaggtcagcgactacagttggcagcagacaaagaccgcggtcttcttgtcactgcccctcaaaggcgtatgcgtgcgcgatacagatgtgttctgtacagaaaactacctcaaagtgaatttccccccctttctttttgaggcttttctctatgcacctatagacgatgagagctctaaagcaaagatcggaaacgataccatcgtgttcactctttacaaaaaggaagccgccatgtgggagacgctgtctgtgacgggcgtcgacaaagagatgatgcagcgaatccgagagaagtctattcttcaggcacaggaaagggcaaaggaagccacagaggctaaagcagcagctaaacgcgaggatcagaaatacgccctgagtgtgatgatgaagatcgaggaagaggaacgcaagaagatcgaggacatgaaagaaaatgaacgcataaaagctaccaaggcccttgaggcgtggaaggagtaccagagaaaggctgaggagcagaagaaaatccagcgtgaggagaaactctgtcagaaggaaaaacagatcaaagaggaacgtaaaaagattaagtataaaagtttgaccagaaatcttgcttcccgcaatctcgcccccaagggccggaactctgaaaacatttttacggagaagctgaaagaggattccataccagctccacgttctgtcggctctataaaaatcaacttcaccccacgcgtgtttccaactgcgcttagagaatcacaggtggctgaggaagaagaatggttgcacaaacaggccgaagctaggcgagccatgaatacagatattgcagaactttgtgacctgaaggaagaggaaaaaaacccagaatggttgaaggataaaggcaataagctttttgccaccgagaattatttggcagccattaacgcctacaatctggccattcgcttaaacaataagatgccccttctgtacttgaatcgtgcagcgtgtcatttgaaactgaagaacctgcacaaggcaattgaagactcatctaaagaattttgctccctggaagggattgaatgccaggcttcggagccgaaactctcccaccacatacccagcgacctgcacgtgtacattcagatggcctag

SEQ ID NO: 17013 - DNA, 615 bp, Artificial Sequence
  Description of Artificial Sequence: Synthetic coding sequence
atggtgatggctgagggtacagccgtcctaaggcggaaccgaccgggtactaaggcccagtatatccaacagaatattagagctgactgttctaacattgataagatactcgagcctcccgaggggcaggacgagggggtatggaaatatgagcacctgaggcagttttgcctggagctgaacggtttggcggtgaaattgcaatctgagtgtcaccctgacacctgtacgcagatgaccgctaccgaacaatggattttcctttgcgccgcccacaagacaccaaaagagtgccccgctatcgattataccagacacaccctggacggcgccgcttgcttactcaattctaataaatacttcccatccagagtctcgataaaagaatcgtccgtggccaaactaggcagcgtttgccggagaatctacaggatattcagccatgcctattttcaccataggcagatcttcgatgagtacgagaacgagacctttctgtgtcacagatttactaagttcgtgatgaagtataacctgatgagcaaagataatctgatagtgccaatcttggaagaagaggtacaaaactctgtgagtggcgagtcagaagcatag

SEQ ID NO: 17014 - DNA, 1293 bp, Artificial Sequence
  Description of Artificial Sequence: Synthetic coding sequence
atggccgccaaccttagcaggaatggccctgcgctgcaagaggcatacgtgcgcgtcgtgaccgaaaaatctccaaccgattgggctttatttacctacgaggggaattcgaacgacatccgggtggccggaaccggcgaaggcgggcttgaagagatggtcgaagagctgaactccggaaaggtaatgtatgccttctgccgggtgaaggacccaaacagcggcctccccaaattcgtccttatcaattggactggggaaggggtgaatgatgtgaggaaaggtgcctgtgcctcacatgtgtcgactatggcctccttcctgaaaggcgcccacgtcaccatcaatgcaagggcggaagaggatgtggaacctgaatgtatcatggagaaggtcgctaaagccagcggagcaaattacagtttccataaggagtcaggccggtttcaggacgtggggccccaggcaccagtcggctcagtgtaccaaaagacaaacgctgttagcgagattaagagggtggggaaagattccttttgggccaaggccgagaaagaggaggaaaaccgtcggttagaagagaaacggagggccgaagaggcacagcggcagctggagcaggagcggcgcgaacgggagttacgcgaggctgcaagaagagagcaaagataccaggagcagggcggcgaggcgtctccccagagaacatgggaacagcagcaggaggtggtgagccgcaaccggaatgagcaggaatcagcggtgcacccccgtgagatctttaagcaaaaggagagagccatgtcgactacgtctataagctcgcctcaacctggaaagctccgcagcccattcctccaaaagcaacttactcagccagagacccactttggaagagagccagccgctgcaatctccaggccgcgggccgatctacctgctgaggagcctgccccatctactcccccctgccttgtgcaggccgaagaggaagccgtgtacgaagagcccccagaacaggaaacattttatgaacaacccccactggttcaacagcagggggcagggtctgagcatattgaccatcatattcagggccagggtcttagcgggcaaggcctgtgtgcaagagctttgtacgattatcaggctgctgacgacaccgagatcagctttgatcctgagaacctcatcactgggatagaagtcatcgatgagggctggtggagaggatacggccctgacggccacttcggcatgttccctgcgaactatgtagaattaattgagtag

SEQ ID NO: 17015 - DNA, 3189 bp, Artificial Sequence
  Description of Artificial Sequence: Synthetic coding sequence
atggtgtcctccgcacagatgggctttaatctgcaggccctgctggaacagctcagccaggacgagttatccaaatttaagtacctgattaccacgttcagtttggcacatgaactccaaaagattccccacaaagaagtcgacaaggccgatgggaagcagctggtggaaattctgaccacacattgcgactcatattgggtggagatggctagcctgcaagtattcgaaaaaatgcaccggatggacctttccgagagggctaaagatgaggttcgggaagcagctttaaagtccttcaataagagaaaaccattgagcctgggaattactcgtaaagagcggccccctctggatgtggacgagatgttagaaagatttaaaacagaggctcaggccttcaccgaaaccaaggggaatgtgatctgcttgggtaaggaggtattcaagggaaagaagcctgacaaagacaatcgctgtcgttatattctgaaaactaagttcagggagatgtggaagagctggcctggcgacagcaaggaggttcaagtaatggccgagcggtacaagatgctcatccccttttcaaacccccgtgttttgcctggaccgttctcctacacagtggtcctctacggtccagccggtcttggaaagactaccttggctcagaaactgatgttagactgggcagaagataacctgatacataagttcaagtatgccttctatctaagctgccgcgaactgtcacggcttggaccatgttcattcgccgagctagtctttcgcgattggccagagcttcaggatgacattccacatatactggcccaggctagaaagatcctgtttgtcatagatgggttcgatgaattgggcgctgctccaggtgccctgattgaggacatctgcggagactgggagaagaagaaaccagtgcctgttctgctggggtcactccttaaccgggtgatgcttcctaaggcagcactgctggtgacaaccaggccccgggcactgagggatctccgaattcttgccgaagaacctatctatattcgcgtggaaggatttcttgaagaagataggagggcatactttttgcgacactttggcgacgaggaccaagctatgagggcatttgagctgatgcgcagcaacgctgcattgttccagttgggcagcgctccagccgtttgctggattgtttgcacgaccctgaaattgcagatggagaagggtgaagaccccgtgcccacgtgtttgactcggaccgggctgttcctgagattcttgtgcagcaggttcccccagggcgcacagctccgcggcgccctgcgcacgctttcccttttagctgcacagggcctctgggcccagacttctgtgttgcatagagaggacctcgagcggttgggggtccaggagtccgatctgaggctatttctggatggggatattctgcgtcaggatagagtgagtaaagggtgctattcttttattcatttgagcttccagcagttcctgactgcactgttctacaccctggagaaagaggaggaagaagatagagatggccatacttgggatatcggggatgtccagaagctgttgagtggagtcgagcgcctaagaaaccctgacctaatccaagcaggatattactctttcggtctggctaatgagaaaagagccaaggagttggaggccacctttggctgtagaatgagccctgatattaaacaagaattactgcgctgcgacatttcctgcaaaggagggcattcaaccgtgactgatttacaggagctattgggatgcctgtatgagtcacaggaggaagaactggtcaaggaagtgatggctcaatttaaagagatttccttacaccttaatgccgttgatgtagtgccctcgtcgttctgcgtgaagcactgtcggaacctgcagaaaatgtctttacaagtaatcaaggaaaaccttcccgaaaatgtaaccgcctccgagtcagacgccgaggtggagaggagccaggacgaccaacacatgctgcctttctggacagatctatgctccattttcggttctaacaaagatctaatgggtctggcaatcaacgattccttcctctcagcaagcctagttcggattctgtgcgaacagattgcctcggacacttgtcatttgcaacgagtcgtcttcaagaacattagcccggcagacgctcaccgaaacctctgcctcgcgctgcgtgggcataagacagtgacatacctgaccttacagggaaacgatcaggacgacatgtttccggcattgtgcgaggtcctgcggcaccctgaatgcaatcttagataccttgggctggtgtcttgcagcgcgactacacagcagtgggctgacctttcactggccttggaagtcaatcagtccctcacctgcgtgaacctctccgacaacgagttgctcgacgagggcgcaaagttactttatacgacgctcaggcatcccaagtgtttcctgcaacgactgtctctggaaaattgccacctcactgaagcgaactgcaaggatctggctgctgtcttagttgtctcaagagagttgactcacctctgccttgccaagaacccaatcggcaataccggcgtgaaatttctgtgcgaaggactccgctacccggagtgcaagttgcaaaccctcgtcctatggaactgtgatattacatcagatggctgctgtgatctcacgaaattgctgcaggagaagagtagcctgttgtgcttggatttagggctcaatcacatcggggtgaaaggtatgaagtttctctgcgaggcattgcgcaaacctctctgcaatctaagatgtctgtggctttggggttgtagcataccacctttcagttgtgaggatctgtgctccgctctaagctgcaatcaaagcttggtgactctcgatttggggcagaacccattgggtagctctggggtcaaaatgttattcgaaacccttacatgtagctcagggactttgcgcactttgcggctgaagattgacgatttcaacgatgagctgaacaaactgctcgaggagatagaggagaagaatccccagctaatcattgatactgaaaagcaccatccctgggctgagagaccatcgtcgcacgattttatgatctag

SEQ ID NO: 17016 - DNA, 390 bp, Artificial Sequence
  Description of Artificial Sequence: Synthetic coding sequence
atggccgagctaattcagaagaagctgcaaggagaagtcgagaagtaccagcagctacaaaaggacttgtccaagtcaatgtctggcaggcagaaactcgaggcccagctgaccgaaaacaatatcgtcaaagaagaacttgcattgttggacggttccaatgtcgttttcaaactcctcggacccgtgttagtcaaacaggagttgggcgaggccagggctaccgtagggaaacgcctcgattacattaccgccgagatcaagagatacgagagccagctgcgagatttagaacgtcagagcgaacagcaaagagaaacactcgcacagctccagcaggaatttcagagagctcaggccgcgaaggcaggcgcgccgggcaaagcttag

SEQ ID NO: 17017 - DNA, 516 bp, Artificial Sequence
  Description of Artificial Sequence: Synthetic coding sequence
atggaggtcgctgagccatcttccccaaccgaagaggaggaggaggaggaggaacattcggccgagccacggccccgcacacgatcaaaccctgagggcgccgaagatcgcgccgttggcgcacaggcttcagtgggttcacggtcggagggagaaggcgaagctgcgagcgctgacgacggatctctgaacacgtccggtgccgggccgaagtcctggcaggtgcctccccctgcgcctgaggttcagatacgcaccccaagggtcaattgccccgaaaaggtgattatctgcctggacctgagcgaagagatgagtctgcctaaattagagtcattcaatggacagcagaagaccgaactgcctgtcacagaaaatgtgcagactatcccccctccatacgttgtgcggactattctggtgtattccagacccccttgccaaccccaattttcactaacagaacctatgaaagtcggcgaggcgtgggaaagggaaggctgcctgcagccctag

SEQ ID NO: 17018 - DNA, 1446 bp, Artificial Sequence
  Description of Artificial Sequence: Synthetic coding sequence
atggcatcggcggcgtcagtgacctcattagcagacgaggtgaactgcccgatctgccagggaacactgagggagcccgtgacgattgattgtgggcataacttttgccgggcctgcctcacccggtattgcgagattccagggcccgatcttgaggaaagtcctacttgccctctttgcaaggaaccatttaggcctggtagtttcaggccgaactggcagctggctaatgtcgtggagaatattgaacgcttacagctggtgtccactcttgggttaggtgaggaggatgtctgtcaggagcacggagagaagatctattttttttgtgaagacgatgaaatgcaactgtgtgtagtctgcagagaggcaggggagcatgcaacacataccatgaggttcctggaagatgcagctgcaccctatcgggagcaaattcacaagtgcctgaagtgcctcagaaaagaaagggaggaaatccaagagattcagtcaagagaaaataagcgtatgcaggtgctgcttacacaggtaagcaccaaacggcagcaggtcatcagcgaatttgctcacctacgtaagttcctggaggaacagcagagtatccttctggcccaactagagagccaggatggagatatcctgcgacagagggatgagtttgacctgctggtcgcaggtgagatttgcaggttctctgcacttatcgaagagctggaggagaagaacgaacgccctgcccgggaattacttaccgatattcggtctactttaatccggtgtgaaacaagaaagtgccgtaagcctgttgccgtttcacccgaactgggtcaaagaatccgcgacttccctcaacaggccctccccctgcaaagagagatgaagatgtttctggagaaactgtgtttcgagctggactatgagccagctcatatttccttggacccacagacaagtcatcccaagctattgctatctgaggaccatcagcgggcccagttttcctataaatggcaaaattctcctgacaacccgcaacgattcgatcgcgcaacatgcgtgctggcacatacaggcattacggggggcaggcacacctgggttgtgtcgatcgacttggcgcatggcggctcatgtacagttggggttgtgtctgaagatgttcagagaaagggggagttacggctgaggcctgaggaaggggtatgggcagtaagactagcttggggatttgtctcagctttgggcagctttcctacgcggctcacactgaaggaacagcctcgccaggtgcgggtctcgctggattatgaggtgggctgggtgacattcacaaatgccgtaactcgagagcccatctatacatttacggccagcttcacccgaaaggtgatccccttctttggtttatgggggagaggatcctccttcagtttgtccagctag

SEQ ID NO: 17019 - DNA, 1986 bp, Artificial Sequence
  Description of Artificial Sequence: Synthetic coding sequence
atgaatacaggcagagactctcagtcacccgatagcgcttggagatcatacaacgacgggaaccaggagaccctcaacggtgatgcgacatactctagcctggcagcaaagggttttcgatctgttaggcctaacttgcaggacaagaggtcgcccacccaatcccaaattaccgtcaatggtaattcagggggggcagtatctcctatgtcctactaccagaggccgttttccccatcggcatattcactgccagcttctcttaatagttccatcgtcatgcaacacggtacctccctggactctacggacacctacccacagcatgcccagagcctagacggaactacatcttcgtctattcctctgtaccggagcagtgaggaggaaaaacgggttaccgtgattaaggctccccactatcccggaatcggccccgtggacgaaagtggtatccccaccgccatccggacgaccgtcgatcgcccaaaggactggtataaaacgatgttcaaacaaattcatatggtgcataagcctgacgacgacaccgacatgtacaacaccccgtacacatacaatgccggcctgtataaccctccctattccgcccaatctcatccggctgctaagactcagacatataggcctttatccaagtctcactccgataattcgccaaatgcttttaaagacgctagtagccccgtgcccccccctcacgtaccaccccctgtcccgcccctccggccacgggacagatccagtacagagaagcacgactgggatccccccgacaggaaagtggatacgaggaaatttagatccgagccaagaagcatctttgagtacgagcctggcaaaagctccatcttgcagcatgaaagaccacctcctaagaaacctctcgactatgttcaggaccactcctcaggtgttttcaacgaggccagcctgtatcaatctagcatcgatcggagtcttgagcggccaatgtctagcgcctctatggcgtccgacttccggaagcgcaggaaaagcgaaccagcggtggggcctccaagaggtctgggcgatcagagtgcctcaaggacttccccagggagggttgatcttcccggatcttcaacgactctgacgaagagttttaccagttccagtcctagcagcccctctagagcaaaagatagggaatctcctcgctcctactcttctacgctcacagacatgggaagaagtgcccctcgcgagcgccggggcacccccgaaaaagagaagctaccagcaaaggctgtgtacgattttaaggctcaaacgagtaaggagttatcttttaagaagggggatacggtttatatcctgaggaaaatcgaccagaactggtatgagggcgaacaccacggccgggtgggaatttttccgatctcctacgtggaaaaattgactccgcccgaaaaagcccaacccgccagacctcctcctcctgcccaaccaggcgagatcggcgaagctatagccaaatataattttaatgctgacactaacgtcgagctgtcgctcagaaaaggggacagagtgattctcttaaaacgtgtggatcagaactggtacgagggcaaaatacccggcaccaatcgacaaggcattttcccagtttcttatgtagaggtcgtcaagaagaacacaaagggagctgaggattaccccgatcctccaatcccgcatagttactctagtgaccgcattcactcgctgtccagcaacaagcctcagcgccctgtgtttacacatgagaacatccaggggggaggagagcctttccaagccctgtataattacacacctcgcaatgaggatgaactggagttaagagagagcgatgtaatcgacgttatggagaagtgcgacgacggatggttcgtcggtacctcaagaaggacaaagttcttcggcactttcccaggcaactacgttaagcgtctatag

SEQ ID NO: 17020 - DNA, 483 bp, Artificial Sequence
  Description of Artificial Sequence: Synthetic coding sequence
atggaggccgagcgtccacaggaagaggaagatggggaacagggaccacctcaggacgaagagggatggccccctccaaactccactactcggccatggcgatccgccccaccctctccaccaccacctggtacgaggcatacggcccttggtccacgctctgcttcactcttatcactccagactgagttactcctcgatctggttgccgaggcgcagagcagacgattagaagagcagagggccacgttttacacacctcagaatccgtcttctctagcccccgcgccactgcgccctctggaggacagagagcagctctatagtactatcttgtcacatcagtgtcaacgtatggaagcccagagatcagagcctccccttccccccggagggcaggaactgcttgaacttctcctgagagtgcagggtggtggtcgaatggaggaacaacgctcccgaccacctactcacacttgttag

SEQ ID NO: 17021 - DNA, 717 bp, Artificial Sequence
  Description of Artificial Sequence: Synthetic coding sequence
atggactgtcgcgaaatggatctgtatgaagattatcagtcacctttcgacttcgacgctggtgtcaataaaagctatctatacttatcgcctagtggtaacagcagcccacccgggtctccaaccctgcaaaaatttggcctgctgcgcacagaccctgtgccagaagagggcgaagacgtcgctgcaacgatctccgctaccgagaccttgagcgaggaggagcaggaggagctgcggagggagttagctaaagttgaggaggagatccaaaccctgtcacaagtcctcgccgccaaagagaagcacctcgcagaaatcaaacggaaactcggcatcaattccctccaggaactgaagcaaaacattgccaaagggtggcaggatgtgaccgccacctccgcctataagaagacctctgagactctgtcccaggccggacaaaaagcctctgcagccttctccagtgtcggatctgtgattaccaaaaaattggaggacgttaacataagatctatccagcactcgatatccatgcccgcgatgcggaacagtccaacattcaaatcttttgaagaaaaagtcgagaatttgaaaagtaaagtcggaggcacgaaacctgccggaggagacttcggggaggtgctgaactccgccgccaacgccagcgctactactaccgagccccttccagaaaagacccaggaaagcctgtag

SEQ ID NO: 17022 - DNA, 108 bp, Artificial Sequence
  Description of Artificial Sequence: Synthetic coding sequence
atgcaaacaagctcctcgagatctgttcacctgagcgaatggcagaagaattacttcgctattaccagcggaatttgtaccggacccaaggctgatgcctatagatag

SEQ ID NO: 17023 - DNA, 327 bp, Artificial Sequence
  Description of Artificial Sequence: Synthetic coding sequence
atgacacggggcaatcaacgggaattggcaaggcagaaaaatatgaagaagcaatctgatagcgtcaagggaaagcgaagggatgacgggctaagcgccgccgcacgcaagcagagcgctataaccagcagcaggaattttctttatccagcctacgtgtactttcctagtagtgtgccctctccaccccgcaagtatacccagacctattacgcggccgtgccggcgggatggtggggcagtggcggaggccccgctactcagcccgcggcaggaggcagatggcggttcctgcacattttaggcacgcagcctcagtcacattag

SEQ ID NO: 17024 - DNA, 846 bp, Artificial Sequence
  Description of Artificial Sequence: Synthetic coding sequence
atgggagctggtaatctgccacctattactcaggaggaagctcttcatattctcggctttcagcctccattcgaggatattagatttgggcccttcactgggaataccactctcatgcggtggttcagacagattaacgatcacttccacgtgaagggatgttcgtacgtcctgtataaacctcatggcaaaaacaaaacagccggcgagaccgctagtggagctctcagcaaactgactaggggactcaaagatgaaagcctcgcttatatttatcactgtcagaaccactacttctgtcctatcggttttgaggcaactccggtgaaggccaacaaggctttttctcgcggaccattgagcccacaggaagttgagtactggatcctgattggcgaatcctcaagaaaacacccggcaatccactgtaagaaatgggcagatatcgtgacagacctgaatacacagaatccagagtacttagacattcggcatctggagcgtggattgcagtatcgaaagaccaagaaacccacgtttttctcctcccaggtgggaggtaacctgcattgtattatcgcgtttcaacgactgaactggcagcgcttcgggctgtggaatttccccttcgggacaatccgccaggagagccagccgcccactcatgcacagggcattgcaaagagtgaatccgaggataatatatctaaaaaacaacacggcaggctgggtagaagcttctctgcttcattccaccaggattccgcctggaagaagatgtcctctattcacgaacggcgcaactctggctatcagggttacagcgactacgacggaaacgactag

SEQ ID NO: 17025 - DNA, 213 bp, Artificial Sequence
  Description of Artificial Sequence: Synthetic coding sequence
atgcgtgcactgacagttcagcgtgtgaaatttgccatggacctgccgctcctgaagcgggccggccaggatctggccgaaaaaacaaaaaatttcgtgagcagaagtttagtgatcggggaggtgctctcaatggccgacatggccacaggagtgaaatgtgggataatctactggctgtttgggggtgcaattcgtaacttgggtagctag

SEQ ID NO: 17026 - DNA, 1644 bp, Artificial Sequence
  Description of Artificial Sequence: Synthetic coding sequence
atggctgggaccaagaataaaacaagggcacaggcaaaaacagagaaaaaggcggcaatacaggccaaggccggagcggaacgagaggccaccggggtcgtgcgcccagtagctaagacacgcgctaaggcaaaagccaagacagggtctaagactgatgccgtggccgagatgaaggccgtgtctaaaaataaggttgtcgctgagaccaaggagggtgcactgtctgaaccaaaaaccctaggaaaggctatgggcgactttaccccaaaagccggcaatgagtctacctcctccacatgtaagaatgaggctggaacagatgcatggttctgggcgggggaagaagctaccattaacagctggttctggaacggcgaggaggcgggcaactccttcagcacaaagaacgacaagcccgagataggagcacaggtctgcgctgaggagctggagcccgcggcaggcgcggattgcaagcctaggagcggcgctgaagaggaagaggaagagaacgtcatcggaaattggttctgggaaggcgatgatacatcctttgacccaaatccaaaacctgtttcccggattgtgaagccccagcctgtctacgagatcaacgaaaagaataggcccaaggattggtcagaggtgacaatctggcccaacgccccagctgtgacccctgccgtccttggcttcaggagtcaggcccctagtgaagcctctccaccttcctatattgttctggcaagtgccgaagagaacgcttgctctctgccggtggccacagcatgcagaccctctaggaacacccgctcttgcagccagcctattccagagtgtcgttttgacagtgatccatgtatccagacaatagacgaaattagacggcagatccgcatcagagaagtcaatgggatcaaaccattcgcatgcccgtgcaagatggagtgctacatggactccgaagagtttgaaaagctggtgtccctactaaagtcaactaccgaccctctgattcacaaaatagcccgcattgctatgggcgtgcataacgtccaccccttcgctcaggaattcatcaacgaagtgggagttgtgactctgattgagtctctgctaagcttcccctcccccgagatgcgcaaaaagacagtaattacactcaacccaccaagcggggacgagagacaacgcaagatcgagctccatgtaaagcatatgtgcaaagagactatgtcattccctcttaattcccccggccaacagagtgggctgaaaatcctgggacaactgacaacagacttcgtgcaccactacatcgtggctaattacttttccgagctctttcacctgctgtcctccgggaattgtaagaccagaaacctcgtcctgaagctgcttcttaatatgtcagaaaacccgacagcggcgcgggatatgatcaacatgaaagccttagcagctctcaagttgatcttcaaccagaaagaggcaaaggctaatctggtatctggcgtggccatctttataaacattaaggagcacataaggaaaggttctatcgtggtggtggatcaccttagctataatacactgatggctattttccgcgaagtaaaggaaatcatcgaaaccatgtag

SEQ ID NO: 17027 - DNA, 489 bp, Artificial Sequence
  Description of Artificial Sequence: Synthetic coding sequence
atgagctacaactgctgttcacgcaacttttccagctgcagtcacggtggctaccttcattaccccggtagctcgtgtggctcctcgtacccctctaacctggtatactcaaccgatttgtgcagcccatccacctgccagctggggagtagcctctatagggggtgccaggagacgtgctggagacccaattcttgtcagacattttgttactacccccgcacgcacatgctttgtaacagttgccttacaatgcatgtcggttctaggggcttcggcagtaactcctgttgtagcctgagctgtggctctcgctcctgttcaagcttgggctgtggctccaacggttttaggtacctgaactatagaattcacaccagcccatcccagagttaccggtcccgtttctgccaccctatttacttccctcctaggcgctggtttcactcttcgtgctaccaacctttttgcaggagcggtttctattag

SEQ ID NO: 17028 - DNA, 495 bp, Artificial Sequence
  Description of Artificial Sequence: Synthetic coding sequence
atgtttatatccttttacgatttcaagaacataccccaggatagcagatgcgacggccagctattcattaacggacgcaataataagaacaactcgatcagcctttacttccagggaggactgcgacatgctagtgcttccatcgggggaagcgaggcctacagacacatgaaatttgagggcggagttcacagagtacagcgcgtaccaaagacagagaagcagggacgggtgcacacttcaacaatgacagtggcaatactacctcagcctacagagattaatctggttataaacccaaaggaccttcggatagataccaaacgggctagcggggctggcggacagcatgtgaacaccaccgattctgccgtcaggattgtgcacctcccgaccggggtggtctcagaatgccagcaggaaaggtcccagctcaaaaacaaagaacttgccatgaccaaacttcgcgcaaagttgtacagtatgcatctgtag

SEQ ID NO: 17029 - DNA, 2166 bp, Artificial Sequence
  Description of Artificial Sequence: Synthetic coding sequence
atggaagaggagctcaagtgtcccgtatgcgggagtttgtttagagagcccataatcctgccatgctcacacaacgtttgcctcccatgcgcccgtacaatagcagtccagacacccgacggcggatcagccgctggaggactcggcggtggcgccggaggcgggggagaccacgccgacaaactttcgctgtactctgagactgatagtgggtacggtagctatacgccttccctgaagtcacccaacggcgtgagagtcctgcctatggttcctgcaccccccggttcctcagcagccgcggcacggggggccgcatgttcctctcttagtagctcgtcatcttcaatcacctgtcctcagtgtcatcgctccgcttctctggatcacaggggtcttaggggctttcagagaaatcgccttctggaggctatcgtccagaggtaccagcaggggcgtggggctgttccgggaacatccgctgcagcagcagtcgccatttgccagttgtgcgaccgaacccctcctgaaccagcagccacattatgtgaacagtgcgatgtgctttattgttccgcttgccagctgaagtgccatccttccaggggcccttttgcgaagcaccgcctgggggcaccatctggcgggggcggatgcaagtctcccgggggcgccggggctggagccaccgggggatctacagctaggaagtttcccacctgcccagaacatgagatggagaattactcaatgtattgcgtctcttgtcggacccccgtgtgctacttatgtctagaggaaggtagacatgccaaacatgaggtgaagcccctgggagccatgtggaagcagcataaagctcagctgagtcaagctttgaacggagtgtccgacaaagccaaggaggccaaggaattcttggtgcagctgaagaacattctgcagcagattcaggaaaatggactagattacgaagcttgcctggtcgcccagtgtgacgccttggtggacgcgttgactcgacaaaaagcaaagcttctgacaaaggtgaccaaagaaagagagcataaactgaagatggtgtgggaccagataaaccactgtacactgaaactgagacaaagtacagggctcatggaatactgtctggaggtgattaaagagaacgacccgtccggatttctccagatctcagacgctctcatcaaacgagtgcaggttagccaggagcaatgggttaaaggtgccctggagcctaaggtgagcgcagagttcgacctgactctcgactcagaacctctgctgcaggccatacaccagctggattttatccaaatgaaatgccgggtgcctcctgtgccacttctgcagctggaaaagtgttgtacccgcaataacagcgtgacactggcctggcggatgcccccattcacccactccccggtggatggttatattctcgaattagacgacggcgcaggaggccagttcagggaagtgtatgtgggcaaggaaacactttgcacgatcgacggcctgcatttcaacagcacttataacgctagagtaaaggcctttaattcctccggtgttggcccttatagcaaaaccgtggtgctgcagacctccgatgtcgcgtggtttacatttgatcctaatagcggacatagggacatcatcctcagtaacgataaccagacggccacctgctcctcttacgacgaccgcgtagtacttgggacagctgcattttccaaaggagtccattattgggaattgcatgtcgatcggtacgacaaccacccagaccccgcattcggcgttgctagggcctcggtagttaaggatatgatgttgggaaaagacgataaagcctgggcaatgtacgtggataataatcgttcctggttcatgcattgcaatagccacacaaacaggacagagggaggggtgtgtaagggggccacggtaggggtgctgctggatctgaataagcatactctcacctttttcattaatggacagcagcagggacctacagcgttttcccatgtcgacggcgtgttcatgcctgccctgtcactcaacagaaatgtacaggtgactctccataccggcctcgaagtccctacaaacttgggaagaccaaaactgagtggaaactag

SEQ ID NO: 17030 - DNA, 1479 bp, Artificial Sequence
  Description of Artificial Sequence: Synthetic coding sequence
atggacttcttgctggggaaccctttcagttctcctgtggggcaacggatcgaaaaagcaacggacggcagtctccagtctgaagactgggccctgaacatggaaatctgcgacatcattaatgaaactgaggagggtcccaaagacgcactccgcgcagttaagaaacgcatcgtaggcaacaaaaacttccacgaagtcatgctggctctcacagtactcgagacctgtgtgaaaaattgcggccatcgctttcacgtgctggtggccagccaggatttcgtcgaatccgtgctagtgaggaccatcctgccaaagaataatccacccacgattgttcacgataaagtcctgaacttgatccagtcatgggccgacgccttccgatcctccccagatttgaccggggttgtaacaatctacgaagatcttcggcgcaaggggctagaatttcccatgacagatttggatatgctttcccctatacacaccccacaacgtaccgtgtttaattcagagacgcagagcggtcaagattctgtgggcaccgattccagccagcaggaagatagtggccagcacgccgccccactacctgctcccccgatattgtctggtgacacaccaatcgcacccacccctgaacagatcggcaaactgcgcagtgagctggaaatggtgtccggcaatgttcgagtgatgagcgagatgctgactgagttggtgcccacccaggctgagcctgccgaccttgaactgctgcaggagcttaacagaacttgccgggcaatgcagcagagagtcctcgaattgatacctcagatcgccaatgagcaacttaccgaggagctgctgattgtaaatgataatttgaacaatgttttcctccgacatgagaggttcgagaggttcaggactgggcagacgactaaggcccccagcgaggccgaacccgcagcagatcttattgatatggggcctgatccagcagccacaggcaatcttagctcacaactcgcaggaatgaatctgggaagttcgtctgtacgagctggtctgcagagtctcgaagcatcaggtagactggaagatgaatttgatatgtttgccctcaccaggggcagctctttagctgaccaacgaaaagaggtcaagtatgaggcgccccaagctactgacggcctggccggcgcactcgacgcaaggcaacagtctaccggggctatccccgtgacccaagcatgtcttatggaggatatcgaacagtggctgtccaccgacgtgggaaacgacgctgaggaaccgaagggcgtcacgagcgaggagttcgataaattcttagaggagagagcgaaagccgcggatcgcctgcccaatctctcatccccaagcgccgagggtcctccaggacccccaagcggacccgctcctcgcaaaaagacccaggaaaaggacgacgatatgctgttcgcactctag

SEQ ID NO: 17031 - DNA, 747 bp, Artificial Sequence
  Description of Artificial Sequence: Synthetic coding sequence
atggcaacgtccgctcctctgcggtctctcgaggaagaagttacctgttctatatgcctcgattatcttcgcgacccagtgacaattgactgcggacacgtcttctgtcgcagctgcaccacagatgtcaggccgatctctggatcacggccagtgtgcccactctgtaaaaaacccttcaaaaaagaaaacattcgtcccgtctggcagttagcctccctggtcgaaaatatcgaacgcttaaaggtggacaaaggtcggcagcccggagaggtgacacgcgaacagcaggacgctaaactatgcgagagacatagagagaagctgcactactattgtgaggatgacggtaaattactctgtgtcatgtgccgggaaagtcgcgaacaccgccctcacacagcagtgctgatggagaaggctgcgcaaccccaccgggaaaaaatcctgaaccacctttcaacactgcgtagagatcgtgacaagatccaaggcttccaagctaaaggggaggccgatatcctcgccgcacttaaaaagttgcaggaccagcgccagtatattgtggcagaatttgagcaaggtcaccagtttctgcgggagagggaggagcatctgctggaacaactcgccaaactggagcaggaactcacagagggccgtgagaagttcaaatctcggggagtgggcgagttagcgaggctggctctggtgatctctgaactcgaaggtaaagcccaacaatag

SEQ ID NO: 17032 - DNA, 21 bp, Artificial Sequence
  Description of Artificial Sequence: Synthetic coding sequence
atgtcacgtcggcggttttag

SEQ ID NO: 17033 - DNA, 165 bp, Artificial Sequence
  Description of Artificial Sequence: Synthetic coding sequence
atgagtgagcagggtgaccttaaccaagcaatcgctgaagagggaggaaccgaacaggagacggccactccggaaaatggcattgtcaagtcggagagcctagatgaggaggagaaactggagctgcagcgaagactggaggcccagaaccaggagaggaggtag

SEQ ID NO: 17034 - DNA, 1446 bp, Artificial Sequence
  Description of Artificial Sequence: Synthetic coding sequence
atggcgtccgctgcctccgtgacaagcctcgcagatgaggttaattgtccaatctgccagggcacactgcgtgagccagttacgattgattgtggacacaacttctgtagagcatgtctgaccagatactgcgagatacccggaccagatctggaagagagccccacctgtcccttgtgcaaagaaccttttagacctggaagcttccggcctaattggcagctcgcaaacgtagttgaaaatatcgagagattgcagttggtatctacacttggactgggcgaggaagatgtgtgccaggagcatggggaaaagatatacttcttttgcgaggatgacgagatgcaattgtgtgtggtgtgtcgagaggccggcgagcacgctacccacacgatgcgcttcctggaggacgctgcggcaccgtacagggaacagattcacaagtgcctcaaatgtctgaggaaagagcgggaggaaatccaggagatccagtcgcgagagaataaacgtatgcaggtgcttttgacccaggtgtctacaaagcggcagcaggtgatctccgagtttgctcacctgaggaagtttctggaagagcagcaaagtattttactggctcagctggaatcccaagacggcgacattctgagacaacgggacgagttcgatctactggtggcaggggaaatatgcaggttttcagcgctgatagaggagttggaggaaaaaaatgagagaccggctagagagttgcttacagatattagaagcaccctaattcgatgtgaaactcgaaaatgccgcaagccagtggccgtgtctcctgagctcgggcagagaattcgggattttccacagcaagccttaccccttcagcgagagatgaagatgttcttggaaaagctgtgcttcgagctcgattatgagccggcgcacataagtctggacccgcaaacaagtcaccccaaattgctgcttagtgaagatcaccagagggctcagttttcatacaaatggcagaatagtcctgacaacccacagcggttcgacagggcaacttgcgttctggcccacaccgggatcacaggaggtcggcacacatgggtggtgagtatcgatctggctcatgggggcagctgcaccgtgggagtggtgagtgaagacgtccaaagaaagggcgagctcaggctgaggcccgaggagggcgtctgggctgtaagactagcctggggctttgtgtcagcgctgggctccttccccacgcggttgactcttaaggaacaaccgagacaggtgcgggtgtcactcgattatgaggtgggatgggtaacatttaccaatgccgtgacccgtgagcccatttatacgttcaccgcttcctttaccagaaaagttatcccctttttcgggctctggggtcgcgggagctccttctcactcagcagttag

SEQ ID NO: 17035 - DNA, 312 bp, Artificial Sequence
  Description of Artificial Sequence: Synthetic coding sequence
atggggcagcagtcctccgtccggcgccttaagaggagtgtaccctgcgagagcaatgaagccaacgaggccaacgaggcaaacaaaacgatgcccgaaaccccaacaggtgactcagacccccagccagcccccaagaaaatgaagaccagcgaatcttccaccatcctagtggttaggtaccgaagaaacgtgaagcgcactagtccagaagagctggtgaacgaccatgctcgtgagaatcgaatcaacccggaccaaatggaggaggaagagtttattgagataactaccgaaagacctaagaagtag

SEQ ID NO: 17036 - DNA, 2919 bp, Artificial Sequence
  Description of Artificial Sequence: Synthetic coding sequence
atggagcgaatgaattggctgagtcgcctggcttcccgtggtccaggacacagaatacctcagggcgcaaatctgcaaacccctgtaatggccgaccccgagacgtgcctcatggtcttcaagaatcactggagccaggtggtgcggatcctggaaaggcaaggaccccgagccgcacctggaggcgccgatgacctgtcagctgtgaggaaccacacttaccagatgttgacactcttggcagaggatagggccgtcccctctgcccctaccggaccgggtcccttactagagttcgctctccacgaagaccttctgacacgggtgctgacttggcaactgcagtgggacgagctgggtgacggcgtagaagagaggcgggccgaacaactcaaactgtttgagatgctagttagtgaagcaagacaacctctcttgagacacggaccagtcagagaagcattgctgaccctgcttgatgcgtgcggacgtcccgtccccagttctcctgcgctggatgagggcctcgtgctgctgctgtcccagctgtgcgtgtgcgtagcgcaggagccctcgctcctggagttctttctccagcctcccccagagcctggtgcggcgccaagacttcttctcttttcccgactggtgcctttcgtgcacagggagggaacactcggccaacaggcaagggacgcacttttgcttttaatggccctctccgcaggaagtcctactgtcggaaggtacattgctgatcattcttacttttgtcccgtcctagcgactggcttgtctgccctgtactcttcacttccaagaaaaatcgaagtgccaggagacgactggcactgtctcaggcgggaagactggctgggtgttcccgctcttgctctatttatgtcgtcacttgagttctgcaatgccgtgattcaggttgctcaccccctggtccagaagcagctcgtggattacatccacaatggatttctggtccctgtcatggggcctgccctgcacaagacaagcgtggaagagatgatcgcctccacagcttacctcgagctctttctgagatctatttctgagcccgctctgttgcggaccttcttgcgcttccttctgctgcacagacacgatacccacacaatccttgatacactggttgcccgaatcggcagcaactctaggctgtgtatggtatctcttagcctattcaggacactcctgaatttgtcctgcgaagatgttcttctgcagctggtcctgaggtacctcgttccttgcaaccatgtaatgcttagccagaagcctgcagtgagagatgttgatttatatggcagggcagcagacaaatttctgagtttaatccccaggtgctgcagacatcatgcccctagtcccccccgacctgagcacgctagctgggcccgggggcccggctctccatcagtagatagcagttcagtgactaccgtgcctcggcccagtactcccagtcggctggcactgttcctcagacaacagtctctgggtggcagtgagtctcccgggcctgccccatgctctccaggtctttcagctagccccgcctcaagcccggggcgcagacctactccagccgaggagccgggcgagctcgaggacaactatcttgaatacttaagggaggcccggcgcggtgtcgatcggtgcgttcgcgcctgtagaacctggtccgctccctatgacggagagaggccctccccagaaccatctcccttcggctcccggaccaagaaacgcagcttactgcctgaggaggataggaataatgtgggcgaaggtgaagaggaagagctggggagacgcgggcgcgcagggggcgctggtgaaggccccggccatctgcctcccccacagctcaacggggtccccggctcttggccagagggagccaagaaagtcaggctcgtccccaaggaaggagctggcgaacttttagaaggcatttctgaaggtatggcgggtctggaggggttcgggcaggagctccgcgaactagaagtggccctctctaacggcggaacaggtagcgaaagccctctcgagccccctctcccactggaggaagaggaggcctacgaatccttcacctgccctcccgagccacccggtccctttctatcaagtcccctgcgcaccctgaaccaattgccctctcagccattcacaggtccttttatggcagttctctttgccaaactcgagaatatgctacagaactccgtgtacgtcaactttctgcttactggcttggtcgcccaattagcttgccatccacagcctttattacgcagcttcttgctgaacaccaacatggtgttccaaccaagtgtcaaatcacttctgcaggttctgggttctgtgaaaaacaaaattgagaacttcgctgcatcccaagaggatttccctgcacttctgagcaaagccaagaagtacctaatagccagaggcaaattggactgggctgaaggtcctgcggccggccctgcccctaggcgttctgatcccttagtgaagagccgccgccccagcttgggcgagttactcctccgtcacgcacatagtcccacacgcgctagacaggctgctcaactggtattgcaaccgggtcgtgatggcgcaggtcttggactgtcgggcgggtcccccggtgcctccacgcccgtgttgctgactcgaggcggggccccagagcgccagggcgaggcactgagagttaagaatgctgtatattgtgcagtcatttttcccgaatttctgaaagagttggcggcaatatctcaagctcacgcggtaacctctcccttcctactggaaacctcagaagaaggcagtggcccgttaatttctgggtgcggccctctcaacccctag

SEQ ID NO: 17037 - DNA, 1929 bp, Artificial Sequence
  Description of Artificial Sequence: Synthetic coding sequence
atgaagattttttgctcaagagctaatcccacgaccggttctgtggaatggttagaggaggacgagcactacgattatcaccaagaaattgcccggtcctcctatgctgatatgcttcacgacaaggatcgagtgttcaaacccatggccgacgccgctgtgaaaattgtcgagaaaaatgggtttagcgacaaaatcaaagtaattaataaacatagcactgaagtgacagtgggacccgaaggagacatgccctgcagggctaacatacttgtcactgagctgttcgacaccgaactcatcggcgagggggccctacctagctacgagcacgcacaccgtcacttagtcgaagagaattgcgaagccgttcctcaccgtgcgacggtttatgctcagctcgtggaatcagggcgtatgtggagctggaacaagctttttccgattcatgtacaaaccagcctgggcgagcaagtgatcgtaccacccgtagacgtggaaagttgtcccggggccccctccgtatgcgatatccagctgaaccaagtaagcccagcagattttactgttctctccgatgttctccccatgttctccatcgatttcagtaaacaggtgtccagtagcgcggcctgccatagccgcaggtttgaaccgctaacaagtggccgtgcccaagtggtgctctcctggtgggacatagaaatggatccagaaggaaagatcaaatgcacaatggccccgttttgggcgcacagcgaccccgaggagatgcagtggcgggaccattggatgcaatgcgtctacttcctcccacaggaggaaccagttgttcaggggagtgcactgtacctcgtggctcatcatgatgattactgcgtgtggtattcgctccaacgaacatcgccggagaaaaatgagagggtaagacagatgcgaccagtgtgcgattgccaagcccatctattgtggaacagaccccggttcggcgaaataaatgatcaggatcgcaccgaccggtacgttcaggcgctgcgcaccgtgctcaaacctgactcagtgtgtttgtgcgtttctgacggatctttactgtccgtgctggcccaccaccttggcgttgagcaagtgtttacagtggaaagcagcgctgcttctcacaagctcctgaggaaaatcttcaaggctaaccacttagaggataaaattaacatcattgagaagagaccagagctgctgactaacgaggatctccagggcaggaaggtatcactgcttctgggggagccattcttcacaacaagtctgctaccttggcataatctgtatttttggtatgtgagaacagccgtggaccagcacctgggacccggcgcaatggtgatgccacaggccgctagtctgcacgcagtagtcgtcgagttcagagatctgtggcgtattcgctctccatgcggggattgcgaagggtttgacgtccatatcatggacgacatgatcaaacgagcactggacttccgcgagagcagagaggccgagccgcaccctttgtgggagtacccatgtcgaagcctgagcgaaccctggcagattctgactttcgacttccagcagcccgtgccccttcaacccctctgcgccgaaggcaccgtggagcttagaagacccggacagtcacatgctgcagttttgtggatggagtatcatctgacgcccgagtgcactttaagtactggtcttctggaaccagctgatccagaggggggatgttgttggaacccccactgcaaacaagccgtgtattttttttcacccgccccagatccacgagctctgcttggaggtcctcgaacagttagttatgctgtggaattccatcccgataccggagacattattatggagttccgccatgccgacactcctgactag

SEQ ID NO: 17038 - DNA, 1935 bp, Artificial Sequence
  Description of Artificial Sequence: Synthetic coding sequence
atgtcagtcacccttacgtcagtgaaaagggttcagagttctcccaacttgctagcagcgggccgcgacagtcagagccctgacagcgcttggcggtcatataatgacggaaatcaggagaccctcaacggggacgctacctactcatccctcgctgccaagggctttcgatcagtgcggccgaacctgcaggataagcggtcccctacacagtcacaaataacggtgaatggcaactcaggaggagccgtttcccctatgtcatattatcagcggcccttctcaccctccgcatattctctgcctgcgtccctgaactcatcgatagtgatgcaacatgggaccagtctggactcgactgatacctatcctcagcacgcccagagtttggacggcacaacctcctctagcattcctctgtatcgatcgtcagaagaggagaaacgggtcacagtgatcaaggccccccattacccgggcatcgggcccgtggatgagtctggtattccaaccgccattagaaccacggtcgaccgacccaaggactggtacaagaccatgtttaagcaaattcacatggttcacaaacccggcctttacaatccgccttattcggcacagtcccatccagctgcgaaaacccagacatatcggcccctgagtaagtcccattctgacaatagtcctaacgcctttaaagacgcttccagcccagtcccccccccacacgttcctccacctgtaccccccttacgtccacgcgaccgctcatcaaccgaaaagcatgactgggatcctcccgacagaaaagttgatacccgtaagttcagatctgaaccgcggtcgatcttcgaatatgaaccaggcaagtcttccattctgcagcatgagaggccagcatctttgtaccagagctcgattgacagaagtctcgaacggcctatgtccagtgctagcatggcctccgactttaggaagcgaaggaaatccgagcctgctgtaggtccccccagagggcttggggaccaatccgcgagcaggactagtcctggtagggttgatctgcctggatctagtactacgctgacaaagagcttcacaagcagctccccttcctcccccagccgcgccaaagatcgggagagtcccagaagctattcctccacactgactgatatgggccgttccgcacctcgggagcgtcgaggtacccctgaaaaggagaagctcccggccaaggccgtttatgattttaaggcccagacatcgaaggagttatcctttaagaagggcgatactgtgtacattcttaggaaaattgaccagaattggtatgaaggggaacatcacggccgcgtgggcatctttcccatttcatatgtcgagaagctgacccctcccgagaaggctcagcctgctcgtccacccccaccggcacagcctggggagatcggcgaagcaatcgccaagtacaatttcaatgcagataccaatgtcgaactgagtctgcgtaagggagatcgcgttattctcctcaagcgcgtggaccagaattggtatgaaggaaaaattcctggcacaaataggcagggtatcttcccagtcagttatgttgaggtagtgaagaaaaacacgaagggcgcagaggactatccagatccaccaatcccccacagctacagtagtgatcgcattcattccttgtccagcaataagccacagcgacctgtgtttacccacgaaaacatacagggcgggggagagccctttcaggctctgtacaattacacaccccggaacgaagatgagctggagctcagggaaagtgatgtgatcgacgtcatggagaagtgcgatgacggatggttcgtgggaaccagccgcaggacaaaattcttcgggaccttcccgggcaattacgttaagcggctgtag

SEQ ID NO: 17039 - DNA, 294 bp, Artificial Sequence
  Description of Artificial Sequence: Synthetic coding sequence
atggggaaatcatgtaaggtggtcgtatgtgggcaggcgtccgtcgggaagacaagcattctggaacaattgctgtacggaaaccacgtagttggctccgaaatgatcgagacccaagaggacatctatgtcgggtcaattgaaaccgataggggcgtgagggaacagatcgccgaatctcttttcagcgtgtggagttgctcacggaggagattgacaaatcccagaactagacggcggtctccaagctggagtctcgctacttccgttacctaccgttcatccggggtctag

SEQ ID NO: 17040 - DNA, 915 bp, Artificial Sequence
  Description of Artificial Sequence: Synthetic coding sequence
atgtcgaagacccacgaccaccagctggaaagttccctctcgccagtcgaggtgtttgctaagacgtcagccagtttggagatgaaccagggggtttcagaagaacgtatccatctgggaagcagcccaaaaaaaggaggtaactgtgatctgtcacatcaggagcgcttacaaagcaagtccctacacctgtcccctcaggagcagtcagccagctatcaggataggcggcagtcttggaggagggcctcaatgaaagaaacgaacaggagaaagagtctgcacccaattcatcagggtattacagagctttctcggagcattagcgtggaccttgctgagtccaagcggctgggttgcttgctactctctagtttccagttcagcatacagaagctagagccatttttgcgggacactaaggggttcagcctggagagtttcagggccaaggcctcatctctaagtgaggagcttaagcacttcgccgatgggcttgagacagatggcacccttcagaagtgcttcgaggactcaaacgggaaggcatcagatttcagtttggaggccagcgttgcagaaatgaaggagtacatcaccaaattttcactggaaagacaaacttgggatcaactgctcctgcattaccagcaggaggcaaaagagatcttgtcgcgaggaagtaccgaggcaaaaatcacagaggtaaaggtggagcccatgacctacctcggctcttctcagaatgaagtgctgaacaccaaaccagattaccagaaaatcctgcagaaccagtcaaaggtatttgattgcatggaactggtcatggatgaattgcagggatctgtcaagcagctgcaagcctttatggacgagtccactcaatgctttcagaaagtgtctgtgcaactttag

SEQ ID NO: 17041 - DNA, 1842 bp, Artificial Sequence
  Description of Artificial Sequence: Synthetic coding sequence
atggcaaccatccccgactggaagctgcaactgctggccagacgtaggcaggaagaggcaagtgtcagaggacgggagaaagccgaaagggagaggttgtctcaaatgcctgcttggaaacgggggctgctagaacggagacgcgcgaagctgggactaagtcccggcgagccatctccagtgctgggtacggtcgaagcaggacctcccgatcccgacgagtctgcggtgctgttggaggctattggacctgtccatcagaatcgttttatcaggcaagagaggcagcagcagcagcaacagcaacagcggtcagaggagctccttgctgagagaaaacccgggccccttgaagctcgcgagcgcagaccctctccaggtgaaatgagagatcagtcacctaaaggcagggagtccagagaagaaagattgagcccgcgggaaactagggagcgtcggctgggaatcggtggtgcgcaggagctgtcactccggcctctcgaggcccgcgactggcggcagagccctggcgaagttggggatagatcttcgagattgagtgaagcctggaaatggagactgtcgccgggagaaactcctgagagatccctccggttggctgagtcccgggaacagtcaccaaggagaaaagaggttgaaagtcgactaagcccaggggaaagtgcctaccagaaactcggtctcaccgaggcacataagtggaggccagattcacgagagtcacaagaacagtcgcttgtgcaactggaggctacagaatggaggttacgatccggagaagaacgacaggactactccgaggaatgcggcagaaaggaagagtggccggtccctggtgtggcccccaaggaaactgcagaactatcagaaacgctcactcgcgaggcccaggggaattcctccgccggggttgaagccgctgagcagcgcccagtagaggacggggaacggggaatgaaaccaacagagggatggaagtggacgctgaactctggtaaggctagagagtggacacctcgggacatcgaggcacaaacgcagaaaccggaacctcccgaatccgccgagaagctgttagaatcacctggggttgaggccggagagggggaggccgaaaaagaggaagctggtgctcagggtcgaccgctgagggcgctacaaaattgctgttcagtgccatctcccttgccccctgaggacgccgggactgggggattgagacaacaggaagaagaggccgttgagctacaacctcctccacccgcgccactctcaccaccacccccagctccaacggccccccagcctccaggggaccctctcatgtctcgactgttctatggcgtgaaagcaggacctggagtcggagcaccacgaagaagtgggcacaccttcactgtaaatcctaggcgtagcgtgccccccgctacgcccgcgacacccacctccccagctactgtggacgcagcagttcctggtgccggcaagaaaaggtatccaactgccgaagagatactcgtcctcggaggttacttgagactgtcacggagctgcctggctaagggcagccctgagcggcatcataagcaactgaagatctcattttcagagacagcgctggaaactacatatcagtacccctcagagtcgagcgtcctggaggaactcggcccggagccagaagtgcctagtgctccgaacccccccgccgctcagcccgatgacgaagaggatgaagaggagctgcttcttctccagcctgaactgcagggcggtcttagaaccaaggctttaatcgtggatgagagctgtcgccggtag

SEQ ID NO: 17042 - DNA, 1560 bp, Artificial Sequence
  Description of Artificial Sequence: Synthetic coding sequence
atggagggcgtgctctataagtggacgaactacctaagcggttggcaaccccgctggttcctgctttgcgggggaatccttagttactacgactcaccagaggacgcatggaaggggtgcaaaggatctatacagatggctgtttgcgagatccaggtccactctgtagataataccaggatggatctcattatcccaggggaacagtatttctacttaaaagctagaagtgtcgcagagcggcagaggtggctggtggccctcgggtcagctaaggcatgcttgacggactcacgaacccagaaggaaaaagagtttgccgagaacactgaaaatctgaagactaaaatgtcagaactccgactgtattgtgatctccttgtgcaacaggtggataagaccaaggaggtgaccactacgggagtgtctaatagtgaagagggaatcgatgtaggcaccttactgaagtctacctgtaacacatttctgaaaacattggaagagtgcatgcagatcgcaaacgctgcatttacctccgaactcctgtaccggacacccccgggaagtccccagctggcaatgctgaagtcatcaaagatgaaacatcccatcatcccaattcataacagcctggaaaggcaaatggaactatccacatgcgagaacggcagtctcaacatggagatcaacggcgaagaagagattctcatgaagaacaagaattccctgtacctgaaaagcgccgaaattgattgttccatctcttcagaggagaacacagacgacaacatcacagtccagggagaaattaggaaggaggacgggatggagaatctgaaaaaccacgataataacctgactcaatctggcagtgactcctcgtgctcccccgagtgcctgtgggaggaggggaaggaggtcattcctactttcttctcaaccatgaatacatcgttctccgacattgagcttctggaggactccggtatacccaccgaagctttcctcgcgtcatgctacgccgttgtacccgtacttgacaaactcggcccgacagtttttgcccccgtgaaaatggacctcgttggtaatattaaaaaggtcaatcaaaagtacatcactaataaagaagaattcactacgctgcaaaagatcgtgctgcacgaggtggaggccgacgttgctcaagtcaggaattcggccaccgaagcactgctctggcttaagaggggcctgaagttcctcaagggatttcttacagaggtgaagaacggggagaaggacatccaaacagccctcaacaatgcctatggcaagaccctgcggcagcaccacggttgggttgttcggggagtgttcgccctggccctcagggctgccccgagttatgaggattttgtcgccgctctcactgttaaagagggggatcaccagaaggaggccttcagcattggtatgcagcgcgacctgagcctctacttgcccgcaatggaaaagcagcttgccatcctggatacattatacgaagtccatggccttgagtccgacgaggtagtgtag

SEQ ID NO: 17043 - DNA, 1446 bp, Artificial Sequence
  Description of Artificial Sequence: Synthetic coding sequence
atggcctcagccgccagtgtgacctctctggctgacgaggtgaattgccctatctgtcaaggcaccctgagagagcccgtaacgatcgactgtggtcacaacttctgtagagcttgcctgacccggtactgtgaaattccagggcccgatctggaggagtcccctacatgtccgctgtgcaaagagcctttcagaccgggcagtttccgacctaattggcagcttgccaacgtggtggagaatatcgaacggttgcagctcgtctccacgctgggactgggagaggaggacgtttgccaggagcacggcgaaaagatctactttttttgcgaagacgacgagatgcagctctgtgtggtgtgccgagaggccggagaacatgctacacacaccatgagattcctcgaagacgccgctgctccctatagggagcagatccacaaatgcctaaagtgcctccggaaagaacgcgaggagatccaggagatccagtcaagagagaataaacgaatgcaggttctgcttacccaggtgtccactaaaagacaacaagtaattagcgaatttgcacatctgcgaaagtttctcgaggaacaacaaagcatcttattagcacagttggaatcccaggatggcgatattttgagacagcgagacgagttcgatttactggttgctggcgagatttgccgttttagcgcgctgatcgaggagctggaggagaaaaacgagagaccagcccgtgaattgttgactgatatccggtctaccctcatacgctgtgagacgcggaagtgccgcaaaccagtggcagtaagtcctgaacttgggcaacgaattcgggatttcccccagcaggccctgccactgcaacgcgaaatgaaaatgttcctggaaaaactttgcttcgagctggattacgaacctgcgcacatatctctggaccctcagacctcccacccaaagctactgctctccgaagaccaccagagagcccagttttcctataagtggcagaattcacccgataacccacaaagattcgacagagcaacctgtgtgttggctcacactgggattactggggggcgtcacacttgggtggtgtcgatcgacctggcgcacgggggttcttgtacggtaggtgtcgtcagcgaggacgtgcagcgcaaaggggagttgagactgcgacccgaggaaggcgtgtgggctgtccggctggcctgggggttcgtatccgcactcggtagtttccctactcggctcactctcaaagaacagcccaggcaggtacgcgtttctctggactatgaggtaggttgggtgaccttcactaacgcagtgaccagagagcccatctatacatttacagccagctttaccaggaaggtgattccttttttcgggctgtggggccgggggtcctctttttcactatcctcatag

SEQ ID NO: 17044 - DNA, 1173 bp, Artificial Sequence
  Description of Artificial Sequence: Synthetic coding sequence
atgtccgccgccaatccagagacccccaattcaacaatttccagggaagcaagcacacaaagtagttccgcagcggctagtcaggggtgggtgttgcccgagggtaagatcgtgccaaatactgtgtttgttggcggtattgacgctcgcatggacgaaacagaaatcggaagttgttttgggaggtacggaagcgtgaaagaggtaaaaatcattaccaacaggaccggagtcagcaagggatacggtttcgtctcattcgtcaacgatgtggacgtccagaagattgtgggaagtcagattcactttcatgggaaaaagctgaagctcgggccagcaatacggaaacagaagctgtgtgccagacacgtccagccccgccctctggtggtaaatccccccccccctcctcagtttcaaaacgtctggagaaatcccaatacagaaacctaccttcagccccaaatcaccccaaaccctgtcacacaacatgtccaggcctactccgcttatccccactcccccggacaggtgattactggctgccagcttcttgtctataactatcaagaatatcctacctatcctgattccgcattccaggttaccacaggctaccagctgccggtctacaattaccagccttttcctgcatatcctcgcagccctttccaggtgacagctggatatcagctgcctgtctacaattatcaggcattccctgcctatcctaactctcccttccaggtcgcaacgggctatcagttccctgtttacaactaccagcccttccctgcttacccatcaagccccttccaggtgacagccgggtatcagctccctgtgtacaactaccaggccttccccgcatatcccaattccccttttcaggtagctacgggataccaattcccggtgtataactatcaggccttccccgcctaccctaactctcctgtacaggtcacaacgggatatcagttacctgtgtataattatcaggctttccctgcatacccaaatagcgccgtgcaggtaactactggataccagtttcacgtgtacaattatcaaatgccgccacagtgccccgttggagaacagcggcgaaacctgtggaccgaagcctataaatggtggtacctggtgtgcctgattcagcggagagactag

SEQ ID NO: 17045 - DNA, 1143 bp, Artificial Sequence
  Description of Artificial Sequence: Synthetic coding sequence
atggagaagaaaaagatggtgactcagggcaatcaggagccaaccaccacgcctgacgcaatggtgcagccctttactactattcccttcccccctccgccccaaaatggcattcccaccgaatatggcgttccccacactcaagactacgctggacagaccggagagcataacctgaccttatatggctccacacaggcacacggtgagcagagctctaattcccccagcacacagaatggatcattaaccaccgagggaggggcacagactgacggtcagcagagtcagactcagtcatctgagaattcagagtccaagtccaccccgaagagattacacgtgagcaacatccccttccgtttcagagaccccgacctccgacagatgttcggtcaattcggcaaaatactcgacgtggagatcattttcaacgagcggggttcaaagggattcggattcgtcacttttgagaatagtgccgacgctgaccgcgcccgggaaaagttgcacggaacagtggttgagggaaggaagatcgaagtgaacaacgccacagcgagggtgatgactaataagaaaatggttactccctatgccaacggatggaagctatctcctgttgtcggagctgtttacggacccgagctttatgctgcaagttcgttccaggccgatgtgtctctgggaaacgatgccgccgttccactgtctggccgcgggggtatcaatacctacattccattgatctcactgcctctggtgcccggctttccttatcctactgcggccacaacagcggccgcctttagaggagctcatttacgtggccgtgggagaacagtctatggcgccgtccgggctgtaccccccacagccattcctgcttaccctggcgttgtttatcaagacggcttttacggcgccgacctttacgggggctacgccgcataccggtacgcccagccagccacagcaaccgccgctacagccgccgccgccgcagccgccgcttatagtgatggatacggtcgagtgtacaccgcagacccataccatgctttggcgccagctgctagctacggggtgggagctgttgcatccttataccggggtggatattccagatttgccccctattag

SEQ ID NO: 17046 - DNA, 1614 bp, Artificial Sequence
  Description of Artificial Sequence: Synthetic coding sequence
atggaccccggggacgcggctattctagaatcctccctccgcatcctgtacagactatttgagtctgtgttaccccctctgcctgctgccctgcagtccaggatgaacgtcatcgatcacgtccgggacatggcagcggccggcctgcatagcaacgttagacttttgtcttcccttctgcttactatgagcaacaacaatccggagcttttctctcccccacagaaataccagctgctggtttatcatgcagactcacttttccacgataaggaatacagaaatgccgtatcaaaatacactatggccctgcagcagaagaaggctctgagtaagacgtccaaagtgagaccatccactggcaacagtgcttccactccccagagtcaatgcttgccatcagagatagaagtcaagtacaagatggccgaatgttacaccatgcttaagcaggataaagacgcgattgctattctggacggtatcccctctcgacagaggaccccaaagattaacatgatgctggctaatctctataagaaggcaggacaggagcgaccttcagtcacttcttataaggaggtgcttcggcagtgccccctggcccttgatgcaattttgggcctcctcagtctgtctgtcaaaggagccgaagttgcttccatgacaatgaacgtaatacagacagtgcccaaccttgattggttgtcagtttggatcaaggcttatgcatttgtgcatactggggataactctagggctatatccacgatctgcagtcttgagaaaaagtccttgcttcgagacaacgttgaccttctgggctcactcgctgatctatatttcagggcaggcgataataagaactcggtcctgaagtttgagcaggctcaaatgttggatccatatctcattaaaggcatggatgtctacgggtaccttctggcccgggagggcaggctcgaagacgtggagaatctgggctgccgacttttcaatatttctgatcagcacgccgaaccttgggtagtgtcaggatgccatagcttttacagcaaacgatacagcagggcgctgtatctcggcgctaaggcaatccagcttaatagcaactccgtacaagccctgttactgaaaggagcagccctgcgaaatatgggtagggtccaagaagccattattcatttccgggaagccattcgtcttgccccctgccgcctcgattgttacgaagggctcatagagtgttacctggccagtaacagcatccgtgaggctatggtcatggccaataatgtatacaaaacgcttggggccaatgcacagacccttacactgctcgctaccgtatgcctcgaggaccccgtcacacaggagaaggccaagactttgttggacaaggctcttacccagaggccagactacatcaaggccgtggtgaaaaaggcggaactgcttagtcgcgagcaaaaatatgaggacggaattgctctcctccgcaatgccttggcaaaccaatcggattgcgttctgcataggattctgggggacttcttggtcgctgtgaacgagtaccaagaggccatggaccagtacagtatagcattacgctag

SEQ ID NO: 17047 - DNA, 351 bp, Artificial Sequence
  Description of Artificial Sequence: Synthetic coding sequence
atggcctttatgactaggaagctatgggatttggaacagcaagtgaaggcccagactgatgaaatcttgtccaaagatcagaagattgcggcccttgaggatctggttcagaccctgcgtccccatcctgcagaagccacccttcagcggcaggaggagctcgaaacaatgtgtgtgcaattacagcggcaagtgcgggagatggagagattcctgtccgactatggcttgcagtgggttggggagccaatggaccaggaggattccgagtccaaaaccgtcagcgagcacggtgaacgtgattggatgaccgccaagaaattttggaagcctggaagggcgggtcgttag

SEQ ID NO: 17048 - DNA, 285 bp, Artificial Sequence
  Description of Artificial Sequence: Synthetic coding sequence
atgacgggctctcgcaattggagggctactcgggacatgtgtcggtaccggcacaactatcctgatttagttgaaagggattgcaacggagatactcctaatctcagcttctaccgcaatgaaattagatttctccctaatgggtgtttcatcgaggatatcctgcagaactggacagacaattacgacttactcgaggacaatcactcttatatccaatggctgttccccctgcgcgaacccggcgtcaattggcatgccaagccccttactcttcgcgaatag

SEQ ID NO: 17049 - DNA, 1029 bp, Artificial Sequence
  Description of Artificial Sequence: Synthetic coding sequence
atgcgtttctgggctccttggggcagccgaactccttcaggacgcagtttgtggacagaccctgtcacttactataccgctctccacatagctgtgttaagaaatcagcctgacatggtggagttgttagtgcatcacggagcggacgtcaaccgaagagacaggatccatgaatcatccccactggacctggcttctgaggagcctgagcgattgccctgccttcaaaggcttctggatctgggagccgatgttaatgcggcagataagcacgggaaaactgcccttttgcatgcgctggctagcagcgacggagtccagatccacaacaccgagaatattaggttactactggagggtggcgcagatgtgaaagctacgactaaggatggcgatacagtgtttacctgtattatcttcctgttaggtgagacagtgggcggtgataaggaagaagctcaaatgattaaccgattctgctttcaggtgacacgtctgcttttggcccacggagccgatccatctgaatgcccagctcacgagagcctgacacacatctgcctgaagtccttcaaattgcactttcctctgctgcgctttttgctggagtctggagctgcctataattgtagcctacacggcgcttcatgttggtctgggttccacattatttttgagcgactgtgtagtcaccccggctgcacagaggatgagtctcacgcagacctgctgcgcaaagctgagacagttctggatttaatggtaaccaattcacagaaactccagttgccggagaatttcgacatccacccagttggctcactcgctgaaaagatacaagccctgcacttttcactgcggcagttagagagctacccacctcctctgaagcatttgtgcagagtagccattaggctatacctccagccctggcctgtagacgtgaaagttaaggcactgccactccctgataggttgaagtggtacctcttatcggaacactctggatcagttgaagacgacatttag

SEQ ID NO: 17050 - DNA, 3192 bp, Artificial Sequence
  Description of Artificial Sequence: Synthetic coding sequence
atgccccatctccctctggcgtcctttaggcctcctttttggggtttgcggcacagccgcggcctgcctcggttccatagcgtaagcacccagagcgagcctcacggttcccctatttctagacgtaacagggaagctaagcagaagcgcctgcgagagaaacaggccaccctggaagccgaaatagccggtgaatcaaaatcgccggcagagtccattaaagcgtggcgtccaaaagaactggttctgtacgaaatccccacgaagcccggcgagaaaaaagacgtttctgggccactgcctcccgcatattcacctcgttacgtggaagccgcttggtacccatggtgggtacgggagggatttttcaagccagaatatcaggctagacttccccaggctacaggggaaacattttccatgtgcattcccccccccaacgttaccggaagcctgcatattggtcacgctctgaccgttgcgattcaggacgcactggttaggtggcatcgaatgcgcggggaccaagtgctgtgggtccctggctccgaccatgctggaattgcgacgcaagctgtggtggaaaaacagttatggaaagaaaggggcgtgagaagacacgaattgagcagggaggcttttcttagggaggtctggcagtggaaggaggccaaggggggcgagatttgcgagcagttgagagcgctgggggcatccctagactgggacagagaatgttttactatggacgtgggatcaagtgttgctgtcactgaggcattcgtcaggttgtacaaggcaggattattgtacagaaatcatcagctcgtgaactggtcctgcgcgctgcgctcagcaatctccgacattgaggtcgagaatcgcccattgcctggccatacacagctgaggttgcccggctgccctacccctgtgagctttggcctgctgttttccgtggcgttccctgttgacggtgagccggacgctgaggtagtggtcgggacaacacgtcccgaaacgctgcctggtgatgtggcggtggcagtgcaccctgacgattctcggtacacccacttgcatggtcgtcagctgcgccacccgctgatgggccagccactccccctcatcacagactatgctgtacagcctcatgtgggaacgggagcggttaaggtcacacctgcgcacagcccggccgatgcagagatgggggctcgacacgggcttagtcctcttaatgtgatcgcagaggacggcacgatgacttctctgtgcggggactggctgcaggggctgcataggttcgtggcccgagagaaaattatgtccgttctgtcagagagaggtctcttcaggggactgcaaaatcatcctatggtcctaccaatctgtagcagaagtggcgacgtgattgaatatctgcttaagaaccagtggttcgtgaggtgccaggagatgggcgcaagggcagctaaagctgttgagagcggcgcccttgagctgagcccttcattccatcaaaagaattggcaacactggttttctcacataggagactggtgtgtctcacgacagctttggtggggccatcaaattccagcctatctagttgtcgaagaccatgcccagggagaggaggattgctgggtcgttggacgctccgaagcggaggctcgggaggttgcagccgaactcaccggtagacctggcgccgagttgacccttgagagagatccagacgtactcgatacgtggttcagctcagctcttttcccattttctgcgctgggatggcctcaggagacgcctgatttggcccgattctacccactgagtttgttggaaacaggctctgatctgctcttattctgggtgggtcgcatggtgatgctaggcacacagctgacaggccaactgccatttagcaaggtgctgctgcaccctatggtacgtgatcgtcaagggaggaagatgtctaaaagtctaggaaatgtgctcgatccgcgcgacataatctcaggcgtcgagatgcagttgctgcaggaaaagttacggtctggcaatctcgatcccgcagaattggctatagtcgccgccgcgcaaaagaaagacttcccacacggcattcccgaatgcggaactgacgccttgaggttcacactgtgctcccatggggtccaagccggcgatctccatctcagcgtgagcgaggtgcagtcctgtaggcacttctgcaataagatttggaatgccctgcggtttatactcaacgcactcggcgaaaaatttgtgcctcaaccagccgaagaattaagcccctcttcccctatggacgcatggatactcagtcgactcgctctggcagcccaggaatgtgaaaggggatttctgacccgcgagctaagcctagtgactcacgcattgcatcatttctggctacataatctatgcgacgtgtatttggaagccgtcaagcccgtcctctggcattctcctcgccctctgggacctccccaggtgctgttttcgtgtgccgatcttggactgaggttgctagcccctctgatgcctttcttagctgaggagctctggcagcggttgccgcctcgccctggctgtcccccggcacccagcatttcagtggccccttatccaagtgcctgtagcctggagcactggaggcagcccgagctcgaacgaagattctcaagggtccaagaggttgtgcaggtgctaagagcgcttcgcgctacttatcaactaaccaaagcgcgccctcgggttctgcttcagagttccgagcccggagaccagggcttgttcgaggcgttcctggaaccacttgggactctgggttattgcggcgccgtaggactcctgccacccgggactgccgcgccctctggatgggcccaggcacccctgagcgacacggctcaggtatacatggagttgcaggggcttgttgacccccagattcagctgcccctgctggctgcgagaaggtataagcttcagaagcagcttgactccctgacagcacggactccttctgaaggagaggccgggacacaaagacaacagaagctcagctccctacagttagaactgagcaagctggataaggctgcatctcacctcaggcaactcatggatgagccacctgctcccgggtctccagaactgtag

SEQ ID NO: 17051 - DNA, 96 bp, Artificial Sequence
  Description of Artificial Sequence: Synthetic coding sequence
atgtctgacgaagtcttcagcaccaccctggcttacactaagtcaccaaaggtgacgaaaagaactacgttccaggacgaactgattcgggcatag

SEQ ID NO: 17052 - DNA, 606 bp, Artificial Sequence
  Description of Artificial Sequence: Synthetic coding sequence
atgcctctccagctcaagaatcccaggttaagacaaaagtccaggacccgttgcaacaagtcgcagaaaaaggctgagctgcttgacaacgagaagcccgcggctgtcgtcgccccaataaccacggggtacaccgtcaagatttccaattacggatgggatcagagcgataagttcgtgaaaatttacattaccctgaccggggtccaccaggtgcctactgagaacgtgcaagttcactttacagagcgctccttcgacttgttggtgaagaacttgaacggcaagagctactctatgattgttaataacctgctgaaacctatatcagttgagggcagctccaagaaggtgaagaccgataccgtgctgatcctctgtcgaaaaaaagtggagaatacacgctgggactatctcactcaggtggaaaaagaatgtaaagaaaaggagaagccctcctacgacaccgagactgatcctagcgagggtcttatgaatgtcttgaagaaaatctacgaggatggagatgacgatatgaaacggacaataaataaagcttgggtcgagtctcgggaaaagcaggcaaagggggataccgaattctag

SEQ ID NO: 17053 - DNA, 480 bp, Artificial Sequence
  Description of Artificial Sequence: Synthetic coding sequence
atggcgacgagtgccccgctgcgcagtctcgaagaggaggtgacttgttccatttgcctcgactatttgcgtgaccccgtgaccatcgactgtgggcatgttttctgtcggtcctgcaccactgacgtgaggcctatatctggttccaggcccgtttgcccgctgtgcaagaagccctttaagaaggagaacataagaccagtgtggcaattggaaaagattttgaaccaccttagcacactgagacgcgaccgcgacaaaatccaaggcttccaggcgaaaggggaggccgatattctggcggcccttaaaaagctgcaggaccagcggcagtacatcgtcgccgaatttgaacagggacatcagttcctgcgcgagcgcgaggagcaccttctggaacaactcgccaaacttgagcaggaactcacggaggggcgcgagaagttcaagagcaggggagttggggagctggccagatag

SEQ ID NO: 17054 - DNA, 4599 bp, Artificial Sequence
  Description of Artificial Sequence: Synthetic coding sequence
atgcagcgtgaactcgtatatgccagaggcgacggcccaggcgccccacggcctgggtcaacagcccacccaccacacgctataccaaactccccaccttccaccccagtacctcacagcatgccaccatccccttcccgcatcccgtatggaggtactaggtcaatggtcgttcccggaaacgccactattccccgggacaggattagcagccttcctgtgagccggccgatttctcccagcccgagcgcaatattggagaggagagatgtgaaacctgatgaagatatgtcgggcaaaaatatcgctatgtatcgcaacgaaggattttatgctgacccttatctttaccacgaaggaagaatgtctatcgcttccagccatggcgggcatcctctagatgttcctgaccatattatcgcttaccacagaacagccattcggtcagcctccgcctattgtaatcctagcatgcaagccgaaatgcacatggagcaatccctgtatagacagaagtctaggaagtatcccgattcgcatttgcctacccttggctccaaaactccccctgcttccccacaccgggtgtctgacttgcgcatgattgacatgcacgcgcattataacgcacatgggcctccacacacaatgcagcctgatcgggcaagtccaagcagacaggcttttaaaaaggagccaggcaccctagtgtatatagaaaaaccccgaagtgctgccggtctttcttctctagtggacttagggccacctctcatggagaaacaagtctttgcctattctacggccactatacccaaagaccgcgagacctccgagaaaatgatgaaaactaccgcaaatcgaaaccatacggattccgctgggaccccgcacgtctcagggggaaaaatgctctccgccctagaatccaccgttcccccctcacagcccccgcctgtaggcaccagtgctatccatatgtctctgttggagatgcgacgatccgtggcagagttaagactccagctgcaacagatgcgccagttgcagctccagaatcaggagttacttcgtgcgatgatgaagaaggcagagcttgaaatatccggtaaagtgatggagaccatgaagaggctcgaggatcccgtgcagcgccagagggtgctggtggagcaggaacgacagaagtacctgcacgaagaggaaaaaatagttaaaaaactgtgcgaactcgaggatttcgtggaagatttaaagaaggacagcacagccgcttccagattggtgaccctgaaggacgtggaagatggggcgtttttactgaggcaggttggcgaagctgtcgcaaccttgaaaggcgaattcccaaccctgcagaacaagatgagagctatcttacggatagaggttgaagccgtcagatttcttaaggaggaaccccacaagttggacagtctcctgaaacgagtgagatctatgacagatgttctgactatgctcaggcgccacgtgactgacggcttattgaagggcacagacgccgctcaagccgcccagtatatggccatggagaaggccactgctgccgaagtattaaagagccaggaggaagctgcccacacctctggccagcctttccattcaaccggggcccctggcgatgcgaagtcagaagtggtcccattgtcaggcatgatggttagacacgcccaatcgtctccggtcgtgattcagccatctcagcattccgttgcacttttgaatccagcccaaaacctacctcacgtggctagcagtccagcagtgccacaagaagccacctctacactccagatgtcacaggccccacaatctccccaaatccccatgaatggcagcgccatgcagagccttttcatcgaggaaatacacagcgtctccgcaaagaatagagccgtgtcgatcgaaaaggctgagaagaagtgggaggagaagcggcagaatctggaccactataacggaaaagagtttgagaagttacttgaggaagcgcaggccaacataatgaagagtatccccaatcttgaaatgcccccagccacgggcccgctgccgcgcggagatgctccggtagacaaggtggagctatccgaggatagccctaatagtgaacaggatctcgagaagcttggaggaaagtcaccacctccacctcccccaccgccccggcgaagctatctgcccggaagcgggcttaccaccacgcgctccggggatgtagtctacacgggacggaaagagaacattaccgctaaagctagcagcgaggatgccggaccgtccccacagactcgagccaccaaatacccggctgaggagcccgctagcgcctggactccttcgcctccgcccgtcacaacttcatcgagcaaagatgaggaagaagaggaggaggaaggggacaagatcatggccgaactgcaggcttttcagaaatgtagctttatggatgtcaactctaatagccacgctgagcctagtcgggccgattcgcacgtaaaagacactagatctggtgccaccgtgccacctaaggaaaagaaaaacctcgaattcttccacgaggatgtgcgaaagagcgacgttgagtacgaaaatggaccacagatggagtttcaaaaggttacaacgggcgccgtccggccttccgaccctcctaagtgggagcgtggcatggaaaactccatatccgacgcctcaaggacaagcgagtataagactgaaattattatgaaggagaactcaatatccaacatgtcacttctgagagatagtaggaactactctcaggagactgtcccgaaggcgagttttgggttctccggaatctccccattagaggacgagatcaacaagggttcaaagattagtgggctccagtacagcatcccagacactgagaatcagacattgaactacggaaaaacaaaagagatggagaagcagaacactgataaatgtcatgtttcatcccataccagactcaccgaaagttcagtgcacgatttcaagaccgaggatcaggaggtcataaccaccgactttggccaggtcgtactgcgaccaaaagaagcgagacacgccaacgtcaatccaaacgaagatggagagagttcttccagctctcccactgaagagaatgccgcaaccgacaacatcgccttcatgatcacagaaactactgtacaagtgctgagctccggggaggtccatgatattgtttctcagaaaggggaggacatccagaccgtgaatattgatgctaggaaagagatgaccccgcggcaagaaggaacagacaacgaagacccagtcgtttgtttggataagaaaccagtcatcataatcttcgacgagccaatggatatacgtagcgcctataaacgtttaagcacaattttcgaggaatgtgacgaggagttagagcggatgatgatggaggagaaaattgaagaagaggaggaggaggagaacggcgactcggtggtacagaacaataacacaagtcagatgtcacataagaaggtggcccccgggaatctacggaccggtcagcaggttgagactaagtcccagccccacagcttggcaacagagacaaggaatccgggcggacaagaaatgaatcggacagaactcaacaagttcagtcatgtcgacagccccaattctgaatgtaagggcgaggacgcgactgacgaccaatttgagtcccctaaaaagaaatttaaattcaagtttccgaagaagcagttagccgccctcacccaggccatcaggacaggcaccaaaactgggaagaaaacacttcaggtggttgtgtacgaagaagaggaggaagacgggaccctcaagcagcacaaggaggcaaaaagatttgaaatagcaaggtctcaacccgaggacacacccacaagcatacccagcgcctctaggaagggctcatccggtgctccccagacctcccgcatgccagtcccaatgtccgctaaaaaccggccagggacgctcgataagccaggcaaacagtcgaagctccaggaccctcgtcagtacaggcaggctaatggatcagccaagaaatccggtggagactttaagcccacaagccctagtctgccggcatcgaaaattccagccctatccccttcctcaggaaagtcttccagcctaccctcctctagtggcgactcctcaaatctcccgaaccctcctgctacaaagccaagcattgccagcaatccgttatctccacagacgggcccaccagcccacagtgctagcctgattcctagcgtgagcaacggcagtttgaagtttcagtctctcacccacaccgggaaaggccaccacttgtcattcagtcctcagagccagaacggacgtgctcctcccccattgtccttttcctctagcccaccgtctcccgcttcctccgtcagcctgaatcagggcgccaaaggcacacgcacgattcatacacccagcctcacaagttacaaggctcagaatggctctagctccaaggccactccatctaccgctaaggagacttcttag

SEQ ID NO: 17055 - DNA, 1566 bp, Artificial Sequence
  Description of Artificial Sequence: Synthetic coding sequence
atgaccagcgcctttaaactagattttttgcctgacatgatggtcgagggcagactgctggtacccgatcggatcaacggtaccgcaaacaaaatgaatggagcactagatcatagcgatcagcccgatcccgatgcaattaagatgtttgtgggacagattccacgatcttggtccgagaaagaactaaaggagctctttgagccatacggggccgtctatcagatcaacgtcctcagagacaggagccagaaccccccccagtccaaaggctgctgttttgtgacattttacactcggaaagccgccctcgaagcccagaacgcccttcataacatcaaaactctgcctggtatgcatcatcccatccaaatgaagccagccgatagcgagaaaagtaacgctgtcgaggataggaagttgtttatcggaatggtttcaaagaaatgcaatgagaacgatatcagagtaatgttcagccctttcggccagattgaagaatgccgcatcctcagaggacctgatgggctcagcaggggatgtgcattcgtaaccttttctactcgagccatggctcagaatgccatcaaagccatgcatcagagtcaaacaatggagggctgttcctcacctatcgtcgtaaagtttgccgacacacagaaagacaaggagcagagaaggctacaacaacagttggctcagcagatgcagcaactcaacactgctacgtggggcaacctgacagggctcgggggattaacaccccagtatttagccctgctgcagcaggccacgtctagtagcaatcttggcgccttctccgggatccagcagatggccggaatgaatgctcttcagctccagaacctggctaccctggcagcagctgccgccgccgctcagacaagtgccacatccactaacgcaaaccccttgtctaccacctcctccgctttaggtgccctcacttctccagtcgccgcatctacaccgaattcaacagcgggagccgccatgaactccctgacatctctcggcacgctgcaagggctggcaggggcaactgttggattgaacaacataaatgcgttggccgtggctcagatgcttagcggtatggccgccctcaacgggggcctgggagctactggtctgaccaacgggaccgccggcaccatggacgccctcacccaggcgtactctggaattcaacagtacgcagccgcagcactgccaactttgtacagccaatcactcctgcagcagcaatccgctgcaggctcccagaaggaaggcccagagggagccaacttatttatctaccacttgccccaagaattcggggatcaggacatcctgcaaatgtttatgccctttgggaacgtgatatcagccaaagtctttatagataagcagactaacctcagcaaatgcttcggatttgtgtcatacgacaatcctgtgagcgcccaagcagctatccaggccatgaacggatttcagattggaatgaagcgactgaaggttcagctgaaaaggagtaagaacgacagtaagccttactag

SEQ ID NO: 17056 - DNA, 315 bp, Artificial Sequence
  Description of Artificial Sequence: Synthetic coding sequence
atgtccgagcagggcgacctgaatcaggctatagcagaggaaggcggaaccgagcaagaaacagccacacccgagaatggaattgtgaagtccgaatcattggacgaagaggaaaaactggaactgcagcggaggttagaggcccagaatcaggaacgcaggaagagcaagtccggggctggcaagggtaaattgacgcgctccttggccgtgtgtgaggagagctcagcccgccctggcggcgagagcctgcaagaccaggaatccattcacctgcaactatctagcttttctagtctccaggaagaggactag

SEQ ID NO: 17057 - DNA, 1653 bp, Artificial Sequence
  Description of Artificial Sequence: Synthetic coding sequence
atggagccgccccaggagactaatcgacctttttcgacattggataaccgttcgggacaagttcaggtactctccgcgacgcctttacttcagcggaatccttattcctcgcctgatatcatgcacatcaaaggaagtgaggccagtagcgtcccatacgcactgaatcagggcacaactgcgctgcccaaaaacaagaatcaggaaggtactgggcaccggttgctcaatatgctgagaaagacgctcaaagagagtgattctgaagaactcgaaattacacaggaaacacccaacttggtaccattcggagatgtcgtgggttgtttagggatccacatcaaaaactgtaggcattttatgcccaaaatttcgttgcagcattatgccaacctcttcatccgaatcagcatcaacaaggccgttaagtgcaccaagatgtgttccttgctctcaaagaatgacgaaaagaatacagtgatcaaattcgatgaagtcaagtattttagtgtgcaggttccgcggcgctatgacgacaagcgcaataacattttgctggagctaatacagtacgacaatagggagaaaagggccttcctgctcggttctgtgcaaatccacctctatgaggtaatccagaaagggtgtttcatcgaagaagttcaggttctgcatggtaacatttttgtgtgcaggctggaggtagaattcatgtttagctacggaaattttggttatggattttcacatcagctgaagccgttgcaaaaaattacggagccgtcaatgtttatgaacctggctcctcccccggaaagaacagaccccgtaacgaaagttattactccccaaacagtggagtacccggctttcctatctcccgacctaaacgtgacggtaggaactccagcagtacagtcaagtaatcaaccaagcgtagttagactggagaagcttcagcagcagcccagggaacggttagaaaagatgaagaaggaataccgaaacctcaacacatggatagataaggcgaactatctcgagtccattctgatgcctaaattggagcataaagactctgaggagactaacatcgacgaggcaagtgagaacaccaagtctaatcatcccgaggaagagctggagaacattgtcggcgtggacatcccgcttgtcaatgaagaagccgaaacaacagcaaacgaactcctggacaacgattctgagaagggactgacgatacctactctgaatcaatccgatcaggacaacagcaccgccgacgcttctaagaatgacgaaagtacccctagcccaactgaggtgcactcactctgtaccattagtaatcaggagacaataaaagccggcaggatacctccattaggagagagacagagcgaatcgatgcccgacagaaaaatgaagaatgtctttttcccacttgaggtaaaactgaaagacaactacccgagcattctgaaagctgactcttctctttccgaggtaaacctacggagcatctgcattaatcctaagagcagaaacctcgactcatccccaacggagatctcgtggcagaataacaacttgaatctcgcagagcgggagaatacggggctggtgagtacaaggctcaaaatcaagcgatag

SEQ ID NO: 17058 - DNA, 363 bp, Artificial Sequence
  Description of Artificial Sequence: Synthetic coding sequence
atgagcatctcctccgacgaggtgaacttcctcgtgtacaggtacctgcaggagtccggcttttcacatagcgcatttaccttcggcatagagtctcacatctcacaatcgaacattaacggagcgctcgttcctcccgcagctctgatctctatcatccagaaggggctacagtacgtggaggccgaggtgagcattaatgaagatggcactcttttcgacggccgacccatagaaagtctatcactgatcgatgccgtgatgccagatgtggtccaaactcgacagcaggcctaccgggataagttagctcagcagcaggcagctgccgctgctgccgctgcagccgccgcttcacagtag

SEQ ID NO: 17059 - DNA, 222 bp, Artificial Sequence
  Description of Artificial Sequence: Synthetic coding sequence
atgtcttactatcagcgacctttctctccctcagcttactctctgcctgctagcctgaatagctcaattgtgatgcagcatggtacatccctcgactctactgatacatatccacaacacgcccagtccctggacgggaccactagttcatctattcccctgtacagatcctccgaggaggagaagagggtgaccgtgatcaaggccccccattatccgtag

SEQ ID NO: 17060 - DNA, 717 bp, Artificial Sequence
  Description of Artificial Sequence: Synthetic coding sequence
atgacagaagactcccagcgtaactttcggtctgtttactacgagaaggtgggcttccggggagtcgaggagaaaaagtctctcgagatcctcctcaaagacgaccgattggggattctcccgccacaccacgagtcacacgctaaagtgatgatgtaccgcaaggaacagtatctggacgtcttgcacgcactaaaagtggtgcgctttgtttcagacgccactccgcaggccgaagtgtatctgcggatgtatcagttggagtctggtaagttaccacgaagccctagctttccactcgaacccgatgatgaggtctttctggctatcgctaaggctatggaggagatggtggaggacagcgtggactgttattggatcactcgacgcttcgtgaaccagcttaacaccaagtaccgggactccctgcctcaactgcccaaggctttcgagcagtacttgaatttggaggacgggcggctgcttacgcatcttaggatgtgcagcgctgctcccaaacttccatacgatctatggttcaaaaggtgttttgccggatgtctgcccgagtcctccctccagagggtctgggataaagtcgtcagcggcagctgcaaaattctggtgttcgtcgcggtggagattttgctgacgtttaaaatcaaggtgatggcccttaactccgctgaaaagatcacaaagttcctggagaattag

SEQ ID NO: 17061 - DNA, 1620 bp, Artificial Sequence
  Description of Artificial Sequence: Synthetic coding sequence
atggccaccagcgcccctttgcgaagcctggaagaagaagttacttgttcaatttgcctggactatcttagagaccccgtaaccatcgactgtggacatgtgttctgccggtcctgtacaacggacgtgaggcctattagcggctctcgccctgtgtgtccgttatgcaagaagccattcaagaaggagaacatacgtcctgtgtggcagcttgccagcctcgttgagaacattgagcgtctcaaggtggacaaaggtcgccagcccggagaggttacaagagagcaacaggatgccaaactctgcgaacgtcaccgcgagaagctgcactactactgcgaggatgacggaaagttgttgtgcgtgatgtgccgcgagtcaagggagcaccgcccacatacagccgtgctaatggagaaggccgctcaacctcaccgcgagaaaatcctgaatcacctctcaacattgcgacgcgaccgcgacaaaatccaggggtttcaggcaaaaggtgaggctgatatcttggctgctctcaaaaagctgcaggaccagaggcagtacatcgtcgctgagtttgagcagggacaccagttccttcgggagcgcgaggagcatctcctggaacagctggccaagctcgaacaggaacttacggagggaagagagaaattcaaatcacgtggcgtcggcgagctggcccgactggcattggttatttctgaacttgaggggaaggcgcagcagcctgccgcagaactgatgcaggacacccgggacttcctgaatcggtaccctcgaaagaagttctgggtgggaaaacctatagctagggtcgttaaaaaaaagacgggagagttcagcgataagctgctctcattgcagcgtggacttagggagttccaaggcaagcttcttcgggatcttgagtataaaaccgtgtcggtgacacttgatcctcagtccgccagcggctacctccagctcagtgaggactggaagtgcgttacatacacctccctctataagagtgcttatcttcacccacagcagtttgactgcgagcccggcgtgcttggcagcaagggtttcacatggggcaaggtgtactgggaggtggaagtagagcgagaggggtggtcggaagatgaagaggaaggagatgaagaagaggaaggggaagaggaggaagaagaggaagaagccgggtatggagacggttatgatgattgggagactgatgaggatgaagaaagcctgggggatgaagaggaagaggaagaggaggaagaagaggaagtgctggagtcctgcatggtcggtgttgcccgcgatagcgtgaagcgcaaaggagacctttccttgcgccctgaagatggcgtgtgggctttgaggctgtcgtccagtggcatatgggcaaatacctccccagaggccgagctgtttcccgccctcaggcctagacgggtgggaatcgctctggattatgaaggcggcactgtgacttttaccaatgccgagagccaagagctgatctacacatttactgcaacgttcacccgtagactggtgccattcctttggctcaaatggcctgggacgcgtttattgcttcggccatag

SEQ ID NO: 17062 - DNA, 609 bp, Artificial Sequence
  Description of Artificial Sequence: Synthetic coding sequence
atggggcagaaggtgacaggtggaattaagactgtcgatatgagagaccccacctacagaccgctgaagcaggagctgcagggcctggattactgtaagccaaccaggctagatttactactggacatgcctcccgtgagttacgatgttcaactccttcacagctggaataataatgacaggtctctgaatgtgtttgtcaaggaggacgataaacttatctttcaccgccatcccgtagctcagtccaccgatgcaattcgaggcaaagtgggttacactagaggcttgcatgtgtggcaaattacatgggccatgagacagagaggaacacatgccgtcgttggagtggctactgctgacgcccctttacatagcgtgggatacaccactctagttggaaataaccacgagagttggggctgggatctgggtcgcaatagactgtaccacgatggtaaaaatcagccatctaagacctaccctgcctttctcgagccagatgagaccttcatcgttcctgactcctttctcgtagcactcgatatggatgatggcacactgtcctttattgtggacggtcagtatatgggagtcgctttccgttag

SEQ ID NO: 17063 - DNA, 174 bp, Artificial Sequence
  Description of Artificial Sequence: Synthetic coding sequence
aacctccccatttgcatggcaaagacccacctcagcttaagccatcagcctgataaaaaaggcgtcccaagagactttatattgcctatctccgacgtgagggcatccattggggccggttttatatatccattagtcggtactggcgggagggaggctcccctctggctgtag

SEQ ID NO: 17064 - DNA, 468 bp, Artificial Sequence
  Description of Artificial Sequence: Synthetic coding sequence
atgaacaaccaaaagcagcagaagcctactctttccggtcagcgctttaaaacacggaagcgggatgagaaagagagattcgatccaacccagtttcaggattgtatcatacaaggcctgaccgagaccgggacagatcttgaagctgttgctaagtttctggatgcttccggcgctaagctggactaccggaggtatgctgagacgttgttcgatattcttgtggccggaggaatgcttgcccccggcggcactctcgcagacgacatgatgagaacagatgtgtgcgtctttgccgcccaggaggacctggaaactatgcaggccttcgcccaggtgtttaacaagcttatccgaaggtacaagtatcttgaaaaaggctttgaagacgaggttaaaaaactgctgctgtttctaaagggtttctccgagtcggaacgcaacaaactggctatgttgacagggtag

SEQ ID NO: 17065 - DNA, 528 bp, Artificial Sequence
  Description of Artificial Sequence: Synthetic coding sequence
taatttgacgaccagcggcgtatgtccttgcatctgcacggagcggactgtgatccaaaaacccagaatgagatgaacatttgtgaagaggagtttgtggaatataaaaaccgagatgcaatatcagccctgatgcccttattcagcgaggaagagtcttcggacggctctaaacataataacggactcccggatcacataagcgcacaactacaaaatacctacaccttgaaggcgttcaccgtgggcagcaagtgtgtggtctggtcaagtctgcggaacacctggtccaagtgtgaaattctggagacggccgaagaaggtacacgggtcctgaatctctctaacggtatggaagaaattgtcaacccggagaatgtgtggaatgggatcccaaagctggataagtctccccctgaagctgtgagtcaacgagttggcaaggatctttattttatgtctgttggggacacaactatcaaggagaagggcttcggaggagatggtgatctgactgtggatctgtag

SEQ ID NO: 17066 - DNA, 2814 bp, Artificial Sequence
  Description of Artificial Sequence: Synthetic coding sequence
tgattacgatcacaacccggttgtggctgcctctggcaggaggcacctacccattcaacagggccttcagtcgagggcgaagcacctagttcagagaccggaacgtcgctggactctccaagcgcctacccacagggcccactggtgccgggcagctctctctcacccgatcactacgagcacacatctgttggggcctatgggctttattcaggccctcctgggcagcagcaacgaactaggcggcctaagctccagcactctacaagtatacttagaaagcaggccgaagaggaggccataaaacggagtcgatccctgtcggagtcttatgaattgtcttccgatctccaggacaaacaggttgagatgctcgaaaggaagtacggaggtaggcttgtgacgaggcatgctgcaagaactatacagacggcctttaggcaataccagatgaacaagaattttgaaagattaaggtctagcatgtctgagaaccgtatgagccgccggattgtgctgagcaatatgaggatgcagttctcttttgagggacccgaaaaagtccacagtagctatttcgaaggaaagcaggtctcggtgactaatgacggaagccagctgggggctctcgtttctccagagtgcggagatcttagcgagcccaccactttaaaatctcccgcaccctctagcgatttcgccgacgccattacagagttggaggacgcgttttctaggcaggtgaagtcccttgctgaatctatcgatgatgccctaaactgtagaagcctgcatactgaggaggcacctgccctggacgctgcccgagctcgcgataccgagcctcagactgcgttgcacggaatggaccacaggaaactggacgaaatgacagcctcgtactccgatgttaccttgtatatcgacgaggaggagctgtccccccccctcccactgagtcaggctggagaccggccttcaagtaccgagagtgacctgaggttaagagccggaggcgcagcaccggactattgggccctggcccacaaagaagataaagcggacacagacacttcttgtcggtctacacctagcctggagcgccaggagcaacgcctgcgcgtggagcatctccccctgctgacaattgaaccaccaagcgacagcagcgtggacctgtcagatcgaagcgagagggggagtctcaaaagacaatccgcttatgaacgtagtcttggtggccagcaaggctcaccaaagcacgggccacattcgggcgcccccaagtctctacccagagaagaacctgaactacgacctcgaccccctcgccccctggactcccatctggcgattaacggttctgccaacagacagagcaagtcggagtccgattactcggacggtgacaatgattcaataaattccactagtaattccaacgacaccattaactgttcctctgagagtagctccagggacagcctgcgcgagcagaccctttccaagcaaacctatcacaaggaagcccgcaactcctgggatagcccagccttctccaacgacgtcattaggaaacgccattatcggattggcctgaatttattcaataaaaaaccagagaagggtgtccagtatctaattgaacgtgggttcgtgccagacacacccgtcggggtggcgcactttttgcttcagaggaagggacttagccgacagatgatcggagaatttttaggcaacaggcagaagcagtttaaccgggatgtgctggattgtgtggttgatgaaatggatttcagcaccatggagctggacgaggccctgcgcaagttccaggcacatatcagagtgcagggtgaagcccagaaggtggagcgcctgattgaggccttctcccagagatactgcatttgcaacccaggagtcgttagacagtttcggaaccctgatacaatctttattttggcttttgctattattctactcaataccgacatgtactcacctaatgttaaaccagagaggaagatgaagctggaggacttcatcaaaaatctgaggggggtcgatgacggggaggacatcccacgtgagatgctgatgggaatctatgaaaggataaggaagcgtgagctcaaaactaacgaagaccatgtgtcacaagtgcagaaggtggagaagctgatcgtgggcaagaagccgatcgggtctctgcatcctgggctcggatgtgtcctgagccttccccaccgaagactggtgtgctattgcagacttttcgaggtccccgatcctaacaaaccacagaaactggggttgcaccagagggagatcttcctttttaatgacctcttggtggtgactaagatctttcagaaaaagaagaactctgtgacctactcattccgacaaagcttctctctgtatgggatgcaggtgcttttatttgaaaaccagtactaccctaacggcatcagactaacttcttcagttcccggggctgacatcaaagtgctgatcaatttcaatgctccgaatcctcaggatagaaaaaagttcaccgatgacttgcgggagtccattgctgaggtgcaagagatggaaaagcatcgtatagagagcgaactggagaaacagaaaggagttgtgcgtccaagcatgtcccagtgttcatccctgaagaaggaatcgggaaatggcactctctctagagcttgtcttgatgattcgtacgcctccggcgaggggctcaaacgaagcgcgctctctagcagtctgcgagacttgagcgaagccggggtccatcactag

SEQ ID NO: 17067 - DNA, 198 bp, Artificial Sequence
  Description of Artificial Sequence: Synthetic coding sequence
atggtcgaggctgcggatcgtgagaaggtggagctactgaaccaacttgaagaggaaaaacgtaaagtcgaagatcttcaatttagggtagaggaagagtccatcaccaagggggatctagaacaaaaaagccagatatcagaagatcccgagaacgtcgcaacagtatctgagaagtccagaattatggagctgtag

SEQ ID NO: 17068 - DNA, 630 bp, Artificial Sequence
  Description of Artificial Sequence: Synthetic coding sequence
atggatttcctgttgggtaatccgtttagctcgcccgtggggcagcgtatcgaaaaggccacagacggaagcctgcagtcagaggactgggccctcaatatggagatctgcgacatcatcaacgagactgaggaaggtcccaaagacgcgctgagggctgttaagaaacgcatcgtgggtaataagaatttccacgaggtgatgctggccctcaccgttctcgaaacatgtgtgaagaactgcggacatcgatttcacgtgttggttgcaagtcaagattttgtcgaatcagtgctcgttaggacaattctgccaaaaaacaaccctcccactattgtccatgataaggttctaaatctgatacagagttgggctgacgccttccggagttctccggatctgacaggggtggtgactatttacgaggatttgcgacgcaaaggcctggagtttccaatgacagatttagacatgctgagtcccatccacactcctcgcgggccgtgtagtacacaaagacataaccaggatagaattctttgggctctgaccccagcaagtaagagaacgctggcatcaatgctgccattatgtccgccacgaccttatagccctgtgactaggccttag

SEQ ID NO: 17069 - DNA, 255 bp, Artificial Sequence
  Description of Artificial Sequence: Synthetic coding sequence
atggccgatacagacctgttcatggagtgtgaggaagaagagctggaaccctggcaaaagatctcggacgttatcgaggattcggtagtggaggactataacagcgtcgacaaaacgaccaccgccggaaatccgctcgtccagcaagggggacagccactgatcctgacacaaaatcctgcacccgggctaggtaccatggtgactcagccggtgttgcgacctgttcaggtgatgcagaatgctaatcactag

SEQ ID NO: 17070 - DNA, 618 bp, Artificial Sequence
  Description of Artificial Sequence: Synthetic coding sequence
atggcaactcctctgggttggtcaaaggcaggatccggatcagtttgcctcgccctcgaccagcttagggatgtcatcgagtctcaagaggaactgatccaccagttaagaaatgtgatggtcctgcaggacgagaatttcgtctccaaagaagagttccaggccgtggagaaaaagcttgtggaggaaaaagcagcacatgcaaaaactaaggtcctgcttgccaaggaggaggagaaacttcagttcgccttaggggaggttgaggtcctgagcaaacagttggaaaaggagaagctggcttttgagaaagctttgtcatctgtgaagtctaaggtcctgcaggaatccagtaaaaaggaccagttaataacgaagtgtaatgagattgagtcccacattattaagcaggaggatatcctgaacggcaaggaaaatgagatcaaagaactccagcaggttatttcacagcaaaagcagatattcagaaaccatatgtccgattttcggatccaaaaacagcaagagtcatatatggcccaggtcctggatcagaagcacaaaaaggcgagcggtacccgccaagcgcggtcacaccaacacccgagggagaaatag

SEQ ID NO: 17071 - DNA, 330 bp, Artificial Sequence
  Description of Artificial Sequence: Synthetic coding sequence
atggagccaagtgctcagcaactgcagcttgcggcatctctgcccgctaacctgtctaacttttgccaaggcagcgagatgcctaccaccagtcggcccgctcttgacgtaaagggtggaacttcgcctgcaaaagaggacgctaaccaagagatgtcttccgtcgcatatagcaacctggccgtgaaggaccgcaaggcggtggcaatacttcactaccccggtgtagcctccaacggaacaaaggccagtggcgcccctacttcttcctccggctctccaatcggctcacctactactactccacccacgaaacccccaagcttctag

SEQ ID NO: 17072 - DNA, 1737 bp, Artificial Sequence
  Description of Artificial Sequence: Synthetic coding sequence
atgcccgaaatccgtgtgaccccactgggtgcaggtcaagatgttggaaggtcctgtattttagttagcattgccggaaagaacgtcatgctcgattgcggaatgcacatggggttcaatgatgataggcggtttccagactttagctatattacacaaaatgggcggcttaccgactttctggactgtgtgatcatctcccacttccatctggaccactgcggggctcttccttatttctctgaaatggtcggctacgatggtccaatatatatgacacatcctactcaggcaatatgtcctatcctgcttgaagactacaggaaaattgccgtggataagaagggtgaagcaaattttttcactagccagatgattaaagattgtatgaagaaggttgtggccgtgcacctacaccagacagtgcaaatcaaggtgggctccgaaagtgtggtctataccggggactacaatatgacacctgacagacacttgggcgccgcatggatcgataaatgccggccaaatttattgattacagagtcaacatatgccactacaatccgcgattctaaacgctgcagagaaagagactttcttaaaaaggtacatgagaccgtggagcgagggggaaaagtgttaattccggttttcgcattgggacgggcgcaggagctgtgcattcttctggaaactttttgggagcggatgaaccttaaggtccctatctacttctccaccggcctgactgagaaggcaaatcactactacaagctcttcatcccctggacaaatcagaagatccgcaagacgttcgtacagcgcaatatgtttgagtttaagcacatcaaggcatttgatcgcgccttcgcagacaaccctggaccaatggtggtgttcgccactcctggtatgcttcatgcaggccagtcattgcaaatttttagaaaatgggcgggaaacgaaaagaacatggtcattatgcccggctactgcgtgcagggcacggtcgggcataagattctcagtggccagagaaaactggaaatggaaggacggcaagtgctggaggtgaaaatgcaagtagaatacatgtctttcagtgctcatgccgacgcgaaaggaatcatgcagctggtaggacaggcagaacctgagagcgtattgctagtccatggggaggctaaaaaaatggaattcctgaagcagaagattgaacaagagctaagagtgaattgctacatgccagccaacggggaaactgttactctgccgacatcgcctagcataccagtaggcatttccttggggctacttaagcgggaaatggcccaggggctgctgcctgaggccaaaaaaccacgtttgctgcatgggacactaatcatgaaggattccaatttccgccttgtttccagtgagcaggctttgaaggagctggggctggctgaacaccaactgagatttacttgtcgtgtccacctgcacgatacccggaaggagcaggagacagcacttagagtgtatagccaccttaaaagcgtgttaaaggaccactgcgtgcagcatctgccagatggttcagtgactgtggagtccgtgctgctgcaggccgccgcgccatccgaggatcccggaacaaaggtcctgctagtatcctggacctaccaggacgaagagctgggcagcttcctgaccagcttgctgaaaaagggcctaccccaagctccaagctag

SEQ ID NO: 17073 - DNA, 570 bp, Artificial Sequence
  Description of Artificial Sequence: Synthetic coding sequence
atgcagcctatgtcattcggatgggaccattctctgcacaagcgcaagaggttacctcccgtgaaaaggtctctggtgtactatttgaaaaaccgggaggtacggctgcagaacgagacctcatattcaagagtcctgcatggatatgccgctcaacagttaccttcactgctcaaggagcgcgagtttcacctcggaactctcaacaaggtgtttgcatcccagtggctgaatcacaggcaggtcgtatgcggcaccaaatgcaataccctgtttgtggtcgatgtgcagacgtcacagataactaaaattcctatattgaaggacagagagccgggtggcgttacacagcagggctgcggtatccatgccatcgagctgaatccttcccgaacactgttagctaccggaggtgacaacccaaactccctggctatctaccgattgcctacacttgatcccgtgtgtgtgggggatgacggccacaaggactggattttttctatcgcgtggatttcagataccatggctgtgtccgggtctcgtgatggctcaatgggcctgtggtag

SEQ ID NO: 17074 - DNA, 2289 bp, Artificial Sequence
  Description of Artificial Sequence: Synthetic coding sequence
atggcttcgctgctgcaggaccagcttacaaccgatcaggacttgctcctgatgcaagaggggatgcctatgaggaaggtacggtccaagtcctggaagaagttgcggtatttcaggctccaaaatgatggcatgactgtctggcacgcccgacaggcccggggatccgccaaacctagttttagcatcagtgatgtagagactatcagaaacggtcacgactcagagctgctacggtcgctggcggaggagctgccactcgaacagggtttcactatagtgttccacggtagaagatctaatcttgaccttatggctaatagcgttgaagaggctcagatatggatgcgaggtctccagctgctagtcgatttagtgactagcatggaccaccaggaacgactcgatcagtggctgtcggattggtttcagcgcggcgataaaaaccaggacggtaaaatgagcttccaagaagtgcagcggctgctccatctaatgaacgtcgagatggaccaggaatacgcatttagtttgttccaagctgcggacacatcacagagtggtactctcgagggtgaagagttcgttcaattctacaaagctttgacgaagagagccgaggtgcaagaactctttgagagcttcagtgctgatggccaaaagctgacgctgcttgagttcctggacttccttcaggaggagcagaaggaacgcgactgcacctccgaactggctctggaactgatcgatcggtatgagccatccgactccggcaagcttagacacgtgctcagcatggacggatttctatcttacctctgttctaaagacggagatatatttaacccagcgtgcctcccaatctaccaggatatgactcagcctctgaatcactacttcatttgcagctcccacaatacctatttggtgggtgaccagttgtgcggccaatcctctgtcgagggatacatcagagcactgaagcggggatgtcgctgtgtggaggttgacgtgtgggacggaccttcgggggagcctgtggtatatcatggccacacccttacatcgaggatcctctttaaagacgtggtcgccaccgtcgcccagtacgcatttcagacgagcgattatccagttattttgagtctggagactcattgctcctgggagcagcagcaaaccatggcaagacacctgaccgagatactcggagagcagctgttgagcaccacattggatggagtgctcccaacccaacttcctagccccgaagagcttaggcgaaaaattctagtcaaggggaaaaaactgaccctcgaggaggaccttgagtatgaagaagaggaagcggaacccgagttggaggaatctgagctggctctcgagtcgcagtttgagacagaacctgaaccccaggagcagaacctacagaacaaagacaagaaaaaaaaatcaaaacccatcctttgtccagcactgagttctttagtgatttacctcaagtcagtgtcgttcagatcatttactcattccaaagaacactatcatttttacgaaatctcttctttttccgaaactaaggccaaaagactcatcaaggaggcgggcaacgaattcgtacaacacaacacttggcagttatcacgggtctacccatctggactgcgtacagacagcagcaattataatccacaggagctctggaacgcaggctgtcaaatggttgctatgaatatgcagacagcaggtttggagatggatatctgcgatggccactttaggcagaatggcggatgcggttacgtgctgaagcccgattttcttcgggatattcagagcagttttcatcctgaaaagcctatatccccttttaaggcccagactttactgatccaagtaatcagtggccagcagctgcccaaagtcgacaagaccaaggaagggtccatcgttgacccactcgtcaaagtccagatcttcggggttcgtttggatacagcccggcaggaaacgaattatgtggagaataatgggtttaatccctactgggggcaaacactctgttttcgggtcttagtgccggagctggccatgctgaggtttgtggtgatggattacgattggaagagtcggaatgatttcatagggcagtacacactgccgtggacttgcatgcagcagggctaccggcatatccacctactatcaaaagacggaatatccctccgccctgcaagtatttttgtgtacatctgcattcaagagggactcgaaggagatgagagttag

SEQ ID NO: 17075 - DNA, 1362 bp, Artificial Sequence
  Description of Artificial Sequence: Synthetic coding sequence
atggcgggtgctgctggaagagtgcaggaccgtgcattaagacgttttcctataacactgcccgtgggggatcttagcaacctgcacctcaaagaggaaaaaatcaagcccgatactaacggtgcggtagtgaagaccaatgccaatgccgagaaaactgacgaagaggagaaggaggacagagcagcacagtccctgctgaacaaactgatcagatcaaacctggttgacaataccaaccaggttgaagtattgcagagagatccaaacagtcctctgtactccgtcaagtcttttgaggagctgagactcccacagaatttgatcgcccagtcacagtccggaactggtaagaccgccgctttcgtgctcgctatgctaagccaagtcgagccggccaataaatatccacagtgtttgtgcctttcacctacatatgagctggcactgcaaaccggaaaggtgatcgagcagatggggaaattttatcccgaactcaaactagcgtacgccgttcgcggaaacaagctcgaacgtgggcagaagatctccgagcagatcgtgattggcactccaggtaccgtgctggattggtgttctaaacttaagttcattgatcctaagaagataaaggtgtttgtattggacgaggccgatgttatgattgctactcagggtcaccaagaccagtccatccgcattcagcggatgctgcccaggaactgccagatgcttctgtttagtgcgacctttgaggatagcgtctggaaattcgcccagaaagttgtacccgaccctaatgtgattaaactaaaaagagaggaggagaccctggacacaataaaacagtactacgttctctgctcaagtcgggatgagaaatttcaggccctgtgtaacctttacggcgccatcacgatcgcacaggccatgatcttctgccataccagaaagaccgcgagctggctggcggcggagctgagtaaggaaggacatcaggtggctctgctatccggtgagatgatggtggagcagcgtgcagctgtgattgagagattccgcgagggaaaagagaaagtgttggtcaccacaaatgtgtgtgcgcgtggaattgatgtggagcaggtatctgtagtcataaatttcgacctccctgtcgataaagacggaaatccagataatgagacttacctacaccgaattggccgcacaggaagattcggcaaacggggtctcgctgtgaacatggttgactctaagcattcaatgaacattctcaaccgcatccaagagcacttcaataaaaagatcgagaggctcgacaccgacgacctcgacgaaatcgagaaaatcgccaactag

SEQ ID NO: 17076 - DNA, 921 bp, Artificial Sequence
  Description of Artificial Sequence: Synthetic coding sequence
atggctagggtgccattgggacgcagcctgaccctcagtccacgattggaacacaatggcatgacgagtgcgcatcataacttccgcctgccaggcagccgcgattcccccgcttcagcctctcaggttgcggaaatcatcgatttagaatggtacgaaaaatccgaagagactcatgccagccagatcgagctactcgagacttcaagcacccaggaacctcttaacgcgtctgaggccttttgtccacgcgattgcatggtgcccgtggtatttcccggacctgtttcgcaagagggttgctgccagttcacctgtgagctccttaagcacatcatgtatcagcgacagcaactgcctctcccctatgagcagctcaagcacttctatagaaagccaagtccacaggctgaggaaatgctcaaaaaaaaaccccgtgcgaccacggaggtgagttctaggaaatgccagcaagcccttgctgagctcgaaagcgtcctgtctcatttggaggactttttcgcaaggactctcgttccccgggtgctcatcctgttaggtggcaacgctctgtctcccaaagaattttatgagctcgatcttagcctcctggccccatatagtgtggaccagtctttatccaccgccgcctgcctgcggcgcctgttcagagcgatttttatggcagacgcctttagcgagctacaagcaccacctttgatgggaaccgttgtcatggcacaggggcacagaaactgcggcgaggactggttcagaccaaagctgaattaccgcgtgccgagtaggggacacaagcttaccgtgactctgtcttgcggcaggccctcaattcgcactaccgcttgggaggattacatttggttccaggcaccagtgacgtttaagggtttcagagagtag

SEQ ID NO: 17077 - DNA, 426 bp, Artificial Sequence
  Description of Artificial Sequence: Synthetic coding sequence
atgccccagctcttgcagaatataaacggaattattgaggcgttccgccggtatgcccgcacggagggcaactgtactgcccttacgcggggtgagctcaagcgcctgctggagcaggagttcgccgatgtaattgtcaaaccccacgatccagccacagtggacgaagttctgcgtctgctcgatgaagatcacaccgggacagtggagtttaaggaatttctcgtgcttgtttttaaggtcgcccaggcctgcttcaagacactgtctgaatccgccgaaggcgcttgcggatctcaggagagtggctcgttacactcaggggcctcacaggaactaggcttccggccacgcgtaaggccattggctctgcgcgggagcgctgccatgacaggcaaacttagccccagggctcgaaaagagtag

SEQ ID NO: 17078 - DNA, 480 bp, Artificial Sequence
  Description of Artificial Sequence: Synthetic coding sequence
atggctacatccgctccacttcgtagcctcgaagaagaggtcacatgttctatctgcctcgattatttaagggaccccgtgaccatcgattgcggacatgttttttgccgttcctgcactacagacgtccgacccatatcagggtcccgtcccgtgtgccccctgtgcaagaagccgttcaaaaaagaaaacatccgacctgtctggcagcttgagaaaatcctgaatcacctcagtaccttgcgccgggatcgcgacaagattcagggtttccaagccaaaggcgaagctgatatcctcgccgccctgaagaagctgcaggaccagcgccagtacatcgtggccgagttcgagcagggccatcagttcctcagggaacgcgaggaacacctgcttgagcagctggcgaagctcgagcaggagttaactgaaggaagagaaaagttcaagagtcgcggggttggcgaactagccaggtag

SEQ ID NO: 17079 - DNA, 1506 bp, Artificial Sequence
  Description of Artificial Sequence: Synthetic coding sequence
atggacttcctactcgggaacccattctcgagccccgtggggcagagaatcgaaaaggcaacagacggaagcttgcaaagtgaagactgggccctgaatatggagatctgtgacatcatcaatgaaaccgaggagggccctaaggacgcgctgagagcggtgaagaagaggatcgttggtaataaaaattttcatgaagttatgctagcccactcagcaaggagacatctctcggcccttcaggtattagagacttgcgtcaagaactgcggtcatagattccacgtgctggtggccagccaggatttcgtcgagtcggtgctagtccggacaattctgccaaagaacaacccacccaccatcgtccacgacaaagtgctcaatctgattcagtcttgggctgatgccttcagatcaagtcctgatctcaccggggtcgtgacaatctacgaggacttgcgccgcaaagggttggagtttcccatgaccgacctggatatgctgagccccatacacacgccccagcgtactgtctttaatagtgagacacagtccggtcaggactccgtggggacagactcttcacagcaggaggattctggccagcacgccgctccactgcccgcgcctcctattcttagcggggatacaccaatcgcacctaccccagagcagatcgggaagctcagaagcgagctagagatggtaagtggcaatgttagggtcatgtccgagatgctaacggagcttgttcccacccaggccgaaccagctgatctggagctactccaagaactgaatcggacatgtcgggctatgcagcagcgagtcttggagctcattccacaaattgcgaatgagcagctgacagaggaactgctgattgttaatgacaatctcaataacgttttcctacgtcatgagcgcttcgagcgcttccgtaccggccagacaaccaaggcccccagcgaagccgagccggcagccgatctaattgacatgggcccagaccctgccgcgactgggaatctgtcttcacaactggcaggaatgaacctgggatcgtcatcagttcgggccggcctccagtccctggaagcctccggacgattggaagatgaattcgatatgttcgcactcacgcgaggaagcagccttgccgatcagagaaaggaggtaaaatacgaagcgccacaagcaacagatggcttagcgggcgccctggacgccagacagcagtctactggagcaatcccggtcacacaggcttgccttatggaggatatcgagcagtggctttctacggatgtgggtaatgacgccgaggagcccaaaggcgttacgagcgaagagtttgacaaatttcttgaggaacgggccaaagcggccgaccgtctgcctaatctttcttccccctctgctgaaggcccccctggcccaccatctggcccagcacctagaaagaagacccaagaaaaagacgatgacatgctgttcgccctgtag

SEQ ID NO: 17080 - DNA, 117 bp, Artificial Sequence
  Description of Artificial Sequence: Synthetic coding sequence
gaacctgtgtatttcgccgagaaagttatgagtctggggagaaactggcatagaccctgcctgaggtgccagcggtgtcataaaaccctaacagctgggtctcatgcagaagtttag

SEQ ID NO: 17081 - DNA, 1122 bp, Artificial Sequence
  Description of Artificial Sequence: Synthetic coding sequence
atggctcaggaatcaccaaagaatagcgctgcagagattccagtgacatccaatggtgaagtggacgactccagggagcactctttcaaccgtgacctcaagcactctctcccctctggattgggcctgtcagagacacagattactagtcatggattcgacaataccaaagagggagtcatcgaggcgggagcattccagggcagcccagctccacctctcccaagtgtaatgtcccccagtcgtgtggctgccagtcggcttgctcagcaggggtctgatctcattgttcctgctggaggccagaggacccaaacaaagagtggtcccgttatccttgctgacgaaatcaagaatccagccatggagaaacttgagctggtgcgcaagtggtccctgaatacatacaagtgcacccgacagatcatttcggagaagctcggccgggggagtcgcacagtggatctcgagttggaggcccagattgacattctccgcgataacaaaaaaaagtacgagaatattctcaaacttgctcagaccttgtccacacagcttttccaaatggttcatacgcagaggcagttaggagacgctttcgctgatcttagcctgaagtccctagagctgcacgaggagttcggatacaacgctgatacccagaagctgttggccaaaaacggtgaaactttattaggggctattaatttcttcattgcaagcgtgaacactctcgtcaataaaacaatagaagataccctgatgaccgtgaaacaatacgaatccgcccggattgaatatgatgcctatagaactgacctcgaggagctgaacctcggaccccgggacgcaaacacactgccaaaaatcgagcagtcgcagcacctcttccaagcacacaaagaaaaatacgacaaaatgcgcaatgacgtcagtgtgaaacttaaatttctcgaggagaataaggtcaaggtccttcacaaccagcttgtcctgtttcataacgccatcgcagcctattttgccggcaaccagaagcaattggagcagactctaaagcagttccatattaagcttaagacccctggcgtagatgccccgagctggttggaggagcagtag

SEQ ID NO: 17082 - DNA, 453 bp, Artificial Sequence
  Description of Artificial Sequence: Synthetic coding sequence
atgcacacaggggatccaaaacaggatctggcctacgaacggcagtacgaacagcagacttaccaggtgattcctgaggttatcaagaattttattcaatactttcacaaaactgtatcagacctgatagatcagaaagtttacgaacttcaggcctccagggtctcttcagacgtgattgaccagaaggtctatgaaatccaggatatctacgagaactcttggacaaaactgacagaacgatttttcaaaaacacaccctggcccgaagccgaagccatcgcccctcaagtaggcaacgatgcggtgtttctgattttgtataaggagctttactaccggcacatttacgctaaggtttccgggggaccctctttggagcagcggtttgagtcctactataactactgcaatctcttcaattacatactgaatgctgatggccccgcatag

SEQ ID NO: 17083 - DNA, 2136 bp, Artificial Sequence
  Description of Artificial Sequence: Synthetic coding sequence
atggcaatgcaggagaaatatccgaccgagggaatcagccacgtgaccagtcctaatttctgtagttcatccggaagcccccctttccagccaataaagagtcacgtcacaatccccacagctcacgtaatgccgtctaccttgggtacaagccccgccaaaccaaacagtacaccagtagggccctccagcagcaagctaccattgagtggcttggcagaatccgtagggatgactcggaatggggatctgggggcgatgaaacacagccctggattaagcagagatttgatgtatttcagcggggccacgggagaaaacggaatcgaacagtcatggttcccagcagtgggccacgagcggcaggaggaagcgagaaaatttgatattcctagcatggaaagcaccctgaatcagagcgctatgatggagacgctctatagtgaccctcaccatcgggtgagattccacaacccccggaccagcacatcaaaggagctgtacagggtgcttcctgaggctaagaaagcacccggatcgggggccgtgtttgagcggaacggcccacacagcaatagctccggcgtgttgcctctcggcttgcaaccggcacctggcctgtcgaagcctctcccgtctcaagtatggcagccatctcccgacacctggcatccccgagagcaatcatgtgagttgtcaacttgtaggcagcagctggagctgatacggcttcagatggaacagatgcagttacagaatggtgctatatgccatcaccctgcagcctttggccccagcctccctatcctcgaacccgcccagtggattagtattctgaactccaacgagcacctcctgaaagagaaagagctcttgatcgataagcagcggaagcacatctctcaactcgagcaaaaagtgagagagtcggagctgcaagttcacagtgccctgctcggccgccccgcccccttcggggatgtgtgcttgttgcggctacaggagctgcagcgcgaaaacacgttcttaagagctcagttcgcgcaaaagactgaggccttatcacgcgagaaaatcgaccttgagaagaaactgtcagcatcagaggtggaggttcagttgatcagggagagccttaaagttgctctgcagaagcacagtgaggaagtaaaaaaacaggaagaacgcgtgaaggggagggacaagcatattaataaccttaaaaagaaatgccagaaggaaagtgaacagaaccgtgagaagcagcagaggattgaaacacttgagcgatacctagctgatttaccaaccctggaagatcaccagaagcaatcgcagcagctcaaggatagcgaactgaagtcgacagagcttcaggaaaaagtcacagaacttgaatctttgcttgaagaaacacaggccatttgtcgcgaaaaagaaatccagctcgagagcctgcgacaaagagaagccgagttcagctccgccggccactctttacaggacaaacagtccgtagaggagacatctggagaagggcctgaggttgagatggagagctggcagaagaggtacgatagccttcagaagattgtcgaaaaacaacagcagaagatggatcagctacggagccaggtccagtccctggaacaagaggtcgcccaggaggagggtacctctcaggccctgcgtgaggaagctcaaaggagagactccgccctgcaacaactgagaactgcggtcaaggagttatccgtgcaaaatcaggacttgatcgagaagaatttgaccctccaggaacatctgcggcaagcacagcccggcagtccacctagtcctgatactgctcagctggcactagagctgcaccaagaacttgccagttgtctgcaggatctgcaggctgtgtgctctattgtgactcagcgtgcccagggtcacgatcctaatctgtcgttgcttctcggcatccactccgcccagcatccagaaacccagctggatctgcaaaagcccgatgtgataaagaggaagctggaggaggtccagcagctgcgaagggatatcgaagacttgcgcacaacgatgtccgacagatatgcgcaggacatgggcgagaactgcgttacacagtag

SEQ ID NO: 17084 - DNA, 531 bp, Artificial Sequence
  Description of Artificial Sequence: Synthetic coding sequence
atggcggccgccaccggcgatcccggactgtctaaacttcagttcgcacccttctccagcgccctcgacgtgggcttctggcacgagctaacacagaaaaaactgaatgagtatagattagacgaggctcccaaagacattaaggggtactactacaacggggactccgctggtctacctgccagattgaccttggagttctccgcgttcgatatgagcgctcccaccccagcgagatgttgtccagccataggcacactgtacaacacaaatactctggaaagttttaagacggctgacaagaagttgttgctcgagcaggccgcaaacgagatctgggagagtataaagtctggaactgcccttgagaatcccgtgctcctcaacaagtttcttctacttacattcgccgaccttaagaagtaccatttctactattggttctgctaccctgccctgtgcctccctgagtccttgcctctaatacaaggccccgtgggactggaccaaaggttttcccttaagcagtag

SEQ ID NO: 17085 - DNA, 1443 bp, Artificial Sequence
  Description of Artificial Sequence: Synthetic coding sequence
atgaaactgaaggagctggaacgccctgctgtgcaagcttggtctcccgccagtcagtatccattatatttggcaacaggaacgagcgcccaacagctcgattctagcttcagcacaaacggcacgctggagatttttgaagtagatttccgcgaccctagcctcgacctcaagcaccggggtgtgctttcagccctatccagatttcacaaactggtgtggggctcattcggatcaggattgcttgagtcaagcggtgtaatcgttggtgggggtgataatggcatgctgatcctctataatgttactcacattttaagcagtgggaaagagccagtgatcgctcagaagcagaaacacacaggcgctgttcgcgccctcgatcttaatcccttccagggtaatttattggccagcggcgcatctgactccgagatcttcatatgggacctgaataatctgaacgttccaatgacattaggctccaaaagccagcaacctcctgaagacatcaaggctttgtcttggaaccgtcaggcccaacacattctctcatctgcacatcctagtggaaaagcagtggtgtgggacctcagaaaaaacgagccaatcatcaaggtgagcgatcacagcaataggatgcattgcagtgggctggcctggcatccagatatcgccactcagctcgtcctctgttccgaagacgatagactgcctgtcattcagctgtgggatcttcgttttgcaagttcgccacttaaggtcctcgaatctcattcacgaggaatcctgtcagtgagctggagtcaggctgatgccgagctgctgttaacaagcgcaaaagatagtcagattctgtgtcgtaatctgggctcttctgaggtcgtgtacaagttacccacccagagctcgtggtgtttcgacgtacagtggtgcccccgggatccatctgtcttttcggccgcctctttcaatggatggatatctctatacagcgtcatggggcggtcttgggaagttcaacatatgcgccaagctgataaaatctcatcttcttttagcaaaggacaaccgcttcctcccctccaagtcccggaacaggttgctcaagccccactgattcccccactcaagaaacctcccaagtggatcaggcgtccaaccggcgttagctttgcattcgggggcaagttggttacctttggactccctagcacccctgcccacctggtcccgcaaccgtgccctaggctggtttttatctcgcaggtcacaacagagagcgagtttctcatgcgctccgccgaactacaggaggcattaggttccggaaacctcctgaattattgccagaataagtcgcagcaggcactcttgcagagcgagaaaatgctgtggcagtttctgaaacctgcacgggactccagtggcgcacggaggtag

SEQ ID NO: 17086 - DNA, 1842 bp, Artificial Sequence
  Description of Artificial Sequence: Synthetic coding sequence
atggccaccattccagactggaagctgcagttgcttgcacgaagacggcaggaggaagcctcggttcggggaagggagaaggccgagcgagagcgcttgtcccagatgccagcatggaagagagggttgttagagcggcggcgggcaaaactcggactctctccaggcgagccttcaccggtgcttgggacggtggaagctggacctcctgatccagacgaatccgcagtcctcctggaggccatcggacctgtgcaccagaataggttcattaggcaggagcggcagcagcaacaacagcaacaacagcggagcgaggaactcctcgccgagagaaaacccgggcccctggaggccagggaaagacggccatcccccggtgaaatgcgcgaccaatcacccaaaggacgagagagtagagaggaacgcctgagcccgagagaaaccagggagcggcggctcggaatcggcggtgctcaagagctatcactgcgccccttggaggcccgagactggcgacaatcgcctggcgaggtgggtgacaggtcctcccgcttatctgaagcctggaaatggcgactgtcacctggcgagacccctgagaggtctctgcgcctggctgaatcccgggaacagagtcctaggcgtaaagaggtggaatcccgtctgtcccccggggagtccgcctatcagaagttaggtctgacagaggctcacaaatggaggccagactcccgagagtcccaggagcagagccttgttcaactagaagctaccgagtggcgtctgcgcagtggtgaagagcggcaagattactccgaagaatgcgggaggaaggaggaatggcctgtcccgggggtggcacccaaggagactgccgaactgtccgaaaccttgacccgcgaggcgcaagggaattcttctgctggagttgaggccgcagaacagagacctgtggaggatggtgagaggggtatgaagccgactgaagggtggaaatggaccctgaattcaggcaaagctagagaatggacacccagggatatcgaggcccagactcagaaaccggaacctcctgagagtgccgagaagctcctcgaatcaccaggggtcgaagctggcgaaggcgaggctgaaaaggaggaagccggtgctcagggcaggcccctcagggccctgcagaattgctgttcggtcccgagccctttaccccctgaagacgctggcactggaggcttacggcagcaggaagaggaggctgtcgaactgcaacccccaccccctgcgcctctctcaccgccacccccagctcccaccgctccccagccccccggagatcccttgatgagcaggctgttttatggcgttaaagccgggcctggtgtcggcgcccctcgtcgttcgggacacactttcacagtaaaccctaggagaagtgttcctcctgctacccccgcgactcccaccagtccagctacggtggacgctgccgttcctggcgcgggcaagaaacgctacccaacagccgaggagattctcgttctgggcggatatcttagactctctagatcttgtctcgctaaaggcagccctgagaggcatcataagcagctcaagatctccttcagcgagacagcgctcgaaacaacctatcagtatccttctgagtccagtgtcctagaagaactggggcccgaacctgaggtaccatccgcccctaatcctcccgcagcacagccagatgacgaggaggatgaagaggaactgctcctgctccaacctgaattgcagggcggcctccgcaccaaggccctgatagttgacgagagctgccgtcgctag

SEQ ID NO: 17087 - DNA, 1446 bp, Artificial Sequence
  Description of Artificial Sequence: Synthetic coding sequence
atggcctccgccgcttctgtgacgagcctggccgatgaagtgaactgtcccatctgccagggaacacttagagaacctgtgacaattgactgtgggcataatttttgtcgagcatgcctgacacgttactgcgagattcctggcccagacttggaggaatctccaacctgtcccctgtgcaaggagccctttagacccggctcgttccggcccaactggcagttggccaacgtggtcgagaacatagagcggctgcagttggtgtccactctcggcttaggggaggaggatgtgtgccaggaacatggcgagaagatttactttttctgcgaggacgacgagatgcagctgtgcgtggtatgtagagaggccggggagcacgccacccacacaatgagattcttggaggacgctgcagctccttacagagaacaaattcataagtgtttgaagtgcctccgcaaggagagggaagagatccaggagatccaatcaagagaaaacaagcgcatgcaggtgctgcttacgcaggtctctaccaagaggcagcaagtgattagcgagttcgcccacttgagaaagtttctcgaagagcagcagagtatcctactggcacagctagagtctcaggatggtgacatactcagacaaagggacgagttcgacctcctcgtcgccggggagatttgtaggttttctgccctaattgaggaactggaggagaagaacgaacgtcctgcgcgggagcttcttactgacattagatcaaccttgattcggtgcgaaaccagaaagtgcagaaagcccgttgccgtctctcccgagcttggccaaaggattcgagacttcccacagcaggctttgccccttcaacgagaaatgaagatgtttcttgagaagctctgcttcgaacttgactatgagccggcccatatctctttagacccccagaccagccatcccaagctcctgctgagcgaggaccaccaacgagcgcagttctcgtacaaatggcaaaactcacccgataacccacagcgctttgaccgggccacctgcgtgctcgcacacaccggcatcactggcggccggcatacttgggtggttagcatagatctcgcccatgggggcagctgtaccgttggggtggtgtccgaagacgttcagaggaagggggagctaaggctgcggcccgaggaaggagtttgggccgttaggctcgcatggggcttcgtctccgcgcttggctcttttcccacccgcctcacactgaaagaacagccgaggcaggtacgggtgtcgctggactatgaagtaggatgggtaacgtttacaaacgctgtaaccagggagccaatatacacctttactgcctcgtttacccggaaggtaataccgtttttcgggctgtggggtaggggaagctccttcagtctctcttcctag

SEQ ID NO: 17088 - DNA, 537 bp, Artificial Sequence
  Description of Artificial Sequence: Synthetic coding sequence
atgtcaagcaacgagtgctttaagtgtggacgatccgggcactgggcaagggagtgccctactgggggaggtagggggagaggaatgcggagcaggggaaggggaggatttactagcgacaggggctttcagttcgtgagcagctcactcccggacatctgctaccggtgtggggaaagtgggcacttggccaaggactgcgatctgcaggaagacgaggcctgctacaactgcggaaggggaggacatattgcaaaggattgcaaagagcctaaaagagagagggaacagtgttgttacaattgcgggaaacccggacacttggcccgcgactgcgatcatgcagatgagcagaagtgctactcttgtggcgagtttggtcatatccagaaagattgtaccaaggtcaagtgctataggtgtggtgaaacaggccatgtggccataaactgctctaaaacttccgaagttaactgttatcggtgcggggagtcgggacacctagccagggaatgcacaattgaagctacagcctag

SEQ ID NO: 17089 - DNA, 87 bp, Artificial Sequence
  Description of Artificial Sequence: Synthetic coding sequence
atggccatggccccctctccttctttagtgcaagtttatacgtcccccgccgctgtggcagtgtgggaatggcaggacggcctatag

SEQ ID NO: 17090 - DNA, 603 bp, Artificial Sequence
  Description of Artificial Sequence: Synthetic coding sequence
atggccgccaccgcacgagaagacggtgccagtgggcaggaacgtggtcagcgcggctgtgaacattatgacaggggctgcctgttgaaagccccttgctgtgataagctgtatacttgcaggttatgccatgacaacaacgaggaccaccagctcgaccgattcaaagtgaaagaggtgcagtgcattaactgcgagaaaattcagcacgcacaacagacctgcgaagagtgctctactctgttcggcgagtattactgcgacatttgtcatctgtttgataaagataagaagcagtaccactgcgaaaactgcggaatttgcagaattggacctaaggaggatttcttccattgcctcaaatgcaacctctgcctggccatgaatctgcaaggccgtcacaagtgtatcgaaaacgtgtctcgtcaaaactgcccaatttgcctggaggacattcatacatctagggtggtcgcgcacgttctcccctgtgggcatctcctacacagaacgtgctacgaggaaatgttgaaggagctgcagatgagtatcatgtatgctctgtgctttaggtacgatcaggttctagagacagcaggctag

SEQ ID NO: 17091 - DNA, 567 bp, Artificial Sequence
  Description of Artificial Sequence: Synthetic coding sequence
atggccacacccctgggttggtctaaagctgggtctgggtctgtgtgtctggccctggaccagctccgggacgtgatcgaatcccaagaggaacttattcatcagctccgcaacgtgatggtgctgcaggacgagaactttgtctccaaagaggagtttcaggctgtcgagaaaaaacttgtggaggaaaaggctgctcacgctaagaccaaggtactcctcgccaaggaagaagagaagcttcagttcgcactgggcgaggtggaggtgttgtccaagcagctggaaaaagaaaagttggccttcgagaaggccctgtcctccgtaaaatcgaaagtcctgcaagagagctctaaaaaggatcaactgataacaaagtgtaacgggaggagagaggcgcgcgcactacaccacggatatatcaacggtttatttcccaatcacccagtgccagtttctaaggctggatttcactctaacacgtgtcctcagctgcgtatccaagcaggtcccggcgggccacatcttagaaaaggcttgaagggacctgggaggcccaggaaatag

SEQ ID NO: 17092 - DNA, 381 bp, Artificial Sequence
  Description of Artificial Sequence: Synthetic coding sequence
atggacagatccaagcgcaactcaattgccggctttccacctagagtcgagcggcttgaggaattcgaggggggaggaggaggggaaggaaacgtgtcccaggtcggccgggtgtggccctcatcatatcgagccctgattagcgccttttcacgcctgactcggcttgacgacttcacctgcgagaagatcgggtccgggttttttagcgaggtatttaaggtacgacatagggccagcgggcaggtcatggctcttaagatgaatacgctatcctctaatagagccaacatgctgaaggaagtacaattgatgaatcgcctctcccacccgaatatcctgagatgccggagtatgaatcagaacttttctccaaactag

SEQ ID NO: 17093 - DNA, 1443 bp, Artificial Sequence
  Description of Artificial Sequence: Synthetic coding sequence
atggaaacagatctgaactcacaggaccggaaggacttggataaattcattaaattcttcgcattgaagactgtacaggtgatagttcaagcgcgcttgggagagaaaatctgcaccaggagctcgtctagtccaacggggtcagactggttcaatttagccataaaagacattccagaagtaacccatgaagccaagaaagcccttgcagggcaactccctgcggtggggcgcagcatgtgtgtggagatttctttaaagacctcagaaggcgattctatggaactggagatatggtgtcttgagatgaatgaaaaatgcgataaggaaataaaggtctcctacaccgtgtataacagactgtcccttctgcttaaatccctcctcgcaatcacccgagttacgccggcctaccggctctctcggaaacaaggtcacgaatatgttattctgtaccggatttactttggtgaggttcaattgtccgggctgggagaagggtttcagacagtgcgcgtgggtactgttgggacaccagttgggacaatcactctcagttgcgcctaccgcattaatctagctttcatgagcactaggcagttcgagcggactccacctataatgggtataattatagaccattttgtagaccggccctaccctagttcctcccccatgcatccatgcaactatagaacagccggggaggacaccggcgtaatttaccccagtgtcgaagatagccaggaagtctgcactacatcatttagtacgagtcctccgtctcagttgatggtgccgggtaaagaaggaggtgtgccacttgccccgaatcagcctgtccacggaacacaagccgaccaagaacgtttagcgacctgcaccccttccgaccgcacacactgcgccgccacccccagttcctcagaggacacagagactgtttctaactccagcgaggggcgggccagtcctcatgatgtcctcgagacgattttcgtccgcaaagtaggggcctttgtgaataaaccaatcaaccaggtgacactgacaagtttggatattccctttgctatgttcgcgccaaagaatctggagcttgaagacaccgatcccatggtaaacccacctgacagccccgagactgagagtcccctccaaggctcattgcatagcgatggaagctcaggggggtcaagcggtaatacacatgacgactttgtcatgatcgacttcaagccagccttctcgaaagatgatatacttccaatggaccttgggacattttacagggaattccagaaccccccgcaactttcctcactttcaattgatattggggcacaatctatggcggaagatcttgatagtcttcccgagaaactggcagtgcacgaaaagaacgtaagggaattcgacgcattcgtggagactctgcaatag

SEQ ID NO: 17094 - DNA, 390 bp, Artificial Sequence
  Description of Artificial Sequence: Synthetic coding sequence
atggccgaactcatccagaagaagctccagggagaagtggagaaataccaacagctgcaaaaagatctgtctaagtccatgagtgggcgccagaaattagaagcgcaactgaccgagaacaacatagtcaaagaggaactggctctcctcgatggctcaaacgtagtattcaagttactcggaccagtcctggttaagcaggaattgggagaggcccgtgcaactgtcggaaagcgactggattatatcacggcggaaatcaaaagatacgagagtcagctgagagatctagagaggcaaagcgagcaacagcgcgagacattagcacagttacagcaggaattccaaagggctcaagccgcgaaggcgggtgcaccagggaaggcttag

SEQ ID NO: 17095 - DNA, 348 bp, Artificial Sequence
  Description of Artificial Sequence: Synthetic coding sequence
atggtcgaggacgagcttgccctctttgacaaaagcattaacgaattttggaacaagttcaaatcaaccgatacttcctgtcaaatggccggattaagagatacttacaaggattctattaaggcctttgctgagaaactgagcgttaaactgaaggaggaggaaagaatggtcgagatgttcttggagtaccagaaccagatctcaaggcagaataagctgattcaggagaaaaaagacaacctgctgaaactaatagctgaagtgaagggtaagaagcaggagctagaggtcttgaccgcgaatatccaggatcttaaggaggagtactcaagaaaaaaggagtag

SEQ ID NO: 17096 - DNA, 402 bp, Artificial Sequence
  Description of Artificial Sequence: Synthetic coding sequence
atggcttcctccgccagggaacatctgctgttcgtgcgacgtaggaaccctcagatgaggtatacactatcgcccgagaacctacagtctctggcggcacaatcctctatgcctgagaatatgacgctgcaaagggctaatagtgataccgatctggtaacgagtgaatccaggtcctccttgaccgccagtatgtatgaatatacattgggccaggcccagaacttgatcatcttctgggacattaaagaggaggtagatccgagtgattggatcggcctgtatcatatcgacgaaaattccccagccaacttctgggacagcaagaacaggggggtgacaggcactcagaaaggtcaaatcgtttggcggattgaacctggaccctattttatggaatag

SEQ ID NO: 17097 - DNA, 264 bp, Artificial Sequence
  Description of Artificial Sequence: Synthetic coding sequence
atgagcctgtttggtacgacttcgggattcggcaccagtgggacttccatgttcggctcagcaactacagacaatcacaatcctatgaaagacattgaggtgacaagctcccctgacgatagcattggatgcttatccttcagccctcccacactgcccggcaactttctcatagcaggctcttgggctaatgacgtgagatgctgggaggtgcaggacagtgggcagactattcccaaggcccagcagatgcacaccggttag

SEQ ID NO: 17098 - DNA, 1329 bp, Artificial Sequence
  Description of Artificial Sequence: Synthetic coding sequence
atggccaactcctttgctgcgagaatcttcaccactctgagtgatcttcaaactaatatggcaaatctgaaagtcatcggaatagtgatcggaaaaacagatgttaagggtttcccagatcgaaagtctatcggcagcgagcgttatactttttcattcacaattagagattcacctgcacattttgtgaatgctgcatcatggggcaacgaagattacatcaaatctctcagcgacagctttcgtgttggagattgcgtcatcattgaaaaccctctgattcagagaaaggagattgagcgagaagagaaattttcccctgctacaccctcaaattgcaaattgttactctctgagaatcactcgactgtgaaggtgtgcagttcttatgaagtcgacacgaaactcttatccctcatccatctcccagtgaaggagtctcatgattactatagcctcggagatatcgtggccaatggccactccctgaatggtcgcataataaatgtgctcgccgcagtgaaatcggtcggtgagccgaagtacttcacaacatccgatcgaagaaagggacaaagatgtgaagtgagactgtacgatgagacagaaagtagttttgccatgacatgctgggataatgagtcgattcttctggcccagagttggatgcctcgagagacggtgattttcgcctctgacgtgcgcatcaatttcgacaaattccgtaattgtatgaccgccactgtgatatctaagaccattattactactaacccagacatccccgaggctaacattcttctaaatttcatcagggagaataaggagaccaatgttctcgacgatgagatcgactcctattttaaggaaagtatcaacctctctaccatcgtggatgtttatacggtggaacaacttaaaggtaaagcgctgaaaaacgaaggaaaagctgatccctcgtatggtattctgtacgcttatatttcaactcttaatatcgacgatgagaccactaaagtagtgaggaacagatgcagttcctgtgggtatatcgtcaacgaggcgtccaatatgtgtacaacctgcaacaagaacagccttgatttcaagtccgtgtttttgagctttcatgtgctcattgatctcaccgaccacacagggacccttcattcctgttcacttacgggctctgtagccgaggaaaccctcggttgtacatttgtcttgtctcatagggctcggtccggcctcaaaatcagcgtgctttcatgcaagctcgccgaccccaccgaggcaagtcgtaacttatcggggcagaagcatgtctag

SEQ ID NO: 17099 - DNA, 651 bp, Artificial Sequence
  Description of Artificial Sequence: Synthetic coding sequence
atgaacaatcagaaacagcagaagccaaccctgtctggacagaggtttaagacaaggaagcgcgatgaaaaagagcgctttgatccgacacagtttcaagattgtattattcaggggctcaccgagactgggacagaccttgaggcagtggccaagttcctagatgcttccggagccaagctcgactaccgtcggtatgctgaaacgctctttgatattttagtggcaggagggatgttggcccccggcggcacattggctgatgatatgatgaggactgacgtttgcgtgttcgcagcccaggaagatttagagacgatgcaggctttcgcacaggtcttcaacaagctgatccgccggtacaaatatttagaaaaaggctttgaggacgaggttaaaaagctgctgctgttcttgaaggggttttcagagagcgaacgcaacaagttggctatgctgaccggggtgttgttagccaacggtaccctcaacgccagcattctcaactctctgtataacgagaacctcgtgaaggaaggggtgagtgctgccttcgcggtgaagttattcaaatcttggattaacgagaaggacatcaacgcagttgctgccagcctgcggaaagtctctatggacaaccggttgatgtag

SEQ ID NO: 17100 - DNA, 429 bp, Artificial Sequence
  Description of Artificial Sequence: Synthetic coding sequence
atgaatgaggttgtgcatacgtctccaaccatcgggagcaatgtcgaggagatagtgatcaacaatactaggttcctcatgtgggacataggaggacaggagagcttaaggagctcctggaatacatattacacgaacactgaatttgtcatcgtggtagtggactctacagaccgtgagagaattagcgtcacacgcgaagagttgtacaagatgcttgctcatgaagatcttcgtaaagccgggctgttaatcttcgccaacaagcaagacgttaaagagtgtatgacagtggcagagatctctcaattccttaagctgacatcaatcaaggatcaccagtggcacatacaagcctgctgtgctctcacaggcgaaggcctttgccaagggttggagtggatgatgtcacggcttaaaattcggtag

SEQ ID NO: 17101 - DNA, 447 bp, Artificial Sequence
  Description of Artificial Sequence: Synthetic coding sequence
gcaatccatatattggatgttctggtgctgaatggcaccgacgtgagagagcagcactttaatcagcggattcagctggccgagaaattcgtgaaggctgtcagtaaaccttctagacctgatatgaacccaattcgggtgaaggaagtttatcgcctggaggagatggagaagattttcgtaaggctcgaaatgaagatcatcaaagggtcttctggcactccaaagttgtcatatacagggagagatgatagacatttcgttccaatggggctgtatattgtccgcacagttaacgaaccgtggacaatggggttctccaaaagttttaagaagaaatttttttacaataagaaaacaaaggactcgacctttgacctgccctactatccatttccctcctttttctttcctaaccgtcgttataaccttcttcttttcgtgtag

SEQ ID NO: 17102 - DNA, 300 bp, Artificial Sequence
  Description of Artificial Sequence: Synthetic coding sequence
atggaagagatccctgctcaggaggccgcaggcagcccccgggtacagttccagagcctggagacacaatctgaatgcctgtccccagagcctcaattcgtgcaagatacagatatggagcaggggctcactgggggtattctgctgcggctccctaccacacgtattcactctgtaaattcgtgcccagctctgtcacacacccaggctagtgcattttctggggaaacgctcgccgttctcactgcaggaatcagcaagaggtggcccaaataccgtcttcctattgatatcgcttag

SEQ ID NO: 17103 - DNA, 2493 bp, Artificial Sequence
  Description of Artificial Sequence: Synthetic coding sequence
atgaaacgtgggaggctgccgtccagctctgaggattcagatgacaatggctcattgtccactacatggagccagaatagccgctcccaacatcggcggtcatcttgttcacggcacgaggaccgaaagccaagtgaggtcttccgtacggacctgataacggcaatgaagctccacgatagttatcagcttaaccccgatgagtactatgtcctggcggatccttggaggcaggaatgggaaaagggggtccaagtgcccgtttctcccggaaccataccccagccagtggctagacctaagaagtatattgtgtctagtggctccgaaccgcccgagctcgggtacgtcgacattagaaccctggcagattcagtgtgccgttacgaccttaacgacatggatgctgcgtggcttgaactgacaaacgaggaatttaaagaaatggggatgcctgagctggatgagtatacaatggaaagagtgctggaggaattcgagcagaggtgttacgataatatgaatcatgcaattgagacagaagagggcctgggaatcgagtatgatgaagacgtggtctgtgacgtctgccagagccctgatggggaagacggaaatgagatggtgttttgcgacaaatgtaacatctgtgtgcaccaagcttgttacggaatcctcaaggtccccgaagggagttggctgtgtagaacatgtgccctgggtgtgcaaccgaaatgtctcctttgccctaagaaaggcggagccatgaaacctacacgctccggtacgaaatgggtccatgtatcctgcgctctttggataccggaggtctccattggctctcctgagaagatggaaccaatcaccaaggtgtctcacattcctagttcccgatgggctctcgtctgctcgttgtgtaatgagaaattcggggcctctattcagtgctccgtgaagaattgccggaccgcattccacgtcacatgcgcttttgaccggggcttagaaatgaaaaccatactggccgagaatgacgaagtcaaattcaagagctattgtcccaaacatagtagtcacagaaagccagaagaatccttgggcaagggagccgcgcaggaaaacggagctcccgagtgctctcccaggaacccactggaaccttttgcctccttggaacagaaccgcgaggaagctcatcgagtcagtgtccgcaaacagaagctgcagcagttggaggacgaattttataccttcgtgaatctgctggacgtggctagggctttgcgcctcccagaagaagtggtggatttcctgtaccagtactggaagctgaaacggaaggtgaattttaataaaccacttataacccctaagaaggacgaggaagataatcttgcaaaaagggaacaggacgttctgtttaggcgcctgcaactgtttacacatctcagacaggatctggaacgtgtgcgcaacttgacctacatggtcactaggagagagaaaattaagaggtctgtgtgtaaagttcaggagcaaatcttcaatctgtatacaaagttgctggaacaggagagagtcagcggcgtgccctcttcttgctcttccagctccctcgagaacatgctgttgtttaactcgccttccgtggggccagatgctccaaagatcgaagacttaaagtggcatagcgcgttctttcgaaaacagatgggaacatccttagttcattctctgaagaaaccacataagcgagaccccctgcaaaatagtcccgggtcagaaggcaagacccttctcaagcaaccagacttgtgcggcagaagagagggcatggtcgtgcctgagagttttctggggctggagaagaccttcgcagaggcgcggctgattagcgcacaacagaaaaacggtgtggtcatgcctgatcatggaaagcggagggacaacagatttcactgtgatttgattaaaggtgatctcaaggacaaaagttttaaacagagccataaaccactcaggtcaactgatgttagtcagaggcatttagataacaccagagcggctacatcacccggggtaggccagtctgcgccgggcactagaaaagaaattgtgccgaagtgcaatggttccctgattaaggtgaattacaatcagaccgccgtgaaggtgcccaccactcccgccagccccgtcaagaactgggggggttttcgcattcctaagaagggagagaggcagcagcagggggaagcccatgacggagcctgtcaccagcactctgattacccctatctgggccttggcagagtgcccgccaaagagcgggctaaatctaaactcaagagcgacaatgagaacgacgggtatgttcctgacgtagagatgagtgacagtgagtccgaggcttcagagaaaaaatgtattcacactagctccacaatcagtagacgcacagacattattagaaggagcattttggcctcttag

SEQ ID NO: 17104 - DNA, 402 bp, Artificial Sequence
  Description of Artificial Sequence: Synthetic coding sequence
atggcttcagaggacattgcgaagctggccgaaacactcgctaaaacacaagtggccggggggcaacttagtttcaagggcaagtccctaaagctgaatactgctgaggacgccaaggacgtaatcaaagagattgaagacttcgattccctggaggccttgcgacttgaaggaaacactgtcggtgtcgaggctgctagagtgattgccaaggcattggagaagaagagtgaactgaaacgctgtcactggagcgacatgtttaccggtagattaagaacagagatcccacctgccctgatttccctgggagaggggctcataactgccggggcccaactggtggaactggatctcagcgacaacgcttttggtccggacggcgttcaggggttcgagtag

SEQ ID NO: 17105 - DNA, 390 bp, Artificial Sequence
  Description of Artificial Sequence: Synthetic coding sequence
atgtcacctggaagcggggtgaagagcgaatacatgaagcgctaccaggaacctcggtgggaagagtatggcccctgttatcgtgagctgctgcactaccgactgggaaggcgcctgctggaacaggctcacgctccctggctttgggacgactggggaccagctggcagcagtgaggacagtgcctcttctgagtctagtggtgctggggggccggcaccaagatgcgcacccccatcccctccaccccccgtcgaaccggcgacacaggaagaggcagagcggagagcccgcggagcgcccgaagagcaggacgctgaagctggcgatgccgaggccgaggatgccgaagatgccgccttgcccggtaacgcctggctgcgtacttag

SEQ ID NO: 17106 - DNA, 390 bp, Artificial Sequence
  Description of Artificial Sequence: Synthetic coding sequence
atggctgagttgatccagaaaaagttacagggggaagttgaaaaatatcaacagctccagaaggacctgagcaagtcaatgtccgggcgccagaaactggaggctcagctcacggaaaacaatatcgtaaaggaggagctagctttactcgatggcagtaacgtggtgtttaaactcctcggcccggtgctcgtaaaacaggagttaggtgaagctagggctactgttggaaagcggctggattacattactgccgaaattaagcggtatgaatcccaactgagggacctggagcgacagagcgaacagcaacgagagacactggcacaactgcagcaggaattccaaagggcccaggccgcgaaggccggagcccccggaaaggcatag

SEQ ID NO: 17107 - DNA, 402 bp, Artificial Sequence
  Description of Artificial Sequence: Synthetic coding sequence
atggctgaaaagttgataacccagacgtttagccaccataaccagctggcccagaaaacgcgtcgggagaagagggcacgacaagaggccgagaggcgtgaaaaagctgaacgggccgcccggctcgctaaagaggccaagagtgagactagtggtcctcaaataaaggaactaaccgacgaggaggctgagagattacagctcgagatcgatcagaaaaaggacgccgaaaaccacgaggcacagctgaagaatgggtccctggattcccctgggaaacaggacaccgaagaagatgaggaggaagatgaaaaggataagggtaagctgaaacctaatttggggaacggcgctgatctcccaaactatagatggacccagacgctgtccgaattggattag

SEQ ID NO: 17108 - DNA, 2373 bp, Artificial Sequence
  Description of Artificial Sequence: Synthetic coding sequence
atggggacccgtaagaaggtacacgcctttgttcgcgtgaaaccgactgacgacttcgcacacgaaatgattcggtacggagacgacaagagaagtatcgacatccacctcaagaaagatatcagaagaggcgtggtgaacaatcagcaaacggactggagctttaagctggacggagttctccatgatgccagtcaggacctggtttatgaaaccgtcgccaaggatgtcgtttctcaggccctggacggatataacggtaccattatgtgctatggccagacaggcgctggcaagacgtacacgatgatgggcgctacagagaattataagcatcgagggatcctgccgagagctctgcagcaggtgttcagaatgattgaggaaaggccaacgcacgcgattacagtccgggttagttatttagagatctataacgaaagcctgttcgacctgctctcaactctaccttatgtcggccccagcgtcaccccaatgaccattgtggaaaacccccagggggtattcattaaagggttgtccgtacatttaaccagccaggaggaagatgcgttcagtttgttgtttgaaggggagacaaacaggattattgccagtcataccatgaataagaatagcagtaggtctcactgcatattcacaatctatcttgaggctcacagtcggacgcttagtgaggaaaagtacattacttctaaaattaacttagttgacctcgccggatccgagcggttgggtaaatccggctccgaagggcaggtgctcaaggaggccacctatattaacaagtcactgagttttctggagcaagcgattatcgcacttggggatcagaaaagagatcatatcccttttaggcagtgtaagctaacccacgcacttaaggactcactgggcggcaactgtaacatggtcctggtgaccaacatttacggggaggccgcccagctagaagaaactctgtcttcactaaggttcgcatctagaatgaagttagtaactaccgagcctgcaattaatgaaaaatatgacgcagagcgcatggtgaaaaatcttgaaaaggagctggcactgctaaaacaggagctcgccatccatgattctctgactaaccgcacattcgtgacctacgatcctatggacgagatccagatcgcagaaattaacagtcaggttcggcggtatttagaaggcaccctggacgagattgacattatcagcctgcgtcaaattaaggaagtattcaaccagtttagggttgtgcttagccagcaagagcaagaagttgaaagcactctgcggaggaagtacacacttatcgaccggaatgactttgccgccatttcagcgatacaaaaagcaggcctggtggacgtggatggccatctcgtgggggagccggaagggcagaatttcggtttgggcgtggctcctttttcaacgaagccaggaaagaaagccaaaagcaagaaaaccttcaaggaaccactgagctcactggcccggaaagagggcgctagctcacccgtgaacggtaaagatctcgactatgtgtcgacatctaaaactcagttggtacctagttccaaagatggggacgtgaaggatatgctgagtcgtgaccgcgagaccagctctattgaacctctcccgtcagactcccctaaagaagagctgagaccaatccgaccggatacaccacctagcaagcccgtggctttcgaagaattcaagaacgagcaagggtccgaaatcaatagaatatttaaagagaataaaagtattcttaacgagagacggaaacgggccagcgaaactacacagcacatcaatgccataaagagggagatagacgtcacaaaagaggcactaaactttcagaagtcacttcgcgaaaagcagggcaagtacgagaacaagggcctgatgattattgacgaagaagaattcctgttgatcctgaagctcaaggatctgaaaaaacaatacaggagtgaatatcaagacctccgtgatctgcgcgccgagattcagtattgtcagcatctggttgatcagtgccggcacaggctgctcatggagttcgatatctggtacaacgagtccttcgtgatcccagaagatatgcagatggccctgaagcctggcggatcaattcgaccaggcatggtgcctgtgaaccgcatcgtgtccctcggtgaggatgatcaggacaagtttagtcagttgcagcaacgggtgctgcccgaaggtccagactctatatccttctacaacgccaaggtgaagatcgagcagaaacataactacctgaaaaccatgatgggcctccaacaggcgcatcggaaatag

SEQ ID NO: 17109 - DNA, 1356 bp, Artificial Sequence
  Description of Artificial Sequence: Synthetic coding sequence
atgtacggcgctcctggtgccccagcacagtctgccagcgtgactgtagttcggtcgctgcggcgcccccctccccaggctacaggggtttcgtttatgaacaaccagaagcagcaaaagcccaccctgtccgggcagcggttcaaaacaaggaagagagacgagaaggaacggttcgatccaacgcagttccaggattgtatcattcagggtttaactgaaaccgggactgacctagaagcagtagcgaaatttctcgacgcctcaggagcaaaacttgattatcgcaggtatgccgagaccctgttcgatattctcgtcgctggcggcatgcttgctccaggtgggacattggccgacgacatgatgcggacagacgtctgtgtatttgcggcgcaggaagaccttgagaccatgcaggccttcgcccaggttttcaataaactcatccggaggtataagtacctggagaagggctttgaagatgaagtaaaaaaattattactgttcctgaaaggattcagcgagtcagaacgcaacaagcttgccatgctgactggggtgctactggctaatgggacactcaatgctagcatcctcaactctctttataatgaaaatctggtcaaagaaggtgtgagtgccgccttcgctgtgaagctgttcaaatcctggatcaatgaaaaggacataaacgccgtcgctgccagcctgcggaaggtgtctatggacaaccggctaatggagctgtttcctgcgaataaacagagcgtggaacacttcaccaagtatttcaccgaagccggcctgaaggagctgtcggaatacgtcagaaaccagcaaaccatcggggctaggaaagagctgcagaaggaactccaggagcagatgagccggggcgacccattcaaggacattatcctgtacgtgaaggaagaaatgaagaagaataatatccctgagccggttgtgattggtatcgtgtggtccagtgtgatgagcacagttgagtggaacaaaaaggaagaactcgtggcagagcaggcaataaaacacctcaaacagtattctcccctgctcgcagcatttaccactcaggggcagtccgagttgacactgttactgaagattcaggaatattgttacgataatatacattttatgaaagcctttcagaaaattgtcgtgttgttctacaaagccgaggtactgagcgaagagcctatcctcaagtggtacaaagatgcgcatgttgcaaagggaaagtccgtcttcctggaacaaatgaaaaagttcgtcgaatggctgaagaacgctgaggaggaaagcgaatcagaagccgaagagggtgattag

SEQ ID NO: 17110 - DNA, 948 bp, Artificial Sequence
  Description of Artificial Sequence: Synthetic coding sequence
atggcgggaggtgctcgcgaagtgcttacattgcaactgggacatttcgccggattcgtgggggcgcactggtggaaccagcaggacgctgccctaggaagagctaccgatagcaaagagcctcctggagagctgtgccccgatgtcctgtacaggaccggtcggaccctccacggccaggaaacatacacgccgcgtctgatcctgatggacttgaaggggagtctgagctctctgaaggaagagggcggcttgtacagggacaagcagttagatgctgctattgcttggcaaggcaaactgacgacacataaggaggagctgtatcccaaaaacccttatctccaggacttcttatccgctgagggtgttctaagtagcgatggcgtgtggcgcgtcaagtctattccaaacgggaaggggtccagcccgctccctaccgccaccactccgaaaccactgattcctacagaggcatctatcagagtgtggtcagactttttacgagttcatctgcacccccgctcaatatgtatgatccagaagtacaatcacgatggagaggctggaaggctggaggcattcgggcagggagaaagcgtgttaaaggaaccaaaataccaggaggagctcgaagataggctgcacttttacgtagaggaatgcgattaccttcaggtcgtagcctggcagtgcgccctgcaggggggaagctcaagccaccccgctaactacctctcttccctgacccctgcccagggttttcagatcctctgcgatttacatgatggtttctcgggggtgggcgcaaaggccgccgaactgctccaggatgagtacagtggcaggggtatcattacttggggcctcctgccaggtccctaccatcgtggggtgagcggaacatggcgcagcaaacatagcaacccaattgggcgtgtcgcctag

SEQ ID NO: 17111 - DNA, 285 bp, Artificial Sequence
  Description of Artificial Sequence: Synthetic coding sequence
tgcacgagctcgtgtacaccaagctgttgtcaacagtcgtcatgccagcccgcctgttgcacctcctctccttgccagcaggcctgctgtgtacctgtatgctgtaagaccgtatgctgtaagccctcttcctgtcagcctgcttgttgcatcagttcgccatgtcagcagagctgctgtgtgccggtctgctgcaagccaatctgctgtgtccctccagcgtgctgcactacgagctgctgccggccttcttcttcagtctctctcctctgtagacccgtttag

SEQ ID NO: 17112 - DNA, 1221 bp, Artificial Sequence
  Description of Artificial Sequence: Synthetic coding sequence
atggccgccaacctctcccggaatggcccggcgctgcaggaggcctacgtccgagttgtaacagaaaagtcacctaccgactgggccctgtttacctacgaaggaaactctaacgacatcagagtggcaggaactggggaagggggactggaagaaatggttgaggagttgaattctggcaaggtgatgtacgctttctgtagggtcaaggatcctaactctggccttccaaaatttgtcttgatcaattggggtgcgcatgtgactataaatgcccgcgctgaagaagatgtggagcctgagtgtatcatggaaaaggtcgccaaggcctcaggggcaaactattcattccacaaagaaagtggccgattccaggacgtgggaccccaggccccagtcggctccgtttaccagaagacaaatgcagtgtcagaaattaagcgggttggcaaggacagtttctgggcgaaagcggaaaaggaggaagagaataggcgtcttgaggaaaaacgcagagccgaagaagcccagcgccagcttgagcaggagcgacgggagcgagagctccgtgaggcagccagaagagagcagaggtaccaagaacagggcggcgaggcctccccgcagtccagaacctgggagcaacagcaagaggtggtttcccggaacaggaatgagcaagagtctgccgtccatccacgcgagatcttcaaacagaaggagcgggcgatgagcacgacttccatttcctcgccgcagcccggaaagctcagaagtccattcttacagaaacaactgacgcagcctgagactcattttggtagagagccggccgccgccattagcagaccgcgggcggatctacccgccgaggaaccagctcctagcacccccccatgcctggtgcaggcagaggaggaagcagtgtatgaggagccccctgagcaggagactttttacgagcaacctccccttgtgcagcagcagggggccggatccgaacatattgaccaccatatacagggacaaggactatcaggccagggcctgtgcgctagggcattgtacgattatcaggctgcagacgatacagagattagctttgaccctgagaatctgataaccggcattgaggtgatcgacgagggatggtggcgggggtacggcccagacggccacttcggcatgttccccgccaactatgtggaattgatcgaatag

SEQ ID NO: 17113 - DNA, 981 bp, Artificial Sequence
  Description of Artificial Sequence: Synthetic coding sequence
atgccccatcttccgctggctagcttccggcccccattctggggcctgcgccacagtcgagggctcccccgattccactccgtgagcactcagtctgagccacatggcagtcccatttctcgccgaaaccgggaggcaaagcagaagcgcctgcgcgaaaaacaggccaccctggaggcagaaatagctggtgaaagcaagagccctgctgagagcattaaagcctggcgtccaaaggaactcgtgctatacgagatacctaccaagccaggagaaaaaaaagacgtttcaggacccttgcctcctgcatactcccctaggtatgtggaagcagcctggtatccatggtgggtccgtgagggcttcttcaagcctgaatatcaagctcggctcccccaggcaacaggggaaaccttctctatgtgcattccaccccctaacgttaccgggagcctccatatagggcacgccttgaccgtcgctatacaggacgcactcgtcaggtggcatcggatgcggggagaccaggtcctctgggttcccgggagcgatcatgccggcatcgcaacacaagccgttgtggagaaacagttgtggaaagagcgtggggttcgacggcatgaactgagcagagaagcatttcttagagaagtgtggcagtggaaggaggccaagggaggcgaaatctgcgaacagttgagggcactgggggcgtctctggactgggaccgtgagtgcttcactatggatgtgggctcctccgtagcagttactgaagccttcgtacgcctttataaagccggcctgctatacagaaaccatcagttggtgaattggtcttgtgcacttcgctccgctatctcagatatcgaagtggaaaatcggcccctccccggccatactcagctgcggctgcctggttgtcccacccccgtctcattcggtctcctgttcagcgttgcgttccccgttgacggttag

SEQ ID NO: 17114 - DNA, 684 bp, Artificial Sequence
  Description of Artificial Sequence: Synthetic coding sequence
atgctgtgttgggggtactggagtttaggtcaacctggcatttccacaaacctacaaggcatcgtggcagaacctcaggtttgcggcttcattagtgaccgcagcgtgaaggaggtggcctgcgggggaaaccactctgtgtttttattagaagatggcgaggtgtacacctgtggacttaataccaaggggcaactcggtcacgaaagggaaggcaacaagcctgaacagatcggcgcactcgcagaccagcacataatacatgtggcttgtggcgagtcacacagtcttgctctgagtgacagaggccagctgttctcttggggcgcaggaagcgatggacaattgggacttatgaccacagaggactctgttgcggtacccaggctgattcagaaactgaatcagcagactatcctacaagtgtcttgtggcaattggcattgcctcgcccttgccgccgatggacagttctttacgtggggcaagaatagccacggccagctgggactgggaaaggaattcccaagtcaggcctccccgcagagagtacggtccttggaaggcatccctcttgcacaagttgctgccggcggggcacactcattcgccctctctttatccggggccgtgttcgggtgggggatgaataatgcaggccaactgggactgtctgatgagtag

SEQ ID NO: 17115 - DNA, 624 bp, Artificial Sequence
  Description of Artificial Sequence: Synthetic coding sequence
atgtcttcacctttggcatctctgtcaaagactcggaaggtccctcttccctctgagccaatgaatccaggacgtcgggggatacggatctatggagatgtgcctgcaagccacgattcagagttaatggcgtttatgacccgaaaattatgggatctggaacagcaggtgaaagcccaaaccgatgagatcctctcgaaggaccagaaaatcgcagcgctcgaggatctagtgcagaccctgaggcctcaccccgccgaggccacgttgcagaggcaggaagagttggagaccatgtgcgtgcagctgcagaggcaagtgcgtgaaatggagagattcctgagcgactatggcctgcagtgggtgggcgaacctatggaccaagaagactctgagtccaaaaccgtcagtgaacatggagagcgcgactggatgactgcaaagaagttttggaagcccggtgactcactggctccacctgaagtggattttgacagactgctggctagtttgcaggatctctctgagctggtggttgagggcgacactcaggtgacccctgttccaggaggagcaaggctcaggacattggaacctatacctttgaaactctaccgaaattag

SEQ ID NO: 17116 - DNA, 717 bp, Artificial Sequence
  Description of Artificial Sequence: Synthetic coding sequence
atgacagaggatagccagcgcaacttccgctctgtgtattatgagaaagtcggattcagaggcgtggaagagaagaaatccctggagatcctcttgaaagatgatcggctgggaatcctgcccccgcaccacgagagtcacgccaaagtgatgatgtataggaaagaacagtatttagacgtcctgcacgctctgaaagtagtgagattcgtcagcgatgcaacaccccaagctgaggtgtatttgagaatgtatcaacttgaatccggcaagctgcctaggagtccctcctttcccctggagcctgatgatgaggtattcctcgcgattgccaaggctatggaggagatggtggaggactccgtcgattgctactggattaccagacgcttcgtcaaccagttgaacactaaatacagggatagtttgccccagcttccaaaggctttcgagcagtacctcaatctggaggatggtcggctccttacacacctccggatgtgcagtgcagcccctaagttaccgtacgatttatggtttaagagatgctttgcaggctgtctgcccgagtccagtcttcagagggtgtgggataaggtcgtcagcggcagttgtaagatcctggtgttcgtggccgtggagattctcttaaccttcaagataaaagtcatggccctgaactcggctgagaaaattacaaaattcctggagaactag

SEQ ID NO: 17117 - DNA, 369 bp, Artificial Sequence
  Description of Artificial Sequence: Synthetic coding sequence
gtgagggagttggaagcagaactggatgccgaacagaaaaaacatgcagaggccctaaagggcgtacggaagcacgaacgtcgtgtgaaagagttggcatatcaggcagaggaggatcgcaagaatctggcacggatgcaggacctggtggataaactgcagtccaaagtgaaatcatacaagagacaatttgaggaggcggagcagcaggccaatacaaaccttgcaaaatataggaaagcccagcatgaactggatgacgccgaggaaagggctgatatggcggagacccaagccaacaagctcagggctcgaactcgggacgcactgggccctaagctgagcctgtcaccacagcataaagagtag

SEQ ID NO: 17118 - DNA, 483 bp, Artificial Sequence
  Description of Artificial Sequence: Synthetic coding sequence
tgagagagtttagtggggctgcaagaaggcaaatccactgaacagggtaaccatgaccagctgaaagaactctacagtgccggcaaccttaccgtgctggccacagaccccctgctgcaccaagacccagtacagctcgatttccatttcagattgacctcccagacaagcgctcactggcatggcctgttgtgtgaccgccgactgttcctcgatattccttaccaggcactcgatcagggaaaccgtgagtcacttaccgctacgctcgagtacgtggaggagaaaacgaatgtagattctgtcttcgtcaatttccagaacgataggaacgaccggggagcactcctgcgggcctttagttatatgggcttcgaggtcgtcaggcctgaccatccggccctgccacctctggataacgtgattttcatggtgtatcccctagagcgggacgtgggccatctgccctccgaacccccttag

SEQ ID NO: 17119 - DNA, 102 bp, Artificial Sequence
  Description of Artificial Sequence: Synthetic coding sequence
atgtctgtcacctacgacgatagcgtgggcgtcgaagtttcgtcagactcgttttgggaggtgggcaattacaagagaacagtgaagcggattgacgattag

SEQ ID NO: 17120 - DNA, 402 bp, Artificial Sequence
  Description of Artificial Sequence: Synthetic coding sequence
atgtggagtctgaccgcgagcgagggggaatcaaccacagctcacttcttcctgggagcaggagacgaagggctgggcacccgcggaatcggaatgcgtcccgaagaatccgacagcgaactgctggaagatgaggaggacgaggtgcccccagagccccaaatcatagtaggcatttgcgcaatgaccaagaagtctaaaagtaaaccgatgactcagatcctcgagaggctctgccggtttgattatctcacagtcgtcattctgggggaagacgtgattttgaacgagccggtggagaattggccaagctgtcactgcctgatatccttccatagcaaaggcttcccacttgataaggcagtggcttacagtaaactgcgaaatccttttcttatttag

SEQ ID NO: 17121 - DNA, 939 bp, Artificial Sequence
  Description of Artificial Sequence: Synthetic coding sequence
atggcccaaccataccctccggcccagtaccccccccctccgcagaacgggattcccgctgagtatgcccctcctcctccccaccccacacaggattacagtgggcaaacccccgtccccactgagcacggcatgaccttatacacccctgctcaaacccacccagaacagccaggaagcgaagccagtacccagcccatcgctgggacccagactgtgcctcagaccgatgaggcagcccagactgattctcagcccctgcatccttctgaccctaccgaaaaacagcagccaaaacgactgcacgtctctaacatcccctttagattccgcgatcctgacctcagacagatgtttgggcagtttgggaaaattctagacgtggagataattttcaatgagcgtggttctaagggcttcggcttcgtgactttcgagacctcaagcgacgctgaccgtgccagagagaaactgaatggcacaatcgtcgagggtcgaaagatcgaggtgaacaacgccaccgctcgtgtcatgactaacaaaaagacgggcaatccatataccaacggctggaaactaaacccagttgttggcgcggtgtacgggccggaattttatgcagtgacaggcttcccctaccctacaactgggactgccgtcgcataccgtggggcccacctgagagggcggggccgagcagtctataatacctttcgtgccgcaccaccacctccaccgattcctacctacggtgcagtcgtttaccaggatggattttacggggctgagatctacggggggtacgcagcataccggtacgcacagcccgcggctgctgccgccgcgtattccgacagctatggccgcgtttacgcagccgctgacccctatcaccacactattggaccagccgcaacatattctataggcacgatgtag

SEQ ID NO: 17122 - DNA, 1308 bp, Artificial Sequence
  Description of Artificial Sequence: Synthetic coding sequence
taaagtatcctgaacagtaacgagcacctcctcaaggaaaaagagctgcttatcgacaaacaacggaagcacatctcccagctggagcagaaggttcgggaaagtgagctacaggtccattccgccctgctgggcagaccggctccattcggggacgtgtgccttctgcggctccaagagctccagcgggagaacaccttccttcgcgctcagttcgcacaaaaaacagaagccctctcccgcgaaaaaattgacttagaaaagaaactgagtgcctccgaagtcgaggtccaattgatcagggaatcgctaaaggttgcacttcaaaagcattccgaagaggtgaagaaacaggaggagcgtgttaaaggtcgggataagcatattaacaatcttaagaagaagtgtcagaaggagtctgagcagaaccgggagaaacagcagcggatagaaactttagagagataccttgctgacctacccactctagaagatcaccaaaagcagtcccagcagctgaaagattcagagctgaagtctaccgagctgcaagaaaaggtcacagaactggagtctctgctcgaggagacgcaggcaatctgcagggaaaaggagatccagcttgaatctttacggcagagggaggctgagttctcctctgctggacactcccttcaagacaaacagtctgtggaggagacaagcggcgaggggcccgaggtggaaatggagtcatggcagaaacgctacgactctctgcagaaaatcgtggaaaagcagcagcagaaaatggatcagctgaggagccaagttcaaagcctggaacaggaagttgctcaagaggaaggaacaagccaggcactgcgggaagaagcccaaagaagagattctgctctgcaacagctgaggacggctgtcaaggaattgagtgtccagaaccaggacttaattgaaaagaacttgactctccaggagcacttgcggcaggctcagcctggaagccctccgagccctgatacagcgcagctagccttagagcttcaccaggaactcgccagttgtctccaggacctgcaggccgtgtgtagcattgtgacacaaagagcccaggggcatgatccgaatctgagcttgctgttggggatccacagccagcatcccgaaacccagctagatctgcaaaaacctgacgttattaagaggaagctcgaagaagtgcagcagctgcgcagagacattgaagatctacgaactacgatgtctgaccgatatgcccaggatatgggggagaattgcgttactcagtag

SEQ ID NO: 17123 - DNA, 474 bp, Artificial Sequence
  Description of Artificial Sequence: Synthetic coding sequence
atggagcttcggtgcggcggattactgttttcaagccgatttgactccgggaacctggcccacgtggagaaagtggaaagcctcagctcagacggtgagggagttggcggcggcgcctctgctcttacctctgggatcgcctcaagcccagattatgaattcaacgtctggacgcggcctgactgcgcagaaaccgaatttgaaaatggaaatagatcctggttttacttctctgtgagaggcggcatgcccggtaaactgataaagatcaatattatgaatatgaacaaacagtcaaagctttactctcaaggtatggcaccctttgttcgaacccttcccacccgcccccgatgggaaagaataagggataggcccacgttcgaaatgaccgaaacgcaattcgtgctctcttttgtacacagatttgtcgaaggaagaggcgccacaacattcttcgctttctgttactag

SEQ ID NO: 17124 - DNA, 1620 bp, Artificial Sequence
  Description of Artificial Sequence: Synthetic coding sequence
atggccacaagcgcccccctcagatctcttgaagaggaggtgacatgttctatctgcctcgactacctgcgcgacccagtgacaatcgattgcgggcatgtgttttgtcgatcatgcactacagatgtgaggcctatttcaggttcaaggccagtgtgtcccctgtgcaaaaaaccctttaaaaaagaaaacatcaggccggtgtggcaactggctagtctggtggagaacattgaacgcctgaaggtagacaaaggcaggcaacctggtgaggtcacacgcgagcagcaagatgcgaaattatgcgagcggcacagagagaagctgcactactactgcgaagatgatgggaaactcttatgtgttatgtgtagggagagcagagaacatcgaccacacacagctgtcctcatggagaaggctgcacagccccaccgcgagaaaatccttaaccatctgtccacccttcgccgcgaccgggacaagatacaggggttccaggctaagggagaagcagacattctggcagccctgaagaagttacaggatcaaaggcagtacatagttgcggagttcgagcaggggcaccagtttctgagagagagggaggagcacctgctcgagcagctagccaagttggagcaggaactaaccgaggggcgcgagaaattcaaatctcgcggagtcggagagctagccagactggctctggtcataagcgagctggaaggcaaagcccagcagcccgcagccgaactcatgcaggatacccgggattttctgaatcgatacccccggaaaaagttttgggttggaaagccaatagcacgggtcgtaaagaagaaaaccggagagttctctgacaaactcctaagcttacaaagaggactgagagaatttcaggggaagctgctccgagatctagaatacaaaacagtgagcgttacacttgaccctcagagtgcctcaggataccttcaattgtcagaggactggaaatgtgtcacatataccagcttgtacaagagtgcctacctccatccgcaacagtttgactgcgaacctggggtccttggaagtaaaggtttcacttggggcaaggtgtactgggaggtggaggtggagcgggagggctggtccgaggacgaggaagagggtgatgaggaggaagagggcgaggaagaggaagaagaggaagaggcaggttatggcgacgggtatgacgactgggagacagatgaggatgaagaatccttgggcgatgaagaagaggaagaagaggaggaagaggaggaagtattggaaagttgcatggtcggagtggcaagagatagcgtaaaaagaaagggagatctcagtctccgccccgaagatggcgtgtgggctctgcggttgtcttcaagcggcatctgggccaatacaagcccagaggccgagttattcccagcactccggccacgccgggttgggattgccctagactacgaaggcgggaccgtcacttttaccaatgccgagtctcaagaactgatttatactttcaccgccactttcacaaggcgtctcgtgcctttcctgtggctgaagtggcccggaacacgcctcctgctacgtccgtag

SEQ ID NO: 17125 - DNA, 6141 bp, Artificial Sequence
  Description of Artificial Sequence: Synthetic coding sequence
atggacgaggttgaacaggaccagcacgaggcacgcctgaaggagctttttgattccttcgataccacgggcactggaagtctgggccaggaggagctgaccgacctttgccatatgttatccttggaggaggtggcgccagtgctacagcaaacactgctgcaggataacctcctgggaagagtgcactttgaccagtttaaagaggccttgattcttatcctgtcccgcaccctgagcaatgaggaacatttccaggagcctgattgttccctggaagctcaacccaaatatgttcggggcggaaagaggtacggacggagatctttaccagaattccaagaaagtgtcgaagagtttccagaggtgacagttattgagccgttagatgaggaggcccgtccctctcacatcccagctggggattgctccgagcattggaaaacacaacgaagcgaggaatacgaggctgagggccagctgcgcttctggaatcccgacgacctcaatgctagccagtcaggttcaagtcccccccaggactggatcgaagaaaagctgcaggaagtatgtgaagatctcggtatcaccagagacggtcacctcaaccggaaaaaacttgtgtcaatatgtgaacagtacgggttgcagaatgtggacggcgaaatgctggaggaagtctttcacaatcttgatcccgatggcacgatgtctgtggaagatttcttctacggactattcaagaatggaaagtccctcaccccgtccgcgtctaccccgtaccgtcaacttaaaaggcatctgagtatgcaaagtttcgatgaatcaggaagaagaaccactacctcttctgcgatgacatcaacaattgggttccgagtgttctcatgtctcgacgatgggatggggcacgcctctgtagagaggattttagatacatggcaagaagaaggcatcgagaattcacaggagatcctgaaagccctggattttagcctcgatgggaacattaacctgactgaactcaccctggctctggaaaatgagttattagttaccaaaaacagtatccaccaggctgcacttgccagtttcaaagccgaaattagacatcttctcgagcgagtggatcaggttgttagggaaaaggaaaaactgcgctcggacctagacaaagctgaaaagttaaagagcctcatggccagtgaggtcgatgatcaccacgccgccatcgaacggaggaatgagtataacctgagaaaactcgatgaagagtacaaagaacgaatcgccgctttgaagaatgaactcagaaaggagcgcgaacagatattacagcaggccggaaagcagcggctagaacttgaacaggagatagaaaaagcaaagacagaagagaactacatcagagacagactggctctgtcgctgaaggagaattcccgactcgagaatgaactgttggagaatgcagaaaaattggctgaatatgagaacctgactaacaaactccaaagaaacttggagaatgtcctcgccgaaaaatttggagacctggacccttcctctgcagagttcttcctgcaagaagagcgccttactcagatgaggaatgagtacgagagacagtgccgggttcttcaggatcaggtagacgagctgcagagcgaactggaagagtaccgcgcccaaggcagagtcctgaggttgccactgaaaaactccccatcagaggaggtagaggctaatagcggagggattgaacctgagcacggcctggggtctgaagaatgcaaccctctgaatatgtctatcgaggccgaattggtaatcgagcagatgaaagagcagcaccacagagatatttgttgcctcaggctcgagcttgaggacaaggtgagacactatgaaaaacagctggatgagacggtagtgtcctgtaagaaggcacaggagaatatgaagcagagacatgagaacgaaacccataccctcgagaaacaaatttcagatctgaaaaacgaaatagctgaactgcaggggcaggccgccgtgttgaaagaggcacatcatgaggcgacctgtcgccatgaggaagagaagaagcaactgcaggtgaagctggaggaagaaaagacacacctgcaggaaaagctgagacttcagcacgaaatggagttgaaagcacgcctgacacaagcgcaggcttcctttgaacgcgagcgagaggggttacagtccagcgcctggaccgaagagaaggttcgtggcctcacccaggagcttgagcagtttcaccaagagcaactgacttcactggtagagaagcacacgcttgaaaaggaggaactcagaaaggagttgctggagaagcatcagcgggaactgcaggaaggacgggaaaaaatggaaaccgagtgcaatagaagaacaagccagatcgaggctcagtttcaatccgactgtcaaaaggtaaccgagaggtgtgagtccgcgttgcagagtctggaaggcagataccgccaggagctgaaggacttgcaagaacagcagcgggaggagaagagccaatgggagtttgaaaaggatgagctcacacaagagtgtgccgaggcccaagagctgctgaaggagaccttaaagagggaaaagaccacatcactcgtcctgacgcaggagagagagatgctggaaaagacatataaggagcacttgaattccatggtcgttgaacgacaacagctgctccaggacctagaggatctgcggaatgtctccgaaactcaacagtcgctgttgagcgatcagatcctcgagttgaaaagcagccacaagagagaacttcgggagagggaggaggtgttgtgtcaggctggtgccagtgagcagctcgccagccaacggttagaacgattagaaatggaacacgatcaggagaggcaggagatgatgtcaaaactcctagccatggagaacattcataaggccacatgcgagaccgcggacagggaacgggctgaaatgagcaccgaaatttcaagactgcagagcaaaattaaagaaatgcagcaggctactagcccattgtccatgttacagtcaggctgccaggtgatcggggaggaggaggtcgagggcgacggtgctctatccctcctccagcagggagaacagttgttggaagagaacggagatgtgctgctctcgctacagcgcgctcatgaacaggccgttaaggagaatgtcaagatggcgactgaaatttcaaggcttcagcagcggctgcagaagttggagcctggcttagttatgtctagttgcttggacgagcccgcaacagaatttttcggcaatacagctgaacagacagagcagtttctccaacagaaccggacgaaacaggttgagggcgttacaagacgccatgtgctaagcgacttagaagatgatgaagtaagagatcttgggtcaacaggcacctctagtgtgcaacggcaagaggtgaagatcgaagagagcgaggcctctgtggaagggttttccgaattagaaaactccgaagagacacggactgaaagctgggagctcaaaaaccagattagtcagctgcaggagcaacttatgatgctgtgtgcagactgtgatagagcttcggaaaaaaaacaggacctgctatttgatgtctccgtactaaagaaaaagctaaagatgctcgaacgaatccctgaagcatctcctaagtacaaactgctctatgaggatgtgtcgcgcgagaatgattgcctccaggaagaactgcggatgatggaaactcgctacgacgaggccttggagaataacaaagaactgactgccgaagttttccggctgcaagacgagttgaagaagatggaggaagttacagaaacattcctgagcctggaaaaatcatacgacgaggtgaagattgagaacgaagggctgaatgtactggtactgcgtctgcagggaaagatcgagaaactccaggagagtgtcgtgcagcgctgcgactgttgcttgtgggaggcaagccttgaaaatcttgagatagaacccgacggtaacatactacagctcaaccagacccttgaggaatgcgtgcccagagtgcgaagtgttcatcatgttatcgaggagtgcaaacaggaaaatcagtatctggaaggaaacacccagctcctggagaaggtcaaagcacacgaaatcgcctggctgcatgggactattcaaactcaccaggagcgcccacgagtgcagaaccaagtaattctggaggagaacaccactttgctgggatttcaggataagcattttcagcaccaggccactatcgccgagcttgaactggagaagacaaaactgcaggaattgacacgtaagcttaaggagagagtgaccatcttagtgaagcagaaagatgtgctgtcccatggggagaaagaagaagaattaaaagccatgatgcacgatctgcagattacgtgttcggagatgcagcagaaagtagagctgttgcggtatgagagcgaaaaactgcagcaagagaatagcatcctgagaaatgagattacgacgctgaatgaggaagatagtatctctaatttaaagttaggcaccctcaatggctctcaagaggaaatgtggcaaaagaccgagaccgtaaaacaggagaacgcagccgtccagaaaatggttgaaaacctgaaaaagcagatttcagaactgaagatcaaaaatcagcagctggacctggaaaacaccgaactcagtcagaaaaactcccagaatcaagagaagttgcaagagctcaaccagcgtctgactgagatgctgtgccagaaggagaaggaaccggggaattctgcattggaagagcgggagcaggaaaaatttaacttgaaagaggagctcgagcgatgcaaggtccagtcaagtacactcgtgagctcactggaggccgagctctccgaggtcaagattcagacacacattgtacagcaagagaatcacctactcaaggatgagctcgagaagatgaaacaactgcataggtgtccagatctgtctgatttccagcagaagatttcatccgtgctgagctataacgaaaagctactcaaagaaaaagaagcattatcagaagagctgaactcgtgtgtggacaagctggccaagtcctcgctgctggagcatagaatcgctactatgaagcaggagcagaagtcctgggaacatcaaagtgcctcccttaaatcacagctcgtcgccagtcaggaaaaagtccaaaatttagaggacaccgtgcagaacgtgaacctgcagatgtcgaggatgaagagcgatctacgggtgacccaacaggagaaagaggctctaaaacaggaggtgatgagcctacataaacagctgcagaatgcgggcggtaagtcatgggccccggaaatagcaactcatccatccggcctacataatcaacagaagcggctgagctgggacaagctcgatcatcttatgaacgaagagcagcaacttctgtggcaagagaatgaacgactacagaccatggtgcagaacacaaaggccgaactgacgcattcacgagagaaggttcgccagcttgaatcgaacctgctcccgaagcatcagaaacatttgaaccccagcggcaccatgaatccaacagaacaggagaaactttctctgaagagagaatgtgaccaattccagaaggaacagagtcctgcaaatcgaaaagtctcccaaatgaatagccttgaacaggagctggagacaatccatctggagaatgaaggcctgaaaaagaagcaggtcaagctggatgagcagctgatggagatgcagcatttgcggtcgaccgctacaccatccccaagcccgcatgcttgggatttgcagctcctccaacaacaagcctgccccatggtgcctagggaacagttccttcagttacagagacagttgcttcaagctgagaggatcaaccagcacctccaggaagaactggaaaatcgcacatctgagaccaacacaccccaggctctgctgcccgagcaaagagctgtgcacgccgattcatatcgcaggatcggccacctgtag

SEQ ID NO: 17126 - DNA, 1203 bp, Artificial Sequence
  Description of Artificial Sequence: Synthetic coding sequence
atggctggggagaaccaccagtggcagggctccattctatacaatatgttgatgtccgccaagcagactcgagctgcacctgaggctccagagacgaggctggtcgaccaatgttggggatgcagttgcggcgacgagcctggcgtgggtcgggaaggactactgggaggtaggaatgtagcactgctctatcgctgttgtttctgcgggaaggatcatcctcggcaaggctcaattctttactccatgctcacctctgcgaaacagacttacgctgcccctaaagcaccggaggccacacttggcccctgctggggctgttcctgcggatcagatccaggcgtcggcagggcaggtcttcctggtgggcgacccgtggctctcttgtacaggtgctgcttctgcggagaagatcaccctcgacaaggatccatactgtacagtctgttgacttcgagcaaacagactcatgttgcccccgcagcgcccgaggccaggccaggaggagcctggtgggatcgaagttacttcgctcaacggccaggcggcaaggaagcccttcccggcggacgcgccacggcactgctgtaccgctgctgcttctgcggagaagatcatccccagcagggcagcacgctgtattgcgtgcccacatccaccaatcaagcccaggccgctcccgaggaaagacccagggccccctggtgggatacttcatctggtgcactgcggcctgtggccctgaagagcccccaagtggtctgcgaggctgctagtgcaggcttgctgaagacactgcgatttgtgaaatacctgccctgtttccaggtgttgccattggatcagcaattggtattggtacgcaactgttgggcatcactcctgatgctggaactggctcaggaccgactgcagtttgaaaccgtggaagtgagcgagccctcgatgctccagaagattctgaccacacgccgtcgcgaaactggcgggaatgagcctttgcctgtgcccaccttgcaacaccacttagctccgcctgcagaggcacgtaaggtgccatctgcttcccaagttcaagcgatcaaatgctttctgtccaagtgttggtccctaaacatctcaactaaggagtatgcttatctcaagggcactgtgttgtttaaccccgggaagggtaaagagaacgactgtaaccatcactag

SEQ ID NO: 17127 - DNA, 627 bp, Artificial Sequence
  Description of Artificial Sequence: Synthetic coding sequence
atgaaacagcttgaagaccacgaagccttcgaaactagttccctgattgggcactccgcccgagtttatgcgttgtactataaggatggattgttgtgtaccgggtctgacgatctgagtgcaaagctgtgggatgtaagcaccgggcaatgcgtgtacggtattcagacccatacgtgcgctgctgttaagtttgatgaacagaagctggttacaggaagttttgataatacagttgcctgttgggaatggagctcaggggcgagaacccagcacttccgcggacatactggcgccgtcttttctgtggactataatgacgagttggatatcttggtgtctggatcagcagactttacagttaaggtgtgggcactatccgcagggacctgtctgaatacactgaccggacacacagagtgggtgaccaaggtggtgctccaaaagtgtaaagtgaagtctctccttcattctcccggagactacattctcctttccgcagacaagtatgagattaagatctggccaatcggaagagagatcaactgtaagtgtctgaagaccttgtccgtgagcgaagatagatcaatatgtttgcaacctcgactgcattttgacggcaaatag

SEQ ID NO: 17128 - DNA, 639 bp, Artificial Sequence
  Description of Artificial Sequence: Synthetic coding sequence
atgttcggagtcaccaagttcggtgataacatcgaagatgagtggttcattgtatacgtcattaaacagattacaaaggagtttcccgaattagtagcccgcattgaggacaacgatggggaatttctgcttatcgaggccgccgattttctccctaagtggcttgatcccgagaactccacaaatagagtgttcttttgtcacggggaactctgtatcatcccagcgcctcgcaagagcggggctgaaagctggctcccaactacccctcctacgattccgcaagcactcaacataattaccgcccattctgaaaaaatcttggcctctgagtctattcgcgccgccgttaaccgacgcatccgcggttaccccgagaaaatccaggccagcctccaccgggcacactgtttcctgccggcaggtattgtcgccgtgcttaagcagagaccccgcttggtggcagccgccgtacaggccttctatttgcgcgatccgattgacctgagagcttgtagggtcttcaaaactttcctgcctgagaccagaataatgacatcagttacattcaccaagtgcctctacgcgcaactggtgcagcagagattcgtgcctgatcgtagatctggttatcggtag

SEQ ID NO: 17129 - DNA, 474 bp, Artificial Sequence
  Description of Artificial Sequence: Synthetic coding sequence
atggcaacgagcgctccactgcgcagcctagaagaagaggtgacgtgcagtatttgtctggattatcttcgagatcccgtgacaattgactgcggacacgtcttttgtagatcatgtacaaccgacgtgcgaccaatcagtgggagccgccctgtctgtcccctatgcaagaagccctttaagaaggagaacataaggccagtctggcagttagcatcccttgtggagaacatcgagaggcttaaagtagataaaggccggcagccaggagaggtgaccagagagcagcaggacgcgaaactgtgcgaacgccaccgcgagaagctgcattattattgcgaggacgacggaaaattgctgtgtgttatgtgtagggaaagtagagaacacagaccccacaccgcggtcttgatggagaaagctgcccaaccacacagggagaagattctcaaccacttgagcaccctgagatag

SEQ ID NO: 17130 - DNA, 4773 bp, Artificial Sequence
  Description of Artificial Sequence: Synthetic coding sequence
atgtccgcgacatcctggtttctggtgtcctcgtccggagcccgccaccggttgcctagggagctcatctttgtgggccgagaggaatgtgagctgatgcttcaatcaaggtctgttgacaagcagcacgccgtcataaattatgatcaggaccgggacgagcactgggtgaaagacttaggctccctcaacgggacattcgttaacgatatgcgaatcccagatcagaaatacgttactctcaaactgaatgacgttattcgctttggctacgactccaacatgtatgtacttgagcgggttcaacaccgagtgccagaggaagccctgaagcacgagaaatacacttctcaactgcaggtgagtgtgaagggcttagctcctaaacgcagtgaggccctgccagaacacactccatactgtgaagcttccaatccgcgacccgagaagggcgaccgccggcctgggaccgaagccgcttcttatcgcactcccctctatggacagccatcttggtggggcgaagatgacgggagtaccttgcctgatgcccagaggcaaggcgaaccctacccagccgaacggcccaaaggcccggttcagcaggacggcgagttgcacgggtttagagctccggctgagcctcagggttgtagctttcggcgcgagccatcttactttgagattcccacaaaggaaactcctcagccaagtcagcctccagaggtcccggctcatgagatgccgacgaaagacgcagaggctggcggcggcggtgcagccccggtggtgcagtctcacgcaagcttcaccatcgagttcgacgactgctccccaggtaaaatgaagatcaaggatcacattactaaattttcactgaggcagcgtcggcccccaggcaaggaggccaccccaggagagatggtgagtgcggaaaccaaggtggctgactggttggttcagaacgacccgagcttactccaccgcgtcggacctggggacgatcgacactctactaagtcagacctcccagttcacaccagaacactgaaaggacacaaacatgaggacggtacgcagtccgactccgaagacccactggccaaggctgcgtcagccgcaggagtacctcttgaggctagcggagagcaagtgagactgcagcgtcagattaaaagagatcctcaggagctcctgcataatcagcaggcttttgtcattgaatttttcgatgaggatacaccacgcaagaagcgatcccaatcattcacacacagtccttcaggagatcctaaagcggacaaaaggcgtggtcccactcccgcagaccgggaccgcccgtcagtgccagccccagtccaggccggtggtagaagttccggacctcagagagccggatcacttaaacgtgaaaaaactgaggagaggctaggttcaccatcccccgcaagcaggacaccagcccgaccttttggcagcgtggggcgacggagtcgactggcacaagatttcatggcacagtgtctccgagagtcaagtcccgcagcgcgtccctcacctgaaaaggtgcctcccgtcctgccggcgcccctaaccccccacggtaccagccctgttggtcctccaaccccaccccctgctcccacggatccacagctcactaaagccaggaaacaagaagaggacgactctctctcagacgccggtacctatacaatcgaaaccgaggcacaggataccgaggtggaagaagcgaggaaaatgatcgaccaggtctttggagtgcttgagtctccagaattatccagagctagtagcgccacatttcggcccgtgatcaggggagatagagacgagtcagacgatggcggtgtagcccagaggatggcgctgctgcaggagtttgcctctcgtccactgggggctgctccacaggccgaacaccaggggctgccggttccgggaagccctggtggccaaaagtgggtgtctagatgggcgagtctcgctgacagctattcggacccaggacttaccgaggatgggctaggtcggcgcggcggcgaaccagaaggaagtttgcctgttagaatgcgaagacgattaccccaattgccttctgaaagagccgattcgccggccggacccgaaagtagccgcagatctgggccgggccctccagagctagattcagagcagccaagtcgcctgtttggacaggaagaactggacccagacagcctgtctgacgcttcaggatccgacgggggcagaggtcccgaacccggggtggagccacaggactcacgaagacggagccctcaagagggacctacctggagccggggtcgccgcagcccacgggcacccggtgaacctactcctgccagcttcttcatcggtgatcagaatggcgatgctgtgctatctaggaaaccactggcggcgcctggtgacggagaggggctgggccagaccgcccagccctctcctccagctagagatggtgtctatgtatcggccaatggccgaatggttattcagcttaggcccggaagaagccccgaacctgacggccctgctcccgcctttttaaggcaggagtcatttaccaaagagcccgcctccggccccccagccccgggcaagcccccacatatttcgagccaccctctgctgcaagacctcgccgccacgcgcgccgcgcgaatggatttccacagtcaagacacccacctcattttgaaggaaacagaaacagcgctggcggctctggaagccaggctactctcaaactcagtggacgcagaatgcgaaggcggatccacacccaggcccccagaagacgctctatcaggagactcagacgtggataccgcaagcaccgttagcctgcggtccgggaagagtgggccgtctcctaccacacctcagccactacgagcccagaaagaaatgtctccatcaccccctgctgcacaggaccccgggggaaccgcactcgtgagtgcccgagagcagtcgtctgagcgccagcatcatccgctgggtcctacggatatggggagaggcgagcctgtgcgccggtcagcaattagacggggccacaggcctcgggggtccctggactggccaagcgaggaaaggggccccgtgctcgcccacctcccctcgtcagatgtgatggcctctaaccacgagacccccgaagcaaccggagccgggagattggggtcacgccggaaacctgctgcccccccaccatcacctgccgccagggaagaacaatcacggagttcagcttccagccagaagggccctcaggctctgacgcgcagcaacagcctctccactcctcgcccaaccagggcctccaggctcagacgggctcgccttggcgatgccagtgacaccgaggccgcagacggcgaaaggggctccctcggcaaccccgaacctgtcggtcgccctgccgccgagcaggccaagaaactgtcccgactggacattttagcgatgccaagaaagcgcgccgggtctttcaccgggacctctgacccggaagccgcgcctgctcggacttcatttagcggtcgatcagtggagctgtgctgtgcgagccgcaagccaactatggcggaggctcgcgctgtcagcaggaaagctgctaacacagccaccacaaccggaccccggcaacccttcagccgtgcccggtcaggcagtgcccgctacacctctaacactaggcggaggcagcaggggagcgattacactagcactagcgaggaagaatacggcagcagacacggatcgcctaagcatacacgtagccacactagcaccgccactcagacccctcgtgctggcagtagcagccgtgccagatcgagagctcctgggcctagggacacagatgacgatgaagaggaacccgacccgtacggctttattgtgcagacagctgaaattgccgaaattgctcgcctgtctcaaacactggttaaggacgtcgccattctcgcccaggaaatccacgacgtggccggcgacggcgacacactggggagcagtgagccagctcactcagcatctctcagtaatatgccctccactcctgcaagtactattagcgccagagaagaacttgtccagagaattccagaagcttccctgaacttccagaaggtgcccccgggatcactaaatagccgagatttcgaccagaatatgaacgattcatgtgaagacgctcttgcaaacaagacccgaccccgcaatagagaggaggtgatcttcgataatttaatgctcaaccctgtgtctcagctcagtcaggccatcagagaaaacactgaacacctagctgaaaagatgaaaatcctctttcaaaatacaggacgagcctgggaggacctggaggcccggatcaacgccgaaaacgaagtgcctatcctcaagacctctaacaaagaaatttctagtatcttgaaggagctcaggcgtgtccagaagcagctcgaggtgataaatgctatcgtggaccccagtggctccctcgacctgctgacagggaatcggtctctcgcatctagcgcccagccagggcttggcaagggacgtgtggctgcccagtctccaccaagcccagcctccgcagaggcgttgctccctgctctacctctgagaaactttccgcagcgcgcatcgtgcggtccaccatctctgccagaccctacattcctacccgatgccgaacggttccttatctag

SEQ ID NO: 17131 - DNA, 1452 bp, Artificial Sequence
  Description of Artificial Sequence: Synthetic coding sequence
atgtccggcggaggtcccagcggcggcggcccgggaggctccggacgggcaagaaccagtagttttgccgagcctggtgggggaggaggtggagggggaggaggccctgggggcagcgccagcggccccggaggcacagggggcgggaaagcctctgtaggcgctatgggaggaggagtaggggcatccagtagcggtggcggtcctggtggctccggcggtggtggctccggcggtcccggggccggtacatcctttcctccccctggtgtgaagctcggcagggactccggtaaagtcaccacggtggtggcgactctaggacagggcccagagcgatctcaggaggtggcctacactgacatcaaagtgataggcaacgggtctttcggtgtagtgtatcaggcgagattagctgagacgcgggagctcgtcgcaatcaaaaaggtgctgcaagacaaacggtttaaaaatagagaactccagattatgaggaagctggatcattgcaacatcgtacgcttgaggtactttttctatagcagtggcgagaaaaaggatgaactctatctaaacctcgtgttggaatacgtccccgaaacagtttaccgagtggcacgtcatttcacgaaagccaagttaactatacccattctctatgtgaaggtttacatgtaccagctattccgaagcctagcctacatccacagccagggagtgtgtcatagagacatcaaaccccagaatctactggtcgatcccgacaccgcagttctgaagctttgcgacttcggatctgcaaagcagctggtccggggagaaccaaatgtaagttatatttgcagccgttactacagagcacccgaactaatctttggggcgaccgactatacttctagtatcgatgtgtggtcggccggatgcgtgctggcggaactgttgctggggcagcctatctttccgggcgatagcggggtcgaccagctcgtcgaaattatcaaagtactgggaacacctacgagagaacagatcagggagatgaatcctaactacactgagtttaagtttcctcagatcaaagctcatccctggactaaagtcttcaagtcccgaaccccacctgaagccattgccttatgttcctccctgctggaatatacgccgtcaagcaggttgagccctttggaggcttgcgcccattccttctttgatgagttgcgctgtctgggaacgcagctccccaataacaggcccctgccacctctgttcaatttcagtgctggagaactgtccatccaacctagcctaaatgccatactcattccccctcacttgcgctcccctgccggcaccaccacactcaccccaagttcacaagccctcacagagacacccacaagcagcgattggcaatctaccgatgcaacacctactctaactaacagttcctag

SEQ ID NO: 17132 - DNA, 1389 bp, Artificial Sequence
  Description of Artificial Sequence: Synthetic coding sequence
atgggaggcgcagaagcagaaccgtgggggcgcgctcctggacccgcaataggaggtcggagggcaggggacagctgtcctggttggaggagacggtctaggtcaagagggcgaggtcagagactatcccacgggccacggcggcgccctcagttactgaccgctgcccccccccttcaagcacggggcgccttccggagtttcccccacagctggggcgaagacttcctggccagcctcatgttcaagattcagcttgagccactcaaactacgcgcctggacactgaatggatttgtgaaattccggaacaaagaaacttcggctgggcccgtcgcagtgatgggcaaggattactacaagatcctgggtatcccctccggcgctaacgaggacgaaatcaagaaagcctatagaaagatggcattgaagtatcacccagataaaaacaaggagccaaacgcggaggagaaattcaaggagatagcagaggcatatgacgtgctctctgatccaaaaaagagagggctgtacgatcagtacggcgaagaaggtctgaagaccggagggggcactagtggcgggtcatctggctcgttccattatacattccacggagatcctcacgctacctttgcctcattctttggcggctccaaccccttcgatatcttttttgcctcctctagaagcacgagaccgtttagcggatttgaccccgatgatatggatgtagatgaggacgaggatccattcggtgcatttggccgttttggttttaatggcctgagtagaggaccacggcgcgcccctgaaccattgtacccccgtaggaaagtacaggatccaccagtagtccacgaactaagggtctccctcgaggagatctaccatggctccaccaagaggatgaagataactaggagacgcctcaatcctgatggacgaacagtcagaactgaggataagattctgcacattgttattaagaggggctggaaggagggcaccaagattactttccccaaagagggagacgcaacgcccgacaacatacccgcagatattgttttcgtattaaaggacaaaccccatgctcacttccgtagggatggcactaatgtgctgtactcagcacttatatctcttaaggaagccctgtgtgggtgcaccgtcaacatcccgacaatcgacggaagagtcattcccttaccctgcaatgatgtcatcaagcctgggacagtaaaacggttgcgtggagagggcctaccgttccccaaagttccaacacagagaggggacctaatagtagaattcaaagtgcgctttccagacaggttgactccccaaacaagacagattctaaagcagcacctgccttgctcgtag

SEQ ID NO: 17133 - DNA, 279 bp, Artificial Sequence
  Description of Artificial Sequence: Synthetic coding sequence
gtgtacggagccaaagacattgagttgtctcccgaggcacaggctaagatcgacaggtatacacagcagggatttggcaacctgcctatctgcatggccaagacccatctaagtctgtcacaccaacctgacaaaaaaggagtgccccgagactttatcctccccatttccgatgtgcgcgcttccattggcgcaggcttcatttaccccctggtgggcactcggagctcccccctggctctcgtgggtgagtcacagccaaagcaagtccacccctag

SEQ ID NO: 17134 - DNA, 468 bp, Artificial Sequence
  Description of Artificial Sequence: Synthetic coding sequence
atgagcgtcacctacgatgacagtgtcggggtggaggtatctagtgatagcttctgggaagtagggaattataagcggaccgtgaagcggattgacgacggccacaggctctgctctgacttgatgaactgcttacacgaaagagccagaatcgagaaagcctacgcacagcaactgaccgagtgggccaggcgctggcgccaactggtcgagaaaggtccccagtatgggactgtggaaaaggcttggatggcctttatgtccgaagcagagagggtctcagaattgcacctggaggtgaaggcgtctctcatgaacgacgactttgagaaaattaaaaattggcagaaagaagcatttcacaagcagatgatgggcggttttaaggagaccaaggaggctgaggacgggttccggaaggctcagaagccctgggcaaagaaattgaaggaagttcacttatcctag

SEQ ID NO: 17135 - DNA, 483 bp, Artificial Sequence
  Description of Artificial Sequence: Synthetic coding sequence
atggaggccgaaaggccccaggaggaggaagacggggaacaagggccacctcaggatgaagagggttggccccctccgaattcaaccacccgaccatggcgcagcgctcctccctcccccccacccccggggacgagacacaccgcgctcggcccccgctctgcatccctgctgtctttgcagacggaattgctgcttgatctggtggcggaggcccaatctcgccgcctcgaggagcaaagggcgacattttatacgcctcaaaatccaagctccctagcaccggcccccctgcggcctctggaggacagggagcagctgtattcgacaatccttagtcaccagtgtcagaggatggaagcacagcggagcgaacccccactgccaccaggaggacaagaactgctggagctgctgctgcgggtgcaaggcggcggaagaatggaggaacaacggtcacgacctcctactcacacttgctag

SEQ ID NO: 17136 - DNA, 660 bp, Artificial Sequence
  Description of Artificial Sequence: Synthetic coding sequence
atggaaccctcggcacagcagctccaactcgccgcatctctgccggcgaatctatctaatttctgccagggaagcgagatgcccactacaagccgcccagcactagacgtgaagggcggcacatccccagccaaagaggacgcaaatcaggaaatgtcgtcagtagcctactccaacctcgctgtgaaggatcgaaaggctgtggcaatactccactatccaggcgtcgcgtccaatggcacgaaagccagtggcgcccctactagcagctcaggcagcccaataggctcacctacgactacacccccaaccaagccccccagtttcaacctgcatccagccccacacctacttgcaagcatgcatttacagaagctgaacagtcagtatcagggaatggctgctgccaccccaggccagccgggggaagcggggcctttacaaaattgggactttggcgctcaggcaggtggtgctgagagcctctcccccagtgccggggcccagagccctgccatcatcgatagcgaccctgtggatgaggaagtgttaatgtctctcgttgttgagctgggattggatagggcaaacgaactccccgaactgtggcttgggcaaaatgaattcgactttactgcagactttcccagtagctgctag

SEQ ID NO: 17137 - DNA, 318 bp, Artificial Sequence
  Description of Artificial Sequence: Synthetic coding sequence
atgaacatgatttggagaaactccatttcgtgtcttcggctgggcaaggtgccccacaggtatcagtccggttatcatcccgtggcaccacttggcagcagaatcctgacagatcctgcgaaagttttcgagcataatatgtgggatcatatgcagtggtctaaggaagaagaagccgcagctcggaagaaggtcaaagagaattcagctgtacgagtcttgctggaagagcaggtcaagtatgagcgcgaagcctccaagtactgggacactttctacaagatccataagaacaagttctttaaggacagaaattag

SEQ ID NO: 17138 - DNA, 366 bp, Artificial Sequence
  Description of Artificial Sequence: Synthetic coding sequence
taagagggggagagtccaacggcgagcccacacagttccgcaacagacgatctgcatcatagcgaccgctaccagacattcctgcgcgtgcgtgccaacaggcagaccaggctgaatgcccggatcggcaagatgaagcggcggaagcaggatgagggccaggtctgccccctctgtaatagacccctcgcgggcagtgagcaggaaatgtccagacatgtggaacattgcctgtcaaagagagaggggtcctgcatggcagaagatgacgcagtggacattgagcacgagaacaataatcgctttgaggagtacgagtggtgtggccagaagaggatacgtgcaacaaccttgctggagggatag

SEQ ID NO: 17139 - DNA, 1701 bp, Artificial Sequence
  Description of Artificial Sequence: Synthetic coding sequence
atggatcttcatcgtgcagctttcaagatggagaattcctcctacttgcctaaccccctggcttctcccgcgctgatggtgctcgcatcgactgcggaagcatcccgagatgcatcgatcccatgccagcagccccggcctttcggggtgcccgtctctgttgacaaggatgtgcacattccattcaccaacggcagttacacgttcgcctcgatgtaccacagacagggcggcgtccctggaacttttgcaaatagggatttccctccatccttgttacacctccatccgcagtttgcgcctcccaaccttgactgtacccccatatctatgctgaaccactccggggtaggtgccttccgccccttcgcctctaccgaagatagagagagctaccagagtgcatttactcctgctaagcgactaaagaattgccacgacacagagtcccctcatctgagattctccgacgccgatggaaaggagtacgatttcggaacacagctgccctcctccagcccaggttctctgaaggtcgatgacactggaaagaaaatattcgctgtttccgggctcattagcgaccgggaagctagctcctctccagaagaccgcaacgaccggtgcaagaagaaggccgccgccctcttcgatagtcaggcacctatatgtcctatttgccaggtgttgctaaggccgagcgagctgcaagaacatatggaacaggaattagagcagctggcacagctgccgagtagcaagaatagcctgctgaaggacgctatggctccgggaacccctaagtcacttcttctgagcgcatccattaaacgtgaaggagagtctcccacagcaagccctcatagtagcgccacagacgacctgcaccactcagatcgctatcagaccttcctgcgggtccgagcaaataggcagacccgactcaacgcccgcatcggtaagatgaaacgccggaagcaggatgaaggccagcgagaagggagctgcatggcagaagatgacgcagtcgatatagagcatgagaataacaacagattcgaagaatatgaatggtgtggccagaagagaatccgtgctaccacgctgctggagggaggtttcaggggcagtggattcataatgtgtagcggaaaagagaaccctgactcagatgccgatcttgatgttgacggcgacgatactctcgagtatggcaaacctcagtacacagaggcggatgttatcccttgtacaggcgaggaacctggagaggctaaggaacgagaagccctacggggggctgtgctgaatggcggacccccctccacacgcatcacccctgaattcagcaagtgggcctccgacgagatgccctcgacgtctaatggggagtctagcaaacaggaggccatgcaaaaaacatgtaaaaactctgatatcgagaaaataaccgaggactctgcagtgaccacattcgaggccctcaaagcacgcgtgcgcgagctggaacgtcaacttagtagaggcgatagatacaagtgcctcatctgcatggactcctacagcatgcccctcacctccattcagtgctggcacgtgcactgtgaggagtgttggctccgtacgctcggtgccaagaaactgtgtccgcagtgtaacacaattactgccccaggagaccttcgaagaatttacctttag

SEQ ID NO: 17140 - DNA, 4719 bp, Artificial Sequence
  Description of Artificial Sequence: Synthetic coding sequence
atgttactgcatctgtgcagcgtcaaaaacttataccagaatagatttctcggcctggccgctatggcttccccgtctagaaattctcagtctcgacgccggtgtaaagaaccactccgctactcttacaacccagaccaatttcacaatatggacctccgaggtggaccccatgatggagttacaatcccacggagtacatcagatactgacctggtcacaagcgactcccggagcactctgatggtgtcatccagctactattcaattgggcactctcaggacttggtgatccattgggatattaaagaggaagtggacgcaggggattggatcggaatgtatcttattgacgaggtcctcagtgagaacttcctggactataaaaacaggggtgtaaacggaagtcaccggggccaaatcatttggaagatcgatgcgagcagctattttgttgaacctgagacaaagatatgttttaagtattaccacggcgtgagcggagccctgcgggccacaaccccatcagttaccgttaaaaattctgctgccccaattttcaaatcaatcggggccgacgagacagtgcaaggacaggggtcacgccggctgatctcttttagtctgagtgatttccaggctatgggactaaaaaagggcatgttttttaatccagatccttatcttaagatatctattcaacccggcaagcactccattttccccgcgctccctcaccatgggcaggaacgtagatccaagatcattgggaacaccgttaatcctatatggcaagcggagcagttctccttcgtaagtctacccacggatgtactggagatcgaagtcaaggataagttcgccaagagccgcccaatcataaagaggttcctgggcaaattgtcaatgcccgtgcaacgcttactggaaaggcacgctatcggtgatcgggtggtgtcatatacccttggcaggaggctgccaacagaccatgtctcaggtcagctgcagttccggtttgaaataacctcatctatacatccagacgatgaagagatttcattgtccacagagcccgagagcgctcaaatccaggacagccccatgaacaatttgatggaaagcggtagcggcgagccaagaagtgaggcccccgagtcgtccgaatcctggaagcctgaacagttgggagaaggatccgtccccgatggacccgggaatcagagtatcgagctgtctagacccgctgaggaggctgccgtcatcacagaggctggagaccaaggaatggtttccgtgggacccgagggcgcaggcgagctgcttgcccaggttcagaaagatatccagcccgcaccttctgccgaggaactggctgagcagctggacctgggtgaggaagcctccgcactcctgcttgaggacggagaggctccagccagcaccaaagaggagccacttgaagaagaggccacaacacagtccagagctggacgcgaggaagaggaaaaggaacaggaggaagaaggcgacgtaagcacactggagcaaggggagggtagactccagctccgagccagtgttaagcggaagtctcgcccatgtagtctcccagtcagcgaacttgaaaccgtgatcgcttccgcctgtggggaccccgagacaccacgaacccactacatccgcatccataccctcctgcactccatgcccagcgcccagggtggatcagccgccgaggaagaggatggggcagaggaggagtcaacccttaaagacagctccgagaaggatggactgtcagaagtggataccgttgctgctgatccttctgccctggaggaggacagggaagaaccagagggagccaccccaggcaccgctcaccctggtcacagcggagggcatttccccagtttggcaaacggcgcggcccaggatggcgatacacacccgagcacagggagcgagtccgatagctcaccccgacagggaggtgaccatagttgtgagggctgtgatgcatcctgctgctctccctcgtgttatagtagctcctgctacagtacgtcgtgttattcatccagctgttattctgcctcttgttatagcccgagttgctataacggaaatagattcgcttctcataccagatttagttcagtggattctgcaaagatctcagaatcgaccgtattctctagccaggatgatgaggaagaagaaaattctgctttcgaaagcgtgcctgattctatgcagtcccccgagctagatccggagtctactaatggggcaggcccctggcaggacgagctggctgctccttccggtcacgtggagcgatctcctgaaggtctcgaatcgccggtcgcagggccctccaataggagagaggattgggaagcacggatcgactcccatggcagggtcttttatgtggaccacgtcaaccgcacaaccacatggcagagaccaacagccgccgctacacccgatgggatgagacggtcaggctcaatccagcagatggaacaattaaatagaagataccagaacatacaacgcacgattgcgaccgagcggtccgaggaggattcggggagtcagtcatgtgagcaggcaccagccgggggaggaggaggcggtggcagtgattccgaggccgagagttctcagtcttcattggatttacgcagggaagggtccctgtccccagtgaatagtcagaaaattactcttctgctgcaatcaccagccgtaaaatttatcaccaatccggaattcttcactgttctgcatgccaattactctgcttaccgagtgtttaccagctcgacctgcctcaaacatatgattctcaaagttcgcagggatgccaggaatttcgaacgctaccaacataatcgagacctggtcaacttcattaacatgttcgcggacaccaggcttgagttgccacgaggttgggaaatcaagacagaccagcaaggaaagtccttcttcgtcgaccataatagcagagctaccacctttattgaccctaggatcccacttcagaacggtcgcctgccgaatcatttgactcatcgacaacacctccaacgtctccggtcctactcagctggagaagcctccgaagtgtcacgtaacagaggggcctctctgctggcacggcccggccacagtctggtagctgccatccgttcccaacaccagcacgaatcattgcccctggcttacaatgacaagatcgtcgcgttcctacgccaaccgaacatctttgaaatgctgcaagagcggcagccctcccttgccagaaaccacactctgcgcgaaaagatccactacatccgcaccgaaggcaaccatggcttggaaaaacttagttgtgacgccgacctcgtaatcctgctgtccctgttcgaggaggagattatgagctacgtgccacttcaggctgcatttcaccccgggtactcttttagccccaggtgtagcccgtgtagcagcccccagaactcccccggtttgcagcgtgcttccgcccgggcgccaagcccctatcgcagggacttcgaggcgaaacttcgcaacttctaccgtaagttggaagcaaaaggcttcgggcaaggtcctggcaagattaaacttattatcagacgagatcatctgctggagggcacctttaaccaggtgatggcatactccagaaaggagctccagagaaacaagttgtacgtgacatttgtgggggaggagggccttgactacagcgggccctcacgggagttcttctttctcctgagccaggagctgtttaatccttactacggtctcttcgagtatagtgcaaatgatacctatacggttcagatatcaccaatgtctgccttcgtggaaaaccacctggagtggttccgcttttcaggtagaatactgggactggcgctgatccatcaatacctgcttgatgccttctttactaggccgttctacaaagcactcctacgccttccctgcgacctgtcggacctggaataccttgacgaagagttccaccagagtctccagtggatgaaggataacaatatcactgacattctggatctcacttttactgtcaatgaggaagttttcggacaggtgactgagcgtgagcttaagagcggaggcgctaacacgcaggtaacggagaagaataagaaggagtacatcgaaaggatggtgaagtggcgggtggagcgtggagtggtacagcagaccgaagccctggtaagaggcttctacgaggtagtcgatagcagactggtgtctgtgtttgacgccagggagttggagttggtgatagccggaacggctgaaatcgacttgaatgactggagaaataacaccgaatatagaggagggtaccatgacggacacttggttattcggtggttctgggcagccgtcgagcgattcaataacgaacagaggcttcgactgctgcaattcgtcaccggtacctcctcagttccatatgaaggcttcgctgccctgagaggctccaacggtctgcggagattctgcatagaaaaatgggggaaaatcacttctctgcctagggcgcatacttgtttcaacagactagacctgcccccatatccaagctactctatgttgtacgagaagctgctcacagcagtggaagaaacatctacctttggtcttgagtag

SEQ ID NO: 17141 - DNA, 1629 bp, Artificial Sequence
  Description of Artificial Sequence: Synthetic coding sequence
atgagtgggttggtgctgggacagagagacgagcccgctgggcaccgcctctctcaagaagagatactgggcagtaccaggctcgtgtctcagggcctcgaggcactgcgctctgagcaccaagccgtgctccagtccctgtcacagaccatagaatgcctgcagcaaggggggcatgaagagggccttgtccacgagaaggcaaggcagctaagacgaagtatggagaacatagagctcggattgtctgaagcccaggaagagaaggaaggtgacgcaaccaaagatagcctcgacgatttgtttcccaacgaggaggaggaagatccttccaatggtctgagccggggccaaggagcaacagcggcccagcagggtggctatgagatccccgcccggttgcgcaccctgcacaatctggtgatacagtatgccgcacagggtcggtacgaagttgccgtccctctatgtaagcaggccctggaggatctggagcggacgtctggtagaggacatcctgacgtggcgacaatgttgaacatcctggctcttgtgtatagagaccagaacaaatataaggaggcggcacacctgcttaacgatgcattaagcataagggaaagtaccttaggacccgatcaccccgctgtggctgctacactgaacaatttagccgttctttacggaaaaagaggtaagtacaaggaagcggaaccactatgccagcgagcactggagattagggaaaaagtacttggaaccaaccacccagatgtagcgaaacagctgaacaacctagctctgttgtgccagaaccagggaaaatatgaggcggttgagaggtactaccagagggcgctcgccatctatgaaggacagctgggtcccgataacccaaacgtcgctagaacgaaaaacaaccttgcctcttgttacctaaaacagggcaagtacgccgaggccgagacactgtacaaggaaattctgacaagggcccacgtccaggagtttggtagtgtggacgacgaccacaagcctatttggatgcatgccgaggagcgtgaagagatgagcaagagcagacaccacgaaggcggcactccatatgccgaatacggagggtggtataaagcctgcaaggtgtcatctcccactgtaaacaccactcttcgcaatctgggagcactgtacagaagacaagggaagttagaagctgcagaaacccttgaggagtgcgctctgaggtcgcgacggcaaggaactgacccgattagccagaccaaggtcgctgagttactcggggagtccgatgggcgtcgcacctcccaggagggcccaggtgattccgttaaatttgaaggcggggaagatgcctcagtagcagtggagtggagcggggacggctctgggaccctgcagaggtctgggagcctgggcaaaattagagatgtcttaaggagaagctccgagctgctcgtacgtaagctgcagggcactgagccccgacctagttcctccaacatgaagcgagcagctagcctcaattacctgaaccagccgagcgctgctccgctgcaagtatcccgcggcttgagtgcctcgacgatggacctgtcctcttcgagttag

SEQ ID NO: 17142 - DNA, 1548 bp, Artificial Sequence
  Description of Artificial Sequence: Synthetic coding sequence
atgtgccaggtgggtgaagactatggtgaacccgccccagaggaaccccctcctgccccccggcctagtagggaacagaaatgcgtgaagtgtaaggaggctcagcccgtggtggtcatcagagcgggagatgccttttgtagagactgttttaaggctttctacgtacacaagttcagggctatgcttggcaagaaccgactgatcttccccggagagaaagttctcctggcttggagtggcggcccgtcctcctcctcaatggtatggcaggtactggaggggctgtcacaggattcagctaaacggctgaggttcgtggctggggttatattcgtcgatgagggagcggcatgtggacaaagccttgaagagcggtccaagacactggctgaggtaaaacccattttacaggccacaggctttccatggcacgtagtggccttggaggaagtgttcagcctcccgccatccgtgctctggtgctccgctcaggaattagttgggtcagaaggcgcatataaagccgcggtggattcgttccttcagcagcagcacgtactcggtgccgggggaggcccgggccctacacagggggaggagcagccgccccagcctccactcgacccacagaatctggctcggcctcctgcccctgctcagactgaggctcttagccaactgttttgctctgtccggacactgacagccaaagaggagcttcttcaaaccctccggactcatctcattttgcatatggcgcgcgctcatggctattctaaagtgatgacgggtgatagctgtacacgcttggctatcaaacttatgactaatctggccctcggcaggggggcattcttagcttgggacacaggattctcagacgagcggcacggcgacgtcgttgttgtgcggcctatgagagaccacaccttaaaggaggtggccttctacaaccgcttgtttagtgtgccatcagtcttcacaccagcagtcgataccaaagcccccgagaaggctagcatccacagactcatggaagccttcatcctccgcctccagactcagttccccagtacagtttctactgtttaccgaacatctgaaaagctggtgaaggggccccgcgatgggcccgccgccggagacagcggaccccgctgtctactgtgcatgtgtgccctggacgtggacgcagcagattctgctactgctttcggtgcgcagacctcctcccgactgtctcaaatgcaatcacctatcccactgactgagacccgaacaccaccagggccatgctgttctcccggagtggggtgggcccagcggtgcggtcagggcgcctgtaggcgcgaggatccccaggcctgcattgaggaacaactgtgttactcttgccgcgtcaacatgaaagatctccctagtctcgatccacttcctccttacatcctggcagaggctcagctgaggacacaacgcgcctggggattacaagagattcgggattgtctcatcgaagatagtgacgacgaggccggccagtcctag

SEQ ID NO: 17143 - DNA, 1263 bp, Artificial Sequence
  Description of Artificial Sequence: Synthetic coding sequence
atgtttaaaaggaccgtgctgtcctgccctccccccgccgctccgcccctccaagccaggggagccttcaggagcttccctcacagctggggcgaggattttctggcttccctgatgttcaagattcagctggagcccctcaagctgagagcatggacgctaaacgggttcgtgaaattcagaaacaaggagaccagtgcggggccagtcgcagttatgggaaaagactattacaagatcctgggcatcccttccggtgcgaacgaagatgagattaagaaagcctaccggaagatggcacttaagtaccaccccgataagaacaaagaacccaacgccgaagagaagtttaaggaaattgccgaggcatacgatgtcctatcggatcctaaaaaacgcggcctgtacgatcaatatggagaggaaggactcaaaactggcgggggaacaagcggcggcagtagtggatccttccactatacctttcatggggatcctcacgccactttcgcatcattcttcggcggcagtaacccattcgacatcttttttgccagctctcgttccacaaggcccttttccgggttcgaccccgacgacatggacgttgacgaagatgaagatcctttcggcgcatttggacgattcggatttaacggactttctagagggcccagaagagccccagagccactgtacccacgccgaaaggttcaagaccctcctgtggtccatgagttgagggtcagccttgaagagatttaccatggctcaaccaagcggatgaagataaccaggagacggctgaaccccgatggcaggaccgtaaggaccgaggacaagatcttacatattgtgatcaaacgaggctggaaggaaggcactaaaattacattccccaaggagggcgacgccacacccgacaatatccccgcagatatcgtgttcgttctgaaggacaaaccacacgctcactttcgccgcgatggaaccaatgtgttgtactctgctctcatttcactgaaggaggccctctgtgggtgtactgtcaatattccgactattgacggaagagtgatccctctcccatgcaatgacgtgatcaaacccgggacggttaagcggctgcgaggcgagggcctccccttccccaaagtgccgacccagcggggcgatctgattgttgagttcaaagtccggttcccagaccgtttgaccccacaaacgaggcagattctgaagcagcacctcccatgttcctag

SEQ ID NO: 17144 - DNA, 2979 bp, Artificial Sequence
  Description of Artificial Sequence: Synthetic coding sequence
atgtatggatcagcccgatctgtcggcaaggtggaacccagtagtcagtcccccggcagatctcctcgactccctagatcaccccgactcggccaccgccggacaaatagtacagggggctcctcgggaagctccgtgggcggagggagtggcaaaaccctctctatggagaacatccagagcctgaacgcagcatacgcaacttcgggccctatgtacctctctgaccacgagaacgtgggttcggaaaccccaaagtcaactatgacactgggtcggtcgggagggagacttccttatggggtgaggatgaccgctatgggaagcagtccgaacattgccagttcaggtgtggcctctgacacaattgccttcggggagcaccacctgcccccagtttcaatggcttcgacagtcccccattcgctgaggcaggcacgggacaacacaataatggatctgcagacacagctcaaagaggtactccgtgaaaacgatctcctcagaaaggacgttgaggtgaaagagtctaagctgagctctagcatgaacagtattaaaactttttggagtccggaactcaaaaaagaacgcgcactacggaaagacgaagcctctaaaatcacaatttggaaagagcagtatcgcgtcgtacaggaggagaatcagcatatgcagatgacgattcaggccctgcaagatgaactgcgcatccagagggatctgaaccagctatttcagcaggattcctcaagccgaacaggagagccttgcgtcgctgagctgactgaggagaactttcagcgattgcacgcggaacacgaaagacaggcaaaggagttgttccttttacggaaaactctcgaggagatggagctgcgcattgaaacacaaaaacagacactcaatgcccgagacgaatctatcaagaaattactcgagatgttgcagtccaaggggctctccgccaaggccaccgaagaggatcacgagcgcacaagacgacttgcagaagccgagatgcacgttcaccacctggagagcctgctggagcagaaagagaaggagaactcgatgctgcgagaggagatgcatcgccggtttgagaatgcacctgattcggccaaaacgaaagcactgcaaaccgtcatagaaatgaaagactcaaagatctcaagtatggaacggggcctgcgggatttggaagaggaaattcagatgttaaaaagcaacggcgcgctctccactgaggaacgcgaggaagaaatgaagcaaatggaggtgtaccgttctcattccaagtttatgaaaaacaaaattggccaggtgaaacaggagctgtccaggaaggacacggagcttctcgcactacagacgaagctggagactttaacaaatcagttcagcgactcaaagcagcatattgaggtgctcaaagagtcattgactgccaaggagcaacgcgccgcgatcctacagactgaggtagatgccctaagactgaggttagaagagaaagagacaatgttgaataagaagacaaagcagatacaggatatggctgaggaaaagggaacccaggcaggtgaaattcacgacttaaaagacatgctagatgtaaaggaaagaaaggttaacgtgctgcagaagaagattgagaacttacaggagcagcttcgtgacaaagagaagcagatgagctcccttaaagaacgcgtgaaatccttacaagccgacactaccaacactgatactgcgctcactaccctggaagaagctcttgccgagaaagagagaactatcgagagacttaaagagcagcgggatagagatgagcgcgagaaacaggaagagattgacaactacaagaaggacttgaaggatctcaaggagaaggtgtctctgctgcagggggaccttagcgaaaaggaggcctcccttcttgacctaaaggaacatgcctcgagtctagcgtctagtggcctgaagaaggattcaagacttaagaccctagagatcgctcttgagcagaaaaaggaggaatgtctgaaaatggaatcacagctgaaaaaggcccatgaggcggctctagaggcacgggctagtcctgagatgtctgatcgaatccagcacctggaacgcgagattacccgctataaggatgagtcatctaaagcccaggctgaggtcgacaggctattagaaattctcaaggaagtagaaaatgagaagaatgataaagacaagaaaatcgccgaactagaaagcctgttttctagacaggtgaaggatcagaataagaaggtggctaacctgaaacacaaagaacaagtcgaaaagaagaagagcgcccagatgttagaagaagcccgcaggagggaggataatctgaatgacagtagtcaacagctccaggactctctgcgcaaaaaggacgatcgcatcgaggaacttgaagaggctctgagggagtcagttcagataaccgcagagcgagaaatggtacttgcgcaggaggagtcagcacgcaccaacgctgaaaaacaagtcgaagagctgttgatggcaatggaaaaagtgaagcaggagctggagtcaatgaaggccaagctttcgagcacccaacagagtctggccgagaaggaaactcatcttactaacctgcgtgccgaaagaaggaaacaccttgaggaagtcttagagatgaaacaagaggcattacttgctgccatcagtgagaaagacgctaacatagcactactcgagctgtcctccagcaagaaaaagacccaggaagaagtggcagctctgaagagggagaaagaccggctagtgcagcagctgaaacagcagacccaaaatcgcatgaaactgatggcagataattatgaggacgaccattttaagtccagccatagtaaccaaacaaatcacaagccatccccagatcaagatgaagaagaggggatctgggcatag

SEQ ID NO: 17145 - DNA, 180 bp, Artificial Sequence
  Description of Artificial Sequence: Synthetic coding sequence
atggagccgagcgctcagcagctgcagttagctgcttccttgcccgctaacctaagcaacttctgccagggaagtgagatgcccacaaccagtcgaccagctcttgatgttaagggaggtacctccccagcaaaggaagatgctaatcaggagatgtcatccgtagcttacagcaactag

SEQ ID NO: 17146 - DNA, 6978 bp, Artificial Sequence
  Description of Artificial Sequence: Synthetic coding sequence
atgaagaagggctcgcagcagaagatcttctccaaagcgaagattcccagctccagtcatagccccatcccttcaagtatgtcaaacatgaggagtaggagtctgagccctctgataggcagtgagacgcttcccttccattccggagggcagtggtgtgaacaagtcgagatcgccgatgagaataatatgctgctggattaccaggatcataaaggcgcggactctcatgcaggcgttaggtatattaccgaggcactgattaagaaactcaccaaacaggacaatctagcccttataaaatcgttgaacctttctctcagcaaagacggcggaaagaaatttaaatacatcgagaatcttgagaagtgcgtgaaactggaggttctaaacctgagttacaaccttattggcaaaatagagaagcttgataagctgttgaaacttcgtgaattaaatctttcctacaataaaatatccaaaatcgaaggcatcgagaatatgtgtaatctgcagaaactcaacctggccggcaacgaaattgaacatatacccgtctggctgggcaagaaactgaaatccttacgagtgcttaatctgaaaggcaataaaatctcatccctgcaggatataagcaagctgaaacccctgcaggatctcataagcctcatcttagtggaaaatccagtggtcactctgccccactacctgcagttcaccatattccatctacgaagtttagaaagtctcgaaggccagccagtaactacacaggatcgccaggaagcgtttgagcgcttcagtctcgaggaagttgaacggctcgagcgcgatctggagaaaaagatgattgaaactgaagaactgaaaagtaaacagacccgtttcctcgaggaaattaaaaatcaggacaagctcaacaagtctctgaaggaagaagcaatgctgcagaaacagtcctgtgaggagttgaaatctgacctgaacacaaaaaacgagttactgaaacagaagaccatcgaactaacacgggcctgtcaaaaacaatacgaattggagcaagagctggccttttataagatcgatgccaagttcgagcccttgaactattaccccagtgagtatgctgaaatcgataaggcacccgacgaaagtccatacatcggcaagtctcgctacaagagaaatatgtttgctaccgaaagttacattatcgactctgcccaggccgtgcagatcaaaaaaatggagcctgacgaacagctccgaaatgaccacatgaaccttagggggcataccccccttgatacccagttggaagataaggagaagaaaattagcgcagcccagacaagactctcagaacttcacgacgaaatcgagaaagccgaacagcagatcctccgcgcgaccgaggagttcaaacagctggaggaggccatccaactcaagaagatcagtgaggcaggaaaggacctgctctataaacagctatcagggaggctccagctggtgaataagttgcggcaggaagccttagatctggagctgcaaatggaaaaacagaagcaggagatcgccggtaagcagaaagaaattaaggatttacagattgcaatcgactcattggactccaaggatccaaagcatagccacatgaaagctcaaaagagcggcaaggaacaacaattggatattatgaataaacagtatcaacagttggagtccagactcgatgagatcctcagtagaatcgctaaagagaccgaagaaatcaaagacttagaagaacaattgactgagggacagatagccgctaatgaagccctgaagaaagatttggagggggtgatttctggtttacaggaatacctcggtacgatcaagggtcaggcaactcaggcccagaatgagtgccgaaaactacgggacgagaaggagacgctcctgcagcgccttaccgaggtggaacaagagcgcgaccagctcgaaatcgtggcaatggacgcggaaaacatgcgaaaagaactcgcggagctagagtcggctcttcaggaacagcacgaggttaatgccagcctgcaacagacacagggagacttatcagcctatgaagctgagcttgaggcacgactgaacctcagggacgccgaggcaaatcagctgaaggaggagctggaaaaggtcacgaggctgacacagctggagcaatctgccctccaggctgagctcgaaaaggagcgtcaggctctgaagaacgccctgggcaaagcgcaattctcagaggaaaaagaacaagaaaactcagaacttcacgctaagctgaaacacttgcaagatgacaataacctactgaaacaacaactgaaggacttccagaaccatctgaatcacgtcgtggacggcctggtgaggcccgaggaggtcgcagccagggtggatgaattacgtcggaagcttaagttgggcaccggagagatgaatatacatagtcccagcgatgtcctcggcaagtcccttgcggatctgcagaagcagttctccgagatcctagccaggtcaaagtgggaacgagacgaagcacaggtacgcgagcggaagctgcaagaggagatggccctgcagcaggaaaaactggcaacaggccaggaggaatttcgtcaggcctgcgagagggcgttggaagccaggatgaactttgacaaacgccaacacgaagctaggattcaacaaatggagaatgaaatccactacctgcaggagaacctcaaatctatggaagagatacaaggtttaacagacctgcaactgcaggaggctgacgaggagaaggagcgcatcctagctcagctccgcgaattggagaaaaagaagaaactggaagacgcaaagtcacaggagcaggtattcggcctggataaggaactgaaaaagttgaaaaaagcagttgcaaccagcgacaaactcgccaccgcggagctcacaattgccaaggatcagctgaaatctctccacgggacagtgatgaagatcaaccaagaaagggccgaagagctccaagaagccgaaaggtttagccggaaagctgctcaggctgcacgggatctgactcgggccgaggcagaaatagagttgctgcagaacctgctgagacagaaaggagagcagtttaggctggaaatggagaagacgggcgtggggaccggcgcaaattctcaggttttggaaatcgagaaactcaacgagactatggaaaggcagaggactgagattgctagattacaaaacgtcttggatcttacaggttccgacaacaagggcggattcgagaatgtattggaagaaatagccgagctgcgccgggaggtgtcttaccagaacgattatatctcctctatggcagatcccttcaagaggcgaggttactggtattttatgccaccccccccctcctcaaaggttagctcacactccagccaggctacaaaggactctggggtcggcttaaaatacagtgccagcaccccagttcggaaacccaggcccggccagcaggacgggaaggagggaagtcagccaccacctgcctcgggttattgggtttactccccaatcaggagtggactccataagcttttccctagtcgcgacgccgattctggaggcgattctcaggaagaatccgagctcgacgaccaggaagagcccccgttcgtgccaccccctggctacatgatgtatactgttcttcccgatggctcacctgtgccacagggtatggctctgtacgcccctcctcccccactccctaataacagccggccattgacacctggtaccgttgtatatgggccaccgccagcaggagctcccatggtgtacggacctccacctcctaacttttccattcccttcattcccatgggcgtgctccattgcaatgtgcctgagcaccataacttagaaaatgaggtaagtagactcgaggatatcatgcagcatctgaaatcgaagaagcgcgaggaacgctggatgcgagcttccaagcggcaaagcgaaaaggagatggaggagctccaccacaatatcgatgacctactccaggaaaagaagagcctggaatgcgaggtggaggagctccacagaactgttcagaagagacagcagcaaaaagatttcatcgatggtaacgttgagagcctgatgacggagttggagatagagaagtccctcaaacaccatgaggacattgtggacgagattgagtgtatcgaaaagactctactaaagcggcgatctgaacttcgagaggccgaccgcctacttgctgaggcagagagcgagttgtcatgcaccaaggaaaagacgaagaacgctgttgaaaaatttaccgacgccaagaggtctctgctgcagacggaaagcgacgccgaggagctcgagcgtcgagcgcaggagacggccgtgaacctggtgaaggccgatcaacagctcagatccctccaggctgacgcaaaagacctggagcagcacaagatcaagcaggaagagatcctcaaagaaattaacaaaattgtggctgctaaggattccgacttccagtgcctgtcgaagaaaaaggagaagctcacagaagagctccaaaagctccagaaagatattgaaatggcagaaaggaacgaagaccatcacctgcaagtattgaaagagtctgaagtccttttacaggctaaacgcgccgagttggagaagttgaaatcccaagtcacttcgcagcagcaggagatggccgtgctggaccgacaactcggacacaagaaagaggagctccacctcctccagggatccatggtccaggccaaggccgatctgcaggaagccttgaggttgggtgaaacagaagtgacagaaaagtgcaaccatatcagagaggttaagtcccttcttgaagagctctcatttcagaagggcgaattgaatgtgcagatctcagagaggaagacgcagctaaccctcatcaagcaagagattgaaaaggaggaggaaaatctacaggtggtattaagacagatgtctaaacataagaccgagctgaagaacatactggacatgctgcagctcgagaaccacgagttgcagggccttaagctccaacatgatcaaagggttagcgaactcgaaaaaacccaggtggctgttttggaggagaaactggaattggagaacttgcagcagatctcccagcagcagaaaggagagattgagtggcagaaacaactgctcgaacgggacaaacgcgaaatcgagcgcatgacagccgagagtagggcactgcagagctgtgtggagtgcttgagcaaagaaaaagaagacctacaagagaagtgtgacatatgggaaaagaagctggcccagaccaagagggtcctcgcagccgctgaggagaactccaagatggaacagagcaacttggaaaagctggagctcaatgtgcggaaactccaacaagaactggaccaactgaaccgagacaaactgtcactccacaacgacatttccgcaatgcaacagcagttgcaggagaagcgggaggccgtcaacagcctacaggaggaactggcaaacgtgcaggatcacctgaatctagcaaagcaggatctgcttcacacaactaaacatcaggatgtccttctctctgaacagacgcgcctgcagaaagatataagtgagtgggccaaccgattcgaggattgtcagaaggaggaagaaacaaagcagcagcaacttcaggtgctacagaatgaaattgaggagaacaagctgaagctggtgcagcaggaaatgatgttccagaggctccaaaaggaacgcgagagcgaggagtctaagttggaaactagcaaggtgacgttgaaggaacagcaacaccaactcgaaaaggaactaaccgaccagaaatctaaactggaccaggtactctccaaggtactcgccgcagaggagcgcgtccgcactctccaggaggaagagcggtggtgtgaatccctggagaaaaccttgagccagactaagcggcaactttccgagcgggagcagcaacttgtggaaaaatctggcgaactgctcgctctgcagaaagaagccgactcaatgcgggcggatttcagcctcctgcgcaatcaatttctgacagagcggaagaaagctgagaagcaagtggctagcctgaaagaggctcttaaaatacagaggagccaactggaaaagaatctgctggagcaaaaacaggaaaattcctgtattcaaaaagaaatggcgacgattgaactggtcgcgcaggataaccacgaacgggcacggcgactaatgaaggagcttaatcagatgcagtatgagtacaccgaacttaaaaagcaaatggcaaaccagaaggatctggagcggcggcagatggagatcagcgacgccatgcggacgctcaaaagcgaggtgaaggacgaaatcaggaccagtttgaaaaaccttaaccaatttctgcctgagttgccagccgacctagaggcaattctggagaggaatgaaaatctggaaggtgagctggaatcacttaaggagaatctccctttcaccatgaatgaggggccattcgaggagaagctcaattttagccaggttcacatcatggatgaacattggcgtggagaagctctaagagagaaactgagacacagggaggacagattaaaagcccagttgcggcactgtatgagcaagcaagcagaggtgttgatcaagggtaagagacagaccgaaggaacattgcactccctacgtcgccaggttgacgctctaggagagctggtaaccagcacctcggctgattcagccagctcaccttccctgtcccagcttgagtcttctctgactgaagacagtcagttaggtcagaatcagaagcagaataattctctgagatag

SEQ ID NO: 17147 - DNA, 657 bp, Artificial Sequence
  Description of Artificial Sequence: Synthetic coding sequence
atggacgaactcgtgactcttgaagaagctgatggaggaagcgacatcctgcttgtggtccctaaggctactgtgttgcagaaccaactggacgaaagtcagcaggaacgtaatgacctgatgcagcttaaactccaactggaggggcaggtgactgaactccgctcccgcgtccaggagctcgagcgggccttggccactgcccgccaagagcataccgaactcatggagcagtataaaggtatctctagaagccacggggagatcactgaggaacgggacatcctaagccggcagcaaggagatcacgttgcccggatactcgaactcgaggatgacattcagaccatctcagaaaaggtcctcaccaaggaagttgaattggacagactccgtgacacagtgaaagcccttactagggagcaggaaaaattgctggggcagctaaaggaagtccaggccgacaaggagcaatcggaagccgaacttcaggtcgctcaacaagagaaccatcacctcaatttggatctcaaggaggccaagtcttggcaggaggagcagtcagcgcaagcccagcggttaaaggacaaggttgcacagatgaaggataccctgggccaggctcagcagcgggtgaggccgagctggtctccttag

SEQ ID NO: 17148 - DNA, 693 bp, Artificial Sequence
  Description of Artificial Sequence: Synthetic coding sequence
atgaaaaagccaagacccgcagctgcggcgcccagtcccaggcctccagcctgcagccggggtgctcacccggggacagcttccgagttgagggtccccgctctccggagaggcggctgcggggatcgtcggcttagagaggaagccgctcccgagcaagccgctgctgggcctaggcgatctacagttggggctctgctggcatccgaactcggctggaagttttacgatgccgacgattatcatccagaggaaaatagaaggaaaatggggaaaggcatcccactgaatgatcaggatcgcatcccctggctgtgtaatctccacgatatccttctgagagacgtggccagtggacagagagtggttctggcatgtagcgcactgaagaaaacttaccgcgacattttgacccagggcaaggatggcgtggcattgaaatgtgaagaatctggcaaagaagccaaacaggcagagatgcagttactggtcgtccacttgagtggctcatttgaggttatctcgggacgactgctcaagagggagggtcactttatgccccccgaactcctccagtcccaatttgaaaccctggagccacctgcggcaccggaaaactttatccagatttcagtagataaaaatgtaagcgagataattgctactatcatggaaacgctgaaaatgaagtag

SEQ ID NO: 17149 - DNA, 957 bp, Artificial Sequence
  Description of Artificial Sequence: Synthetic coding sequence
atgtgtaggacggccttaggcgtaaccactttgcaggaccttggggtgtgttggaggaaggagcatgatccggccgagatgctacgtgtaggacgggccgagctgggcggctggaaaccttcctgggaggctattgtgaaggaggttgccgcggcaaccggccataccgttgtgctggtcgatcagaccgaagacatcctggccaagagcaagaaaggcattgaagaatctcttcgcaaagtggcaaaaaagaaatttgcagaaaacctaaaggcaggagacgagtttgtcgagaagactctgagcactattgcaacttcaactgacgccgcaagcgtcgtgcattctaccgacctagtggttgaggccattgttgagaatttgaaggtcaaaaatgagctgtttaaaagactggataaatttgccgctgagcataccatctttgcaagcaacacctcttcgcttcaaatcaccagcattgctaacgcaaccacccggcaggacagattcgctgggctgcacttctttaacccggtcccagttatgaaacttgtagaagtcatcaaaacacctatgacctcgcagaagactttcgagtctctggtcgatttctctaaagcccttgggaaacaccccgtctcatgtaaggatacccccggcttcattgttaaccggctgcttgtcccctacctgatggaggcaataagactctatgaacgcggagacgcatcaaaggaagatatagacacagccatgaagttgggggccggctatccaatggggccattcgaacttctggactacgtcggcctggacactacaaaattcatcgtggacggatggcacgaaatggacgcagaaaaccccctgcaccagccgtcgcctagcctaaacaagctggtggcagagaacaaattcgggaagaagaccggcgaagggttctataagtacaaatag

SEQ ID NO: 17150 - DNA, 666 bp, Artificial Sequence
  Description of Artificial Sequence: Synthetic coding sequence
atggccatagtccagactttgcctgtgcctctcgaacctgcgccagaggccgcaaccgctccccaggcgcccgtaatgggcagtgtctcctcactcatttcaggccgcccttgccctggaggacccgccccccctaggcatcacggccccccaggacccacgttttttcgccagcaggatggcctgttgcgaggaggatatgaagctcaagagcctctctgtcccgccgtgcccccccggaaagccgtgcccgtgactagcttcacctacatcaacgaggacttcagaaccgagtcaccccccagcccaagttctgatgtggaagacgccagggagcaaagggctcacaatgcccatctgcgggggccacctcctaagttgattcccgtatccgggaaactggaaaagaacatggagaaaatccttattagacccaccgcatttaaaccagtgctgcccaagcccaggggggctccttctctaccttccttcatggggcctagagccactggtctctcaggcagccaaggatcgctaacccagctgtttggcgggcccgccagcagttcaagctcaagctcttccagtagcgctgccgataaaccgctggcatttagcggctgggcctccggatgtccatccggtacactgagtgattctggttag

SEQ ID NO: 17151 - DNA, 585 bp, Artificial Sequence
  Description of Artificial Sequence: Synthetic coding sequence
atgagagagctggccgctgtggttagccgggatatataccttcataaccctaacatcaagtggaacgacattatcgggctcgacgccgcgaagcaactggtgaaggaggcagtggtgtatcccattaggtacccacagctgttcaccggaatcctttctccttggaaggggctcttgctttatgggcccccaggtaccgggaaaacacttctcgccaaagcggtggcgactgagtgcaagactactttttttaatatatctgcctcaacaatcgttagcaagtggcgcggcgacagcgagaagctggtgcgagtcttgtttgagctggcaaggtatcacgcccctagtacaattttcctggatgagctggaaagcgtgatgagtcagcggggaaccgcaagtggcggcgaacacgaaggaagtctgcgaatgaaaaccgagctgctggttcaaatggacgggcttgcacggtccgaggatctggttttcgtgctggcggcatctaacctcccctgtctgaaggctatcgcactgcagccgggggatagagcaaggttgaggttgaaaaagaaaaagtgtacatag

SEQ ID NO: 17152 - DNA, 555 bp, Artificial Sequence
  Description of Artificial Sequence: Synthetic coding sequence
atgaccttccagtttaattttacaattgaggaccatcttgagaacgaattaacacctattcgggatggggctctgaccctcgattcttccaaagagctctctgtgagtgaatcacagaaaggggaggaacgcgatcggaaatgcagcgccgagcagttcgacctgcctcaagaccacctgtgggagcataagtccatggagaacgcagcccccagccaggacaccgattctcccctgtccgcagcttctagcagccgcaacttggaaccccacggcaagcagccttctctccgcgctgcaaaggaacacgccatgcccaaagacttgaagaaaatgttggagaacaaggtaatcgagaccttgccaggatttcaacatgtgaagctgtcagtggtcaagaccatcttgctgaaagagaattttcctggggaaaacatcgtgagcaaaagctttagctcccattcagacctcatcactggcgtgtacgaaggaggccttaaaatctgggagtgtacctttgatttgctggcctattttacaaaagccaaggtctag

SEQ ID NO: 17153 - DNA, 354 bp, Artificial Sequence
  Description of Artificial Sequence: Synthetic coding sequence
atggtgctgattctgggccgaaggctgaacagagaggatctgggcgtaagggactctcccgctacaaaacgcaaggtgttcgaaatggacccgaagtctctgaccggacatgaatttttcgatttctccagcgggtccagccatgcagagaatatactgcagattttcaacgagtttcgcgatagccggttgtttactgacgtgataatctgcgttgaaggcaaagagtttccgtgtcatagggctgtcttatccgcgtgttcatcatattttcgcgccatgttttgcaacgaccatcgtgagagtagggagatgctggtggagatcaacggcatcctggccgaagctatgtag

SEQ ID NO: 17154 - DNA, 498 bp, Artificial Sequence
  Description of Artificial Sequence: Synthetic coding sequence
atgattttgaatgtgctcgaatacggctcacagcaggtagcagacctgaccttgaatctcgacgattacatagatgcggaacatcttggcgattttcacaggacatataagaattctgaagaactgcgaagccggattgtctccggcattatcactcctatccacgagcaatgggagaaggccaatgtatcaagtccccatagagagtttcctccggccaccgcgcgagaggttgatccactccgcatcccaccgcaccacccccacacgagtcgccagccgccttggccacgacgcggcggcatgatcgtagatccactgaggagcggctttcctcgcgccctcatcgacccttctagcggcctgccaaacaggctcccccctggggcagtgccacccggcgcacggtttgatccattcggccctatcggtacatctcctccaggtcctaaccctgaccatctgccacctcccggttatgatgatatgtatctgtag

SEQ ID NO: 17155 - DNA, 369 bp, Artificial Sequence
  Description of Artificial Sequence: Synthetic coding sequence
gccctgacgttctccctgcgcgcaggtgcagcatccgcgcaagacggacggtgcccatgcggcgctaggcggcccgactcacgccttctgcagcttcacataacaatgcctttctctagtcccatggaggcagaactggttcgaaggatactctctagagacgccgccccactgccaagaccaggcgccgttctcaaggactttactgtgagcggcaacttgctgttcatccggttaactgccgcagatcaccggcaactccagctgtccatttcttcctgtcttcagcagctgagcctgctaatgtggattactcagtgtttcctgccagtgtttctggcccaggcccctagcgggcagcggaggtag

SEQ ID NO: 17156 - DNA, 2415 bp, Artificial Sequence
  Description of Artificial Sequence: Synthetic coding sequence
atgaaaagtatcggtgtcaagaccgtgaaagtgtgtggcagcaagagctctgtgaggattgagggtcagccttgcagtctggggcaaagtcggcgcaaagtgaagctgatgggcgaaaggagttataccctctcaattggaaacggcgattacttttgggccaacaaggagatgctgtgggactacgtgcagacactgtcagatcaaggagctgaaaaacatgagggaaccgggcaatcctccggtatcactgatcaagagaaagagttgtccaccaatgcattccaagccttcaccagtgggaattacgacgcctgcctccagcacctggcttgcctacaggacataaataaagatgactacaaaattatattgaacactgccgtagccgagtttttcaaaagcaaccagaccactaccgataacctgcggcagactcttaatcaactgaagaaccaagtacactctgcagtggaggaaatggacgggttagatgacgtggagaactccatgttgtactacaaccaggccgtcattctctatcacctgagacagtatacagaggctatttcagtcggggagaaactctaccagtttatcgagccatttgaagagaagttcgcccaggccgtatgctttctgctcgttgatctctacatcctcacttatcaggcagaaaaggcactccatctcctagccgtactcgagaagatgatctcgcaagggaacaacaacaaaaacggcaagaacgaaacgggtaataataataacaaagatgggtcaaaccacaaggccgagtccggagcactgattgaggccgctaagagcaagatccatcagtacaaggtgagggcgtatatccagatgaagagtctcaaagcctgtaagcgggagataaaatctgtgatgaacaccgccgggaactccgcaccaagtttgttccttaagtctaatttcgagtatcttcgtggaaactatcggaaagctgttaaacttctgaactcatcaaacatcgcagagcatcccggctttatgaaaacaggcgaatgcctaaggtgcatgttttggaacaacctgggctgcatacactttgctatgagtaagcacaatctgggcatcttttatttcaaaaaggctctacaagagaatgacaatgtttgtgctcagctgtccgcaggaagcactgaccctggaaaaaaatttagcggccgtcccatgtgcacgctgttaactaacaaaaggtatgagttattgtataactgcggcatccagctgttgcacattggaagacccctggcagccttcgaatgtctgatcgaggccgtgcaggtgtatcatgccaacccccgcctctggctgagacttgcagaatgttgcatcgccgctaacaagggcacatccgaacaggagactaaaggtcttccatccaagaaggggatcgttcaaagcattgtgggacagggctaccaccggaagattgtgttggcaagccagtccattcagaacaccgtgtataatgacggccagagttccgcaatacctgtggcttctatggagtttgcagctatctgcctgaggaacgcgttactactcctgccggaggaacagcaggacccaaaacaggagaatggtgccaaaaatagcaatcaacttggcggcaacaccgagtcttctgagtctagcgaaacatgttcatccaagagccatgatggcgataaatttatccccgctccaccttcttcaccactacggaaacaggagctcgaaaacctcaagtgctccatcttagcctgctccgcctatgtcgctctggctttgggtgataatcttatggccctgaatcatgcggataagctcctgcagcaacccaagctgtccggaagtctcaagttcctcggacacttatacgccgccgaggcgttaatcagcctggaccggattagcgacgccatcacccaccttaacccagagaacgtcactgatgtgtcactcggcatatcatcaaatgagcaagatcaagggtcggacaagggggagaatgaagcgatggagagttccggaaagcgggctccacagtgttacccatcctcggtcaactctgcccgcacagtgatgcttttcaacttaggctccgcatactgcctgcggtcggagtatgacaaggcgagaaaatgtctgcaccaggctgcatcaatgatccaccctaaggaagttccgccagaggcaatcctgcttgctgtgtatctcgaacttcagaacggcaatacccagcttgctttgcagatcatcaaaagaaaccagctcctgcccgcagttaaaactcatagtgaagtccgtaaaaaacccgttttccagcccgtgcaccccatccagcctatccaaatgccagcattcacaacagtacagcgcaagtag

SEQ ID NO: 17157 - DNA, 1899 bp, Artificial Sequence
  Description of Artificial Sequence: Synthetic coding sequence
atggatactatgatgctcaacgtgcgtaacctgttcgagcagctggtgcgtcgggtggagattctgtccgaagggaatgaagttcagtttattcagttagctaaagatttcgaggacttccggaagaagtggcagagaaccgatcatgagctgggcaagtataaggatctgctgatgaaagcagaaaccgagaggtcggccttagacgtcaaactgaaacacgcaagaaaccaagtggatgtggagataaaacgccgccagagggctgaagcggactgtgagaagcttgagagacagattcagctgatcagggaaatgctgatgtgcgatacatccggatccattcagctgtctgaggagcagaagtctgccctggctttcttaaacaggggacaaccaagctcaagtaacgccgggaataagagactaagcaccattgacgaaagtggttcaatcctgtcagacattagcttcgataaaaccgacgaatcactggactgggattcgagtctggtgaagactttcaagcttaagaagagggaaaagcggagatcaacaagccgccagttcgtggacggccctcctgggcctgtgaaaaagacaaggtcgatcggctccgcggtggaccagggtaatgaatccattgtagccaagacaaccgtaaccgtgccgaacgatgggggacccatcgaagccgtgtccactattgaaaccgtgccctattggaccaggtcccgacgcaagactgggacgctgcagccctggaattctgattcaaccctgaattctcgacagcttgagccaaggactgagacagattctgtcgggaccccacagtccaatggaggaatgcgtctgcatgactttgtgtcaaaaacagttatcaaaccagaaagttgcgtgccttgtggcaaacgaatcaagtttggcaaacttagccttaaatgtcgcgactgcagagtggtgtcccacccagagtgtcgcgaccggtgtccactcccctgcattcctactttgattgggacccccgtcaaaattggggaaggcatgctcgccgattttgtgagccagacatccccaatgattccgagtatcgtcgttcattgtgtcaatgagatcgagcagagaggattgactgagacggggctgtatcgcatatctggttgtgatcgaacggtaaaggagctcaaggaaaaatttctcagagtcaagacagtccccctgctaagcaaagttgatgacatccacgccatttgtagcttgctgaaagactttctccgaaatctgaaagaacctctactgactttccgtctgaacagagcgtttatggaagctgccgagattacagacgaggataacagcatcgctgccatgtatcaggccgtgggagaattgccgcaggccaaccgcgatacgctcgccttcctcatgatccacctacagagggtcgcccagagtccacacaccaagatggatgtcgccaatttagctaaggttttcggacctactatcgtcgcacatgccgtgccaaaccctgatcccgtgaccatgctgcaggatatcaaacgccagcctaaggtggtggagcgacttctttctttgcctctcgaatactggagccagtttatgatggtggaacaggagaatatcgaccccttgcatgtgatagaaaactcaaatgccttctcgaccccacagactcctgacatcaaagtatccctgctcggcccagtgacgacacctgaacatcagttgctgaagaccccttcttcttcttcactgtctcagagagtgcgtagcaccctgacaaagaatactcccagatttgggagcaaatctaagtccgcgaccaacctcgggagacaggggaatttctttgcatcccctatgctgaagtag

SEQ ID NO: 17158 - DNA, 585 bp, Artificial Sequence
  Description of Artificial Sequence: Synthetic coding sequence
atggaggacttgttcgaaacattccaggacgagatgggtttctcaaatatggaagacgatgggcctgaagaagaggagcgcgtagccgagccccaagcaaatttcaacacgccccaggcgcttagattcgaggagttgctggccaatctccttaatgagcaacaccagatcgccaaagagctgtttgagcagcttaaaatgaagaagccttccgccaaacagcagaaggaggtggagaaggtcaagccgcagtgtaaggaggtgcaccaaaccctgattctcgaccccgcacagcggaaacgtttacagcagcagatgcagcaacacgttcagctgttgactcagatccacctccttgctacctgtaacccaaacctgaatcccgaggcatcttccacccgcatttgtctaaaggaactgggcactttcgcccagagcagcatcgcgctacaccatcagtataaccctaaatttcagacactgtttcagccatgcaacctgatgggagctatgcagttgatcgaggacttctcaactcacgtttcgatagattgttcaccccataagactgtcaaaaagacatag

SEQ ID NO: 17159 - DNA, 1803 bp, Artificial Sequence
  Description of Artificial Sequence: Synthetic coding sequence
atggtccttatcctcggcaggaggctgaatcgtgaggatctgggagtgcgtgatagcccagctacgaagcggaaggtctttgaaatggaccccaaaagcttgacaggccacgagttctttgacttcagttccggaagctcccatgccgagaacattctgcagatatttaacgagttccgagattcccggctttttactgacgtgatcatatgcgtggagggcaaagagtttccatgtcaccgcgctgtgctctcagcttgtagctcttatttcagggccatgttctgcaatgatcaccgggagtccagggaaatgctggtggagattaatggtatcttagccgaagcgatggaatgtttcctgcagtacgtgtacacaggtaaggtgaagatcactactgagaatgtacagtacctgttcgagacatcttcactctttcaaatctccgtattgagggacgcttgcgcaaagtttctggaggagcagctggacccgtgtaattgcttaggtatacagagattcgctgatacccattctcttaagacgctgtttacaaaatgtaagaatttcgcgctgcagactttcgaggacgtgtcacaacacgaagagtttctagagctcgataaagatgagctcattgattacatttgcagtgatgagctggtgattggtaaggaggaaatggttttcgaagcggtgatgagatgggtgtatcgggccgtggacctgcgccgacccctgctgcacgaactacttacccacgtgagattaccgcttcttcatcctaattattttgtccaaactgtcgaggtagatcagttgattcagaattccccagaatgctatcagttgcttcatgaggctagacgatatcacattcttggcaatgagatgatgtccccaaggacccggccgcggagaagcactggttacagtgaggtgatagttgttgtggggggttgtgagagggtgggaggtttcaatctcccttacactgagtgctacgaccctgtgacgggcgagtggaaatctctcgccaagctgcctgaattcacgaaatctgaatatgccgtgtgtgccttgaggaatgatatcttggtctcaggcgggagaatcaactcccgtgatgtgtggatatacaatagtcagctgaatatttggattcgtgtcgcgtctctgaataaaggcaggtggcgtcataaaatggctgtgctgctgggcaaggtttatgttgtcggcggctacgacggccaaaaccgtctgagttccgtggagtgctacgatagcttctccaaccgatggaccgaagttgctcctttaaaagaggcagtctcctcccctgcagtgacatcatgcgtggggaaattgttcgtaataggcggtggcccagatgataacacctgctcagacaaggttcagtcttacgatccagagacgaactcatggcttcttcgggcagcgatccccatcgctaagagatgtatcactgcagttagccttaacaatctcatctacgttgctggcggtctaaccaaggcgatatattgttacgaccccgttgaggattactggatgcatgtgcagaacaccttcagtcggcaggaaaattgcggtatgagcgtgtgcaacggaaaaatatacattttgggtggacgcagggagaatggggaagcgaccgataccattctttgttacgatccggcgacctcaatcatcactggggtcgccgctatgccaagacctgtttcttaccacggttgtgtcaccattcatagatacaacgagaaatgttttaaactgtag

SEQ ID NO: 17160 - DNA, 1620 bp, Artificial Sequence
  Description of Artificial Sequence: Synthetic coding sequence
atggctacttcagcacctctccggtccctggaagaggaagtaacctgctcaatctgtcttgactaccttcgggaccccgtaacgattgactgtgggcacgtgttctgccggagctgtaccaccgatgtgaggcccatctccggcagccgcccggtgtgtccactatgtaagaagcccttcaagaaggagaatatccgtccagtatggcagttagccagcctcgtcgagaatatcgagaggctgaaggtggataagggcagacagcccggcgaggtgactcgcgaacaacaggacgcaaaattatgcgagcggcacagagaaaagctccactactactgcgaggacgacggaaagctgctctgcgtcatgtgccgagaatcacgcgaacaccgcccccacaccgcagtgcttatggaaaaggctgcacagcctcaccgcgaaaagattctcaaccacctgtccacattgcgcagagatagagataaaatccagggcttccaggccaaaggagaggccgacattcttgctgccctgaagaaactccaagaccagaggcaatatattgtagccgaattcgagcaagggcaccagtttttacgtgagagagaggagcacttgcttgagcagcttgcaaaactggaacaggagctaactgaggggcgcgaaaaattcaaaagtcgaggcgttggtgaattggcgcgtttagcactggtcatctctgagctggaaggaaaagctcagcagccggctgccgagctgatgcaggacacgcgcgacttcttaaatcgctacccgaggaagaaattctgggtcggaaaacctatcgctagggtcgtcaagaagaaaaccggcgagtttagcgataaacttctaagtttgcagagggggctgagggaattccagggaaagcttctgagagatctggagtacaaaaccgtgtcggtcactctggacccccaaagtgcatctggctatcttcagctgtccgaggattggaaatgtgtaacctacactagtctttataaaagcgcgtacctgcatccgcagcagttcgactgtgagccgggcgtcttgggctctaaggggttcacttggggcaaggtttattgggaagtggaagttgaaagagagggatggtctgaagacgaggaagagggagatgaagaggaggagggtgaagaggaggaggaggaggaagaagctggttatggtgacggatacgatgactgggaaacagacgaagacgaggagtctcttggagacgaagaagaggaagaggaagaggaggaggaggaggtgctggagagttgcatggtcggagttgcacgcgacagtgtcaagcggaagggcgatctgtccctgaggccagaggacggcgtctgggccctgcgactgagctccagtggaatttgggccaacacctcacctgaagcagaactgtttcccgccctgcggcctcggagggtgggaatcgcattggattacgaaggtggcactgttactttcaccaacgccgagtcgcaggagctcatttacacatttaccgcgaccttcactcggaggctggtcccattcctgtggctgaagtggccgggcacccgtctcctcttgcgaccatag

SEQ ID NO: 17161 - DNA, 567 bp, Artificial Sequence
  Description of Artificial Sequence: Synthetic coding sequence
tgatatgtcaacgctgtggactctagatggtcaagctacggaaacgaagccacttcttctgcccattacgtcgaacgcgaccggtttatcgtgaccgatctgagcggccatcgtaagcactcctccactggcgacctgctgtcattggagctgcagcaagctaaaagcaactctctgttgctccagagggaagcaaacgcactggcaatgcagcagaagtggaatagcctcgacgagggacggcatttgacactgaaccttcttagcaaggaaatcgaattaagaaacggcgagctgcagtccgattataccgaagatgctactgacacaaagccagacagggatattgagctggaactgtcagctctcgacactgatgagcctgatgggcagtcagagccgatcgaagaaatccttgatatacagctgggaattagcagccagaacgaccagctgctgaacgggatggcagtagaaaatggccaccccgtgcaacaacatcagaaggagccccccaagcagaagaagcagtctcttggcaggagtaagaagcagttctgtaggtag

SEQ ID NO: 17162 - DNA, 1806 bp, Artificial Sequence
  Description of Artificial Sequence: Synthetic coding sequence
atggaggaaacgatgaagctcgctactatggaggatactgtcgaatactgtttgttcttgattcccgatgagagtcgagattcagataagcacaaagagatcctccaaaagtatattgagcgcatcatcacccggttcgctcctatgctcgttccatacatttggcaaaatcaacctttcaatcttaagtataaacctggcaaaggtggcgtaccagcacatatgttcggggtaacaaagtttggtgataacatcgaggatgagtggtttatagtctacgtcattaaacagatcactaaagagttccccgagctcgtggctaggatcgaagacaatgatggcgaattcctcttgattgaggcagctgatttcttacccaagtggctggaccccgaaaactctaccaaccgagttttcttctgtcatggagagttgtgtatcatacccgccccccgaaaaagtggagccgaatcttggctccccacaacaccacctactatccctcaagctctgaacattattacagcacacagcgagaaaatacttgcatccgagtccatcagggccgcggtgaacaggcgcattcgcggctacccagagaagattcaggcttctctccaccgtgcccattgcttccttccagccggaatagttgctgtgctgaagcagagaccaagactggtggctgctgcggtgcaggcgttctacctgcgggatccaatcgacctaagggcttgccgcgtgtttaagacttttttgccggaaaccagaatcatgacctccgcccacgggtttgaaatcctatgcagtaaatgttccccccatttctccgattgcaaaaagtccctggttacggcatcccctttatgggccagcttcttagagagcctgaaaaagaatgactacttcaagggactgatagaggggagcgcacagtacagagagcgtttggaaatggccgagaattatttccagctgtccgtggactggccagagagttcactggcaatgtccccgggggaagaaattctgacgttgctgcagacgataccattcgacattgaagatctgaaaaaggaggctgctaacctgccccccgaggatgacgaccagtggctggacctgtcacccgaccagttggaccaactcttgcaggaagcagtgggaaaaaaagaaagtgaaagcgtctccaaggaagagaaggaacagaattacgacctgaccgaggtgagcgagtccatgaaggcattcattagtaaagtcagcacccacaagggtgcggaactcccaagggagccttcagaggccccaattaccttcgatgcggactcatttctgaactattttgacaaaattctggggcccagacccaacgaatccgattctgacgatcttgatgatgaagactttgagtgcctggacagtgatgacgacctggacttcgagactcacgagcccggagaagaggcatcgttgaagggaactctagataatttaaaatcatatatggcccagatggatcaggagctagcccatacctgcatctctaagtctttcactacccgaaatcaggtcgagccagtgtcccagaccaccgataacaatagcgatgaagaggatagcggaactggggaaagcgttatggcgccagtggacgttgacctgaaccttgtgtccaatatcctggagtcctactctagtcaagcggggctggccggaccagctagtaacctcctgcagtctatgggcgtgcagctgccggataataccgaccataggcccactagtaagcctactaagaactag

SEQ ID NO: 17163 - DNA, 405 bp, Artificial Sequence
  Description of Artificial Sequence: Synthetic coding sequence
atgaaaaagaagcatgatggtattgtatacgagactaaggaggtattgaacccgagcccgaaagtgacacattgctgcaaaagtctctggctgaaatacagcttccaaaaggcctatatgacccagctcgtgtctagccaacccgtgcctgcaatgtcccgaaatcctgaccataacttactgagtcagcctaaggagcactcgatcgtgcagaaacatcatcaggaagagatcattcataaactggctatgcagctgaggcatatcggcgataatattgatcatcgtatggtccgtgaggatcttcaacaagacggtcgggatgcgctcgatcactttgtgttttttttctttcgcagagtgcaagttctcttgcacttcttttggaacaatcacctactctag

SEQ ID NO: 17164 - DNA, 1791 bp, Artificial Sequence
  Description of Artificial Sequence: Synthetic coding sequence
atggaggatgctccccagcgccttagatggcaggcccatctggagttcacacataatcatgacgtgggggacctgacctgggacaagatcgctgtgagtcttcctaggtccgagaagctccggtcactggtgctcgcgggcattccgcatgggatgcgcccccaattatggatgagactttccggcgccctacaaaaaaaacgaaactccgagctctcataccgagagatcgtgaaaaactctagtaacgacgagaccattgcagctaagcagatcgaaaaagacctgttgcggaccatgccctccaatgcatgttttgcatccatgggatctattggggtgccaaggttaaggcgcgtgctacgagctctggcctggctttacccagaaatagggtactgtcaaggaaccggaatggttgcggcttgtctgttattatttctggaggaggaggacgctttctggatgatgtcggcgatcattgaggacctgctaccagcgtcctacttctctacaactctgctcggagttcagactgaccaacgggtactccggcatttaatcgtccagtacctgccccgattggacaagctgttacaggagcacgacatcgagcttagtcttatcaccttgcattggttcctcacagccttcgcctccgttgtagacattaagctcttgctccgcatttgggacctcttcttttatgagggatcccgagtgctgtttcaactgaccctcgggatgttgcacctgaaggaggaagaactgattcagagtgaaaacagtgccagtatatttaacactctttccgacatcccgtcgcagatggaagacgctgaattactgctcggggttgctatgaggctggcaggctcgctgacagatgtggcagtcgagacacaacgcaggaaacacttagcctatctgattgcggatcaaggccagctccttggcgccggtacactaaccaacctgagtcaggtggtcaggcgccgaacacaacggagaaagagcaccatcaccgccctgttgttcggggaagatgacctagaggccctcaaagccaagaatatcaagcaaacagagttagtagccgaccttcgcgaagcaatacttagggtggccagacacttccagtgcactgatcccaagaactgcagcgtcgagctgactcccgactattccatggagagtcaccagagggaccacgagaattatgtcgcctgcagccgcagtcacaggcgccgtgctaaagcgctgctggactttgagcgacacgacgacgatgaactgggatttcggaaaaacgacatcataaccattgtctcccagaaggacgaacactgctgggtcggtgagttaaatggcctccgcggatggttcccagccaaatttgtagaggtcttggacgaacggtcaaaggagtattcaatcgctggggatgactcggtgaccgaaggcgtcacagacctggtgaggggcacgttgtgccccgccctgaaggctctattcgagcacgggctaaaaaaacctagccttctaggaggtgcttgccatccatggctttttatcgaagaggcggcgggtcgggaagtagagcgggacttcgcaagcgtgtactcacgactggtgctttgcaagaccttccggttagatgaggacggaaaggtgctgacccctgaagagcttctctacagggccgtacagagcgtgaacgtcacccatgatgccgtccatgcccagatggacgtgaaactaaggtcgcttatttgtgtaggcctcaaatag

SEQ ID NO: 17165 - DNA, 399 bp, Artificial Sequence
  Description of Artificial Sequence: Synthetic coding sequence
atggagtctcgggttgctgatgccggaacaggcgagactgcacgcgctgctggcggatccccagccgtagggtgcaccactcggggccctgtggtatcagctcctctgggtgccgcccgctggaaactactgcggcaggtgctgaagcagaagcacctggacgattgtctgagacacgtgtccgtgcgccgctttgaaagttttaatcttttcagcgtgacggaaggcaaagaacgcgagacggaagaggaagtgggagcatgggtacagtacacctcgatcttctgtccagaatattctatatccctccggcacaacagcgggtctttgaatgtggaagatgtgcttacatccttcgacaatacgggaaatgtctggtctttttcgcgaggcaagtag

SEQ ID NO: 17166 - DNA, 1620 bp, Artificial Sequence
  Description of Artificial Sequence: Synthetic coding sequence
atggcaaccagtgctccactccgatcgttggaggaggaagtgacgtgcagcatatgtctagattacctacgggatcccgtgacaatcgactgtggacacgtgttctgcagatcctgtactacggatgtcagacccatcagcggcagtagaccggtgtgtccactgtgcaagaaacccttcaaaaaggagaacatccgccccgtgtggcaacttgcttcacttgtggaaaacatcgagcgtctgaaggttgataaaggtagacagcctggagaggtgacacgcgagcaacaagatgccaaactttgcgagcgccaccgagagaaactgcactattactgcgaagacgatgggaaactgctgtgtgtgatgtgccgggaatcacgtgagcatcggccgcacactgccgtcttaatggaaaaagccgctcagccccatagggagaaaatactcaaccacctgagtacgttgagaagagatcgggacaaaatccagggatttcaggccaagggggaagccgacattctggccgcgctgaaaaaattacaggatcaacggcaatatatcgtcgcagaattcgaacaaggccatcagttcttgagggaaagagaggagcacctgcttgagcagctggccaagctcgagcaagaactgactgagggcagggaaaagttcaaatctcggggggttggggaattagcaagacttgcgcttgtcatcagcgaattagagggcaaggcccagcagccagctgccgaactgatgcaggataccagagactttctgaaccgttacccccgtaaaaagttctgggtggggaagcccattgccagggtcgtgaagaaaaagacaggtgagttctccgacaaactgctgagcctgcagcgtggtctcagggaattccagggtaaacttcttagagaccttgaatataagaccgtctctgttacactcgatccacaaagcgcttccggatatctccaactgagtgaagactggaagtgcgtgacctacacttctctgtacaagagcgcatatcttcatccccagcagttcgactgtgaaccaggagtcctgggaagtaagggttttacatggggaaaagtgtactgggaggtagaggtggaaagggaagggtggagcgaagacgaggaagagggagatgaagaggaggagggtgaagaagaagaggaggaagaggaagcaggatacggagatggatatgatgattgggagacggacgaagacgaggagagcctgggcgatgaggaggaggaggaagaagaagaagaggaggaggtgttagagtcttgtatggttggtgtggcaagggatagcgtcaagcgtaaaggagatttaagtctgcgccccgaggacggggtgtgggctctgcgactgagcagttccggcatctgggcgaacacctcccctgaagctgaactctttcccgccctgaggcctaggcgcgtgggcattgctctagactacgaaggtggcaccgtgacctttactaatgccgaatcccaggagctgatatacacattcacagcaacattcacccgacgcttggtgccatttctgtggctgaaatggccaggtacccgtctcttgctaagaccatag

SEQ ID NO: 17167 - DNA, 2193 bp, Artificial Sequence
  Description of Artificial Sequence: Synthetic coding sequence
atgaacaacagtagttccgagacccgcggtcatcctcacagtgcgtcttctccatcagaacgggtgttccccatgccactacctcgcaaagcaccattaaacataccaggtactcccgtgttggaggactttccccagaacgacgacgaaaaggagcggctgcagaggcgccgctccagagtgttcgacctacagttctctaccgatagtccgcgacttttggcttccccgagctcaagatcgattgacatcagcgcgactatacccaagttcaccaatacccagataaccgagcactacagcacttgcatcaagctctctaccgagaataaaataactaccaagaacgccttcggactgcatctaattgactttatgagtgaaattctaaagcagaaggacaccgagcccaccaattttaaagtggcagcaggcacactggatgcatcaactaagatatacgcagttagagtcgacgctgtccacgctgatgtgtaccgtgttctaggcgggctaggaaaagacgccccgtccctggaagaggtggagggtcacgtcgctgacgggtccgctaccgagatgggaactaccaagaaggctgtgaagcctaagaaaaaacatcttcaccggaccattgagcagaatattaataatctgaacgtcagcgaagctgaccgcaagtgcgagattgatcctatgttccaaaagaccgccgcgtcttttgacgagtgctccacagccggcgtcttcctttctactttacactgccaggactatcgatcagagttactgttcccctccgacgtacagactctaagcacgggcgagcctctggagttgccagaactcggttgtgtggaaatgaccgacttaaaggccccccttcagcagtgtgccgaggaccggcaaatttgccccagcctagccggatttcagtttacccagtgggactctgaaacccacaacgaatccgtctcagccctcgtggacaagtttaagaagaatgaccaagttttcgatattaacgccgaagtggacgaaagtgactgcggtgacttccctgatgggtccctgggcgacgattttgatgccaacgatgagccagaccacaccgcggtgggggatcatgaggagtttcgatcttggaaagaaccctgccaggtgcaaagctgtcaagaggaaatgatctccctcggggacggtgatatcagaaccatgtgccccctgctcagtatgaaacccggcgaatacagttacttttctccgaggacaatgtctatgtgggctgggcctgatcactggcgctttcgcccaagaaggaagcaggacgcaccgagtcagtctgagaacaagaaaaagagtaccaaaaaggactttgaaatcgatttcgaagacgacatcgatttcgatgtctacttccggaagacgaaagctgcaacgatattgaccaagtcaacgttggagaatcagaactggagggccactacacttccaaccgattttaactataacgtggatacacttgttcagttgcatttgaaacccggtacaaggctgctgaaaatggcacaaggtcatcgcgtagagactgagcactacgaagagatagaagattacgattataacaatcccaatgacacgtctaatttctgtcctgggttacaggctgccgactccgacgacgaggatctagatgatctctttgtggggcccgtggggaactccgacctgtctccctatccctgtcatccccccaaaacagcgcagcagaatggggatacgcccgaggcacaagggctcgacatcacgacttatggggaatcaaatctagtggcagaacctcaaaaggtgaacaaaatcgaaatacattatgcaaaaacagccaagaagatggacatgaagaagctgaaacagagcatgtggagtttgttaaccgctttgagcgggaaagaggcagacgcagaagcaaatcatagagaggccggtaaggaagcagctctggccgaggttgccgatgaaaaaatgctcagtggcctgactaaagatctgcagcgctccctgccccctgtaatggcccagaacttaagtatccctctcgcctttgcatgcctactacatctggctaatgaaaaaaaccttaagcttgagggaactgaggatttgtctgacgtcttagtacggcagggggattag

SEQ ID NO: 17168 - DNA, 900 bp, Artificial Sequence
  Description of Artificial Sequence: Synthetic coding sequence
atggaaacgcagttccctgtgtcagaaggaaaagtcgacccataccggagctgcggtttctcgtacgaacaggacccaactcttcgggaccctgaggcagtggctaggagatggccctggatggtaagcgtgagggccaacggtacccacatttgcgccggcacaattattgcgagccagtgggtgctcacggtcgcacattgcctgatttggcgcgacgtcatttactcggtccgggtgggttctccctggatcgatcagatgacacagaccgcctcagatgtccccgttctgcaagttatcatgcattcccgctacagagctcagaggttttggagctgggtgggacaggcaaatgatatcggcctgctcaaactcaagcaggagcttaagtattcgaactatgtgagaccaatttgtctccccggcaccgactacgtgctcaaagatcacagcagatgcacagttactggatggggcctaagcaaggccgacggcatgtggccccaattccggactattcaagagaaagaagtgattattctgaacaacaaggagtgcgacaatttttatcataatttcaccaagatccccacacttgtgcagatcattaaatcccaaatgatgtgtgccgaggacacacatagggagaagttttgctatgaattaacaggtgagcctttagtgtgttcaatggagggaacttggtacttagtagggctcgtctcttggggagctggctgtcaaaagagcgaggctccaccaatttatcttcaggtgagctcctatcagcattggatttgggactgcctaaacgggcaggcactggccctgcctgcccccagccggaccctgcttcttgcgctgcctctaccacttagcttactcgccgctctatag

SEQ ID NO: 17169 - DNA, 1089 bp, Artificial Sequence
  Description of Artificial Sequence: Synthetic coding sequence
atgctggtgcctggatccacgcgaccctatagcaagaaacgccagaacagtaaatccgcgcagggcctggccggactacggaacctgggcaatacttgttttatgaatagcattctccaatgcctctccaatacaagagaactgcgagattattgcctccagcggctctatatgagggacctgcaccatggttcaaacgctcatacagccttggtcgaggaatttgccaagttaatccagactatctggacctctagcccaaatgatgtggtcagcccctccgagtttaaaacacagattcagagatacgcaccacgcttcgtaggttataaccaacaagacgcacaagaattcctgaggtttctcctcgacggcctccacaatgaagtgaaccgggtgaccctgagaccaaaatcaaacccggagaatttagaccaccttcccgatgatgaaaaaggtcgacagatgtggcgtaaatatcttgaacgcgaggactcccggatcggcgacctgtttgtcggacagctgaaatctagcctgacttgcacagattgtgggtactgcagtacagtgttcgatccattttgggacctatccctgccaatcgctaagcgtgggtatccggaggtgaccttgatggattgcatgaggctcttcactaaggaggacgtactggatggcgacgaaaagcccacatgttgtcggtgcagaggacgaaaaagatgtatcaaaaaattttccatccaacgctttccaaagattctggttttgcatctgaaacgattttccgaaagccgaataagaacctcaaagctaaccactttcgtgaatttcccactgcgggatctcgatctccgggagtttgccagtgagaatactaatcatgctgtatacaatctctatgccgtttccaatcacagcggcaccactatggggggccactatacggcctactgtcgcagtccagggacaggcgagtggcatacctttaacgacagctccgtgacaccaatgtcctcttcccaagtgcggacttcggacgcctacttactgttttatgaattggcctctcctcctagcaggatgtag

SEQ ID NO: 17170 - DNA, 1800 bp, Artificial Sequence
  Description of Artificial Sequence: Synthetic coding sequence
atggatcccggcgacgctgcaatcctggagtccagcctgagaatactgtatcgcttgtttgaaagtgtgcttccaccactgcccgccgcactgcagtctcgaatgaatgttattgaccatgtgcgcgatatggccgctgccgggcttcactccaatgttaggctcctgtcatccctgctgctgaccatgtctaacaacaacccagagctgttctcaccccctcagaaataccagctgttggtgtaccatgcagacagcctgtttcatgataaagaatacaggaatgctgttagcaaatataccatggctttacagcagaaaaaggcgttatccaagacatctaaggtgcggcctagtactggcaactccgcatctacaccccagtcacaatgcctccccagtgagatcgaagtaaagtacaaaatggccgagtgctacaccatgctgaaacaggataaggatgcaattgcaatcctggatggcattcccagtcggcagagaacccccaagatcaatatgatgctcgccaacctgtataagaaagccgggcaggagcgtccatccgtgaccagttacaaggaggtgctgcggcagtgtcccctagccctggacgcaatattagggctgctaagtctgagcgttaaaggggctgaagttgcatctatgaccatgaatgtgattcagaccgttcctaacctggactggctgtcagtttggataaaagcatacgcattcgttcacacaggtgataactctcgggcaatttcaacgatctgttcactagaaaagaagtccttactgcgagacaacgtggacctgctgggctccctggctgacctgtacttcagggcgggtgataataaaaatagcgtgctcaaattcgaacaggcccaaatgctcgatccatacctcattaagggaatggacgtctatggttacctcctagcacgcgaaggccggctggaagatgtcgagaacttgggttgtcgtctgttcaacataagcgaccaacatgcggagccgtgggtggtgtctggctgtcattctttctacagcaagcgatacagccgggctctttacctaggcgccaaggccattcagctgaatagtaattcagtgcaagccctcctgttgaagggggccgccctaagaaatatggggcgggtgcaggaggccataatccacttccgagaggcgatccgtctggccccttgccggcttgattgttacgaagggttgatagagtgctacctggcatcaaatagcatcagagaagctatggtcatggccaataacgtgtacaaaacactgggggccaacgcacaaaccctcacccttctggctactgtgtgtctcgaagaccctgtgactcaagagaaggcaaagacgcttcttgacaaggctctgacccagcgacccgactatataaaagccgtcgtgaagaaagccgagctcctgtcacgggaacagaagtacgaggacggtatcgcattgctgcgcaatgcacttgccaatcagtccgattgcgttctacatcgcattcttggtgacttcctggtggccgtgaacgaatatcaagaggcaatggaccaatactctattgcactgagcctggaccctaatgatcagaaaagtctggagggcatgcagaaaatggagaaagaggagtctcctacggatgctacccaggaagaggatgtggacgatatggagggaagtggagaagagggagacctcgaggggtcagattccgaagccgcacagtgggccgaccaagaacagtggttcggtatgcagtag

SEQ ID NO: 17171 - DNA, 507 bp, Artificial Sequence
  Description of Artificial Sequence: Synthetic coding sequence
atgcccgcgacgagaaagcctatgcgctacggacacaccgagggccatacagaagtgtgttttgacgacagtggcagcttcatcgtcacctgcggttccgacggcgatgtcaggatctgggaagatctggacgacgatgatccaaaatttattaatgtgggagaaaaagcgtacagctgcgcacttaaatccggcaaactggtgactgctgtgtcaaataatactatacaggtccacacatttcccgagggggtgccggatggtatcctgactaggttcaccacaaacgctaaccatgttgtatttaatggcgacgggacaaagatagcagcaggatcttccgattttctcgtaaaaattgtcgacgtaatggattcttctcagcagaagaccttccgggggcatgacgcccccgtgctgtctctgtccttcgaccccaaagacatatttctggcatcggcgagctgtgacgggtctgttcgcgtttggcagattagtgaccagtag

SEQ ID NO: 17172 - DNA, 141 bp, Artificial Sequence
  Description of Artificial Sequence: Synthetic coding sequence
atggtgaactcctgctgcggttccgtgtgctcagatcaagggtgcgggttggaaaactgctgccgcccttcttgttgtcaaacaacctgttgtagaactacgtgttgtaggcctctctgctgcgcaagctcctgttgttag

SEQ ID NO: 17173 - DNA, 669 bp, Artificial Sequence
  Description of Artificial Sequence: Synthetic coding sequence
atggcatccgtggttgagtataaaggcttgcgtgccggctaccattgcgggtattgcgatagcaaggagggcaaagcatcatgtggaatgtgggcccactccatgaccgtgcaggactaccaggatctgatcgatcgtgggtggaggagatcaggtaaatacgtatataagccagtcatgaatcaaacttgttgccctcagtacacaatcaggtgccggcccctccagttccagccttctaagagccacaagaaggtgcttaagaaaatgctgaaatttctagccaaaggcgaggtgcctaagggatcctgcgaggatgagcccatggacagcactatggatgatgcggtggctggtgattttgccctgataaacaagctggacatacagtgtgacttgaaaacactgtccgacgacattaaggagagtctggaatccgagggaaagaatagcaaaaaggaagagccccaggaactgctgcagtctcaggattttgtgggtgaaaaactgggctccggggagcccagtcacagtgtgaaggtgcacacagtgcctaaaccaggcaaaggcgccgatctctccaagccgccatgccgcaaggctaaggaaataaggaaggagcggaagcgcctgaaactgatgcaacaaaacccggctggcgagctgtag

SEQ ID NO: 17174 - DNA, 495 bp, Artificial Sequence
  Description of Artificial Sequence: Synthetic coding sequence
atgctcaaagccgtcattctgattggcggaccacaaaaaggaacacgattccggccattgtcattcgaagtacccaaacccctcttccctgtcgccggggtgcctatgatacagcatcacatcgaggcctgtgcccaggttccagggatgcaggaaatactgctgattggcttttaccagcccgacgaaccactgacacaattcctggaagccgctcagcaggaattcaacctgcccgtgcgctacctacaggagttcgctcccctgggcaccggtggcggcctgtatcatttccgcgatcagattctcgcggggtcgccagaggccttctttgtacttaacgctgatgtttgctcagattttccgttgtcggcaatgctggaggctcacagacggcagagacatccatttctattattgggtaccactgccaatcggacccagtcattgaattacggctgtatcgtcgaaaacccccagacccatgaggtttag

SEQ ID NO: 17175 - DNA, 339 bp, Artificial Sequence
  Description of Artificial Sequence: Synthetic coding sequence
atgttcgtgtctgattttcggaaagagttttacgaggtagtacaaagccagcgggtcctcctctttgttgctagcgatgtggacgccctttgcgcctgcaaaattctgcaagctttgttccagtgcgatcatgtccagtacacgctcgtgcctgtgtcaggctggcaggaactagagacggctttcctggagcataaggagcagtttcattattttattctcatcaactgcggagccaacgtcgaccttttagacatactacagccagatgaggacacaatattcttcgtttgtgacactcacagacccgtcaacgtggtcaacgtgtataatgactag

SEQ ID NO: 17176 - DNA, 942 bp, Artificial Sequence
  Description of Artificial Sequence: Synthetic coding sequence
accctggtggtctcaggtcgggatgatccaccaacacacagtcagcccgactcggatgacgaggctgaagagatccagtggagcgatgacgaaaatacagccactctaaccgctcctgagttcccggaattcgccacaaaggtgcaggaggcaattaactccctcggggggtcggtgttccccaaacttaactggtcagctccacgggacgcatactggatcgcaatgaactccagtctgaagtgtaagactttatcagatatctttctgctgtttaaatccagtgatttcatcactcgagattttacccagccctttatccattgtactgacgacagccccgatccttgcatcgaatacgagttagttctgagaaagtggtgcgagttgatccccggagctgagttcagatgcttcgtcaaggagaacaaattgattggtatatcccagcgcgattatacacagtactacgatcatatctccaagcaaaaggaagaaattcggcgctgcattcaggacttctttaaaaaacatattcagtataagtttctcgacgaggatttcgtctttgatatctatagagacagccgcgactctcccgcattccgctgcacaaattctgaagttaccgtgcagccctcaccttacctctcctatcgcctgcctaaggactttgtcgatctgtcaaccggggaggatgcgcataagttgattgataagtccgcgggcgggcgtctgatgagtgtcctggagctcgaaaaacggagacctcgtcccacagcgccaggagcagcccaccagccgcagttacctgctgatcccgatgccggcggtccatcttccgttgacatctcccactttctttactcctgcacattcacctggggaaagaagaggcgtgacttcgccacatgcaagaataacatcataaatcgtagttag

SEQ ID NO: 17177 - DNA, 1017 bp, Artificial Sequence
  Description of Artificial Sequence: Synthetic coding sequence
atggaactgtggggaagaatgttgtgggctctgctgtccggccctggccgacgcggctcgacaaggggttgggcattctcatcctggcagcctcagccgccactggctggcctcagctccgccattgagctagtctctcactggacgggtgttttcgaaaaaagaggcatcccagaggccagggaatcatccgaatacatagttgcccacgtgttgggggctaagacatttcagtcactgcgccctgccctatggactcaacccctgacttctcagcaactccaatgcataagagagctaagttctcgacgtctgcagagaatgcctgtccaatacatattgggcgagtgggacttccaggggctgtcactgcgcatggtgcctcccgtgttcattccacggcccgagacagaggaactagttgagtgggtgctggaggaggtggcacagcggagccacgcagtgggatcacccggttctccgttgatcctggaggtgggatgtgggagtggggccatatccctttccctgctttctcagctgcctcaatctcgcgtcatcgccgtcgataagcgcgaagcggccatcagcctcacccatgaaaatgcccagcggcttcgactgcaagacaggatttggatcatccatcttgacatgacaagcgaacgcagttggactcatctgccctgggggccaatggatctcattgtgtctaacccaccttatgtctttcatcaggacatggagcagttagctcccgagattagatcttacgaggacccagccgctctggatggaggggaagagggaatggacataatcacccatatcttggcattagctccaaggctgctaaaggatagtggatccatcttcttagaggttgacccgagacaccccgagctcgtgagtagctggttgcagtcgcgaccagacctctacctgaatttagttgcagtaagacgggatttctgtggacggccccgcttcctgcacatccggaggtcaggaccctag

SEQ ID NO: 17178 - DNA, 1119 bp, Artificial Sequence
  Description of Artificial Sequence: Synthetic coding sequence
atgaagcgcagaactgaccccgaatgtactgcccccatcaaaaaacagaaaaagcgcgtggcagagctggctctgagcctgtcgtctacctctgatgatgagcccccatctagcgtcagtcacggcgctaaagcctcaacgacctccctgtctggcagtgatagtgagacggagggcaaacaacacagcagtgactcattcgacgacgcctttaaggccgattctctggtggaaggcacctcaagtaggtattctatgtacaattccgtttcacagaagctgatggccaagatgggatttcgtgaaggcgagggcctgggcaaatatagccagggccggaaggacatcgtcgaagcatcaagccagaagggccggaggggactggggcttaccctaagggggtttgatcaggagttaaatgttgactggcgcgacgagcctgaaccctccgcctgtgagcaggtttcttggttccctgagtgtaccactgaaattcctgacacacaggaaatgtctgactggatggtggtcgggaaacgcaagatgataatcgaagatgagacagagttttgcggcgaagagctcctgcattccgtactccagtgcaaaaagccactggtcaaggaccgtgaagccgagctcctgtactttgccgatgtttgcgccgggccagggggcttctctgaatatgtgctgtggcggaaaaagtggcatgcaaaagggtttggaatgacacttaagggtccaaacgacttcaaactggaggatttttacagcgcctcatccgagctgtttgagccctattacggagagggggggattgacggagatggggatattaccaggccggagaacatcagcgcattccgcaatttcgtactcgacaatacagacaggaaaggcgttcactttcttatggctgatggtggcttctcggtggagggacaagagaacctgcaggagatattatccaagcagctcctgctatgccagttcttaatggccttgtcaatcgtaaggaccggaggccactttatctgcaaaaccttcgaccttttcacccccttcagcgttggcctggtttacctgttgtattgctgctttgaaagggtgtgctag

SEQ ID NO: 17179 - DNA, 408 bp, Artificial Sequence
  Description of Artificial Sequence: Synthetic coding sequence
tagcagctggcaagcatggtatggaataacccaagtcagcagcaatttatgcagttcggcgggagcagtggctcacaactgccccagatccagactgatgtggtgctccctagttgtaagaaaaaagcccctgccgaaactccagtgaaggagcggctcttcattgtctttaacccccaccctctgccccttgatgtcttggaggatatcttttgtaggttcgggaatctcatcgaagtgtacctcgtctcgggtaagaatgtcggctatgcaaaatacgctgacaggatcagcgctaatgacgcgatcgctacactccatggtaagatactgaatggcgtcagattaaaggtgatgctggcagactcccctcgggaagagagcaacaaaaggcagaggacatattag

SEQ ID NO: 17180 - DNA, 1764 bp, Artificial Sequence
  Description of Artificial Sequence: Synthetic coding sequence
atggcgtctgaggacatcgcgaagttggctgaaacacttgcaaaaacccaggtcgccggagggcagctgtccttcaaagggaagtcccttaaacttaataccgctgaggatgccaaggatgtgataaaggagatagaagatttcgactccttagaagccttgaggctcgaggggaatacggtaggagtggaggccgctagggtgatcgccaaggccctcgagaagaaaagcgagctgaaaagatgtcattggtctgatatgttcaccggcaggcttaggaccgaaatcccaccagccctcattagcctgggggagggcctgattacagccggggcccaattagtagagctcgacctgtctgacaacgcttttggtcccgatggtgtgcaaggattcgaggctctcctgaaatcctcagcctgtttcactctgcaggaactcaaactgaacaattgcggaatgggcatcggtgggggcaagatcttggccgctgcactgactgagtgccataggaaatcatccgctcagggcaagcccctagcattgaaggtgttcgtcgccggcaggaaccgactcgagaatgacggcgccacagcattagctgaggcctttagggttattggcacccttgaagaggttcacatgcctcagaatgggatcaatcatcccggcattaccgctctggcccaagcatttgccgttaatccacttctgagagtcatcaatctgaacgataatacatttaccgagaaaggcgccgtggcaatggctgagaccctcaagaccctgcgtcaggtggaggtcatcaacttcggggactgtttagtgcgatcaaaaggggcagtggctattgcggacgccatccgtggggggctgcccaaattaaaggaactaaacctctccttttgtgaaataaagagagacgccgcccttgctgtggctgaagcgatggctgataaagccgagctcgagaagctggaccttaatggcaatactctcggtgaggagggatgcgagcagctccaggaagtcttggaagggttcaatatggctaaagtgttggcaagcttgtcagacgacgaagacgaggaggaagaagaggagggcgaggaggaggaagaagaggccgaggaggaggaggaggaggacgaagaagaggaggaggaagaggaggaagaggaggaggaggagcctcagcagcgtgggcagggagagaagagcgccaccccaagcagaaaaatcctcgaccctaatactggcgaacccgccccagttctttcaagcccacctcctgctgacgtcagtactttcctcgcttttccttcccctgagaaactgctccgactcggtcctaaaagctctgtgctgatcgcgcagcaaactgacacctctgaccctgaaaaggtagtgtccgctttcctgaaggtgtcaagcgtcttcaaggacgaggcgaccgtgcgaatggccgtccaggatgccgtcgacgctttaatgcagaaggcctttaactcctcttcctttaattcaaatacattcctgacacgcttgttggtgcatatggggctgctgaaaagcgaggacaaggtcaaagctattgctaacctctacggcccactgatggcacttaaccacatggtgcaacaggactacttccccaaagccctagccccactgctgttggccttcgttactaagcctaacagcgcactggaatcgtgttcctttgctaggcactctctcctccaaacactgtacaaggtgtag

SEQ ID NO: 17181 - DNA, 1842 bp, Artificial Sequence
  Description of Artificial Sequence: Synthetic coding sequence
atggccactataccggactggaagctgcagttactcgctcggcgccggcaagaagaagcatctgttagaggcagggagaaggcagaaagagagaggttgtcccagatgcctgcttggaaacgcggcctgctcgaacgccgacgggccaagctcgggttatccccgggggaacccagtcccgtgctgggaactgtggaggctggacctcccgacccggacgagtctgccgtgctattggaggcgattgggccggtgcaccaaaaccgctttattcggcaggaaagacaacagcaacaacagcagcagcaacgctccgaggaactcctggcggagcggaaacctgggcctctggaggcacgagagcgaaggcccagccccggagaaatgcgagatcagtcacctaaaggaagggagagccgagaggaaaggctgtctccccgagagactcgggagagaagattagggattgggggcgctcaggagcttagtctgcggcctctagaggcacgagattggaggcagagccccggcgaagttggagatcggagtagccggctttcagaggcgtggaaatggaggctatctccaggtgaaactcctgaaagaagcctgcgcctggcagaaagcagggagcaatctcccaggcgcaaggaggtggagagtagactaagtcctggtgagtcggcctatcagaaacttgggctcaccgaggcacacaagtggagaccagacagtagggaatcccaggagcagtcccttgttcaactagaggccacagagtggagattgcgtagcggcgaagagaggcaggattattctgaggagtgcggcaggaaggaggagtggcctgtgccgggagtggcacccaaagagactgcggagctctccgaaacactaactcgtgaagcccagggcaactcgtccgctggtgtggaagccgccgaacagcgacccgtggaggacggggaaagggggatgaaaccgactgagggctggaagtggacactgaactccggaaaggctcgcgagtggacacccagagacattgaagctcagactcagaagcctgagcccccggaaagtgccgagaaattgttggagagtccaggagtggaagcgggcgagggcgaagctgagaaggaagaagcaggcgcccagggtaggcccttgcgtgccctgcaaaattgttgctctgtcccttctccactgccacccgaggacgccggaacaggaggccttcgtcagcaggaagaggaagctgtcgaactacaaccaccccccccagcccctctgtcgcccccaccgcctgcaccaactgccccccagcctcctggagacccattgatgtccagacttttctatggggtgaaagcaggtcccggggtcggagctccccggcggagcggccataccttcaccgtgaaccctagaaggagtgtgcctcccgctacccccgccaccccaaccagtccagctactgttgatgctgccgtgccaggcgctggcaaaaaacgataccctactgcagaagaaatcctagtccttggggggtacctgcggttgtccaggtcatgcctggccaaaggatctcctgagagacaccataagcaacttaagatcagcttttcggagaccgctctcgaaacaacataccagtacccttctgagtcatcagtgctggaagagttgggaccggaacccgaagtgccgagcgcgccgaacccgcccgctgctcagcccgatgatgaggaggatgaggaggagttgctgctattgcagccggaactgcagggcggtctgcggactaaagctctgatagttgatgaatcttgtaggcggtag

SEQ ID NO: 17182 - DNA, 477 bp, Artificial Sequence
  Description of Artificial Sequence: Synthetic coding sequence
atgacccactgctgcagtccctgttgtcaaccaacttgctgcagaaccacatgctgtcgcactacctgctggaaaccgaccaccgtcaccacctgctcttccaccccatgttgccaacccgcttgttgtgtgtcctcttgttgtcagccttgctgcagacccacatgctgccagaatacctgttgtaggacaacatgctgccaacccacttgtcccacctgttgcggttcctcatgctgcggacagacatcatgtggctctagctgcgggcaaagttccagttgcgcgccagtctactgccgacggacctgctattaccccacaacggtatgccttcctgggtgtcttaatcagtcatgcgggagcaactgctgccagccttgctgtaggcccgcttgctgtgaaactacctgctgccgaaccacttgtttccaacccacctgcgtgtctagctgctgtcagcctagttgttgctag

SEQ ID NO: 17183 - DNA, 1620 bp, Artificial Sequence
  Description of Artificial Sequence: Synthetic coding sequence
atggccacctccgcccccctacgttccttggaggaagaggtgacatgctcaatttgcctagattacctacgcgatcctgtaacaattgattgtggccacgtgttctgtaggtcctgcacaaccgatgtccggccaatatctgggagccgaccagtctgcccgttgtgcaaaaaacccttcaagaaggagaatatacgccccgtttggcagctggcaagtcttgtggagaacatcgagagactgaaggtcgataaagggcgtcagcctggagaggtcacaagagagcagcaggacgcaaaactatgtgagcggcacagagagaaactccattattactgcgaggacgacggcaagcttctgtgcgttatgtgtagagaatcacgtgagcatcggcctcatacggccgtcttaatggagaaggctgctcaaccacatcgagagaaaatcctcaatcacctgagcaccctccgaagggatcgcgataagatccaggggtttcaggccaagggcgaggccgacatcctagccgcactgaaaaagctgcaagaccagcgtcagtatatcgtggccgagttcgaacagggccatcaattcctaagggagagagaggaacatcttcttgagcaactcgccaaacttgagcaggaactgacagaggggcgggagaaattcaagagccgcggcgtgggcgagctcgcacgtctcgctcttgtaatatctgaactcgagggaaaggctcagcagccagctgcagagctgatgcaggacacacgggatttcctcaatcgttacccccgcaaaaaattctgggtgggtaaacccatagcccgcgttgtgaagaaaaagacaggagagttcagcgataaactactgtctctccagaggggattgagagaattccaaggaaaactcctgcgtgatttggagtacaaaaccgtgtcggtgactttggacccccagagcgcatcaggttacttgcaactctctgaggattggaagtgtgtgacatatacatcattatataagagcgcctaccttcaccctcaacaattcgattgcgaaccgggagttttgggatctaagggatttacgtggggcaaagtgtactgggaagtggaggtggagcgtgagggctggagtgaagacgaggaggagggcgatgaagaagaggagggcgaagaagaagaggaggaggaagaagccggctacggcgacgggtatgacgattgggagacggacgaagatgaagagagcctaggcgacgaggaggaggaggaggaggaagaggaagaagaggtcttggagtcctgtatggtcggtgttgcccgggacagtgtaaaacgaaagggagacctttcccttcgacccgaagatggcgtgtgggccctgcgattgtccagcagcggcatttgggcaaatacatcccccgaggccgagttgtttcctgctctgcgcccccggagagtgggtatcgccctggactacgaaggcgggactgttacattcacaaatgccgaaagtcaagagctgatttatacctttacggctacctttactaggcgattggtgcctttcctgtggctgaagtggcccgggactcggttgctgttgagaccctag

SEQ ID NO: 17184 - DNA, 2511 bp, Artificial Sequence
  Description of Artificial Sequence: Synthetic coding sequence
atggcagctgccctgggcccgcctgaagtaatagcccagctcgagaacgccgcgaaagttttaatgcagactttggcatgttccatcctgaccgccctgttgtccgaattctctagctcttcaaaaacctccaatattggactgtcaatggagttccatggaaattgcaaacgggtcttccaggaagaagatttgcggcagattttcatgctgaccgttgaagtgctgcaggagttcagccgaagggagaacttgaatgctcaaatgtcttccgtgttccaaagatacctggccctggcaaatcaggtgctaagctggaatttcctcccccctaaactcggcaggcattacattgcaatgttcgagagcagccagaatgtgctcttaaagccgactgaatcctggcgtgaaaccctgcttgattctagagttatggagctgtttttcactgtgcatagaaaaattcgggaggattctgatatggcccaggatagtttgcagtgcctcgcccagctcgctagtttacatggccctatctttccggacgaaggtagccaggtggactatctggctcactttatcgaaggccttctcaatacaattaacggaattgaaattgaggacagcgaggctgtgggtatctcttcgattatttcaaatctgattaccgtcttcccccgtaatgtattaacggccatcccttctgaactgttctctagttttgtgaactgtttaacccacctaacatgtagcttcggacgatcagcagccctcgaagaggttctggataaggacgacatggtgtacatggaggcttacgataagttattggaaagctggctgactctggtgcaagacgacaagcattttcataaagggttcttcacccagcatgccgtccaggtttttaactcctatattcagtgtcacctcgccgccccggacgggacgcgaaacctaaccgctaacggcgttgcttcgcgggaggaggaagagatttcggaattgcaagaagacgacagggaccagttcagcgatcagttagcctcagttggtatgttagggcgcatcgccgcagaacactgcattccccttctgactagcctcctcgaggagagggtaactagactacacgggcaactccaacggcatcaacagcagcttctggcatccccgggcagttccactgtagacaacaagatgctggatgacctttacgaggatatccactggctgatcctcgtcacaggttatctactggccgacgacacccagggtgagacacctctaattccccctgagatcatggagtatagcataaaacactcttctgaagtggatatcaatacaactttgcaaattttgggaagtcccggtgaaaaggcctcctctatccctggctacaacaggactgacagtgtgatcaggctcctgtcggcaatcttacgcgtgtcagaagttgagagccgcgccataagagcggatctgacccacctgctgtccccccagatggggaaggacatagtgtggttcctcaagcgctgggccaagacatatctcctcgtggatgaaaagctgtacgatcagataagcttgccgttctccactgccttcggcgctgataccgaggggtcccaatggattatcggctacctgctgcagaaagttatctcaaacctctcagtgtggagctctgagcaggacttggcaaacgacaccgttcagcttcttgtgacactggttgagagaagggagcgcgccaatcttgtcattcaatgtgagaattggtggaacttagctaagcagtttgcctccagaagtccacctctaaatttcctctcctcacccgtgcagagaacactaatgaaggctctggtcctgggcgggttcgcccacatggacaccgagaccaagcagcagtattggacggaagttcttcaaccactccaacagagatttctgagggtcattaatcaggaaaactttcaacagatgtgtcaacaggaggaagtgaaacaggagatcactgctacactggaagccctgtgtggtatcgctgaagccacccaaatcgataatgtggccatcttgtttaatttcctgatggactttctgaccaactgcatcggattaatggaagtatacaaaaacacccccgagactgtcaacctgatcatagaggtctttgttgaagtggcccacaaacaaatctgctatctgggcgaatctaaggcgatgaacctgtacgaggcttgtctgacactactccaagtctactctaaaaacaatttaggccgccaacgcatcgatgtgaccgcagaagaggagcagtaccaagacctgctgttgatcatggagctactgacaaatcttctgtcaaaggaattcatcgattttagtgataccgatgaggtgtttcgggggcacgaacccggacaggcggccaatcgttctgttagtgcagctgacgttgtactctatggagtgaaccttatcttgccactaatgtag

SEQ ID NO: 17185 - DNA, 1008 bp, Artificial Sequence
  Description of Artificial Sequence: Synthetic coding sequence
atggacttcttgttgggcaatccgtttagcagccccgtcgggcagcgcatagaaaaagctaccgacggcagcctccagtcagaggactgggccctcaacatggagatctgtgatatcataaacgaaactgaagaagggcccaaagacgctcttagggccgtcaaaaaacgaattgtgggtaacaagaacttccacgaggttttggaaacctgtgtgaaaaactgcggacataggttccatgtcctggtggcttcccaagacttcgtggaatccgttctggtgagaacaatactgcctaagaataatccacctaccattgtgcacgataaagtccttaacctcatacagtcctgggccgacgcttttagatcatcacccgatctcactggcgttgttacgatttatgaggatctaaggagaaagggcttagaattccccatgaccgacctcgatatgctatcgcctatccataccccacaaagaaccgtctttaactcggagacacagtctgggcaagactcagtgggcactgacagttctcagcaggaagacagcggtcagcatgccgcacctctgcccgctccacccatcctctctggtgatactcccatcgcccccactcctgagcagatcggcaagctacgctctgaactggagatggtgtctgggaacgtgcgtgtgatgtcagagatgctgactgaactcgtgcctacgcaggctgagcccgctgacttagagctattacaggagttaaaccgaacatgcagagcaatgcaacagcgcgtactagagctgattccacagatcgctaatgaacagctcacggaggagctgctaatcgtgaatgacaatttgaacaacgtgtttcttcggcatgaacgcttcgaacggttccgcactgggcagaccacgaaagcacccagtgaagccgagcccgccgccgatctgattgacatgggcccagatcctgccgctacgggaaatctgtcaagtcagcttgccggatag

SEQ ID NO: 17186 - DNA, 5193 bp, Artificial Sequence
  Description of Artificial Sequence: Synthetic coding sequence
atgggcaactctgactctcagtatactctgcagggatccaagaatcacagtaatactatcaccggggcaaagcagattccctgctctctgaaaataagggggattcatgcaaaagaagaaaaatcactccacggttggggacatggatctaatggcgcgggctacaaaagtcgttccctggctcgatcatgcctgtctcacttcaagtcgaaccagccctatgctagtcgactggggggacccacctgtaaagtgtctagaggagtagcttattccacacatagaacaaatgcaccagggaaagactttcagggcatctcagcggcgttttcaacagagaacggtttccactcggtcgggcacgagctcgctgataaccacatcacttcacgagactgcaatggccacctactcaactgttatggtagaaatgagtccatagcaagtaccccccccggtgaagacagaaagtccccccgagtcctgattaaaacgctgggtaagctggacgggtgcttaagggtggagtttcacaatggcgggaatccctccaaggtgcccgccgaggattgcagcgaacccgtccagctcctgaggtactcccctacactagcttctgagacgtctcccgtgccggaggctaggaggggctccagcgcggattcgctgcccagtcataggcctagtcccacggactcgagactcagatccagtaagggcagttctctgtcaagtgagagtagttggtatgacagtccctggggtaacgccggcgagctctcagaggccgaaggcagctttctcgcacctggcatgcctgacccaagcctccacgcctcattccctccgggtgacgcaaaaaagccgttcaatcagagttcttctttgagttccctgcgcgaactttacaaggatgccaacctcggctctctctcgcctagcggcattcgattatccgacgagtatatgggcacacacgcctcactctccaatcgcgttagcttcgcttcagacattgatgtgccttcaagagtcgcccatggcgatcctatccaatattctagtttcactctcccttgcaggaagccaaaggcctttgtagaagacacagccaagaaggactctttaaaagcaagaatgaggcggattagcgactggacaggcagtctgtccaggaagaagaggaaactccaggaacccagaagcaaagaaggcagtgattacttcgacagccgctctgacggcctgaatacagatgtgcaaggcagctcacaagcttctgccttcctgtggtctggtggaagtacgcagattctgtctcagagatcagaaagtacccatgccatcggatcagatccactgcggcagaacatatatgagaactttatgcgggaactcgaaatgtcccgtacaaacactgaaaatattgagacaagtacagagactgccgagtcctctagcgagagtctatccagcctggaacagctggacttactgtttgagaaagaacagggcgttgtccgcaaggccggatggttgttctttaagccactcgttaccgtgcagaaagagcgcaaattagaactggttgcgcggcgaaagtggaagcagtactgggtgaccttaaagggatgtactctgcttttttacgagacctacggtaaaaactctatggaccagtctagtgcaccacgatgcgccctttttgccgaagactccattgtgcagagtgtgcccgagcaccccaagaaagagaacgtgttttgtcttagtaactctttcggtgatgtgtacctctttcaagcaacgtctcagactgacttggaaaattgggttacggccgttcatagcgcctgtgcaagtttattcgcgaaaaaacatggaaaagaggatactctgcggttgctcaaaaatcaaactaagaacctgttgcagaagatagacatggatagtaagatgaaaaaaatggctgaactgcagctcagtgtggtgtcagatccaaagaatagaaaggcaatcgaaaaccaaatacagcagtgggaacaaaatctcgaaaagttccatatggaccttttccgcatgcgctgctatctcgcctcactgcagggcggcgaactcccaaaccccaaaagcctgctggcagcagcctcacggccgtcaaagttagcacttgggagactggggatcctctcagtcagcagtttccacgctctggtgtgttcgcgcgatgattcggcccttcggaaaaggacgttatcactcactcagagaggtcggaacaagaaaggaatcttctcatccctgaagggtctcgacactctggctcggaaggggaaagagaaacgaccatcaattacacaggtggacgaactgctgcacatatacggtagcacagtcgatggcgtcccccgagacaacgcttgggagattcaaacttatgtccatttccaggacaaccacggggtcactgtggggatcaagcccgagcatcgggtagaggacattctgaccctggcctgcaagatgagacagctggagccatctcactatggccttcagctccggaagctcgtcgacgacaacgttgagtactgcatccctgctccatatgagtacatgcagcaacaggtgtacgatgaaattgaggtgttcccactaaacgtgtacgatgtgcagctgactaagaccggatctgtgtgtgactttggattcgctgttaccgcacaggtggatgaaagacagcatctgtccaggatctttatctcagacgtgctgccagatggcttagcatatggcgaaggcttacgaaagggcaacgaaatcatgacccttaacggggaagctgtaagcgacctcgacttaaaacagatggaagctcttttttcagagaagagtgtgggactcaccttaattgcgcggccaccagacactaaggccaccctctgcaccagctggagtgattccgacctgttctcccgcgatcagaagtctttgctcccaccaccgaatcagtcacagctactggaagaattccttgacaacttcaagaagaataccgcgaacgattttagcaatgtgcccgacatcacaacaggtctcaagagaagccaaacggatggtacactagatcaggtgagccatagagagaaaatggagcagacatttaggagcgccgagcaaatcaccgcactgtgcagaagcttcaacgactcacaggccaacggcatggagggcccaagagagaatcaggatccccctccccggtcccttgctagacatctcagtgacgctgatagactgcgtaaagtaatccaagaattagtggacacagagaaaagctacgtgaaggacttgtcgtgtctgttcgagctataccttgaacctcttcaaaatgaaacttttctgacgcaggatgagatggaaagcctattcggatcactgccagaaatgctggaattccagaaagtcttcttagagacgctggaggacggcatctcagctagctctgacttcaacacactcgagacaccatcccagttccgaaagctccttttctctctcgggggctcttttctttattatgcagaccacttcaagctgtactccggattttgcgccaaccacatcaaagttcagaaggtgttggagagggcaaagaccgacaaggcgtttaaggcgtttctcgatgcacgtaatcctacgaagcagcatagcagtactctcgagagttatctgatcaagccagtgcaacgggtcctcaaatacccccttctcctgaaggaattagtctcactgacagaccaggagagcgaggaacactaccatctgactgaagccttgaaggccatggagaaggtggcatcccacattaacgaaatgcagaagatttacgaggactatggaaccgtgttcgatcagctggtagccgagcagtctggtaccgaaaaggagcaaccagagtggtcttctgaagtcatggatgtgttagacccccgtggtaaactgaccaaaggaactctggaggaaccgagaacactggtgacagagctctcaatgggcgagctgctgatgcatagtaccgtaagctggctcaaccctttcctctcgttaggaaaggccagaaaagacctggagcttacagttttcgtgtttaaacgggccgtcatcctggtgtacaaagagaactgcaagttgaagaagaaactgccctccaattcccggccagcccacaacagcacagatctggacccattcaaatttaggtggttgattccgatctccgcacttcaggtgagactgggtaacccggcgggaactgaaaacaattcaatctgggagctcatccataccaaatctgaaatcgagggccgtccagagaccatcttccaactgtgctgcagcgacagcgaaagtaagacaaatattgtgaaagtgattagatcaatccttagggaaaatttcaggcgacacataaaatgtgaactgcccctggagaaaacttgcaaagacagactggttcccctgaaaaatagagtccccgttagcgctaagcttgccagcagtcgctccctgaaagtgttaaagaatagcagctctaacgagtggaccggagagaccgggaaggggacgctcctggattccgacgaaggatctctctcctctggaacccagagctccggctgtcccacggctgaggggagacaggacagtaagagcacatcacctggtaaatacccccacccaggattagccgattttgcggataatcttattaaagagtccgacatcctgtctgacgaagacgatgaccacagacagacggtcaagcaggggtccccaactaaagacatcgagattcaattccagcgcttacgcatttcggaggaccctgatgtccaccctgaagctgaacaacagcccggcccagagtccggggaggggcagaagggaggggaacaacctaagttggttcggggtcacttctgtccaatcaagcgcaaggcaaattcaactaagagagatagaggcactctgctgaaagctcagatccgacaccaatcactcgactctcaatcagaaaacgcgactatagacctaaatagcgtgctggaacgggaattttccgtacagagcctcacgtctgtggtcagcgaagagtgtttctatgagaccgaaagtcacggcaaaagctag

SEQ ID NO: 17187 - DNA, 348 bp, Artificial Sequence
  Description of Artificial Sequence: Synthetic coding sequence
atggccccagctaagaagggtggagagaagaagaagggccgtagcgccattaacgaagtagtcaccagagaatataccatcaatatacataagcggatacacggagttgggtttaagaagagggccccgcgtgcactcaaagagatacgcaagttcgctatgaaggagatgggcactcccgatgtgcggatagacactagactcaataaagctgtttgggctaaaggtatccgaaacgttccctaccgcattagagtgcggttgtccagaaaacgaaatgaagatgaggactcacccaacaagctgtacactctcgttacctatgtccctgtgacaacatttaagtag

SEQ ID NO: 17188 - DNA, 747 bp, Artificial Sequence
  Description of Artificial Sequence: Synthetic coding sequence
atggcattagaggtcggcgatatggaggatggacaactgtccgactctgacagtgacatgaccgttgcaccctcagacaggccgttgcagctgcctaaagtgctcggtggcgactctgcaatgcgagctttccaaaatactgctacagcctgtgcccctgtctcccactacagggccgtcgagagtgtggattccagtgaggaatccttcagtgacagtgacgatgactcgtgcttgtggaagaggaaaagacagaaatgctttaatccacctcccaagccggaaccttttcagtttgggcagagttcccagaagccacctgtagctggcgggaagaagataaacaacatttggggggctgtgctgcagaagcttcgaaaagaaagccaggagcacacaaaagacctggataaggaattggatgagtacatgcatggaggcaagaagatgggcagtaaggaggaggagaacggccagggtcacctgaagaggaaacggcccgtgaaggatcggctgggcaaccgtccagaaatgaattacaaggggcgctacgaaatcacagctgaagactcccaagaaaaggtagcagatgaaattagcttcaggctgcaggaacctaagaaagacctgattgcacgagtggtccgcaacaagctccgtactttctccactctcaaaaccaagcgaaatatgaaaataaaaaagttactggggcgaggcgagcacaaatgctgggggaagaggtag

SEQ ID NO: 17189 - DNA, 78 bp, Artificial Sequence
  Description of Artificial Sequence: Synthetic coding sequence
atggccatggctccttcacccagtctagtgcaggtgtatacttcaccagccgctgtcgccgtgtgggaatggcagtag

SEQ ID NO: 17190 - DNA, 171 bp, Artificial Sequence
  Description of Artificial Sequence: Synthetic coding sequence
atgagctattatcagaggccgttttctcccagcgcttacagtctgcctgcaagcctgaattcttctatcgtcatgcagcacggaacttccctggacagtaccgatacatacccccaacacgcccagagcctggatgggactacctcttcctctatccccctgtacaggtag

SEQ ID NO: 17191 - DNA, 450 bp, Artificial Sequence
  Description of Artificial Sequence: Synthetic coding sequence
gtcagggaactggaagcggaactggacgccgaacagaagaagcacgccgaagctctgaagggcgtcaggaagcacgaacgccgcgtgaaggaactggcatatcaagccgaagaggataggaagaacctggctagaatgcaggacttggtcgacaaattgcaatctaaggtgaaaagttataaaaggcagtttgaggaagctgaacaacaagctaatactaatctagctaaatatcggaaggcccagcacgagctggatgatgccgaggaacgggcagatatggctgaaactcaagcgaataaactgcgcgcccggaccagggacgctctcgggcccaaggtgcgaagtggccggggtatcgctctatgtgcgggggggctgtggggactcacaggatctaccgctcactcagccattcccttctccagcgcgcaaggtgtgactgcatag

SEQ ID NO: 17192 - DNA, 468 bp, Artificial Sequence
  Description of Artificial Sequence: Synthetic coding sequence
tccaacgtgatggaagcgaacgctgccagacaagcaactccagctgaatggagccaggacgactcaaatgatatgtgggaggaccaggaagaggaagaggaagaagaggaggatggtttggctgggcagctcctctcagatatactcgcaactagcaaatacgaggaggactactacgaagacgatgaggaggatgatcccgatgcgttaaaagaccccctttaccaaattgatctgcaggcaaccctcatgaccatgcggggtgagttctacagaccttctgcaagtaaaaagggcagtctgagtacttttgccccttctggacccgcggcgaatcattttgcggccctaacagggctagagatgcatttccttctcaacctcaaatggcatctggatccctggcctctggcttccgccgtaactctgatgacaatccagactcggcttacaggggcggtgacgtag

SEQ ID NO: 17193 - DNA, 1620 bp, Artificial Sequence
  Description of Artificial Sequence: Synthetic coding sequence
atggcaacatcagctcccctccgctccttagaggaggaggtgacatgctccatttgtcttgactacttacgggaccctgtgacaattgattgcggacatgtattctgtcgtagttgtactactgatgttcgtcccatatccggcagtcgccccgtttgtcccctctgcaagaaacccttcaaaaaagagaatatccgtcccgtgtggcagctagcgagcctggtcgagaacatagagcggctgaaggtggacaagggcaggcagcctggtgaggtcaccagagagcagcaagatgcaaaactctgcgagcggcatagggaaaaactccactattattgcgaggacgacggtaaactgctctgcgtgatgtgcagagaatcaagagaacacaggccgcatacagcggtgctcatggagaaagcagcacagccacatagggaaaagattttaaatcatctgagtaccctcagacgggatcgggacaagatccaaggcttccaagcgaaaggagaggccgatattcttgcagcactgaagaagcttcaggatcaacggcaatacatagttgcagaatttgagcagggtcatcagtttcttcgggagcgcgaggaacatttgcttgagcagctggcgaagctcgagcaggagcttacagaggggagggagaagtttaagtcacgcggagtaggcgagctggctcggctggctctcgtgatttcggagctggaaggaaaggcccagcagcccgctgctgagctgatgcaggatactcgtgactttttgaatcgatatccgaggaagaagttttgggtggggaaacctattgcccgggtggttaagaagaagaccggtgagttctccgacaaactcctgtcactccaacgggggctgagagaattccagggtaagcttttaagagacctcgagtacaagacagtgtctgtgactctggatccacagtccgcgagcggctacctgcagctcagtgaagactggaagtgcgtgacttacacctcgctctataaaagtgcttacctgcatccacagcagtttgattgcgagcctggcgtgctgggaagcaaaggcttcacctgggggaaggtgtattgggaagtcgaggttgagcgggaaggatggtccgaagatgaggaagagggtgatgaagaggaagaaggagaagaggaagaggaggaggaggaagcaggatacggcgacggatatgacgactgggaaacagacgaggatgaagagagcctgggagatgaagaggaagaggaagaagaggaggaggaagaggtgctggagtcatgtatggttggggtagcccgagatagcgtaaagcgtaagggggatcttagcctgcggccagaagacggggtatgggccctcagactttcttcttcaggcatttgggctaacacaagtcccgaagccgagttgttccccgccctcagaccgcggagagtgggaatcgccttagactacgaagggggaacagtcacgttcactaatgcagagtctcaggaacttatttataccttcacggcaactttcactaggcgtttagtgcctttcctctggctgaagtggcccggaactcggcttcttctgagaccctag

SEQ ID NO: 17194 - DNA, 645 bp, Artificial Sequence
  Description of Artificial Sequence: Synthetic coding sequence
atgccttcaccctgggggtggttcgccgtaactgcgtgtggtgctcagcggaacaattttgaagagcctgtagctctgcaggaaatggacacttctaatggagtgctattgcctttctacgatcccgactctagtatcgtatacctgtgtggaaagggcgactcctccattcgttatttcgaaataaccgatgaacccccattcgtacattatcttaacacattctctagcaaagaacctcaacggggaatgggattcatgcccaaacgagggttggacgtctcaaagtgtgaaatcgcacgtttttacaagctgcatgagcgtaagtgtgaacccatcattatgaccgtgcctcggaaaagtgatctgttccaggacgccgagcctgtgctcatctcattaagagacgggtatgtccctcctaagcatagagagctccgggttacgaaacgcaatatactggacgtgcggcccccatcgggaccccgtcgatcacaatccgctagcgacgctccgctgtcacagcacacattagaaaccctgctagaggaaatcaaggcgcttagagaaagagtgcaggcacaggagcagagaattactgctctggaaaacatgctgtgtgagctggttgatggcactgattag

SEQ ID NO: 17195 - DNA, 690 bp, Artificial Sequence
  Description of Artificial Sequence: Synthetic coding sequence
atgctgcagctgcgcgattccgtcgactccgcgggaacatcacctactgcagtgctggccgccggagaggagcccggaagcatcgaacaagctgttgaagaaataagggttgtagttcgacctgtggaggacggggagatacagggcgtatggctgctaaccgaggtggaccattggaacaacgaaaaagagcggctggtcttagtcaccgagcagtcgttgctgatatgtaaatacgattttatttcactacagtgccaacaagtggtacgtattgccctgaacgcagtcgacactatctcctatggcgaatttcagttcccacctaagagcttgaacaagagagagggattcggcatcagaattcagtgggataaacagagtcgaccatccttcatcaataggtggaacccttggagtaccaatgttccatacgcaacatttacagaacaccccatggccggcgccgacgagaaaacagctagcctgtgccagctcgagtccttcaaggcgctgcttatccaggccgtcaagaaggctcagaaagagagcccactcccgggacaggctaatggagttctcatcttggaacggcctctgttaatcgaaacctacgtggggctgatgagctttatcaacaacgaggccaagcttggttactcgatgaccaggggtaagataggtttttag

SEQ ID NO: 17196 - DNA, 390 bp, Artificial Sequence
  Description of Artificial Sequence: Synthetic coding sequence
atgtgcgaagtctcacgcggctggaaaccatgcacagaaggtattctaaaagtgcgtccaacacggaagatctcttacgaagggaatattacccccaccgtggagctaaatgccctttgcatgaagctggggaaaaaacctatgtacaaacctgttgatccctattctaggatgcagtccacctacaattacaatatgaggggaggggcctacccgcctcgctacttttacccttttcccgtccctcccctgctgtaccaggtggagctgagcgtggggggacaacagtttaatggtaagggtaagacgcgacaggctgccaaacatgacgccgctgccaaagctctccgcatccttcaaaacgaacctttacctgagcgcctcgaatag

SEQ ID NO: 17197 - DNA, 3042 bp, Artificial Sequence
  Description of Artificial Sequence: Synthetic coding sequence
atggacctctttaggatgcggtgctaccttgcctccttacaggggggggagctcccaaacccgaaatcattgctggccgccgcctcccgccccagtaagctggcactgggcaggctgggcatacttagtgtgtctagttttcatgctcttgtttgctctcgggatgattcagcattacgtaagcgaacactgtccttgacacagcgaggtaggaataaaaagggcatcttttcttccttgaagggacttgatacgctggccaggaagggaaaagaaaagagaccaagtatcacccaggtggacgagctgctccacatttatggatcaacagttgacggggtgccgcgagataacgcatgggaaatccagacttacgttcacttccaggacaatcacggcgtgactgttggaatcaagcctgagcaccgcgtcgaggatatactaacactggcttgtaaaatgcgccagctcgagccttcacactacggcctccaattgcgtaagctggttgatgacaacgttgaatactgcatccccgccccgtacgagtatatgcagcagcaagtttatgatgagatcgaggtgtttcccttaaacgtgtacgacgtccagttaaccaagacaggatcagtgtgcgatttcggattcgccgtaactgcccaagtcgatgagcggcagcacctcagtagaatctttatctccgatgttttgccagatggtctggcttacggcgaaggtctgagaaaaggcaatgaaatcatgacacttaacggcgaggcagtatccgatctggacctgaagcagatggaggcactattctcagagaaaagcgtggggttaacgctgattgcccgaccccccgatactaaagcaacactctgcacatcctggtctgacagtgatctcttctccagagaccagaagagcctgctgcctccacctaatcagtcccagttgctggaagaatttttagataatttcaaaaagaatactgccaacgactttagtaacgtgccagacattaccacaggccttaagcggtctcagaccgacgggacgctggaccaggtatctcaccgcgagaagatggaacagacctttcgcagcgcagagcaaatcacagctctttgtagatctttcaatgattcgcaagccaacggcatggaaggcccccgcgagaaccaggaccctccaccaaggtctctagccagacacctgtcagatgccgaccggttacgcaaggttatacaagaactggtggacactgagaagagctatgttaaggatctgtcatgtctgtttgagttgtatcttgaaccgttgcagaatgagaccttcctcacacaggatgaaatggagagtcttttcggtagcctccctgaaatgctggagttccagaaagtctttctcgaaaccctcgaggacggaattagtgcttcgtccgatttcaacacactggaaactccgtcacagtttaggaaattgttgttttcacttggaggctcctttctttactatgcagaccattttaaattatacagtggcttctgcgccaatcatatcaaggtgcagaaagtgctggagcgagcaaagaccgacaaagccttcaaagcatttctcgatgccaggaacccgactaaacagcacagcagcacccttgagagctacctgatcaagccagtccagcgggtcctgaagtaccctctgttgctgaaagagctagttagtctgaccgaccaggagtctgaagagcactaccacctgaccgaagcgctgaaagcaatggagaaggtcgcctctcatattaacgagatgcaaaaaatttatgaggactatggaaccgtgtttgaccagctggtggcagagcagagtgggacagaaaaggaagtaactgaactgtctatgggagaactgctcatgcattccactgtaagttggcttaacccattccttagtctggggaaagcccgcaaggacctggagcttaccgtatttgtgtttaagagagccgtaattcttgtctacaaggaaaattgcaaacttaaaaagaaactcccatcaaactcccgacctgcccacaattctaccgacctggacccttttaagtttcgctggttgattcctatatccgctcttcaagtaagactggggaaccctgccggcacagagaataacagcatctgggaacttatccatacgaaaagcgagatcgaagggcggccagagaccatctttcaactgtgctgttcagattctgaaagcaaaacaaacatagtgaaagtgatcagatcaattttgagagaaaacttccgtcgccatataaagtgtgaacttcctcttgagaagacctgtaaggaccggctggtgcccttaaaaaacagagtcccagtttccgctaaactcgcaagctcccgctctctcaaagtactgaaaaactcgtcgtccaatgaatggactggagaaaccggcaaggggacccttctggacagtgacgagggcagcctcagctctggcacacaaagttccgggtgtccgaccgccgaaggccggcaggacagtaagtccacatctcctgggaagtacccacaccccgggctcgccgatttcgcggataacctgatcaaagagtccgatatcctttctgatgaggacgacgaccaccggcagacagttaaacagggctcacccaccaaagacatagagatccagttccagagactgcgcattagcgaagacccagatgtgcatcccgaagctgaacagcagccaggacctgaatccggcgagggccagaagggcggtgagcaaccgaaactggtgagggggcatttttgccccatcaagcgaaaggcaaattcaaccaagagggacaggggcacactgctcaaggcacagattaggcatcagagtcttgattcccagagcgaaaatgctacgattgatctcaacagcgttctcgagagagaattctcagtgcaaagccttacatctgtggtgtcagaggaatgcttttacgaaacagagtcacacggaaaatcttag

SEQ ID NO: 17198 - DNA, 1149 bp, Artificial Sequence
  Description of Artificial Sequence: Synthetic coding sequence
atggcggctaatctatcacggaatggccccgccctccaggaagcttacgtgcgggtagtgactgagaaatcccctacagactgggccctatttacgtacgaaggaaattcaaatgacataagagtggctggaactggtgagggtggcctagaggagatggtcgaggagctcaactcaggtaaagtgatgtatgcgttctgtcgggttaaagacccgaattccggtttgcctaagtttgtgctgattaactggacaggcgagggcgtcaatgacgtcagaaaaggcgcctgtgcttcccacgtgtccacgatggcatcttttttaaaggggagcgtgtaccagaagaccaatgctgttagcgagattaagcgggtaggcaaggacagtttctgggctaaagctgaaaaagaggaggagaaccgcagactggaggagaaaagaagagccgaagaggcccaacgccagctggagcaggagagacgggagcgggagctgagagaagccgctcggagggagcagcggtaccaagagcaagggggcgaagctagtcctcaatctcggacctgggagcagcagcaggaggtcgtgtctcggaatcggaatgagcaagagagtgctgtgcaccctcgtgagatttttaagcagaaagaacgggctatgtctacaacttctatttcgagccctcagccgggaaaactccggtcaccttttttgcagaaacagctgacacagccagagacccactttggtcgcgagccagcggctgccatatctcgccctcgcgccgacttaccagcagaagaacccgccccatccacgccgccttgtctggttcaggccgaagaagaggctgtatatgaagagccaccggagcaagagaccttctatgagcaaccacccttggtgcagcagcagggcgcagggtccgagcacatagaccatcatatccagggtcagggcttgtcggggcagggtctttgtgccagggcgctctacgactaccaggccgccgatgatacggagatttccttcgatcccgagaatctgatcacgggcattgaggttattgatgaggggtggtggcgcggatatggccctgatggacactttggcatgttccccgctaactacgtagagcttattgagtag

SEQ ID NO: 17199 - DNA, 660 bp, Artificial Sequence
  Description of Artificial Sequence: Synthetic coding sequence
atggtggtgttatctgtgcccgccgaggtgaccgtaattctgctggatatcgagggaactacaacgcccattgcatttgtaaaagacattcttttcccttatattgaagaaaatgtgaaggagtacctgcagacacactgggaggaggaagagtgccaacaggacgtatccctgctgcgtaagcaggctgaggaagatgctcacctcgacggcgctgtccccatccctgccgctagcggcaatggtgtcgacgaccttcagcagatgattcaggccgtggtcgacaatgtgtgctggcagatgagcctcgatcggaagaccacagctttgaagcagttgcagggacacatgtggagggcggccttcacggccggccgcatgaaggctgaatttttcgccgatgtcgttcccgccgttcgcaaatggcgagaagccgggatgaaagtgtatatatacagtagcgggagtgtagaggcccagaagctgctgttcgggcactcgactgaaggcgatatcctcgagctggtggacggccacttcgacactaaaattggacataaggtggaatctgagtcctacaaggattgtaggcagcactgggtcttgaaccagcagcacttcgtcagtgatagatgctattcacgcggacagtgctgctag

SEQ ID NO: 17200 - DNA, 1446 bp, Artificial Sequence
  Description of Artificial Sequence: Synthetic coding sequence
atggcaagcgctgctagcgtcaccagcctagcagacgaggtgaactgccctatctgtcagggaaccctgcgggagccagtgactattgactgtgggcataacttttgtagggcttgccttacgcgctattgcgaaatccctggcccagatctggaagaaagcccgacgtgccctctctgtaaggaaccattccgtcccgggagtttcaggccaaactggcagcttgctaatgtcgtcgagaatattgaacggcttcagctcgtgagcactctgggactgggtgaggaggacgtgtgccaagaacacggtgagaaaatatactttttctgtgaggatgacgagatgcagttatgcgtggtatgtagggaggcgggtgaacacgccactcataccatgcgatttctggaagacgctgctgcaccataccgagagcaaattcataaatgcttgaagtgcctccgcaaggaacgtgaagaaattcaggagatacagtccagggagaataagaggatgcaagtgctgctgacccaggtttctacaaaaaggcaacaagttattagcgaattcgcccatcttagaaaatttctggaagaacagcagtcgatcctgctcgcccaactggagtcccaagacggcgatatcctgcgccagagagacgaattcgacctgctggtcgctggggagatctgccggttttctgccctcatcgaagaactggaagaaaagaatgagaggcctgctcgagagctcctgaccgatatccggtcaactctgatccgatgcgaaactaggaaatgccggaagcctgttgctgtctctcccgagctaggccagcgaatccgcgatttccctcaacaggcactgcctctgcagcgggagatgaagatgtttctggaaaagttatgttttgaattggattacgagccagctcacataagtctagaccctcaaacttcacaccctaagctgctgttaagtgaggatcatcagagagcccagttcagctataagtggcagaattcccctgacaacccgcagcgtttcgatcgtgcaacctgcgtgctcgcacatacgggcataactggtgggcgtcatacttgggtggtgtcaatcgatctggcccatgggggcagctgtacggtgggggtggtgagcgaagatgttcaaagaaagggtgaactacggcttcgccccgaggagggagtgtgggcagtcagactggcctgggggttcgttagtgctctaggctcattccccacccgcttgacactgaaagaacagccaagacaggtcagggtgtccctggactacgaggtgggatgggtgaccttcaccaatgctgtgaccagggagcccatatataccttcaccgcatcattcactcggaaggtaatccctttctttggtctgtgggggagaggtagtagcttctccctcagtagctag

SEQ ID NO: 17201 - DNA, 1644 bp, Artificial Sequence
  Description of Artificial Sequence: Synthetic coding sequence
atggccggaactaagaataagacgcgggcacaggctaagacagagaagaaggcagccattcaagcaaaggctggcgccgagagagaagccaccggtgtggtgagacccgtcgccaaaacgagggcaaaagccaaggctaagactggctctaaaaccgatgcggtggccgagatgaaggcagtgtcaaaaaacaaagttgtagccgagacaaaagaaggcgccctgtccgagcctaagactcttggcaaggccatgggcgacttcactcctaaagccggcaatgaaagtacctcgtctacatgtaaaaacgaggctggaaccgatgcctggttttgggctggtgaggaggcaactatcaactcctggttctggaacggcgaagaggcgggcaactctttcagcaccaagaacgataaacccgagattggcgcgcaggtctgtgcagaagagttggagccagccgccggcgccgattgtaaacctcgctccggcgccgaggaggaggaagaagagaatgtgattggaaattggttttgggagggcgatgatacgtcgttcgatccaaacccaaaacctgtctcacgtatcgtgaaacctcagcctgtttacgagattaacgagaaaaaccggcctaaagattggagtgaagtgaccatctggcctaatgctccagccgttactccggctgtgcttggctttcggtcccaggcaccatcagaagcctccccgccctcttacatcgtgctggcctccgctgaggaaaacgcttgcagtttgccggtggccactgcatgcagacctagcaggaatacccgttcctgtagtcagccaatccccgagtgtcgcttcgactctgatccctgcattcagacgattgatgaaatcagacggcagatccggattcgggaggtgaatggaatcaagcctttcgcctgtccttgcaaaatggagtgctacatggacagtgaagaattcgagaaattagtgagtttgttaaagagcactactgatcctctgattcacaagatcgctagaatcgccatgggggtgcataatgttcaccccttcgcacaggagtttataaacgaggtcggggtggtcaccctgattgagagtttgctgtcctttccctctcctgagatgcgaaagaaaacagttatcacactgaacccacctagcggggatgaacgtcagcgtaaaatagagctgcacgttaagcacatgtgcaaagagactatgtccttcccccttaactctcctgggcagcagagtggactgaaaattctaggccagctgacgactgacttcgtgcatcactacatcgttgccaactatttcagtgaactgtttcacctcctgagctctggcaactgcaagaccaggaacttagtgctgaagctgctgttgaatatgtccgaaaaccctaccgctgctcgtgatatgatcaacatgaaagctttggcggctcttaagctgatatttaaccaaaaggaagcaaaggcaaatctggtaagcggagtcgctattttcatcaatattaaagaacatatccgcaaaggctcaattgtggtggtggatcacctctcatataacacacttatggccatattccgagaggtcaaggaaataatagaaacaatgtag

SEQ ID NO: 17202 - DNA, 1887 bp, Artificial Sequence
  Description of Artificial Sequence: Synthetic coding sequence
atgagcgacaaatcagacctgaaagctgagttagaaagaaaaaaacagcggctggctcagataagggaggagaagaagcgaaaggaggaagagagaaaaaaaaaggaagctgacatgcagcagaagaaggagcctgtccaggatgacagcgacctggatcggaaaaggagggaaaccgaggctctgctccagagcattggcatctcccccgagccacctttggtccctacacctatgtctccaagttccaaaagcgtgagcacaccgagtgaggccggctctcaggacagcggtgatcttggccctctgacacgcacccttcagtgggacacagacccatcggttcttcagctgcagagtgactcggagctaggcagacgcctccataagttgggcgtgagtaaagtgacccaggtggacttcctgcctagagaagtcgtgtcctactctaaggaaacacagacgccacttgcaactcatcagagtgaagaagacgaggaagatgaggaaatggtggaaagcaaggtcggacaagattccgagctggagaatcaagacaaaaaacaggaagttaaagaagctcctcccagagaactgacagaggaggagaagcagcagattctacactctgaggaattcctgattttctttgacaggaccattcgcgtgatcgaacgcgccttagctgaagactcggacattttctttgattacagtggccgagaactggaagagaaggatggtgatgtgcaggctggagcgaatctgagcttcaatcggcagttctatgatgagcactggagtaaacacagagtggtgacctgcatggattggagcctgcagtaccctgaactaatggtcgccagctataacaacaatgaggacgccccccatgagcccgatggcgtggcactcgtttggaacatgaagtttaagaagacgacccctgagtacgtctttcactgccaatctagtgtgatgtctgtgtgttttgctcggtttcatcccaatctcgtggtgggggggacctacagcggccagatcgtcctgtgggacaataggagtcacagaaggaccccagtgcagaggacaccactgagcgccgccgcccatacccaccccgtctactgtgtgaacgtggtgggaactcagaatgcccacaatctgattaccgtgtccaccgacggaaagatgtgtagctggagtctggatatgctgagtacaccccaggagtccatggagctggtgtacaataagagcaaacccgtggccgtaacgggcatggcctttcccaccggagacgtaaacaatttcgtcgtcggctccgaggaggggactgtatatacggcttgtaggcatgggtcaaaagctggaatcggagaagtcttcgagggtcaccagggccccgtgacaggcatcaattgccacatggcagtggggcctatagatttctcccatctgttcgttactagttccttcgactggacagtaaagttgtggacaaccaaacacaataagcctctgtacagcttcgaggataatgccgattacgtctatgacgtgatgtggagccccgtgcaccccgccctcttcgcatgtgtcgacggtatgggcaggctggacctctggaacctgaacaacgacaccgaagtgccaaccgccagcgtggcaattgagggcgcttcagcattaaaccgagtccgctgggcgcaggcgggcaaggaagtggcagtaggagatagtgagggacgtatctgggtatacgatgttggagagttggctgtccctcataacgacgagtggacccggttcgccagaaccttagtggagatccgtgcgaatagagcagatagcgaggaggaaggcactgtggagctatccgcttag

SEQ ID NO: 17203 - DNA, 474 bp, Artificial Sequence
  Description of Artificial Sequence: Synthetic coding sequence
atgaggagtgggtttagatgcgatgaaccagccgaggccgtggccccagaaagacagacagtttccggagccgtcgccttggcttcttttacatctccccacactcaccccgtcgatgacggggggcgtcactatagttgggggagtcctaagaggatccttggccttggtcccggggacgctgctaaagaggccggtttggtgagaccccttcaggggcagagtgagaagattctgctacgcacacgcaatagacagccaatggaaccaccaatggagccgagcggaggcgagcaagaacccggtgccgtgcgattcctggatctcccatgggaggatgtgctgctgccccatgtgctgaatagggtgccactaaggcaactcttgcggctgcagagagtctcacgcgctttccggtccctggtgcagctccacctggccgggctgcggaggttcgacgcagcgcaggtgtag

SEQ ID NO: 17204 - DNA, 483 bp, Artificial Sequence
  Description of Artificial Sequence: Synthetic coding sequence
atggaagccgagagaccacaggaggaagaagacggggagcaaggccccccccaagacgaagaggggtggccaccccctaactctacaacccgaccttggcgctctgctcctccaagccctccacctccgggtactcgccacactgcgttgggtcctagatccgctagccttctgtccctgcagacggagctcttacttgacttggtcgccgaagcccagtctcgaagactggaggaacagagggcaaccttttacacacctcaaaatccttcctctctggccccagcccctctcaggcccctcgaagatagggaacagctttattcaaccatcctttctcaccagtgtcagagaatggaggcccagaggagcgagcctcccctccctccggggggacaggagttgttagaacttctgcttagagttcaaggtgggggcaggatggaggagcagcgatcaaggccacccactcatacgtgttag

SEQ ID NO: 17205 - DNA, 402 bp, Artificial Sequence
  Description of Artificial Sequence: Synthetic coding sequence
atggctgccctgcgtccattggtcaagccaaaaattgtcaagaaaaggaccaaaaagttcataaggcaccaatccgatcgttatgtgaagataaaacgaaattggcggaaaccgaggggaattgacaatcgagttcgccggcggtttaaggggcaaatcctgatgcctaacatcggctatggctccaacaaaaagactaaacacatgctaccaagcggctttcggaagtttctggtccataacgtgaaagaactcgaggtactgctcatgtgcaataagtcttattgcgccgaaatcgcccataatgtgtcttcaaaaaacagaaaggcaatcgtcgagcgtgctgctcaactggcaattcgcgtcaccaacccaaatgcaagactgaggagcgaagaatag

SEQ ID NO: 17206 - DNA, 639 bp, Artificial Sequence
  Description of Artificial Sequence: Synthetic coding sequence
atggacttgtttggagacttgccagaacccgagcggagtcctagaccagccgccggcaaagaagcacaaaaaggtccacttctgttcgacgacctacctcccgccagcagcacagattccggatccgggggccccctcttgtttgatgacctccctccggcgagttcgggagacagtggatctttagctaccagtatctcccagatggtaaagacggagggtaagggggctaaaagaaaaacctcggaagaggagaaaaacggttccgaggagctggtcgaaaaaaaagtgtcaagcagcgtcatcttcgggctgaaaggttacgtggccgagcgtaaaggcgaacgtgaagaaatgcaggatgctcatgtgatcctcaatgacattacagaggaatgtagacctccttcgtccctgatcactcgggtgagttactttgccgtcttcgacggccacggtggcatcagagcctctaaatttgcagcacagaacttgcaccagaacctgattcgcaaattccctaaaggagatgtgatctctgtggagaagaccgtgaaaagatgtctgctggatacatttaagcatacagatgaggaatttttgaaacaggccagctctcaaaagcctgcatggaagtag

SEQ ID NO: 17207 - DNA, 1131 bp, Artificial Sequence
  Description of Artificial Sequence: Synthetic coding sequence
atgcccttacaggtcagcgactactcatggcaacaaaccaagaccgcggtgttcctctcactccctctcaaaggggtgtgtgtacgggataccgacgtattttgtacagagaactacctcaaggtgaactttcctcctttcctgttcgaggcgttcctttacgccccaatcgatgacgagtccagcaaagctaagatcgggaatgacactattgtgtttacactgtacaagaaggaggctgcaatgtgggaaacacttagcgtgaccggtgtggacaaggagatgatgcagaggattagggagaaatccattctgcaagctcaggaacgagcaaaggaagcaaccgaggctaaggctgctgccaagcgtgaggaccagaaatatgcactgtctgttatgatgaagatcgaggaggaggagcgcaagaagattgaagatatgaaggaaaatgagaggattaaggcaacgaaggcattggaagcatggaaggagtaccagagaaaggctgaggaacagaagaagattcagagggaggagaaactctgtcagaaagagaagcagattaaggaagagcgcaagaagattaaatataaatccctgaccaggaacctcgcctcgcggaatctcgctcccaaaggaaggaactcagagaatatcttcactgaaaaacttaaagaggactccattcccgctccaagaagcgtgggcagcataaaaattaatttcaccccacgtgtgtttcccacggccctgcgggagtctcaggtagccgaggaagaagagtggctccataagcaagccgaagcccgccgcgccatgaacacagatattgcagaactttgcgacttgaaagaggaggaaaaaaaccctgaatggttaaaagataagggaaacaagctgtttgcaaccgaaaattaccttgcggctatcaatgcatataaccttgctatcagactgaataataagatgccgcttctgtacttgaatagggccgcgtgccacttgaagttaaagaatctgcacaaagcaatcgaggatagctccaaggcgtacagaattatgaagagacatctgaggctaatacacccaaccaagctgtataagctaatgttgaggcggtttggaatgtag

SEQ ID NO: 17208 - DNA, 1485 bp, Artificial Sequence
  Description of Artificial Sequence: Synthetic coding sequence
atggccgctgccgccgagtgcgacgtggtgatggcggcaactgaaccagagctgctcgacgatcaagaggcgaaacgggaagccgagacttttaaggagcaggggaacgcgtattatgctaaaaaagattataacgaggcctataactattacacaaaggccattgatatgtgcccaaagaacgctagttactacggcaaccgggccgcgaccctcatgatgctaggccggttcagggaggcacttggagacgcccagcaatccgtgagactggacgactctttcgttcggggacacctaagagaaggtaagtgtcatttgtcactgggcaacgcgatggctgcgtgtcggtctttccaaagagcactcgaacttgaccataaaaacgctcaggcacagcaagaatttaaaaacgccaacgctgtgatggaatatgaaaaaatagcagagacagactttgagaagcgggattttaggaaggttgttttctgcatggatcgtgctttggagttcgcgcctgcatgtcaccgctttaagatcttgaaggccgagtgccttgccatgcttggtaggtacccagaggcgcagtcagtggctagcgacatcctacggatggacagcacaaacgcagatgcactctacgttcggggcttatgtctgtattacgaggattgtattgaaaaggccgtccagttctttgtgcaggcactgcgtatggctcctgaccatgagaaggcctgcattgcctgtcggaatgccaaggctctgaaggcaaagaaggaggatgggaataaggccttcaaggaggggaactataagttggcctacgaactgtacacagaagcattaggtattgaccccaataacataaagaccaatgccaaactctattgcaacaggggaacagtgaattctaagttgaggaagttagatgacgctatcgaggactgtactaacgccgtcaaactggacgacacttacattaaagcttacctaaggcgcgcccaatgttacatggataccgagcagtatgaagaggcggtgagggactacgaaaaggtgtaccagacagagaaaacaaaagagcataagcagctgctgaagaacgcccaactggagttaaaaaaatccaaaaggaaggactattataagatcttgggggtggataagaacgcaagtgaggacgagattaaaaaggcctataggaagagagccttaatgcaccatcctgatagacactccggcgccagcgccgaggtccagaaggaagaggaaaagaagttcaaggaggtcggggaagcctttaccattctgtcggatcccaaaaaaaagacaagatacgattctggtcaagacctagacgaggaaggaatgaatatgggcgactttgatcccaacaacatcttcaaggcttttttcggaggtcctggcggatttagtttcgaggcttccgggcctggcaacttcttcttccagtttggatag

SEQ ID NO: 17209 - DNA, 1329 bp, Artificial Sequence
  Description of Artificial Sequence: Synthetic coding sequence
aacgaagtgtacaatctcacccaggaattctttcggcacgacaagcccgtaaatgcggagagtcaaaatagcgttggcgtgttcactagagaagaggtccgcaatcgcatcagaaacgatcctgatgacccagaggcgactaaacgtttgaagctcgccatgatccagcagtacctgaaagtagaaagctgtgaatcgtcatcacacagtatggatgaggtgtctctgtccgcattcggggagtggacagaaatacccggggcccaccatatcatcccatctgggttcatgagggtcgtggagctgctggccgagggcatccccgcccatgtgattcagctgggtaaaccagttcgatgcatccactgggaccaggcttcggcccggccaagggggcctgaaattgaaccgcgaggagaaggtgaccacaatcacgatacaggtgagggagggcagggaggtgaagaaccccggggcggaagatgggacgaggatgaacaatggtcggtcgttgtcgagtgtgaggactgtgagttaatcccagctgatcacgttatagtgactgtgtccctgggcgtgctgaaaagacaatacacatccttttttcgccctggcttgcctactgagaaggtcgcagctatccatcggctggggatcgggacaacagataagatcttcctcgagttcgaagagcctttctgggggccagagtgcaacagcctgcagttcgtctgggaggatgaggctgaatcccatacgctcacataccccccagaactgtggtaccgtaagatctgcggttttgacgtgttataccctcccgagcgatatgggcatgtgctgtccgggtggatatgtggcgaggaggccctcgttatggagaaatgcgacgatgaagccgtagcagagatctgcactgagatgctgagacaattcacaggtaatccaaatatccccaagccacggcggatacttcggtcagcatggggttccaacccttattttaggggatcctatagctatactcaggtgggctcttctggagctgacgttgaaaagctggccaaaccattgccctataccgaatcttctaagaccgcccacgggagttctacaaaacagcagcccggacacctcttttcgtcaaagtgccctgagcagcctcttgacgcaaatcgaggagccgtcaagccaatgcaagttctgttctccggggaagccactcacagaaagtattactctaccacacacggcgcgctgctttccgggcagcgagaggccgcaagactcatcgaaatgtaccgagacttgtttcaacagggcacttag

SEQ ID NO: 17210 - DNA, 180 bp, Artificial Sequence
  Description of Artificial Sequence: Synthetic coding sequence
atgagttactaccagcgaccgttctcgccttccgcctattccctgccagcatccttaaactccagcatcgtgatgcagcatggaacctcattggatagcactgatacgtacccccagcacgcgcaaagcttggatggaaccacgtccagctccatcccactctaccgctcaagtgagtag

SEQ ID NO: 17211 - DNA, 837 bp, Artificial Sequence
  Description of Artificial Sequence: Synthetic coding sequence
atgaagtgcgaacattgcaccaggaaggagtgtagtaagaagacaaaaaccgacgatcaggagaacgtgagcgccgacgccccatctcctgcgcaagagaacggcgaaaagggcgaattccataagctagccgacgctaagatcttcctttcggactgcctggcgtgcgactcatgcatgacagccgaagaaggagtgcagttaagtcaacagaatgctaaagacttcttccgagtgctgaacctcaacaagaaatgtgataccagcaaacacaaagtgctggttgtgtccgtttgccctcagtctctgccttactttgcggccaaatttaatttgtcggtcacagacgcaagcagacgcctgtgtgggtttctcaaaagtttggggtgggtccgctacgccgagcgggtgttaggtcgacccatcactgcccacctgtgtaccgccaagtcgccgcagcaggtaatgggctccctcgtcaaagattacttcgccagacaacagaatctgagcccggaaaaaattttccacgttattgtggctccctgctatgacaaaaaactcgaggcactgcaggaaagcctgccacccgctcttcatgggtcccggggagccgactgtgtactaacttccggaacgggatcactttgggagtgtacccctgtgattacggctacacaggaagcggccgccagggagtctctcgagccaggtcggcagcggcttcaacgggataagatcgcccccctagattctagcttgggaggcggcggcgaaatcgcccaaatcatggagcagggggatctgtccgtccgcgatgcagcggtcgacacctag

SEQ ID NO: 17212 - DNA, 471 bp, Artificial Sequence
  Description of Artificial Sequence: Synthetic coding sequence
taagggaaagcacagcgcaagattagtgcaatccacatattggacgtgctggtgttgaacgggactgacgttcgcgagcagcacttcaatcagcgcatccagcttgccgagaaattcgtgaaggcagtgagcaaaccatctcgaccagacatgaatccaattagggtgaaggaggtgtacaggctcgaagaaatggagaagattttcgtcaggctcgaaatgaaaattatcaaaggctccagcggcacaccaaaactgagctacacaggccgcgacgacaggcacttcgttcctatgggtctgtatatcgtgcggaccgtcaacgaaccttggactatggggttctctaaatcttttaagaagaagtttttttacaacaagaagaccaaagacagcacattcgatctacctgcagactcaattgctccattccacctgccctctcttgcatgcctgagcaagatggattag

SEQ ID NO: 17213 - DNA, 1200 bp, Artificial Sequence
  Description of Artificial Sequence: Synthetic coding sequence
atggcaaccggggacctgaagaggagtctgcgcaatctggagcaggtgctcagattactgaactaccctgaggaggtcgattgcgtggggctgataaagggtgaccccgctgccagtctcccgattatctcgtactcttttacctcttacagtccatacgtgaccgagctcattatggagagcaatgtggagttaattgccaagaacgacctgaggttcattgatgccgtgtacaagctgttacgggatcagtttaattataagcccatcttaaccaaaaagcagttcatacagtgtggcttcgcagaatggaaaattcaaattgtgtgtgatattctgaactgcgtgatgaagaaacacaaggagctctccagcctgcagaaaattccctctcagcagagaaagaaaattagttcaggcaaatccgaaccccccctggggaatgagaaaatcagcgcagaggccgtgggagttgatatttccggacgttttatgaccagcggaaaaaagaaagctgttgtgatccgtcatttgtacaacgaagataacgtggacatctccgaggacaccctcagtccgattacggatgtgaacgaggctgtagacgtttcagatctgaacgctaccgagattaagatgcccgaggtcaaggtgcctgagatcaaagccgagcagcaggacgtgaacgtgaatccagagatcaccgcactccagactatgctggctgagtgccaagagaacctgaagaagttgacatctattgagaaaagattggattgtctggagcaaaaaatgaaaggaaaggtcatggtggatgagaatacctggaccaacttgctctccagggtaactcttttggagactgaaatgctgctcagcaaaaagaatgatgagttcattgaatttaacgaggtcagcgaagactatgcgtcttgtagcgacatggatttgctgaatcctcacaggaagtccgaggtcgaacgcccggccagtattcccctttctagcggatactcaaccgcaagcagcgactccacaccccgggcttccacagtcaattattgtggcctgaacgaaataagcgaaaatttccctgcttggtctgccactagctcttgtagctcgctcagttggctcctgaggggccacacaagctaccttagcagtcagtcgtttgcgtggcctctttcctgcgtctag

SEQ ID NO: 17214 - DNA, 819 bp, Artificial Sequence
  Description of Artificial Sequence: Synthetic coding sequence
atggcaagtctgctccaggatcaactgaccaccgatcaagatctacttctgatgcaggagggtatgccaatgcgaaaggtgaggtcaaaaagctggaagaaactgagatacttccgccttcagaatgacggaatgaccgtttggcatgccagacaggctcgtggaagtgctaagccttctttctccatatccgacgtggagaccatcaggaatggacatgactctgagctactacgctctcttgctgaagagctccccttggagcagggctttaccattgtgtttcacggaagacgctccaacttggacctgatggcgaattcggtggaagaggcccagatctggatgaggggtctgcagctcttagtagacctggtcactagcatggaccaccaggaaagattggaccgctggctgtcggactggtttcagagaggtgacaagaatcaggacgggaagatgtcattccaggaggtgcaaaggctgttacatctcatgaatgtggaaatggatcaggaatacgcctttagtctctttcaagctgccgatacttcccaaagcggtaccctggagggcgaagaattcgtccagttttacaaagctcttaccaaaagggccgaagtccaggagctgtttgaatctttttctgccgatggccagaagttgacactgttagagtttcttgatttcctgcaggaggagcaaaaggagagggactgcacttcagaactggctctggaactgatcgacagatatgaaccctcggatagcggggcctcagaagaggatcctggggagggggaggaggtgaacacttag

SEQ ID NO: 17215 - DNA, 360 bp, Artificial Sequence
  Description of Artificial Sequence: Synthetic coding sequence
atggacaagaatataggcgagcaactgaataaagcctacgaggcgttcagacaggcttgtatggatcgtgacagcgctgtgaaagagctgcagcagaaaactgaaaactatgagcagagaataagggagcagcaagaacaactctctctgcagcagaccattattgataagctgaagtcccagctcctcctcgtgaacagtactcaggacaacaattacggttgcgtgcctctgcttgaggattcagagactcgcaaaaacaacttgacactggatcagccacaagataaagtgatctccggcatcgctagggaaaagttgccaaaagttgacatcgcaagtgccgaatcctctatttag

SEQ ID NO: 17216 - DNA, 1881 bp, Artificial Sequence
  Description of Artificial Sequence: Synthetic coding sequence
atgtgcagcacccttaaaaagtgcggaacatacaggacagaagttgccgaatgtcatgaccacggctcaacatttcagggaagaaagaaaggcgggagctcctttcgcgacaacttcgacaaaaggagctgccattacgagcatggaggctatgagcgtccgccctcccattgccaggaaaacgacggctcagtcgagatgagagatgtgcacaaagaccagcagttgcggcatactccatacagcatcagatgcgagcggaggatgaaatggcattctgaggatgaaattcggattacaacgtggcgaaaccgcaagccgcccgaaagaaaaatgagccagaatactcaagacggctatacaaggaactggtttaaagttaccatcccttacggtatcaaatacgacaaagcttggctgatgaattcaatacagtctcattgcagcgacagattcacgcctgtggattttcattacgtcagaaaccgggcatgcttttttgtgcaagacgcgagtgcagccagcgccctcaaagacgtttcatataaaatttatgatgacgagaatcagaaaatttgtatcttcgtcaatcacagcacagccccttactcagtgaagaataagctaaaaccaggacagatggaaatgttgaagttgactatgaacaagcggtacaacgtcagccaacaagctctggatttgcaaaacctgcgatttgatccagatctcatgggtagagatattgacatcatcttgaatcgacggaactgcatggccgccacactgaagatcatagagaggaatttccccgagttgctgtcacttaacttatgtaacaacaagctgtaccaattagatggtctctccgatatcaccgagaaggccccgaaggttaagaccctgaatctgagcaaaaacaaattggaatctgcttgggaattaggcaaagtgaaggggctgaagctggaggaactgtggcttgagggcaatcccctatgtagcaccttctccgaccaaagtgcttacgtctcagcaattcgtgactgcttcccgaagctcctcaggctcgacgggcgggaactttctgcacccgttatcgtggacatcgactcatctgaaacgatgaaaccatgcaaagagaattttacaggttcagagactctgaagcacctcgttctgcagttcttacagcaatattacagcatctacgatagtggagatcgccagggcttgctcggcgcctaccatgacgaagcttgcttttccctggccatcccatttgaccctaaagattcagctccttctagcctctgtaagtattttgaggacagccgcaacatgaagaccctgaaagatccatatttaaagggggagttactcagaaggacaaagcgagatatcgttgatagcctgtcagctttgcctaaaacacaacacgatctatctagcatcctggttgatgtttggtgtcagacagaacgtatgctttgtttttctgtaaatggggtgtttaaggaagtcgaaggccaaagccagggtagtgtgcttgcattcacaagaacctttattgccacccctgggtcttcctcgtctctgtgcatagtgaatgatgaattgtttgtgagggacgccagcccacaggaaacgcagtccgcgttcagtataccggtctctacactgtcgtcctctagcgagccttcacttagtcaggaacagcaagaaatggtgcaggcatttagtgctcagagcggaatgaagctggaatggagtcaaaagtgtctgcaggacaacgaatggaattacacccgtgcaggtcaggcctttacgatgctccaaacggagggcaaaataccagcggaggccttcaagcagattagttag

SEQ ID NO: 17217 - DNA, 189 bp, Artificial Sequence
  Description of Artificial Sequence: Synthetic coding sequence
atggcaatggctccgtccccgtcacttgtgcaggtgtatacatctcccgccgctgtggctgtgtgggagtggcaggacggcctgggtacttggcacccttatagtgcaactgtttgttcttttatcgagcagcagtttgttcagcagaaaggccagaggtttgggcttgggtctctggcacacagctag

SEQ ID NO: 17218 - DNA, 228 bp, Artificial Sequence
  Description of Artificial Sequence: Synthetic coding sequence
atgcgcttgtccctcccactcctgttactcctactgggggcatgggcgattccaggcgggctgggggacagggcgccactcaccgccacagcccctcagctggacgatgaggagatgtactccgcccatatgccggctcacctgcggtgtgacgcatgtagggcagtggcctaccagagactctgttcataccctccccacctgccattaacagagcaacagtcatag

SEQ ID NO: 17219 - DNA, 2619 bp, Artificial Sequence
  Description of Artificial Sequence: Synthetic coding sequence
atgggggacagcgatgacgagtatgatcgtaggcgaagggacaagtttcggcgcgagagatcagactatgatcgctcacgagagcgggatgaacgcaggcgaggcgacgattggaatgaccgcgagtgggacagaggccgcgagaggagatcacggggagaataccgcgattacgatcgtaatagaagggagaggttctccccgccccggcacgaactgagtcccccgcaaaaacgaatgcgcagggattgggacgagcacagcagcgacccatatcacagtggatatgaaatgccatatgccggggggggcggcggaccaacttacggaccaccccaaccctggggccacccggacgtgcacattatgcagcatcatgtccttccaatccaagccagattgggctctattgctgagatcgatctgggcgtccctccacccgtgatgaaaacgtttaaggagtttctcctgtcactggacgatagtgtcgatgaaaccgaggctgtgaaaagatacaatgactacaaattggacttcaggcgacaacaaatgcaggacttcttcctcgctcacaaagacgaggagtggttcaggtctaagtatcatccggatgaagttgggaaaagacgccaggaagccagaggcgccttgcagaacagattacgcgtctttctgtcgttgatggaaactgggtggtttgacaatctcctgcttgatatagacaaagccgatgcaattgtgaagatgctggatgctgctgtgataaaaatggaagggggtaccgagaacgaccttcggatactggagcaggaggaggaagaggagcaggccggcaaaccgggcgagcccagtaaaaaagaagaggggagggccggagcaggattgggggatggcgaaagaaaaactaacgacaaagatgagaaaaaggaagacggtaaacaggccgaaaatgattcatcgaacgacgacaaaaccaaaaagtccgagggcgacggcgataaggaagaaaagaaggaggattccgaaaaagaagcaaaaaagtccagtaagaagcggaatcgaaagcatagcggagacgactctttcgacgagggaagcgtctccgaatctgagagtgaatccgaatcggggcaggccgaagaagagaaggaggaggctgaagaggccctcaaagagaaggagaagcccaaggaagaagagtgggagaaaccgaaggatgccgctgggctggaatgcaagccgcgccctctgcataagacctgctcactgttcatgagaaatattgccccaaacatttctcgggccgagatcattagcctctgtaagcgctatcccggttttatgcgtgtcgccctcagcgagccacaacctgagaggcgatttttccgtagaggctgggtgacttttgaccgttccgtgaacattaaggaaatctgctggaatctacagaatattcgacttagggagtgcgagctttctccaggggtcaacagggatcttacccgtcgggtgagaaacattaatggtataacacagcacaaacagattgtcaggaatgacatcaagttggcagctaagctgatccacaccctcgacgacagaacccagttgtgggcctctgagccgggaactcctccactgccaacttcattacccagccagaatccgatcttgaagaatatcacggattacctgattgaggaggtttccgcagaggaagaggagctcctgggaagcagtgggggcgctccccccgaggaacccccaaaggagggcaatcctgcagagatcaacgtggagcgggacgaaaagcttatcaaagtgctggacaagttgttactgtacctgcgcattgtacactctttggattattacaacacatgtgagtatcctaatgaagacgaaatgccaaataggtgtggcataattcatgtgcgcggacctatgcccccaaatcgaatatcacacggcgaggtgcttgagtggcagaagacattcgaagagaaactgactccgctcctcagcgtgagagaaagcctgtctgaggaagaggcccagaagatgggaaggaaagaccccgaacaggaggtggaaaagtttgttacatcaaatacgcaagaactcggaaaggacaaatggttatgtcctctgagtggaaagaaatttaaaggccctgagtttgtgagaaaacacatcttcaataaacatgccgagaaaatcgaggaggtgaaaaaagaagtggcctttttcaacaatttcttgacagacgctaagaggcccgccttgccagaaattaaacccgcccagcctccaggccctgcacagtccttaaccccaggccttccatacccccatcagacaccccaggggcttatgccctacggtcagcctaggccccctattctcggctacggcgctggggcagtgcgtccggctgttcccaccggcggtccaccttatccccacgccccgtacggcgcaggaaggggaaattatgacgccttccggggccaggggggatatcccggcaagccacgaaatcggatggtcaggggcgatcctagagctatcgtcgaatatcgcgatctggacgctcctgacgatgtcgattttttctag

SEQ ID NO: 17220 - DNA, 483 bp, Artificial Sequence
  Description of Artificial Sequence: Synthetic coding sequence
tagcccgaggacgtgcaggctttggttagtgggaagcttgccttgaggtatgcagggcgccagactgaagctctaaaatgtgtggctcaggcctccaagaaccgatcattggccgacttcgagaaggcacttactgattatcgcgcggaactgcgtgacgatcctatcataagcacccacctggccaaactgtatgataacttgctcgagcagaatctcatccgcgtaattgaaccatttagcagggtccaaattgagcacatttcatcactcattaaactttctaaggccgatgttgaacgtaagctgtcacagatgatcctcgacaaaaaattccatgggattctcgaccaaggagaaggggtgctaatcatcttcgatgaacctccggtagataagacttatgaggctgcgctggagacaatccaaaacatgagcaaggtcgtcgattctctgtacaataaagcaaagaagttgacctag

SEQ ID NO: 17221 - DNA, 3906 bp, Artificial Sequence
  Description of Artificial Sequence: Synthetic coding sequence
atgtggcggagaaagcatccacgtacttctggcggcacaagaggagtcttgtccgggaatcgcggggttgagtatggatctgggcgcggccacctcggaacttttgagggcagatggagaaaactccccaaaatgcctgaggccgtagggactgatccctccacttctcggaagatggctgagctggaggaggtgactttagacggaaaacctctgcaagcattacgggtgaccgacttaaaggcagcattggagcagcgaggcttggcaaaaagcgggcagaaatctgctctggtcaaacgactgaaaggtgctctgatgctggaaaacctacagaagcacagcaccccacacgctgcttttcagccaaattctcagatcggcgaggagatgtcccagaatagctttatcaaacagtatctggagaagcaacaggagctcttgcgccaaagactcgaacgggaagccagagaagccgccgaactggagggcaaaagctcctctatctccgaggaaaaaggcgattctgacgatgagaaaccccgaaaaggcgagaggcgctcgagccgtgtcaggcaagcacgcgcggccaagctctccgagggaagtcaacccgccgaggaggaggaggaccaggaaaccccctcccggaacctacgcgtgagggctgacaggaacctgaagacagaagaagaggaggaggaagaggaggaagaggaagaggatgatgaggaagaagagggcgatgatgagggccagaagtctagagaggcacctatactcaaggagtttaaagaggagggcgaggagatcccacgggtaaaacctgaggaaatgatggacgagcgacctaaaacaaggtcccaggagcaagaggtgctagaaagaggaggtagatttacccgctcacaagaagaagcccggaaaagccaccttgcaagacagcagcaagagaaagaaatgaaaacaacctctcccctcgaggaagaagagcgtgagattaaatcctcccaggggctgaaggagaaatcaaagtctccaagtcctccaagactgacagaggatcgaaaaaaggcttccctcgtagcgcttcccgaacagacggcatctgaggaggaaactcccccccctctgctgacgaaggaggcctccagtcccccaccccatccacagctgcacagcgaggaagagattgagcctatggaggggcctgctccggccgtgcttatccagcttagcccacctaacaccgacgccgatacccgagaactgctggtaagccagcatacagtgcaactcgtgggaggccttagccccctgagcagtccttctgacacgaaggcagagtcccccgccgagaaagtgcccgaggaatccgtgctccccttagtgcagaagtccaccctggccgattactcagcccagaaagatctagaaccagaatctgaccgtagcgcacaaccactgccactcaagatcgaagaactggcccttgccaaaggtatcacagaggagtgtttaaaacagccttcccttgaacagaaagaagggcgccgcgcctctcacacgcttcttcccagtcatagacttaaacaatcagcggactcatcttcatctcggtcaagcagctcctcttccagctcctctagatcccgttcccggtctcccgactcttccggtagccggtcacacagccctttacgtagcaaacagagagacgtcgcacaggcacggacacatgccaaccctagaggccggcccaagatgggatcacggtccacctcagagagccggagccggtccaggagtcgtagccgctctgccagctctaattcacgaaagtcactttcacccggagtgagtagggactcgagcaccagttataccgagaccaaagacccctcctccgggcaggaggtggctacgccccccgttcctcagcttcaggtttgcgagcctaaagaacggacatccacatcctcctcttccgtgcaggcccgcagactgtctcagccagaaagcgcagaaaagcacgtgactcagcgtctgcagcctgaacggggatctccaaaaaaatgtgaagccgaagaagcggaacctccggccgcaacccaaccacagacatccgagactcaaacctcccacttgccagaaagtgagcgtatacatcatacagtggaagagaaagaggaagtaactatggataccagtgagaaccgcccagagaacgatgttcctgagcccccaatgcctatcgctgaccaagtcagcaacgatgaccgcccagagggctcagtggaggacgaagagaagaaggaatcttctctgccaaaatcattcaaacgcaaaatatccgttgtgagcgcaactaagggcgtgccggccgggaatagtgacaccgaaggtggccagccagggaggaagcggcgctggggggctagtacagctacaacccagaagaaaccaagcatttcaatcaccaccgaatccctgaaaagtctgatccctgatattaaaccactggcaggccaggaggctgtcgttgacctccacgccgatgactctaggatcagcgaagatgaaaccgagcgtaatggagatgatggaacacacgacaagggcctgaagatttgtcggacagttactcaagttgtgcccgccgaagggcaggagaacggacagcgggaagaagaggaagaagagaaggaaccagaggccgagccacccgttcctccgcaggtctccgtggaggtagccctgcctcctcccgccgagcatgaggtgaaaaaggtgacattaggcgacactttgacgcgccgttccatttctcagcagaagtcgggcgtgagcatcacaatcgacgaccctgtccgaactgctcaagtgcctagtccacctcgggggaaaatttccaacatcgtgcatatttccaatttagttagacccttcacgctgggccagcttaaggagctgttgggacgcaccggaaccctggttgaagaggctttttggattgacaagattaagagccattgctttgtcacgtattcaactgtcgaagaagccgtcgctacgcggacagcgctgcacggcgtgaagtggccacagagtaatccaaaatttctgtgtgccgattatgcagaacaggatgagctggactatcatcgcggcttgctggtggataggccgtccgaaacaaagacagaagaacaaggcattcctaggccgctgcatcccccccctcctccaccagttcagcctcctcagcatcctcgcgcggagcagcgggagcaggaaagagctgtgagggaacagtgggcagaacgggaaagggagatggaaagaagggagagaacgcgatccgagagggaatgggacagagataaagttagagagggacccaggagccggtctagatcaagggatcggcgccgaaaggagagagcaaaaagtaaggaaaaaaaatccgagaagaaagagaaggcccaggaggagcctcctgctaagctgctcgacgaccttttccgtaaaaccaaggcagctccttgtatctattggcttccgctgaccgatagccagattgtgcagaaggaggccgagagagccgagagggccaaagagcgtgagaaacgccggaaggagcaggaagaagaagagcagaaagaaagagaaaaagaggctgagagggaacgcaaccgccagctggagcgggaaaaacgacgggagcactcccgtgagcgagacagagaaagagagcgggagcgtgaacgagatcggggggacagagacagagatcgcgaacgcgaccgggagcgaggacgtgaacgcgaccgacgagatacgaagagacactcaagatcacggagtcgatcaactcccgtgagggatcggggtggccggagatag

SEQ ID NO: 17222 - DNA, 231 bp, Artificial Sequence
  Description of Artificial Sequence: Synthetic coding sequence
atgctcctcgaaaacctgacagataacgaatccgagaataccaatctgaagaagaaggtcttcgaaaaggaagcccacatccaggagctcagctgcctgttccagagcgaaaagtctctggaaaccaaaatcgcaaagtggaacttgcagagcagaatgaataagaatgaggcaatagttatgaaggaggctagcagacagaaaacagtggcgttgaagaaggcctcttag

SEQ ID NO: 17223 - DNA, 1749 bp, Artificial Sequence
  Description of Artificial Sequence: Synthetic coding sequence
atggaggtgcgcgcgtcccttcagaaggtgtcagggtcatccgactcagttgctactatgaactctgaagaattcgttctggtgcctcaatacgcagacgataacagcacaaaacacgaagaaaaaccacagctgaaaatcgtgtccaatggagacgaacaactggaaaaggctatggaggagatactccgagacagcgaaaagcgccctagctctctcctcgtcgactgccaaagctcatcagaaatatctgatcactctttcggagacatccccgcttctcagactaacaagccctcacttcagcttatcctggaccccagtaacacagagatcagcactcccaggccttcaagtccagggggcctgcccgaagaggacagtgtgttgtttaataagttgacttacctgggatgcatgaaagtgagttccccacgcaacgaagtggaggccttgagggcaatggccaccatgaagtcctcctcgcaatacccatttccagttacattatacgtacctaatgtgccagaaggctccgtcaggatcatagatcagtcgtctaatgtagaaatcgcaagtttccccatctacaaggtgcttttctgcgcacgcggccacgacggcactactgagagtaactgtttcgcttttactgagtcgtcccatggtagcgaagagtttcaaatccatgtgttctcctgcgaaatcaaagaggctgtgtcaaggatcctatactcgttctgtacagcctttaagagatcaagtcgtcaggtctcagacgtgaaagactccgtgattccaactcctgactctgacgtcttcacattttccgtgagcttggaggtgaaggaagatgatggcaagggcaatttccgactgctcgtaattcctatacctttcgagtatttctcacccgtccctaaggaccgggacaaattctatttcaaactcaaacagggtatagagaaaaaagtggttatcaccgtgcagcagctgagtaacaaagaactggcaatcgaaagatgttttggcatgctcctgagccctgggcgcaatgtgaagaatagcgacatgcacctcctcgacatggaaagcatggggaagtcctatgacggcagagcttacgttatcaccggtatgtggaaccccaacgcaccggtttttctggcactcaacgaagagacacccaaggacaaacaggtttacatgactgtggccgtggatatggtcgtcaccgaagtggtggaaccagtgagatttttgcttgaaactgtggtgcgggtataccccgctaatgaaaggttctggtattttagccgaaagaccttcactgaaacattttttatgcggctgaaacagagcgagggtaagggccataccaacgccggcgatgcaatctatgaggtcgtgtctctgcagagagaaagtgacaaagaagagcctgtaacaccgacttccggcggcgggcctatgagcccccaagacgatgaagctgaggaggaatccgacaatgaactgtcttctgggacgggagacgtctccaaagactgtccagaaaagatcctctactcctggggcgagctccttgggaagtggcatagcaacctaggcgctagacctaaaggtcttagcacactggtgaagtccggtgtacccgaggcactccgcgcagaagtctggcaactgctggcgggttgtcatgataatcaggctatgctggacaggtaccggatcctcataactaaatag

SEQ ID NO: 17224 - DNA, 138 bp, Artificial Sequence
  Description of Artificial Sequence: Synthetic coding sequence
atggatgctgattctgacgtggcactcgacatcctgatcacgaacgtggtgtgcgtgttccggaccaggtgccacctgaacttgagaaagatcgcactggagggagcgaacgtgatttacaagcgggatgtgggttag

SEQ ID NO: 17225 - DNA, 762 bp, Artificial Sequence
  Description of Artificial Sequence: Synthetic coding sequence
atggaagacgcgccccagcggctcaggtggcaggctcatcttgaattcacacataatcacgacgtgggagatcttacatgggacaaaatcgccgtgagcttacctagaagtgagaagcttcgctctttggtcttggccggcatccctcacgggatgcgaccacagctctggatgagactgagcggggctctgcagaaaaaacgaaattccgaactgtcctaccgtgaaatcgtgaagaactcttctaatgatgaaactatagctgccaaacagatcgaaaaggatttgcttcggaccatgccttcaaacgcttgcttcgcaagcatggggagcatcggggttccgaggctgcggagagtactgagagccctggcctggctttacccagaaatcgggtactgccaggggactggcatggtcgcagcctgcctcttgctctttcttgaagaagaggacgccttctggatgatgtccgcgattatcgaggatctattaccggccagttacttctccacaacgctgttaggggtgcaaaccgatcaaagggttcttcgccacctcatagtccagtaccttccaaggctggacaaactgctccaggagcacgacatagagctatccctaattaccctgcactggtttctcacggcctttgcctctgtggttgatattaaattacttctgcggatttgggacttgtttttctacgaaggtagcagagtgcttttccagctgacactgggaatgttacacctgaaatag

SEQ ID NO: 17226 - DNA, 336 bp, Artificial Sequence
  Description of Artificial Sequence: Synthetic coding sequence
tgaccgctggtgaaagtgcagatctttggagtacggttggacacagctaggcaggagaccaactacgtggagaataacggcttcaacccatattggggccagactctatgttttagggtcctggtgcccgagctagccatgctgagattcgtggttatggactatgattggaagtctagaaatgattttatcggtcagtatacactcccatggacttgcatgcagcagggatacaggcacatacatctcttaagtaaggatggcatctctttacgtcccgcttctatcttcgtgtatatctgtattcaggagggtctggagggagatgaatcctag

SEQ ID NO: 17227 - DNA, 552 bp, Artificial Sequence
  Description of Artificial Sequence: Synthetic coding sequence
atgatgcagatctgtgacacatacaaccaaaaacacagtctttttaatgctatgaatagatttatcggggcggtgaacaacatggaccagacggtgatggtgccgagtctgttgagagatgtgcccttggccgacccaggacttgataacgatgtgggagtggaagtcggaggttccggtggatgcctagaggagagaacgcctccggtgccagacagcggcagcgcgaacggcagtttcttcgcgccatccagagatatgtatagccactatgtccttctgaagtcaatacgaaatgacatcgaatggggcgtactgcatcaacccccaccccctgccggatccgaggaaggatcggcttggaaaagtaaggacatattggtggacctgggccacctggagggggccgatgccggtgaggaggacttggagcaacaattccactaccacctgaggggtctgcacaccgtcctgtctaagctgaccaggaaggctaatatcctcactaatcggtacaagcaggagatcggctttggcaattggggacactag

SEQ ID NO: 17228 - DNA, 1215 bp, Artificial Sequence
  Description of Artificial Sequence: Synthetic coding sequence
atgatgttgtccaccgaaggacgggaaggattcgtggtgaaagtacgggggctgccctggagctgtagtgctgacgaggtgatgaggttcttttccgattgcaagatccagaacggtacatctggaatccggttcatttacacccgtgagggaaggccctcaggagaagcgttcgttgagcttgagtccgaggaggaggtgaaactcgcacttaaaaaggaccgcgagacaatggggcaccgctacgtcgaggtgttcaagtccaactcggtagagatggactggatgactctccctgtggacttccagggccggtctaccggcgaggctttcgtacagttcgcgtcccaggagatagccgagaaagcccttaagaaacacaaggagcggattggacatcggtacatcgaaattttcaagagttccagggccgaggttagaacccactacgacccacctaggaagcttatggccatgcagaggccaggcccttatgacagacccggggccggaagaggctataattctatcgggcgcggagccggctttgaaaggatgcgccggggtgcttatgggggtggctatgggggatacgatgattatggaggatataatgacggatatgggtttgggtctgaccgctttgggagagacctgaactactgtttcagcggaatgagcgatcatcgctatggggatggtggctcctcattccagtccacgaccggtcattgcgtccacatgagggggctgccctatagggccactgaaaacgacatctataacttcttcagccccctgaatcccatgcgtgtgcatatagaaataggcccggacggcagagtgacaggcgaagctgatgtggaattcgctacacacgaggacgcagtcgctgctatggccaaagacaaggccaacatgcagcacaggtacgtggagcttttcctgaattccacagccggcacaagtgggggagcctatgaccacagttacgtggaactgtttttgaactccactgcaggtgcttcaggtggggcttacggctcccaaatgatgggaggcatgggcctctcaaaccagtcatcttacgggggccccgccagccagcaattaagtgggggttatggcggtggatacggaggccagtcctctatgagtggttacgatcaggttttacaggaaaattcctccgactatcagagtaacttagcgtag

SEQ ID NO: 17229 - DNA, 1545 bp, Artificial Sequence
  Description of Artificial Sequence: Synthetic coding sequence
atgtccattagttccgacgaggtcaacttcttggtttatcggtacttgcaggaaagtggtttctcccatagtgccttcactttcggaatcgagtcccacatttcccagtcgaacataaacggcgcgctcgtgcccccagcagcacttatcagcatcatccagaaaggcctgcagtatgttgaggccgaggtgagcatcaatgaagacgggaccctctttgacgggcgacccatcgaaagcctctctctaatcgacgccgtcatgcccgatgtggtgcaaacccgccagcaggcctacagagataagctggcacagcagcaggcggccgccgccgcagcagccgccgccgctgcgagtcagcagggctccgccaaaaatggcgaaaatacagccaatggagaagagaacggtgcacatacaatagcaaacaatcacaccgacatgatggaagtcgatggagacgtggaaatccctcccaataaggcagtggttctgagggggcacgagtctgaggtgttcatttgcgcatggaaccctgtctctgatctgcttgcctccggttccggcgactctaccgcccgaatatggaacctctctgagaactctacatctggcagcactcagctggttctccggcattgcattcgggagggtggccaggatgtgcctagtaataaagatgtgacatctcttgattggaacagcgagggcaccctgctcgcaactggcagttacgacggtttcgctcggatctggactaaagatggaaatctagcctcaaccctgggccagcataagggccccatttttgcgctgaagtggaacaaaaaagggaatttcatcttgtccgcgggagtggacaagacaaccatcatctgggacgcacacacaggcgaagcaaagcaacaattccccttccattctgcccctgctctggacgttgattggcagagtaataacacattcgcctcatgctccacggatatgtgtattcatgtctgtaaattaggacaggatcgtccaattaagacttttcagggacatactaacgaggtgaatgccatcaagtgggatccaaccggcaatttgttagcaagctgcagcgatgatatgactctcaagatctggagcatgaagcaagacaattgcgtccacgacctgcaagcacataataaagaaatttacacaatcaaatggtcacctactggcccagggactaataatcccaacgccaacctgatgctcgcttccgctagttttgactcaaccgtgcgcctctgggacgttgacaggggtatttgtatccataccttgaccaagcaccaagagcccgtgtatagtgttgcttttagcccggacggccggtatctagcctcaggtagttttgacaaatgtgttcacatctggaatacacagacaggcgccctggttcactcctaccggggcaccggcggtatattcgaagtgtgctggaatgctgcgggcgataaggttggcgcttctgcctccgatggctcagtatgcgtgctggacctgcggaagtag

SEQ ID NO: 17230 - DNA, 2928 bp, Artificial Sequence
  Description of Artificial Sequence: Synthetic coding sequence
atgaaatttgttagtgaggaccttcatcgttgcgccttgctcaccgctgacagttttggagatcccttcttcccgcggacaacacagatactattggagtatcagctgggacgctgggtgcctcgcctccgggagccacgtgacctgtacggagtatcaagcagtggccctttgtctccaaccaggtggccgtaccattgcgaggtgatcgatgagaaggtgcaacatatcgattggacccctagctgtccggaaccagtgtacattcccacaggcctcgagacagaacctctgtatcccgacagcaaggaagccacagttgtgtacttggctgaagacgcatataaagagccctgttttgtctactctagggtgggaggaaatcgcacccccctcaaacagccagtcgactacagagataacacattaatgtttgaggctaggtttgaatcagggaacctccagaaagtcgttaaagtagccgagtacgagtaccagctgaccgttcgaccagatttattcactaacaagcatacccagtggtattatttccaagtcacaaacatgcgtgccggtattgtctatcgctttacaatagtaaatttcaccaaaccggccagtctctatagccgtgggatgcggcccctgttttatagcgaaaaagaggctaaggcccatcacattgggtggcagaggattggtgaccagattaaatactacagaaacaacccgggacaggacggacgtcattacttctctctgacttggacgttccagtttccgcataataaggacacatgttatttcgctcattgttacccatacacgtatacgaacctgcaggaatatctgtcagggatcaacaatgatcccgtccgcagcaagttctgcaagattagggtgctatgccataccctggcacgaaatatggtgtacattctgactatcaccacccccttgaaaaattccgactcccggaagaggaaggccgtcatcctgaccgcaagagtgcatcccggcgaaaccaacagttcttggatcatgaagggcttcctggattatatcctgggtaactcctcggacgcccagctgttacgtgacacatttgttttcaaggtcgttccgatgttaaacccagatggtgtgattgtcggaaattaccgctgctcacttgcagggcgtgatctgaatcgaaactatacgagcctgctcaaggagagcttcccttctgtatggtacaccagaaatatggtgcatcgcctcatggaaaaacgtgaggtcatcctgtattgcgacctccacggacattcaaggaaggagaatatcttcatgtatggctgtgatgggtctgataggtcaaaaaccttgtatctgcagcagcgcatcttccctctcatgctgagtaaaaactgccctgataagtttagcttctcagcctgcaaatttaatgttcagaaatccaaagaaggaacaggcagggtggtaatgtggaaaatgggaatccggaactcatttactatggaggcgacattttgcggcagcacactgggaaataagcgcggcacacacttcagcacaaaagatctggaaagtatggggtaccacttctgtgactccctacttgactattgtgaccccgaccggacaaagtactacaggtgtctgaaggaattggaggagatggaacgacacataacattagaaaaggtgttcgaagatagtgacacacctgttatcgatatcacgctagatgtcgaaagctcgagtagggggagcgatagtagtgagagtattgactccctgacctacttgctcaaactaacttcccaaaaaaagcacctaaaaacaaaaaaggagcgcaatagcacaatcgcttctcaccaaaacgcacgaggccaggaagtttacgatcgtggacacctattgcagcggcatacccaaagtaattcagacgtaaaagatacccggcctaatgagcccgatgactacatggtggactactttaggcggcaattgcccaaccaagggctggcacactgcaaattgcgcctgcctggtagccgtcactcccctgcatctgcctcgcgcgtcgccggtactaccggtaccagacaccatacttggctcattttcgtgtttcttgtggaaatgggtaagaagattccactgaagggcactgatctatacggcaattgcttcaaggtgacctcactgcagtcacccatgggcaagcagacctctacctggacggagaagacacgtatcccgaccgaggacttacaccacaatcttaagtcaaagattaaggagtgtatctcctttcagtccaaaaagaccggcatcaattggaccgacgatgagaagcgctcctacaaagacaagggaatcgtgcagacacaggaaatcttacagtacctgctcccgatcgtgcactcaacaaagaatatgcaaaccacacaaatcaaacagctttttaatcctcggaccaactttcagattcaacatcagctgaatcccgcaacttgccggaatattaaaaagtactcaactagttggacagctccgcggaaccaccccttcgtcatccagggtgatgtcatggcgaattcatctgagtgggtgcagagcaaaccacaccggagtctcgaatctctttcaccactcaaaggacctaagaaaaacaaacactcccagatctgggcaattaaaaacgaagacatcaaaccgctgtctagtaaatgggaaacagcttccagctcttttggcatggacgccaacgtattgaagtataaatccctgcaggcagaagaaacaaaccagcaatcctccaagcacacggcactgcatctcaccaaaaataaggacgaacaggcgaacaaaaacgacgggcagccaacactgtatctgaagtttcagcgagagtcttag

SEQ ID NO: 17231 - DNA, 1626 bp, Artificial Sequence
  Description of Artificial Sequence: Synthetic coding sequence
atgagctcgtccggctatcctccaaaccagggcgcattctctaccgagcagtcaagataccctccacacagcgtgcagtatacattccccaatacgcggcaccagcaggagttcgctgtgcccgattaccgttcctcccatttggaggtctcgcaggcatcgcaacttctacagcagcagcagcagcagcaattgcggcgcaggcccagtctgctgtctgaatttcatcccgggtctgatcggcctcaggagaggcgcaccagctacgagccctttcaccctggaccttcccctgtcgatcatgatagtctggaatccaagcgacctcgtttggagcaggtgtccgactcccattttcagcgcgtgagtgctgcggtccttcccctcgtccacccactgcctgagggactccgtgcaagtgccgacgcaaagaaggaccccgccttcggcggcaagcatgaagcgccctcatcgccaatttcgggccaaccctgtggcgacgatcaaaacgccagcccgtccaagctgagcaaggaggagctgatccaaagcatggacagagtggaccgcgaaatagccaaagtcgaacagcagattctgaaactgaagaagaaacagcagcagttggaggaggaagcggcaaagccaccagaacctgagaagccggtttcacccccgcccgtggagcagaagcaccggagcatcgtgcagatcatttacgacgagaatagaaaaaaagccgaggaagcccacaaaattttcgaaggactggggcctaaggttgaactgcctttatacaaccagccaagtgatacaaaagtgtaccacgagaacattaagactggcgtccctgcccggagaatgatgaaaaaccaggtgatgagaaagaaactcatcctgttcttcaagcgtcgcaaccacgcgagaaagcagcgggaacagaagatctgccagagatatgatcagctcatggaggcctgggaaaagaaagtagaccgaatcgagaataatccacggagaaaggcgaaggaatctaaaacaagggagtattatgaaaagcagttccctgaaattcgtaagcagcgggagcagcaggagcggtttcagagggtaggccagagaggggctggcctgtccgcaaccatcgctcggagcgaacatgaaattagtgaaattatcgacggactgagtgaacaagaaaataacgagaaacagatgcggcagttaagcgttattccacctatgatgtttgatgcggagcaacggagggtcaaattcattaatatgaacggcctcatggaagacccaatgaaggtctacaaagaccgacagttcatgaatgtgtggactgatcacgaaaaagagatctttaaggataaattcatccagcacccgaaaaattttgggctgatcgccagttatcttgagagaaagtcagtaccggactgtgtgctgtactattatttgaccaagaagaatgagaactacaaggctcttgtgcggagaaattatggtaaaaggaggggtaggaatcaacagattgcccggcctagccaggaagagaaagtcgaggagaaggaagaagataaagctgaaaagacggaaaagaaggaggaggagaaatag

SEQ ID NO: 17232 - DNA, 840 bp, Artificial Sequence
  Description of Artificial Sequence: Synthetic coding sequence
atgaaatttccctttctccctattctagtgatgaagtttattgagaaggcccagaatatgtctaagtacgtcctgatcgacacacccggacagatagaggtgtttacgtggagcgctagtggaacaattataacagaagccttagcttctagtttcccaacagttgtgatatatgtgatggacacatcccgatctacaaatcccgtgacctttatgtccaatatgctgtacgcttgctccattctgtataaaacgaagctgcctttcattgtcgtcatgaacaagaccgacatcatcgatcactcctttgccgtggaatggatgcaggactttgaagcatttcaggatgcgctgaatcaggagacgacatatgtcagtaacttaactcgctctatgagcttggttctcgacgaattctattctagtctgcgggtggtcggcgtgagtgccgtcttaggaacaggactcgacgagcttttcgtgcaggtgacgtctgccgctgaggagtacgaaagggagtaccggccggagtacgagagactgaaaaaatcgctcgccaacgccgaatctcaacagcagcgggagcagcttgaaagactaaggaaggacatgggctcagttgccctggacgcagggacagcaaaagactcgttgtcccccgtgctgcacccatctgacctcattctgacaagaggcacccttgatgaagaggacgaggaggcggattctgatactgacgacatagatcatcgggttaccgaggaaagccatgaggagcctgccttccagaattttatgcaggagtccatggctcagtattggaaacgaaacaacaagtag

SEQ ID NO: 17233 - DNA, 1230 bp, Artificial Sequence
  Description of Artificial Sequence: Synthetic coding sequence
atgaaggatacccaggacattcaggaggcatcaaaagcaatgcagaataaggtgcatgagcaggaagacaaaaacgagaaacaaaagcagcgggaggacaagcttggcgtttacagtctcgtgcatttcagccccaagatgctcgggagtgtggccactaccctgccactctcctccagtaattcaagtggcatgccgttaggttactacctctcatcgcctcagattagcagggtgaccatatctacaacgggtcagctcacttccaaagccaccgttggatcttgctcacgcgtggaaaacagtctggatgccagcccttttagcgttccaaaaaagcaggatgagtccccgatgatcggcgatggtgaggattatttcctgagccttttcggagacagcaaaaagctgaccgcgcacagcaattatacacagaagaccctgaaatactttagcatgatacttgaggaggtagggcagtttacaagcagctcactgggcgacgtggaaattgccgaagtcaacgtgaaagggctattcgtaaagctgattaactcttcgctggacaaagaaatggctattggagaccatatactgcagcagaatgtgaatggccagaccatatccctctaccgctttctgcccaacatcgtgatgcaagccaacagtaccgtcaccgtttgggccgccgcatcagaagctaaacaccagcctccttccgattttctgtggaaggagcaagacaaatttagagcctctccggattgcataacaattctgtgcaagcccaacgggcaagccatcgcttggtacacgccaatacactggaagcaggcctgggaaaagctggacgcagatgtggagttcaaccggtgttcagtggttagccctactttccgaaagcgcgttttccaatggacggcaagtactgctaccattacaaaagaaaaacaggatcaacccaagaaggatatctctaattatcaggtcgagcaggctcaagtacttttgaagcgcgaaaaggaaatcccccctaccgtattccctaatagaagcccctggtgtcaaaatccttatgtctccgcacatccgtattgccctttaatagagccacacaatacttcaacggcgggaggccggttggaccggcagcctcggactcggtcgaccagaccaaatcgagcttcaggttctaagaaaaaaaaaacaagcgagagccaaaagcagtag

SEQ ID NO: 17234 - DNA, 2442 bp, Artificial Sequence
  Description of Artificial Sequence: Synthetic coding sequence
atgtcggagcagggcgacctcaaccaggccattgcagaggagggcgggacagagcaggagactgcaacccccgaaaacggcatcgtaaaaagtgagtccctggatgaggaggagaagttggagctgcagcggcgcctggaggcccagaatcaagagcgccggaagtccaagtcgggcgctggcaagggcaaactgacccggtccttagctgtttgtgaggaatcatcggctaggcccgggggggaatctcttcaggaccaagaaagcatccacctgcagttgagctccttctcctctctgcaggaagaggataaaagtagaaaggatgacagcgaacgcgaaaaagaaaaagataaaaacaaggataagacaagtgagaagcccaagatccgtatgttgtcaaaagattgtagccaagaatacacagactccacgggtatcgacttgcatgaattcttgatcaatacccttaagaacaactctagagatcggatgattctcctgaagatggaacaggagatcatagacttcatcgccgacaataacaatcactacaaaaagtttccccagatgtctagttaccagcgcatgttggtgcacagagtggctgcctacttcggtctagaccataatgtggaccaaacaggcaagtcagtgattataaacaagacttctagcactcgcatcccagagcagcgcttctgcgagcatctcaaagacgaaaagggagaggagtctcaaaaaaggttcatacttaagagggacaattcttctatagataaagaggacaatcagtcggtatgctcacaagagagccttttcgttgagaacagccggcttttggaggatagcaatatttgcaatgagacttacaagaagcgccagctgttccgaggcaatagagacggttcaggtcgaacgtccggctcccgtcagtcatcctctgagaacgaacttaagtggagcgatcatcagcgcgcatggtcttccaccgacagcgacagttccaatcgcaatctcaagcctgccatgaccaaaaccgccagttttggaggcatcacagttcttacacggggagactcgacatccagcactagatcgacaggcaagctgagtaaagcaggctcagaatcatcatcatctgccggatcaagcggctcgctgagccgcacccatccaccactccagtctacaccgctggtgtccggcgtcgccgctggctcccctggatgcgtgccgtacccagagaacggcattggcggacaagtcgccccgtctagtacttcctatatcctgctgccattggaggccgccacaggcattccaccaggcagtatcttgctaaatcctcacaccggacagccatttgttaatcccgacggcacgccagctatttataacccccccacatcacagcagccccttagatccgctatggttggccagagccagcagcagccgccccaacaacaacccagccctcaaccgcaacagcaagtacagccgccccagccgcagatggccggccctctcgtcacccaaagcgtgcagggactgcaggcttcatcccagagcgttcagtaccccgccgtctcattcccaccacagcacctgctacccgtttcacccacgcaacatttccccatgagagatgacgtcgcaacccagtttggccagatgacactttctagacagagctctggagagactccagaacccccttccggtcctgtgtacccatcatcattaatgccccagccagcacagcagccctcgtatgtaatcgcctctaccggccagcaacttccgacaggcgggttcagcggaagtggtcctcccatcagccaacaggtcctgcagccccctccctcaccgcaaggcttcgtgcagcaaccacctccagctcaaatgcctgtttactattacccatccggccagtatcccacttctaccactcaacagtatcgtccaatggcacccgtacaatataatgcgcagcgatcacagcagatgccacaagccgcacagcaggctggatatcaaccggtcctgagtggacagcagggatttcaggggcttattggcgtgcagcagcccccccagtcccagaatgtcataaacaaccagcaaggtactccggtccagtccgtaatggtcagttatccaaccatgagctcataccaggtgcctatgacacagggtagccaagggttgccacagcaaagctaccagcaacctatcatgttacccaaccaagctgggcaggggagcctacccgccacaggcatgccagtgtactgtaatgtcacgccaccaaccccgcaaaataacttgaggctcattggccctcactgcccctcatcaacagtgcctgtcatgtcagcgtcatgcagaacaaactgtgcatcaatgtcaaatgcaggttggcaggtaaaattctag

SEQ ID NO: 17235 - DNA, 1773 bp, Artificial Sequence
  Description of Artificial Sequence: Synthetic coding sequence
atgcccagccctcagttgcttgtactattcggctcacagaccgggacagcccaggacgtgtccgagcggctaggccgggaagcaagacgcaggagactgggttgcagagtccaggcattagactcttatcctgttgtgaaccttattaatgagccactcgtgatctttgtgtgtgcgaccacgggtcaaggcgaccctccagataacatgaaaaatttctggcgtttcatttttagaaagaacctgcctagtaccgcactgtgccagatggacttcgcagtgctcgggctgggagattcatcttacgcaaaatttaacttcgtggctaaaaaactgcatcgacgtctgctgcagctcggcggctccgcactactgcccgtgtgcctgggtgatgaccagcatgagcttggtcctgacgctgctgtagacccttggctaagagacctttgggaccgggtgctcggactgtatccgccaccccctggtcttactgaaatcccacccggtgttccactgccatctaaattcacactcctgttcttacaggaggccccgagtactggttccgagggccagcgcgttgctcaccctgggtcacaggaacccccaagtgaatcaaagccttttctcgctcctatgatcagcaaccagcgcgttaccggcccttcgcacttccaggatgtccgactgatcgaattcgatatcctcgggtccggcatctcttttgctgccggtgatgtggtcttaatccagccctctaacagcgctgctcacgtacagaggttctgccaggtgctaggcctggaccctgaccagctgtttatgctgcagccacgggagcctgacgtgtcctcccccacccgtctgccccagccttgttccatgcgccatctggtgtctcactacctggacattgcttcagtgccaaggagaagcttcttcgaacttctcgcttgcctgtctctgcatgaacttgaaagggagaaactactggaatttagcagcgcccagggccaggaggaattatttgaatattgtaaccggccacgaaggactattttagaggtgttgtgcgatttcccccataccgcggctgcaatcccgcccgattatctgttagacctgatccccgtaatcagacctagagctttctccatcgcgtcttcattgctgattttagtggctgttgtgcagtttcagaccaggctgaaggaacctagaagaggactctgctccagctggctcgccagcctagacccgggccaggggccagtgcgggtacctctgtgggtgcggcctgggtcactggcgtttcccgagacaccagacacgccggtcatcatggtgggcccaggcacaggagttgcccccttcagggctgctatccaggaacgcgtggcccagggccagaccggcaactttctgttcttcggctgccgctggcgggatcaggatttttattgggaggctgagtggcaagagttggagaagagagactgcttaactctcatacccgccttttccagggagcaggagcagaaagtgtacgtccagcaccgtcttagggagctcggttcattagtttgggagctgttggacagacagggtgcatacttctacctagccggcaacgcaaagtcaatgcccgccgacgtgtcggaggccctgatgtctattttccaagaggagggcgggctctgctcccccgatgctgccgcttacttggcacggttacagcagacccggaggttccagaccgaaacctgggcatag

SEQ ID NO: 17236 - DNA, 2436 bp, Artificial Sequence
  Description of Artificial Sequence: Synthetic coding sequence
atgcccctgtccagtcccaatgcagctgccacggcaagcgacatggacaaaaatagtggtagtaactcatcctcagcatcctcaggctcatcaaagggccagcaaccacctcgctccgcctctgctggcccagccggagagagcaagccgaagtcggacggaaagaatagttccggcagtaagagatataaccgaaaacgggagctgtcatacccaaagaatgagagtttcaataatcagtcccgccggtcatcctcgcaaaagtccaaaacctttaacaagatgcccccccagcggggtgggggatcatctaagttgttttcctctagcttcaatggtggacgcagggacgaggtggcagaagcacagcgcgccgagttcagccctgcacagttctcaggccccaagaagatcaacctcaaccacttgcttaatttcacctttgagccccgcggccagacaggccacttcgaggggtctggccacggaagctggggtaaacgtaataagtggggtcataaaccatttaataaggagctttttttacaggctaactgccagttcgtggtgtctgaggatcaagactacacggcccattttgcggaccccgatactcttgtgaactgggacttcgtggagcaggtgaggatatgttcccacgaagtgcctagctgcccaatctgtctgtatcctccaaccgccgcgaagatcacgaggtgtggtcatattttttgctgggcctgtatcctgcactatctaagtctgagcgaaaagacatggagcaaatgccctatttgttatagcagcgtccacaaaaaggatcttaagtccgttgtggccacagaatctcaccagtatgtagtgggagacacaattactatgcagctcatgaagcgggagaagggcgtgctggttgcactaccaaaatctaaatggatgaatgtcgatcaccccatccatctgggggacgaacaacatagccagtactccaagttgcttctggcctctaaggagcaggtgctgcatcgtgttgtcttagaagagaaagttgcacttgagcaacagctggccgaagagaagcacactcctgaatcttgttttatagaggcagcaatccaggaactaaaaacaagggaggaggccctgtccgggctcgctggttcccggcgggaggtgacgggggtggttgccgccctagaacagcttgtcttgatggcccccctcgcaaaggagtccgtgttccaacccaggaagggcgtcctggagtacctgtcggcattcgacgaggaaactaccgaagtgtgcagcctggataccccgtcacgcccccttgccctgcccctggtggaggaggaagaagcagtctctgagccagaacccgagggcctccctgaagcatgtgacgacctggagttagccgacgataatctgaaagaaggcacgatctgcaccgagagctcacagcaggagccaattactaaatctggtttcacccgcctctcgtcctccccttgctactatttctaccaggcagaggacggccagcatatgttcctgcaccccgtaaatgttaggtgtctggtgagagaatacggatcattagagcggtcacctgagaagatttcagccacagttgtagaaatcgccggatactctatgagcgaggacgtgcggcaaaggcacagatacctgagccatcttcccctcacatgcgagttctcaatctgcgaattggctctgcagcctcccgtggtcagcaaggagacgttagaaatgttcagcgacgacatcgagaagcgaaagaggcagcgacagaaaaaagccagagaggaacggaggagagaaagaagaatagagatagaagaaaataagaagcagggtaagtatcctgaagttcacatcccgctggagaacctccagcagtttcctgcttttaattcttacacttgctcatctgatagcgcacttggacccacctctacagaaggtcatggggcgctgagcattagccccctttcgaggagtccaggaagtcatgctgatttcctcctcacaccgttgtcccccaccgcgagccaaggatcgccatccttttgtgtgggcagcctggaggaggactctccgttcccctcgttcgcccagatgttaagagtgggcaaggcgaaagcagacgtgtggccgaagaccgctccaaagaaagacgaaaattccctggttccgcctgctccagtagattccgatggggagagcgataactctgatcgcgtgccagtgcccagcttccagaacagcttcagccaggcaattgaggccgccttcatgaagctggatacgcctgctacctccgaccccttgagcgaagaaaaggggggcaaaaaacggaaaaaacagaagcagaagcttctcttcagcactagcgtggtacatacaaaatag

SEQ ID NO: 17237 - DNA, 189 bp, Artificial Sequence
  Description of Artificial Sequence: Synthetic coding sequence
atgcccgagataagggtaactccattgggtgcttgccctgtgttgtcctggaacctggtgttgccccctgggcgaggaagtcgggcaccaagctctacggataccagaacgggtttccacgtgctgccccacggcgtatccgcttcaagtgaaggcgcacccagacccggagtggatacagtgctgtag

SEQ ID NO: 17238 - DNA, 948 bp, Artificial Sequence
  Description of Artificial Sequence: Synthetic coding sequence
atgtccgggctcgttctgggccagcgggatgagcctgccgggcacagactgagtcaagaagaaatcttgggtagcactcgccttgtgtcccaaggattggaggccttgaggtcggagcatcaggccgtgctccagtctctgtcccaaacaatcgagtgtctgcaacagggagggcacgaggaaggacttgtgcacgaaaaagccaggcagctgcggcgctctatggagaatatcgaactgggcctcagcgaggcccaagtcatgctcgctttggctagccatctgtccacagtcgaatcagaaaaacaaaaattaagagctcaggttagaagactttgccaggagaatcaatggctgagagatgagctggcggggacacagcaacgcctacagcggagtgaacaggccgtggcccagctggaggaagaaaagaaacatctagagttccttggtcagctgagacagtacgacgaggatggccacacctccgaagagaaggagggcgatgctaccaaagacagtctggatgacctgtttcccaatgaggaagaagaggacccctctaacggtcttagccggggtcaaggcgccaccgccgcacagcaaggcggctacgagatacccgcacgactccgtacactccacaacctggttattcaatatgcagcccaaggcaggtacgaagttgccgttcctctgtgtaagcaagccttagaggatctggagcgcacatccggaaggggccaccctgatgtcgccacaatgcttaatatcctcgccctggtgtatagagaccagaataaatacaaggaggctgcccatctgttgaacgacgcattgtccatacgggagagtactctgggtcccgatcacccagcagtgtctattccctgtcccccccacccgacacccagaactccacaccactgctgttttgggttgagttag

SEQ ID NO: 17239 - DNA, 2055 bp, Artificial Sequence
  Description of Artificial Sequence: Synthetic coding sequence
atggagaatttacagactaatttttccctggtacagggaagtactaaaaagctaaacggcatgggcgacgacggcagtcctccagccaaaaagatgattactgatatacatgcgaatggaaaaacaatcaataaggttcccacggttaagaaagaacacctggacgactatggggaggccccagtcgagaccgatggagaacacgtcaagcgaacctgtaccagcgtgccagaaacactccatctgaatccttctttgaagcatactttagcccagtttcacctatccagtcagtcctccctggggggacctgccgccttttcagctaggcacagtcaggagagcatgagcccaactgtattcctcccactgccctccccacaggtccttccgggtcctcttctgattccaagcgactcctctacagagctgacgcagacagtcctggagggagagtcaatctcctgcttccaggtgggcggagagaagaggctatgcctgccacaggtgctgaattcagtgctgcgggaatttacgctgcaacagataaatactgtctgcgacgaactctacatttactgcagcaggtgtacctctgaccagttgcatattctcaaggtattgggcattcttccgttcaatgccccctcttgcgggctaattaccctaacagatgcccaacggctgtgcaacgctttactgcggccccgtactttccctcaaaatggctctgtgctgccagccaagtcaagcctcgctcagcttaaggaaacgggatctgcgttcgaagttgaacacgagtgtttaggtaaatgtcagggactcttcgctccccagttttacgtacagcctgacgccccatgcatccagtgtctggagtgctgtgggatgttcgctccacagacctttgtgatgcactctcataggtcaccggacaaacggacttgtcactggggcttcgagtctgccaaatggcactgctatctccatgtgaatcagaagtacttgggcacgcctgaagagaagaaacttaagatcatcctggaagaaatgaaggagaaattctctatgcgatctggcaagcggaaccaatccaagacagatgctcctagcggcatggagttgcaatcctggtatccagtgataaaacaggaaggcgaccacgtgagccagacgcatagtttcctgcatccttcgtactacctttatatgtgtgacaaagttgtcgccccaaacgtctccctcactagtgctgtttctcaaagtaaagagcttacaaaaacggaggcttccaagagcattagtcggcaaagcgagaaagcccacagcagcggaaaactacaaaaaaccgtgtcctacccagatgtgagcctggaggagcaggaaaagatggatcttaagacatccagggaactctgcagccgactggatgcttcaattagcaacaacagcacctcgaagagaaagagtgagtctgccacatgcaatttggtccgagatataaacaaagtgggcatcggattggtggctgcggccagttccccacttctcgtgaaggacgtaatctgtgaggacgacaagggaaaaattatggaggaggtcatgcggacatacttaaaacagcaggaaaagcttaacctgattttacagaaaaaacagcagctgcaaatggaagtgaagatgttgagctcttcgaagagcatgaaagaactcaccgaggaacagcagaacctacagaaggagctcgaaagtctgcagaacgaacatgcacagcggatggaggagttctacgtcgaacagaaagacctggagaagaagctagaacagataatgaagcagaaatgcacctgtgattctaacctcgaaaaggacaaagaggccgaatacgccggacagttggcagagctcaggcagagactggatcacgctgaggccgaccgccaagaattacaggacgaactgagacaggagagagaggccaggcagaagttagagatgatgatcaaggagctgaaactacagattctgaagtcttctaagacagccaaagagtag

SEQ ID NO: 17240 - DNA, 4050 bp, Artificial Sequence
  Description of Artificial Sequence: Synthetic coding sequence
atggaggagaatgagtcccagaagtgtgaaccttgcctgccatattctgccgaccgccgtcagatgcaggagcagggcaaaggaaatctccacgtcactagccccgaggatgcagagtgtagacgtacgaaggaacgcctgagtaatggcaattcgcgggggtccgtctccaaatcatcccgcaacattccgcggagacacaccttgggcggtccccgatcctctaaagagattctaggtatgcaaacctcagagatggaccgcaagcgcgaggcatttttggaacatctcaaacaaaagtacccacatcacgccagcgcgatcatgggtcaccaggaacggctcagggatcagactcgatcacctaaactttcccattcaccacagccgccaagcctgggtgatcctgtggaacatctttccgaaacttccgcagattcgctcgaggccatgagtgagggcgatgcacccacgccattctcacgcgggagccgtactcgcgcaagtctgcccgtggtgcgatccacaaatcagaccaaggaacggtcattaggggttctttacttgcagtacggcgatgagacaaagcagctgcgcatgcctaacgagataaccagcgctgacacaatcagagcattattcgtaagcgccttcccacagcaattgaccatgaaaatgctcgaaagtccatctgtggccatctacattaaggacgaatcgcgtaacgtatactacgagttaaacgacgtgcgaaacattcaggaccgcagcctcctcaaagtgtacaacaaggacccggcccacgcctttaaccacaccccaaaaaccatgaacggtgacatgagaatgcaacgggagctggtctatgcaagaggggatggccccggagcaccaaggcccggcagcacggctcacccgccccacgccattcccaattctccaccaagcactcccgtgccccattccatgcccccttccccatcccgaatcccatatggggggacccggtcaatggtcgttcctggaaatgctaccatacctcgcgaccgaataagctcgctcccggtgagcaggcctatctcgccatccccttcagcgatattagagcggcgcgatgttaaaccggacgaggacatgtccgggaagaacatcgcgatgtacaggaatgaggggttttacgccgacccttacttgtatcacgaaggccggatgtccattgcctctagtcacggaggacaccccctcgacgtccccgatcacataattgcttaccatcgcaccgccatacgtagcgcttctgcttattgcaaccctagcatgcaggcggaaatgcacatggagcagtctctctaccggcagaaatctcgcaagtacccagatagtcatctaccaacgctgggaagcaagacgcctcctgccagtcctcacagggtctctgatctcaggatgattgacatgcatgcgcattacaatgctcatggcccaccgcacacgatgcagcccgacagagcctcgccaagtaggcaggcctttaaaaaggaaccaggtactctagtttacatcgagaagccgagatccgctgcaggactgagcagcctggtagacctcgggcccccgcttatggaaaaacaggtgtttgcctacagcacagccactatccctaaggatcgcgagacatccgagaaaatgatgaagaccacagcaaacagaaatcatacagattcagcaggcacccctcacgtgagcggcggaaagatgctcagcgccttagagtctacggtccctcccagtcagccccctcctgtgggcacttcggccatccacatgtctcttctggagatgcgccgatcagttgccgagctgagattgcagttgcagcagatgcggcagctccaactacagaaccaggaattgttaagagccatgatgaagaaggccgaattagagatctctggtaaagtgatggaaactatgaaaaggctcgaggacccagtgcaaagacagagagtactcgtggagcaggaaagacaaaagtacttgcacgaggaggaaaagatcgttaaaaagttatgtgagctggaggacttcgtggaggatctaaagaaagactcgacggctgccagccgcctggtgacgttgaaagacgtcgaggacggggccttcctcctgcgtcaggtcggagaagccgtggccactctcaaaggagaattcccaacgctgcagaacaagatgcgggcgatactgcgtatagaagtcgaggcagtccgcttcctgaaagaagaaccacataaactggactcactgctgaagcgagttcgaagcatgacggatgtgttaacaatgctacgccgtcatgttactgacgggttactcaagggcacagacgcggcacaggccgcccagtacatggctatggaaaaggccacggccgctgaagtgctcaagtctcaggaggaagccgcccacacaagcggacagccgttccattccacgggggcccccggggacgccaaaagcgaagttgtcccactgtcaggcatgatggtcagacatgcgcaaagtagtcccgtcgttattcagcccagtcagcatagcgtcgccctgcttaatcctgcccagaatctgcctcacgtggcctcctcccctgccgtaccacaagaggcaacaagtaccttgcagatgagccaagctccacagtcccctcaaatcccaatgaacggaagcgccatgcagagtctgtttatcgaggagatccatagtgtctccgctaaaaatcgggcagtttctatagagaaagcagagaagaagtgggaggaaaaaaggcagaatcttgaccattacaacgggaaagaatttgaaaagctgctggaggaagcacaggctaacatcatgaagagcattccaaatctcgagatgccacctgccactgggcccttgccccgaggggacgcccccgttgacaaagttgaacttagtgaggattcccccaatagcgaacaggatctggaaaagcttggagggaaatcccctccccccccgcccccccccccacggagatcttacctgcccgggagcggattaaccactactcgctccggcgacgtggtgtacacgggtaggaaggaaaacattactgctaaggcaagtagtgaggacgccggaccatccccacagactcgcgctactaagtatcccgcggaagagccagcaagcgcctggacaccttcaccccctccggtgaccacctcctcatctaaggacgaagaggaggaggaagaggagggcgacaagatcatggcagaactccaggcgttccaaaaatgcagctttatggacgtgaattccaattcccatgccgaaccttcgcgtgcagattcacacgtgaaggatacccgaagcggtgccaccgtgccacccaaggagaagaagggtagctccggcgcgcctcagacatcccggatgcccgttcctatgtcagccaagaatagacctggtactcttgataaacctggaaagcagtccaaactacaggacccacgtcagtaccgtcaggccaacggaagcgcgaagaagagcggcggagacttcaaacctacctccccctcactgcctgcaagcaagattccagctctgagtccttcctcagggaaaagctcaagccttccttcctctagcggggatagtagcaacctgcccaatcctcccgccacaaaacccagcatcgcatccaatcctctgtcaccccagactggtccccctgcccactcggcaagtctcatcccaagcgtttctaacgggtccctcaaatttcagagtctgacacatacaggaaaagggcatcacctgtctttctccccccaatcccagaacggcagggcccccccgccccttagtttcagtagtagccctccaagcccggcatcttcagtatccctcaatcagggagccaagggcaccagaacgatacacacgccctccctgacctcttacaaggcacagaatggctcgtccagtaaagccaccccctccacagccaaagaaacctcctag

SEQ ID NO: 17241 - DNA, 177 bp, Artificial Sequence
  Description of Artificial Sequence: Synthetic coding sequence
tgaataatccacaaactggcaatgcagctgcgtcacataggggacaacattgaccacagaatggtgagagaagatcttcagcaggacggacgagacgccttggaccactttgtgttttttttcttcaggagggtccaggtcctgctccattttttctggaacaaccatcttctgtag

SEQ ID NO: 17242 - DNA, 429 bp, Artificial Sequence
  Description of Artificial Sequence: Synthetic coding sequence
atgccggaagaccaagtggggaagctggaagcaaccgagaacactatctccgccatggcagccgctgctgccgagcagcaacagttttacttactgttgggaaatcttttgtcacccgataacgtggtgagaaagcaggctgaagagacgtacgagaacatccctggacagtccaagattacatttctcctccaggccatacggaacaccactgcagccgaggaggcccgccagatggctgcagtcctgctgcgaagactactgagtagcgctttcgacgaggtgtatccggctctgccaagcgacgttcagacggcaataaagagcgagttattgatgatcatacagatggagacccagagcagcatgaggaaaaaggtgtgcgatatagccgcggaactggctcggaacctcattggcgtctattag

SEQ ID NO: 17243 - DNA, 93 bp, Artificial Sequence
  Description of Artificial Sequence: Synthetic coding sequence
atgggaagccggaaaaaagagatagctttgcaggtgaatatatcgactcaggagctttgggaggagatgctgagttccaaaggcctaacctag

SEQ ID NO: 17244 - DNA, 645 bp, Artificial Sequence
  Description of Artificial Sequence: Synthetic coding sequence
atggccggggagaactttgccactccctttcacgggcacgtcggccgcggtgcattttctgacgtgtacgaacccgccgaggatacatttctactacttaacgctctggaggctgcggccgccgagttagccggagtggagatctgcttggaggtgggatcgggctctggagtcgtctccgccttcttggcaagcatgatcgggccgcaggctctttatatgtgtactgatatcaaccccgaagccgctgcgtgtaccttagaaacagctagatgtaataaggtccatatccagccagtcatcacggacctcgtgaaagggcttctgccccgactgactgagaaagtagacctgctggtgttcaaccctccttacgttgtgacccctccacaagaagtaggctcgcacgggatcgaagccgcctgggctggcggcaaaaatggtagggaagtcatggatcgattctttccgctcgtgcccgatcttctgtctcccaaggggctattttatctagtgactatcaaggaaaataatcccgaggaaattctgaagattatgaagacaaagggactgcagggaacgactgcgctctcccgccaggcaggccaggaaaccctatccgtgttgaagtttacaaaatcttag

SEQ ID NO: 17245 - DNA, 1158 bp, Artificial Sequence
  Description of Artificial Sequence: Synthetic coding sequence
atgggccgatggtgccagaccgtagcccgcgggcagagacctcgaacatcagcaccctcccgagcaggcgctttactgctgttattgctgttgttaaggtccgccggctgctggggcgccggagaagcgccaggtgccttatccactgctgacccagcagaccaatcggtccaatgtgtacctaaagcaacttgcccatccagtagacctcgtctcttatggcaaacccccaccacacaaaccctcccgagcaccaccatggagacgcaatttccagtgagtgagggcaaagtggatccctatcgcagctgcggatttagttacgaacaggatcccacactgagggatcctgaggctgtagcccggcggtggccttggatggtcagcgtgcgtgccaatggaactcacatctgcgcaggtaccatcatcgcctcccagtgggtcctgaccgtggctcactgtctgatttggcgtgatgtcatctatagtgtgagagtgggctctccttggattgaccaaatgacacagactgcgtcagacgtcccagtactccaggtcatcatgcactcccggtacagagctcagcggttttggtcatgggtagggcaggctaacgacataggactgctaaagttgaaacaggaactgaaatatagcaactacgtgcgacctatctgcctgccagggacggactacgtgctgaaggaccattccagatgcactgtgacaggttggggactttcaaaggcagacggaatgtggccacaatttagaactatccaagagaaggaagtgattatattgaataataaggaatgcgacaacttctaccacaacttcacaaagatccctacacttgtgcagatcattaagagccagatgatgtgtgccgaggacacccaccgggagaagttctgttacgagctcactggggagccactggtttgctcaatggagggtacatggtacctcgtggggctggtgagctggggcgctggttgccaaaaatcagaagctccccccatttacctgcaggtctcaagctaccagcattggatctgggactgcttaaacggacaggcccttgcccttcccgcgccctcgagaaccctactgctggccctcccactgccactctcactcctggccgctctatag

SEQ ID NO: 17246 - DNA, 255 bp, Artificial Sequence
  Description of Artificial Sequence: Synthetic coding sequence
atgagtggtctcgtgctgggccagagagacgagccagccgggcacaggctgagtcaagaggaaatcctcggaagtacacgccttgtctcccaggggttggaggccttgagaagtgagcaccaggccgtgctccagtccttgtcacagaccatcgaatgcctccagcaggggggacatgaggaagggctcgtgcatgaaaaagcacggcagctgcgcagatccatggagaatatcgagcttggcctgtctgagtag

SEQ ID NO: 17247 - DNA, 483 bp, Artificial Sequence
  Description of Artificial Sequence: Synthetic coding sequence
atgtccgtgaacagcgaaaagtcttcaagtagtgagcgacctgagccgcaacagaaggccccactggtgcctcctcctcccccccctccaccgccccctcctcctcccttacctgaccccaccccccctgaacctgaagaggaaattttaggctcagatgacgaggagcaggaggatcctgcggactactgtaagggcgggtatcacccggtaaagattggagacctgtttaatggcagataccatgtgattcggaagctgggctggggtcacttcagtacagtatggctctgttgggacatgcagggcaagaggttcgtggccatgaaagtggtaaaaagcgctcagcactacactgaaaccgctctggacgagatcaagctcctaaagtgcgtgcgcgaaagcgatccctccgacccgaacaaggacatggtggtgcaattaatagatgactttaaaatctccggtatgaatggaatatag

SEQ ID NO: 17248 - DNA, 66 bp, Artificial Sequence
  Description of Artificial Sequence: Synthetic coding sequence
atgaaccccgcgtccgcaccccctcctctacctccgccaggccagcaagtgattcacgtgacatag

SEQ ID NO: 17249 - DNA, 1212 bp, Artificial Sequence
  Description of Artificial Sequence: Synthetic coding sequence
atgagcggttctgacggcggcctggaggaggagcccgaactgtccatcacactaaccttaagaatgctgatgcacggaaaagaggtcggctctatcattgggaagaaaggagagactgtcaaaaggatccgcgagcagagctcagcccgtattactatctcagaagggagctgcccagagcggatcaccaccataacgggaagcacagctgccgtatttcacgccgtctcaatgatcgcattcaagttagatgaggacctttgtgcagcaccggcaaacggaggcaacgtgagcagacccccagttacactgcgcttggtgattcccgcgagccagtgtggaagcctgattggcaaggccggaaccaagattaaggagatacgcgaaacgaccggcgcccaggttcaagttgccggtgaccttctcccaaattccacggagcgcgctgtgactgtctccggagtgcctgacgcaatcatcctttgtgttcggcaaatctgtgccgttatcttagagtccccccccaaaggagcaacaatcccctaccatccctctctgagtctgggtaccgtcttgctctccgcaaaccaaggcttctctgtccagggacagtatggcgccgtgacgcccgccgaggttacaaagttgcaacagctgagtagccacgccgtcccgttcgccacacccagtgttgtcccaggcctggacccaggcacacagacatcctctcaggagtttctggtcccaaacgatctaattggatgcgtgatagggcggcagggatcaaagatcagtgagatccgccagatgagtggtgcacatattaagatagggaatcaagcagagggcgcaggggaacgtcacgtcacaatcacaggctctcccgtgagtattgcactggcacagtacctgattacagcatgcctggagacagccaagagtacctctgggggcactccttcaagtgctccagctgatctgccagctcccttcagcccgcccctgacagcgcttcctacagccccccctggattgctgggcacgccttacgcaatttcactgtctaatttcatcggcttgaaacctatgccctttctggccctgcccccagcttcccccgggcccccgcctgggttggccgcttacactgccaaaatggccgccgctaatggatccaagaaagcagaacgccagaaattctcaccttactag

SEQ ID NO: 17250 - DNA, 5106 bp, Artificial Sequence
  Description of Artificial Sequence: Synthetic coding sequence
atggggaacagcgacagccagtacaccctgcagggctccaagaaccattcgaacaccataacaggcgctaaacaaataccatgctccctgaagatccgcggtattcacgccaaagaggaaaaatcccttcacggctggggccacggatccaacggggcaggctacaaatcccgaagcctcgctcgctcctgtctgtcccacttcaagagtaaccagccctatgcttctaggttaggtgggccgacttgcaaagtcagcagaggggtggcttatagtacacataggacgaacgccccgggaaaggacttccaaggcatcagcgcagccttttctaccgaaaacggcttccacagtgtgggtcatgagctagcggataaccacattacctcccgggactgtaatggtcacctacttaattgttacgggcggaatgagagtatcgcttccacgcctccaggtgaagatagaaagagcccgcgggtgctgatcaagaccctcggcaagttggatgggtgtctacgggtggagtttcacaatggtgggaacccctcaaaggttccagccgaggactgctcggaacccgtccagctactgagatattcccctacactcgcttcagagacgtcccctgtgcctgaggctaggcgtggctcctctgcagactccctaccgagtcaccgaccttctccaaccgactcccgccttaggagcagtaagggttcttcgttaagttctgagtccagttggtacgattcaccttggggcaatgccggcgagctgagcgaggccgaagggtcttttttggccccaggcatgccagaccccagcctccatgccagcttcccgcctggtgatgcaaaaaagcccttcaaccagtctagctctctaagttcactgcgtgagctatacaaagacgctaatctggggagtctgagcccctcaggcatccgattgagcgacgagtacatggggacacatgcctctttaagtaaccgggtctcttttgcatcagatatcgacgttccctctagggttgcccacggggaccctatacagtatagtagctttacgctgccatgccggaagcctaaggcattcgtggaagatactgctaagaaggattctctcaaggctaggatgaggcggatcagcgactggaccgggtcactatcacgcaaaaagcgtaagctgcaagaaccccggtccaaagaggggtcagactatttcgactcccgcagcgatgggctgaacaccgacgtccaagggagcagccaggctagtgctttcctgtggtctggaggctctactcagatccttagtcagaggtcggagtctactcacgccattggaagtgatcccttgagacagaacatatacgagaattttatgagggagctggagatgtctaggacaaacacagagaatattgaaacatccaccgaaacggctgagagctcttcagaatctctgagtagtctcgagcagttagaccttctgtttgagaaggaacagggagtcgttagaaaggctgggtggctattctttaagccgcttgtgaccgtgcagaaagaacgaaagctagaactggttgcgcggcggaaatggaagcagtattgggtgacattgaagggctgtacattgctcttttacgagacgtacggcaagaattctatggaccagtccagcgctccacggtgcgcactctttgccgaagattccattgtacaatctgtcccagagcaccctaagaaagagaatgtgttttgtctcagtaattcatttggcgacgtgtatctcttccaggcaaccagtcaaacagacctcgaaaattgggtaaccgctgtccatagcgcctgtgcatccctgtttgcgaagaagcacgggaaagaagatactctacgattactcaagaaccagaccaaaaacctcctgcaaaaaatagacatggactcaaagatgaagaaaatggcggaactgcagctgtccgtggtcagtgacccaaagaatcgtaaggccatagaaaatcagatacaacagtgggagcagaacctcgagaagttccatatggatttatttcggatgcggtgttatttagcctcattgcagggaggggaacttcctaaccccaagtcccttctcgccgcagcctccaggccttccaagttggcacttgggcggttgggcattctcagcgtcagttcatttcacgcgttggtgtgcagcagggatgatagcgcactccgtaagcgcactctgtccttaactcagagggggcgaaataagaaaggcatcttcagcagtctcaaaggattggacacccttgctcgcaaaggtaaagaaaaaaggccaagcataacacaggtagacgagctgttacatatatacggaagtaccgtggatggtgtacctcgcgacaatgcttgggagatacaaacctacgtgcatttccaggataaccatggcgtgaccgtcgggattaaacctgagcaccgggtagaggatatactgactctggcttgtaagatgcgccagctcgagccatcacactacggtctgcagttaaggaaactagtggacgataatgtagaatactgcataccggcaccttatgagtatatgcagcagcaggtgtatgacgagatcgaagtgttcccactcaacgtctatgacgttcagttgaccaagacagggtccgtttgtgattttggtttcgctgtcacagctcaggttgacgaacgtcagcacctgtcgcgcatattcatttccgacgtcctacctgacggtcttgcatacggggaggggctccggaaaggcaatgaaatcatgacactaaacggcgaagcggtgtcagaccttgacctaaaacagatggaggctcttttttcagaaaaaagcgttggcctgacgttgatcgctagaccacctgacacgaaggccactctgtgtacaagctggtcagacagcgacctgtttagtagggatcagaagtctctcttacctccaccaaaccagagccagctccttgaagagttcctagataactttaagaaaaataccgccaacgatttctctaacgttcctgatataactaccggactgaagagatcacagaccgacggcactttagatcaagtgagccaccgagagaagatggaacaaaccttccggtcagcggaacaaatcaccgctctgtgccgctccttcaacgactcacaagcaaacgggatggagggcccacgcgaaaatcaggatccaccccctcggtcactggcccgacatctgtctgatgctgaccggctgcgtaaagtcatccaagaactcgtggatactgaaaaatcttacgtgaaagacctgtcatgcctcttcgaactgtacctcgagcctctgcagaacgagacattcctgacccaggatgagatggagagtctttttggatctctgcctgaaatgcttgagtttcaaaaagtgtttctggagaccctggaagatggcattagcgcctccagcgattttaacacgctggaaactccaagtcagttcagaaaattgctgttcagcttaggtggtagcttcttatactacgctgaccacttcaaactttattccggcttttgcgccaatcatattaaagtgcaaaaagtgctcgagagggccaagacggataaagcttttaaagcattcctggacgctcggaatccgaccaaacagcactctagcacgctggagagctatctaattaagccggtgcagcgcgtattgaaatatcctctgctgctcaaagaactagtgtcccttactgatcaggagtccgaagaacattatcacctgaccgaggccctgaaagctatggagaaggttgcatctcatataaatgaaatgcagaagatttatgaggactatggaacagtgttcgaccagttagtggcagagcagtctggcaccgagaaggaagtgacagaactctcaatgggagagctcctgatgcactcgaccgtcagctggcttaatccattcctgtctcttggcaaggcgcgaaaagacctcgagttaactgtgttcgtgttcaagcgtgccgtcattctggtgtacaaggagaattgtaagctcaaaaaaaagctcccttccaattcaagacccgcccataattctacagacctcgatccatttaaattccgatggttgattccgatctctgccttacaggtcaggctcggaaatcccgccggaactgaaaacaactccatatgggaactgatccacacgaagagcgaaatcgaaggccgcccggagaccattttccaactgtgctgttctgattcggaaagcaaaacaaacatagttaaagtgattagatcgattttgcgggagaacttcaggcgacatattaaatgcgagctgcccctcgaaaagacctgcaaagatcggctggtaccactgaagaaccgcgtgccggtatccgcaaagctcgccagcagtcggtctcttaaagttttgaagaacagttcttctaatgagtggacaggcgagacaggcaagggaacgttgttggattcagatgaggggagcctcagctcagggacccagtctagtggttgtcccaccgctgaaggccggcaggatagcaagagtacatccccgggcaagtatcctcacccaggattggctgactttgccgataaccttatcaaggagagtgatatactgtctgacgaagacgatgaccatcgacagaccgtaaagcaggggtctccaaccaaggacattgaaatccagtttcagaggcttaggattagcgaagaccctgatgtccaccccgaggccgagcagcagccaggccccgaatccggcgaaggtcagaagggtggcgagcagccaaaactcgttaggggacacttctgtcctatcaagcgcaaggccaacagtactaaaagagacaggggaactttactgaaggcacagattagacaccagtctctcgacagtcaaagcgaaaacgctacaatcgacttgaattccgtgctggagagagagttttctgtccaatcccttacatccgtagtgtcagaggagtgtttttatgaaacagagagccacggaaaatcgtag

SEQ ID NO: 17251 - DNA, 408 bp, Artificial Sequence
  Description of Artificial Sequence: Synthetic coding sequence
atgggtaagagttgcaaggtcgtggtctgtggccaggcttcagtcgggaaaaccagtattctggaacagttactgtacgggaaccacgtggtcggcagtgagatgatagagactcaagaggatatttacgtcggatccattgagaccgacagaggggtcagggagcaggtgacaattgttgtccttggaaataagtgtgaccttcaggagcaacgccgggttgatccagacgtggcccagcactgggccaagtccgagaaggtcaagctgtgggaggtgagcgtggctgaccgtcggtccttgctggagccctttgtgtatctggcctcaaagatgactcagccacaatctaaatctgcattccccctgtctaggaagaataaaggttccggcagcttggacgggtag

SEQ ID NO: 17252 - DNA, 3693 bp, Artificial Sequence
  Description of Artificial Sequence: Synthetic coding sequence
atgcctcgaaaggggacgcagccctctactgcccgcaggagggaagaaggccctcctcctccttctccagatggggccagctctgatgctgaaccagaacctcccagcggccggaccgaaagtcccgccactgcggcggagactgccagcgaagagcttgataatcgaagcctggaggagattttgaactcaataccacccccacctccaccagcaatgactaacgaagctggggccccccgtcttatgattacacacatcgtcaaccagaactttaagagctatgcaggggagaaaattctgggccctttccacaagcgattcagctgtattattgggcccaatggctctggcaagagcaacgtgatcgactctatgctctttgtatttggctaccgcgcccagaagatcaggtccaagaaactgtccgtcctgattcataattccgacgagcataaggacatccagtcatgcaccgtggaggtacacttccagaaaattattgacaaggagggggatgactacgaggtgattccaaattctaatttctacgtttcaagaacagcctgcagagataacacatccgtctaccacatctccggaaagaagaagaccttcaaagacgtcggcaatctcctgaggagtcacggtatcgatcttgaccacaataggttcctgatcctgcagggcgaggtggagcaaattgccatgatgaagccgaaaggccagactgagcatgacgaaggcatgctggaatacctggaggacattattggatgtggaagattgaacgaaccaatcaaggtactatgcagacgagtagagatcctgaacgagcaccgaggcgagaaactgaaccgggtcaagatggtagagaaagaaaaagatgccctggagggagagaaaaacatcgcaatcgagtttcttacattggagaatgaaatcttcaggaagaagaaccacgtgtgccagtactacatctacgaactgcagaagagaattgctgagatggagacacagaaagagaaaattcatgaggatacaaaggaaattaacgaaaagagcaacatactgtccaatgagatgaaagccaagaacaaagatgtcaaggacacagaaaaaaagctgaacaagatcacgaaatttatcgaagagaataaagagaagttcacacagctcgatctggaggatgttcaagtccgggagaaacttaaacacgccacgtcaaaagctaaaaagttagaaaagcagctacagaaggacaaagagaaggtggaggagttcaaaagcatacccgccaaatccaataacattatcaatgaaacaaccactcggaacaatgctcttgagaaggaaaaagagaaggaagaaaaaaagctgaaggaggtaatggatagtctaaaacaggagacacagggcttacagaaagagaaagagagtcgggaaaaagaactcatgggttttagcaaaagtgttaatgaagcccggtcaaagatggacgtggcccagtcggagcttgatatttacctgagccggcacaacaccgctgtgtcccaactaaccaaagctaaggaggccctgatcgctgcaagcgagaccctgaaagagcgcaaggcagcaattagagacatcgaggggaagctgccacagactgagcaggagctgaaagaaaaagagaaggagctgcagaaacttacccaagaagagaccaactttaagtcattggtccacgacctatttcaaaaagtggaggaggcaaaaagcagtctcgccatgaataggagtcgcggaaaggtgttggatgcaatcatccaggagaaaaagagcggacgcatccctgggatttatggccgtctaggagacctcggtgctattgacgagaagtatgatgtggccatctctagctgctgccacgccctggactatatcgtggttgactctatcgatattgcccaggagtgtgtaaatttcctgaaacggcaaaacattggggtcgctacgttcatcgggctggacaaaatggcggtctgggctaaaaaaatgaccgagattcaaactcctgagaataccccaaggttgtttgacctcgtcaaggtgaaagacgagaagatccggcaagcattttatttcgccctgagggacacgctggtggcagataatttggatcaggctacacgggtggcttatcagaaggaccgacggtggcgagtcgtgaccctgcagggacagatcatcgaacagagtggcacgatgacgggcggcggatcaaaagtgatgaaggggcggatgggctcatcactcgtgatcgagatcagcgaagaagaggtaaataagatggagtctcaactgcagaatgactctaagaaagcaatgcaaatccaggagcagaaggttcagctcgaagaaagggtcgttaaacttcgccactccgagcgagaaatgagaaatacactcgaaaaattcaccgcctccatccagagactcattgaacaggaagaatacttaaatgtacaagtaaaggagctggaggctaatgtgctcgccactgcaccagacaagaaaaaacaaaagctgctggaggagaacgtgagtgccttcaaaactgagtacgacgcagtcgcagaaaaggccggcaaagtagaggccgaagtgaagaggttacacaataccattgtggagattaataaccacaaactgaaagcccaacaggataaattggacaaaataaacaagcaactggacgagtgcgccagtgcaatcacgaaggcccaggtggccattaagaccgcagaccgcaatctgcagaaggcccaggatagtgtgctgcgaactgagaaggaaatcaaagacaccgagaaggaagtggacgacctgacggcagaactgaagagcctggaagataaggcagccgaagtggtcaagaatactaatgctgcggagataagtaagatttccctgcaccctatcgaggacaatcctattgaggaaatctcggtactgtccccagaggatctggaagcaattaagaacccggatagcatcaccaatcagatcgcgctcctcgaagcacgctgccacgaaatgaagcccaatttgggcgcaatcgctgaatacaagaagaaggaagaactttacttacagcgcgtggccgagctggacaagatcacgtatgagcgtgattctttcaggcaggcctatgaagaccttcgaaaacaacgactgaatgaatttatggccggattctacataatcacaaacaagcttaaagagaactaccaaatgctgaccctagggggggatgcggaacttgagcttgttgatagcctggacccatttagtgaggggattatgttctcggttcgccctcccaaaaaaagttggaaaaagatattcaatctgtccggcggggagaaaacactatcaagtctcgctctggttttcgcgctgcaccactacaaacctacacccctctattttatggacgagatcgatgctgctctggatttcaaaaatgtctcgatcgttgcattctacatttatgagcagaccaaaaacgcccagttcatcattatctcacttcgcaacaacatgttcgaaatttctgatagattgattgggatttacaaaacctataatattactaagagtgtggccgtgaatcccaaagaaatcgccagcaagggactatgctag

SEQ ID NO: 17253 - DNA, 267 bp, Artificial Sequence
  Description of Artificial Sequence: Synthetic coding sequence
atgcctgaagatcaggtcggcaagctggaggctacagagaataccatatccgctatggctgcagcggcggctgagcagcagcagttctacctcctgttgggaaatctactgtcccccgataatgttgtacgtaaacaggcagaagaaacttatgaaaatatccctggacagtcgaagattacattcctgctgcaggccatccgcaacacgacggcggctgaagaggctcgccaaatggcagcagttctgttgaggcgactattatag

SEQ ID NO: 17254 - DNA, 3627 bp, Artificial Sequence
  Description of Artificial Sequence: Synthetic coding sequence
atggacagcttgcctgacgaattcttcgtccgtcaccccgccgtggaagatcagaggaaggaggagacagaaaacaaactcgagaagagctccgggcaattgaataaacaggagaacgacatccctacggacctggtccctgtgaatctcttactggaggtaaaaaagctcctgaacgccatcaacacccttcccaaaggggtggtccctcatatcaaaaaattccttcaggaagactttagcttccaaaccatgcaacgggaggtagccgcgaatagtcagaatggggaagaaattgtccctgcattgacgctgaggttcttgattactcagctggaggcagctctgcgaaatattcaggcaggaaactataccgctcaccagatcaacatcggttactatttgacactgctgtttctctatggcgtagccctaaccgaaaggggaaagaaagaggactataccgaagctgagaacaaatttctggtgatgaagatgatgattcaggagaacgaaatttgcgaaaattttatgagtcttgtttacttcggcaggggactactgcgctgcgctcagaaacgttacaacgggggtctattggagtttcacaagtcattgcaggagataggcgataaaaacgatcattggtttgatatcgatcccacagaagacgaggatctgccaacaacattcaaggacctgctgaacaactttatcaaaacaaccgagagtaacattatgaaacagaccatatgcagttatctggactgtgagcggtcttgcgaggccgacatcctcaaaaatacttcttataaggggttttttcagttgatgtgttctaagagctgctgcgtctactttcacaagatttgctggaagaaattcaaaaatctgaagtatccaggagaaaacgatcaaagcttttctgggaaaaaatgcttgaaagaaggatgcacgggcgatatggttcggatgttacagtgtgatgtgcccgggatcgtgaagatattattcgaagtggtgagaaaggacgagtacataacgatcgaaaatcttggcgcttcctatcggaagctgatttcactaaaaattactgatactgatatccgacccaagataagcctcaagttcaacacaaaagatgaaatgccaatatttaagctcgattacaactatttctaccatctactccacattatcatcattagtgggactgatattgtgcggcaaattttcgatgaggccatgccgccacctctcctgaagaaggaacttctgatccataaaaacgttctggagagctattataaccacctgtggacaaatcatcctcttggcgggagttggcacctactgtatccgccaaataaagagctgccacaaagtaagcaattcgacctttgccttttgctggccttgataaaacatctgaatgtgttccctgcacctaagaagggctggaatatggagccaccaagcagtgacataagcaagagtgctgacattctgaggctgtgcaagtaccgagacattctgctctccgagatcttaatgaacggtttgacagagtcacagttcaacagcatctggaaaaaggtgtccgatattctccttcgactcggaatgatgcaggaagacatcgataaggtaaaagagaatccgatcgaaaacattagcctcgactatcatcagctgtccgtttatctcgggatccccgtaccagagattatacagcgcatgctgagttgttaccaacaaggcattgctcttcagagtatcacaggcagccagcgaatcgaaattgaggaactgcagaatgaagaggaggagctgtcgccacctctgatggaatacaacatcaatgtcaaaagtcaccccgaaattcagttcgcagagatcaataaagacgggaccagtatcccaagtgaatcatccacggagtccctaaaggacttgcaggaggtaaagagcaagcagcggaagaagaagaaaacaaagaacaaaaaaaataaggactcaaaggaggaccaagtcccctacgtggttgagaaggaagagcaactgcgaaaagagcaggcaaacccccacagcgtctctaggctaataaaggatgatgcgagcgatgtacaggaagactcggcaatggaggacaaattttattccttagatgagctgcacatcctcgatatgatcgaacagggctctgccggaaaagtgactaccgattacggtgagaccgagaaagagagactcgcacggcagagacagttgtacaagctgcattaccaatgcgaagactttaagaggcagctccggacagtgacttttagatggcaggagaaccagatgcaaattaaaaagaaagataagatcatagcctctcttaatcagcaagtcgcttttggtatcaataaagtgagtaagctccagcggcagattcacgccaaggataacgaaatcaaaaatctgaaggagcagctatccatgaaaaggtcccaatgggagatggaaaaacacaatctggaatccacaatgaagacttacgtcagcaaacttaacgcggaaacatcccgtgccctgaccgctgaagtttactttctccagtgtagaagggacttcggccttctgcacctcgaacagaccgagaaagaatgtttgaaccagcttgccagagtaacccatatggctgcttcgaaccttgaaagcctgcagttgaaggccgccgtggattcctggaatgcaattgtcgcagacgtgcgcaataagatcgcatttctaaggacacaatacaacgagcaaattaacaaggtcaaacagggatttgcactcagtacactccctcccgttcagctgcctcctccgccgccatctccagaaatcctgatgcagcagtttcttgggcgcccactggttaaagaaagtttttttcggccgatcctgacagtgccgcagatgccagccgtatgcccgggtgtggtcagcgccaccggccagccacgggcccctctcatgaccggaattgcttgggcactgccagccccagtgggcgatgcggtgcccccgagcgcaggactccgtagtgacccaagcattatgaattgggaaagaattacggaccggctgaaaacagccttccctcagcagacacgcaaagagctcactgatttccttagaaagctcaaggatgcatacggaaagtcgctgtcggaactaaccttcgacgagattgtctgtaaaatcagtcagttcatcgacccaaagaagtcccagtcccagggaaagtcagtgtctaacgtcaattgcgtttcaccaagccactccccaagtcagccagatgctgcccagccccccaaaccggcatggcgcccgctgaccagccagggcccggccacgtgggagggcgcaagcaaccccgatgaagaagaagaggaagaagagccctgcgtcatttgccatgaaaatctgagtcccgaaaatctgagtgtattgccttgtgcacataaattccatgcccagtgtatccgcccttggctcatgcagcagggcacgtgccccacatgccgcttgcacgtacttctccctgaagaattcccggggcatccctctaggcagctgcctaagatctag

SEQ ID NO: 17255 - DNA, 1743 bp, Artificial Sequence
  Description of Artificial Sequence: Synthetic coding sequence
atggtgctcgtcgggacacaggatgcgatctctgccgccaatcctcgcgtaattgatgactccagagcccggaagctctcaacggatctgaagcgctgtacctattacgagacctgcgcgacttatggacttaacgtcgagcgtgtttttcaagacgtcgcccaaaaggtcgtggcgctgcgcaaaaaacaacaactggcaatcggcccctgtaaatcactgcctaactctccctcccattctgccgtctctgcagcctccattcccgcagtgcacattaatcaggcaacaaacggggggggttctgcattcagcgattattcctccagcgtgccatccactccttctatcagtcagcgcgaactccgcattgagacgatcgccgcttctagtactcctacccctatccggaaacagtctaagagacggagtaacatcttcaccagcagaaaaggcgccgacttggacagagagaaaaaagccgcagaatgtaaggtggatagcataggctctgggcgggctattcctataaagcagggtatcctcctgaagcggagtggcaagtctctgaataaggagtggaaaaaaaaatacgttacattatgtgacaacggactgcttacctaccatccgagcctgcacgattacatgcaaaacatccacggaaaagagattgacctgctgcgtactaccgtgaaagtcccggggaaacgtctgccccgagcgactcctgccactgcccccgggactagtcctcgggcaaacggattgtcagtcgagaggagcaatacccagctgggcggtggcaccgaggcggaagagagtttcgagtttgtagtagtgtccttaaccggccaaacatggcatttcgaagcctcaaccgccgaggaaagggagctatgggtccaaagcgtgcaagcccagattctggcctctctccagggatgcagaagcgccaaagacaaaacaaggcttggcaaccagaacgccgccctggcggtccaggccgtgagaaccgtgcgcggcaactccttttgcatcgattgcgacgctcccaacccagactgggcgagcctcaatctgggagctttaatgtgcatcgagtgctcgggtatacatagacacctgggcgcacatctttcccgtgtacggtccctagatctggacgattggccccccgagcttctggcggtcatgaccgccatgggaaacgccctggccaacagcgtgtgggagggtgctctgggtggctacagcaagcccggtcccgatgcctgtagggaagagaaggaacgctggatccgggctaagtatgagcaaaagctgtttttggcccccctgccttctagcgatgtcccgttggggcaacagctcttgcgggccgtggtggaagatgaccttaggttactggtcatgttgctagcacacgggtcaaaggaggaggtcaatgagacttatggcgacggagatggccgcacggcactgcacctgagctcagcgatggctaatgtagtatttacacagctgctgatttggtacggagtagatgtgcgttctagagatgcgcggggtctgacaccactagcctacgccagacgcgcaggatctcaggagtgtgctgatattttgattcagcacggctgcccgggcgaaggatgtggcctcgcccccacgcctaacagggaaccagccaacggaaccaatccatccgcagaattacatcgtagcccaagcctgctgtag

SEQ ID NO: 17256 - DNA, 312 bp, Artificial Sequence
  Description of Artificial Sequence: Synthetic coding sequence
atggcagaactgattcagaagaagctacagggcgaggtggaaaagtaccaacaactgcagaaggacttgagcaaatcaatgtccggtcgccagaagctggaggcccagctgaccgagaacaacattgtgaaggaggagcttgcacttttagacgggagcaacgtcgtttttaaactgttaggccctgtgttagtgaagcaggaattgggagaagcgagggccactgtggggaagcgcttggattacattactgcggaaatctttcttcggactataccagatcctggcgacgttcctgactcctttttctag

SEQ ID NO: 17257 - DNA, 453 bp, Artificial Sequence
  Description of Artificial Sequence: Synthetic coding sequence
atgacgtcacggaagaaggtcttgctcaaggtgatcattctgggagatagcggtgtcgggaaaacatctttgatgaaccagtatgtgaacaagaaattttctaatcagtacaaggccaccatcggtgccgacttcttaacaaaagaggtgatggtggatgaccggcttgtgacaatgcagatctgggataccgcgggacaggaaaggttccaaagcctgggcgtggccttctatagaggtgcggactgttgcgttttggtgttcgatgtgaccgctcccaatacatttaagacgctggactcatggagggacgaatttctgatacaggccagccccagggatccggagaattttccatttgtagttttaggaaataagatagacttagaaaacagacaagtcgcaacaaagcgtgctcaggcatggtgttattcaaagaataatattccctag

SEQ ID NO: 17258 - DNA, 540 bp, Artificial Sequence
  Description of Artificial Sequence: Synthetic coding sequence
atgaccgatctcgtggccgtgtgggatgtagctctgtctgacggcgtgcacaaaatcgaattcgaacatggaaccacatctgggaagagagttgtttatgtggacggcaaagaggaaatacgtaaggagtggatgttcaaactggtggggaaagagactttctacgtcggcgcagcaaaaacaaaagccacgataaacattgatgccatttcaggttttgcctatgaatacactctggagatcaacggaaagtcattaaagaaatatatggaggacaggagtaagactacaaatacttgggtgctccatatggatggagagaacttcagaatcgtacttgagaaagatgcgatggatgtgtggtgtaacgggaagaagctagaaaccgccggcgagtttgttgacgatggcaccgaaacacacttctcaatcggcaaccatgattgttatattaaagccgtaagctccggtaagaggaaagagggaatcattcacaccttgatcgttgataacagagagattccagagatcgccagctag

SEQ ID NO: 17259 - DNA, 171 bp, Artificial Sequence
  Description of Artificial Sequence: Synthetic coding sequence
atggatagttccatacatctgtcatccttgatctcccggcacgatgacgaagctactagaacatcaacttctgagggcttggaggagggcgaagtggaaggagagacactccttattgtggagtcagaggaccaagccagcgtcgacctcagccatgatcagagcgggtag

SEQ ID NO: 17260 - DNA, 153 bp, Artificial Sequence
  Description of Artificial Sequence: Synthetic coding sequence
atgtgcagtacaagtgggtgcgacctcgaagaaatcccattggatgatgatgacttgaatactattgaatttaagatcctcgcctattatacacgacaccatgtatttaagtctacacctgctctgtttagtcctaagctgctgaggacctag

SEQ ID NO: 17261 - DNA, 1203 bp, Artificial Sequence
  Description of Artificial Sequence: Synthetic coding sequence
atgaaccccgcatcggctccaccccctctgcccccaccaggacagcaggtcatccatgtgactcaggatttggataccgatttggaggccctattcaatagtgtgatgaatcctaaaccttcttcttggcggaagaagattctccccgaatcattctttaaggagccagattccggctcccacagcaggcaaagctctactgattcatctggcgggcacccagggcctcggctcgccggtggagctcagcacgtgcggtctcactcgtcccccgcatccctccagctcggaacaggagctggtgccgccggaagcccagcacagcagcatgcacatctgagacaacagtcctacgacgttaccgatgagctcccccttccacccgggtgggaaatgactttcactgccacaggacagcgatattttctaaaccacattgagaagatcaccacttggcaggaccctcgaaaggccatgaaccaaccactgaaccacatgaatttacatcctgccgtcagcagcacccccgtaccccagcgatccatggcagtgtcccagccaaatctggtgatgaaccaccagcaccaacaacaaatggctccctcgactctgtcccagcagaaccatccaacccagaacccccccgccggcttgatgtcaatgccaaatgcacttaccacgcagcagcagcaacagcagaagctccggctgcaacggatccagatggaacgggagcggatccgtatgcgccaggaagaacttatgagacaggaagccgccctttgcagacagctccccatggaggccgagacgctcgccccggtacaggcggccgttaatccccccactatgacgcccgacatgcgaagtatcactaataactcttccgatcctttcctcaacgggggaccataccactcccgcgagcaatcaaccgattccggactcggcctgggctgttattctgtgcccacgacaccagaggattttctttccaatgtggacgagatggacaccggagagaacgcaggccagactcccatgaacattaaccctcagcagacccgctttcctgactttcttgactgcttgcctgggacaaatgtagatttagggaccctggaatccgaggacctgatccctttattcaacgacgttgaatctgcccttaacaagagtgaaccctttttgacatggctctag

SEQ ID NO: 17262 - DNA, 513 bp, Artificial Sequence
  Description of Artificial Sequence: Synthetic coding sequence
atgccccggaaagggactcagccaagcaccgcccggcggcgcgaggaagggccccccccaccaagtcctgacggtgcatcatctgatgcggagcccgagcctccaagcgggcggacagagagtccagccactgcggcggagactgcttcagaagagctggacaacagaagtctggaggagattctgaatagcatccctccacctcccccaccagcaatgacaaacgaggccggcgcacccaggctcatgatcacacacatcgttaaccaaaacttcaagtcctacgcaggggagaagatcttgggacctttccacaagaggttttcctgtatcataggtcccaatgggtcgggcaaatcaaacgtcatagactccatgcttttcgtgttcggctaccgagcacaaaaaattcggtcaaagaaacttagcgtcttgatccataatagcgacgagcacaaagatatccagtcctgcaccgttgaagtgcacttccagaaaataattgacaagtag

SEQ ID NO: 17263 - DNA, 504 bp, Artificial Sequence
  Description of Artificial Sequence: Synthetic coding sequence
atggagaaagctgttaacgatggaagccactccgaggagctcttttgccatttgaagacaatctcggagaaagaggacctacccagatgtactagcgaatctcacctgagttgtttaaagcaggatatcctcaacgaaaagacagagctggaggccactctcaaggaggccgagctcgtcacccactcagtcgagcttctcttacctctgtttaaggatactatcgaaaaaatcaacttcgagaacgcgaacctatcagctctcaaccttaagataagcgaacagaaggagattctcattaaagagctggataccttcaaatcagtgaaacttgctctggagcaccttctgcgtaaacgggactacaaacaaacaggagacaatttgagttctatgctgctcgaaaatcttaccgacaacgagagtgaaaacacaaatttgaagaaaaaggtgtttgagaaagaggcgcatatccaggagctaagctgcttattccagtcctag

SEQ ID NO: 17264 - DNA, 2376 bp, Artificial Sequence
  Description of Artificial Sequence: Synthetic coding sequence
atgtcaaaccagcaggagaagtacgaagcccaaaatattgtgaactccaccgaggagtcagatgacgccttcgataccgtcaccatcccagtacctagtgaggagccccaggaaagcgatcagactgaggagcacgagtcaggcattgagcagtttagcgagtcccacgccatccatgtggaggagcagagcgatcagagcttcagctcactcgagcccgacaacgagcagctgatggaagaagtgatttcccccagacaagtcagctatactccccagcaccacgaaaaacagtacgcaatgcagcgccctaatgatgactctctggccttcctggataaaatcaaatcggtgaaagaaagcttgcaagaatctgtggaggactctctggccaccgtcaaggttgtgctgataccggtgggacaggaaattgttattcccttcaaggttgacacaatactcaagtacctaaaagatcacttttcacatctgctgggaatccctcattcggtcctccagattaggtactccggcaaaatcctgaagaataacgagaccctggtacagcacggcgtgaagcctcaggagattgtgcaagtggagattttctctaccaacccagatttatacccggtcagacgaattgacggcctgactgatgtctcacagataattactgtgaccgtgcagactggcctcgaccaataccagcaggtgcccgtagagatcgtcaagtccgattttcacaagccctttctgggagggttccggcacaaagtgaccggtgtggaatatcacaatgctggtacacagaccgtcccaaaacggatacctgagcgtctgagtatcttctgcagagacactcagactgtctttcaaaagaaaaacctccagcagaccactaacacaaccagcactcagatgacaaacatcggagtgtacgtgtccaacatgacagacaagctggtgactccaggtaaatacttcagcgcagcagaataccacgctcagcgcctgaaggccgttatagtgatccagacctactatcgccaatggcatgccaagattttcgtggagaatcttcgcaggcagaagtctctgagactggagtgggaaacgcagcaggaactgcgcaagatccgagaaaaagaagaatggatcaagttagactaccatcgccgacacaaccccaaaactaacgaagacttcgagttcctgtacaacgccctggagttttggcggcaagaagaactcactcggatcaatcaatcctttaccggagccgaaagaaaggccgctttatgcgagttactggaaaaggagacgcaaattatcgcctcaattgggaggcataggtatatcgcctatatggcaaatcaggaggctgcgattcaagccttcttagataaatgcagcgcccctaagatctggaggacgcccaatggcaaaacgatcgagatggatactcaattcaccattcgcgcccgcgaacttcagaatatttataagtgtataatgttaaaaaatatctcacaggacgaaaggttggacgtattgcttacccttaagcataccgtaaaagagcacgagtgcaagcttacccaggagatcctggaactcatcgatagggaggtggatctcatgatgcggggagtgaaacaccataacctggaaggactacgcaagaggatcgccaccttgttcttccactacattaagactcccctctttaatccagaggtcgcaaaatatttaaaggtgccccaggatcctcttaagttctacaaaaagatttatttttgccacagctgccagctctacttgccatcgaccgaattttccgtgtccagcacctcacgtcgcatctatcgctgcaggaactgtatcaacctgcagaatgaagcccaaaagcgggagagtttcctgaaatataagtgtctgctgcagcagctgtactacactgaagccgactacgaggacgattcaaagatcgcttttttaatgcaacttcaggacatccagtatctcaccgaaaatatttgggcctcacagtcagtcctgtctgcctgcgataatctgagcgatctggtgatggtgcgatggaataagtctttagagtggtctccttggaattgcattctcctgacgaaggacgaagctgccgctcatcttaagttgacatcaatcgaggaaggttacgaacgatctttcattcacaaaatcaaacacaagcatatcctcgccaagaactattttagtcaggtcccagttctggcctctttcatcctggatgatggggagatcgatgaaatcagatggaagtaccattctgacacaacaccaaaaattatagaatcccaacgccctcctcactag

SEQ ID NO: 17265 - DNA, 687 bp, Artificial Sequence
  Description of Artificial Sequence: Synthetic coding sequence
atgactgaccagacttactgcgatagattggtgcaagatacaccatttcttacaggacatggcaggttatctgagcagcaggtggacaggattatcttacagttgaaccgttactacccccaaattctgacaaataaagaggctgaaaaattccggaatccaaaggccagcctgagggtgaggctctgcgatcttttgagccacctgcagaggtctggggagagggactgccaggagttctacagagccctgtatatacacgcgcagccacttcactcccgtcttccctcacgccacgccctgaggaaattccacattactaaccatgcatgcctggtgctcgctcggggggggcacccatcactgcccttgatggcctggatgagttccatgacaactcaggtgtgttgctcgcccgggcttgccagtccactggcctctgcccctcctcaacgaccgccatccggacccgagggtcgagtttggcaggcccaggccgtgcagatgctggtgagcgtatcacatttcctcccactgcccccgtcgctcagtcacggatctttccacactgcctggggaatcctgtacgtgcactcctgtccctccttttcgaatctgattcccaggggctcactgcatgtgtgcgtggacagcaacttggtgcccacagccgcctggagaagctag

SEQ ID NO: 17266 - DNA, 948 bp, Artificial Sequence
  Description of Artificial Sequence: Synthetic coding sequence
atgcccggactttcctgtcgtttctatcagcacaagttccccgaggtagaggatgtggtgatggtgaatgtgcggtctattgcagaaatgggggcttatgtctctctgcttgagtacaacaacatcgaagggatgatcctgctgtccgagctgtcccgtcggagaattagaagcatcaataagttaatcagaatcggcagaaatgagtgtgtggtggtaattcgagtagataaagagaaaggttatatagatctatccaaacgccgcgtaagcccggaggaagctattaaatgtgaggataagttcacaaagagcaaaaccgtgtatagcatcctcaggcatgttgcggaggtgctggagtacacgaaggacgaacagctcgaaagcttattccagaggactgcctgggtgttcgatgataaatataagagaccgggctatggcgcttatgacgccttcaaacacgcagtatcagatccatccatcttagattctctcgatctgaacgaggatgagcgtgaggtactgattaacaatataaaccgacggctaaccccacaggcggtgaagattcgagcagatattgaggtcgcctgttatgggtacgagggtatcgacgccgtgaaggaggcgctgcgcgccggtcttaattgctcaacagagaatatgccaattaaaatcaatcttatagcccctccaagatatgttatgacaacgacgacacttgagagaaccgagggattgtctgtgctatcgcaggctatggccgtcatcaaggaaaaaattgaagagaaacgtggtgtgttcaatgttcagatggagccaaaagtggtcacggacaccgacgaaacagaattggcacggcaaatggaaaggctggagagagaaaacgccgaggtcgatggagacgacgatgcagaagaaatggaagccaaggctgaggattag

SEQ ID NO: 17267 - DNA, 1203 bp, Artificial Sequence
  Description of Artificial Sequence: Synthetic coding sequence
atgaaccccgcttcagcacccccgcctttgcctcctccgggtcagcaggttattcacgtgacccaggacctggatacagatctcgaagcccttttcaatagtgtgatgaaccctaagccgtcctcctggcgaaagaaaatcctccctgaatcatttttcaaggaacctgattccggcagtcactcccggcagagctccacagacagttcgggaggccatcctggaccgagactcgctggtggagcgcagcacgtcagatcacactcatccccagcctcactgcagctgggcacaggtgccggggcagccggctccccagcacagcagcatgcccacttaaggcagcagagttatgacgttacagacgagctgccactaccccctggctgggaaatgaccttcaccgccaccggacagcgatattttctcaaccacatcgagaagataaccacctggcaggacccccgtaaggctatgaatcagccacttaatcatatgaacctccacccggccgtgtcctcaactccagtccctcaaagaagcatggccgtatctcagccgaacctagtgatgaatcaccagcatcaacaacagatggcacccagtactctctctcaacagaatcatcctacacagaatcctcccgctggattaatgagtatgcccaacgcattgacgactcagcagcaacagcagcagaagctgcgcctacagaggatacagatggaaagggaacgcatacgaatgcggcaggaagagctgatgcgacaagaagcagccctgtgtcgtcaacttcctatggaggctgagacactggcaccggttcaggctgctgtgaaccccccgacaatgactccagatatgcgctccattactaataattcttcagatccattccttaatggcggaccttatcactcaagagagcaatccaccgactcaggccttggtttagggtgttactccgtgcctactactcctgaggactttttgagtaacgttgatgagatggacaccggtgaaaacgccggtcagaccccgatgaacatcaatccccaacagacgcggtttcccgactttcttgactgcctgcctggtacaaatgtcgatcttggaaccctggaatcggaagacctcattccattatttaacgacgtcgaatcagctctgaataaaagcgagcccttcctcacctggctctag

SEQ ID NO: 17268 - DNA, 381 bp, Artificial Sequence
  Description of Artificial Sequence: Synthetic coding sequence
atggtgctgattctgggcagaaggctgaaccgagaggacctgggagtgcgggactcgccagcaaccaagagaaaagttttcgagatggatcccaaatccctgacaggtcacgaatttttcgacttttcctccgggtcttctcacgccgagaacatacttcagatcttcaacgaatttcgggactcgcggctcttcactgacgtcataatctgtgtcgaaggcaaggagttcccctgccaccgggcggtactctccgcatgcagttcctatttcagagccatgttttgtaatgaccaccgcgaatcccgggagatgctcgtagagatcaacgggatcctggcagaggcaatggagtgcttcctgcagtacgtgtacacatag

SEQ ID NO: 17269 - DNA, 312 bp, Artificial Sequence
  Description of Artificial Sequence: Synthetic coding sequence
atggcagagttaattcagaagaagctgcaaggcgaagtggagaaatatcagcagctgcagaaggacctgagtaagtctatgagcggccgtcaaaagctggaagctcagcttactgagaacaacatagtaaaagaggagcttgcacttctcgacggctccaacgtcgtgttcaagctactaggacctgtgctggttaagcaagagctcggagaggcccgagcaacagttggaaagcggttggattacatcacagctgaaatcttcctgcgcactatcccagacccaggggacgttcccgacagcttcttctag

SEQ ID NO: 17270 - DNA, 237 bp, Artificial Sequence
  Description of Artificial Sequence: Synthetic coding sequence
atggtacttatcctggggagacggctgaacagggaggacctgggcgtgcgggactcccccgcaacaaagcggaaagtgtttgagatggatccgaagtcactcacaggacatgaatttttcgacttcagctcaggctcaagccacgcagaaaatattttacagattttcaacgaatttcgggactcgagattgtttactgacgtgatcatatgcgtagaaggaaaggagtttccgtag

SEQ ID NO: 17271 - DNA, 1320 bp, Artificial Sequence
  Description of Artificial Sequence: Synthetic coding sequence
atggcggccaatttgtcgcgcaatggccccgccctccaagaggcctatgtaagagtagtgactgaaaagagccccacggactgggccctgtttacatacgaaggaaactcaaacgacattcgcgtagccggcaccggcgaaggtggcctggaagaaatggtggaggagttgaatagcgggaaagtcatgtacgccttctgtagggtgaaggaccctaatagtggcctcccaaagtttgtcttaataaattggaccggggagggagtaaacgacgtgcgaaagggtgcttgtgcatctcacgtaagcacaatggcctctttcttgaagggagcacatgtgaccatcaatgcccgtgccgaggaggacgtagagcccgagtgtatcatggagaaagtggccaaggccagcggcgctaactactcattccacaaagagagcggtagatttcaggacgtgggaccacaggcccccgtggggagcgtgtaccagaaaacaaatgccgtgtccgagatcaaaagagtcggtaaggacagtttctgggccaaagctgaaaaggaagaggagaatagacgtctggaagagaagcggcgcgctgaggaggcccagaggcaactcgaacaggagaggagagaaagagagctgcgcgaggcggcccgcagggaacagcgttatcaagagcagggcggggaagccagcccacaatcacgaacgtgggaacagcaacaggaagtggtttcacgcaatcgtaatgaacaaggatccacctgcgcctccctgcaagagtcagctgttcatccaagagagatcttcaagcagaaggaaagggccatgtccacaaccagtatttcatccccccaacccggcaaactgaggtccccctttctgcaaaagcaattgactcagcccgagactcattttggccgcgagccagccgcggctatcagtaggcctcgtgccgacctgccagcagaggaacctgctccttccacccccccctgcctggtgcaggctgaagaggaagcagtgtacgaagagccgcctgagcaggagaccttctacgagcagccacccctcgtccagcaacagggcgctggttccgagcacatcgaccatcacatacaggggcagggtttgtcggggcagggtttgtgcgctcgggccctttacgattaccaggcagcagacgacactgaaattagttttgatcctgaaaaccttatcacaggcattgaagttatcgacgagggatggtggcgtggttacgggccagacggccacttcggcatgtttccagccaattacgtggaactgattgaatag

SEQ ID NO: 17272 - DNA, 219 bp, Artificial Sequence
  Description of Artificial Sequence: Synthetic coding sequence
atgagctaccagcaacagcagtgtaaacagccttgccagcctccaccagtgtgcccagcccccaagtgtccagaaccctgtcccccgcccaaatgccccgagccatgccccccttctaagtgccctcagtcttgccctccccagcaatgtcagcagaagtgccccccggtcacccctagcccaccgtgccagcccaagtgcccgccaaaatccaagtag

SEQ ID NO: 17273 - DNA, 342 bp, Artificial Sequence
  Description of Artificial Sequence: Synthetic coding sequence
atgtctgcaatccaaaacctgcactcatttgaccctttcgctgatgcctctaagggggatgacctcttgcctgccggaaccgaggactacatacacatcaggatccagcagcgtaacggccgcaaaaccttaacgaccgttcaggggatagccgacgactacgataaaaagaagttggttaaggcgttcaaaaaaaaattcgcgtgtaatgggaccgttatagagcaccctgagtatggagaggtgattcaattgcagggtgaccaacgaaagaatatctgtcaattcctggttgagatcgggctggccaaggatgaccagctgaaggtacacggattctag

SEQ ID NO: 17274 - DNA, 927 bp, Artificial Sequence
  Description of Artificial Sequence: Synthetic coding sequence
atggccagttctaatacggtgcttatgcggcttgtggcctctgcatacagcattgctcaaaaggctggcatgatcgtccgccgcgtaattgccgagggcgacctgggtatcgttgagaagacatgtgccacagatctccaaaccaaagctgatcggctggcccaaatgtctatttgttccagcctggcccgaaaatttcccaagctgacaataattggggaagaagaccttccgagcgaagaggtggaccaggagctgatagaggattcacaatgggaggagattctcaagcaaccctgtccttcgcagtacagtgctatcaaagaggaggacctggtcgtctgggttgaccccttagacggcactaaggaatacacagagggcctgttagataacgtgacagttctgatcggcatcgcctatgaaggcaaagcgatcgctggagtgatcaaccagccctattacaattacgaggccggacctgacgcagtgttgggtcgaactatatggggcgtgctggggttaggggcctttggctttcagctgaaggaagtacctgcaggcaaacatattatcacaaccacaaggtctcatagcaacaaacttgtaaccgactgtgtggcagcaatgaacccagatgccgtccttagggtcggcggagcaggaaataaaataatccaactaattgaaggaaaggcctccgcctatgtgtttgcctctcctggctgcaaaaaatgggacacatgcgccccagaggtcatcctgcacgcagtggggggaaaactgaccgacattcatggcaatgttctccaataccataaggatgtcaaacacatgaacagtgcaggcgtcctcgccactctacgcaactatgactattatgcctctcgtgtgcctgagtcaattaaaaacgcattagttccttag

SEQ ID NO: 17275 - DNA, 1809 bp, Artificial Sequence
  Description of Artificial Sequence: Synthetic coding sequence
atgattgagaaaatgcaagggagcaggatggacgaacagaggtgctcgtttccaccaccactaaagaccgaagaagactatatcccctatccaagtgtacatgaagtcctggggcgggaggggccattccccctaattctgctgccacagttcggcgggtactggatcgagggcaccaaccatgagattacctcaatccctgagaccgaacccctccaatccccaaccaccaaagtgaaactcgaatgtaaccctaccgctcggatctatagaaagcactttctgggaaaagagcactttaattactactcactggatgcagcactgggccatcttgtgttctcgcttaagtatgatgtcataggtgaccaggagcacttgagactgttactccgtaccaaatgcaggacctaccatgacgtaatccctatcagttgcctaacagagttcccaaacgttgtccagatggcaaaattggtgtgcgaagacgtgaatgtagacaggttctatcctgtcctataccctaaagcctcaagattaattgtcacatttgatgaacacgtaatctcgaataatttcaaatttggagtcatttaccagaagctcggccagacttctgaggaagagctgttctcaacaaatgaagagtcgccagccttcgtggagtttctcgagtttttaggacagaaggtcaagctgcaggatttcaaggggttcagaggtggactggacgtgactcacggccagacgggaacagagtccgtttactgcaattttagaaataaggagatcatgttccacgtgagcaccaagcttccttacactgaaggtgacgcccagcagttacaacggaaaagacacattggcaacgatatagtggccgtagtctttcaggacgagaatactcccttcgtgcctgacatgatcgcatcaaacttcctgcatgcttacgtcgtggttcaggccgaaggaggcggacctgacggacccctgtacaaggtatcagtcactgcccgtgacgacgtcccttttttcggccctccgctgcccgaccccgcagtatttcgcaagggaccggaatttcaggagtttctgctcacaaagctgattaacgcagagtacgcttgttataaggcagagaaattcgcaaaattagaagaaagaaccagggctgcacttctcgaaaccctctacgaagaactccacatccattcccagtcaatgatgggcttgggcggcgacgaagacaagatggagaatgggagcggcggtggagggttctttgaatccttcaagagggtgattaggtcccgcagtcagagcatggacgccatggggctgagcaataaaaagcccaatacggtgagtacctctcattccggcagctttgcacctaataaccccgatctagccaaagccgccggaatttcgctgatagtgcccggcaaaagtcctactagaaagaagtccgggccttttgggagccgcagatcctcagcgatcggtatcgaaaatatccaggaagtccaggagaaacgcgaaagcccgccagcggggcagaagactcctgattctggccatgtcagtcaggagcccaaatccgaaaactcttcgacacagagctcgcctgagatgcctacaaccaaaaaccgagcagaaacagcagctcagcgagcagaggctctgaaggatttctctagaagcagtagctctgcttcctcatttgcttctgttgtggaggaaactgaaggagtggacggggaagatacgggcctgcatgtagctggcggacagtgccaacatcactag

SEQ ID NO: 17276 - DNA, 177 bp, Artificial Sequence
  Description of Artificial Sequence: Synthetic coding sequence
atgggtagggtgtgggacctccccggtgtgctgaaggtggaaggcttccgcgctaccatggctcagaggttagttagagtcctccagatttgcgccggccatgtccctggggtatctgccctgaacctgcttagtcttctgcgaagcagcgaggggccatctctcgaggacctttag

SEQ ID NO: 17277 - DNA, 2199 bp, Artificial Sequence
  Description of Artificial Sequence: Synthetic coding sequence
atgctgccatgtgccgcaggggctagaggccggggggctatggtggtgttacgggcaggaaagaaaacgttcctgccacccctttgtagggcatttgcttgtaggggatgccagctggctccagagcgcggagctgagagacgagataccgctccttctggcgtctcaaggttctgtcctcctaggaaatcctgccacgactggataggtccacctgataagtactctaatctgcggccagtccatttttatatccccgaaaatgaaagtccactggagcaaaagctgcggaagttgcgccaggagacccaggaatggaatcagcagttttgggctaaccaaaacctaactttctccaaagaaaaagaggaattcatccattctagattaaaaacaaagggcttaggcctccggacagagtctggtcagaaggccacactgaacgcagaggagatggccgatttctacaaggagtttttaagcaaaaatttccagaaacatatgtactacaaccggatgtacgataacatgagcacaatggtctacatcaaggaagacaagcttgagaagctgacccaggacgagatcattagtaagactaagcaggttattcaaggactagaggcactgaaaaatgaacataacagtatcctccaatcgttgcttgagacactcaagtgtctaaaaaaggatgacgagtctaatctggtggaggagaaatcaaacatgatcaggaagtctctggaaatgctggaactgggcttgtccgaggcacaggttatgatggccctgagtaaccatctgaacgctgtcgagtcggaaaaacagaaattacgcgcacaggtgagacggctctgtcaagaaaatcagtggctgcgcgacgagctggccaatacgcagcagaaactgcagaaaagcgagcagtctgtggcccagttggaggaagagaagaagcacctggaattcatgaaccagcttaaaaagtacgacgatgacattagcccatctgaagataaagataccgatagcaccaaggaacccctagacgacttgtttcctaatgacgaggacgacccgggacaaggcatccaacagcagcactcgtcagctgccgcagctgcccagcagggcggatatgaaattcctgcacgcctgcggactcttcacaacctcgtcattcagtacgctagccaaggtcgatatgaagtcgccgtgcctctgtgcaaacaagcacttgaagacctggaaaaaacatccggccacgatcaccctgatgtagcaactatgttaaacattctcgccttagtgtacagagaccagaacaaatataaagacgcagctaatctcttgaacgatgccctcgccatccgggagaaaacactgggaaaggatcaccccgctgttgccgcgaccctgaataatctcgctgtgctctacggcaagcgtggaaaatacaaagaagcagagcccctgtgcaagcgggcacttgagataagagagaaagtgttggggaaggaccacccggacgtggctaagcagctcaataatttggccctactctgccagaaccaggggaaatatgaagaagtggagtactattatcagcgggcgctagagatctaccagaccaaactcggtcccgatgaccctaatgtcgcaaagacaaagaataacctggccagctgctacttaaaacagggaaagtttaaacaagccgagaccctgtataaagagattctgacaagagctcatgagagggagtttggcagcgtagacgacgagaacaagcccatttggatgcacgctgaggaaagggaggaatgtaaaggcaagcagaaagacggtactagttttggagaatacgggggctggtacaaagcctgtaaagtggattcccccacggtcaccacaacgctgaaaaacttgggggcgttgtatcgacggcaaggcaagtttgaggctgcagagaccttagaggaggccgccatgagatcccggaagcagggacttgacaacgtccataagcaacgggtggccgaggtccttaatgatccagagaatatggaaaaacgccgtagcagagagagcttgaatgtggacgtagtcaaatacgagtccggccccgacgggggtgaagaggtttccatgtctgtggaatggaatggcatgaggaagatgaaattaggacttgtgaattag

SEQ ID NO: 17278 - DNA, 249 bp, Artificial Sequence
  Description of Artificial Sequence: Synthetic coding sequence
atgagcggcctggttctgggtcaacgagatgagcctgccggacatcggctgtcacaggaggaaatcctgggcagcactcggctggtcagtcaggggctcgaagctctgcggagtgaacaccaggcagtgttacaaagcctgtcacagacaattgaatgtttgcaacaaggtggccatgaagagggcctcgtacatgagaaggccaggcagcttcggaggtctatggagaatattgagctgggactatag

SEQ ID NO: 17279 - DNA, 222 bp, Artificial Sequence
  Description of Artificial Sequence: Synthetic coding sequence
atggttctcattctaggaagaagattaaaccgagaagacttgggggtacgtgatagcccagccaccaagagaaaagtattcgagatggatcccaagtctctcacggggcatgagtttttcgatttctctagcggcagcagccacgccgaaaacattctccagatcttcaacgagtttcgtgacagtaggctgtttaccgatgtgattatttgtgtggaatag

SEQ ID NO: 17280 - DNA, 1191 bp, Artificial Sequence
  Description of Artificial Sequence: Synthetic coding sequence
atgaatttccaagcgggggggggtcaatctcctcagcagcagcaaagtctggctgcccccggcgggggaggagccgcagcacaacagctggtgtgtggcggccagtttggcggggctggaccaggagccgggggggggggaggccccagccagcaactggctggtgggcctccgcagcagttcgccctgagcaattctgccgctattcgcgccgaaattcagcggttcgaatctgtacaccctaacatttatgctatttacgatctaatcgaaaggatagaagacctcgctcttcaaaaccagatccgcgagcatgttatcagcatcgaggacagcttcgtgaacagtcaggagtggactctcagccgctccgtgccagaactcaaagtcggcattgtaggaaatctgtccagcggaaagtcggccttagtccaccggtacctaactggaacctatgtccaggaggagtccccagagggcgggcgtttcaaaaaagaaatcgtcgttgacggccaaagctatctgctgctgattcgggacgaaggaggccctccggagttacagtttgcagcctgggtcgatgcagtggtcttcgtcttttcccttgaggatgaaatatcatttcagaccgtgtacaactacttcttgcggctatgcagctttcggaatgctagcgaagttcccatggttctggtggggacacaggatgcaatcagtgcagctaatccccgagttatcgacgactctagagcacgaaagctcagtaccgatctcaagcgatgcacttattatgaaacgtgcgccacctatgggttgaatgtcgagagagtttttcaggatgtggcccagaaggtcgtggcactgagaaaaaaacagcagctggccattgggccatgcaagagcctgccaaactcccccagtcacagcgctgtcagcgccgccagtattcccgccgtccacatcaaccaagccacaaacggcggaggctccgcctttagcgactatagttcctccgtcccatctacccccagtatatcacaacgggagctgcggattgaaaccattgccgcgtcctccaccccaacacccatacggaagcagtcaaagagaaggtctaatatattcactatctgtgccaccgtcagcaactttagcagtacaaagcgaccattccagctccttcctaactag

SEQ ID NO: 17281 - DNA, 1110 bp, Artificial Sequence
  Description of Artificial Sequence: Synthetic coding sequence
atggattcatgtctcatggtttggcacatgaagccccagtcaagggcctaccgttttactggacacaaggatgcggtcacttgcgttaactttagcccctccgggcacctcctggcttccggatccagggataagaccgtccgcatctgggtccctaacgttaagggagaatccactgtgtttcgcgcacataccgctaccgtccggagtgttcatttttgctcggacggccagtccttcgtgaccgcttccgatgacaagactgtgaaagtatgggccactcataggcagaaattcctgttttcactgtctcaacatatcaactgggtaaggtgtgccaagttctcccccgacggccggctcatcgtgtctgcttctgatgataagacagtaaagctgtgggacaagtcttctagagagtgtgtgcactcctattgcgagcacggaggcttcgtcacctatgtggacttccaccctagtgggacatgcattgcagccgccggaatggataacacggtgaaggtctgggacgtaagaacacatcggttgctccagcattaccagctccatagtgccgcagttaatggcctcagcttccacccttctggcaactacttgattaccgccagctccgactccacgctgaagattctggacctcatggaaggcagactcctatacacactccacggacatcagggaccagccacaactgtcgcattctccaggaccggcgagtacttcgcctctggaggatcagacgagcaggtgatggtctggaagtccaacttcgatatcgtggaccacggtgaagtgacaaaagttccaaggccacccgccactctggccagcagcatgggaaacctgccagaggtggacttcccggttccgcctggccgaggtcgctctgtggagagcgtgcaatcccagcctcaggagcctgttagcgtgccccagactttgacctccacactggagcatatcgttggacagctggatgttttgacccaaactgttagtatcctggagcagcggctgaccttaacagaggacaaactaaaacagtgtcttgagaatcagcaactaattatgcaacgggccaccccatag

SEQ ID NO: 17282 - DNA, 312 bp, Artificial Sequence
  Description of Artificial Sequence: Synthetic coding sequence
atggctgagttaatccagaagaaactgcaaggcgaggtagagaagtaccaacagttgcagaaagacttgtcgaagtcaatgagtgggcggcaaaaactcgaggcccagcttacagaaaataacatcgtcaaggaagagttggcattgctggatggatcaaatgtagtctttaaactgctcggaccagttctagttaagcaggagctgggagaggcccgggcaaccgtgggaaaaaggctcgattacattaccgctgaaatcttcctgcgaactatcccagacccgggcgacgtcccagactcttttttctag

SEQ ID NO: 17283 - DNA, 270 bp, Artificial Sequence
  Description of Artificial Sequence: Synthetic coding sequence
atgagtgagcagggggacctgaatcaggcaatcgccgaagaggggggcaccgagcaggagaccgctacacctgaaaacggaatagtaaagtctgaaagcctcgacgaggaagagaagctcgagttgcagaggaggctcgaggctcagaatcaggagcgccgtaagtctaagagtggggccggcaagggcaagctaacaagatccctggccgtgtgcgaggaaagctctgcacggcctggcggtgaatccctgcaggaccaaactctatag

SEQ ID NO: 17284 - DNA, 1140 bp, Artificial Sequence
  Description of Artificial Sequence: Synthetic coding sequence
atgtggcacttggattttgggctgcatacaggcaaaactttccagcctctcccctttatcatagtggtgtatccaggcgccggcagacgttggggccttgtactgtcactggcttcacaccggcggaggacggaggcgggtggtggaaccgggcccacaagtgacactggatggggatgtatgctgcgctgtggacaaatgatttttgcccaggctctagtgtgccgtcatctgggaagagattggcgctggacccagcgaaagaggcagcccgacagctacttttcagttctcaatgccttcatagaccggaaagattcctactacagtatccatcagatcgcacagatgggtgttggcgagggaaagagtatagggcagtggtatggacctaacacagtcgcccaagtgctgaaaaaattggcggtgtttgacacatggtcctcattggctgttcacatcgctatggacaatactgtggtgatggaagagattaggcgtctatgccggacgagcgtgccatgtgctggggccacagccttccccgccgattccgatcgacattgtaatggattccctgccggcgccgaagtaactaaccgaccctcaccttggaggcccctagttcttttgattccactgcgtttggggctaaccgacataaatgaagcctacgtagagacactaaagcattgctttatgatgccccaatctttgggagtcatcggcggaaagccgaacagcgctcactatttcatcggctatgtgggggaagagcttatatatctagacccccacacgacccagcccgcagtggaaccgactgacggatgtttcattcccgatgaatctttccactgtcagcaccctccttgccggatgtccatcgccgagctggacccgtctattgctgtcggatttttctgcaaaaccgaggatgacttcaacgattggtgccagcaggtcaagaagctgagcctactaggtggcgccttacctatgttcgagttagtggagctgcagcccagccaccttgcttgcccagacgtcttaaatctctcccttgactcaagcgacgtggaaaggctagagcgctttttcgactcagaagacgaggacttcgaaatcttgtcactgtag

SEQ ID NO: 17285 - DNA, 1683 bp, Artificial Sequence
  Description of Artificial Sequence: Synthetic coding sequence
atgagcgagcacagccggaactccgaccaagaagagctcttggacgaagagattaatgaggatgaaatacttgctaatctgtcagctgaagaactcaaagaacttcagtctgaaatggaggtgatggcccccgatccctctctccccgttggcatgattcagaaggatcagacggataaaccgcccacaggaaacttcaatcacaaaagcctggtggattacatgtattgggaaaaggccagccgcagaatgttggaagaagaaagggttccagtaaccttcgtaaaatcagaggagaagacccaggaagagcatgaggagatagagaagaggaacaagaatatggcccaatacctgaaggagaaactgaataatgaaatcgtcgctaacaagcgggagagcaaagggtcaagcaacatccaggagaccgatgaagaagatgaggaagaggaggatgatgacgatgacgacgagggcgaggacgacggagaggaatcagaggagactaatcgcgaggaggagggcaaggcaaaggagcagattaggaactgcgaaaacaactgccagcaagtgacagacaaggcctttaaggagcagcgagacagacctgaggctcaagagcaatctgagaaaaagattagtaaactggaccctaagaagctggcgctggatacatccttcttaaaagttagcactaggccgagtgggaaccagaccgaccttgatggtagcctgaggagagtgcgaaaaaacgatcccgacatgaaagagctgaacttgaacaatatcgaaaacattccgaaggagatgttgcttgatttcgttaatgccatgaaaaaaaacaaacacatcaagaccttctccctcgcgaatgtgggggccgacgaaaatgtggcttttgcactggccaacatgctcagagagaataggtctatcactactcttaacattgagtctaatttcattaccgggaaggggatcgtggctatcatgcggtgtctgcagtttaacgaaaccttaaccgaactccgattccacaaccaacggcatatgttgggtcaccacgccgaaatggaaattgcacgcttgttgaaagccaacaatacactgctaaagatgggctaccacttcgaactacctggaccgcggatggttgtgacaaatttactcactaggaaccaggacaaacagaggcagaagcggcaagaggagcagaaacagcaacagctcaaagagcagaaaaagctcatagcaatgctggagaatggcctgggtttgcctccaggtatgtgggaactcctgggcggaccaaagcctgatagtcggatgcaagaattttttcagccccctccccctaggcctccgaacccacagaacgtaccttttagccaacgttctgaaatgatgaagaagccttcccaggctcctaaatatcgcaccgaccccgatagctttagagtagtcaaattaaagaggatacagcgaaaatctaggatgcctgaagcgcgtgaacccccagaaaagaccaatctgaaagacgtaatcaaaaccttgaagccggtgccacgaaaccggcccccccctctggtcgaaataactcctagagaccagctcctaaacgatatcaggcattcgagcgtggcctatctgaaacccgtgcagctcccaaaagagctcgcgtag

SEQ ID NO: 17286 - DNA, 330 bp, Artificial Sequence
  Description of Artificial Sequence: Synthetic coding sequence
atgaatcccgctagtgctcctcctccattgccacctcccgggcagcaggtcattcacgtgacccaggacctggatacggacttagaggcattattcaactccgtcatgaaccctaaaccgtcttcctggcgtaaaaagattctccctgagagctttttcaaagagcctgactcaggttcccactcaaggcagtcttctactgacagcagcggaggccaccccggcccacgtctcgctggaggggctcagcacgtgaggtcacatagttcccctgcatccctgcaactgggaacgggtgccggggccgccggtagcccagcccaacaatag

SEQ ID NO: 17287 - DNA, 609 bp, Artificial Sequence
  Description of Artificial Sequence: Synthetic coding sequence
atggggagccgcaaaaaggagatcgccttgcaggtgaacatctctacacaggagctgtgggaagaaatgctatcaagtaaaggcctcacagtagttgacgtatatcagggctggtgcggcccatgtaaacctgttgtcagcctctttcagaaaatgcgcatagaagtgggcctggacctactacattttgcacttgccgaagcagatcggctggacgtcctggaaaagtatcgggggaagtgcgagcccaccttcctgttttacgcaggcggggagctcgttgctgtggttaggggcgctaacgccccacttctccaaaaaaccattctcgatcagcttgaggccgagaaaaaagttttagctgaaggccgggaacggaaggttataaaggacgaagctctttcggacgaggatgaatgcgtcagccacggcaagaataatggagaggatgaagatatggtgagctcggaacgtacttgtactctggccatcatcaagccagatgcagttgcgcatggcaaaactgatgaaatcatcatgaagattcaagaagctggcttcgagatcctgaccaacgaagaacggacaatgaccgaagctgaggtttag

SEQ ID NO: 17288 - DNA, 195 bp, Artificial Sequence
  Description of Artificial Sequence: Synthetic coding sequence
atggccccgcaaaaagatagaaagccaaagaggtcaacatggcggtttaacctcgacttgactcatcccgtggaggacggtattttcgactccggcaactttggaacattcccttccgaatacttaggattctctagtctggtgctgcatttcttctgctttaagattggcgcaatctcaacgggggaaggctag

SEQ ID NO: 17289 - DNA, 372 bp, Artificial Sequence
  Description of Artificial Sequence: Synthetic coding sequence
atggagaacctgcagacaaacttcagcctggtgcagggctccactaagaaactcaatggcatgggagatgacgggagccctcctgcgaagaaaatgattactgacatccacgccaatggtaagacaatcaacaaagtgcccacagttaagaaggagcacctggatgactacggtgaagctcctgtcgagacagatggcgaacatgtgaaaaggacctgcacctcagtgcccgagactcttcatctcaatccaagcttgaagcataccttggctcagtttcatttgtccagtcagagcagtctgggcggccctgctgctttcagcgctcgccacagtcaggaaagtatgtcaccaacagtgtttttaccctag

SEQ ID NO: 17290 - DNA, 201 bp, Artificial Sequence
  Description of Artificial Sequence: Synthetic coding sequence
atgaaccctagtatgaagcagaaacaggaggaaataaaagagaacatcaaaaattcctccgtgcctcgccgcactttaaagatgattcagccatcggcgtcaggatccctcgtgggtcgggaaaacgagttgtcagctgggctttctaagaggaagcatcgtaatgatcacctcacctccacgaccagttccccagggtag

SEQ ID NO: 17291 - DNA, 1614 bp, Artificial Sequence
  Description of Artificial Sequence: Synthetic coding sequence
atggtgttgattcttggacgcagattaaatagggaggacttgggggtgagggattcacccgccactaagcgcaaagtcttcgagatggatccgaaaagtctgacaggccatgaatttttcgactttagttcaggatcttcacatgcagaaaatatcctgcagatattcaacgagtttcgcgattctcgcctcttcaccgacgtcattatttgcgtcgaggggaaggaattcccctgtcaccgagcagtattatcagcttgcagcagctacttccgggcaatgttctgcaacgaccaccgcgagtcccgggaaatgttggtcgaaatcaatgggatactggcagaagcaatggagtgctttttgcagtatgtgtatacgggcaaggtgaagatcaccactgaaaacgtgcagtacttgtttgagactagtagcttgttccagattagtgtattgcgtgatgcttgtgctaagttccttgaagagcaattggacccctgtaactgtctggggattcagcgctttgcagatacacatagcctaaaaacgctgttcacgaaatgtaagaactttgccctgcagacttttgaagacgtgagccagcacgaggaattcctcgaactcgataaagatgagttgatagactacatttgctccgacgagcttgtgatcggtaaagaggaaatggtctttgaggcagttatgaggtgggtctaccgggctgtcgacctccgccgtcccctgctacacgaactcctgacacatgtaagactgcctctgcttcatcctaactattttgtgcagaccgtcgaggtcgaccagctgatccagaatagcccagaatgctatcagctcctacatgaagccagaagataccatatcctgggaaatgagatgatgagtccccggaccaggcctagacggagtactggctacagtgaagtgatcgtggtcgtcggcggctgtgagcgggtgggtggattcaatttgccatacactgagtgttatgatccagtaactggggagtggaaaagccttgcaaagctgcccgagtttacaaaaagcgagtacgctgtctgcgcactgagaaacgatattctcgtctcaggaggccggattaactccagggacgtgtggatctataattcccagctaaacatctggatacgtgtcgcgagcttgaataagggccggtggcggcacaaaatggctgtgttgctcggtaaggtctacgtggtcgggggctacgacggacagaaccgactcagcagcgtggagtgttacgattctttcagcaacaggtggacagaagtggcacctctgaaggaggccgtctcatcccctgccgtgacctcctgcgtgggaaaactttttgtaattggagggggaccggacgacaatacctgttccgacaaagtgcaatcttatgaccctgaaaccaattcctggctcctccgggccgctattcccatcgcaaagcggtgcatcaccgctgtcagtttgaataatctaatctacgtggccggaggacttactaaagccatctactgctatgaccccgtcgaagactactggatgcacgtgcagaatactttctctcgacaggtgataacttag

SEQ ID NO: 17292 - DNA, 1611 bp, Artificial Sequence
  Description of Artificial Sequence: Synthetic coding sequence
atgaggctggaagaactgaagcggctgcagaatcccttggagcaagtcaacgacgggaagtactcgtttgaaaacatccagcgcgcatggagggaatatctccaaaggcaggaacctctggggaagaggtccccaagccccccaagtgtctcttctgaaaaattgagctctagcgtctcaatgaatactttcagtgattcttccacccccgactatagggaagacggcatggatcttggatcagatgccggctccagcagctctagcagtcgggccagctcacagtccaactcaaccaaggtgaccccttgcagcgagtgcaagagctcctcatcgcccggtggttccctggatctcgtgagcgcactggaagactatgaggagccttttcccgtgtaccagaagaaggtcatagatgagtgggcccccgaagaagatggcgaggaggaggaagaggaagacgagagggatcagcgaggataccgtgacgaccggtccccggctagagagcccggtgacgtctcggcccgcacgaggtccggcgggggggggggaagaagcgctacaaccgcaatgcccccaccagttccgaacggcaacctgcaccagcatgatccccaggacctgcggcataacggcaacgtggtagtggccggccgccccagttgtagccgcggacctaggagggctatacagaagccacagcccgcaggcggtcgacggagcggccggggtccggccgctggaggactttgtctccagccccctgacggtgggacctgtgtgcctgaggagcctcccgtgccacccatggattgggaagccctcgagaagcacctggcaggactccagttccgggagcaagaggtgaggaaccagggacaggcaagaactaattccacctcagcacagaaaaatgaacgcgaaagcataaggcagaaactggcccttggctcattcttcgatgatggacctgggatttatacttcatgcagcaagtccggaaagccttcgttgtcttctaggctgcagagcgggatgaatctgcagatttgttttgtcaacgattcaggttccgacaaagactcagacgcagacgactccaagaccgaaacgtccctggacacaccactgagtcctatgagtaagcagtcttcttcctattccgaccgggacacaactgaggaggagtccgagtctctggatgacatggacttcctcaccagacagaaaaagctgcaggcagaagctaagatggctttggccatggcaaagccaatggccaaaatgcaggttgaggtggagaagcagaatcggaagaagagccccgtggccgaccttttgccgcacatgccccacataagcgagtgccttatgaagcggtcccttaaacccaccgacctgagagatatgactattggacagctacaggtcattgtgaatgatcttcatagccaaatcgaatctttaaatgaagagcttgtacagctgctgctgatcagagatgagctccacactgagcaagatgctatgcttgtagatattgaggacctgacaagacacgcagaatcgcaacaaaagcatatggccgagaagatgcccgcaaaatag

SEQ ID NO: 17293 - DNA, 630 bp, Artificial Sequence
  Description of Artificial Sequence: Synthetic coding sequence
atgagtgagaacgcggctcccgggctgatctccgagctgaaactagctgttccatggggtcatatcgccgcaaaggcttgggggtcactgcagggccccccagtcttatgtctccatggttggctcgacaacgctagctcctttgacaggctgatcccattactgccacaggatttctactacgtcgccatggactttggcggacacggcttatctagccattacagccccggtgttccatactatctgcagacttttgtgagcgagataagacgtgtagtggccgccttaaagtggaatcggtttagcatcctcgggcatagctttgggggggtggttggcggtatgtttttctgcacatttcctgagatggtggacaaactcatacttctggacacacccctgttcctgcttgagtcagatgagatggagaacctccttacatacaaacgaagagctattgagcacgtcctgcaggtggaagccagtcaggaacccagccacgtcttttctttaaagcagctgctccagaggctcctgaagagtaacagtcacctttcagaggaatgcggcgaactcctgctgcaacgtgggaccacaaaggtcgctaccggacgtgagcagcactag

SEQ ID NO: 17294 - DNA, 201 bp, Artificial Sequence
  Description of Artificial Sequence: Synthetic coding sequence
atgccagaagatcaggtgggaaagctggaggccaccgaaaatacgatcagcgccatggcggcagcggctgctgagcaacagcagttttacctgctcctcgggaacctgctgtccccagataacgtggtgcgtaagcaggccgaggaaacttacgagaatattcctggccagtcaaaaatcaccttcctgctgcaagcatag

SEQ ID NO: 17295 - DNA, 2061 bp, Artificial Sequence
  Description of Artificial Sequence: Synthetic coding sequence
atggctatttctcagcaccagttctatcttgaccgcaaacagagtaaggcgaagatccctagtgcaagatccctcgatgaaatagccatggacctgactgagactggcacccagagagcgagtaagttggtgaccttagagactaaatcgcagttcataatggctagtaacggcagccttatctcttcgggatctcaagattcagaagttagtgaagagcaaaagagggaaaagattctcgaacttaagaagaaagagaagctgctccaggagaagctccttaaaaaagtggaggagctcaaaaaaatttgtctgcgggaggccgagctcactgggaagatgccaaaggagtaccctctaaacatcggcgagaaacccccgcaggtgcgtcgaagagtgggaactgcctttaaactcgatgataacttgctgccatcagaggaggatcctgcactgcaggagctggagagcaatttcctgattcaacaaaagctagtggaggcagcgaagaagttagctaatgagcccgacctgtgcaagaccgtcaagaaaaaacgcaagcaggattatacagatgcaatgaaaaaactccaggaaatcgagaatgccatcaacgagtatcgaatcaggtgtggcaagaaaccttcccagaaagctactgtactgccagaagacatcatcccatcagaatcctcatcacttagcgacacaaccacatatgatgacccaagcgatgctttcactttccccggtcagagatcgtcctccgtgccacacagccctagaattctgccacctaaatcattagggattgagaggattcattttaggaaatccagcattaacgaacagttcgtggacacccggcagagtagagagatgcttagcacacacagcagcccctacaaaacactggagcggcgtccacaagggggccgttctatgcccactacccctgtactcacacggaatgcatactcatcctcacatttggaacctgaatcatctagccagcattgccgacaaagatccgggtccctggagtcccagtcccatttattgtctgagatggatagcgataaacctttcttttccctctccaagagccaacgctcgtcttccactgagatattggacgacggtagttcttacacttctcagtcatccacagaatattattgtgtgacaccagttaccgggccatattacacaacccagacactggacacaaggactagagggagacggcggagcaagaagcagaatgtgtctacttccaactctggaagcatgcccaacttggcccagaaagacagtctcaggaacggtgtctactccaagagccaagaaccaccctcaagcagttattatatcgccggctatactccttacgcagagtgcgacttttattattctggcggctatgtctatgaaaatgacacagaggggcagtattcggtaaatccctcgtaccggagtagtgcgcactacggatatgaacgccagagggattactcgcggagctttcatgaagacgaagtcgatagagtccctcacaatccctacgcaaccctgcgtctaccccgcaaggctgccgctaaatctgagcatattaccaagaatattcataaagccctagtcgccgagcacctgagaggatggtaccagcgagcatccggccaaaaggatcaaggccacagcccccagacctcattcgatagtgatcgtggcagtcaaagatgcttgggctttgcagggcttcaagtgccatgctccccttccagcagagctagcagttacagcagcgtatcaagcaccaatgcctctgggaactggcggacccaactcactatcggcttgtctgattatgaaacacctgcacacagctcctacacttcctgctacggcaatgtgtataacccgttaccctcccccagccggcaatacaccgaaattagccaactcgatggtaccgatggcaaccagctggaggacaacctggaaagctcagagcaaagactattctggcacgaggatagcaaacctggaactctcgtgtag

SEQ ID NO: 17296 - DNA, 219 bp, Artificial Sequence
  Description of Artificial Sequence: Synthetic coding sequence
atgatggaggaaatctctattatggtggcatacgatgcacacgtcttttcccagctgcacgatgaagatttcctgacaagtctggttgcaattagcaagcccaggagcatggtgcctacaaagaagcttaagaaatacgagaaggagtaccagactatgcgagaatctcaactgcagcaagaggatccaatggaccggtacaaattcgtatacctatag

SEQ ID NO: 17297 - DNA, 1965 bp, Artificial Sequence
  Description of Artificial Sequence: Synthetic coding sequence
atggactcactgcccgatgaattctttgtacggcatcccgccgtcgaagaccagaggaaggaggagaccgagaacaagctggagaaaagcagcggccagttgaacaagcaagaaaatgacatcccgaccgatctggtgccagtgaacctcctccttgaggtgaagaagttactgaatgcaataaataccctaccaaagggcgtggtaccacacatcaagaagttcctgcaggaggatttcagcttccagactatgcaacgggaggtcgccgccaacagccagaacggtgaagagatcgtgccagccctgactctacgattccttatcacacagcttgaggcagctctccgtaatatccaggcgggcaactacacagcccaccaaattaacattgggtactatcttacattgctctttctatatggagtagcacttactgagcgtggcaagaaggaggactatacagaggccgagaataagtttctggttatgaaaatgatgattcaggagaacgagatttgcgagaactttatgtctttggtgtatttcggccgcggtctgctcagatgcgcacagaaacgctataacgggggattgctggagttccacaaatctttgcaggaaatcggagacaagaatgatcactggtttgacattgatcccactgaagatgaagatctccccaccacgttcaaggatctactgaataattttataaagaccaccgagtccaacatcatgaagcagacaatttgctcctacctggattgtgagcgttcttgtgaagcggatattctcaagaacacctcctataagggattcttccagctgatgtgctcaaagtcctgctgcgtttactttcacaaaatttgttggaagaaatttaagaacctcaaatatccgggagaaaacgaccagtcttttagcggcaaaaagtgcttaaaagaggggtgtaccggggacatggtgcgcatgcttcaatgcgacgtgcccggaattgtaaagattctcttcgaagtggtccggaaggacgagtatatcacaatcgagaacctgggcgcttcttacaggaagctcatttcgctcaaaatcaccgataccgacatccgacctaagatctctttgaagtttaatacaaaagatgagatgccaatcttcaaattggattataattatttttaccatctgctccacattatcattattagcggaactgacatcgtgcgccagattttcgatgaggcaatgcctccgcccttactgaaaaaggagctgttgatccacaaaaacgtcttggagtcctattataaccacttgtggacaaatcaccctctgggagggtcctggcatctcctgtatccgccaaataaggagctgccacagtccaaacagttcgacctgtgcctgttgctagccttgattaagcacctgaacgttttcccagcccctaagaaaggttggaacatggagccaccctcttccgacataagcaagtccgccgacatcctacgtctgtgcaagtaccgagatatccttctgagtgaaattcttatgaacgggctcactgagtcccagtttaactcaatttggaaaaaagtgtcagacatcctgctgaggttgggaatgatgcaggaggacattgataaagtgaaagaaaaccctattgagaatatatctctagattatcaccagctgtcagtatatctggggattccagtgccagagattatccagcggatgctgtcctgttaccagcaggggatcgcgctgcagtccattactgggtcacagcggatcgaaatcgaagaactccagaacgaagaggaggagttgtcaccccctctcatggagtataacattaatgtgaaatcccatccagaaatacagtttgccgagattaacaaagatggcacatctataccatctgaatcatcaactgagagcttgaaggaccttcaggagtag

SEQ ID NO: 17298 - DNA, 570 bp, Artificial Sequence
  Description of Artificial Sequence: Synthetic coding sequence
atgaatcccgccagcgcaccaccacccctccctccacctggccaacaggtgatacacgtgacccaggacttggacacagatctggaggcactgttcaatagtgtgatgaaccccaagccaagctcgtggcgcaaaaagatcctgccagaaagtttttttaaggaacccgattctggatctcactcaaggcagtccagcacagactcttcggggggacatcctggaccacgcctggcaggcggggcccagcatgtgcgcagtcatagttcccccgcaagcctgcagctcggtacaggtgccggcgccgctggctcccccgcacagcagcacgctcacctgcgtcagcagagctacgatgtcaccgacgaactgcccttgccaccagggtgggagatgacctttacagcgactggacagcggtacttcctcaaccatattgagaaaataacaacatggcaggatcctcggaaggccatgaaccagcctttgaaccacatgaacctccaccccgcggtgtcatcgacaccagtcccacaaaggtccatggccgtttctcagcctaacttatag

SEQ ID NO: 17299 - DNA, 849 bp, Artificial Sequence
  Description of Artificial Sequence: Synthetic coding sequence
atgggacctctcccccggaccgtggagctgttctacgacgtgctgagtccctacagctggctcggcttcgaaattctctgccgctaccagaatatatggaacatcaaccttcagctaaggcccagtctcattaccggcatcatgaaggacagcggaaataaaccccctggactactccctagaaagggtttgtatatggcaaacgacctaaaattgcttagacaccatttacagatacccattcacttccctaaggatttcctgtcggtgatgctagagaaggggtccttgtcagctatgaggttcctgaccgccgttaatctcgaacatcctgagatgctcgaaaaagcctccagagaattgtggatgcgagtttggtcgcgtgtgagcgtgggcctctgggagtcttcaggtaggaccctagatgattttctgacatttcccagacacgttttcagagtgatgattctgcccccacccgggggatcgaccgtgctgcctgtgacccccctttccccacaccggcttcctgctgtgttcagtagctcacaaaacgaggatatcaccgagccacagagcatattagccgctgctgagaaagccgggatgtcagccgagcaggcgcagggactgctggagaagattgctacccccaaggttaaaaaccagctcaaggaaacaaccgaggccgcttgccggtacggagctttcggactgccaattacagtggctcacgttgacggtcagacccatatgcttttcggctccgatcgtatggagttgctggctcatcttttgggggagaaatggatgggtcccattccgcccgcagttaatgctaggctgtag

SEQ ID NO: 17300 - DNA, 1221 bp, Artificial Sequence
  Description of Artificial Sequence: Synthetic coding sequence
atggatcagttggagaacgccaaaatggagcatacaaatgccagttttgacacattcttctgtgagaccagggcaggaaaacacgtccctagggcactctttgtcgacctggagcccacggttatcgatggcattcgaacagggcagcatcggtcactgttccacccagaacaacttttgagcggcaaggaggatgctgccaacaattatgcccgcggcaggtactcagtcggctcagaagtgatcgatcttgtactggagagaactaggaaactcgctgaacagtgtggggggcttcagggctttcttattttccggtcttttggaggggggactgggagtggattcaccagccttttgatggaaaggctcactggcgagtatagtcgcaaaaccaaactggaatttagcgtctacccggcgcccagaattagtacggcagtcgtcgagccgtacaacagcgtccttactactcacagtacaacagagcacacagattgcacatttatggtggataatgaagccgtgtacgacatctgtcacagaaagctgggggtggaatgcccaagccacgctagtatcaatcgcctggtggtccaagtggtctcatctattacagcctctttgagattcgaaggaccgctcaacgtagacctaattgagttccagacaaacctggttccttacccgcgaatacatttccctatgacagcctttgctccaattgtctccgccgacaaggcttatcacgaacagttctccgtgtccgacattaccaccgcctgtttcgagagttccaatcagcttgtgaaatgtgaccctagactcggtaagtacatggcatgttgcctgctgtacaggggggacgtcgtccccaaggaagttaatgccgcaatcgccgcgaccaaaagccggcattcagtacagttcgttgactggtgcccgaccggtttcaaggtcggtattaataacagaccacctactgtgatgcctggaggagatctggccaaagtgcaccgaagcatctgtatgttgtcgaataccactgctatagtcgaagcctgggctcgtctcgatcataagtttgatctgatgtatgccaaacgagcgttcttgcactggtatctgcgcgagggaatggaagaggctgaatttctggaggcaagagaagatctcgccgctctcgagcgagactacgaggaggttgcccagagcttctag

SEQ ID NO: 17301 - DNA, 1860 bp, Artificial Sequence
  Description of Artificial Sequence: Synthetic coding sequence
atgtccggcttggtgctaggtcagcgtgatgaaccggctggccaccggctgtcacaagaagaaatactgggcagtactcgccttgtctctcaggggctcgaagccctccgaagtgagcaccaagccgtcctgcagagcttatcccaaaccatcgagtgtctccagcaagggggacacgaagagggccttgtgcatgaaaaggcccgccagctcagacgctcaatggagaacatcgaactcggactatcagaggcacaggttatgctggccttggccagccacctgtcaaccgtcgagtcagagaagcagaaactgagagcccaggtgcgacggctttgccaagaaaaccagtggctgcgagacgagctggccggtactcagcagagacttcagcgtagcgagcaagccgtcgcgcagctcgaggaagagaagaagcatttggagttcctcggtcagctgaggcaatatgacgaggacggacacacttctgaggagaaggagggcgatgctactaaggactccctggacgatctgttccctaacgaggaagaggaagatccttcaaatggcttgtcacgcggtcagggggctactgctgcccagcagggcggatatgagatccctgcccggctaagaaccttacataacctagtgattcagtacgcagcccaagggagatatgaggtcgctgtcccattatgcaagcaggccctggaagatttggaacgaacttctgggcgggggcatcccgatgtggcgacaatgttgaatatcttggccttggtgtacagggaccagaacaaatataaggaggctgctcacttactcaacgacgctctgtcaatacgcgagtcgaccctgggcccagaccacccagctgtggccgctacccttaataaccttgcagtgctgtacggcaagagggggaaatataaagaggccgaacccctgtgccaaagagccctggagattagagagaaagtactgggcaccaaccaccccgatgtggccaagcagcttaacaatctcgcactgctgtgtcaaaatcaggggaaatacgaggccgtggagaggtattatcagcgcgcactggcaatctatgaaggacagttgggacccgacaatccaaacgtagctcgtacaaaaaataatctggcctcgtgctatctcaagcaagggaagtatgctgaagctgagaccctatacaaagaaatcctgacacgggcccatgtgcaagagttcggctctgtggatgacgatcacaagccgatctggatgcacgccgaagagcgtgaggagatgtcaaaaagtcgtcaccacgaaggtgggactccctacgccgagtatggcggttggtacaaggcctgcaaagtctcgtcccctacggtcaatacaactctgcgcaacctcggggccctctatcggcgccaggggaaattggaggccgcagagacactggaagagtgcgcccttcggagcaggagacaaggaacggaccccatctctcagacaaaggtggcggaactgctgggggagtcggacggccggagaacctctcaggagggacccggcgactcagttaaattcgaaggtggagaggacgcctctgtggcggtggaatggagcggcgacggaagcggcacactccagcgctccggatctctgggaaagatccgggatgtccttaggcggtcctcggaattgttagtcaggaaactccagggcacagaacctcgtcctagcagctctaatatgaagcgcgctgcctctctgaattacttaaaccagcctagtgccgcccctctgcaggtctctagggggttgagcgcgtccacaatggatctcagttcatcatcctag

SEQ ID NO: 17302 - DNA, 294 bp, Artificial Sequence
  Description of Artificial Sequence: Synthetic coding sequence
atggggaaaagttgcaaagtggtcgtctgtggtcaagctagtgttggaaaaacctctattttggagcagcttctgtacggtaaccatgtcgtgggctccgagatgatcgaaacgcaggaggacatatacgttggaagcatcgaaacggacagaggggtaagggaacaaatagccgagtcactgttctctgtttggtcttgcagtagacggcggcttacgaatccaaggacaaggaggaggtcccctagctggtccttggctaccagcgtcacctatagaagcagtggtgtatag

SEQ ID NO: 17303 - DNA, 387 bp, Artificial Sequence
  Description of Artificial Sequence: Synthetic coding sequence
atgactgacctggtggctgtatgggatgtggctttgagcgacggggtccataaaatagagttcgagcacggaaccacatccggtaaaagggtggtctacgtagatgggaaggaagaaatcagaaaggagtggatgttcaagctcgtcggcaaagaaacattttatgttggtgccgctaaaaccaaggctacaataaacattgatgctatctcaggctttgcctatgagtataccctggaaatcaatgggaaaagcctcaaaaagtacatggaagataggagcaagacaacaaacacctgggtgctccacatggatggagaaaactttcgcatcgtgctagaaaaggacgcgatggatgtgtggtgtaacggaaagaagctggagtag

SEQ ID NO: 17304 - DNA, 879 bp, Artificial Sequence
  Description of Artificial Sequence: Synthetic coding sequence
atgaccgtgtctaaattcatggcgatccaaaaggccctccagcctgactggtttcagtgtctttccgatggagaagtttcttgcaaagaggctaccagtatcaagcgagtcaggaagagcgtggatcgctctctgttatttctcgacaattgcctcagactccaggaagaatctgaggtgctgcagaagagcgtaattatcggtgtcatcgaaggaggcgacgtcatggaagagcggctaagaagcgcacgggagacggcaaaaagaccggtgggggggtttctgctcgacgggttccagggcaatccaaccactttagaggccagattgcggctgctcagctccgttacagcggaattgcccgaagataaaccgaggctcatatctggcgtgtctcggccagacgaggtgttggaatgtattgaacggggggtggacctatttgaaagcttctttccataccaagtcactgagagggggtgcgccctaacgttttcttttgactaccagcctaaccctgaagagactctcctgcagcagaatggcacccaagaagaaatcaagtgcatggaccagatcaagaagatagaaaccactgggtgcaaccaagaaattacttcctttgagataaatcttaaggagaagaaataccaggaagacttcaatccgctggtaagggggtgcagctgctattgctgcaagaaccacacacgggcttacatccatcatctgctggtgacaaatgagcttctggctggggtcctactgatgatgcacaacttcgagcactacttcgggttcttccattacatcagagaggccctcaagagcgataaactggcgcagctcaaggagctgatccaccgccaggcttcctag

SEQ ID NO: 17305 - DNA, 600 bp, Artificial Sequence
  Description of Artificial Sequence: Synthetic coding sequence
atgcggtttaggttttgcggagacctcgattgcccagattgggtgttagccgagatctcaacgctagctaaaatgtcctcagtgaagctgaggctgctctgttctcaggtgctgaaagaactgctaggccaggggatagactacgaaaagatcctgaagcttaccgcagatgcaaagtttgaaagcggggatgtgaaggccactgtcgccgtcctcagcttcatcctctcatccgcagccaaacacagcgtcgacggcgagtccctgagctctgaactgcagcagctgggtctgcctaaagagcacgcagcatccttgtgcagatgttatgaagagaaacaaagcccactccagaagcacctgcgggtgtgctcacttcggatgaatcgactcgctggcgtcggatggagggtcgactatactcttagctcttctctgctgcagagtgtggaagagcctatggtacaccttcgtctagaagtggccgctgcacctggtacgccagcacaacccgtggcaatgtcactgagtgctgacaaattccaggttttacttgctgagctgaaacaggcacagacactgatgagcagcctcgggtag

SEQ ID NO: 17306 - DNA, 354 bp, Artificial Sequence
  Description of Artificial Sequence: Synthetic coding sequence
atgcccgaggatcaggtgggaaagttagaagctaccgaaaataccatcagtgcaatggctgcggccgccgccgagcaacagcagttttacctgctcctcggaaacctcctttctcctgacaacgtggttcgtaagcaggccgaggagacctacgaaaatattcccgggcagtcaaagattacctttctgttgcaagccatcaggaacactaccgccgcggaagaggcgcgacagatggccgccgtcctgctgagacgcctgctgtcatccgcatttgacgaggtgtatcctgccctcccgtccgacgtgcagactgcaattaagagcgagctcctgatgatcattcagatgtag

SEQ ID NO: 17307 - DNA, 888 bp, Artificial Sequence
  Description of Artificial Sequence: Synthetic coding sequence
tgaacgaagctggctacggggtccaaagacaccaccgtgatcatctggcaggtggatcctgacacccacctgttgaagctgctgaaaactttggaaggccatgcatatggcgtgtcctacattgcctggtccccagatgacaactaccttgtagcctgtgggccggacgattgcagcgagttgtggctctggaacgtccaaacgggggaactacggacaaagatgtcccagtctcatgaagattctctgacatcagtagcgtggaatcctgatggtaaaaggttcgttaccggtggccagagggggcaattctaccagtgcgatctggacgggaatctgctcgattcatgggaaggggtccgcgtccagtgtctctggtgtctgtcagatggaaagaccgtcctagcatctgacacacatcaacggatcagggggtacaacttcgaagacctgacggacagaaacatagtgcaggaagaccacccaatcatgtccttcacaataagtaaaaatggtcggctggcacttctcaacgtcgccactcaaggcgtgcacctctgggatctgcaggatcgggtgctcgttagaaaataccagggtgtcacacaaggcttttacacaattcattcttgttttggcggacacaatgaggactttattgcatccgggagcgaagaccacaaggtttatatctggcataagagaagcgaattgccaatcgccgagcttaccggccatacgaggacagtgaactgcgtgtcctggaacccacagattccctcaatgatggcctccgcgtcagacgacggaacagtgcgcatctggggcccagcaccctttattgatcaccaaaatatagaagaggaatgcagctccatggattcttag

SEQ ID NO: 17308 - DNA, 1053 bp, Artificial Sequence
  Description of Artificial Sequence: Synthetic coding sequence
atggcgcgttggatccccaccaaaagacagaaatacggggttgccatctacaactataatgctagccaagacgtcgagctttccctccagatcggggataccgtgcatatcttggagatgtatgagggatggtatagaggatatacactgcagaacaagtctaagaagggaatctttcctgaaacatacatccatctgaaggaagctactgtggaggacctcggccagcacgagacagtgatccccggggagctccctctggtacaggaactgactagcacactgcgtgagtgggctgtgatctggagaaagctgtatgtgaacaataagctgaccttgtttcgtcagctgcagcagatgacttatagcctcatcgagtggaggtctcagatccttagtggaacattgcccaaggacgaactggcagagctgaagaagaaggttacagccaaaatagatcacggcaacaggatgctggggctagatctcgttgtccgagacgacaatgggaatatactagatcccgatgaaacgagcactattgccctgtttaaggcccatgaagtggcttcgaaacgcatagaagagaagattcaagaggagaaatctatactgcagaatctggatctccgggggcagtctattttttcaactatccacacctatggcctgtatgtgaacttcaagaacttcgtttgtaatataggagaggacgctgagcttttcatggccctgtacgatcccgatcaatctacattcatctccgagaactacctgataaggtggggatccaatggcatgcccaaggagattgagaagctgaataatctccaggctgtgtttacggacctcagcagtatggacctcattaggccccgcgtcagtttagtctgccagatcgtgcgtgtcggccacatggagctgaaggaggggaagaaacacacatgcggcctgcgcaggccctttggcgttgccgtaatggatatcactgacatcatccacggtaaggtggacgacgaggagaagcagcatttcatccccttccagcagtag

SEQ ID NO: 17309 - DNA, 360 bp, Artificial Sequence
  Description of Artificial Sequence: Synthetic coding sequence
atgccggaggatcaggtgggtaagctggaagccaccgagaacaccatctcagcgatggcagcagctgcggctgagcagcagcagttctatctgcttctcggcaatctactcagtcccgacaatgtggtgagaaaacaggctgaggagacatacgaaaatatcccaggacagtccaagattacgttccttctacaggcaattagaaatacgacagctgctgaggaggcaagacagatggccgccgtccttctgaggcgtctcctcagctccgcttttgatgaagtgtatccagcgctgccatccgatgtgcaaacagccattaaatctgagctgcttatgattatacagatggaaacatag

SEQ ID NO: 17310 - DNA, 279 bp, Artificial Sequence
  Description of Artificial Sequence: Synthetic coding sequence
atgtccgggctcgtgcttggtcagagagatgaacccgcaggccatcgcctgagtcaagaagagatactcgggtccactcgcttggtgtcccagggcctggaagccctccgctctgagcaccaggccgtactccagagtctgtctcagactatagaatgtctacagcagggtggacatgaggagggtctggtgcacgagaaggcccgccagctgagacggagcatggagaacatcgagttagggctctccgaggcccaggtgatgctggcgcttgcctag

SEQ ID NO: 17311 - DNA, 405 bp, Artificial Sequence
  Description of Artificial Sequence: Synthetic coding sequence
atggtgctgatcctgggtagaagactgaacagagaggatctgggggtgcgagatagcccggctacaaaacgaaaggtgttcgaaatggatcctaagtccctgacgggtcatgagttcttcgatttctccagtggctcctcgcacgccgagaatatcctgcagatttttaacgagttccgggattccagattgtttactgatgtaatcatctgtgtggagggtaaggaatttccttgtcaccgcgccgtgctatcggcatgcagtagttatttccgtgctatgttttgcaatgatcaccgggaaagccgtgagatgcttgttgagatcaacggaatcctcgcagaagccatggaatgttttctgcagtatgtttatacaggaaaggtcaaaataacgactgagtag

SEQ ID NO: 17312 - DNA, 312 bp, Artificial Sequence
  Description of Artificial Sequence: Synthetic coding sequence
atggcagagctgatccagaagaaactgcagggtgaagttgagaaatatcagcagctgcagaaggacctgagtaagagcatgagcggacgacaaaagctggaagctcagcttacagagaataacattgttaaggaagaactcgcgttgctcgacggttccaacgtggtgtttaagttactcggccccgtcttggttaagcaagagttgggagaagcccgcgcaactgttggcaagcggctcgactacattacagctgagattttcttaagaaccatcccagatcctggagatgtccccgatagtttcttctag

SEQ ID NO: 17313 - DNA, 1923 bp, Artificial Sequence
  Description of Artificial Sequence: Synthetic coding sequence
atggggaggagatccggcctgctgggactgaggccaggaccggaacccgtggctctggagagagttataaacaaggtccatctgaaggcaaaccacgtggtgaagcgagacgtggatgaacacctcagaattaagacagtttatgacaagagtgtagaggaactgctgcccgaaaaaaaaaatttggtcaagaacaagcttttccctcaagcaatctcatacttggaaaagaccttccaggtcagaagacccgctggaaccattctgctgagtcgtcagtgcgccactaaccaatatctgcgcaaggagaacgacccccaccgttactgtaccggcgagtgcgccgctcatacaaagtgcgggcccgtgatcgtgcctgaagagcatctgcagcaatgtcgggtctacagggggggtaagtggcctcatggcgccgttggtgtaccggaccaggagggtatctccgacgccgatttcgtactatacgtgggagctctggcaaccgaacgatgttctcacgaaaacatcatctcctacgcggcttattgccagcaggaggcaaacatggatcggcctatcgccggctacgccaacttgtgccctaatatgatctccacccaaccacaagaattcgtagggatgctctctaccgtgaaacacgaggtgattcatgctctgggattttctgccggtctgttcgctttttaccatgataaagatggaaatccgctcacatctagattcgccgatggtctgcccccattcaattacagcttaggcctctaccagtggagcgataaggtcgtgcggaaagtggaacgcttgtgggacgtgagagataacaagatcgttaggcacaccgtgtatctgctggtcacaccaagagtcgtcgaagaggcgcgcaagcattttgactgccctgtcctggagggtatggaattggaaaaccaaggcggggtgggcaccgaactgaatcactgggaaaagcgactgttggaaaacgaggcaatgaccggatcccacacccaaaatcgcgtgctctccaggattactctggctctcatggaagataccgggtggtataaggccaactattccatggctgaaaagctggattggggccggggcatgggatgcgactttgtgaggaaaagttgtaaattctggatcgaccagcagaggcaaaagcgccagatgctatccccttactgcgacacactgcgatcaaacccactgcaactgacctgtcggcaagaccagcgggccgtggctgtctgtaacctacaaaaatttcctaaaccactgccgcaggaatatcagtattttgatgagctgtctggcattcctgcggaggacctcccttattatggaggcagcgttgagattgctgattactgcccattctcccaggagttctcatggcatctgtcaggcgaataccagcgctcatccgactgcagaattctggaaaaccagccagaaatctttaaaaactacggtgctgagaaatatggacctcactctgtgtgcttaatacagaagtccgcttttgtgatggagaagtgtgagagaaaactctcataccctgattggggctccggatgttatcaggtatcgtgctcaccgcaaggcctcaaggtctgggtgcaggacacgagttatctgtgctccagggctggacaggttctgccagtgagcatccagatgaacgggtggattcatgatggcaacctgctctgtccgtcctgctgggacttttgtgaattatgtcctccggagacggatcctcctgcgacaaacctgactcgggccctccctttagacctgtgttcctgttctagttccctggtggtgactttatggctgcttcttggaaacttattccccctgctggccggtttcttactctgcatatggcattag

SEQ ID NO: 17314 - DNA, 783 bp, Artificial Sequence
  Description of Artificial Sequence: Synthetic coding sequence
atgaaccttgactctgatggtatggacgacataatatcacaggaatccagcctcgatatggaaggtaactacaagaaagcccaaaaaaatgaaagggagtctatacgccagaaacttgcccttggatccttttttgatgatggccctggaatctacacatcgtgctctaagtcagggaagccgagcctgtcctcacgactacaatccggaatgaacctgcagatatgtttcgtgaatgactctggcagcgacaaggactcagacgctgacgactcaaagaccgaaacaagtctggacacccctctgtctcctatgtccaagcagtccagcagctatagtgaccgagataccaccgaggaggaaagcgagtctctcgacgacatggattttctaacacggcagaagaaactccaggccgaagccaaaatggccctggcaatggcgaaacctatggccaagatgcaggtggaggtggagaaacagaatagaaagaagtcccccgtggcagacctgttgccccacatgccccacatttccgagtgcctgatgaaacggagcttaaaacctactgatctgcgagacatgaccattggccagctgcaggtaatcgtgaacgacctccattcacagatcgaatccctgaacgaagaactggtgcagctgttgcttatcagggatgagctccatacagaacaggacgcaatgctcgtggatattgaagatctgacaaggcacgcagagtcccagcagaagcatatggccgaaaagatgcctgctaagtag

SEQ ID NO: 17315 - DNA, 633 bp, Artificial Sequence
  Description of Artificial Sequence: Synthetic coding sequence
atggccgcatctgtcgaacagagagagggcaccattcaggtgcagggccaggccctgtttttcagggaagctctgcctgggagcggtcaggcccggttcagcgtcctcctcttacacggcatccgtttcagctcagaaacttggcagaacttgggcactctacatagactggcccaggcaggctatcgggctgtggctatcgatttacctggcctggggcactccaaggaagccgccgctcccgcgccaataggtgaattagcacctgggtctttcctcgcagccgtggtggacgccctcgaactcgggcctccagtggttatttctcctagcttatcaggcatgtattctctgccattcttgactgccccgggttctcagttgcccgggtttgtgcccgtggcgccaatttgcaccgataagataaatgccgccaactatgcctccgttaaaacccccgcccttattgtttatggcgaccaggatccaatgggccagaccagtttcgaacatctgaaacaactccccaatcaccgggtactgataatgaaaggagcaggccacccgtgctacctggataagcccgaggagtggcatacaggactgctggatttcttgcaggggcttcagtag

SEQ ID NO: 17316 - DNA, 381 bp, Artificial Sequence
  Description of Artificial Sequence: Synthetic coding sequence
atgaaccagagatcgcacctgggaacgacttatctcgacactgctaaaggggcggttgagacatttatgaagctccgggcccgtgaccccgcctccagaggagaccggtatatgcttgtgacattcgaggaacccccttacgctatcaaggctggatggaaggaaaatcacgcgactttcatgaatgaactaaaaaatctgcaggccgagggactaacaactctggggcagagcctcagaacagccttcgacctgctaaacctgaatcggttggtgaccgggatagacaattatggccaggggagaaacccgttctttctagagcccgcaataattatcacaattaccgatggatcaaagctcactactacatcagggtag

SEQ ID NO: 17317 - DNA, 1188 bp, Artificial Sequence
  Description of Artificial Sequence: Synthetic coding sequence
atggccaatgaccctttggagggcttccacgaggtgaacctcgcctctcctactagtcccgatcttctcggcgtctatgaaagcggcactcaggagcaaactacctccccaagcgtgatttataggccccacccctccgcccttagctccgtgccaatccaggccaacgccctggacgtatccgaactccccacccagcccgtgtactctagcccgcgacgtcttaactgcgctgagatatccagtatctcttttcatgtgacagaccccgcaccatgttccacttctggagtcaccgctggcttgacaaaattgaccactcgcaaggataactataatgctgaaagggagttcttgcaaggagctaccattaccgaggcctgtgatggcagcgacgacattttcggactcagcactgatagcctcagcagactgagatctccttcggtgcttgaggtgcgggaaaaagggtacgaacgcctcaaggaggaactggccaaggcgcagcgagagctgaagctgaaggacgaagagtgcgagcgcctgagtaaggtcagagatcagctgggccaagagcttgaagagttgacagcttccttgttcgaggaggctcacaaaatggtccgagaggctaacattaagcaggctaccgccgagaaacagctgaaggaggctcagggaaaaatcgacgtgctgcaagctgaggtagccgccctcaagacactggtgctgtcaagttctccaacctcacccactcaggaaccactccccggtggcaagacccccttcaagaaggggcatactcgaaataaaagcacatcttcagcaatgagtggatcacatcaggacttatcggtgatccagcccattgtcaaagactgtaaggaagcggatctgtcactctacaatgaatttagattgtggaaagacgagccgacaatggataggacctgcccgttcttggataagatatatcaggaggacatctttccctgcctgaccttctcaaaaagtgagctggcatctgccgtcctggaggcggtggagaataatacgctgtccatcgagcctgttggtctgcaacctatccggttcgtcaaggcaagcgcagtggagtgcggggggcccaagtctttactctacgtgaccttccttcacacatttgatacattctccagagactcttag

SEQ ID NO: 17318 - DNA, 786 bp, Artificial Sequence
  Description of Artificial Sequence: Synthetic coding sequence
atgggcagcagaaaaaaggagatcgcactgcaggttaatataagtacacaagaactctgggaggagatgctgtcttctaagggactgacagtcgtcgatgtttatcagggctggtgcgggccttgcaaaccagtcgtgagcctcttccagaagatgagaatcgaggtgggccttgatctcctccatttcgccctaataaaggatgaggctctctcagatgaggatgagtgcgtttctcacggaaagaacaatggagaggacgaagatatggtgagctccgagcggacatgtactctagcaataattaaacccgatgcggttgcccatgggaagaccgatgagatcatcatgaaaatccaagaggcgggtttcgaaattctaaccaatgaggaaaggactatgaccgaagcagaggtaagactgttttaccagcacaaggctggagaagaagctttcgaaaagctggttcaccatatgtgcagcgggccatctcatctgttgatattgacccggaccgaggggtttgaggatgtggttactacatggcgcactgtcatggggccccgcgatccaaacgtagccaggcgcgaacagccagagtcccttcgggcccaatacggtactgagatgcccttcaacgctgtccacgggagcagggaccgggaagatgccgatagagaacttgccctgctatttccctctctcaagttctccgacaaagacaccgaagccccacagggagagagctctactcagccccgcttgaagatcaccgacctcgactag

SEQ ID NO: 17319 - DNA, 1284 bp, Artificial Sequence
  Description of Artificial Sequence: Synthetic coding sequence
atggtatgttggcaggatctggaggagagccttaggatgaaactgagccttacgaaggtagttaatggatgtcgtttgggaaaaatcaaaaacctcgggaagactggcgatcacaccatggacattcctggatgtctgctgtacacgaaaacagggtctgccccccatttgacacatcataccctacacaatatccacggtgtccctgccatggctcagttgactctgtcttccttggccgaacaccatgaagtgctgacggaatacaaggaaggggtcgggaaattcatcgggatgccagagtcattgttgtactgttccttgcacgatccagtgtctccttgccctgccggatacgttaccaataaatcagtgagcgtgtggtcagtggctggacgggtggagatgacagtatcgaaattcatggccatacagaaggccctgcagcctgattggtttcaatgtcttagcgacggcgaagtttcttgtaaggaagctacctcaattaagcgcgttagaaaatctgtggaccgctccctgctgtttcttgataactgcctgcgactacaagaggagagcgaagttctgcagaagtcagtcatcatcggggtgattgaaggcggcgatgtaatggaagagcggctgcgcagcgctcgggaaacagccaaacgccccgtgggtggattcctgttggacggcttccagggaaatcctactacccttgaagctaggctgagactcctgtccagcgtgactgctgagttgcccgaagataagcctaggcttatcagcggggtctctagacccgatgaagtactggaatgcatcgaacgcggagtggatctgttcgagtccttctttccatatcaggtgactgagcgcggctgcgctcttactttctcttttgattaccagcctaatcctgaggagacactcctccagcagaatggcactcaggaagagattaagtgcatggaccagattaaaaaaatagaaaccacgggctgcaaccaggagattacttcatttgagatcaacctcaaggagaagaagtaccaggaagacttcaatcctctagtgaggggatgtagttgctactgctgcaagaaccacacaagggcctacattcatcatctgctggtaacaaatgaactgctcgctggcgtgctgctaatgatgcacaactttgaacactacttcggcttctttcactatatcagggaggccttgaagtccgataagctggcccagctcaaagaactgatccacaggcaggcgagctag

SEQ ID NO: 17320 - DNA, 393 bp, Artificial Sequence
  Description of Artificial Sequence: Synthetic coding sequence
atgaaccagagatcgcacctgggaactacatacctcgacactgcaaaaggtgccgttgagacgttcatgaaactacgcgcccgcgaccccgcctcaaggggcgacaggtacatgctggtcactttcgaggagcccccctacgccatcaaggctgggtggaaagaaaatcatgctacttttatgaatgagttaaaaaacctgcaggccgaaggtctgactaccctgggccagagcctcaggaccgcgtttgaccttcttaatcttaatcgcctcgtcactggcatcgataactatggacagggaaggaaccccttttttctggaacctgccatcatcattactattacggatggctcaaagttgaccacgaccagtggtgttcaggacgagtag

SEQ ID NO: 17321 - DNA, 417 bp, Artificial Sequence
  Description of Artificial Sequence: Synthetic coding sequence
atgaacccagcatccgcaccgccacccctgcctcctcctggccaacaagtgatccacgtcacccaggatctggatactgacctcgaagccctattcaacagtgttatgaatcctaagccctcctcctggaggaagaagatcctgcctgagtcgttcttcaaagaaccagatagcggcagtcacagtcgtcagtcctcaactgatagctctgggggacaccctgggccacgcctggccggtggggctcagcacgtacgatcccactccagccccgcgagtttacagttaggcacgggcgccggtgctgccggtagccccgcccagcagcacgcgcacctgaggcagcagtcatacgatgtcaccgacgagttgccactgcccccgggttgggaaatgacttttactgcgactgggtag

SEQ ID NO: 17322 - DNA, 1692 bp, Artificial Sequence
  Description of Artificial Sequence: Synthetic coding sequence
atgcggctggaggagcttaagagacttcagaaccccttggagcaggtcaatgatggcaaatattcatttgagaaccaccaattggctatggatgccgaaaacaatattgagaagtaccccctgaaccttcaacctctggagagcaaggtgaagatcatacagagggcctggagggagtatctccaaagacaggagcctctgggcaagagatctccctccccgccttccgtgtcttcagagaaactgagtagctccgttagcatgaataccttctctgactcatccacaccagactatcgcgaagatggtatggacctgggatccgacgctggctcaagttctagcagctctcgggcttcctctcagtcgaattctacgaaagtgaccccttgctctgaatgcaagtctagctctagcccgggggggagtctggatttggtctctgcgctagaggactatgaggagccatttcctgtgtatcagaagaaagtgattgatgagtgggccccggaagaggacggagaggaggaggaggaggaggatgaacgggaccagcgcggatatagggatgaccgctcgcccgcgagagagcccggcgacgttagcgcacgcactcggtccggagggggaggcggccgcagcgctaccacagctatgccacctcctgtgccaaacggcaatctgcatcagcacgatccacaggatctgcgacacaacggcaacgtggtagttgccgggcgaccatcatgttccagagggccccgcagagccattcaaaagccccagcctgctggaggtagacgctctggcaggggccccgcagccggaggcctctgtctgcaacccccagacggaggcacctgcgtgccagaggaaccaccagttcccccgatggattgggaagccctcgaaaaacacctagcgggtttacagttcagagaacaggaagtgcgcaatcagggacaagcaagaactaactctacctcggcccagaagaacgagcgggagtccatcaggcagaaactggcccttggttcattcttcgatgacggaccagggatatacacaagttgttccaaaagcggtaagccatctcttagctcccgtcttcagtccgggatgaatttacagatatgcttcgttaacgacagcgggagtgacaaggattctgatgccgacgacagcaagaccgaaacctcactagatactcctctgtcccctatgtcaaaacaatcatccagctacagcgatagagacacgaccgaagaagagtctgagtccctggacgacatggacttcctgactcggcagaagaagctgcaggctgaggctaagatggcactcgctatggctaaaccaatggcgaagatgcaggtcgaggtggaaaagcagaataggaaaaagtcccccgttgccgacctcctgccacacatgccacacatctcggagtgtttgatgaaaaggtcacttaagcccactgatttaagagatatgactatcggccagctccaggtaatagtaaatgatttgcattcccagatcgagtcgctgaacgaggagcttgtgcaactgcttttgatacgcgatgagctccacactgaacaggatgctatgttagtggatatcgaagaccttaccaggcacgccgaatcacaacagaagcatatggctgaaaaaatgcctgctaagtag

SEQ ID NO: 17323 - DNA, 228 bp, Artificial Sequence
  Description of Artificial Sequence: Synthetic coding sequence
atgccagaggaccaggtaggaaagctggaagcaacagagaacacaattagtgctatggctgccgccgctgcagagcagcagcagttctaccttcttttggggaacctgctgtctccagataacgtggtgcgaaagcaggccgaagagacatacgaaaacatccctggacagtcaaagattacctttctattgcaagccatccgaaacaccaccgccgccgaagagtag

SEQ ID NO: 17324 - DNA, 2712 bp, Artificial Sequence
  Description of Artificial Sequence: Synthetic coding sequence
atgcccgagcagttcagcgtggctgagttcctagcagtgactgccgaagatctgagtagccctgccggggctgccgcattcgcagctaagatgccgaggtatcggggtgcagctctggcccgtgaagagatcctggaaggggaccaggccattcttcagagaataaagaaagccgtccgggccatccactcgtctggcttagggcatgtggaaaacgaggagcagtaccgcgaggccgtggagtcactaggtaattctcacttatcccagaattcacacgagctcagcacaggatttctgaacctggcagtctttaccagagaggtcgccgccctgttcaaaaatttaattcagaaccttaataacatagtatcctttcccctggactcccttatgaagggccagttaagagatggaaggcaggactcaaaaaagcagctggagaaggcctggaaggactatgaggctaaaatggcaaagctggaaaaagagcgggatcgtgccagagtaacaggagggatcccaggggaagtggctcaggatatgcagcgcgagaggagaatcttccaactccacatgtgcgaatatttattaaaagcaggggagagccagatgaaacagggacccgattttcttcagtctctgatcaaattttttcacgcccagcataactttttccaagatggatggaaagcggcccaatccttgtttccctttatagagaagttagctgcaagcgtgcatgctctgcatcaggcccaggaagacgagctccagaagctcacacagctgcgggattctctgcgcggcacgttgcaactcgaaagccgagaggagcatctgtccaggaaaaattcaggctgcggctattccatccaccaacaccagggcaataagcagttcggaaccgagaaggtgggctttttgtataagaaatccgatggaatcaggcgggtttggcagaagcggaagtgcggtgtcaaatacggctgtcttactatcagtcatagtactatcaacaggccacccgtgaaactcactcttctgacgtgtcaggtgcgacccaaccccgaggagaagaagtgtttcgacctagttacccacaaccgcacataccactttcaggctgaggacgagcacgagtgtgaagcgtgggtttctgtgctacagaactccaaggacgaagccttgagtagcgcgttcttaggcgaaccctccgccgggccaggttcctggggatccgctgggcatgatggagagccacacgatcttacaaagctgcttatcgccgaggtgaagagtagaccggggaattcccagtgttgtgattgtggggccgcggatccgacttggttatcaactaatcttggcgtgctgacatgtattcaatgcagcggtgtccatagagaactgggcgtccggtttagcaggatgcagtctctaacactcgatctgcttgggccatccgaactgctactcgcgctgaacatgggtaatacttcctttaatgaggtcatggaggcccagctgcccagccatggggggcccaagccatccgctgagagtgatatgggtaccaggagggattacataatggccaagtatgtggagcacagattcgccaggcggtgcactcctgaacctcagcggctgtggacggccatttgtaatcgagacctgttatccgtgctggaggcttttgccaacggccaggactttgggcagccccttcccgggcccgacgcgcaggctcccgaagagttggtcctccatctggctgtgaaagttgcaaaccaggcaagcttgccattagtggacttcattatccagaatggcggacacctggacgccaaggcggccgacggcaacaccgcgctgcactacgctgctctgtacaaccagcctgattgcttaaaactcctgctgaaaggtagagccctagtgggcaccgtgaatgaagctggtgagaccgccctcgatatcgcgcgtaagaaacaccacaaagaatgtgaggaactgctggagcaagctcaggccggcaccttcgcatttccactacacgttgactactcatgggtgattagcactgagcccggctccgactcagaagaggatgaggaggaaaaacggtgtcttctcaaactgccagcccaggcacattgggccagcggtcggctggatatttcaaataagacatatgagaccgtggcctcactgggggcagccactccccagggggaatccgaagattgcccaccaccactgccagtgaagaattccagtcgcacactcgtgcaggggtgcgctcgtcatgcgtctggtgataggagcgaggttagttcactcagtagcgaggcgcctgagaccccagagagccttggttcccccgcttcctcaagctcgctcatgtcacctctagagcccggggacccaagccaggccccacctaacagcgaggagggcctgagagagccccctggcacgagccgacccagcttgaccagcgggacaacacccagtgaaatgtacctgccagttaggttctccagtgagtccaccaggtcatacaggcggggggcacgttccccggaggacggaccttctgccagacagcccctcccgaggagaaacgtcccagtgggcatcacagagggcgacgggagcagaaccggatctttaccagcttcttctgtccagttactccaggactag

SEQ ID NO: 17325 - DNA, 522 bp, Artificial Sequence
  Description of Artificial Sequence: Synthetic coding sequence
atgccaagaaaggggacacaacccagcaccgccaggagacgcgaagagggcccaccacctccctccccagacggagccagctccgatgctgagcctgaaccacccagcgggagaacagagtcaccggccactgcagctgagacggcctcagaagagttggacaataggtccctggaagaaatcctgaattccattccacctccacctcctcccgctatgactaacgaggccggagcaccaagactgatgatcacccacatcgtgaatcagaactttaaaagttacgcaggagagaagatcctgggccctttccacaagaggttttcatgcattattgggcctaacggctccggaaagagtaacgttatagattccatgttgtttgtgtttggttacagggcacagaagattagatccaagaaactctctgtgctgattcataatagtgacgagcacaaagacatccagtcatgcaccgtcgaggtgcactttcagaaaatcatcgataaagaaggcgattag

SEQ ID NO: 17326 - DNA, 2262 bp, Artificial Sequence
  Description of Artificial Sequence: Synthetic coding sequence
atgtactcccctataatctatcaggctctctgtgagcacgtgcaaacacagatgagcctcatgaatgatttaacctctaagaacattcctaatggcatcccagctgtaccttgccatgcacccagtcactcagaatcccaggccacaccacatagctcctatggcttgtgtacttcaactcccgtctggtctttgcagcgtcctccttgccctccaaaagtccattcggaggtgcaaactgacggaaactcccagttcgcaagccaggggaagacagtgagtgccacttgtacggatgtgctaaggaattcatttaacaccagtccgggagttccttgctctctgcccaaaacagatatttctgccatcccaacattgcagcaattgggcctagtcaacggcattttgccccagcagggcatccacaaggagaccgacctactgaaatgtatccagacatacttaagcctgttcagaagtcatgggaaggagacccatcttgacagccaaacacaccgcagtcccacccagtcccagcctgccttcctggccacaaacgaggagaaatgtgcacgggagcagatccgtgaggctaccagtgaacgaaaggatctcaatatccacgtcagggataccaagacagtcaaagatgtccagaaggctaagaatgtcaataagacggcagagaaagtgaggatcatcaaatatctgttgggagaactaaaggcacttgtggcggaacaggaagattccgagatccagaggctgatcactgagatggaagcctgcattagtgtactccccaccgtgtccgggaacaccgatatacaagtagaaattgccctggcaatgcaacctctccgcagcgagaacgcacagttgaggcggcagctccgcatcctcaatcaacagcttagggagcagcaaaaaacacaaaaaccaagcggcgctgtggactgcaacctcgagctgttttcgctccaatccttgaacatgtctctgcagaaccaactagaggagagtttaaaatcgcaggagctgctgcagagcaaaaacgaggaattattaaaggtcattgaaaatcagaaggacgaaaacaaaaagttctccagcatttttaaggataaggatcaaaccattttagaaaacaaacagcaatatgatatcgagatcaccagaatcaagatagagcttgaagaggccctcgtgaacgtgaaaagcagccagttcaagctggaaacggccgagaaagagaaccagattctgggcatcacgctgcggcagagagacgctgaagtgacaagactgagggagctgactaggacactgcagacctctatggctaagctgctcagcgatctgtccgtggattctgcacgttgcaagccgggtaataatctcactaagtccctgctgaacatccacgacaaacaactccagcatgatccagccccagcacatacttctatcatgagttacctgaacaagcttgagacaaattattcctttacccatagcgagccgctttctacaatcaaaaatgaggagacaattgagcctgacaagacctatgagaacgtcttgtcgtctcggggccctcaaaattccaacactagaggcatggaggaagcttccgcaccgggtattatatcagccctctctaagcaggacagtgacgagggctccgaaaccatggccctgatagaggatgaacataatctggacaacacgatctatatcccgttcgccaggtccacccccgaaaagaagagtccactctcgaagagactaagtccacaacctcagattcgcgctgccacaacacagctggtttctaactccgggcttgctgtgtcaggcaaggagaacaagttgtgcacgcctgtgatctgtagcagctccacaaaagaggcagaagacgcgcccgagaagctgtcaagagccagcgacatgaaagacacccagctgctcaagaaaatcaaggaggccatcggaaaaatccctgcagcaaccaaagagccagaagagcaaacagcatgtcatggtccatccggctgcctctccaacagcctgcaagtgaaggggaatacggtgtgtgatggctcagtcttcacttctgacctgatgtccgactggtcaatttccagcttctctacattcacaagccgggatgagcaggattttcggaatggccttgctgctcttgacgccaacatcgctcgtctgcaaaagtcccttagaacaggcctgctagaaaagtag

SEQ ID NO: 17327 - DNA, 219 bp, Artificial Sequence
  Description of Artificial Sequence: Synthetic coding sequence
atgatggaagaaatctccataatggtggcatatgatgcccacgttttctctcagctccatgacgaggactttctgacaagtctcgtggcaatttccaaacccaggtcaatggtcccaacaaaaaagcttaaaaagtacgagaaggagtatcagaccatgagagaatcccaactacagcaagaagacccaatggaccgatataaatttgtttatttgtag

SEQ ID NO: 17328 - DNA, 588 bp, Artificial Sequence
  Description of Artificial Sequence: Synthetic coding sequence
atgtggcacatgaccaggaattggccactcgtgggtaaaacatctctgatcacccggtttatgtacgattcttttgacaacacctaccaggcgacgatcggaatcgatttcctaagcaagacaatgtatcttgaagacaggaccgtgagactgcagttgtgggatactgctggccaagaacggtttagatctctgataccatcttacatccgagactccaccgtagcagtcgtggtttacgacattactaacttgaacagcttccaacagactagcaagtggatcgacgacgtgcgaacggagcggggctcggacgttatcatcatgctggttggcaataaaactgatctggcagataaacgccagattacaattgaggaaggagagcagagggcaaaagagctttctgtaatgtttatcgagacctctgcgaaaaccggctataatgttaaacagttgttccggagggtggcttccgccctccctggaatggagaatgtgcaggaaaagagcaaggaaggaatgattgatattaagttggacaagccgcaggaaccccctgcttcagagggaggctgctcctgttag

SEQ ID NO: 17329 - DNA, 1047 bp, Artificial Sequence
  Description of Artificial Sequence: Synthetic coding sequence
atgagcttgcctcgctttcaaagagtgaattttgggccctacgataattacatcccagtaagcgaactgtccaagaagagttggaaccagcagcactttgccctcctgtttcctaagcctcaacgacctggtacaaaaagacggtcaaagcctagtcaaattagagataacaccgtcagtattattgacgaagagcagttgcgcggggacaggcggcagcctctctggatgtacaggagtctgatgcgcattagcgaaagaccttccgtttatctggccgcaagacgccaacccctaaaacctacgcgaactgtcgaggtcgactcaaaggctgccgagatcgggaagaaaggagaagataaaaccacacagaaggacacgacagattctgagtcggaattgaaacaggggaagaaagactcaaaaaagggaaaggatatcgagaaaggaaaagaggaaaaactggatgccaagaaagattcaaagaaaggaaaaaaagacgctgagaagggcaaggactccgccacagagagcgaagacgaaaagggcggagctaagaaagacaacaagaaggacaaaaaggactcaaacaaaggcaaagattctgcgacagagtccgagggcgaaaagggagggacagagaaagactctaaaaaaggaaaaaaagactccaaaaaagggaaggatagtgcgatagaactgcaggcggttaaggctgacgagaagaaggacgaagacggaaagaaagatgcaaataaaggggacgaatctaaagacgccaagaaggacgccaaggaaataaagaaaggaaagaaagacaagaaaaaaccctcatccaccgacagtgactcaaaagacgatgtcaagaaagagagcaagaaggatgctaccaaagacgctaagaaagtcgcgaagaaggatactgaaaaagagagtgctgatagcaagaaggacgcgaaaaagaatgccaaaaaggacgccaaaaaagatgccaagaaaaacgccaaaaaggacgaaaaaaaagacgccaaaaagaagggcaaatag

SEQ ID NO: 17330 - DNA, 2862 bp, Artificial Sequence
  Description of Artificial Sequence: Synthetic coding sequence
atgaaaaggggcattcgacgcgacccttttaggaaacgcaagctaggagggagggctaagaaggtgcgagagcccactgcggtcaacagcttttatcgggaagcttctcttcccagcgtgtgggccagcctccgccgcagggagatggttcgctcgggagccagaccaggccaggtgctgtcttctggacggcacaccggaccagcgaaactgaccaatggaaagaaagcaacatacttgagaaagatcccacgattcaacgcagactcagggtatagtatccatagcgactcagagtcacaggccgaaaccgtgcacggccttgacggttgtgcatcactactgcgggatatcctgagaaatgaagacagtggtagtgagaccgcctatctcgagaatagaagtaatagcagacccctagagtccaaaagatacggatcaaaaaaaaagcggcatgaaaaacatactatacccctcgtggtccagaaggagacatcaagtagcgataacaaaaagcagatcccaaacgaagccagcgcacggtccgaaagggatacatcagatctggagcagaattggagtctgcaagaccactaccgtatgtacagcccaattatttaccaagccctctgcgaacacgtgcaaactcagatgagcctgatgaacgacttgacgtccaaaaacattccgaatggcatcccggccgttccttgtcacgcacccagccactccgaatcacaagctaccccccatagcagttatggactctgcacttctacccctgtctggtcactccaacgtcctccctgtccacccaaggtgcatagcgaggtacagaccgatggaaacagccagtttgcctcgcaggggaaaacggttagcgcaacctgcaccgacgtcctgcgcaattccttcaacaccagtccaggagtgccctgttctctcccaaagaccgacatctctgccattccaaccttgcagcagttgggactggtgaatggaattctcccccagcaaggtatacacaaagagactgacttactcaagtgcatccagacctatctgtctctgtttcgctctcatgggaaagaaacccatctcgacagtcagacccatagaagcccaacacaatctcaacccgcttttctcgccactaacgaggaaaaatgcgccagagagcagatccgcgaggctacaagtgaacgaaaagacttgaacattcacgtaagagacacaaagaccgttaaggacgtgcagaaagcgaagaatgtgaataaaacagcagagaaagtgagaattattaagtacctcctcggggagttgaaggcacttgtggctgaacaggaagatagcgaaatccagagactcatcaccgaaatggaggcttgcatcagtgtactccccaccgtcagcggtaatacagacatccaagttgagattgccttggctatgcaaccattgcgtagcgagaacgcccagctgcgaagacagctgcggatcttgaatcagcaactcagagagcagcagaagactcagaagcctagtggcgctgttgactgtaacctggagttgttttcgcttcagagtttgaatatgagtctgcagaatcaactcgaggaatcactgaagtcacaagaactgcttcagagcaaaaacgaggagttgctgaaggttatcgaaaatcagaaagacgagaataagaagttctccagtatcttcaaagataaagatcagaccattttggagaacaagcagcaatacgatattgaaattacccggatcaagatcgagttagaggaggctctggtcaatgtaaaatctagccaatttaagctagaaactgcagagaaagaaaaccagattctcggcataacactcagacagcgggatgctgaggtgacacggctccgggagctaacccgaactctgcaaacctccatggccaagcttctcagcgatttaagtgtcgatagcgctaggtgcaagccaggcaacaacctgactaaatctctgctgaacatccacgataaacagctgcagcatgatccagcccctgcccacacatcgataatgtcatatttaaacaagttggaaaccaattactcctttacacacagtgaacccttgagcacaataaaaaacgaagagaccattgagcctgataagacctacgaaaatgtgcttagtagtcggggaccccagaattccaacaccagagggatggaggaggcttctgctcctgggattattagcgcactttcaaagcaagattcggacgagggatccgagacaatggctttgatcgaggatgagcacaaccttgacaataccatctacattccctttgcccgatccacaccagaaaaaaagtctccgctcagcaagcgactttctcctcagccccagatccgtgccgctaccactcaactcgtgagtaacagtggtctggctgtttccggcaaagaaaacaagctgtgcaccccagtcatctgcagttcttcaactaaagaagcagaggatgccccggagaaactatccagagcgagcgacatgaaggacacccagctgctcaaaaagattaaggaagctattggaaagatcccggcagccacaaaagagccggaggaacagaccgcgtgccacggccctagtggctgtctgtctaacagtcttcaggtaaaagggaatactgtctgcgacgggagcgtttttacttccgacttaatgagtgactggagcatttcgtctttcagtacatttacctcccgcgatgagcaggatttccgcaacggacttgccgctctggatgccaatattgcgagacttcagaaatctctgcgcaccggtttgctggagaagtag

SEQ ID NO: 17331 - DNA, 1683 bp, Artificial Sequence
  Description of Artificial Sequence: Synthetic coding sequence
atgtccgaacatagccggaattccgaccaggaagaactgcttgacgaagagatcaacgaagacgaaatcctggcaaatctatccgcggaggagctgaaggagcttcagtctgaaatggaagttatggctccggacccatccctcccggtgggcatgattcagaaagaccaaacagacaagcctccaacaggaaacttcaatcacaaatcactagtggactatatgtattgggagaaggcctctcgcaggatgttggaggaggagcgggttcctgtgacctttgtgaagagcgaggaaaaaacccaagaggagcacgaggaaatcgagaaaagaaataaaaatatggcccagtaccttaaagagaaattaaataatgaaatcgtggccaacaagcgagagtctaagggcagctccaatatccaggagactgacgaggaagatgaggaggaggaggacgatgatgacgatgatgagggagaggacgacggtgaggagagcgaggagactaaccgagaagaagaagggaaggccaaggagcagattcgcaactgtgaaaataactgtcaacaagttacagacaaagcattcaaggaacaacgggacagaccggaagcacaagagcagtcggagaaaaaaatcagcaaattggaccccaagaagcttgccctagacacatctttccttaaggtgtccacccgaccttctggcaaccagacagacttggacggctcattgagaagagtgcgaaagaacgacccggacatgaaagagctaaacctgaacaatattgagaacattccgaaggaaatgctcttagactttgtaaatgccatgaagaaaaacaaacatataaaaacattttctctggccaacgtgggggcagatgaaaacgtagcctttgctcttgccaacatgctacgggagaaccggtcaatcacaacgttgaacatagagtcaaatttcattacagggaaaggaatcgtagctataatgcgctgcttgcagttcaacgaaacgttgacagaactcagatttcataaccaaagacatatgctgggtcaccatgcagagatggaaatcgcacgcttgctgaaagcgaacaataccctgctcaagatggggtaccatttcgagctgccaggaccccggatggttgtgactaacttgctcactcgaaaccaggataaacagaggcagaaaaggcaggaggagcagaagcagcagcagctgaaggaacagaagaaactgatcgcgatgctcgagaacgggcttggcctaccacctggtatgtgggaactgctgggtgggcccaagccagactctaggatgcaagagttttttcagccaccaccacctaggcctcccaatccacagaatgtgcccttctctcaaagatcagaaatgatgaaaaagccctcccaggctccgaagtatagaaccgatcccgacagcttccgagtcgtgaagttaaagaggattcagcgcaaaagccgaatgcccgaggccagagagccccctgaaaagactaacctgaaggatgtcatcaaaacacttaagccagtgcccaggaaccggccccctcccttagtcgagatcactccacgggaccaactgcttaatgatatccggcactctagtgtagcctacctgaagccagtacagctaccaaaagagctcgcctag

SEQ ID NO: 17332 - DNA, 153 bp, Artificial Sequence
  Description of Artificial Sequence: Synthetic coding sequence
atgccagaggatcaggtcggcaaacttgaggccacagagaacacgatctccgccatggcagccgccgccgctgagcagcagcagttctatctccttttaggtaacttgctttccccagacaacgtcgtgcggaaacaagccgaggttacctag

SEQ ID NO: 17333 - DNA, 288 bp, Artificial Sequence
  Description of Artificial Sequence: Synthetic coding sequence
atggccataggcaaacggctggccacattgccaactaaagaacagaagacacagaggctgatttcagagctcagtctgctcaatcacaaactcccggcccgtgtttggctgcccaccgctgggtttgatcatcatgtagtccgcgtgccgcacacacaggccgttgtgctcaactcgaaggacaaggccccctatcttatatacgtcgaggtgttagaatgtgagaacttcgacactacatccgtgccagccaggattccggagaacagaatacgttcaaccagatag

SEQ ID NO: 17334 - DNA, 1260 bp, Artificial Sequence
  Description of Artificial Sequence: Synthetic coding sequence
atggctggctctggatgcgcttggggggcagagccgcccagattcctcgaagcatttggaaggctttggcaggtgcagtccaggctcggcagcgggtcttcggctagcgtgtatcgcgtgcgttgctgtggaaaccctggctctcctccaggcgctcttaaacagtttctgccccctggtaccaccggagccgcagcatccgcagctgagtacggcttcaggaaagaaagagcagctttggaacagcttcagggccaccgcaatatagtcacactctacggcgtgtttactattcacttctccccaaatgtgccaagccggtgtctgctccttgaactcctggatgtctccgtgtcggagctccttttgtactcgagccatcaaggttgtagtatgtggatgatccagcactgcgcacgcgacgtcctggaggctctcgccttcttacaccatgagggctacgttcacgccgatctcaaaccccgtaacatactttggagcgccgaaaacgagtgcttcaagctgatcgatttcgggctgtcttttaaggagggaaaccaagacgtcaagtacattcagactgacggctaccgcgcccctgaggccgagctgcaaaactgcttggcgcaggccggtctccagagtgacactgagtgcacaagcgctgtcgatctctggtcattgggcattatcctgctcgagatgttttccgggatgaaattgaaacacacagtcaggtctcaggaatggaaggcaaatagctcagctatcatcgaccacatcttcgccagcaaggctgttgtcaatgccgctatccctgcctaccacttgagagacttaatcaaatcaatgctccatgatgacccatctcgtcgaatccctgctgaaatggccctgtgcagcccatttttttcaatcccctttgcgccgcacatcgaggacctcgtcatgctgcccaccccagtactgcggctgttgaatgtcttggacgacgactatttagaaaatgaagaagaatatgaggacgtggtcgaagatgtcaaggaggagtgccagaagtatggacccgtcgtgtctctactggtgccgaaggaaaacccggggcgcggccaggtgttcgtggagtacgccaacgccggggattctaaggccgcacagaagctcctgacaggaagaatgttcgacggtaagtttgtagttgccaccttttatcctctgagcgcctacaaacgcggctatctgtatcagacactgctgtag

SEQ ID NO: 17335 - DNA, 1272 bp, Artificial Sequence
  Description of Artificial Sequence: Synthetic coding sequence
atgccccgcaaaggtacacagccatccacagcccgccgccgggaggagggtccaccaccaccttcaccggacggggcctcatccgacgcagagccggagcctcctagcggccgcacagaaagtccggccacagccgcggagaccgcatctgaagaactggataaccgcagtttggaggagatcctgaacagtatcccccccccccctcctcccgccatgaccaacgaagcaggagcgcctcggctgatgattactcatatcgttaaccaaaacttcaaaagctacgccggcgaaaagattctcggaccattccataaacgattcagttgcataattggtccaaatggttctgggaagtctaacgtgatagattcaatgttattcgtgttcggctacagagctcagaaaattagatctaagaagctttccgtacttattcacaatagcgacgagcacaaggatatacagtcttgcaccgtagaggtccacttccagaaaatcatagataaggagggggacgattatgaggttattcccaacagtaatttctatgtttctaggaccgcttgccgggacaacactagcgtgtatcacattagcggaaaaaagaagacattcaaggatgtgggtaatctacttcggtctcacggtattgacttggaccataaccggttcctaattctgcagggcgaggtggagcagatcgcaatgatgaagcccaaagggcagacagagcatgacgaaggcatgctggagtatctggaagatatcattggatgcggtcggctcaacgagcccatcaaagtgttatgtcggcgggttgaaatactgaatgagcataggggcgagaaactgaatagagtgaaaatggttgaaaaggagaaggatgccctcgagggcgaaaagaacatcgccattgaattcttgactctggaaaatgagattttcagaaaaaagaatcacgtgtgtcagtactacatctacgagctgcaaaagagaatcgcagagatggagacgcaaaaagaaaagattcacgaagatacaaaagagattaatgagaaatccaatatcctgagcaacgaaatgaaagcgaagaataaagatgttaaagacaccgaaaagaaactgaacaagattacaaagttcatcgaagaaaacaaggaaaagttcacccaactagacctggaagacgttcaagttcgtgagaagcttaaacacgcaacctccaaggcaaagaaattggaaaagcagctgcagaaggataaggagtag

SEQ ID NO: 17336 - DNA, 1113 bp, Artificial Sequence
  Description of Artificial Sequence: Synthetic coding sequence
atggaagagggagtgccatgtcctgccccagctgcaaagctcactcccccagtgaagaagtcacaggatatgcacgatgagagatctaagctggtgaatgaatacgcatgccgagttctcgagctgctcggtatgggtcatagattgtttgtaccacgcctgctggccactagtaaggaggatcttctccaggccgattttgagggagccctgaagtttttccgcgtccagttgccaaagcggtaccgcgccgaagagaacgcacggcgccttatggagcaagcatgcaacattaaggtgccaactaagaagcttaaaaaatatgagaaggaataccaaaccatgagggaatcacagctgcagcaggaggatcctatggatcggtataagagggagaatcgcaggctccaagaagcttccatgagactggaacaggaaaacgatgacttggcacatgagctagtgaccagcaagatcgccctgcgcaatgatttggatcaggccgaggacaaggccgacgtgctgaataaggaacttttgctgacaaagcagagactggtggaaactgaagaggagaaacgaaagcaggaggaggagacagctcagttaaaggaggtgttcaggaaacaactcgagaaagcagagtacgagataaaaaaaactacagctattattgcggagtacaagcagatttgcagccaactttcaacacggctcgaaaaacagcaggcagcttcaaaggaggaactggaagtggtgaagggcaaaatgatggcgtgcaaacactgttccgatatcttcagcaaagaaggagcactaaaattggcagccaccggcagagaggaccagggcattgagacggacgacgagaaggatagcctgaagaagcagcttagagaaatggaactggagttggctcagactaaattgcagctggttgaggcaaaatgcaagatccaggagctcgagcatcagagaggtgctctgatgaacgaaatccaggctgccaaaaattcttggttctcaaaaaccctgaacagtattaagaccgctacaggcactcaacccctccagccagcgcccgttacacagccgcccaaggaatctacctag

SEQ ID NO: 17337 - DNA, 2262 bp, Artificial Sequence
  Description of Artificial Sequence: Synthetic coding sequence
atgtactcccccataatttaccaggcattgtgcgaacacgtacagacacagatgtccttgatgaatgacctgacttccaaaaatatcccaaacgggatacctgctgtgccgtgtcatgccccctcacactcggagtcgcaagcaactccccacagcagctacggactgtgcacttccacacctgtgtggagtctacagcggcctccttgtccaccgaaggttcattccgaggtgcagaccgacggaaactcccagtttgccagtcaagggaagacagtaagcgctacgtgtacagacgtgctgagaaattcatttaacacttccccaggggtgccttgttcactgcctaagactgacatctctgccatacctaccctgcagcagctcggcctcgtgaacggaatcctaccacagcaaggcatccacaaggagacggatcttttgaagtgtattcagacctacctgagccttttcaggtcccacgggaaggaaacccacttggactcacagacacaccgctctcccacacagagtcagcctgcgtttctggctactaacgaggagaagtgtgccagagaacagatccgtgaggctacatcggagagaaaggatctgaatatccacgttcgcgacacaaaaactgtaaaggacgttcagaaggcaaaaaatgttaataaaaccgccgaaaaagtcaggatcatcaagtatttgcttggggaactgaaagctctggtcgcggagcaggaggactcagagatccagcggctaattacagagatggaggcatgtattagcgtgctaccaacagtgtccggcaacactgatatacaggtcgaaatcgctcttgcaatgcaaccactgcgtagcgaaaatgcgcagctgagaagacagcttcgtatccttaaccagcagttgagagaacagcagaagacccaaaagccttctggagcagtggactgcaacctggagctgttttccctacagagcctgaacatgtctctgcagaatcagttagaggaaagcttgaaaagccaggaattgcttcaatctaagaacgaagaactgctgaaggtgatcgagaaccagaaggacgaaaataagaaattctccagcatctttaaggataaagaccaaactatcctcgagaacaaacagcagtacgacatcgagatcacccggatcaagatagagctcgaagaagcactggtcaacgttaaaagcagccagttcaaactagagaccgccgaaaaagagaaccaaatcctggggatcacactcagacaacgggatgctgaggtgacgcggctaagagagctaacccgaaccctgcagacatcaatggccaaactcctgagcgatctttcagtcgatagcgcgagatgtaagcccgggaacaatctcaccaagagccttctgaacatccacgataaacagttgcagcatgatcctgcccctgcacatacatctattatgtcctatctgaataaactagagacaaattacagctttacacattcagagcccctctctacgataaagaatgaggagactatcgagcctgataagacctatgagaatgtcctttcaagcagaggtccacagaattccaacactagaggcatggaggaggctagcgctccgggaataatttcagccttaagcaaacaggatagcgatgagggctctgaaactatggctctgatcgaggatgagcataatctggataacactatatacatcccattcgctaggagcaccccggagaagaaatcaccactatcgaagaggctttccccacagcctcagattcgtgctgccaccacacagctggtctccaactctggtctggccgtgagcgggaaggagaacaagctgtgcaccccagtcatctgttcaagctctacaaaggaggcagaggacgcacccgaaaaactaagccgggcgagtgatatgaaagacacccagctgcttaaaaagatcaaggaagctatagggaaaatcccagctgctacaaaagaacccgaggagcagactgcttgtcatgggccaagcggatgcctgtcaaactctctccaggtgaaaggcaacaccgtttgtgatggatccgtcttcaccagtgatttaatgagcgactggtcaatttcctctttcagcacttttacttcaagagatgaacaggattttaggaatggattagccgccttggatgccaacattgcccgactgcagaagtctctcagaactggccttctcgaaaagtag

SEQ ID NO: 17338 - DNA, 2067 bp, Artificial Sequence
  Description of Artificial Sequence: Synthetic coding sequence
atgagcgtcaatagtgagaagagttcctcttcggagaggcctgaacctcagcagaaagccccacttgtgccccctccgccaccaccacctccaccacctccaccgccgctccctgaccccacaccaccggagcctgaggaggagatactcggcagcgatgatgaggaacaggaggaccctgcagactactgtaagggtgggtatcacccagtcaaaattggagacctgttcaatgggcgctaccacgtgatccgaaagctcgggtggggtcatttcagtactgtctggctgtgttgggacatgcaaggcaagaggtttgttgcaatgaaggtggtcaagagcgctcaacactatacagagacagccctcgacgaaatcaaattactgaaatgtgtcagagaatccgatcccagtgaccccaataaggatatggtcgtgcagttaattgacgacttcaagataagtggcatgaatggcatccacgtttgcatggtgtttgaggtgctgggacaccacctgctgaaatggataatcaaatcaaattatcaggggttgccagtcaggtgtgtcaaaagcataatcagacaggtgttacagggccttgattacctgcacagtaagtgcaagataatccatacggatataaaacccgaaaatatcctgatgtgcgttgacgatgcgtatgtacgacgcatggcggccgaggccactgagtggcagaaggcgggagcgcctccccctagtggcagcgcagtaagtactgccccccagcagaagcctatcggcaaaatatctaaaaacaaaaaaaagaaactgaaaaaaaagcagaaacgccaggccgaactactcgaaaaacgattgcaggagatcgaggagctggagagagaggctgaacggaagatcatcgaagagaacataacaagcgccgctccgagcaacgaccaggacggagaatattgtcccgaagtcaagctgaagaccaccggcttagaagaggccgcagaagctgagaccgccaaagataacggagaggctgaagatcaagaggagaaggaggatgcagaaaaggagaacatagaaaaggatgaagacgatgtagaccaggagcttgccaacattgatccaacgtggatcgaaagcccgaaaacgaatgggcacatcgagaacgggcccttcagccttgaacaacagttggatgacgaagatgacgacgaagaggattgcccgaaccccgaggagtacaacctagacgagcccaacgcggagtcggattacacttatagctccagctacgagcaatttaatggtgaattacccaacgggcggcacaagatcccagaatcacaatttcccgaattttctacatctctcttcagcggttcgctagagccagtagcttgcggatcggtgctgtctgaagggtctccgttgactgagcaggaggagtcaagcccttcccatgaccgatctagaactgtgtccgcctccagcacaggagacttaccaaaagcgaagacacgcgctgccgatctgctggtgaatccactggatcctcgcaacgccgataaaatccgcgttaagatcgccgatcttggaaatgcatgttgggttcacaaacattttacagaagatattcagacccggcaatacagaagcatcgaggtgctcattggcgcaggctatagcacgcccgctgatatatggtcaactgcttgtatggctttcgaactggccaccggtgactacctcttcgagcctcacagcggggaggactacagtagagatgaggaccatattgcacacattatcgagctactgggaagcatcccccggcattttgccctttctggcaagtacagtagagaattcttcaaccgccggggcgagttgaggcatatcaccaagctgaaaccatggagccttttcgatgtgctggttgagaaatacggctggccacatgaggatgctgctcagtttactgacttccttattccgatgctcgagatggtgccagaaaagagggcttccgcaggcgagtgtttacgacacccttggctaaactcctag

SEQ ID NO: 17339 - DNA, 543 bp, Artificial Sequence
  Description of Artificial Sequence: Synthetic coding sequence
atgccgcgtaagggtactcagccctctactgcccgaagaagagaagaaggaccaccccctccctccccagacggcgcttctagcgatgccgagcccgaacctccatcaggacgtacagagtcaccagcaactgctgccgagacagcatccgaggaacttgataaccgcagccttgaggagatcctcaactccattcctccacctcccccaccggctatgaccaacgaagcaggagctccccgacttatgatcacccatattgtaaatcagaactttaagtcctacgcaggtgagaagattcttgggccctttcataaacgttttagctgcatcattggacccaacgggtcagggaagtccaatgtgatcgatagcatgctgttcgtttttggctacagggcccagaaaataagatctaagaagttgtctgtccttattcacaacagcgacgaacacaaggatatccagtcatgcacggtggaggtccatttccagaagatcattgacaaggagggtgacgactacgaggtgattcctaattag

SEQ ID NO: 17340 - DNA, 4689 bp, Artificial Sequence
  Description of Artificial Sequence: Synthetic coding sequence
atgcccggagaagcagcacgtgcagagttgctcctgccggaggccgacaggcccggccctcgcacagacctgagctgtgacgcggccgccgcgacaacgattctgggaggcgataggcgcgagccatgcgctctgacacccggaccctcacaccttgctctcacattcctgccatcgaagcccggggcgcggccacagcctgagggagcatcatgggacgccgggcccgggggtgctcccagcgcctgggccgatccaggagaaggagggccatctcctatgttgctacctgaaggtctaagctctcaggctctgtcgaccgaggcgcctttacccgccacactggagccccgcattgttatgggagaagagacttgtcaagcgctgctgagtccacgggccgccaggaccgcactgcgagaccaggaaggcggacacgcctccccagatccacccccagagctttgctcgcagggagatctatcggtacccagcccaccgcctgacccagattctttcttcacacctccctctacccctacgaagaccacatacgctttgctgcctgcatgcggcccccatggagacgcgcgggacagtgaagccgagcttcgtgacgagcttctggacagccccccggctagtccatcgggttcgtatatcaccgctgacggcgactcctgggcttcttcaccatcttgttccctgtcactgctggctcccgccgagggcctggacttccccagcggctggggactgagtccacagggctccatggtggatgagagggaattgcatccagcgggtacccctgagcccccctctagcgagagttcactcagtgctgatagcagctcctcctggggacaggaaggccatttctttgacttagacttccttgccaacgaccccatgattccggccgcgttactgccttttcagggtagtctcattttccaagttgaggcagtggaggtgacccctctctcccccgaggaggaggaggaagaggcagttgctgaccccgaccctggcggcgatctcgccggagagggggaggaagactcaactagtgcctcatttctccagtccttaagtgatttgtcaataacagagggaatggatgaggcttttgctttccgcgatgacacgagtgctgcttccagtgattccgattctgcttcctatgccgaggccgacgatgaacgcctttactccggagagccccatgcccaagccactcttctgcaggatagtgtgcagaagaccgaggaagaatctggcgggggtgcaaaaggacttcaagctcaggatggaacagtcagttgggctgtggaagcagccccccaaacctcagataggggagcgtatctgtctcagcggcaggaattgatttcagaagtcacagaagaggggctcgcgctgggccaagagagcactgccactgtgacacctcacaccctgcaggttgcccccggattgcaagtggaagtggccacgcgggtgacacctcaagccggagaagaggagactgattcaaccgccggtcaggagagcgccgctatggcgatgccacaaccatcacaggaaggcatctctgagatcctaggccaagaatcagtgactgccgagaagcttcccacaccacaggaggaaacctcattaacgctctgccctgattctcctcaaaaccttaaggaggaagggggactggacctgcccagcggaagaaagccggtagccgcggccaccatagtgccccgacaagctaaggaggatttgacactgcctcaggacagcgctatgacacctcccttaccccttcaggacacagatctatcgtctgcacctaaacccgtcgccgccgcgaccatcgtctcacagcaagccgaggagggactcactttaccgcaggattctgtgatgacaccaccactcccactgcaggacacagagctgtcttcagctcccaaaccagtagccgccgctaccctggtgtcccagcaagccgaagagggccttaccctacctcaggactccgcaatgacacctcccctgcctctgcaagacacagatctgagctccgcccctaagccagtggccgccgcaaccctggtgagtcagcaggctgaagagggcctgacattaccccaggattcagcaatgacaccaccactgcctctgcaagacaccgatctgtcctctgcccctaagcctgtggctgctgcaaccctagtctcccagcaggcagaagaaggccttactctaccccaggattccgcgatgactccacccctgcccctccaagacaccgacttatccagcgcccctaagccggtggctgcggcgaccatcgtgtctcagcaggccgaagaaggtctcacactgccccaagactccgccatgactccccccttgccacttcaagacactgacctgtcctccgctccgaagccagtagcggccgccaccattgtatctcagcaggctgaagaaggccttacattgcctcaagactcagcaatgaccccacctctccctctacaggatactgacctttcgtccgccccaaaaccagttgccgctgccactccagtctctcagcaggctgaggagggcctgaccctcccccaggactccgctatgacaccacccttgccgctccaagataccgacttgtcttccgcaccaaaaccagtggccgccgccacccctgtgagtcagcaggccgaggaaggcttgacactccctcaggacagtgccatgacagctccgttgccactgcaggacacaggacccacgtccggaccagaacccctggcggtggcaacaccgcagaccctccaagcagaagctggctgtgcgcccgggacagaacccgtggctacgatggcacagcaggaggtaggcgaagcgctgggcccacggccagctccggaggaaaagaacgccgctctgcccactgttccggaaccagccgcactggatcaggttcagcaggacgaccctcaacccgcggctgaagctgggacgccatgggcagcccaggaagacgccgactctacattggggatggaggccctctccctgcctgaaccagctagcggagccggcgaagaaattgccgaagctctgtcaagaccagggcgggaggcatgcttggaggccagagcccacacgggtgatggtgccaagccagattccccgcagaaagagaccctggaggtggaaaaccagcaagagggtgggctcaagccgctcgcacaggagcatgggccaaggtccgctctggggggagcaagggaggtgcctgacgctcccccagcggcctgtcccgaggtcagccaggctcgcttattatctcctgccagagaagagagaggattgtccggaaagtccactccagaacctacgttgccctccgcggtcgcaaccgaggcatccctggattcctgccccgagtcaagcgtgggagcggtctcctctctggacagagggtgtcctgatgcccctgctcctacctcagcccccacttcgcagcaacccgaacctgtgttgggactgggaagcgtcgagcagcctcatgaagttcccagtgtgctaggaaccccactccttcaaccccccgaaaacctggcaaaggggcagcccagcacacccgtggatagacctttaggccccgaccctagcgcaccgggcactctggccggagcagccctgccacctctggaaccaccagccccttgtttgtgccaggatcctcaggaggacagtgttgaggatgaagagccaccaggctcactggggctcccaccgccccaggccggggtgcaaccagcagccgcagctgtgtccggcacaactcaacccctcggaacagggcctagagtatcgctaagcccccactctcctctactgagtcctaaggtcgcaagcatggacgccaaggatctcgccctgcaaattctgcctccatgccaggtcccaccaccttctggtcctcagtctccagctgggccacaaggcctgagtgcgcctgaacaacaagaggacgaagacagtctggaagaggatagccccagggcactcggaagcggacagcacagcgacagccacggcgagtcatcagccgagttggacgaacaggacatcctggccccccagacagtgcagtgtcctgcgcaggcgccagccggcggcagtgaagaaacgatcgccaaagctaagcagtctcggtcggaaaaaaaggcgaggaaagccatgtctaagcttggcctgaggcagatacagggcgttactcggattaccattcaaaaaagtaagaacattctgttcgtaattgccaagcccgacgtgtttaaatcgccagcaagcgacacctatgtggtttttggcgaggcgaagatagaggatctcagtcaacaggtccacaaggcagcagccgagaagtttaaggtccccagtgaaccttccgccttagtacctgagtctgctccaagacccagggtgcgactagaatgcaaggaggaagaggaggaagaagaggaagaagtcgacgaggccggactcgaactgagggatatcgagctggttatggcacaagcgaatgttagccgggctaaggctgtaagagcactccgcgacaaccatagtgatatcgtcaatgccattatggaactgacaatgtag

SEQ ID NO: 17341 - DNA, 3294 bp, Artificial Sequence
  Description of Artificial Sequence: Synthetic coding sequence
atggcagccgctgctgctgagcagcagcagttctatctgttactcggtaatttgctttccccagacaatgtcgtcagaaaacaggccgaagaaacatacgaaaacatccctgggcaaagcaagattacttttctgctacaggctatcagaaacaccacagccgccgaagaggcaagacaaatggctgccgtgcttctgcggcggctccttagcagcgcctttgacgaagtctatccggcgctcccatctgatgtgcaaactgctatcaaatctgagttactgatgatcattcagatggaaacacagagctcaatgaggaagaaggtgtgcgacatcgcagccgagcttgctcgtaatctgattgatgaagacggaaataatcaatggcctgaaggtctcaaatttctcttcgattctgtgagcagtcagaacgtgggactgagagaagctgcgctccacattttttggaatttccccggtattttcggcaaccagcagcaacattatctcgatgtgatcaagcgtatgctggtacagtgcatgcaagaccaggaacacccttctattagaactctatcagcaagggctaccgcggctttcatcttggcaaacgagcacaatgtggctctgtttaagcactttgctgacctgttaccgggcttcctgcaggcggtcaatgatagttgctaccagaacgatgactcggttctgaagagcttagtggagatcgccgatacagtccccaaatatcttcgaccacacttggaagctactctgcagttgagtctgaaactatgtggcgatactagtctgaacaacatgcaaagacagttggccctggaagtgatcgtgacattatcagagactgccgcagccatgctccgcaaacataccaacatagtcgcacagaccattccgcagatgcttgccatgatggtagacttggaagaggacgaggattgggccaatgccgacgaacttgaggacgacgattttgattctaatgccgtggcaggggagtccgcactggatcggatggcctgtgggctcgggggcaaattggtacttccaatgatcaaagagcatattatgcagatgttacagaatcccgattggaaatataggcatgcagggctgatggcacttagcgctattggtgaaggttgtcaccaacaaatggaagggattctcaatgagattgtgaacttcgtgctgctgttccttcaagacccccacccccgagtacgttacgccgcttgtaatgcagtgggtcagatggccacagactttgccccaggcttccagaagaagttccacgagaaagtgattgctgccctgcttcagaccatggaagaccagggtaaccagcgagtgcaggcgcatgcggctgccgcgctgattaactttactgaagactgtccaaagagcctgctgatcccataccttgataacctcgttaagcatctgcatagtataatggtgttgaaactgcaagagctcatccagaagggcactaagttggtgctcgagcaggttgtcaccagtattgcgtcagtggccgataccgcagaggagaaatttgtgccgtactacgatcttttcatgccatctctgaagcacattgtggagaatgctgtgcagaaagaactcagactcctgcggggcaagacaattgagtgcatctctctgataggattggcagtgggaaaagagaaatttatgcaggatgcctccgacgtgatgcagctactgctgaaaacgcaaaccgatttcaatgatatggaagatgacgacccccaaatctcctatatgatttccgcttgggccagaatgtgtaagattcttggaaaggaattccaacaatacttgcctgtggtgatgggcccactcatgaagacagccagtattaagccagaagttgcgttactggatactcaggacatggagaatatgtccgatgacgatggttgggagttcgtgaatctaggcgatcaacagagtttcggtatcaagactgctggcttagaggaaaagtccaccgcgtgtcagatgctcgtgtgttacgccaaagaattgaaagaaggattcgtggagtatactgaacaagtggtcaagctgatggtgccactcctaaagttctatttccacgatggcgtgagagtggcggcggctgagagcatgccactgctcctcgaatgtgccagggttcgtggcccagaatatctcacgcagatgtggcacttcatgtgcgatgcgctgatcaaggccatcggtactgagcctgatagcgatgtgctttccgaaattatgcatagctttgctaagtgcattgaggtgatgggtgatggctgtctgaataatgagcatttcgaggagctagggggcatattaaaggcaaaactggaagagcattttaaaaatcaagaacttcggcaggtgaaaagacaggacgaagattacgatgagcaggtcgaggaaagcctccaagacgaggatgacaatgatgtgtacattctgacaaaagtgtccgatattctccactctatcttctcttcttacaaggagaaggtgctaccctggttcgagcagctgttgcctttgatcgtgaacctcatatgcccgcataggccctggccggataggcaatggggactatgtattttcgacgacgttatcgaacattgcagcccagctagttttaaatacgccgagtatttcctgcgacctatgcttcaatacgtgtgcgataattcacctgaggttcgccaggccgctgcttacggactcggggtgatggcccagtacggaggagataattacagaccgttctgcacagaggcgttaccactgctcgttcgagtcatacagagcgcggattcgaagacgaaggaaaacgtaaatgcgacagaaaattgtatcagcgctgtcggcaagatcatgaagtttaaacccgattgcgttaacgttgaagaagtcctgccccattggctgagctggctgccactccacgaggataaagaggaggctgtgcagacatttaactacctttgcgatctgatcgagagtaatcaccctattgtgttggggcctaacaataccaacctgccaaagatcttctcgattatcgctgaaggtgagatgcatgaagccattaagcatgaggacccctgtgcaaaacggctggccaacgttgttagacaagtgcagacctctggcggtttgtggactgagtgtatcgcccaacttagccctgagcagcaggccgctatccaagaactcctgaactctgcctag

SEQ ID NO: 17342 - DNA, 1011 bp, Artificial Sequence
  Description of Artificial Sequence: Synthetic coding sequence
atgaaggctactgctatgaccagcgcctggctcgcccaggggggtgcacacgtcaccattaacgccagggcggaagaggacgtcgagcctgagtgtatcatggagaaggtggctaaagctagtggtgccaactatagcttccataaggaatctggccgtttccaggacgttggaccacaggccccagttgggtctgtgtatcagaaaactaatgccgtcagtgaaatcaaacgagtgggtaaagactcattttgggccaaggcagaaaaagaggaggaaaaccggcgcctggaggaaaagcgccgagcagaggaggcacaaagacagctggagcaagaacggcgcgaacgcgaactcagagaggcggcaagacgggagcagaggtatcaggaacagggcggcgaagcttctccccagtcaagaacctgggagcaacagcaggaagttgtgagccggaacagaaacgaacaagagtccgcggttcaccctagagagatcttcaagcaaaaggagcgcgccatgtccactacctcaatttccagcccacagccaggaaagctgcgctcgccttttttacaaaaacaactcacccaaccagagacacactttgggagggagccggcggctgctatttcacggccaagagcagacctgccagctgaggaaccagccccttctacacccccctgtcttgtgcaagcggaagaggaagctgtttatgaagagccacccgagcaggagaccttttacgaacagccaccgctggtgcagcagcagggggcgggatccgaacacatcgaccatcacatacaggggcaaggactgtcaggccagggattatgcgcacgagccctgtacgactaccaggctgcagacgatacagaaatatcctttgaccccgagaacctcatcactggcatcgaagtgatagacgagggttggtggcgggggtacggcccggatggacattttgggatgttccctgctaattacgtcgagctgattgagtag

SEQ ID NO: 17343 - DNA, 78 bp, Artificial Sequence
  Description of Artificial Sequence: Synthetic coding sequence
atgtggatgcacgttgcaaaggttcaccccaaagggggggagatggtgggagctatacgtaatgccgcctttctgtag

SEQ ID NO: 17344 - DNA, 312 bp, Artificial Sequence
  Description of Artificial Sequence: Synthetic coding sequence
atggccgagctgatacagaagaagttacaaggagaggtggagaagtatcaacagctgcagaaagatctatcaaaatccatgtcaggccgccagaagttggaggcccagctaacagaaaataacattgtcaaggaggaactagccctcttagacggaagcaacgtcgtgtttaaacttctcgggccagttcttgtgaaacaggagctgggtgaagcccgagctactgtgggcaagagactagattacattacagcagaaatttttttgcgtacgatcccagatccaggagacgtgccagattcatttttctag

SEQ ID NO: 17345 - DNA, 4101 bp, Artificial Sequence
  Description of Artificial Sequence: Synthetic coding sequence
atggccgataccgatctgttcatggagtgcgaagaagaggagctggaaccgtggcagaagatcagtgatgtaatagaggattctgtggtcgaagactacaacagcgtggacaagaccacaactgccgggaacccactggtgcagcagggtggccaaccccttattctgacgcagaatcctgcacctggcctcggtaccatggttacccagccggttctaaggccagttcaggtgatgcagaacgccaaccacgttacttccagtccagtcgcctcgcagcccattttcattactacccagggatttccagttagaaacgttagaccagtgcagaatgccatgaaccaagtgggaattgtgctgaatgtgcagcagggtcagaccgtcagacctattacgctggtgcccgcaccaggtacacaatttgtaaaacctacagtgggtgtacctcaagtgttctcgcagatgacccctgtacgacctgggagtactatgcctgtccggcctaccacaaacacttttaccactgttattcccgccacgctcacaatcaggagtactgtaccccagtcccagtcacagcaaacgaaatccaccccttcaacatccaccacacctacagcgacacagcccaccagtttaggacaattggctgtgcagtccccaggccagagtaatcagaccacaaaccccaagcttgcaccaagtttcccctctccaccagcagttagcatagcgagcttcgtaactgtaaagcgccccggggtgactggagagaacagtaacgaggttgcgaagttggttaatacacttaatacgattccaagcctcggccagtcacctggcccagtcgtagtttccaataattcgtccgcacacggatcccagcgaacaagcggtcccgagagtagcatgaaagttaccagctcaattcctgtgtttgacttgcaggacggcggccgcaagatctgccctaggtgcaatgcccagttcagagtcaccgaagccctccgcggacacatgtgctactgctgtcctgagatggtcgaataccagaaaaagggcaagagcttagattctgagccaagtgtcccttccgcagccaagcctcctagccccgagaagactgcccccgtcgccagtaccccaagtagcacccctatacccgctctttcccctcctactaaggtgcctgagcctaacgagaacgtgggggatgcagttcaaaccaaactgatcatgctggttgatgacttctattatgggcgagatggggggaaggtggctcagctgacaaacttcccaaaggtcgccacgtctttccgctgtccacactgtactaagaggcttaaaaacaatatacggttcatgaaccacatgaagcaccatgtggagcttgaccaacagaacggggaagtggacggtcacacaatatgccagcattgttacaggcagttcagtacgccttttcagttacagtgccacttagagaacgtgcactccccctacgaatccaccaccaaatgtaaaatctgtgagtgggcctttgaatctgagcccttgttcctccaacacatgaaggacacacacaagcccggtgagatgccgtacgtgtgccagccctactttcctagttatgtgacccaggtgtgtcagtacaggtctagcctttattcagaagtcgatgttcactttagaatgattcacgaagatacccgacaccttctgtgcccctactgcttgaaagttttcaagaacgggaatgcctttcagcaacattacatgcgccatcagaagcggaacgtgtaccattgcaataagtgcagactgcagtttctatttgctaaggataagatcgagcataagctgcaacaccataagacctttcgcaaacccaaacagttggaagggctaaagccaggaactaaggtgaccataagagcctcaagaggccaacctaggacggtcccggttagtagtaatgatactccaccctcagcactgcaggaagcggccccactcacaagttcgatggatccactgcccgtcttcctctatcctcccgtgcagagatccattcaaaagcgggccgtacgcaagatgagcgttatgggtagacaaacctgccttgaatgttctttcgagatccctgactttccaaaccactttccaacttatgtacactgtagcctgtgcaggtattctacgtgttgtagtagggcttacgctaaccatatgataaataaccatgtgccccgtaagtcccccaaatacctggctttgttcaagaactcagtaagtggaatcaaactggcttgtacgtcctgtacatttgtgacgtccgtaggggacgctatggccaaacatctggtgttcaatccatcccatcggtcatcctctatactccctcgaggactcacctggatcgctcattctaggcacggtcaaaccagagatagggtgcacgacaggaatgtgaaaaatatgtaccccccccccagttttcctacgaacaaagcagccaccgtgaaaagcgcaggcgctactcccgcggaacctgaagagctcctgacgccactcgccccagcactgccaagcccagctagtacagcaacgcccccacctacacctactcacccacaggcactcgcccttcccccactcgcaaccgaaggggccgaatgtttgaacgtggacgaccaagacgagggatcccccgtgacgcaagagcctgagctggcatctgggggtggcggctctggtggggtcgggaagaaagaacaactttccgtcaaaaagctgcgggttgtgctcttcgctctgtgttgcaacaccgaacaggcagcagagcacttcagaaatccccagagacggattagacggtggttaagaaggtttcaggcctcccaaggggaaaacttggagggaaagtacctgagcttcgaagctgaggagaaattagccgaatgggtgctcacacagagagagcagcagctgccagtgaacgaagagacactcttccagaaggcaactaaaatcggtcgtagcctggagggaggattcaaaatctcttatgagtgggctgtacggtttatgttgaggcatcacttgacacctcacgccagaagagctgtcgctcatacactgccaaaagacgtcgccgaaaatgcgggactcttcatcgactttgtccagaggcagatccacaatcaggaccttccgctatccatgatagtcgcaattgatgagatcagcttgttcctggacacagaagttctctcctcagacgatcgaaaggaaaatgccctgcagaccgttggcactggagagccttggtgtgatgtggtgctcgcgatcttggctgacggcactgtccttcccacgttagtcttttatcgcggccagatggaccaaccggcgaacatgcctgatagcatcctcctggaggccaaggaaagcggatatagcgacgatgaaatcatggaactgtggtcgacccgagtctggcagaagcacaccgcttgtcagcgctctaagggcatgttggtcatggattgtcatagaacccacctgagcgaagaggtactggccatgctgtccgcatcatctacactgccagctgtggtcccagccggctgctcatccaagattcagcccctggatgtgtgtatcaagcggacagtcaaaaacttcttgcataaaaaatggaaagaacaagcgcgggaaatggcagataccgcatgtgatagtgacgtactcttacagctcgtactcgtgtggcttggcgaggtgctcggtgtaatcggtgactgccctgagttggtgcagcggtcctttctggtcgcctcggttctaccggggccggacggcaatatcaactcacctacaaggaatgccgacatgcaggaggagctcatcgcttccctggaagagcagctgaaattatcaggtgaacactccgagagttccacaccgagacccaggagcagccctgaggagaccattgaacccgaaagcctccatcagttgttcgagggtgaatccgaaaccgagtccttctatggcttcgaagaagctgacctggatctgatggaaatttag

SEQ ID NO: 17346 - DNA, 564 bp, Artificial Sequence
  Description of Artificial Sequence: Synthetic coding sequence
atggatatctccaagggtctcccagggatgcagggcggtctccacatttggatttcggagaatagaaagatggtgcctgtgcccgagggcgcctacggaaatttttttgaagagcactgctacgtaatactgcacgtgcctcagagcccgaaagccacccagggagcctctagtgaccttcattactgggtaggcaaacaggcaggcgctgaggcgcaaggagctgctgaagccttccagcaacgcctgcaagatgaactgggcggccagacagtcctccaccgggaagcccagggtcacgaatccgactgcttctgctcttattttagaccaggcatcatttaccgcaagggcggacttgcttccgacctgaaacatgttgagacaaatctgtttaacattcaaagacttctccacatcaaagggaggaagcacgttagcgctacagaggtagagttatcttggaattcttttaacaagggcgacattttcctgctagacctgggcaagatgatgattcagtggaatggacccaagacttccatttctgagaaggcacgatag

SEQ ID NO: 17347 - DNA, 1329 bp, Artificial Sequence
  Description of Artificial Sequence: Synthetic coding sequence
atgcctctggagaatctggaggaggaagggttgcccaagaacccggaccttcggattgcccagttgaggttcctgctgtctctgccagagcaccggggagacgctgctgtccgcgacgaattgatggctgcggtccgggacaacaacttctggaatcggatacggcaggaacagacagaagactgtccaccgagctccccgtctcgaggctggcactgccaggactggccatcgagaaagcctccgaccagtatccggttatgttttgctaagcccataatcaagaggcacagaatgccttcttatatggccccgtactacgaggcactctgtaagagcctggactggcagatcgacgtcgatctgctcaataaaatgaagaaagccaacgaggatgagctgaagcgcctcgacgaagaactggaggacgcggagaagaatctgggggaaagcgaaatccgcgacgccatgatggccaaggctgaatatttgtgcagaataggtgacaaagagggcgcattaacagccttcaggaagacctacgataaaaccgtggcactgggccataggctggatatagtgttttatctgttacggattgggcttttttacatggacaacgatctgattacccgcaacacagagaaggccaagtcattaatcgaagagggtggtgactgggataggcgaaataggctcaaggtttatcagggcctctattgtgtggcaatccgcgacttcaagcaggcagccgaactattccttgacactgtttctacattcacgagttacgaactgatggactataaaaccttcgtgacctacactgtgtacgtttccatgatcgccctcgaacgcccggacctcagggaaaaagtgattaagggggcagaaatacttgaagtactccacagtcttcccgcagtgcggcagtaccttttttctctttacgaatgtcgatattcagtcttcttccagtcactggcagtagtcgagcaggagatgaaaaaggactggctgtttgctccacattacaggtactatgtcagagagatgcggatccacgcatacagccagctgctcgaatcttaccgctccctgacactgggctacatggccgaggcattcggagtgggcgtggagttcatcgaccaagagctgtcccggtttatcgcagctgggcgtttacattgcaagatcgacaaggtaaacgagatagtggaaacaaatcgacctgatagcaaaaattggcagtaccaggagaccattaaaaagggcgatctcctcctgaatcgagtgcaaaaactgagtcgagtgatcaatatgtag

SEQ ID NO: 17348 - DNA, 333 bp, Artificial Sequence
  Description of Artificial Sequence: Synthetic coding sequence
atgctgtgctggggtaacgcttcctttggtcagttaggactcggagggatcgatgaggaaatagtgcttgaacctaggaagagcgacttctttataaataagcgggtacgtgacgtaggctgcggtctgcgtcatacagtctttgtacttgatgatggaactgtatacacatgcggttgcaacgatttaggacaactggggcacgagaagagtcgtaagaaacccgagttccgctcatgctttcccggtcgttcagcaatggctccttctcgtctgaccgctacgagtgcaagtcaggtgcaagcgatactccttcctcagccgccagagtag

SEQ ID NO: 17349 - DNA, 930 bp, Artificial Sequence
  Description of Artificial Sequence: Synthetic coding sequence
atggtctgttggcagtccgtctcagtgtggagtgttgcaggtagggtcgagatgaccgtaagcaaattcatggccattcagaaggccctacaaccagactggtttcagtgcttaagcgatggggaggtcagctgtaaggaagcaacatcaataaagcgggtcaggaaaagtgttgacaggtccctcctttttctggataattgcctgcggctccaggaggagtcagaggttctgcagaagtccgtgattattggcgtaatcgagggaggggatgtaatggaagagcggctacggtccgccagggagaccgctaagagacctgttgggggtttcttgttggatggctttcaggggaatccaaccaccctagaagctagactcaggcttttatcatcggttactgccgagctccccgaggacaaaccacggctgatttccggcgtcagcagacccgacgaggttctggagtgcattgaacgcggagtggacctcttcgagtctttcttcccctaccaggttactgaaaggggctgcgcgctgacgttcagctttgattaccagccgaatcctgaagaaactctcctccagcagaacggtacccaggaagaaattaagtgcatggaccagatcaaaaagatagagacaaccggctgcaatcaggaaatcacgtctttcgagataaacctgaaagaaaaaaaataccaggaagactttaacccattagttaggggttgtagttgttactgttgtaagaatcatacccgggcctacatacaccacctccttgtaaccaatgagctgttagcaggagtgctgttaatgatgcacaatttcgagcactactttggcttcttccattacatccgagaggcactcaagagcgacaaattggcacagcttaaagaacttatccaccgccaggccagctag

SEQ ID NO: 17350 - DNA, 384 bp, Artificial Sequence
  Description of Artificial Sequence: Synthetic coding sequence
atggtgctaattttaggccgacgcttgaatcgagaagacttaggtgtaagagactccccagccacaaaaagaaaggtttttgagatggatcccaagtctttaacaggacacgagtttttcgacttcagctcgggaagctcccacgctgaaaacatcctgcagatctttaacgagttcagggattcaagactcttcacagatgtaataatttgtgtggaagggaaagagtttccttgccacagggctgtgctgtctgcctgctcctcctacttccgagctatgttctgcaacgaccatcgggaaagtagagagatgcttgtcgagattaatgggattcttgccgaggctatggagtgtttcctccagtacgtctacacaggatag

SEQ ID NO: 17351 - DNA, 1581 bp, Artificial Sequence
  Description of Artificial Sequence: Synthetic coding sequence
atggaagaaattcctgcgcaagaagcagcaggttcacctagggtacagtttcagagtctagagacgcagtccgagtgtctgtcccctgagccccagttcgtgcaggacaccgatatggaacagggcttgaccggcggcttcccaataagcaaaccggacggcatctcccaactcgagcaggatcttcaggtgtttgacctggagacaaaaacaagagaagtgctgagggacgactgttccgacggcgagacccgcgaggaaaacaaactcttgatccctaagcagaaaatctccgaggaagttcacagttataaggtccgggtcggccggctaaaacacgacattacccaagtccctgagactcgggaggtgtacaaatcagaggatagactggaacggctgcaggagatcctccgaaaatttctgtatcttgagagggagttccgccagatcaccatctccaaagagacctttacttcagagaagaataacgaatgtcacgaaccagagaaatcattctctctggacagcacaatcgatgccgaccaaagggttctcaggattcagaacaccgacgacaatgacaaatatgatatgtctttcaatcaaaatagcgcatccggcaaacatgagcacttaaatctgactgaagactttcagtcttccgaatgcaaggaatcactgatggatttgagccatttgaacaagtgggaaagcattcctaacaccgagaaaagctataaatgtgatgtctgtggtaagattttccaccagtcctcggcacttacgcgacaccagcggatccacacacgagagaaaccatataaatgtaaggaatgtgaaaagagtttttcccaaagttccagtctttcccggcataagagaatccatacaagagagaagccttacaaatgcgaagcctccgataagagctgtgaggcgtctgataagtcttgctccccatcaagtggtatcatccagcacaaaaaaatccacacacgtgcgaaatcttacaagtgcagttcctgtgagagagtgttcagccgatccgtgcacctgacgcagcatcagaagatacataaagaaatgccttgcaagtgtacagtgtgtgggtctgatttttgccacacttcttatctcctggagcatcaaagagtgcaccatgaggaaaaggcatatgagtatgatgaatatgggctggcctatattaagcagcagggtattcactttagggaaaaaccctatacttgttccgaatgcggaaaagacttccgcctcaatagtcatctgatccaacaccaaagaatccatactggtgaaaaggcacacgagtgcaatgaatgcggaaaggctttctcacagacctcctgcttaatccagcaccataagatgcacagaaaggagaaatcttatgagtgcaacgaatacgaaggcagcttttcccactcctcagacttgatccttcagcaggaagtacttactagacaaaaggcgtttgactgcgatgtgtgggagaagaatagcagccagagggctcatctagtgcagcatcagtccattcataccaaggaaaattcttag

SEQ ID NO: 17352 - DNA, 195 bp, Artificial Sequence
  Description of Artificial Sequence: Synthetic coding sequence
atgccagaagatcaggtaggaaagctggaagcaactgaaaacacaatctctgcaatggccgccgccgccgcagagcagcaacagttctacctcctcctaggaaatcttctgtcacccgataacgtggtgcggaagcaggcagaagaaacctatgaaaacattcccggccagagtaagatcactttcctcctgtag

SEQ ID NO: 17353 - DNA, 741 bp, Artificial Sequence
  Description of Artificial Sequence: Synthetic coding sequence
atggctgagcaggaacagcgcaagatccctcttgtgccagaaaatcttcttaagaaacgcaaagcctaccaggcgctgaaggccacgcaagctaagcaagccctcttggcgaaaaaggagcagaaaaagggcaaggggctccggtttaagcgcctggagtcctttctgcacgactcttggcgtcagaagcgtgacaaggtgagacttagacgcctggaggtcaaaccccacgctttggagctgccagataaacacagtttagctttcgtggtgaggatcgaaaggattgacggcgtctctttgttggtgcagcgcacaatcgcaaggctacggttaaaaaagatttttagtggtgtgttcgtgaaagtcacacctcagaatcttaagatgttgaggatagtggagccgtacgtgacctggggtttcccaaacttgaaatcggtgcgtgagctcatcctaaaaaggggccaggcgaaggttaagaacaagaccataccgctgaccgacaacacagtgatcgaagaacacctaggcaagttcggcgtcatctgcctagaggacttgattcacgagatcgcattcccaggcaagcactttcaggagatctcatggtttctgtgcccctttcacctgagcgtcgctcggcacgctacaaagaaccgggtgggttttctgaaggaaatgggaacccccggatatcggggtgagcggataaaccagttgattaggcagctgaattag

SEQ ID NO: 17354 - DNA, 1296 bp, Artificial Sequence
  Description of Artificial Sequence: Synthetic coding sequence
atggctgccaacctcagtagaaacggcccagctctgcaggaagcatacgttcgagtggtcacagaaaaatcacccactgattgggctctgtttacctacgagggtaattccaacgacatccgggtagcgggtaccggcgagggtggcttggaggaaatggtagaggagctgaacagcgggaaggtcatgtacgcgttctgtcgggtcaaagatcctaacagcggcctacccaagtttgtgttgattaattggacaggagagggggtcaacgatgtcagaaaaggtgcctgcgcctcacatgtctccactatggcgtcctttttgaaaggggcacacgtcaccataaacgctcgggctgaagaagacgtggagccggagtgcatcatggagaaggtcgctaaagcttctggcgcaaactactcattccacaaagaatctggcagatttcaggacgtgggacctcaagcccccgtggggagcgtataccagaagacaaatgccgtcagcgaaattaagcgggtggggaaagacagcttctgggccaaggccgaaaaggaagaggagaaccggcggcttgaggagaaaaggagagcggaggaagcccagcgccagttggagcaggagaggcgagagagagaattacgggaggctgccagaagggagcaaaggtatcaagagcagggcggtgaggcttctccccagagtagaacgtgggagcagcaacaggaagtcgtgtctagaaatcgtaacgaacaagagtctgccgtgcatcccagagagatctttaagcagaaggaaagagctatgtccactacgagcatatccagcccacaaccaggtaaactgcggtcccccttcctccagaaacagttaactcagccggagacacactttggaagggagccagctgccgctatcagccggcctagagccgacctgcccgcagaggagcctgcaccgagcactcctccgtgcctcgtgcaggctgaggaggaggccgtgtacgaagaacctcctgagcaggagactttttatgaacagccaccattggtacagcagcagggtgcagggagcgagcatatagaccatcacatccagggccagggcctgtctggtcaggggctttgcgcaagggccctgtacgactaccaggcggcagatgataccgagatttctttcgatcctgaaaacttgatcaccggcattgaagtgatcgatgaaggctggtggcggggatatggcccagatgggcatttcggaatgtttccagccaattacgtcgagttgattgaatag

SEQ ID NO: 17355 - DNA, 1854 bp, Artificial Sequence
  Description of Artificial Sequence: Synthetic coding sequence
atgattgagaaaatgcagggctcaagaatggatgagcagagatgttcttttccgccacccctgaaaacagaggaggactacattccttatccttccgttcacgaggtgctgggccgcgaggggccttttcctctaatattactgccccaatttggcggttactggatcgaaggaaccaaccatgaaataaccagcatccccgaaacagaacccctccagtcgcccaccaccaaagttaaactcgagtgcaacccaacggcacgcatataccggaagcatttcctcggcaaggaacacttcaattattactcattggacgccgcgctgggacacctggtctttagtttgaagtacgacgtcatcggtgaccaagagcaccttagattactgctcaggaccaagtgtcgaacatatcacgatgtcattcctatttcttgtttgacagagttccctaatgtggtgcagatggccaagctggtgtgcgaagatgtcaatgttgaccgcttctaccccgttctgtaccctaaggcatcacgtctgattgttacgtttgacgaacatgttatatccaataacttcaaattcggagtgatataccagaagcttggacagacttctgaggaggagttattctcaacgaatgaggagagccccgctttcgttgagtttctggaattcctggggcagaaggtaaaactccaagactttaagggcttccgggggggcctagacgtgacccacggccagacaggtacagagtccgtgtattgtaattttaggaataaggagattatgttccacgtgtcaactaaactgccttacactgagggcgatgcccagcagctgcaacggaagaggcatatcgggaacgatatagtagctgtggtgtttcaagatgagaataccccatttgttccagacatgatagcttccaacttcctccacgcatatgtcgtagttcaagcagagggcggggggcccgatggaccgctgtataaggttagcgtgacggcacgcgatgacgtcccattctttgggccccccctgcctgatcccgcggtgtttcggaaaggtcctgagtttcaggaattcctgcttaccaaactgatcaacgcggagtatgcgtgctataaagctgagaagttcgcaaaactggaggaaaggacccgcgccgccctgctggaaacgttgtatgaggaactccacattcactcacaatccatgatgggcctggggggagatgaagataagatggagaacgggagcggtggagggggttttttcgaaagctttaagcgtgttatccgcagccggagccagtcaatggacgcaatgggtttgtccaataagaagccaaatacagtcagcacgtctcactccggatcattcgcacctaacaaccccgacttagccaaggctgcgggaattagcctgctgatccccggaaagagtgcaagccgctttggaagaagaggcagcgcaatcgggattggcaccgttgaggaagtcgtggtccggggcgccgccggctcgggcgggtgcctgcacgctctgttttctgcgaggtcccaggacggcgggcatatcggagacgttgcccccctgccccccggacaggcaccaggtagagccggctggtcaggcggctctagtgatggtactcagcatctcctgtggggcctggtccctgtgcctgaacccgttcctctcacgcggggtttttggccctgcctgggaccttgggatcctggacctgtgccagctaggataagatatccaaaggccctacacccggctgcaaggcctccgataagcccagtgtgcatggagaggcatccctcacctttgccttag

SEQ ID NO: 17356 - DNA, 1224 bp, Artificial Sequence
  Description of Artificial Sequence: Synthetic coding sequence
atgggaaacacttcgttcaacgaagtgatggaggcccagctgccgtcacacggaggtccgaaaccatctgccgaaagcgatatgggtacgagacgcgactacattatggctaaatatgtcgagcaccgattcgcgaggagatgcacccctgagccccagcgcttatggaccgcgatctgtaatagggatttactttccgtcctggaagcatttgcaaatggccaggatttcggccagcccctgccaggccccgacgcacaggcaccagaggaactggtcctgcaccttgccgtcaaagtggcaaatcaggctagcctgcctctggtagacttcattatccagaacggagggcatctcgatgccaaagccgcggacggtaataccgcattgcactatgccgccctgtacaatcaacctgattgcctgaagctgttgctgaagggccgagccttagtggggacggtaaacgaggctggagagaccgctctcgacatcgcacgcaagaagcatcacaaagagtgtgaggaactgctggagcaggcccaggcaggcacttttgcatttcccctccacgtggattattcatgggtgatcagcacggaacccggatccgattcggaggaggacgaggaagaaaaacggtgtctgcttaaactcccagcgcaagcccattgggcctcgggtcgccttgacatctctaacaagacttatgagacagtcgcatcactcggagcagccacgcctcagggggaatccgaggactgccctccgccgctgcctgttaagaacagcagccggaccctggttcagggctgcgccaggcatgcctcaggagatcgctcagaggtatctagcttgtctagcgaggctcccgaaacccccgagtccctcggtagcccggcgagcagtagcagcctgatgtctccattagagcccggcgatccctcccaggcaccacccaactccgaagaaggattacgggagcccccagggacgtccagaccaagccttaccagcggaactacaccgagtgaaatgtatcttcctgttagattcagttccgagagcactcgttcgtatcgccggggcgccagaagtcccgaggatggcccttcagctagacaacccctgccccggagaaatgtgcctgtaggcatcaccgagggagatgggtcccgcaccgggagcctgccagcctcatctgtgcaactcttacaggactag

SEQ ID NO: 17357 - DNA, 813 bp, Artificial Sequence
  Description of Artificial Sequence: Synthetic coding sequence
atggccatggaaatgcgtctgccagtggctcggaagccgctctcagagaggttgggcagagacacaaagaagcaccttgtggttccaggggataccatcaccacagatacagggttcatgcgggggcacggaacttacatgggcgaggaaaagctcatagcttccgtggcggggagtgttgagcgagtcaacaaactgatctgtgttaaagccctcaagacaaggtacataggcgaagtaggggacatcgtggtgggaaggataacagaagtccagcagaagcggtggaaggtggaaactaattcaagattagattctgtgttactgctgtctagcatgaatctccctggaggagaactccgacgccggtccgctgaggatgagttggccatgcgtgggtttctacaggaaggggacctgatttccctggggcagggagtgttggtgcaggtgtcacccagtttagtgaaacgtcaaaaaacacattttcacgacctcccttgcggagcctccgtgattttaggtaataacggcttcatatggatctatccgacacctgagcataaggaagaagaagctggcggcttcatcgcaaacctggagcccgtgtccctcgcagaccgcgaagtcattagtcgtctgaggaattgtataatctctctagtgacacagcggatgatgctgtacgatacaagtatactttattgctatgaggcgagcctgccacaccagattaaagatatcttaaaacccgagataatggaagaaattgtaatggaaacacgccagcgcttgctggagcaggagggatag

SEQ ID NO: 17358 - DNA, 297 bp, Artificial Sequence
  Description of Artificial Sequence: Synthetic coding sequence
atgcctgaagatcaagtgggtaagttggaagctactgagaacacaatctcagccatggccgcggcagccgctgagcaacagcagttctatctgctgctggggaacctgctatcaccagacaatgtggtgcgcaaacaggctgaagagacgtatgaaaatattccagggcagtcgaagattaccttcctgttgcaggccatccgcaatacaacagcggcagaggaagcgcgacagatggccgccgtgcttcttcgaaggctcctgtcatctgcgtttgatgaggtttaccctgcctag

SEQ ID NO: 17359 - DNA, 306 bp, Artificial Sequence
  Description of Artificial Sequence: Synthetic coding sequence
atggacgaggtggagcaagatcagcacgaggccaggctgaaagagctgtttgacagcttcgacactactgggaccggcagtcttggacaagaagaactgacagacctgtgtcacatgctgagcttggaggaggtggctccagtcctgcagcagacactcctccaggataatctgctgggccgagtccattttgaccagttcaaggaagctctgattttgatcttatcccgtacactgagcaatgaagaacacttccaggagcctgattgtagtctggaggctcaacccaaatacgtgcgcggctag

SEQ ID NO: 17360 - DNA, 1065 bp, Artificial Sequence
  Description of Artificial Sequence: Synthetic coding sequence
atggcccacagccccgtggcagtgcaggtgcccggtatgcagaacaatatcgcagacccagaggagttgtttaccaaattagaaagaattgggaagggtagcttcggcgaagttttcaaaggcatcgacaaccgaactcagcaggtagtggccatcaaaataatagatttggaagaggcagaggacgagatcgaagatattcagcaggagatcacagtcttgagtcagtgtgacagctcgtatgtcacaaaatactatggatcttatcttaaggggagtaagttatggatcatcatggaatatctggggggaggaagcgccctggaccttttacgagctggaccattcgatgaatttcaaatagctaccatgctgaaggagatattgaagggcctggattacctgcacagcgaaaagaagatccaccgagacattaaagcggccaacgtgctgctctcggaacagggagacgtcaagttagcggacttcggagtcgcggggcagctgaccgatactcagataaagcgcaatacgttcgtcgggacaccattctggatggcgcctgaagttatacaacagagcgcctatgactcaaaaaggccgactgcaaaggagcttctgaagcacaagttcattgttaaaaactcgaagaaaacttcatatctgaccgagctgatagataggttcaaaagatggaaagccgaaggacattccgacgacgaatccgattctgagggctcggactctgagtctacttctcgcgagaataacactcatcctgaatggtcgtttaccacggtacgcaagaagcccgaccccaaaaaggtgcagaacggagcagaacaggatttagttcagactctgtcttgtctctcgatgatcatcacacccgcattcgccgagctcaaacagcaagacgagaataacgcgagtaggaaccaggcgatcgaggagctggagaagtctatagccgtcgctgaggcggcgtgcccaggcatcacagataaaatggtgaaaaagctgatcgaaaaattccagaagtgttccgcggacgaaagcccttag

SEQ ID NO: 17361 - DNA, 522 bp, Artificial Sequence
  Description of Artificial Sequence: Synthetic coding sequence
atgcctcggaaagggacacagccgtccacagctcggcgacgggaagaggggccacctccccccagtcccgatggagctagcagtgatgctgagccggagccccccagcggaaggactgagagccccgccactgccgctgaaaccgcctctgaagaattggataaccggtccctagaagagattctcaattctattccaccaccacctccgccagccatgactaatgaggctggcgcgccgcggcttatgattacacacatcgttaatcagaacttcaagagctacgcaggagagaaaatcctcggaccattccataaaaggttctcttgcatcattggcccgaacggatcgggcaaaagcaacgtgattgatagcatgttatttgttttcggctaccgggcgcagaaaattaggtctaaaaagctttccgttctgattcacaatagtgacgagcacaaggatattcaatcctgtactgtggaggtacacttccagaagatcatcgataaggaaggagactag

SEQ ID NO: 17362 - DNA, 801 bp, Artificial Sequence
  Description of Artificial Sequence: Synthetic coding sequence
tagcctcgtgccgccgcgagagttagagctgcaggcgaggccctggagaggaggcgccgatggctcggacggctctccccttctgcaccaagaccccgcagagctcgcccctctcttagacgcgcttctgcctgggtacgtgacagggtagccgggcgccctggagctttacctgggtttcaggcctccggcgttgccggagaggcacagaaagccccaggccatcctgccgctcctgcccctgccgcctcatgcctcacggaagctgacgggcgcgtcttcttacatgctttccgcttggcactcatccagctccaaatttcatctataaaaagtgacaacgtgacaagagcttgtagctttatcagggaagccgcaactcagggagccaaaatcgtgtccctgccggaatgctttaactctccctatggagccaagtacttcccagaatatgcagagaagatccccggagagtccacccagaagttgagtgaagttgcgaaggagtgctcaatctatctgataggcggctccatccccgaagaagacgctggtaaactttacaatacatgcgccgtgtttggacctgacggtactctccttgccaagtatagaaaaatacatctcttcgatatagacgtgcctggcaagatcacctttcaagagagcaaaacgctgagtcctggagattccttctctacttttgacaccccctattgtcgagtcggactcggcatttgttatgacatgaggtttgcagagcttgctcagatatatgctcaaagaggcgaagcggtgtag

SEQ ID NO: 17363 - DNA, 216 bp, Artificial Sequence
  Description of Artificial Sequence: Synthetic coding sequence
atggactctttgcccgatgagttctttgtgcgacaccccgctgtagaggaccagcgtaaagaggaaactgagaacaaactcgagaagtcctcgggccagctgaataagcaggagaatgatattccaaccgacctcgttcccgtgaatctcttactggaggttaagaagctcttgaatgcgatcaacacgctcccaaagggcgtggtgccccattag

SEQ ID NO: 17364 - DNA, 2130 bp, Artificial Sequence
  Description of Artificial Sequence: Synthetic coding sequence
atgtcagtggagtcggagcagctaactggcgtcccactcgatgactccgcaattactccaatgtgcgaggtgaccggaggccgctcctactccgtatgcagcccgcgaatgcttaatcaatgccttgagtctctagttcagaaagtccagagtggggtggtgattaactttgagaaggctggacccgacccatcaccagtggaagatggccagcccgacatttcccgaccattcggctcccagccttggcactcatgccacaaactgatatatgttaggccgaatcccaaaacgggcgtgcccatcggccactggccagtccccgagagtttttggccggaccagaactcccccactcttcctcctcggacaagccatcccgtggtgaaattctcatgtactgactgcgagcctatggtcatcgataaattgcccttcgacaaatacgagctcgagccctctccgctaacccagtttattctggagagaaagtccccacaaacatgctggcaggtgtacgtgagtaattctgcgaagtactccgagctgggtcatccttttggctacctcaaggcaagcacagctctcaattgtgtgaaccttttcgtcatgccttacaactaccctgtacttcttccattgttggatgatctgttcaaggtacacaaggccaagccgacactgaagtggcgtcagtcttttgagagctacctgaagacgatgcctccatactatttagggcctctgaaaaaggctgtgaggatgatgggggcgccaaacttaattgccgattcaatggagtacggtctgagctactcagttatttcatacttgaagaagttaagccagcaggccaagatagagagcgaccgggtaatcgggtctgttggaaaaaaggtggtgcaggagacgggaataaaagtacgaagtcggtcccatggccttagcatggcttatcggaaagactttcagcaactgctgcagggcataagcgaggacgtcccgcatcggctgctcgatctgaatatgaaagaatacactggattccaggtggctcttctgaacaaggacctgaaaccacaaaccttccgaaacgcctatgacattccaagaaggaatctgctcgatcaccttacgcgtatgcgaagtaatttgctaaaaagtaccaggcgctttctcaagggccaggacgaagatcaagtccacagcgtgccaatagcgcagatgggcaactaccaagagtaccttaaacaggtcccatccccacttagggaactggacccggatcagccccgacgcctgcacaccttcggcaaccccttcaagctggacaagaagggaatgatgattgatgaggctgacgaattcgtagcagggccccaaaacaaacacaagcgaccaggcgaacccaatatgcagggtattcccaagcgccggcgatgtatgtcaccactcctgcgcggccgccagcagaacccggtggtcaataatcacattggaggaaaaggaccaccagctcctaccactcaagcccagcccgacctaataaaaccgttgccgctacacaaaatttctgagaccactaatgatagcattatccatgatgtggtggagaaccacgtggcggaccagcttagctcagatataactcccaacgccatggacaccgagttctcagcaagttccccagcttcccttctcgagagacctacaaaccacatggaggccctcggccacgaccatctcggcacaaacgatctgaccgtgggcggttttctcgagaatcacgaagaaccgcgcgataaagagcagtgcgccgaggaaaatattcctgcttccagtctgaataaaggcaagaaactgatgcactgccgcagccacgaggaagtcaatactgagctgaaggcccagattatgaaggagatccggaaacctgggaggaagtacgaacggattttcaccttactgaaacacgttcagggtagcctgcagactaggcttatctttctgcagaatgtgataaaggaggcgtcacggttcaaaaaaaggatgctgatcgaacagctggaaaatttcttggatgaaattcaccggcgggccaaccagattaatcatatcaacagcaactag

SEQ ID NO: 17365 - DNA, 387 bp, Artificial Sequence
  Description of Artificial Sequence: Synthetic coding sequence
atggcttcctccaataccgtgttgatgaggctggtagcttccgcctatagcattgcacagaaagccgggatgattgtgcggcgcgtgatagcagagggcgatctgggtattgtcgaaaagacctgtgccaccgacctgcagacgaaggccgataggctggcccaaatgagtatctgctcgtctctggcccgtaaattcccaaaactgacgatcatcggcgaggaggacctcccgtccgaagaagtggatcaagaattgatcgaagattctcagtgggaggaaatcctgaaacaaccatgtcctagccagtactccgctatcaaggaagaggacttggttgtctgggttgaccctctggatgggactaaagaatataccgaaggttag

SEQ ID NO: 17366 - DNA, 237 bp, Artificial Sequence
  Description of Artificial Sequence: Synthetic coding sequence
atgagatttatgatgatgagagccgagaattttttcatacttcggcgcaagcctgtggagggctatgatattagcttcttgattacaaattttcacactgagcagatgtacaaacataagcttgtggattttgtcatccactttatggaagaaatcgataaggagatttctgagatgaagctgtctgtgaacgcccgagcaagaatcgttgccgaggagttcctgaagaacttttag

SEQ ID NO: 17367 - DNA, 171 bp, Artificial Sequence
  Description of Artificial Sequence: Synthetic coding sequence
atggtcatggaaaagccaagccccttgctggtgggcagagagttcgtgaggcagtactacactttactaaacaaagcccctgagtacctgcacagattctacggccgtaattcgagttacgtccatgggggagtggacgcttcagggaaaccacaggaggccgtctactag

SEQ ID NO: 17368 - DNA, 357 bp, Artificial Sequence
  Description of Artificial Sequence: Synthetic coding sequence
atgaaaatctttgttggcaacgtggatggcgcagataccactccagaggagctggcagccttgttcgctccttacgggactgttatgtcatgtgccgtgatgaagcaattcgcattcgtgcatatgcgagaaaatgctggggcattgagagccatcgaggccctacacgggcacgaacttagacccggacgtgccctggtcgtggaaatgagtcggccacggccattgaacacctggaagatattcgtaggcaacgtatccgccgcctgcacctcccaggagctccgcagcctattcgaaagacggggtcgtgtcattgagtgtgatgtcgtgaagggaggaatgtgtgtagggtag

SEQ ID NO: 17369 - DNA, 438 bp, Artificial Sequence
  Description of Artificial Sequence: Synthetic coding sequence
atgtcttccccccgggactttagggccgagcccgtgaacgactatgaggggaacgatagcgaggccgaagatctgaattttcgtgagaccctgccaagctcttcccaagagaatacaccccgctctaaggtgtttgagaataaagtcaactctgagaaagtgaaacttagccttagaaattttccacataacgattatgaagacgtcttcgaggagccatctgagagcggatccgacccatccatgtggaccgcacgcggccctttccggagagatcgctggtcgagcgaggacgaggaggccgctggtccatcacaggcactgtcaccattactctcagtccagcaccacggctactccggccctaatgagcggacaaccttttggcatggaagtaacgaaggcgctgtgtcactacttctgagatattgtgcctag

SEQ ID NO: 17370 - DNA, 438 bp, Artificial Sequence
  Description of Artificial Sequence: Synthetic coding sequence
atgtggactgcgagagggccattcaggcgggaccgatggagctctgaggacgaggaagcagccgggcccagccaggcactgtcccctctactgtcggacacccggaaaatcgtatccgagggcgagctggatcagcttgcgcagatccggcctttgatctttaacttccacgaacagaccgccatcaaggactgccttaagatcttggaggagaaaaccgctgcttatgacattatgcaggagttcatggctctggagcttaaaaacctcccgggcgaatttaactcggggaatcagccaagcaaccgggagaagaatcgctacagagatattctgcctttccagcatcacgggtacagtggcccgaatgaacgcactacgttttggcacgggagtaatgaaggggctgtctcattgctgctgaggtactgcgcctag

SEQ ID NO: 17371 - DNA, 444 bp, Artificial Sequence
  Description of Artificial Sequence: Synthetic coding sequence
atgtggaagtttcccggggggttgtctgagcccgaggaagacattggggacactgccgtgagagaggtgttcgaggaaaccggcattaagtctgagttccgttccgtgctgtctatccgccagcagcatacgaatcctggagctttcggtaagtccgacatgtacatcatttgtcgactcaagccttactcctttaccatcaatttttgccaggaggagtgcctccgctgtgaatggatggacttgaacgacctggcaaaaaccgagaacactacgcctataacctctagggttgcacggctgttgttgtacgggtacagggaggggtttgacaagatcgatctcactgtagaggaacttcccgccgtttacactgggctgttttataaactatatcacaaagagctccctgagaactacaaaaccatgaagggtatcgactag

SEQ ID NO: 17372 - DNA, 300 bp, Artificial Sequence
  Description of Artificial Sequence: Synthetic coding sequence
atggatgagtctgctcttctcgatctgctagagtgtcccgtctgcctggaaaggcttgacgcctctgctaaagtgctgccatgtcaacacactttttgcaaaaggtgtttgttggggatagttggctcccgcaacgagctgcgatgccctgagtgcagaacattagtggggtcaggagtcgaagagttgcctagcaacatactgctcgtgagactgcttgatggaatcaaacagagaccctggaagccaggtcccggaggggggagcgggacgaattgcacgaacgctttaaggtcttag

SEQ ID NO: 17373 - DNA, 3675 bp, Artificial Sequence
  Description of Artificial Sequence: Synthetic coding sequence
atggccctacggccgggcgcaggcagcgggggtggaggagctgccggcgccggggcgggatccgccggtgggggcggtttcatgttccctgtggctgggggcattagaccccctcaagcgggactgatgccaatgcagcagcaaggtttccccatggtctcagtgatgcagcccaatatgcagggaattatgggcatgaattactcctcgcaaatgtcacaagggcctatcgcaatgcaggccggcatccctatgggcccaatgccagctgccggtatgccctatcttgggcaggctccttttctaggcatgcgcccacccggtccacagtatacacccgatatgcagaaacagttcgcggaggagcaacagaaacgtttcgagcagcagcagaagctcctggaagaggaaagaaaacggcgccagtttgaagaacagaagcagaaattgagacttctgtccagcgttaaacctaaaacaggcgagaaatcgagagatgacgccctggaggcaatcaagggaaaccttgacggtttttcacgagacgccaaaatgcatcctacccccgcaagccaccctaagaaacccggcgtgggagtatttccatcacaggatccagctcaaccaaggatgcccccctggatttataatgagtctctggttcccgatgcctacaagaaaatccttgagactacaatgaccccaaccgggatagacacagctaagttgtatccaatcctcatgtccagcggactcccacgagagactttggggcagatttgggcacttgccaaccggaccaccccaggcaagctaactaaggaggagctgtacactgtgctggctatgatcgccgtcacccagcgcggggtgccagcgatgtctccagatgcccttaatcagttccctgcagccccaatccccaccctctccgggttcagcatgaccctaccgaccccagtgtcccagccaacagtgattcccagtgggccggctggctccatgcccctttcccttggccagccagtgatgggaatcaatttggtgggaccggttggcggagccgctgcgcaggcgtcctccggatttatacctacctacccggcgaatcaagtggtgaagccggaggaggacgatttccaggatttccaagatgcaagcaaaagcggaagcctggacgactcattttccgactttcaggaactcccagcttctagcaagacctccaacagccaacatggtaatagcgctcccagtctccttatgcctttgcctggcaccaaggccctgccgagcatggacaaatacgctgtgtttaagggcatagccgccgacaaatccagcgagaatacagtgcctccgggcgatccaggcgataagtattctgccttccgtgaattagagcagacggcagaaaacaagccgctgggtgaatccttcgctgagttccgctcggcaggcactgatgatggattcacagattttaaaactgctgactcagtgtctccattagagcctcccactaaggacaagaccttccctcccagctttccatcaggcaccattcagcaaaaacaacaaacccaggtaaagaacccccttaacctggctgatcttgacatgtttagctctgtgaactgctcatccgagaaacccctgtccttctcagcagtttttagcactagcaaatcagttagtactccccagtctaccggttctgccgcaacaatgaccgcacttgccgcaaccaagacctctagtctggcagacgacttcggggagttctcattgtttggcgaatattcaggtctcgcacctgtgggggaacaggacgattttgcggactttatggcatttagcaattcgtcgatctcatcagaacaaaagcctgatgacaaatatgacgcccttaaagaagaagcaagtccagtgccattaacatcgaacgtaggatctacggtcaagggaggacagaactccactgcagcatcgacaaaatatgacgtttttagacagctgtccctggaaggttcagggttaggtgtagaagacttgaaagataacaccccgtctggaaaatctgacgacgatttcgcagactttcattcatcaaagttctccagtatcaatagcgataaaagcctcggtgaaaaagctgtggctttcaggcataccaaggaggacagcgctagtgtcaagtccctggaccttccttctataggcggtagctcggtgggaaaagaggacagcgaggatgccctgtcggtgcagtttgacatgaaacttgcagacgtgggcggcgacctcaagcatgtgatgtcggattcaagtctggatctgccgaccgtgtctggccagcacccccccgccgcagacatcgaagatcttaaatatgctgcatttggaagttactcctccaattttgctgtgtctaccttaacgagttatgactggtcagatcgtgacgacgcaacacagggccgtaagctctcccccttcgtcctgagcgcggggtccggatctccgtccgccaccagcatcttgcagaagaaggaaacttcatttggaagcagtgaaaacatcactatgacctccctgtctaaggtcactaccttcgtgagtgaggacgccctgcccgagactacctttccggccctggccagtttcaaggatacaatccctcagacctcagagcagaaagaatatgaaaatcgagattacaaagatttcaccaagcaggacctacccacagctgaacgttcccaggaggctacttgccccagtcccgcatcaagcggcgcctcccaggagactcccaacgagtgttctgacgactttggggagtttcagagcgaaaagcctaagatatccaaattcgacttcttggtagccacctcacagagtaaaatgaaatcaagcgaagaaatgattaaaagcgagctggcaacatttgatctatccgtccagggatctcacaaacgctctctgtccctcggggacaaagagatctcccggtctagcccctcacctgctctggagcagccttttagggaccggtctaataccttgaatgagaagcccgcgctgcctgtgatcagagataaatacaaggaccttaccggcgaggtagaggaaaatgagcgctacgcctatgagtggcagagatgtcttggatctgcgctcaatgtgataaaaaaggctaatgacacccttaacgggatttctagctcatcagtctgcaccgaggtgattcaatctgcccaaggcatggaatacttactgggagtcgtggaggtttatagggtgacaaaacgagtggaactaggaatcaaagctacagccgtctgttccgaaaagctgcagcagctcctgaaggatattgataaggtttggaacaacttgatcggtttcatgtctctcgcaactctaactcccgacgagaactcacttgacttctcctcctgtatgctgcgtcccggcataaagaacgcacaggagctggcgtgcggtgtgtgcctgctcaatgttgattctagatccagggcatttaactctgagaccgattcctttaagctcgcatacggcgggcaccagtatcacgctagttgtgcaaacttctggatcaactgcgtggagcctaaacctcccggtttggtcctgcccgatttgctgtag

SEQ ID NO: 17374 - DNA, 354 bp, Artificial Sequence
  Description of Artificial Sequence: Synthetic coding sequence
atggtgcaacgcctcacctacagaagacggctctcttacaacactgcgtctaataaaacccgactttccagaacgccaggaaacaggatcgtatatttgtacactaagaaagtgggcaaagctccaaagtctgcctgtggcgtgtgccccggtagacttaggggcgtgcgagccgttcgtcctaaggtgctgatgcgcctctcaaagaccaagaagcacgtatcccgcgcctacgggggctcaatgtgcgccaagtgcgtgcgggatcgcatcaagagggcgtttctgattgaggaacagaaaatcgtcgtgaaggtacttaaggcccaggcccagagtcaaaaagccaaatag

SEQ ID NO: 17375 - DNA, 621 bp, Artificial Sequence
  Description of Artificial Sequence: Synthetic coding sequence
atgagttctccccgagatttcagggcggagcccgtcaatgactacgaggggaacgacagcgaggccgaagaccttaacttccgtgaaacattacccagctcatcccaggaaaacactccccgatctaaggtttttgagaataaagtgaatagtgagaaagttaaactgtctctccggaactttcctcataacgattacgaggacgtttttgaggaaccttcagagagcggctcagatccgtccatgtggactgcccggggacctttcagacgtgaccggtggagtagcgaggacgaggaagccgcaggcccttcccaggcactgagcccactgctctcagatacacgcaaaattgttagcgaaggggaactcgatcagttagcacagatccgccctcttatattcaactttcacgaacaaacagctataaaggactgcctgaagatacttgaggagaagacagctgcttatgacattatgcaggagtttatgttcaatataatggatatagtggcccagatgagagaacagcggtctgggatggtacagaccaaggagcagtatcacttctgctatgacattgtgctggaggtacttaggaagttgctgaccctcgactag

SEQ ID NO: 17376 - DNA, 582 bp, Artificial Sequence
  Description of Artificial Sequence: Synthetic coding sequence
atggaggaaactatcaaagaccctcctacttccgcggtcctcttagatcattgccattttagccaagttatctttaactctgttgagaagttctacatccccggcggcgatgttacttgccactacacgtttacccagcatttcatccccagacggaaggattggatcgggatttttagggtgggctggaaaaccacccgcgaatactatacctttatgtgggtgacgctccccattgatttaaataataagagtgctaaacagcaggaggtgcaattcaaggcatattacttgcccaaagatgatgagtactatcagttctgctacgttgatgaggacggggttgtcagaggggcaagcattcctttccagtttcggcctgaaaatgaggaggatattctcgtggtgacaacgcagggggaagtggaggaaatcgagcagcacaacaaagagctctgcaaagagaaccaggaactaaaggactcctgcatatcactgcagaaacagaacagtgacatgcaggccgagttacaaaagaagcaggaagaactggagacactgcagagcataaacaagaagtag

SEQ ID NO: 17377 - DNA, 156 bp, Artificial Sequence
  Description of Artificial Sequence: Synthetic coding sequence
atggacttcttcagtagccatttattggctgactctagctccccagctacaaacagcagtcataccgatgctcatgaaattctggtgagtgattttttggtttcagatgagaacctccaaaagatggagaatgtcctagacctctggtcttcttag

SEQ ID NO: 17378 - DNA, 513 bp, Artificial Sequence
  Description of Artificial Sequence: Synthetic coding sequence
atgagtagtaacgagtgcttcaaatgtgggcggtccggacactgggcccgagagtgccccactggcgggggacgagggaggggcatgagatctcgcggtagaggatttcaatttgtgtcctccagtctacccgacatttgctacagatgcggggaatctggtcacttggctaaggactgtgacctgcaggaggatgcgtgctacaactgtggccgaggaggtcacatcgcgaaagattgcaaggaacctaagagagagcgggagcagtgctgttacaattgcggcaaaccaggccatctggcaagggactgcgaccacgcggacgaacagaaatgttattcctgtggagagtttgggcatatccagaaagattgtactaaagttaaatgctaccggtgtggagaaactggacatgtggctatcaactgttctaagacctctgaagtaaactgttatcgctgcggagaaagcggccacctagcgcgggagtgcacaattgaggctaccgcctag

SEQ ID NO: 17379 - DNA, 399 bp, Artificial Sequence
  Description of Artificial Sequence: Synthetic coding sequence
atgaatcaggaagaccttgatcccgatagcaccaccgacgtcggagacgtgacgaacaccgaggaagaactgatccgtgaatgtgaggaaatgtggaaagacatggaagagtgtcaaaataagctgtcactgatcggaactgaaacgctgaccgattccaacgcacagctcagtctcctgatcatgcaggtgaaatgcctgactgcggagctctcacagtggcaaaagaagacgccagaaacgattccgctgacggaggacgtgctcatcaccctcgggaaggaagaattccaaaagttgcggcaggatctagagatggtcttgagtacaaaggaatccaagaacgagaagctgaaggaggatctggaaagagagcagaggtggcttgacgaacagtag

SEQ ID NO: 17380 - DNA, 1095 bp, Artificial Sequence
  Description of Artificial Sequence: Synthetic coding sequence
atggtcaagttgtttataggtaatctccctcgcgaggccaccgaacaagagattcgcagcctgttcgagcaatatggcaaggttttagaatgtgatattattaaaaattacggatttgtgcatatcgaggacaaaaccgctgcagaagacgcgatcagaaacttacaccattataaactccacggagtgaacatcaacgttgaagccagcaaaaataagtccaaaactagtaccaagctacacgtcggcaacatctctcctacatgcacaaataaggaattacgggcgaagtttgaggagtacggtcctgtcatagaatgcgacatcgtgaaggattacgcgttcgtccacatggaaagggctgaggacgcagtggaagctatccgaggcctggataacaccgaattccagggaaagagaatgcatgtgcaactgtctaccagccggctcagaaccgcccctggaatgggggatcaatctggatgctaccgttgcggcaaagagggtcattggagcaaggagtgtccaattgatcggtcgggtagggtcgccgacctcactgagcaatacaatgagcaatacggcgccgtgcgcacaccttatacaatgagctatggcgactctctctactataacaacgcctacggagctctggacgcatattataaaaggtgtcgggcagcgagatcttacgaagctgtggccgctgctgccgcatcagtctacaattatgccgaacagaccctgtcacagctgccacaggtgcaaaacacagctatggcttctcacctgacttccacctcgctggacccgtacgaccggcacttacttccaacttcaggcgccgccgcgacagcggccgcggcggcagccgctgccgcagctgtcaccgccgcaagcacatcatactatggtcgcgatcgaagtcctctgagacgtgcaaccgctcctgtgcccacggtgggcgaaggctatggatacggacacgaatctgaactcagccaggcatcagcggcagctcgcaatagcttatacgatatggctcggtatgaaagagaacagtacgcagacagagcccgctacagtgcattctag

SEQ ID NO: 17381 - DNA, 420 bp, Artificial Sequence
  Description of Artificial Sequence: Synthetic coding sequence
atggccacaggcgaccttaagcgcagcctacggaatctagaacaggtactaaggttactgaattaccctgaagaggtcgattgcgtaggccttatcaaaggcgaccccgcagcctctctgccaatcatctcctactctttcaccagctactccccatatgtgaccgagctgattatggaaagcaatgtggaactgattgctaagaatgacctgcgcttcattgatgcggtgtataaacttttaagagaccagttcaattataagcctatcctgacaaagaaacaattcatacagtgtggattcgcagagtggaagatccaaatcgtgtgcgacatcctgaattgcgtgatgaagaaacacaaggagctctcatctctgcaaaagattcctagtcagcagcggaaaaagattagcagttag

SEQ ID NO: 17382 - DNA, 450 bp, Artificial Sequence
  Description of Artificial Sequence: Synthetic coding sequence
atggccaacatcgccgtgcagcggataaaacgggagttcaaggaagtgctgaagtctgaagaggttcgcttcataacaaaaatctggcaccccaacatctcttctgttactggggccatttgtctggacatactgaaggaccaatgggccgcagcgatgacactgcgcacagtgctgctaagcctgcaggctctgctggctgctgccgagcccgacgacccccaggatgcagtggtcgccaaccaatacaaacagaaccccgagatgttcaaacaaacagcgagactctgggctcatgtgtatgcgggggcgcctgtgtcttcccccgagtacacaaaaaaaatcgagaatctgtgcgcgatgggtttcgaccgcaacgccgtcatcgtggctctcagtagtaagtcctgggatgtcgaaacagccacagagctgttattgagcaactag

SEQ ID NO: 17383 - DNA, 597 bp, Artificial Sequence
  Description of Artificial Sequence: Synthetic coding sequence
atggtgatggaaaagccctcacccctgctggtgggaagggagttcgtgaggcaatattacactctactcaacaaggcaccagagtaccttcatcggttctatggccgaaatagctcatatgtgcacggcggcgtggatgcttccggaaaaccacaggaggctgtttatggccaaaatgatatccaccacaaggtgctctcactgaatttcagcgaatgccacaccaagatccgacatgtcgatgctcatgccactttatccgacggggtggtggtgcaagtgatgggcttgttgtccaatagtggccaacctgagagaaaatttatgcagacgttcgttctggctcctgaaggatcagtgccgaataagttctacgttcacaacgatatgttcagatacgaggatgaagtcttcggggacagtgaaccagaactggatgaagaaagtgaagatgaagtagaggaggagcaagaagaacggcagcccagtcctgagcctgtgcaggagaacgccaatagcggctactacgaagctcacccggtgacaaacggaatagaagagcctctggaggagtcttctcacgagcccgaaccctag

SEQ ID NO: 17384 - DNA, 150 bp, Artificial Sequence
  Description of Artificial Sequence: Synthetic coding sequence
atgatgctgggcaccgagggaggggagggcttcgtggtgaaggtccgaggactgccgtggagctgcagcgcggatgaggtgcagcgattcttcagtgactgtaagattcagaacggggcacagggtattcgcttcatttatacccggtag

SEQ ID NO: 17385 - DNA, 1266 bp, Artificial Sequence
  Description of Artificial Sequence: Synthetic coding sequence
atgatggaagacaataagcagctcgcattacgcatcgacggagcagtgcagagcgcgtcccaagaggtgaccaacctgcgggcagagctgacggcaaccaataggcgcctagcagagctctccggcggaggtggcccaggtcctggtccaggggctgccgcatcagctagcgcggccggcgacagcgccgcgactaacatggaaaacccacagcttggcgcccaagtcctgctcagagaagaagtgagccgcctacaggaggaagttcacctgctgagacaaatgaaagaaatgcttgcgaaagacctggaggaatcccagggaggcaagtcaagcgaggttttaagcgcgaccgaattaagggtgcagcttgctcagaaagagcaggaactcgctcgcgcaaaagaggcccttcaggccatgaaggccgaccgaaaacggcttaagggggaaaaaacagacctagtatcccagatgcagcaactgtacgccaccctggagagcagagaggagcagttgagagattttattcggaactatgaacagcatagaaaagaatccgaagacgcagttaaagcgctggccaaggaaaaagacttgctggaacgggaaaagtgggaactaagacggcaagcaaaggaagccaccgatcatgccaccgctctgagaagccagttggatctcaaagacaataggatgaaagaactcgaagctgagctggctatggcaaaacagtcattggccaccctgaccaaggacgtccctaaacgacactcattggctatgccaggcgagactgtgctgaacggaaatcaagaatgggtagtccaggcggatttacctctgactgctgctatccgccaatcccagcagacgctgtaccactctcatccccctcacccagcggatcggcaggccgtgagggtttccccttgtcatagtaggcagccatccgttatctcggacgcgagcgctgccgaaggagatcgctcctctacaccctctgacattaacagtccaaggcaccgtactcacagcttatgtaacggagattctccaggtccagtgcagaaaaacctgcacaaccctatcgtgcagtccctggaagatttagaggaccagaagagaaagaagaagaaagagaaaatggggttcgggtcgatttctagggtcttcgcccgcggcaagcagagaaagagtcttgaccctgggctctttgatgggaccgcacctgattattacatagaggaagacgcagattggtag

SEQ ID NO: 17386 - DNA, 1173 bp, Artificial Sequence
  Description of Artificial Sequence: Synthetic coding sequence
atggccaccggggatcttaaaaggtcccttcgcaatctggagcaggtcctgcgtcttcttaattatccagaagaggtggattgcgtgggcttgatcaaaggagacccggccgccagcctgcccataattagctacagcttcactagttactcaccttacgtgacagaactgataatggagtcaaacgtcgaactgatagcaaagaacgacctccggtttatcgatgccgtgtataaactgctgagagatcaattcaattacaagccaattctgaccaagaagcagttcatccagtgcggcttcgccgaatggaagatacagatcgtgtgtgacatcctgaattgtgtgatgaagaagcacaaggagctcagttcactgcagaaaattccgtcacagcagcgaaagaagatttcttcaggaaagtcagagccgccactaggcaatgagaaaataagcgccgaagccgtgggggtcgatattagcgggaggttcatgacatctggtaagaagaaggcggttgtaatacgccatctatataatgaggacaatgtggatatctccgaagacaccctgtccccgattacggatgtcaatgaggcagtggatgtgtcagacctcaacgcgactgaaatcaaaatgcccgaagtgaaagttccggagataaaggccgaacagcaggacgtgaacgtgaaccctgaaatcactgccttacaaactatgctggctgaatgtcaggagaacctgaagaaactcactagcattgagaagcgactagactgcctcgaacaaaaaatgaaaggaaaggtgatggtagacgaaaatacctggacaaacctgctctccagagtgacgctgctggagaccgaaatgttgctgagtaagaagaacgacgagtttattgagttcaatgaagtaagcgaagactacgccagctgctcagatatggacctgctgaacccgcatagaaaatccgaggttgagaggcctgctagcattccgttgtcttctgggtattcaactgctagctctgattccactccccgcgctagtaccgtgaactattgtgggcttaacgagataagtgaagaaactacaatccaaaagatggagcgcatgaagaagatgtttgaggaaactgctgagttgctgaagtgcccaaaccactacctgtag

SEQ ID NO: 17387 - DNA, 390 bp, Artificial Sequence
  Description of Artificial Sequence: Synthetic coding sequence
atgaagcgggggcggttgccatcatcgtcggaggactcagacgataacggatccttgtcaaccacttggtctcagaattctaggagtcaacatcggcgaagcagctgctcacgtcacgaggaccgcaagccttcagaggtgttccgtacagacctcattaccgccatgaaactgcatgattcatatcaactgaatcccgacgagtattacgtgcttgcggacccatggagacaggagtgggagaagggcgtccaagtgccagtcagtcccgggacaattccacaacccgttgcccgggtggtgtcagaggagaaatccctaatgttcattcgccctaagaagtatattgtgtctagcggctctgagcctcctgagctgggatatgtctag

SEQ ID NO: 17388 - DNA, 489 bp, Artificial Sequence
  Description of Artificial Sequence: Synthetic coding sequence
atggacttcttctcgtcccatctgttagcggacagctctagccctgccaccaattcttctcacacagatgcccacgaaatactagttagcgatttcctggtgagcgacgaaaacctgcagaaaatggaaaacgtgctcgatttgtggtcatccggacttaagactaacatcatcagcgaattatcaaaatggcggctgaatttcatcgattggcacagaatggagatgaggaaggaaaaagagaagcacgccgcacatctcaagcaactgtgcaatcagatcaatgaactgaaggagctccagaagactttcgagatctccattgggaggaaagatgaggtgatcagttccctgtcccacgcaataggaaaacaaaaggaaaagattgaactgatgaggaccttcttccattggcgaataggtcacgtcagagcacgccaggacgtctatgagggtaagctggctgatcagtattatcagcggacttag

SEQ ID NO: 17389 - DNA, 411 bp, Artificial Sequence
  Description of Artificial Sequence: Synthetic coding sequence
atgatcgtaaacgattacgagggcaatgacagcgaggctgaggacttgaactttcgcgaaacgctcccaagtagctcgcaagaaaataccccccggtccaaggtttttgaaaacaaggtgaattccgaaaaagttaaacttagcctccggaattttccccataacgactacgaagatgtctttgaggaaccttccgagagtggatccgatccctctatgtggacggcacgcgggccctttcgtagagatcggtggagcagtgaagacgaggaggccgcaggaccaagccaggccctttcccccttactgagcgtgcaacaccatggatactccggtcccaatgaacgcactacattttggcacgggtcgaacgagggagctgtgagcctccttttgcgatactgtgcttag

SEQ ID NO: 17390 - DNA, 321 bp, Artificial Sequence
  Description of Artificial Sequence: Synthetic coding sequence
atggcaagtcagctccaggtcttcagtccgccgagcgtttcaagctcagccttctgttccgccaaaaaactcaagattgagccctctggatgggacgtatcgggacagtctagcaacgacaagtactacacacatagcaagacactgccggccacgcaagggcaggccaacagttcccaccaggtcgcaaacttcaacattcctgcctatgaccaaggtctactattacctgctcctgccgtggagcacatcgtggttaccgccgctgattcctccggcagtgcggccaccagcaccttccagtcttcccaaaccctgtag

SEQ ID NO: 17391 - DNA, 411 bp, Artificial Sequence
  Description of Artificial Sequence: Synthetic coding sequence
atgaagcgcggtcgtcttccaagctcatcagaggactccgacgataacgggtccctgagtactacatggtcacaaaatagcagatcccagcataggcgctcctcgtgttcaagacatgaggaccggaagcctagtgaggtgttcaggacagatctgattacagccatgaagctccacgattcctatcagttgaatcccgacgagtactacgttctcgcagatccctggcggcaagaatgggagaaaggcgtgcaggtccccgtatcacccgggacaatcccgcagcccgtggctagggtcgtgtccgaagaaaaatccctgatgttcattaggcccaagaagtacatagtctcttccgggtccgaaccacctgagctagggtatgtcgacatcagaaccctggcagactag

SEQ ID NO: 17392 - DNA, 396 bp, Artificial Sequence
  Description of Artificial Sequence: Synthetic coding sequence
atggaggatggcacccctaaacatatcattcagatgaccggatttaagatggaagaaaaggaggctttggttaaactgcttttgaagctggactgcactttcatcaagtctgaaaagtataagaattgtactcacctcatcgcagagcgcctgtgcaagtccgagaagtttctggccgcctgtgccgcaggcaaatggattctcactaaggactacattatccactctgccaagtccgggagatggctggatgagaccacatatgagtggggatataagattgagaaggactcaaggtactccccccagatgcagtctgctcctaagcgctggagagaggagctaaagagaacaggagcccccggggctttccatcgctggaaagtggtcttatag

SEQ ID NO: 17393 - DNA, 1668 bp, Artificial Sequence
  Description of Artificial Sequence: Synthetic coding sequence
atgcgccttatcggtatgccaaaagagaaatacgaccctccggaccctcgccggatttacactattatgtccgccgaagaagtcgccaatggaaagaagtcccactgggccgagctggaaatcagtggacgcgtgagatccctgagcactagcctatggtcactgacccacttaaccgctctgcatctgaacgataactacctttcaaggattccaccagacattgctaaactccataacttagtttatcttgacctctcgtctaacaaactaagaagtctacctgccgaactcggaaatatggtatctttgagggagttgctacttaacaataatctacttcgggtgcttccttacgagctgggccgactattccagttacagacgctgggacttaaaggaaatccacttagccaggacatattgaatctctaccaggatccagatggcaccagaaaattgctcaacttcatgttagataatttggcagtccaccctgaacagctccctccaagaccttggatcacactgaaagaaagagatcagattctgccatctgcttcatttactgtgatgtgttataacgttctgtgtgacaaatatgcgactcgccagctgtacggttactgcccaagctgggccttgaactgggagtacagaaaaaagggcattatggaggagattgtaaactgtgacgccgacatcatctccctgcaggaggttgagaccgagcagtattttacactcttcttgcctgccctgaaagagagggggtatgatggttttttctcgcccaaaagtagagcaaaaattatgtccgagcaggagagaaaacatgtcgacggctgtgccatcttttttaagacagagaagtttacgcttgtacagaagcacactgtcgaattcaatcaggtcgctatggcaaactccgatggaagtgaagcaatgctgaacagagtcatgacaaaagacaatatcggcgtggccgtggtattggaagtgcacaaagaactgttcggggcgggaatgaagcctatccatgcggcagacaaacagctgctgatagtcgcaaacgcgcacatgcactgggaccctgagtactccgatgtcaagttgatccaaacaatgatgttcgtatctgaagtgaagaacattctggagaaagccagtagtcgacctgggagtccaaccgcggaccccaattctatcccactggtcctctgcgccgacctgaattctcttcctgattcaggggttgtcgaatatctgtcgaacggcggcgttgctgataaccataaagatttcaaagagctccgctacaacgagtgcttaatgaatttctcttgtaatgggaagaacgggagcagcgaagggcgcatcacacatggattccagctgaaaagtgcttatgaaaataatctgatgccctacaccaattacaccttcgacttcaagggcgtgattgattatatcttctacagtaagacacacatgaacgtcctgggcgtactcggtcccttggacccccagtggctggtggagaacaacatcaccgggtgcccacatccacacatccccagcgatcactttagtctcctgacccagctggaacttcacccccctttgctgccattggttaatggcgtccacttgcccaaccgtcgttag

SEQ ID NO: 17394 - DNA, 1635 bp, Artificial Sequence
  Description of Artificial Sequence: Synthetic coding sequence
atgaacacctcaatcccgtaccaacaaaatccgtataatccccgcgggtcgtctaacgtgatccagtgctataggtgtggggacacttgcaaaggagaagtggtccgggtccacaacaaccacttccatattcggtgcttcacttgtcaggtctgcggctgcgggcttgcacagagcgggtttttttttaagaatcaggagtacatatgtactcaggactaccaacagctatacggaactcgttgtgattcctgtcgggacttcattaccggtgaagttatcagtgcccttgggaggacctatcaccctaaatgctttgtgtgttcgctctgcaggaagccctttcctattggggacaaggtcactttttccggcaaagagtgcgtttgccaaacctgtagccagagtatggcatcctctaaaccgatcaagattagaggtccctctcattgcgccggttgcaaagaggagatcaagcacggtcagtccttgctcgccctcgataaacagtggcatgtgtcttgctttaagtgccagacatgctctgttattctgaccggcgaatatattagcaaggacggagtgccttattgcgaatcggactaccacgcgcaattcggcataaaatgcgagacttgcgaccggtacattagtggtcgggtactggaggccggcggaaagcattaccatcccacttgcgctagatgtgtgagatgccaccagatgttcacagaaggtgaagagatgtatttgactggtagcgaggtgtggcaccctatttgcaagcaggcagccagagccgaaaaaaagctgaagcatagaaggacgtccgaaacaagcattagccctcctggctcaagcatcggatctcccaacagggtaatttgtgacatctacgagaacctggatctcaggcagcgtcgagcatccagtccaggatacatcgacagtccaacctactcacggcagggtatgtcacccacattttccagaagccctcatcactactacaggtccggggacttatccactgccacaaaaagcaagacaagcgaagatatcagccagacctcgaaatacagtccgatttacagcccagacccatattacgcatctgagtccgagtactggacttaccacggcagtcctaaagtgcccagagctcggaggttcagcagcggcggcgaagaggatgattttgataggagtatgcacaagttacagtccggcatcggcaggctgattctgaaggaagaaatgaaggctcgcagtagcagctacgctgatccatggactccacccaggtctagtacttcatcccgagaggctctgcacactgccgggtacgaaatgtcactaaatgggagtccccgatcccactacctcgccgactccgatcctctcatcagcaagagcgcctccctgcctgcctacagacggaatggacttcatcgcacaccgagtgccgacctattccactacgactctatgaacgccgtgaattgggggatgcgtgagtataaaatctacccatacgagctattgctggtcaccacacgcgggagaaacaggctgcccaaggatgtggaccgaacccgattggaagggaatttctggaagtctggttgcttgtag

SEQ ID NO: 17395 - DNA, 393 bp, Artificial Sequence
  Description of Artificial Sequence: Synthetic coding sequence
atgggtcgcctggatggcaaagtcattattctgactgccgccgctcaaggaattgggcaggccgcagccctcgcttttgcaagagaaggcgcgaaggttatcgccacggacattaacgagtccaagcttcaggagctcgaaaagtatcctggcatacagacaagggtgctggatgttactaagaagaaacaaattgatcaattcgcaaacgaagttgagagattagacgtgttattcaatgtcgccggctttgtgcaccacggaaccgttctggattgcgaggagaaggattgggatttctccatgaatcttaacgtgaggagtatgtacctcatgatcaaagcatttctcccaaagatgctcgcacaaaaatccggcaatatcataaattag

SEQ ID NO: 17396 - DNA, 1119 bp, Artificial Sequence
  Description of Artificial Sequence: Synthetic coding sequence
atgcagggaccagccggcaacgctagccgaggcttaccaggtggcccgccatccactgtcgccagtggcgctggccgatgtgagagcggagcgttgatgcatagcttcggtatatttctgcaaggcttgctgggtgttgtggccttttcaaccctcatgttaaagaggtttcgggagccaaagcatgagcgacggccttggaggatatggtttttggacacaagtaagcaggccattggaatgctattcattcatttcgcaaacgtctatctcgccgacctgactgaggaggatccgtgtagtctttacctgataaatttcttgctcgatgctacggtcggcatgcttctcatctacgtgggcgtgcgggccgtcagcgtactcgtggagtggcaacaatgggagtccctccgctttggagaatacggagatcccctgcagtgcggggcgtgggtcggccagtgtgccctgtacatcgtgattatgatcttcgagaaatcagtagtatttattgtgctgctgatactgcagtggaaaaaagtcgccctcctgaaccccattgaaaaccccgatctgaagcttgctatcgtgatgcttatcgttcctttcttcgttaacgctctgatgttttgggtggtggataatttcttgatgagaaaaggaaaaaccaaggccaaacttgaagaacgaggcgccaatcaagatagcaggaatggctccaaggtgcgctatcgccgggcagccagccatgaagaatctgaatcagagattctgatctcagccgacgacgaaatggaagagagcgacgtagaggaagaccttcgccgactcactccgctcaaacctgttaaaaagaagaagcaccgcttcggactgcctgcgggcgctcaggaggctccgattaagaaaaaacggcctcccgtcaaagacgaggatcttaaaggcgcacgaggcaacctgactaagaatcaggagatcaaaagcaaaacttatcaggttatgcgagagtgcgagcaagccgggtccgctgccccttctgtgttttcacggactagaaccggcacagaaaccgtgtttgaaaaaccaaaggcgggccctactaagagtgtctttggctag

SEQ ID NO: 17397 - DNA, 507 bp, Artificial Sequence
  Description of Artificial Sequence: Synthetic coding sequence
atgatgttgggcaccgagggcggagagggctttgtagtgaaagtccgcgggttgccctggtcctgcagcgccgacgaggtccaaagattcttcagcgattgtaaaatacagaatggcgcacagggtatccgtttcatctacacccgcgaggggcggccttccggagaggctttcgtcgagttagaaagcgaagacgaagtgaaactggctttaaagaaggaccgggagacgatgggccataggtacgtggaggtgtttaaatcaaataatgtcgagatggactgggtactgaagcacaccggccctaacagtcctgatacagccaacgacggatttgtgagattaaggggcctcccatttggttgctctaaggaggagatagtccagtttttctctggtttagagatagttcctaacggaatcactctgccagtggatttccaagggcggagcaccggcgaggcatttgtacaatttgctagtcaggaaatcgctgaaaaagcctag

SEQ ID NO: 17398 - DNA, 9 bp, Artificial Sequence
  Description of Artificial Sequence: Synthetic coding sequence
atggcttag

SEQ ID NO: 17399 - DNA, 1131 bp, Artificial Sequence
  Description of Artificial Sequence: Synthetic coding sequence
atgacgactgtggtggtgcatgtcgattccaaggcagagctaactacacttttggaacagtgggaaaaggaacacggaagcggccaggacatggtgcccattttgaccagaatgagccaacttatagaaaaggagaccgaggagtaccgcaaaggggacccagaccctttcgacgaccgacaccccgggcgagctgacccagagtgcatgctaggccatctactccggattctgtttaagaatgacgactttatgaacgcactcgtgaatgcatacgttatgactagcagagagcctccacttaacactgcagcctgccgcttgttgctggacatcatgcccggcttggagactgcagtggtgtttcaggagaaggagggcatagtagaaaatctcttcaagtgggcaagagaagcggaccagccattgaggacatattccacggggctgctggggggcgccatggagaatcaggacatcgcagccaattatcgagatgaaaatagccaattagtcgccatcgtgctgcgcaggctgcgcgagttacagctccaagaggtagctctgagacaggaaaacaagaggccttctccacgcaaactgagtagcgaaccactcctgcctcttgacgaggaagccgttgacatggattacggagacatggcagtcgacgtggtggatggagatcaggaggaggcgagcggtgacatggaaatatcttttcacctcgactcaggccacaagactagcagcagggtgaactccactactaaaccagaagatgggggtctgaaaaagaataagtccgccaaacagggagatagagagaattttaggaaggccaaacaaaaacttggtttctcatcgtccgatcctgataggatgttcgtagagctgtctaactcttcttggtcagaaatgtccccttgggtgatcgggaccaactacactctgtatcccatgactcctgccattgaacagaggcttattttacagtatctcactcctttgggcgagtaccaggaactgctgccaatctttatgcaactgggctccagggagttgatgatgttttacattgaccttaagcagacaaacgacgtgcttctgaccttcgaggccttgaagtag

SEQ ID NO: 17400 - DNA, 504 bp, Artificial Sequence
  Description of Artificial Sequence: Synthetic coding sequence
atgagctctaatgagtgctttaaatgcgggagaagcggccattgggccagggaatgtccaactggggggggacgaggccgcggcatgagatcccgcggaaggggaggatttaccagcgacagggacatttgctacaggtgtggtgaaagtggccacctcgcaaaggattgcgatttgcaggaagatgcgtgctacaattgtggacgaggaggacatattgccaaggactgtaaagagcctaaacgggaaagagagcagtgttgttacaactgtggcaagcctggccatcttgctcgggattgcgaccatgcagacgagcaaaaatgttacagctgtggggagttcgggcacatccagaaggactgtacaaaggtgaagtgctatcgctgcggggagaccgggcacgtggccatcaattgctctaaaacctctgaggtgaactgctacaggtgcggtgaatcagggcacctggctcgtgaatgtaccattgaagctactgcatag

SEQ ID NO: 17401 - DNA, 999 bp, Artificial Sequence
  Description of Artificial Sequence: Synthetic coding sequence
atgtccgaggcgggagaagagcaacccatggaaacaactggtgctaccgaaaatgggcacgaagccgtccctgagggggagtctcctgcgggcgcgggcacgggtgccgctgcaggtgctggaggggcgaccgccgctcctccctcaggaaatcagaatggggccgagggcgatcagattaatgctagtaagaatgaggaagacgcaggaaaaatgttcgtgggaggtctcagttgggacaccagcaagaaagatctgaaggattacttcactaaattcggcgaggtggtggattgcactattaagatggaccccaatactgggaggtcccgaggatttggattcattctcttcaaagacgctgcctctgtggagaaagtgctagaccagaaagaacacagattggatggcagggtaattgatcccaagaaagccatggccatgaaaaaagatccagtcaagaaaatctttgtgggcggtttaaaccctgaagcaactgaagagaagattcgagaatatttcggagaatttggagagatcgaagctatagaactgccaatggacccaaaacttaataagcggagggggtttgtgttcataacttttaaggaggaggaacctgtaaaaaaggtgctggagaagaagttccatactgtgtcaggaagtaaatgcgagattaaggtagctcagcctaaggaggtctaccagcagcagcaatacggaagcggaggccggggaaatcgtaacagggggaatcggggaagcggtggaggaggcggcggtgggggacagtctcagagttggaatcagggctatggcaattattggaatcagggctacggctatcaacagggctacggcccgggatatggagggtacgattacagtccatatggctactacggatatggcccaggatatgactactctcagggctctaccaactacgggaagagccagagacgcggagggcaccagaacaattataagccatattag

SEQ ID NO: 17402 - DNA, 615 bp, Artificial Sequence
  Description of Artificial Sequence: Synthetic coding sequence
atgagtgacttaagaattacagaagcgttcctgtacatggattatctctgcttccgggccctctgttgcaaaggaccaccgcctgcaagacccgagtacgatttagtttgtattgggctcacagggagcggaaaaactagccttctgagcaagttgtgtagtgagtcacccgataatgttgtgtccactactggcttttccatcaaggcggtacctttccaaaacgcaattctcaatgtcaaagagcttggaggagctgataatatccgtaaatattggtcacgttactaccagggaagccaaggggtgattttcgtgcttgacagcgcgagttcggaggacgatctagaggcggcacggaacgaactgcactccgcgcttcagcatccccagctttgcacgcttcccttcctcattctggccaaccatcaggataaaccagccgctcgtagcgtccaggaaataaagaagtacttcgagctggagccactggccaggggtaaacgatggatcctgcagccttgttccctggacgacatggacgccctgaaggattcattctcacaactcattaatctcttggaggagaaggatcacgaggccgtgagaatgtag
